United States Patent 11,078,247 (RNA ENCODING A THERAPEUTIC PROTEIN) - sequence listing, part 9

SEQ ID NO: 18039 - RNA, 294 nt, Artificial Sequence
  HIGD1C__Homo_sapiens__NP_001103089
augagcagcgacaaccaguggagcgccgacgaggacgagggccagcugagcagacugaucagaaagagcagagacagccccuucgugcccaucggcaucgccggcuucgugaccguggugagcugcggccuguacaagcugaaguacagaagagaccagaagaugagcauccaccugauccacaugagaguggccgcccagggcuucguggugggcgccgugacccugggcgugcuguacagcauguacaaggacuacaucagacccagauucuucagcgagagcaagaaguaa

SEQ ID NO: 18040 - RNA, 321 nt, Artificial Sequence
  HIGD2A__Homo_sapiens__NP_620175
auggccacccccggccccgugauccccgaggugcccuucgagcccagcaagccccccgugaucgagggccugagccccaccguguacagaaaccccgagagcuucaaggagaaguucgugagaaagaccagagagaaccccguggugcccaucggcugccuggccaccgccgccgcccugaccuacggccuguacagcuuccacagaggcaacagccagagaagccagcugaugaugagaaccagaaucgccgcccagggcuucaccguggccgccauccugcugggccuggccgugaccgccaugaagagcagacccuaa

SEQ ID NO: 18041 - RNA, 192 nt, Artificial Sequence
  HILPDA__Homo_sapiens__NP_001092256
augaagcacgugcugaaccuguaccugcugggcguggugcugacccugcugagcaucuucgugagagugauggagagccuggagggccugcuggagagccccagccccggcaccagcuggaccaccagaagccagcuggccaacaccgagcccaccaagggccugcccgaccaccccagcagaagcauguaa

SEQ ID NO: 18042 - RNA, 1260 nt, Artificial Sequence
  HINFP__Homo_sapiens__NP_001230188
augcccccccccggcaaggugcccagaaaggagaaccuguggcugcagugcgaguggggcagcugcagcuucgugugcagcaccauggagaaguucuucgagcacgugacccagcaccugcagcagcaccugcacggcagcggcgaggaggaggaggaggaggaggaggacgacccccuggaggaggaguucagcugccuguggcaggagugcggcuucugcagccuggacagcagcgccgaccugaucagacacguguacuuccacugcuaccacaccaagcugaagcaguggggccugcaggcccugcagagccaggccgaccugggccccugcauccuggacuuccagagcagaaacgugauccccgacauccccgaccacuuccugugccugugggagcacugcgagaacagcuucgacaaccccgagugguucuacagacacguggaggcccacagccugugcugcgaguacgaggccgugggcaaggacaaccccguggugcugugcggcuggaagggcugcaccugcaccuucaaggacagaagcaagcugagagagcaccugagaagccacacccaggagaaggugguggccugccccaccugcggcggcauguucgccaacaacaccaaguuccuggaccacaucagaagacagaccagccuggaccagcagcacuuccagugcagccacugcagcaagagauucgccaccgagagacugcugagagaccacaugagaaaccacgugaaccacuacaagugcccccugugcgacaugaccugcccccugcccagcagccugagaaaccacaugagauucagacacagcgaggacagacccuucaagugcgacugcugcgacuacagcugcaagaaccugaucgaccugcagaagcaccuggacacccacagcgaggagcccgccuacagaugcgacuucgagaacugcaccuucagcgccagaagccugugcagcaucaagagccacuacagaaaggugcacgagggcgacagcgagcccagauacaagugccacgugugcgacaagugcuucaccagaggcaacaaccugaccgugcaccugagaaagaagcaccaguucaaguggcccagcggccaccccagauucagacugggccacuucugcaucccccugcccggcuucgccgcccuguacgcccccaccagccccggcaccagaaacaugaagauggccaucugcggcugcagcugguucgccaccagaguguaa

SEQ ID NO: 18043 - RNA, 381 nt, Artificial Sequence
  HINT1__Homo_sapiens__NP_005331
auggccgacgagaucgccaaggcccagguggccagacccggcggcgacaccaucuucggcaagaucaucagaaaggagauccccgccaagaucaucuucgaggacgacagaugccuggccuuccacgacaucagcccccaggcccccacccacuuccuggugauccccaagaagcacaucagccagaucagcguggccgaggacgacgacgagagccugcugggccaccugaugaucgugggcaagaagugcgccgccgaccugggccugaacaagggcuacagaaugguggugaacgagggcagcgacggcggccagagcguguaccacgugcaccugcacgugcugggcggcagacagaugcacuggccccccggcuaa

SEQ ID NO: 18044 - RNA, 492 nt, Artificial Sequence
  HINT2__Homo_sapiens__NP_115982
auggccgccgccguggugcuggccgccggccugagagccgccagaagagccguggccgccaccggcgugagaggcggccaggugagaggcgccgccggcgugaccgacggcaacgagguggccaaggcccagcaggccacccccggcggcgccgcccccaccaucuucagcagaauccuggacaagagccugcccgccgacauccuguacgaggaccagcagugccugguguucagagacguggccccccaggcccccgugcacuuccuggugauccccaagaagcccauccccagaaucagccaggccgaggaggaggaccagcagcugcugggccaccugcugcugguggccaagcagaccgccaaggccgagggccugggcgacggcuacagacuggugaucaacgacggcaagcugggcgcccagagcguguaccaccugcacauccacgugcugggcggcagacagcugcaguggccccccggcuaa

SEQ ID NO: 18045 - RNA, 2961 nt, Artificial Sequence
  HIP1__Homo_sapiens__NP_001230127
auggacagaauggccagcagcaugaagcaggugcccaacccccugcccaaggugcugagcagaagaggcgugggcgccggccuggaggccgccgagagagagagcuucgagagaacccagaccgugagcaucaacaaggccaucaacacccaggagguggccgugaaggagaagcacgccagaaccugcauccugggcacccaccacgagaagggcgcccagaccuucuggagcguggugaacagacugccccugagcagcaacgccgugcugugcuggaaguucugccacguguuccacaagcugcugagagacggccaccccaacgugcugaaggacagccugagauacagaaacgagcugagcgacaugagcagaauguggggccaccugagcgagggcuacggccagcugugcagcaucuaccugaagcugcugagaaccaagauggaguaccacaccaagaaccccagauuccccggcaaccugcagaugagcgacagacagcuggacgaggccggcgagagcgacgugaacaacuucuuccagcugaccguggagauguucgacuaccuggagugcgagcugaaccuguuccagaccguguucaacagccuggacaugagcagaagcgugagcgugaccgccgccggccagugcagacuggccccccugauccaggugauccuggacugcagccaccuguacgacuacaccgugaagcugcuguucaagcugcacagcugccugcccgccgacacccugcagggccacagagacagauucauggagcaguucaccaagcugaaggaccuguucuacagaagcagcaaccugcaguacuucaagagacugauccagaucccccagcugcccgagaacccccccaacuuccugagagccagcgcccugagcgagcacaucagccccgugguggugauccccgccgaggccagcagccccgacagcgagcccgugcuggagaaggacgaccugauggacauggacgccagccagcagaaccuguucgacaacaaguucgacgacaucuucggcagcagcuucagcagcgaccccuucaacuucaacagccagaacggcgugaacaaggacgagaaggaccaccugaucgagagacuguacagagagaucagcggccugaaggcccagcuggagaacaugaagaccgagagccagagaguggugcugcagcugaagggccacgugagcgagcuggaggccgaccuggccgagcagcagcaccugagacagcaggccgccgacgacugcgaguuccugagagccgagcuggacgagcugagaagacagagagaggacaccgagaaggcccagagaagccugagcgagaucgagagaaaggcccaggccaacgagcagagauacagcaagcugaaggagaaguacagcgagcuggugcagaaccacgccgaccugcugagaaagaacgccgaggugaccaagcaggugagcauggccagacaggcccagguggaccuggagagagagaagaaggagcuggaggacagccuggagagaaucagcgaccagggccagagaaagacccaggagcagcuggaggugcuggagagccugaagcaggagcuggccaccagccagagagagcugcaggugcugcagggcagccuggagaccagcgcccagagcgaggccaacugggccgccgaguucgccgagcuggagaaggagagagacagccuggugagcggcgccgcccacagagaggaggagcugagcgcccugagaaaggagcugcaggacacccagcugaagcuggccagcaccgaggagagcaugugccagcuggccaaggaccagagaaagaugcugcuggugggcagcagaaaggccgccgagcaggugauccaggacgcccugaaccagcuggaggagcccccccugaucagcugcgccggcagcgccgaccaccugcugagcaccgugaccagcaucagcagcugcaucgagcagcuggagaagagcuggagccaguaccuggccugccccgaggacaucagcggccugcugcacagcaucacccugcuggcccaccugaccagcgacgccaucgcccacggcgccaccaccugccugagagccccccccgagcccgccgacagccugaccgaggccugcaagcaguacggcagagagacccuggccuaccuggccagccuggaggaggagggcagccuggagaacgccgacagcaccgccaugagaaacugccugagcaagaucaaggccaucggcgaggagcugcugcccagaggccuggacaucaagcaggaggagcugggcgaccugguggacaaggagauggccgccaccagcgccgccaucgagaccgccaccgccagaaucgagggcaccgccagccccaaggaguucuacgccaagaacagcagauggaccgagggccugaucagcgccagcaaggccgugggcuggggcgccaccgugaugguggacgccgccgaccugguggugcagggcagaggcaaguucgaggagcugauggugugcagccacgagaucgccgccagcaccgcccagcugguggccgccagcaaggugaaggccgacaaggacagccccaaccuggcccagcugcagcaggccagcagaggcgugaaccaggccaccgccggcgugguggccagcaccaucagcggcaagagccagaucgaggagaccgacaacauggacuucagcagcaugacccugacccagaucaagagacaggagauggacagccaggugagagugcuggagcuggagaacgagcugcagaaggagagacagaagcugggcgagcugagaaagaagcacuacgagcuggccggcguggccgagggcugggaggagggcaccgaggccagcccccccacccugcaggagguggugaccgagaaggaguaa

SEQ ID NO: 18046 - RNA, 3207 nt, Artificial Sequence
  HIP1R__Homo_sapiens__NP_003950
augaacagcaucaagaacgugcccgccagagugcugagcagaagacccggccacagccuggaggccgagagagagcaguucgacaagacccaggccaucagcaucagcaaggccaucaacacccaggaggcccccgugaaggagaagcacgccagaagaaucauccugggcacccaccacgagaagggcgccuucaccuucuggagcuacgccaucggccugccccugcccagcagcagcauccugagcuggaaguucugccacgugcugcacaaggugcugagagacggccaccccaacgugcugcacgacugccagagauacagaagcaacaucagagagaucggcgaccuguggggccaccugcacgacagauacggccagcuggugaacguguacaccaagcugcugcugaccaagaucagcuuccaccugaagcacccccaguuccccgccggccuggaggugaccgacgaggugcuggagaaggccgccggcaccgacgugaacaacaucuuccagcugaccguggagauguucgacuacauggacugcgagcugaagcugagcgagagcguguucagacagcugaacaccgccaucgccgugagccagaugagcagcggccagugcagacuggccccccugauccaggugauccaggacugcagccaccuguaccacuacaccgugaagcugcuguucaagcugcacagcugccugcccgccgacacccugcagggccacagagacagauuccacgagcaguuccacagccugagaaacuucuucagaagagccagcgacaugcuguacuucaagagacugauccagauccccagacugcccgagggcccccccaacuuccugagagccagcgcccuggccgagcacaucaagcccgugguggugauccccgaggaggcccccgaggacgaggagcccgagaaccugaucgagaucagcaccggcccccccgccggcgagcccguggugguggccgaccuguucgaccagaccuucggcccccccaacggcagcgugaaggacgacagagaccugcagaucgagagccugaagagagagguggagaugcugagaagcgagcuggagaagaucaagcuggaggcccagagauacaucgcccagcugaagagccaggugaacgcccuggagggcgagcuggaggagcagagaaagcagaagcagaaggcccugguggacaacgagcagcugagacacgagcuggcccagcugagagccgcccagcuggagggcgagagaagccagggccugagagaggaggccgagagaaaggccagcgccaccgaggccagauacaacaagcugaaggagaagcacagcgagcuggugcacgugcacgccgagcugcugagaaagaacgccgacaccgccaagcagcugaccgugacccagcagagccaggaggagguggccagagugaaggagcagcuggccuuccagguggagcaggugaagagagagagcgagcugaagcuggaggagaagagcgaccagcuggagaagcugaagagagagcuggaggccaaggccggcgagcuggccagagcccaggaggcccugagccacaccgagcagagcaagagcgagcugagcagcagacuggacacccugagcgccgagaaggacgcccugagcggcgccgugagacagagagaggccgaccugcuggccgcccagagccuggugagagagaccgaggccgcccugagcagagagcagcagagaagcagccaggagcagggcgagcugcagggcagacuggccgagagagagagccaggagcagggccugagacagagacugcuggacgagcaguucgccgugcugagaggcgccgccgccgaggccgccggcauccugcaggacgccgugagcaagcuggacgacccccugcaccugagaugcaccagcagccccgacuaccuggugagcagagcccaggaggcccuggacgccgugagcacccuggaggagggccacgcccaguaccugaccagccuggccgacgccagcgcccugguggccgcccugaccagauucagccaccuggccgccgacaccaucaucaacggcggcgccaccagccaccuggcccccaccgaccccgccgacagacugaucgacaccugcagagagugcggcgccagagcccuggagcugaugggccagcugcaggaccagcaggcccugagacacaugcaggccagccuggugagaaccccccugcagggcauccugcagcugggccaggagcugaagcccaagagccuggacgugagacaggaggagcugggcgccgugguggacaaggagauggccgccaccagcgccgccaucgaggacgccgugagaagaaucgaggacaugaugaaccaggccagacacgccagcagcggcgugaagcuggaggugaacgagagaauccugaacagcugcaccgaccugaugaaggccaucagacugcuggugaccaccagcaccagccugcagaaggagaucguggagagcggcagaggcgccgccacccagcaggaguucuacgccaagaacagcagauggaccgagggccugaucagcgccagcaaggccgugggcuggggcgccacccagcugguggaggccgccgacaagguggugcugcacaccggcaaguacgaggagcugaucgugugcagccacgagaucgccgccagcaccgcccagcugguggccgccagcaaggugaaggccaacaagcacagcccccaccugagcagacugcaggagugcagcagaaccgugaacgagagagccgccaacgugguggccagcaccaagagcggccaggagcagaucgaggacagagacaccauggacuucagcggccugagccugaucaagcugaagaagcaggagauggagacccaggugagagugcuggagcuggagaagacccuggaggccgagagaaugagacugggcgagcugagaaagcagcacuacgugcuggccggcgccagcggcagccccggcgaggagguggccaucagacccagcaccgcccccagaagcgugaccaccaagaagcccccccuggcccagaagcccagcguggcccccagacaggaccaccagcuggacaagaaggacggcaucuaccccgcccagcuggugaacuacuaa

SEQ ID NO: 18047 - RNA, 2349 nt, Artificial Sequence
  HIPK1__Homo_sapiens__XP_011539282
augaccuucuacagcuggauccccuaccacagacaggccccccugaaccacagaagagugugcagcgccgagggcgccggcagccccggccccgcccuggaccccagauggcugcccaccgaggcccaccugcuggaggcccacagacugcugcugcagagcgugcugugcgacagacccagagagagcauccagcugcacuucagacugagcauggccagccagcugcagguguucagcccccccagcgugagcagcagcgccuucugcagcgccaagaagcugaagaucgagcccagcggcugggacgugagcggccagagcagcaacgacaaguacuacacccacagcaagacccugcccgccacccagggccaggccaacagcagccaccagguggccaacuucaacauccccgccuacgaccagggccugcugcugcccgcccccgccguggagcacaucguggugaccgccgccgacagcagcggcagcgccgccaccagcaccuuccagagcagccagacccugacccacagaagcaacgugagccugcuggagcccuaccagaagugcggccugaagagaaagagcgaggagguggacagcaacggcagcgugcagaucaucgaggagcaccccccccugaugcugcagaacagaaccguggugggcgccgccgccaccaccaccaccgugaccaccaagagcagcagcagcagcggcgagggcgacuaccagcuggugcagcacgagauccugugcagcaugaccaacagcuacgaggugcuggaguuccugggcagaggcaccuucggccagguggccaagugcuggaagagaagcaccaaggagaucguggccaucaagauccugaagaaccaccccagcuacgccagacagggccagaucgaggugagcauccugagcagacugagcagcgagaacgccgacgaguacaacuucgugagaagcuacgagugcuuccagcacaagaaccacaccugccugguguucgagaugcuggagcagaaccuguacgacuuccugaagcagaacaaguucagcccccugccccugaaguacaucagacccauccugcagcagguggccaccgcccugaugaagcugaagagccugggccugauccacgccgaccugaagcccgagaacaucaugcugguggaccccgugagacagcccuacagagugaaggugaucgacuucggcagcgccagccacgugagcaaggccgugugcagcaccuaccugcagagcagauacuacagagcccccgagaucauccugggccugcccuucugcgaggccaucgacauguggagccugggcugcgugaucgccgagcuguuccugggcuggccccuguaccccggcgccagcgaguacgaccagaucagauacaucagccagacccagggccugcccgccgaguaccugcugagcgccggcaccaagaccaccagauucuucaacagagaccccaaccugggcuacccccuguggagacugaagacccccgaggagcacgagcuggagaccggcaucaagagcaaggaggccagaaaguacaucuucaacugccuggacgacauggcccaggugaacaugagcaccgaccuggagggcaccgacaugcuggccgagaaggccgacagaagagaguacaucgaccugcugaagaagaugcugaccaucgacgccgacaagagaaucaccccccugaagacccugaaccaccaguucgugaccaugacccaccugcuggacuucccccacagcaaccacgugaagagcugcuuccagaacauggagaucugcaagagaagagugcacauguacgacaccgugagccagaucaagagccccuucaccacccacguggcccccaacaccagcaccaaccugaccaugagcuucagcaaccagcugaacaccgugcacaaccaggccagcgugcuggccagcagcagcaccgccgccgccgccacccugagccuggccaacagcgacgugagccugcugaacuaccagagcgcccuguaccccagcagcgccgcccccgugcccggcguggcccagcagggcgugagccugcagcccggcaccacccagaucugcacccagaccgaccccuuccagcagaccuucaucgugugcccccccgccuuccagaccggccugcaggccaccaccaagcacagcggcuuccccgugagaauggacaacgccgugcccaucgugccccaggcccccgccgcccagccccugcagauccagagcggcgugcugacccagaccugcagagagaagaucagcagacacagcuaa

SEQ ID NO: 18048 - RNA, 3516 nt, Artificial Sequence
  HIPK2__Homo_sapiens__NP_001106710
auggcccccguguacgagggcauggccagccacgugcagguguucagcccccacacccugcagagcagcgccuucugcagcgugaagaagcugaagaucgagcccagcagcaacugggacaugaccggcuacggcagccacagcaagguguacagccagagcaagaacaucccccugagccagcccgccaccaccaccgugagcaccagccugcccgugcccaaccccagccugcccuacgagcagaccaucguguuccccggcagcaccggccacaucguggugaccagcgccagcagcaccagcgugaccggccaggugcugggcggcccccacaaccugaugagaagaagcaccgugagccugcuggacaccuaccagaagugcggccugaagagaaagagcgaggagaucgagaacaccagcagcgugcagaucaucgaggagcacccccccaugauccagaacaacgccagcggcgccaccguggccaccgccaccaccagcaccgccaccagcaagaacagcggcagcaacagcgagggcgacuaccagcuggugcagcacgaggugcugugcagcaugaccaacaccuacgaggugcuggaguuccugggcagaggcaccuucggccagguggugaagugcuggaagagaggcaccaacgagaucguggccaucaagauccugaagaaccaccccagcuacgccagacagggccagaucgaggugagcauccuggccagacugagcaccgagagcgccgacgacuacaacuucgugagagccuacgagugcuuccagcacaagaaccacaccugccugguguucgagaugcuggagcagaaccuguacgacuuccugaagcagaacaaguucagcccccugccccugaaguacaucagacccgugcugcagcagguggccaccgcccugaugaagcugaagagccugggccugauccacgccgaccugaagcccgagaacaucaugcugguggaccccagcagacagcccuacagagugaaggugaucgacuucggcagcgccagccacgugagcaaggccgugugcagcaccuaccugcagagcagauacuacagagcccccgagaucauccugggccugcccuucugcgaggccaucgacauguggagccugggcugcgugaucgccgagcuguuccugggcuggccccuguaccccggcgccagcgaguacgaccagaucagauacaucagccagacccagggccugcccgccgaguaccugcugagcgccggcaccaagaccaccagauucuucaacagagacaccgacagccccuacccccuguggagacugaagacccccgacgaccacgaggccgagaccggcaucaagagcaaggaggccagaaaguacaucuucaacugccuggacgacauggcccaggugaacaugaccaccgaccuggagggcagcgacaugcugguggagaaggccgacagaagagaguucaucgaccugcugaagaagaugcugaccaucgacgccgacaagagaaucacccccaucgagacccugaaccaccccuucgugaccaugacccaccugcuggacuucccccacagcacccacgugaagagcugcuuccagaacauggagaucugcaagagaagagugaacauguacgacaccgugaaccagagcaagacccccuucaucacccacguggcccccagcaccagcaccaaccugaccaugaccuucaacaaccagcugaccaccgugcacaaccagcccagcgccgccagcauggccgccguggcccagagaagcaugccccugcagaccggcaccgcccagaucugcgccagacccgaccccuuccagcaggcccugaucgugugcccccccggcuuccagggccugcaggccagccccagcaagcacgccggcuacagcgugagaauggagaacgccgugcccaucgugacccaggcccccggcgcccagccccugcagauccagcccggccugcuggcccagcaggccuggcccagcggcacccagcagauccugcugccccccgccuggcagcagcugaccggcguggccacccacaccagcgugcagcacgccaccgugauccccgagaccauggccggcacccagcagcuggccgacuggagaaacacccacgcccacggcagccacuacaaccccaucaugcagcagcccgcccugcugaccggccacgugacccugcccgccgcccagccccugaacgugggcguggcccacgugaugagacagcagcccaccagcaccaccagcagcagaaagagcaagcagcaccagagcagcgugagaaacgugagcaccugcgaggugagcagcagccaggccaucagcagcccccagagaagcaagagagugaaggagaacaccccccccagaugcgccauggugcacagcagccccgccugcagcaccagcgugaccugcggcuggggcgacguggccagcagcaccaccagagagagacagagacagaccaucgugauccccgacacccccagccccaccgugagcgugaucaccaucagcagcgacaccgacgaggaggaggagcagaagcacgcccccaccagcaccgugagcaagcagagaaagaacgugaucagcugcgugaccgugcacgacagccccuacagcgacagcagcagcaacaccagccccuacagcgugcagcagagagccggccacaacaacgccaacgccuucgacaccaagggcagccuggagaaccacugcaccggcaaccccagaaccaucaucgugcccccccugaagacccaggccagcgaggugcugguggagugcgacagccuggugcccgugaacaccagccaccacagcagcagcuacaagagcaagagcagcagcaacgugaccagcaccagcggccacagcagcggcagcagcagcggcgccaucaccuacagacagcagagacccggcccccacuuccagcagcagcagccccugaaccugagccaggcccagcagcacaucaccaccgacagaaccggcagccacagaagacagcaggccuacaucacccccaccauggcccaggcccccuacagcuucccccacaacagccccagccacggcaccgugcacccccaccuggccgccgccgccgccgccgcccaccugcccacccagccccaccuguacaccuacaccgcccccgccgcccugggcagcaccggcaccguggcccaccugguggccagccagggcagcgccagacacaccgugcagcacaccgccuaccccgccagcaucgugcaccaggugcccgugagcaugggccccagagugcugcccagccccaccauccaccccagccaguaccccgcccaguucgcccaccagaccuacaucagcgccagccccgccagcaccguguacaccggcuacccccugagccccgccaaggugaaccaguaccccuacaucuaa

SEQ ID NO: 18049 - RNA, 3585 nt, Artificial Sequence
  HIPK3__Homo_sapiens__NP_001265092
auggccagccaggugcugguguacccccccuacguguaccagacccagagcagcgccuucugcagcgugaagaagcugaagguggagcccagcagcugcguguuccaggagagaaacuaccccagaaccuacgugaacggcagaaacuucggcaacagccacccccccaccaagggcagcgccuuccagaccaagauccccuucaacagacccagaggccacaacuucagccugcagaccagcgccguggugcugaagaacaccgccggcgccaccaaggugaucgccgcccaggcccagcaggcccacgugcaggccccccagaucggcgccuggagaaacagacugcacuuccuggagggcccccagagaugcggccugaagagaaagagcgaggagcuggacaaccacagcagcgccaugcagaucguggacgagcugagcauccugcccgccaugcugcagaccaacaugggcaaccccgugaccguggugaccgccaccaccggcagcaagcagaacugcaccaccggcgagggcgacuaccagcuggugcagcacgaggugcugugcagcaugaagaacaccuacgaggugcuggacuuccugggcagaggcaccuucggccagguggugaagugcuggaagagaggcaccaacgagaucguggccaucaagauccugaagaaccaccccagcuacgccagacagggccagaucgaggugagcauccuggccagacugagcaccgagaacgccgacgaguacaacuucgugagagccuacgagugcuuccagcacagaaaccacaccugccugguguucgagaugcuggagcagaaccuguacgacuuccugaagcagaacaaguucagcccccugccccugaaggugaucagacccauccugcagcagguggccaccgcccugaagaagcugaagagccugggccugauccacgccgaccugaagcccgagaacaucaugcugguggaccccgugagacagcccuacagagugaaggugaucgacuucggcagcgccagccacgugagcaagaccgugugcagcaccuaccugcagagcagauacuacagagcccccgagaucauccugggccugcccuucugcgaggccaucgacauguggagccugggcugcgugaucgccgagcuguuccugggcuggccccuguaccccggcgcccuggaguacgaccagaucagauacaucagccagacccagggccugcccggcgagcagcugcugaacgugggcaccaagagcaccagauucuucugcaaggagaccgacaugagccacagcggcuggagacugaagacccuggaggagcacgaggccgagaccggcaugaagagcaaggaggccagaaaguacaucuucaacagccuggacgacguggcccacgugaacaccgugauggaccuggagggcagcgaccugcuggccgagaaggccgacagaagagaguucgugagccugcugaagaagaugcugcugaucgacgccgaccugagaaucacccccgccgagacccugaaccaccccuucgugaacaugaagcaccugcuggacuucccccacagcaaccacgugaagagcugcuuccacaucauggacaucugcaagagccaccugaacagcugcgacaccaacaaccacaacaagaccagccugcugagacccguggccagcagcagcaccgccacccugaccgccaacuucaccaagaucggcacccugagaagccaggcccugaccaccagcgcccacagcguggugcaccacggcaucccccugcaggccggcaccgcccaguucggcugcggcgacgccuuccagcagacccugaucaucugcccccccgccauccagggcauccccgccacccacggcaagcccaccagcuacagcaucagaguggacaacaccgugccccuggugacccaggcccccgccgugcagccccugcagaucagacccggcgugcugagccagaccuggagcggcagaacccagcagaugcuggugcccgccuggcagcaggugaccccccuggcccccgccaccaccacccugaccagcgagagcguggccggcagccacagacugggcgacuggggcaagaugaucagcugcagcaaccacuacaacagcgugaugccccagccccugcugaccaaccagaucacccugagcgccccccagcccgugagcgugggcaucgcccacgugguguggccccagcccgccaccaccaagaagaacaagcagugccagaacagaagcaacagccugcagaacaccaacaucccccacagcgccuucaucagccccaagaucaucaacggcaaggacguggaggaggugagcugcaucgagacccaggacaaccagaacagcgagggcgaggccagaaacugcugcgagaccagcaucagacaggacagcgacagcagcgugagcgacaagcagagacagaccaucaucaucgccgacagccccagccccgccgugagcgugaucaccaucagcagcgacaccgacgaggaggagaccagccagagacacagccugagagagugcaagggcagccuggacugcgaggccugccagagcacccugaacaucgacagaaugugcagccugagcagccccgacagcacccugagcaccagcagcagcggccagagcagccccagccccugcaagagacccaacagcaugagcgacgaggagcaggagagcagcugcgacaccguggacggcagccccaccagcgacagcagcggccacgacagccccuucgccgagagcaccuucguggaggacacccacgagaacaccgagcuggugagcagcgccgacaccgagaccaagcccgccgugugcagcgugguggugccccccguggagcuggagaacggccugaacgccgacgagcacauggccaacaccgacagcaucugccagccccugaucaagggcagaagcgcccccggcagacugaaccagcccagcgccgugggcaccagacagcagaagcugaccagcgccuuccagcagcagcaccugaacuucagccaggugcagcacuucggcagcggccaccaggaguggaacggcaacuucggccacagaagacagcaggccuacauccccaccagcgugaccagcaaccccuucacccugagccacggcagccccaaccacaccgccgugcacgcccaccuggccggcaacacccaccugggcggccagcccacccugcugcccuaccccagcagcgccacccugagcagcgccgcccccguggcccaccugcuggccagccccugcaccagcagacccaugcugcagcaccccaccuacaacaucagccaccccagcggcaucgugcaccaggugcccgugggccugaaccccagacugcugcccagccccaccauccaccagacccaguacaagcccaucuuccccccccacagcuacaucgccgccagccccgccuacaccggcuucccccugagccccaccaagcugagccaguaccccuacauguaa

SEQ ID NO: 18050 - RNA, 3054 nt, Artificial Sequence
  HIRA__Homo_sapiens__NP_003316
augaagcugcugaagcccaccugggugaaccacaacggcaagcccaucuucagcguggacauccaccccgacggcaccaaguucgccaccggcggccagggccaggacagcggcaagguggugaucuggaacaugagccccgugcugcaggaggacgacgagaaggacgagaacauccccaagaugcugugccagauggacaaccaccuggccugcgugaacugcgugagauggagcaacagcggcauguaccuggccagcggcggcgacgacaagcugaucaugguguggaagagagccaccuacaucggccccagcaccguguucggcagcagcggcaagcuggccaacguggagcaguggagaugcgugagcauccugagaaaccacagcggcgacgugauggacguggccuggagcccccacgacgccuggcuggccagcugcagcguggacaacaccguggugaucuggaacgccgugaaguuccccgagauccuggccacccugagaggccacagcggccuggugaagggccugaccugggaccccgugggcaaguacaucgccagccaggccgacgacagaagccugaagguguggagaacccuggacuggcagcuggagaccagcaucaccaagcccuucgacgagugcggcggcaccacccacgugcugagacugagcuggagccccgacggccacuaccuggugagcgcccacgccaugaacaacagcggccccaccgcccagaucaucgagagagagggcuggaagaccaacauggacuucgugggccacagaaaggccgugaccguggugaaguucaaccccaagaucuucaagaagaagcagaagaacggcagcagcgccaagcccagcugccccuacugcugcugcgccgugggcagcaaggacagaagccugagcguguggcugaccugccugaagagaccccugguggugauccacgagcuguucgacaagagcaucauggacaucagcuggacccugaacggccugggcauccuggugugcagcauggacggcagcguggccuuccuggacuucagccaggacgagcugggcgacccccugagcgaggaggagaagagcagaauccaccagagcaccuacggcaagagccuggccaucaugaccgaggcccagcugagcaccgccgugaucgagaaccccgagaugcugaaguaccagagaagacagcagcagcagcagcuggaccagaagagcgccgccaccagagagaugggcagcgccaccagcguggccggcguggugaacggcgagagccuggaggacaucagaaagaaccugcugaagaagcagguggagaccagaaccgccgacggcagaagaagaaucaccccccugugcaucgcccagcuggacaccggcgacuucagcaccgccuucuucaacagcaucccccugagcggcagccuggccggcaccaugcugagcagccacagcagcccccagcugcugccccuggacagcagcacccccaacagcuucggcgccagcaagcccugcaccgagcccgugguggccgccagcgccagacccgccggcgacagcgugaacaaggacagcaugaacgccaccagcacccccgccgcccugagccccagcgugcugaccacccccagcaagaucgagcccaugaaggccuucgacagcagauucaccgagagaagcaaggccacccccggcgcccccgcccugaccagcaugacccccaccgccguggagagacugaaggagcagaaccuggugaaggagcugagacccagagaccugcuggagagcagcagcgacagcgacgagaaggugccccuggccaaggccagcagccugagcaagagaaagcuggagcuggagguggagaccguggagaagaagaagaagggcagacccagaaaggacagcagacugaugcccgugagccugagcgugcagagccccgccgcccugaccgccgagaaggaggccaugugccugagcgcccccgcccuggcccugaagcugcccauccccagcccccagagagccuucacccugcaggugagcagcgaccccagcauguacaucgagguggagaacgaggugaccguggugggcggcgugaagcugagcagacugaagugcaacagagagggcaaggagugggagaccgugcugaccagcagaauccugaccgccgccggcagcugcgacguggugugcguggccugcgagaagagaaugcugagcguguucagcaccugcggcagaagacugcugagccccauccugcugcccagccccaucagcacccugcacugcaccggcagcuacgugauggcccugaccgccgccgccacccugagcgugugggacgugcacagacagguggugguggugaaggaggagagccugcacagcauccuggccggcagcgacaugaccgugagccagauccugcugacccagcacggcauccccgugaugaaccugagcgacggcaaggccuacugcuucaaccccagccugagcaccuggaaccuggugagcgacaagcaggacagccuggcccagugcgccgacuucagaagcagccugcccagccaggacgccaugcugugcagcggcccccuggccaucauccagggcagaaccagcaacagcggcagacaggccgccagacuguucagcgugccccacguggugcagcaggagaccacccuggccuaccuggagaaccagguggccgccgcccugacccugcagagcagccacgaguacagacacuggcugcugguguacgccagauaccuggugaacgagggcuucgaguacagacugagagagaucugcaaggaccugcugggccccgugcacuacagcaccggcagccagugggagagcaccguggugggccugagaaagagagagcugcugaaggagcugcugcccgugaucggccagaaccugagauuccagagacuguucaccgagugccaggagcagcuggacauccugagagacaaguaa

SEQ ID NO: 18051 - RNA, 1671 nt, Artificial Sequence
  HIRIP3__Homo_sapiens__NP_003600
auggccagagagaaggagaugcaggaguucaccagaagcuucuucagaggcagacccgaccugagcacccugacccacagcaucgugagaagaagauaccuggcccacagcggcagaagccaccuggagcccgaggagaagcaggcccugaagagacugguggaggaggagcugcugaagaugcagguggacgaggccgccagcagagaggacaagcuggaccugaccaagaagggcaagagaccccccacccccugcagcgaccccgagagaaagagauucagauucaacagcgagagcgagagcggcagcgaggccagcagccccgacuacuucggcccccccgccaagaacggcguggccgccgaggugagccccgccaaggaggagaaccccagaagagccagcaaggccguggaggagagcagcgacgaggagagacagagagaccugcccgcccagagaggcgaggagagcagcgaggaggaggagaagggcuacaagggcaagaccagaaagaagcccguggugaagaagcaggcccccggcaaggccagcgugagcagaaagcaggccagagaggagagcgaggagagcgaggccgagcccgugcagagaaccgccaagaagguggagggcaacaagggcaccaagagccugaaggagagcgagcaggagagcgaggaggagauccuggcccagaagaaggagcagagagaggaggagguggaggaggaggagaaggaggaggacgaggagaagggcgacuggaagcccagaaccagaagcaacggcagaagaaagagcgccagagaggagagaagcugcaagcagaagagccaggccaagagacugcugggcgacagcgacagcgaggaggagcagaaggaggccgccagcagcggcgacgacagcggcagagacagagagccccccgugcagagaaagagcgaggacagaacccagcugaagggcggcaagagacugagcggcagcagcgaggacgaggaggacagcggcaagggcgagcccaccgccaagggcagcagaaagauggccagacugggcagcaccagcggcgaggagagcgaccuggagagagaggugagcgacagcgaggccggcggcggcccccagggcgagagaaagaacagaagcagcaagaagagcagcagaaagggcagaaccagaagcagcagcagcagcagcgacggcagccccgaggccaagggcggcaaggccggcagcggcagaagaggcgaggaccaccccgccgugaugagacugaagagauacaucagagccugcggcgcccacagaaacuacaagaagcugcugggcagcugcugcagccacaaggagagacugagcauccugagagccgagcuggaggcccugggcaugaagggcacccccagccugggcaagugcagagcccugaaggagcagagagaggaggccgccgagguggccagccuggacguggccaacaucaucagcggcagcggcagacccagaagaagaaccgccuggaacccccugggcgaggccgccccccccggcgagcuguacagaagaacccuggacagcgacgaggagagacccagacccgccccccccgacuggagccacaugagaggcaucaucagcagcgacggcgagagcaacuaa

SEQ ID NO: 18052 - RNA, 648 nt, Artificial Sequence
  HIST1H1A__Homo_sapiens__NP_005316
augagcgagaccgugccccccgcccccgccgccagcgccgcccccgagaagccccuggccggcaagaaggccaagaagcccgccaaggccgccgccgccagcaagaagaagcccgccggccccagcgugagcgagcugaucgugcaggccgccagcagcagcaaggagagaggcggcgugagccuggccgcccugaagaaggcccuggccgccgccggcuacgacguggagaagaacaacagcagaaucaagcugggcaucaagagccuggugagcaagggcacccuggugcagaccaagggcaccggcgccagcggcagcuucaagcugaacaagaaggccagcagcguggagaccaagcccggcgccagcaagguggccaccaagaccaaggccaccggcgccagcaagaagcugaagaaggccaccggcgccagcaagaagagcgugaagacccccaagaaggccaagaagcccgccgccaccagaaagagcagcaagaaccccaagaagcccaagaccgugaagcccaagaagguggccaagagccccgccaaggccaaggccgugaagcccaaggccgccaaggccagagugaccaagcccaagaccgccaagcccaagaaggccgcccccaagaagaaguaa

SEQ ID NO: 18053 - RNA, 681 nt, Artificial Sequence
  HIST1H1B__Homo_sapiens__NP_005313
augagcgagaccgcccccgccgagaccgccacccccgcccccguggagaagagccccgccaagaagaaggccaccaagaaggccgccggcgccggcgccgccaagagaaaggccaccggcccccccgugagcgagcugaucaccaaggccguggccgccagcaaggagagaaacggccugagccuggccgcccugaagaaggcccuggccgccggcggcuacgacguggagaagaacaacagcagaaucaagcugggccugaagagccuggugagcaagggcacccuggugcagaccaagggcaccggcgccagcggcagcuucaagcugaacaagaaggccgccagcggcgaggccaagcccaaggccaagaaggccggcgccgccaaggccaagaagcccgccggcgccacccccaagaaggccaagaaggccgccggcgccaagaaggccgugaagaagacccccaagaaggccaagaagcccgccgccgccggcgugaagaagguggccaagagccccaagaaggccaaggccgccgccaagcccaagaaggccaccaagagccccgccaagcccaaggccgugaagcccaaggccgccaagcccaaggccgccaagcccaaggccgccaagcccaaggccgccaaggccaagaaggccgccgccaagaagaaguaa

SEQ ID NO: 18054 - RNA, 642 nt, Artificial Sequence
  HIST1H1C__Homo_sapiens__NP_005310
augagcgagaccgcccccgccgcccccgccgccgccccccccgccgagaaggcccccgugaagaagaaggccgccaagaaggccggcggcacccccagaaaggccagcggcccccccgugagcgagcugaucaccaaggccguggccgccagcaaggagagaagcggcgugagccuggccgcccugaagaaggcccuggccgccgccggcuacgacguggagaagaacaacagcagaaucaagcugggccugaagagccuggugagcaagggcacccuggugcagaccaagggcaccggcgccagcggcagcuucaagcugaacaagaaggccgccagcggcgaggccaagcccaaggugaagaaggccggcggcaccaagcccaagaagcccgugggcgccgccaagaagcccaagaaggccgccggcggcgccacccccaagaagagcgccaagaagacccccaagaaggccaagaagcccgccgccgccaccgugaccaagaagguggccaagagccccaagaaggccaagguggccaagcccaagaaggccgccaagagcgccgccaaggccgugaagcccaaggccgccaagcccaagguggugaagcccaagaaggccgcccccaagaagaaguaa

SEQ ID NO: 18055 - RNA, 666 nt, Artificial Sequence
  HIST1H1D__Homo_sapiens__NP_005311
augagcgagaccgccccccuggcccccaccauccccgcccccgccgagaagacccccgugaagaagaaggccaagaaggccggcgccaccgccggcaagagaaaggccagcggcccccccgugagcgagcugaucaccaaggccguggccgccagcaaggagagaagcggcgugagccuggccgcccugaagaaggcccuggccgccgccggcuacgacguggagaagaacaacagcagaaucaagcugggccugaagagccuggugagcaagggcacccuggugcagaccaagggcaccggcgccagcggcagcuucaagcugaacaagaaggccgccagcggcgagggcaagcccaaggccaagaaggccggcgccgccaagcccagaaagcccgccggcgccgccaagaagcccaagaagguggccggcgccgccacccccaagaagagcaucaagaagacccccaagaaggugaagaagcccgccaccgccgccggcaccaagaagguggccaagagcgccaagaaggugaagaccccccagcccaagaaggccgccaagagccccgccaaggccaaggcccccaagcccaaggccgccaagcccaagagcggcaagcccaaggugaccaaggccaagaaggccgcccccaagaagaaguaa

SEQ ID NO: 18056 - RNA, 660 nt, Artificial Sequence
  HIST1H1E__Homo_sapiens__NP_005312
augagcgagaccgcccccgccgcccccgccgcccccgcccccgccgagaagacccccgugaagaagaaggccagaaagagcgccggcgccgccaagagaaaggccagcggcccccccgugagcgagcugaucaccaaggccguggccgccagcaaggagagaagcggcgugagccuggccgcccugaagaaggcccuggccgccgccggcuacgacguggagaagaacaacagcagaaucaagcugggccugaagagccuggugagcaagggcacccuggugcagaccaagggcaccggcgccagcggcagcuucaagcugaacaagaaggccgccagcggcgaggccaagcccaaggccaagaaggccggcgccgccaaggccaagaagcccgccggcgccgccaagaagcccaagaaggccaccggcgccgccacccccaagaagagcgccaagaagacccccaagaaggccaagaagcccgccgccgccgccggcgccaagaaggccaagagccccaagaaggccaaggccgccaagcccaagaaggcccccaagagccccgccaaggccaaggccgugaagcccaaggccgccaagcccaagaccgccaagcccaaggccgccaagcccaagaaggccgccgccaagaagaaguaa

SEQ ID NO: 18057 - RNA, 624 nt, Artificial Sequence
  HIST1H1T__Homo_sapiens__NP_005314
augagcgagaccgugcccgccgccagcgccagcgccggcguggccgccauggagaagcugcccaccaagaagagaggcagaaagcccgccggccugaucagcgccagcagaaaggugcccaaccugagcgugagcaagcugaucaccgaggcccugagcgugagccaggagagagugggcaugagccugguggcccugaagaaggcccuggccgccgccggcuacgacguggagaagaacaacagcagaaucaagcugagccugaagagccuggugaacaagggcauccuggugcagaccagaggcaccggcgccagcggcagcuucaagcugagcaagaaggugauccccaagagcaccagaagcaaggccaagaagagcgugagcgccaagaccaagaagcuggugcugagcagagacagcaagagccccaagaccgccaagaccaacaagagagccaagaagcccagagccaccacccccaagaccgugagaagcggcagaaaggccaagggcgccaagggcaagcagcagcagaagagccccgugaaggccagagccagcaagagcaagcugacccagcaccacgaggugaacgugagaaaggccaccagcaagaaguaa

SEQ ID NO: 18058 - RNA, 393 nt, Artificial Sequence
  HIST1H2AE__Homo_sapiens__NP_066390
augagcggcagaggcaagcagggcggcaaggccagagccaaggccaagaccagaagcagcagagccggccugcaguuccccgugggcagagugcacagacugcugagaaagggcaacuacagcgagagagugggcgccggcgcccccguguaccuggccgccgugcuggaguaccugaccgccgagauccuggagcuggccggcaacgccgccagagacaacaagaagaccagaaucauccccagacaccugcagcuggccaucagaaacgacgaggagcugaacaagcugcugggcagagugaccaucgcccagggcggcgugcugcccaacauccaggccgugcugcugcccaagaagaccgagagccaccacaaggccaagggcaaguaa

SEQ ID NO: 18059 - RNA, 387 nt, Artificial Sequence
  HIST1H2AH__Homo_sapiens__NP_542163
augagcggcagaggcaagcagggcggcaaggccagagccaaggccaagaccagaagcagcagagccggccugcaguuccccgugggcagagugcacagacugcugagaaagggcaacuacgccgagagagugggcgccggcgcccccguguaccuggccgccgugcuggaguaccugaccgccgagauccuggagcuggccggcaacgccgccagagacaacaagaagaccagaaucauccccagacaccugcagcuggccaucagaaacgacgaggagcugaacaagcugcugggcaaggugaccaucgcccagggcggcgugcugcccaacauccaggccgugcugcugcccaagaagaccgagagccaccacaaggccaaguaa

SEQ ID NO: 18060 - RNA, 381 nt, Artificial Sequence
  HIST1H2BG__Homo_sapiens__NP_003509
augcccgagcccgccaagagcgcccccgcccccaagaagggcagcaagaaggccgugaccaaggcccagaagaaggacggcaagaagagaaagagaagcagaaaggagagcuacagcguguacguguacaaggugcugaagcaggugcaccccgacaccggcaucagcagcaaggccaugggcaucaugaacagcuucgugaacgacaucuucgagagaaucgccggcgaggccagcagacuggcccacuacaacaagagaagcaccaucaccagcagagagauccagaccgccgugagacugcugcugcccggcgagcuggccaagcacgccgugagcgagggcaccaaggccgugaccaaguacaccagcagcaaguaa

SEQ ID NO: 18061 - RNA, 381 nt, Artificial Sequence
  HIST1H2BH__Homo_sapiens__NP_003515
augcccgaccccgccaagagcgcccccgcccccaagaagggcagcaagaaggccgugaccaaggcccagaagaaggacggcaagaagagaaagagaagcagaaaggagagcuacagcguguacguguacaaggugcugaagcaggugcaccccgacaccggcaucagcagcaaggccaugggcaucaugaacagcuucgugaacgacaucuucgagagaaucgccggcgaggccagcagacuggcccacuacaacaagagaagcaccaucaccagcagagagauccagaccgccgugagacugcugcugcccggcgagcuggccaagcacgccgugagcgagggcaccaaggccgugaccaaguacaccagcagcaaguaa

SEQ ID NO: 18062 - RNA, 381 nt, Artificial Sequence
  HIST1H2BM__Homo_sapiens__NP_003512
augcccgagcccgugaagagcgcccccgugcccaagaagggcagcaagaaggccaucaacaaggcccagaagaaggacggcaagaagagaaagagaagcagaaaggagagcuacagcguguacguguacaaggugcugaagcaggugcaccccgacaccggcaucagcagcaaggccaugggcaucaugaacagcuucgugaacgacaucuucgagagaaucgccggcgaggccagcagacuggcccacuacaacaagagaagcaccaucaccagcagagagauccagaccgccgugagacugcugcugcccggcgagcuggccaagcacgccgugagcgagggcaccaaggccgugaccaaguacaccagcagcaaguaa

SEQ ID NO: 18063 - RNA, 411 nt, Artificial Sequence
  HIST1H3G__Homo_sapiens__NP_003525
auggccagaaccaagcagaccgccagaaagagcaccggcggcaaggcccccagaaagcagcuggccaccaaggccgccagaaagagcgcccccgccaccggcggcgugaagaagccccacagauacagacccggcaccguggcccugagagagaucagaagauaccagaagagcaccgagcugcugaucagaaagcugcccuuccagagacuggugagagagaucgcccaggacuucaagaccgaccugagauuccagagcagcgccgugauggcccugcaggaggccugcgaggccuaccuggugggccuguucgaggacaccaaccugugcgccauccacgccaagagagugaccaucaugcccaaggacauccagcuggccagaagaaucagaggcgagagagccuaa

SEQ ID NO: 18064 - RNA, 312 nt, Artificial Sequence
  HIST1H4D__Homo_sapiens__NP_003530
augagcggcagaggcaagggcggcaagggccugggcaagggcggcgccaagagacacagaaaggugcugagagacaacauccagggcaucaccaagcccgccaucagaagacuggccagaagaggcggcgugaagagaaucagcggccugaucuacgaggagaccagaggcgugcugaagguguuccuggagaacgugaucagagacgccgugaccuacaccgagcacgccaagagaaagaccgugaccgccauggacgugguguacgcccugaagagacagggcagaacccuguacggcuucggcggcuaa

SEQ ID NO: 18065 - RNA, 411 nt, Artificial Sequence
  HIST3H3__Homo_sapiens__NP_003484
auggccagaaccaagcagaccgccagaaagagcaccggcggcaaggcccccagaaagcagcuggccaccaagguggccagaaagagcgcccccgccaccggcggcgugaagaagccccacagauacagacccggcaccguggcccugagagagaucagaagauaccagaagagcaccgagcugcugaucagaaagcugcccuuccagagacugaugagagagaucgcccaggacuucaagaccgaccugagauuccagagcagcgccgugauggcccugcaggaggccugcgagagcuaccuggugggccuguucgaggacaccaaccugugcgugauccacgccaagagagugaccaucaugcccaaggacauccagcuggccagaagaaucagaggcgagagagccuaa

SEQ ID NO: 18066 - RNA, 8157 nt, Artificial Sequence
  HIVEP1__Homo_sapiens__XP_011512855
augcccagaaccaagcagauccaccccagaaaccugagagacaagaucgaggaggcccagaaggagcugaacggcgccgaggugagcaagaaggagauccugcaggccggcgugaagggcaccagcgagagccugaagggcgugaagagaaagaagaucguggccgagaaccaccugaagaagauccccaagagcccccugagaaacccccugcaggccaagcacaagcagaacaccgaggagagcagcuucgccgugcugcacagcgccagcgagagccacaagaagcagaacuacauccccgugaagaacggcaagcaguucaccaagcagaacggcgagacccccggcaucaucgccgaggccagcaagagcgaggagagcgugagccccaagaagccccuguuccugcagcagcccagcgagcugagaagauggagaagcgagggcgccgaccccgccaaguucagcgaccuggacgagcagugcgacagcagcagccugagcagcaagaccagaaccgacaacagcgagugcaucagcagccacugcggcaccaccagccccagcuacaccaacaccgccuucgacgugcugcugaaggccauggagcccgagcugagcacccugagccagaagggcagccccugcgccaucaagaccgagaagcugagacccaacaagaccgccagaagcccccccaagcugaagaacagcagcauggacgcccccaaccagaccagccaggagcugguggccgagagccagagcagcugcaccagcuacaccgugcacaugagcgccgcccagaagaacgagcagggcgccaugcagagcgccagccaccuguaccaccagcacgagcacuucgugcccaagagcaaccagcacaaccagcagcugcccggcugcagcggcuucaccggcagccugaccaaccugcagaaccaggagaacgccaagcuggagcagguguacaacaucgccgugaccagcagcgugggccugaccagccccagcagcagaagccaggugaccccccagaaccagcagauggacagcgccagcccccugagcaucagccccgccaacagcacccagagcccccccaugcccaucuacaacagcacccacguggccagcguggugaaccagagcguggagcagaugugcaaccugcugcugaaggaccagaagcccaagaagcagggcaaguacaucugcgaguacugcaacagagccugcgccaagcccagcgugcugcugaagcacaucagaagccacaccggcgagagacccuaccccugcgugaccugcggcuucagcuucaagaccaagagcaaccuguacaagcacaagaagagccacgcccacaccaucaagcugggccuggugcugcagcccgacgccggcggccuguuccugagccacgagagccccaaggcccugagcauccacagcgacguggaggacagcggcgagagcgaggaggagggcgccaccgacgagagacagcacgaccugggcgccauggagcugcagcccgugcacaucaucaagagaaugagcaacgccgagacccugcugaagagcagcuucacccccagcagccccgagaacgugaucggcgacuuccugcugcaggacagaagcgccgagagccaggccgugaccgagcugcccaaggugguggugcaccacgugaccgugagcccccugagaaccgacagccccaaggccauggaccccaagcccgagcugagcagcgcccagaagcagaaggaccugcaggugaccaacgugcagccccugagcgccaacaugagccagggcggcgugagcagacuggagaccaacgagaacagccaccagaagggcgacaugaacccccuggagggcaagcaggacagccacgugggcaccgugcacgcccagcugcagagacagcaggccaccgacuacagccaggagcagcagggcaagcugcugagccccagaagccugggcagcaccgacagcggcuacuucagcagaagcgagagcgccgaccagaccgugagcccccccacccccuucgccagaagacugcccagcaccgagcaggacagcggcagaagcaacggccccagcgccgcccuggugaccaccagcacccccagcgcccugcccaccggcgagaaggcccugcugcugcccggccagaugagacccccccuggccaccaagacccuggaggagagaaucagcaagcugaucagcgacaacgaggcccugguggacgacaagcagcuggacagcgugaagcccagaagaaccagccugagcagaagaggcagcaucgacagccccaagagcuacaucuucaaggacagcuuccaguucgaccugaagcccgugggcagaagaaccagcagcagcagcgacauccccaagagccccuucacccccaccgagaagagcaagcagguguuccugcugagcgugcccagccuggacugccugcccaucaccagaagcaacagcaugcccaccaccggcuacagcgccgugcccgccaacaucaucccccccccccacccccugagaggcagccagagcuucgacgacaagaucggcgccuucuacgacgacguguucgugagcggccccaacgcccccgugccccagagcggccaccccagaacccuggugagacaggccgccaucgaggacagcagcgccaacgagagccacgugcugggcaccggccagagccuggacgagagccaccagggcugccacgccgccggcgaggccaugagcgugagaagcaaggcccuggcccagggcccccacaucgagaagaagaagagccaccagggcagaggcaccauguucgagugcgagaccugcagaaacagauacagaaagcuggagaacuucgagaaccacaagaaguucuacugcagcgagcugcacggccccaagaccaagguggccaugagagagcccgagcacagccccgugcccggcggccugcagccccagauccugcacuacagaguggccggcagcagcggcaucugggagcagaccccccagaucagaaagagaagaaagaugaagagcgugggcgacgacgaggagcugcagcagaacgagagcggcaccagccccaagagcagcgagggccugcaguuccagaacgcccugggcugcaaccccagccugcccaagcacaacgugaccaucagaagcgaccagcagcacaagaacauccagcugcagaacagccacauccaccugguggccagaggccccgagcagaccauggaccccaagcugagcaccaucauggagcagcagaucagcagcgccgcccaggacaagaucgagcugcagagacacggcaccggcaucagcgugauccagcacaccaacagccugagcagacccaacagcuucgacaagcccgagcccuucgagagagccagccccgugagcuuccaggagcugaacagaaccggcaagagcggcagccugaaggugaucggcaucagccaggaggagagccaccccagcagagacggcagccacccccaccagcuggcccugagcgacgcccugagaggcgagcugcaggagagcagcagaaagagccccagcgagagacacgugcugggccagcccagcagacuggugagacagcacaacauccaggugcccgagauccuggugaccgaggagcccgacagagaccuggaggcccagugccacgaccaggagaagagcgagaaguucagcuggccccagagaagcgagacccugagcaagcugcccaccgagaagcugccccccaagaagaagagacugagacuggccgagaucgagcacagcagcaccgagagcagcuucgacagcacccugagcagaagccugagcagagagagcagccugagccacaccagcagcuucagcgccagccuggacaucgaggacgugagcaagaccgaggccagccccaagaucgacuuccugaacaaggccgaguuccugaugauccccgccggccugaacacccugaacgugcccggcugccacagagagaugagaagaaccgccagcgagcagaucaacugcacccagaccagcauggaggugagcgaccugagaagcaagagcuucgacugcggcagcaucacccccccccagaccaccccccugaccgagcugcagccccccagcagccccagcagagugggcgugaccggccacgugccccugcuggagagaagaagaggcccccuggugagacagaucagccugaacaucgcccccgacagccaccugagccccgugcaccccaccagcuuccagaacaccgcccugcccagcgugaacgccgugcccuaccagggcccccagcugaccagcaccagccuggccgaguucagcgccaacacccugcacagccagacccaggugaaggaccugcaggccgagaccagcaacagcagcagcaccaacguguuccccgugcagcagcugugcgacaucaaccugcugaaccagauccacgccccccccagccaccagagcacccagcugagccugcaggugagcacccagggcagcaagcccgacaagaacagcgugcugagcggcagcagcaagagcgaggacugcuucgcccccaaguaccagcugcacugccagguguucaccagcggccccagcugcagcagcaaccccgugcacagccugcccaaccaggugaucagcgaccccgugggcaccgaccacugcgugaccagcgccacccugcccaccaagcugaucgacagcaugagcaacagccacccccugcugccccccgagcugagaccccugggcagccaggugcagaaggugcccagcagcuucaugcugcccaucagacugcagagcagcgugcccgccuacugcuucgccacccugaccagccugccccagauccuggugacccaggaccugcccaaccagcccaucugccagaccaaccacagcguggugcccaucagcgaggagcagaacagcgugcccacccugcagaagggccaccagaacgcccugcccaaccccgagaaggaguuccugugcgagaacguguucagcgagaugagccagaacagcagccugagcgagagccugcccaucacccagaagaucagcgugggcagacugagcccccagcaggagagcagcgccagcagcaagagaaugcugagccccgccaacagccuggacaucgccauggagaagcaccagaagagagccaaggacgagaacggcgccgugugcgccaccgacgugagaccccuggaggcccugagcagcagagugaacgaggccagcaagcagaagaagcccauccuggugagacaggugugcaccaccgagccccuggacggcgugaugcuggagaaggacguguucagccagcccgagaucagcaacgaggccgugaaccugaccaacgugcugcccgccgacaacagcagcaccggcugcagcaaguucguggugaucgagcccaucagcgagcugcaggaguucgagaacaucaagagcagcaccagccugacccugaccgugagaagcagccccgcccccagcgagaacacccacaucagcccccugaagugcaccgacaacaaccaggagagaaagagccccggcgugaagaaccagggcgacaaggugaacauccaggagcagagccagcagcccgugaccagccugagccuguucaacaucaaggacacccagcagcuggccuuccccagccugaagaccaccaccaacuucaccuggugcuaccugcugagacagaagagccugcaccugccccagaaggaccagaagaccagcgccuacaccgacuggaccgugagcgccagcaaccccaacccccugggccugcccaccaagguggcccuggcccugcugaacagcaagcagaacaccggcaagagccuguacugccaggccaucaccacccacagcaagagcgaccugcugguguacagcagcaaguggaagagcagccugagcaagagagcccugggcaaccagaagagcaccgugguggaguucagcaacaaggacgccagcgagaucaacagcgagcaggacaaggagaacagccugaucaagagcgagcccagaagaaucaagaucuucgacggcggcuacaagagcaacgaggaguacguguacgugagaggcagaggcagaggcaaguacaucugcgaggagugcggcaucagaugcaagaagcccagcaugcugaagaagcacaucagaacccacaccgacgugagacccuaccacugcaccuacugcaacuucagcuucaagaccaagggcaaccugaccaagcacaugaagagcaaggcccacagcaagaagugcguggaccugggcgugagcgugggccugaucgacgagcaggacaccgaggagagcgacgagaagcagagauucagcuacgagagaagcggcuacgaccuggaggagagcgacggccccgacgaggacgacaacgagaacgaggacgacgacgaggacagccaggccgagagcgugcugagcgccacccccagcgugaccgccagcccccagcaccugcccagcagaagcagccugcaggaccccgugagcaccgacgaggacgugagaaucaccgacugcuucagcggcgugcacaccgaccccauggacgugcugcccagagcccugcugaccagaaugaccgugcugagcaccgcccagagcgacuacaacagaaagacccugagccccggcaaggccagacagagagccgccagagacgagaacgacaccauccccagcguggacaccagcagaagccccugccaccagaugagcguggacuaccccgagagcgaggagauccugagaagcagcauggccggcaaggccguggccaucacccagagccccagcagcgugagacugccccccgccgccgccgagcacagcccccagaccgccgccggcaugcccagcguggccagcccccaccccgacccccaggagcagaagcagcagaucacccugcagcccacccccggccugcccagcccccacacccaccuguucagccaccugccccugcacagccagcagcagagcagaacccccuacaacauggugcccgugggcggcauccacguggugcccgccggccugaccuacagcaccuucgugccccugcaggccggccccgugcagcugaccauccccgccgugagcguggugcacagaacccugggcacccacagaaacaccgugaccgaggugagcggcaccaccaaccccgccggcguggccgagcugagcagcguggugcccugcauccccaucggccagaucagagugcccggccugcagaaccugagcacccccggccugcagagccugcccagccugagcauggagaccgugaacaucgugggccuggccaacaccaacauggccccccaggugcacccccccggccuggcccugaacgccgugggccugcaggugcugaccgccaaccccagcagccagagcagccccgccccccaggcccacauccccggccugcagauccugaacaucgcccugcccacccugauccccagcgugagccagguggccguggacgcccagggcgcccccgagaugcccgccagccagagcaaggccugcgagacccagcccaagcagaccagcguggccagcgccaaccaggugagcagaaccgagagcccccagggccugcccaccgugcagagagagaacgccaagaaggugcugaacccccccgcccccgccggcgaccacgccagacuggacggccugagcaagauggacaccgagaaggccgccagcgccaaccacgugaagcccaagcccgagcugaccagcauccagggccagcccgccagcaccagccagccccugcugaaggcccacagcgagguguucaccaagcccagcggccagcagacccugagccccgacagacaggugcccagacccaccgcccugcccagaagacagcccaccgugcacuucagcgacgugagcagcgacgacgacgaggacagacuggugaucgccaccuaa

SEQ ID NO: 18067 - RNA, 7341 nt, Artificial Sequence
  HIVEP2__Homo_sapiens__NP_006725
auggacaccggcgacaccgcccugggccagaaggccaccagcagaagcggcgagaccgacaaggccagcggcagauggagacaggagcagagcgccgugaucaagaugagcaccuucggcagccacgagggccagagacagccccagaucgagcccgagcagaucggcaacaccgccagcgcccagcuguucggcagcggcaagcuggccagccccagcgagguggugcagcagguggccgagaagcaguaccccccccacagacccagccccuacagcugccagcacagccugagcuucccccagcacagccugccccagggcgugaugcacagcaccaagccccaccagagccuggagggcccccccuggcuguuccccggcccccugcccagcguggccagcgaggaccuguuccccuuccccauccacggccacagcggcggcuaccccagaaagaagaucagcagccugaaccccgccuacagccaguacagccagaagagcaucgagcaggccgaggaggcccacaagaaggagcacaagcccaagaagcccggcaaguacaucugccccuacugcagcagagccugcgccaagcccagcgugcugaagaagcacaucagaagccacaccggcgagagacccuaccccugcauccccugcggcuucagcuucaagaccaagagcaaccuguacaagcacagaaagagccacgcccacgccaucaaggccggccuggugcccuucaccgagagcgccgugagcaagcuggaccuggaggccggcuucaucgacguggaggccgagauccacagcgacggcgagcagagcaccgacaccgacgaggagagcagccuguucgccgaggccagcgacaagaugagccccggcccccccaucccccuggacaucgccagcagaggcggcuaccacggcagccuggaggagagccugggcggccccaugaaggugcccauccugaucauccccaagagcggcaucccccugcccaacgagagcagccaguacaucggccccgacaugcugcccaaccccagccugaacaccaaggccgacgacagccacaccgugaagcagaagcuggcccugagacugagcgagaagaagggccaggacagcgagcccagccugaaccugcugagcccccacagcaagggcagcaccgacagcggcuacuucagcagaagcgagagcgccgagcagcagaucagcccccccaacaccaacgccaagagcuacgaggagaucaucuucggcaaguacugcagacugagccccagaaacgcccugagcgugaccaccaccagccaggagagagccgccaugggcagaaagggcaucauggagccccugccccacgugaacaccagacuggacgugaagauguucgaggaccccgugagccagcugauccccagcaagggcgacguggaccccagccagaccagcaugcugaagagcaccaaguucaacagcgagagcagacagccccagaucauccccagcagcaucagaaacgagggcaagcuguaccccgccaacuuccagggcagcaaccccgugcugcuggaggcccccguggacagcagcccccugaucagaagcaacagcgugcccaccagcagcgccaccaaccugaccaucccccccagccugagaggcagccacagcuucgacgagagaaugaccggcagcgacgacguguucuaccccggcaccgugggcauccccccccagagaaugcugagaagacaggccgccuucgagcugcccagcgugcaggagggccacguggagguggagcaccacggcagaaugcugaagggcaucagcagcagcagccugaaggagaagaagcugagccccggcgacagagugggcuacgacuacgacgugugcagaaagcccuacaagaagugggaggacagcgagacccccaagcagaacuacagagacaucagcugccugagcagccugaagcacggcggcgaguacuucauggaccccguggugccccugcagggcgugcccagcauguucggcaccaccugcgagaacagaaagagaagaaaggagaagagcgugggcgacgaggaggacacccccaugaucugcagcagcaucgugagcacccccgugggcaucauggccagcgacuacgaccccaagcugcagaugcaggagggcgugagaagcggcuucgccauggccggccacgagaaccugagccacggccacaccgagagauucgaccccugcagaccccagcugcagcccggcagccccagccuggugagcgaggagagccccagcgccaucgacagcgacaagaugagcgaccugggcggcagaaagccccccggcaacgugaucagcgugauccagcacaccaacagccugagcagacccaacagcuucgagagaagcgagagcgccgagcugguggccugcacccaggacaaggcccccagccccagcgagaccugcgacagcgagaucagcgaggcccccgugagccccgagugggccccccccggcgacggcgccgagagcggcggcaagcccagccccagccagcaggugcagcagcagagcuaccacacccagcccagacuggugagacagcacaacauccaggugcccgagaucagagugaccgaggagcccgacaagcccgagaaggagaaggaggcccagagcaaggagcccgagaagcccguggaggaguuccaguggccccagagaagcgagacccugagccagcugcccgccgagaagcugccccccaagaagaagagacugagacuggccgacauggagcacagcagcggcgagagcagcuucgagagcaccggcaccggccugagcagaagccccagccaggagagcaaccugagccacagcagcagcuucagcaugagcuucgagagagaggagaccagcaagcugagcgcccugcccaagcaggacgaguucggcaagcacagcgaguuccugaccgugcccgccggcagcuacagccugagcgugcccggccaccaccaccagaaggagaugagaagaugcagcagcgagcagaugcccugcccccaccccgccgaggugcccgaggugagaagcaagagcuucgacuacggcaaccugagccacgcccccgugagcggcgccgccgccagcaccgugagccccagcagagagagaaagaagugcuuccuggugagacaggccagcuucagcggcagccccgagaucagccagggcgaggugggcauggaccagagcgugaagcaggagcagcuggagcaccugcacgccggccugagaagcggcuggcaccacggcccccccgccgugcugcccccccugcagcaggaggaccccggcaagcagguggccggccccugccccccccugagcagcggcccccugcaccuggcccagccccagaucaugcacauggacagccaggagagccugagaaacccccugauccagcccaccagcuacaugaccagcaagcaccugcccgagcagccccaccuguucccccaccaggagaccauccccuucagccccauccagaacgcccuguuccaguuccaguaccccaccgugugcauggugcaccugcccgcccagcagccccccugguggcaggcccacuucccccaccccuucgcccagcacccccagaagagcuacggcaagcccagcuuccagaccgagauccacagcagcuacccccuggagcacguggccgagcacaccggcaagaagcccgccgaguacgcccacaccaaggagcagaccuaccccugcuacagcggcgccagcggccugcaccccaagaaccugcugcccaaguuccccagcgaccagagcagcaagagcaccgagacccccagcgagcaggugcugcaggaggacuucgccagcgccaacgccggcagccugcagagccugcccggcaccguggugcccgugagaauccagacccacgugcccagcuacggcagcgugauguacaccagcaucagccagauccugggccagaacagccccgccaucgugaucugcaagguggacgagaacaugacccagagaacccuggugaccaacgccgccaugcagggcaucggcuucaacaucgcccaggugcugggccagcacgccggccuggagaaguaccccaucuggaaggccccccagacccugccccugggccuggagagcagcaucccccugugccugcccagcaccagcgacagcguggccacccugggcggcagcaagagaaugcugagccccgccagcagccuggagcuguucauggagaccaagcagcagaagagagugaaggaggagaagauguacggccagaucguggaggagcugagcgccguggagcugaccaacagcgacaucaagaaggaccugagcagaccccagaagccccagcuggugagacagggcugcgccagcgagcccaaggacggccugcagagcggcagcagcagcuucagcagccugagccccagcagcagccaggacuaccccagcgugagccccagcagcagagagcccuuccugcccagcaaggagaugcugagcggcagcagagccccccugcccggccagaagagcagcggccccagcgagagcaaggagagcagcgacgagcuggacaucgacgagaccgccagcgacaugagcaugagcccccagagcagcagccugcccgccggcgacggccagcuggaggaggagggcaagggccacaagagacccgugggcaugcuggugagaauggccagcgcccccagcggcaacguggccgacagcacccugcugcugaccgacauggccgacuuccagcagauccugcaguuccccagccugagaaccaccaccaccgugagcuggugcuuccugaacuacaccaagcccaacuacgugcagcaggccaccuucaagagcagcguguacgccagcuggugcaucagcagcugcaaccccaaccccagcggccugaacaccaagaccacccuggcccugcugagaagcaagcagaagaucaccgccgagaucuacacccuggccgccaugcacagacccggcaccggcaagcugaccagcagcagcgccuggaagcaguucacccagaugaagcccgacgccagcuuccuguucggcagcaagcuggagagaaagcuggugggcaacauccugaaggagagaggcaagggcgacauccacggcgacaaggacaucggcagcaagcagaccgagcccaucagaaucaagaucuucgagggcggcuacaagagcaacgaggacuacguguacgugagaggcagaggcagaggcaaguacaucugcgaggagugcggcaucagaugcaagaagcccagcaugcugaagaagcacaucagaacccacaccgacgugagacccuacgugugcaagcugugcaacuucgccuucaagaccaagggcaaccugaccaagcacaugaagagcaaggcccacaugaagaagugccuggagcugggcgugagcaugaccagcguggacgacaccgagaccgaggaggccgagaaccuggaggaccugcacaaggccgccgagaagcacagcaugagcagcaucagcaccgaccaccaguucagcgacgccgaggagagcgacggcgaggacggcgacgacaacgacgacgacgacgaggacgaggacgacuucgacgaccagggcgaccugacccccaagaccagaagcagaagcaccagcccccagccccccagauucagcagccugcccgugaacgugggcgccgugccccacggcgugcccagcgacagcagccugggccacagcagccugaucagcuaccuggugacccugcccagcaucagagugacccagcugaugacccccagcgacagcugcgaggacacccagaugaccgaguaccagagacuguuccagagcaagagcaccgacagcgagcccgacaaggacagacuggacauccccagcugcauggacgaggagugcaugcugcccagcgagcccagcagcagccccagagacuucagccccagcagccaccacagcagccccggcuacgacagcagccccugcagagacaacagccccaagagauaccugauccccaagggcgaccugagccccagaagacaccugagccccagaagagaccugagccccaugagacaccugagccccagaaaggaggccgcccugagaagagagaugagccagagagacgugagccccagaagacaccugagccccagaagacccgugagccccggcaaggacaucaccgccagaagagaccugagccccagaagagagagaagauacaugaccaccaucagagcccccagccccagaagagcccuguaccacaaccccccccugagcaugggccaguaccugcaggccgagcccaucgugcugggcccccccaaccugagaagaggccugccccaggugcccuacuucagccuguacggcgaccaggagggcgccuacgagcaccccggcagcagccuguuccccgagggccccaacgacuacguguucagccaccugccccugcacagccagcagcaggugagagcccccauccccauggugcccgugggcggcauccagauggugcacagcaugccccccgcccugagcagccugcaccccagccccacccugccccugcccauggagggcuucgaggagaagaagggcgccagcggcgagagcuucagcaaggaccccuacgugcugagcaagcagcacgagaagagaggcccccacgcccugcagagcagcggcccccccagcacccccagcagccccagacugcugaugaagcagagcaccagcgaggacagccugaacgccaccgagagagagcaggaggagaacauccagaccugcaccaaggccaucgccagccugagaaucgccaccgaggaggccgcccugcugggccccgaccagcccgccagagugcaggagccccaccagaacccccugggcagcgcccacgugagcaucagacacuucagcagacccgagcccggccagcccugcaccagcgccacccaccccgaccugcacgacggcgagaaggacaacuucggcaccagccagaccccccuggcccacagcaccuucuacagcaagagcugcguggacgacaagcagcuggacuuccacagcagcaaggagcugagcagcagcaccgaggagagcaaggaccccagcagcgagaagagccagcugcacuaa

SEQ ID NO: 18068 - RNA, 2085 nt, Artificial Sequence
  HJURP__Homo_sapiens__NP_001269891
augcugggcacccugagagccauggagggcgaggacguggaggacgaccagcugcugcagaagcugagagccagcagaagaagauuccagagaagaaugcagagacugaucgagaaguacaaccagcccuucgaggacacccccguggugcagauggccacccugaccuacgagaccccccagggccugagaaucuggggcggcagacugaucaaggagagaaacgagggcgagauccagcccgccgugccccagagcccccugaagaacgagcugagaagaaaguaccugacccagguggacauccugcugcagggcgccgaguacuucgagugcgccggcaacagagccggcagagacgugagagugaccccccugcccagccuggccagccccgccgugcccgcccccggcuacugcagcagaaucagcagaaagagccccggcgaccccgccaagcccgccagcagccccagagagugggacccccugcaccccagcagcaccgacauggcccuggugcccagaaacgacagccugagccugcaggagaccagcagcagcagcuuccugagcagccagcccuucgaggacgacgacaucugcaacgugaccaucagcgaccuguacgccggcaugcugcacagcaugagcagacugcugagcaccaagcccagcagcaucaucagcaccaagaccuucaucaugcagaacuggaacagcagaagaagacacagauacaagagcagaaugaacaagaccuacugcaagggcgccagaagaagccagagaagcagcaaggagaacuucauccccugcagcgagcccgugaagggcaccggcgcccugagagacugcaagaacgugcuggacgugagcugcagaaagaccggccugaagcuggagaaggccuuccuggaggugaacagaccccagauccacaagcuggaccccagcuggaaggagagaaaggugacccccagcaaguacagcagccugaucuacuucgacagcagcgccaccuacaaccuggacgaggagaacagauucagaacccugaaguggcugaucagccccgugaagaucgugagcagacccaccaucagacagggccacggcgagaacagacagagagagaucgagaucagauucgaccagcugcacagagaguacugccugagccccagaaaccagcccagaagaaugugccugcccgacagcugggccaugaacauguacagaggcggccccgccagccccggcggccugcagggccuggagaccagaagacugagccugcccagcagcaaggccaaggccaagagccugagcgaggccuucgagaaccugggcaagagaagccuggaggccggcagaugccugcccaagagcgacagcagcagcagccugcccaagaccaaccccacccacagcgccaccagaccccagcagaccagcgaccugcacgugcagggcaacagcagcggcaucuucagaaagagcgugagccccagcaagacccugagcgugcccgacaaggaggugcccggccacggcagaaacagauacgacgagaucaaggaggaguucgacaagcugcaccagaaguacugccugaagagccccggccagaugaccgugccccugugcaucggcgugagcaccgacaaggccagcauggaggugagauaccagaccgagggcuuccugggcaagcugaaccccgacccccacuuccagggcuuccagaagcugcccagcagcccccugggcugcagaaagagccugcugggcagcaccgccaucgaggcccccagcagcaccugcguggccagagccaucaccagagacggcaccagagaccaccaguuccccgccaagagacccagacugagcgagccccagggcagcggcagacagggcaacagccugggcgccagcgacggcguggacaacaccgugagacccggcgaccagggcagcagcagccagcccaacagcgaggagagaggcgagaacaccagcuacagaauggaggagaagagcgacuucaugcuggagaagcuggagaccaagagcguguaa

SEQ ID NO: 18069 - RNA, 2754 nt, Artificial Sequence
  HK1__Homo_sapiens__NP_000179
augaucgccgcccagcugcuggccuacuacuucaccgagcugaaggacgaccaggugaagaagaucgacaaguaccuguacgccaugagacugagcgacgagacccugaucgacaucaugaccagauucagaaaggagaugaagaacggccugagcagagacuucaaccccaccgccaccgugaagaugcugcccaccuucgugagaagcauccccgacggcagcgagaagggcgacuucaucgcccuggaccugggcggcagcagcuucagaauccugagagugcaggugaaccacgagaagaaccagaacgugcacauggagagcgagguguacgacacccccgagaacaucgugcacggcagcggcagccagcuguucgaccacguggccgagugccugggcgacuucauggagaagagaaagaucaaggacaagaagcugcccgugggcuucaccuucagcuuccccugccagcagagcaagaucgacgaggccauccugaucaccuggaccaagagauucaaggccagcggcguggagggcgccgacguggugaagcugcugaacaaggccaucaagaagagaggcgacuacgacgccaacaucguggccguggugaacgacaccgugggcaccaugaugaccugcggcuacgacgaccagcacugcgaggugggccugaucaucggcaccggcaccaacgccugcuacauggaggagcugagacacaucgaccugguggagggcgacgagggcagaaugugcaucaacaccgaguggggcgccuucggcgacgacggcagccuggaggacaucagaaccgaguucgacagagagaucgacagaggcagccugaaccccggcaagcagcuguucgagaagauggugagcggcauguaccugggcgagcuggugagacugauccuggugaagauggccaaggagggccugcuguucgagggcagaaucacccccgagcugcugaccagaggcaaguucaacaccagcgacgugagcgccaucgagaagaacaaggagggccugcacaacgccaaggagauccugaccagacugggcguggagcccagcgacgacgacugcgugagcgugcagcacgugugcaccaucgugagcuucagaagcgccaaccugguggccgccacccugggcgccauccugaacagacugagagacaacaagggcacccccagacugagaaccaccgugggcguggacggcagccuguacaagacccacccccaguacagcagaagauuccacaagacccugagaagacuggugcccgacagcgacgugagauuccugcugagcgagagcggcagcggcaagggcgccgccauggugaccgccguggccuacagacuggccgagcagcacagacagaucgaggagacccuggcccacuuccaccugaccaaggacaugcugcuggaggugaagaagagaaugagagccgagauggagcugggccugagaaagcagacccacaacaacgccguggugaagaugcugcccagcuucgugagaagaacccccgacggcaccgagaacggcgacuuccuggcccuggaccugggcggcaccaacuucagagugcugcuggugaagaucagaagcggcaagaagagaaccguggagaugcacaacaagaucuacgccauccccaucgagaucaugcagggcaccggcgaggagcuguucgaccacaucgugagcugcaucagcgacuuccuggacuacaugggcaucaagggccccagaaugccccugggcuucaccuucagcuuccccugccagcagaccagccuggacgccggcauccugaucaccuggaccaagggcuucaaggccaccgacugcgugggccacgacguggugacccugcugagagacgccaucaagagaagagaggaguucgaccuggacgugguggccguggugaacgacaccgugggcaccaugaugaccugcgccuacgaggagcccaccugcgaggugggccugaucgugggcaccggcagcaacgccugcuacauggaggagaugaagaacguggagaugguggagggcgaccagggccagaugugcaucaacauggaguggggcgccuucggcgacaacggcugccuggacgacaucagaacccacuacgacagacugguggacgaguacagccugaacgccggcaagcagagauacgagaagaugaucagcggcauguaccugggcgagaucgugagaaacauccugaucgacuucaccaagaagggcuuccuguucagaggccagaucagcgagacccugaagaccagaggcaucuucgagaccaaguuccugagccagaucgagagcgacagacuggcccugcugcaggugagagccauccugcagcagcugggccugaacagcaccugcgacgacagcauccuggugaagaccgugugcggcguggugagcagaagagccgcccagcugugcggcgccggcauggccgccgugguggacaagaucagagagaacagaggccuggacagacugaacgugaccgugggcguggacggcacccuguacaagcugcacccccacuucagcagaaucaugcaccagaccgugaaggagcugagccccaagugcaacgugagcuuccugcugagcgaggacggcagcggcaagggcgccgcccugaucaccgccgugggcgugagacugagaaccgaggccagcagcuaa

SEQ ID NO: 18070 - RNA, 2754 nt, Artificial Sequence
  HK2__Homo_sapiens__NP_000180
augaucgccagccaccugcuggccuacuucuucaccgagcugaaccacgaccaggugcagaagguggaccaguaccuguaccacaugagacugagcgacgagacccugcuggagaucagcaagagauucagaaaggagauggagaagggccugggcgccaccacccaccccaccgccgccgugaagaugcugcccaccuucgugagaagcacccccgacggcaccgagcacggcgaguuccuggcccuggaccugggcggcaccaacuucagagugcugugggugaaggugaccgacaacggccugcagaagguggagauggagaaccagaucuacgccauccccgaggacaucaugagaggcagcggcacccagcuguucgaccacaucgccgagugccuggccaacuucauggacaagcugcagaucaaggacaagaagcugccccugggcuucaccuucagcuuccccugccaccagaccaagcuggacgagagcuuccuggugagcuggaccaagggcuucaagagcagcggcguggagggcagagacgugguggcccugaucagaaaggccauccagagaagaggcgacuucgacaucgacaucguggccguggugaacgacaccgugggcaccaugaugaccugcggcuacgacgaccacaacugcgagaucggccugaucgugggcaccggcagcaacgccugcuacauggaggagaugagacacaucgacaugguggagggcgacgagggcagaaugugcaucaacauggaguggggcgccuucggcgacgacggcagccugaacgacaucagaaccgaguucgaccaggagaucgacaugggcagccugaaccccggcaagcagcuguucgagaagaugaucagcggcauguacaugggcgagcuggugagacugauccuggugaagauggccaaggaggagcugcuguucggcggcaagcugagccccgagcugcugaacaccggcagauucgagaccaaggacaucagcgacaucgagggcgagaaggacggcaucagaaaggccagagaggugcugaugagacugggccuggaccccacccaggaggacugcguggccacccacagaaucugccagaucgugagcaccagaagcgccagccugugcgccgccacccuggccgccgugcugcagagaaucaaggagaacaagggcgaggagagacugagaagcaccaucggcguggacggcagcguguacaagaagcacccccacuucgccaagagacugcacaagaccgugagaagacuggugcccggcugcgacgugagauuccugagaagcgaggacggcagcggcaagggcgccgccauggugaccgccguggccuacagacuggccgaccagcacagagccagacagaagacccuggagcaccugcagcugagccacgaccagcugcuggaggugaagagaagaaugaagguggagauggagagaggccugagcaaggagacccacgccagcgcccccgugaagaugcugcccaccuacgugugcgccacccccgacggcaccgagaagggcgacuuccuggcccuggaccugggcggcaccaacuucagagugcugcuggugagagugagaaacggcaaguggggcggcguggagaugcacaacaagaucuacgccaucccccaggaggugaugcacggcaccggcgacgagcuguucgaccacaucgugcagugcaucgccgacuuccuggaguacaugggcaugaagggcgugagccugccccugggcuucaccuucagcuuccccugccagcagaacagccuggacgagagcauccugcugaaguggaccaagggcuucaaggccagcggcugcgagggcgaggacguggugacccugcugaaggaggccauccacagaagagaggaguucgaccuggacgugguggccguggugaacgacaccgugggcaccaugaugaccugcggcuucgaggacccccacugcgaggugggccugaucgugggcaccggcagcaacgccugcuacauggaggagaugagaaacguggagcugguggagggcgaggagggcagaaugugcgugaacauggaguggggcgccuucggcgacaacggcugccuggacgacuucagaaccgaguucgacguggccguggacgagcugagccugaaccccggcaagcagagauucgagaagaugaucagcggcauguaccugggcgagaucgugagaaacauccugaucgacuucaccaagagaggccugcuguucagaggcagaaucagcgagagacugaagaccagaggcaucuucgagaccaaguuccugagccagaucgagagcgacugccuggcccugcugcaggugagagccauccugcagcaccugggccuggagagcaccugcgacgacagcaucaucgugaaggaggugugcaccgugguggccagaagagccgcccagcugugcggcgccggcauggccgccgugguggacagaaucagagagaacagaggccuggacgcccugaaggugaccgugggcguggacggcacccuguacaagcugcacccccacuucgccaaggugaugcacgagaccgugaaggaccuggcccccaagugcgacgugagcuuccugcagagcgaggacggcagcggcaagggcgccgcccugaucaccgccguggccugcagaaucagagaggccggccagagauaa

SEQ ID NO: 18071 - RNA, 2772 nt, Artificial Sequence
  HK3__Homo_sapiens__NP_002106
auggacagcaucggcagcagcggccugagacagggcgaggagacccugagcugcagcgaggagggccugcccggccccagcgacagcagcgagcuggugcaggagugccugcagcaguucaaggugaccagagcccagcugcagcagauccaggccagccugcugggcagcauggagcaggcccugagaggccaggccagccccgcccccgccgugagaaugcugcccaccuacgugggcagcaccccccacggcaccgagcagggcgacuucguggugcuggagcugggcgccaccggcgccagccugagagugcugugggugacccugaccggcaucgagggccacagaguggagcccagaagccaggaguucgugaucccccaggaggugaugcugggcgccggccagcagcuguucgacuucgccgcccacugccugagcgaguuccuggacgcccagcccgugaacaagcagggccugcagcugggcuucagcuucagcuuccccugccaccagaccggccuggacagaagcacccugaucagcuggaccaagggcuucagaugcagcggcguggagggccaggacguggugcagcugcugagagacgccaucagaagacagggcgccuacaacaucgacgugguggccguggugaacgacaccgugggcaccaugaugggcugcgagcccggcgugagacccugcgaggugggccuggugguggacaccggcaccaacgccugcuacauggaggaggccagacacguggccgugcuggacgaggacagaggcagagugugcgugagcguggaguggggcagcuucagcgacgacggcgcccugggccccgugcugaccaccuucgaccacacccuggaccacgagagccugaaccccggcgcccagagauucgagaagaugaucggcggccuguaccugggcgagcuggugagacuggugcuggcccaccuggccagaugcggcgugcuguucggcggcugcaccagccccgcccugcugagccagggcagcauccugcuggagcacguggccgagauggaggaccccagcaccggcgccgccagagugcacgccauccugcaggaccugggccugagccccggcgccagcgacguggagcuggugcagcacgugugcgccgccgugugcaccagagccgcccagcugugcgccgccgcccuggccgccgugcugagcugccugcagcacagcagagagcagcagacccugcagguggccguggccaccggcggcagagugugcgagagacaccccagauucugcagcgugcugcagggcaccgugaugcugcuggcccccgagugcgacgugagccugauccccagcguggacggcggcggcagaggcguggccauggugaccgccguggccgccagacuggccgcccacagaagacugcuggaggagacccuggcccccuucagacugaaccacgaccagcuggccgccgugcaggcccagaugagaaaggccauggccaagggccugagaggcgaggccagcagccugagaaugcugcccaccuucgugagagccacccccgacggcagcgagagaggcgacuuccuggcccuggaccugggcggcaccaacuucagagugcugcuggugagagugaccaccggcgugcagaucaccagcgagaucuacagcauccccgagaccguggcccagggcagcggccagcagcuguucgaccacaucguggacugcaucguggacuuccagcagaagcagggccugagcggccagagccugccccugggcuucaccuucagcuuccccugcagacagcugggccuggaccagggcauccugcugaacuggaccaagggcuucaaggccagcgacugcgagggccaggacguggugagccugcugagagaggccaucaccagaagacaggccguggagcugaacgugguggccaucgugaacgacaccgugggcaccaugaugagcugcggcuacgaggaccccagaugcgagaucggccugaucgugggcaccggcaccaacgccugcuacauggaggagcugagaaacguggccggcgugcccggcgacagcggcagaaugugcaucaacauggaguggggcgccuucggcgacgacggcagccuggccaugcugagcaccagauucgacgccagcguggaccaggccagcaucaaccccggcaagcagagauucgagaagaugaucagcggcauguaccugggcgagaucgugagacacauccugcugcaccugaccagccugggcgugcuguucagaggccagcagauccagagacugcagaccagagacaucuucaagaccaaguuccugagcgagaucgagagcgacagccuggcccugagacaggugagagccauccuggaggaccugggccugccccugaccagcgacgacgcccugauggugcuggaggugugccaggccgugagccagagagccgcccagcugugcggcgccggcguggccgccgugguggagaagaucagagagaacagaggccuggaggagcuggccgugagcgugggcguggacggcacccuguacaagcugcaccccagauucagcagccugguggccgccaccgugagagagcuggcccccagaugcguggugaccuuccugcagagcgaggacggcagcggcaagggcgccgcccuggugaccgccguggccugcagacuggcccagcugaccagaguguaa

SEQ ID NO: 18072 - RNA, 2754 nt, Artificial Sequence
  HKDC1__Homo_sapiens__NP_079406
auguucgccgugcaccugauggccuucuacuucagcaagcugaaggaggaccagaucaagaagguggacagauuccuguaccacaugagacugagcgacgacacccugcuggacaucaugagaagauucagagccgagauggagaagggccuggccaaggacaccaaccccaccgccgccgugaagaugcugcccaccuucgugagagccauccccgacggcagcgagaacggcgaguuccugagccuggaccugggcggcagcaaguucagagugcugaaggugcagguggccgaggagggcaagagacacgugcagauggagagccaguucuaccccacccccaacgagaucaucagaggcaacggcaccgagcuguucgaguacguggccgacugccuggccgacuucaugaagaccaaggaccugaagcacaagaagcugccccugggccugaccuucagcuuccccugcagacagaccaagcuggaggagggcgugcugcugagcuggaccaagaaguucaaggccagaggcgugcaggacaccgacguggugagcagacugaccaaggccaugagaagacacaaggacauggacguggacauccuggcccuggugaacgacaccgugggcaccaugaugaccugcgccuacgacgaccccuacugcgaggugggcgugaucaucggcaccggcaccaacgccugcuacauggaggacaugagcaacaucgaccugguggagggcgacgagggcagaaugugcaucaacaccgaguggggcgccuucggcgacgacggcgcccuggaggacaucagaaccgaguucgacagagagcuggaccugggcagccugaaccccggcaagcagcuguucgagaagaugaucagcggccuguaccugggcgagcuggugagacugauccugcugaagauggccaaggccggccugcuguucggcggcgagaagagcagcgcccugcacaccaagggcaagaucgagaccagacacguggccgccauggagaaguacaaggagggccuggccaacaccagagagauccugguggaccugggccuggagcccagcgaggccgacugcaucgccgugcagcacgugugcaccaucgugagcuucagaagcgccaaccugugcgccgccgcccuggccgccauccugaccagacugagagagaacaagaagguggagagacugagaaccaccgugggcauggacggcacccuguacaagauccacccccaguaccccaagagacugcacaagguggugagaaagcuggugcccagcugcgacgugagauuccugcugagcgagagcggcagcaccaagggcgccgccauggugaccgccguggccagcagagugcaggcccagagaaagcagaucgacagagugcuggcccuguuccagcugaccagagagcagcugguggacgugcaggccaagaugagagccgagcuggaguacggccugaagaagaagagccacggccuggccaccgugagaaugcugcccaccuacgugugcggccugcccgacggcaccgagaagggcaaguuccuggcccuggaccugggcggcaccaacuucagagugcugcuggugaagaucagaagcggcagaagaagcgugagaauguacaacaagaucuucgccaucccccuggagaucaugcagggcaccggcgaggagcuguucgaccacaucgugcagugcaucgccgacuuccuggacuacaugggccugaagggcgccagccugccccugggcuucaccuucagcuuccccugcagacagaugagcaucgacaagggcacccugaucggcuggaccaagggcuucaaggccaccgacugcgagggcgaggacgugguggacaugcugagagaggccaucaagagaagaaacgaguucgaccuggacaucguggccguggugaacgacaccgugggcaccaugaugaccugcggcuacgaggaccccaacugcgagaucggccugaucgccggcaccggcagcaacaugugcuacauggaggacaugagaaacaucgagaugguggagggcggcgagggcaagaugugcaucaacaccgaguggggcggcuucggcgacaacggcugcaucgacgacaucagaaccagauacgacaccgagguggacgagggcagccugaaccccggcaagcagagauacgagaagaugaccagcggcauguaccugggcgagaucgugagacagauccugaucgaccugaccaagcagggccugcuguucagaggccagaucagcgagagacugagaaccagaggcaucuucgagaccaaguuccugagccagaucgagagcgacagacuggcccugcugcaggugagaagaauccugcagcagcugggccuggacagcaccugcgaggacagcaucguggugaaggaggugugcggcgccgugagcagaagagccgcccagcugugcggcgccggccuggccgccaucguggagaagagaagagaggaccagggccuggagcaccugagaaucaccgugggcguggacggcacccuguacaagcugcacccccacuucagcagaauccugcaggagaccgugaaggagcuggcccccagaugcgacgugaccuucaugcugagcgaggacggcagcggcaagggcgccgcccugaucaccgccguggccaagagacugcagcaggcccagaaggagaacuaa

SEQ ID NO: 18073 - RNA, 1098 nt, Artificial Sequence
  HLA-A__Homo_sapiens__NP_001229687
auggccgugauggcccccagaacccugcugcugcugcugagcggcgcccuggcccugacccagaccugggccggcagccacagcaugagauacuucuucaccagcgugagcagacccggcagaggcgagcccagauucaucgccgugggcuacguggacgacacccaguucgugagauucgacagcgacgccgccagccagaagauggagcccagagcccccuggaucgagcaggagggccccgaguacugggaccaggagaccagaaacaugaaggcccacagccagaccgacagagccaaccugggcacccugagaggcuacuacaaccagagcgaggacggcagccacaccauccagaucauguacggcugcgacgugggccccgacggcagauuccugagaggcuacagacaggacgccuacgacggcaaggacuacaucgcccugaacgaggaccugagaagcuggaccgccgccgacauggccgcccagaucaccaagagaaagugggaggccgugcacgccgccgagcagagaagaguguaccuggagggcagaugcguggacggccugagaagauaccuggagaacggcaaggagacccugcagagaaccgacccccccaagacccacaugacccaccaccccaucagcgaccacgaggccacccugagaugcugggcccugggcuucuaccccgccgagaucacccugaccuggcagagagacggcgaggaccagacccaggacaccgagcugguggagaccagacccgccggcgacggcaccuuccagaagugggccgccgugguggugcccagcggcgaggagcagagauacaccugccacgugcagcacgagggccugcccaagccccugacccugagaugggagcugagcagccagcccaccauccccaucgugggcaucaucgccggccuggugcugcugggcgccgugaucaccggcgccgugguggccgccgugauguggagaagaaagagcagcgacagaaagggcggcagcuacacccaggccgccagcagcgacagcgcccagggcagcgacgugagccugaccgccugcaagguguaa

SEQ ID NO: 18074 - RNA, 1089 nt, Artificial Sequence
  HLA-B__Homo_sapiens__NP_005505
augcuggugauggcccccagaaccgugcugcugcugcugagcgccgcccuggcccugaccgagaccugggccggcagccacagcaugagauacuucuacaccagcgugagcagacccggcagaggcgagcccagauucaucagcgugggcuacguggacgacacccaguucgugagauucgacagcgacgccgccagccccagagaggagcccagagcccccuggaucgagcaggagggccccgaguacugggacagaaacacccagaucuacaaggcccaggcccagaccgacagagagagccugagaaaccugagaggcuacuacaaccagagcgaggccggcagccacacccugcagagcauguacggcugcgacgugggccccgacggcagacugcugagaggccacgaccaguacgccuacgacggcaaggacuacaucgcccugaacgaggaccugagaagcuggaccgccgccgacaccgccgcccagaucacccagagaaagugggaggccgccagagaggccgagcagagaagagccuaccuggagggcgagugcguggaguggcugagaagauaccuggagaacggcaaggacaagcuggagagagccgacccccccaagacccacgugacccaccaccccaucagcgaccacgaggccacccugagaugcugggcccugggcuucuaccccgccgagaucacccugaccuggcagagagacggcgaggaccagacccaggacaccgagcugguggagaccagacccgccggcgacagaaccuuccagaagugggccgccgugguggugcccagcggcgaggagcagagauacaccugccacgugcagcacgagggccugcccaagccccugacccugagaugggagcccagcagccagagcaccgugcccaucgugggcaucguggccggccuggccgugcuggccgugguggugaucggcgccgugguggccgccgugaugugcagaagaaagagcagcggcggcaagggcggcagcuacagccaggccgccugcagcgacagcgcccagggcagcgacgugagccugaccgccuaa

SEQ ID NO: 18075 - RNA, 1101 nt, Artificial Sequence
  HLA-C__Homo_sapiens__NP_001229971
augagagugauggcccccagagcccugcugcugcugcugagcggcggccuggcccugaccgagaccugggccugcagccacagcaugagauacuucgacaccgccgugagcagacccggcagaggcgagcccagauucaucagcgugggcuacguggacgacacccaguucgugagauucgacagcgacgccgccagccccagaggcgagcccagagcccccuggguggagcaggagggccccgaguacugggacagagagacccagaacuacaagagacaggcccaggccgacagagugagccugagaaaccugagaggcuacuacaaccagagcgaggacggcagccacacccugcagagaauguacggcugcgaccugggccccgacggcagacugcugagaggcuacgaccagagcgccuacgacggcaaggacuacaucgcccugaacgaggaccugagaagcuggaccgccgccgacaccgccgcccagaucacccagagaaagcuggaggccgccagagccgccgagcagcugagagccuaccuggagggcaccugcguggaguggcugagaagauaccuggagaacggcaaggagacccugcagagagccgagccccccaagacccacgugacccaccacccccugagcgaccacgaggccacccugagaugcugggcccugggcuucuaccccgccgagaucacccugaccuggcagagagacggcgaggaccagacccaggacaccgagcugguggagaccagacccgccggcgacggcaccuuccagaagugggccgccgugguggugcccagcggccaggagcagagauacaccugccacaugcagcacgagggccugcaggagccccugacccugagcugggagcccagcagccagcccaccauccccaucaugggcaucguggccggccuggccgugcugguggugcuggccgugcugggcgccguggugaccgccaugaugugcagaagaaagagcagcggcggcaagggcggcagcugcagccaggccgccugcagcaacagcgcccagggcagcgacgagagccugaucaccugcaaggccuaa

SEQ ID NO: 18076 - RNA, 786 nt, Artificial Sequence
  HLA-DMA__Homo_sapiens__NP_006111
augggccacgagcagaaccagggcgccgcccugcugcagaugcugccccugcuguggcugcugccccacagcugggccgugcccgaggcccccacccccauguggcccgacgaccugcagaaccacaccuuccugcacaccguguacugccaggacggcagccccagcgugggccugagcgaggccuacgacgaggaccagcuguucuucuucgacuucagccagaacaccagagugcccagacugcccgaguucgccgacugggcccaggagcagggcgacgcccccgccauccuguucgacaaggaguucugcgaguggaugauccagcagaucggccccaagcuggacggcaagauccccgugagcagaggcuuccccaucgccgagguguucacccugaagccccuggaguucggcaagcccaacacccuggugugcuucgugagcaaccuguucccccccaugcugaccgugaacuggcagcaccacagcgugcccguggagggcuucggccccaccuucgugagcgccguggacggccugagcuuccaggccuucagcuaccugaacuucacccccgagcccagcgacaucuucagcugcaucgugacccacgagaucgacagauacaccgccaucgccuacugggugcccagaaacgcccugcccagcgaccugcuggagaacgugcugugcggcguggccuucggccugggcgugcugggcaucaucgugggcaucgugcugaucaucuacuucagaaagcccugcagcggcgacuaa

SEQ ID NO: 18077 - RNA, 792 nt, Artificial Sequence
  HLA-DMB__Homo_sapiens__NP_002109
augaucaccuuccugccccugcugcugggccugagccugggcugcaccggcgccggcggcuucguggcccacguggagagcaccugccugcuggacgacgccggcacccccaaggacuucaccuacugcaucagcuucaacaaggaccugcugaccugcugggaccccgaggagaacaagauggcccccugcgaguucggcgugcugaacagccuggccaacgugcugagccagcaccugaaccagaaggacacccugaugcagagacugagaaacggccugcagaacugcgccacccacacccagcccuucuggggcagccugaccaacagaaccagaccccccagcgugcagguggccaagaccacccccuucaacaccagagagcccgugaugcuggccugcuacguguggggcuucuaccccgccgaggugaccaucaccuggagaaagaacggcaagcuggugaugccccacagcagcgcccacaagaccgcccagcccaacggcgacuggaccuaccagacccugagccaccuggcccugacccccagcuacggcgacaccuacaccugcgugguggagcacaccggcgcccccgagcccauccugagagacuggacccccggccugagccccaugcagacccugaaggugagcgugagcgccgugacccugggccugggccugaucaucuucagccugggcgugaucagcuggagaagagccggccacagcagcuacaccccccugcccggcagcaacuacagcgagggcuggcacaucagcuaa

SEQ ID NO: 18078 - RNA, 753 nt, Artificial Sequence
  HLA-DOA__Homo_sapiens__NP_002110
auggcccugagagccggccuggugcugggcuuccacacccugaugacccugcugagcccccaggaggccggcgccaccaaggccgaccacaugggcagcuacggccccgccuucuaccagagcuacggcgccagcggccaguucacccacgaguucgacgaggagcagcuguucagcguggaccugaagaagagcgaggccguguggagacugcccgaguucggcgacuucgccagauucgacccccagggcggccuggccggcaucgccgccaucaaggcccaccuggacauccugguggagagaagcaacagaagcagagccaucaacgugccccccagagugaccgugcugcccaagagcagaguggagcugggccagcccaacauccugaucugcaucguggacaacaucuucccccccgugaucaacaucaccuggcugagaaacggccagaccgugaccgagggcguggcccagaccagcuucuacagccagcccgaccaccuguucagaaaguuccacuaccugcccuucgugcccagcgccgaggacguguacgacugccagguggagcacuggggccuggacgccccccugcugagacacugggagcugcaggugcccauccccccccccgacgccauggagacccuggugugcgcccugggccuggccaucggccuggugggcuuccuggugggcaccgugcugaucaucaugggcaccuacgugagcagcgugcccagauaa

SEQ ID NO: 18079 - RNA, 822 nt, Artificial Sequence
  HLA-DOB__Homo_sapiens__NP_002111
augggcagcggcugggugcccugggugguggcccugcuggugaaccugaccagacuggacagcagcaugacccagggcaccgacagccccgaggacuucgugauccaggccaaggccgacugcuacuucaccaacggcaccgagaaggugcaguucguggugagauucaucuucaaccuggaggaguacgugagauucgacagcgacgugggcauguucguggcccugaccaagcugggccagcccgacgccgagcaguggaacagcagacuggaccugcuggagagaagcagacaggccguggacggcgugugcagacacaacuacagacugggcgcccccuucaccgugggcagaaaggugcagcccgaggugaccguguaccccgagagaaccccccugcugcaccagcacaaccugcugcacugcagcgugaccggcuucuaccccggcgacaucaagaucaagugguuccugaacggccaggaggagagagccggcgugaugagcaccggccccaucagaaacggcgacuggaccuuccagaccguggugaugcuggagaugacccccgagcugggccacguguacaccugccugguggaccacagcagccugcugagccccgugagcguggaguggagagcccagagcgaguacagcuggagaaagaugcugagcggcaucgccgccuuccugcugggccugaucuuccugcuggugggcaucgugauccagcugagagcccagaagggcuacgugagaacccagaugagcggcaacgaggugagcagagccgugcugcugccccagagcugcuaa

SEQ ID NO: 18080 - RNA, 783 nt, Artificial Sequence
  HLA-DPA1__Homo_sapiens__NP_001229454
augagacccgaggacagaauguuccacaucagagccgugauccugagagcccugagccuggccuuccugcugagccugagaggcgccggcgccaucaaggccgaccacgugagcaccuacgccgccuucgugcagacccacagacccaccggcgaguucauguucgaguucgacgaggacgagauguucuacguggaccuggacaagaaggagaccguguggcaccuggaggaguucggccaggccuucagcuucgaggcccagggcggccuggccaacaucgccauccugaacaacaaccugaacacccugauccagagaagcaaccacacccaggccaccaacgacccccccgaggugaccguguuccccaaggagcccguggagcugggccagcccaacacccugaucugccacaucgacaaguucuucccccccgugcugaacgugaccuggcugugcaacggcgagcuggugaccgagggcguggccgagagccuguuccugcccagaaccgacuacagcuuccacaaguuccacuaccugaccuucgugcccagcgccgaggacuucuacgacugcagaguggagcacuggggccuggaccagccccugcugaagcacugggaggcccaggagcccauccagaugcccgagaccaccgagaccgugcugugcgcccugggccuggugcugggccuggugggcaucaucgugggcaccgugcugaucaucaagagccugagaagcggccacgaccccagagcccagggcacccuguaa

SEQ ID NO: 18081 - RNA, 777 nt, Artificial Sequence
  HLA-DPB1__Homo_sapiens__NP_002112
augauggugcugcaggugagcgccgcccccagaaccguggcccugaccgcccugcugauggugcugcugaccagcguggugcagggcagagccacccccgagaacuaccuguuccagggcagacaggagugcuacgccuucaacggcacccagagauuccuggagagauacaucuacaacagagaggaguucgccagauucgacagcgacgugggcgaguucagagccgugaccgagcugggcagacccgccgccgaguacuggaacagccagaaggacauccuggaggagaagagagccgugcccgacagaaugugcagacacaacuacgagcugggcggccccaugacccugcagagaagagugcagcccagagugaacgugagccccagcaagaagggcccccugcagcaccacaaccugcuggugugccacgugaccgacuucuaccccggcagcauccaggugagaugguuccugaacggccaggaggagaccgccggcguggugagcaccaaccugaucagaaacggcgacuggaccuuccagauccuggugaugcuggagaugaccccccagcagggcgacguguacaccugccagguggagcacaccagccuggacagccccgugaccguggaguggaaggcccagagcgacagcgccagaagcaagacccugaccggcgccggcggcuucgugcugggccugaucaucugcggcgugggcaucuucaugcacagaagaagcaagaaggugcagagaggcagcgccuaa

SEQ ID NO: 18082 - RNA, 768 nt, Artificial Sequence
  HLA-DQA1__Homo_sapiens__NP_002113
augauccugaacaaggcccugcugcugggcgcccuggcccugaccaccgugaugagccccugcggcggcgaggacaucguggccgaccacguggccagcugcggcgugaaccuguaccaguucuacggccccagcggccaguacacccacgaguucgacggcgacgagcaguucuacguggaccuggagagaaaggagaccgccuggagauggcccgaguucagcaaguucggcggcuucgacccccagggcgcccugagaaacauggccguggccaagcacaaccugaacaucaugaucaagagauacaacagcaccgccgccaccaacgaggugcccgaggugaccguguucagcaagagccccgugacccugggccagcccaacacccugaucugccugguggacaacaucuucccccccguggugaacaucaccuggcugagcaacggccagagcgugaccgagggcgugagcgagaccagcuuccugagcaagagcgaccacagcuucuucaagaucagcuaccugaccuuccugcccagcgccgacgagaucuacgacugcaagguggagcacuggggccuggaccagccccugcugaagcacugggagcccgagauccccgcccccaugagcgagcugaccgagaccguggugugcgcccugggccugagcgugggccugaugggcaucguggugggcaccguguucaucauccagggccugagaagcgugggcgccagcagacaccagggcccccuguaa

SEQ ID NO: 18083 - RNA, 768 nt, Artificial Sequence
  HLA-DQA2__Homo_sapiens__NP_064440
augauccugaacaaggcccugcugcugggcgcccuggcccugaccgccgugaugagccccugcggcggcgaggacaucguggccgaccacguggccagcuacggcgugaacuucuaccagagccacggccccagcggccaguacacccacgaguucgacggcgacgaggaguucuacguggaccuggagaccaaggagaccguguggcagcugcccauguucagcaaguucaucagcuucgacccccagagcgcccugagaaacauggccgugggcaagcacacccuggaguucaugaugagacagagcaacagcaccgccgccaccaacgaggugcccgaggugaccguguucagcaaguuccccgugacccugggccagcccaacacccugaucugccugguggacaacaucuucccccccguggugaacaucaccuggcugagcaacggccacagcgugaccgagggcgugagcgagaccagcuuccugagcaagagcgaccacagcuucuucaagaucagcuaccugaccuuccugcccagcgccgacgagaucuacgacugcaagguggagcacuggggccuggacgagccccugcugaagcacugggagcccgagauccccgcccccaugagcgagcugaccgagacccuggugugcgcccugggccugagcgugggccugaugggcaucguggugggcaccguguucaucauccagggccugagaagcgugggcgccagcagacaccagggccugcuguaa

SEQ ID NO: 18084 - RNA, 810 nt, Artificial Sequence
  HLA-DQB1__Homo_sapiens__NP_001230890
augagcuggaagaaggcccugagaauccccggcgaccugagaguggccaccgugacccugaugcuggccaugcugagcagccugcuggccgagggcagagacagccccgaggacuucguguuccaguucaagggcaugugcuacuucaccaacggcaccgagagagugagacuggugaccagauacaucuacaacagagaggaguacgccagauucgacagcgacgugggcguguacagagccgugaccccccagggcagacccgacgccgaguacuggaacagccagaaggaggugcuggagggcaccagagccgagcuggacaccgugugcagacacaacuacgagguggccuucagaggcauccugcagagaagaguggagcccaccgugaccaucagccccagcagaaccgaggcccugaaccaccacaaccugcuggugugcagcgugaccgacuucuaccccggccagaucaaggugagaugguucagaaacgaccaggaggagaccgccggcguggugagcaccccccugaucagaaacggcgacuggaccuuccagauccuggugaugcuggagaugaccccccagagaggcgacguguacaccugccacguggagcaccccagccugcagagccccaucaccguggaguggagagcccagagcgagagcgcccagagcaagaugcugagcggcgugggcggcuucgugcugggccugaucuuccugggccugggccugaucaucagacagagaagccagaagggcccccagggccccccccccgccggccugcugcacuaa

SEQ ID NO: 18085 - RNA, 684 nt, Artificial Sequence
  HLA-DQB2__Homo_sapiens__NP_001185787
auggcccugcagauccccggcggcuucugggccgccgccgugaccgugaugcuggugaugcugagcacccccguggccgaggccagagacuuccccaaggacuuccuggugcaguucaagggcaugugcuacuucaccaacggcaccgagagagugagaggcguggccagauacaucuacaacagagaggaguacggcagauucgacagcgacgugggcgaguuccaggccgugaccgagcugggcagaagcaucgaggacuggaacaacuacaaggacuuccuggagcaggagagagccgccguggacaaggugugcagacacaacuacgaggccgagcugagaaccacccugcagagacagguggagcccaccgugaccaucagccccagcagaaccgaggcccugaaccaccacaaccugcuggugugcagcgugaccgacuucuaccccgcccagaucaaggugagaugguucagaaacgaccaggaggagaccgccggcguggugagcaccagccugaucagaaacggcgacuggaccuuccagauccuggugaugcuggagaucaccccccagagaggcgacaucuacaccugccagguggagcaccccagccugcagagccccaucaccguggaguggagacccagaggccccccccccgccggccugcugcacuaa

SEQ ID NO: 18086 - RNA, 765 nt, Artificial Sequence
  HLA-DRA__Homo_sapiens__NP_061984
auggccaucagcggcgugcccgugcugggcuucuucaucaucgccgugcugaugagcgcccaggagagcugggccaucaaggaggagcacgugaucauccaggccgaguucuaccugaaccccgaccagagcggcgaguucauguucgacuucgacggcgacgagaucuuccacguggacauggccaagaaggagaccguguggagacuggaggaguucggcagauucgccagcuucgaggcccagggcgcccuggccaacaucgccguggacaaggccaaccuggagaucaugaccaagagaagcaacuacacccccaucaccaacgugccccccgaggugaccgugcugaccaacagccccguggagcugagagagcccaacgugcugaucugcuucaucgacaaguucaccccccccguggugaacgugaccuggcugagaaacggcaagcccgugaccaccggcgugagcgagaccguguuccugcccagagaggaccaccuguucagaaaguuccacuaccugcccuuccugcccagcaccgaggacguguacgacugcagaguggagcacuggggccuggacgagccccugcugaagcacugggaguucgacgcccccagcccccugcccgagaccaccgagaacguggugugcgcccugggccugaccgugggccuggugggcaucaucaucggcaccaucuucaucaucaagggccugagaaagagcaacgccgccgagagaagaggcccccuguaa

SEQ ID NO: 18087 - RNA, 801 nt, Artificial Sequence
  HLA-DRB1__Homo_sapiens__NP_001230894
auggugugccugagacugcccggcggcagcugcauggccgugcugaccgugacccugauggugcugagcagcccccuggcccuggccggcgacaccagacccagauuccuggaguacagcaccagcgagugccacuucuucaacggcaccgagagagugagauaccuggacagauacuuccacaaccaggaggagaacgugagauucgacagcgacgugggcgaguucagagccgugaccgagcugggcagacccgacgccgaguacuggaacagccagaaggaccugcuggagcagaagagaggcagaguggacaacuacugcagacacaacuacggcgugguggagagcuucaccgugcagagaagagugcaccccaaggugaccguguaccccagcaagacccagccccugcagcaccacaaccugcuggugugcagcgugagcggcuucuaccccggcagcaucgaggugagaugguucagaaacggccaggaggagaagaccggcguggugagcaccggccugauccacaacggcgacuggaccuuccagacccuggugaugcuggagaccgugcccagaagcggcgagguguacaccugccagguggagcaccccagcgugaccagcccccugaccguggaguggagagccagaagcgagagcgcccagagcaagaugcugagcggcgugggcggcuucgugcugggccugcuguuccugggcgccggccuguucaucuacuucagaaaccagaagggccacagcggccugcagcccagaggcuuccugagcuaa

SEQ ID NO: 18088 - RNA, 801 nt, Artificial Sequence
  HLA-DRB3__Homo_sapiens__NP_072049
auggugugccugaagcugcccggcggcagcagccuggccgcccugaccgugacccugauggugcugagcagcagacuggccuucgccggcgacaccagacccagauuccuggagcugagaaagagcgagugccacuucuucaacggcaccgagagagugagauaccuggacagauacuuccacaaccaggaggaguuccugagauucgacagcgacgugggcgaguacagagccgugaccgagcugggcagacccguggccgagagcuggaacagccagaaggaccugcuggagcagaagagaggcagaguggacaacuacugcagacacaacuacggcgugggcgagagcuucaccgugcagagaagagugcacccccaggugaccguguaccccgccaagacccagccccugcagcaccacaaccugcuggugugcagcgugagcggcuucuaccccggcagcaucgaggugagaugguucagaaacggccaggaggagaaggccggcguggugagcaccggccugauccagaacggcgacuggaccuuccagacccuggugaugcuggagaccgugcccagaagcggcgagguguacaccugccagguggagcaccccagcgugaccagcgcccugaccguggaguggagagccagaagcgagagcgcccagagcaagaugcugagcggcgugggcggcuucgugcugggccugcuguuccugggcgccggccuguucaucuacuucagaaaccagaagggccacagcggccugcagcccaccggcuuccugagcuaa

SEQ ID NO: 18089 - RNA, 801 nt, Artificial Sequence
  HLA-DRB4__Homo_sapiens__NP_068818
auggugugccugaagcugcccggcggcagcugcauggccgcccugaccgugacccugaccgugcugagcagcccccuggcccuggccggcgacacccagcccagauuccuggagcaggccaagugcgagugccacuuccugaacggcaccgagagaguguggaaccugaucagauacaucuacaaccaggaggaguacgccagauacaacagcgaccugggcgaguaccaggccgugaccgagcugggcagacccgacgccgaguacuggaacagccagaaggaccugcuggagagaagaagagccgagguggacaccuacugcagauacaacuacggcgugguggagagcuucaccgugcagagaagagugcagcccaaggugaccguguaccccagcaagacccagccccugcagcaccacaaccugcuggugugcagcgugaacggcuucuaccccggcagcaucgaggugagaugguucagaaacggccaggaggagaaggccggcguggugagcaccggccugauccagaacggcgacuggaccuuccagacccuggugaugcuggagaccgugcccagaagcggcgagguguacaccugccagguggagcaccccagcaugaugagcccccugaccgugcaguggagcgccagaagcgagagcgcccagagcaagaugcugagcggcgugggcggcuucgugcugggccugcuguuccugggcaccggccuguucaucuacuucagaaaccagaagggccacagcggccugcagcccaccggccugcugagcuaa

SEQ ID NO: 18090 - RNA, 801 nt, Artificial Sequence
  HLA-DRB5__Homo_sapiens__NP_002116
auggugugccugaagcugcccggcggcagcuacauggccaagcugaccgugacccugauggugcugagcagcccccuggcccuggccggcgacaccagacccagauuccugcagcaggacaaguacgagugccacuucuucaacggcaccgagagagugagauuccugcacagagacaucuacaaccaggaggaggaccugagauucgacagcgacgugggcgaguacagagccgugaccgagcugggcagacccgacgccgaguacuggaacagccagaaggacuuccuggaggacagaagagccgccguggacaccuacugcagacacaacuacggcgugggcgagagcuucaccgugcagagaagaguggagcccaaggugaccguguaccccgccagaacccagacccugcagcaccacaaccugcuggugugcagcgugaacggcuucuaccccggcagcaucgaggugagaugguucagaaacagccaggaggagaaggccggcguggugagcaccggccugauccagaacggcgacuggaccuuccagacccuggugaugcuggagaccgugcccagaagcggcgagguguacaccugccagguggagcaccccagcgugaccagcccccugaccguggaguggagagcccagagcgagagcgcccagagcaagaugcugagcggcgugggcggcuucgugcugggccugcuguuccugggcgccggccuguucaucuacuucaagaaccagaagggccacagcggccugcaccccaccggccuggugagcuaa

SEQ ID NO: 18091 - RNA, 1077 nt, Artificial Sequence
  HLA-E__Homo_sapiens__NP_005507
augguggacggcacccugcugcugcugcugagcgaggcccuggcccugacccagaccugggccggcagccacagccugaaguacuuccacaccagcgugagcagacccggcagaggcgagcccagauucaucagcgugggcuacguggacgacacccaguucgugagauucgacaacgacgccgccagccccagaauggugcccagagcccccuggauggagcaggagggcagcgaguacugggacagagagaccagaagcgccagagacaccgcccagaucuucagagugaaccugagaacccugagaggcuacuacaaccagagcgaggccggcagccacacccugcaguggaugcacggcugcgagcugggccccgacggcagauuccugagaggcuacgagcaguucgccuacgacggcaaggacuaccugacccugaacgaggaccugagaagcuggaccgccguggacaccgccgcccagaucagcgagcagaagagcaacgacgccagcgaggccgagcaccagagagccuaccuggaggacaccugcguggaguggcugcacaaguaccuggagaagggcaaggagacccugcugcaccuggagccccccaagacccacgugacccaccaccccaucagcgaccacgaggccacccugagaugcugggcccugggcuucuaccccgccgagaucacccugaccuggcagcaggacggcgagggccacacccaggacaccgagcugguggagaccagacccgccggcgacggcaccuuccagaagugggccgccgugguggugcccagcggcgaggagcagagauacaccugccacgugcagcacgagggccugcccgagcccgugacccugagauggaagcccgccagccagcccaccauccccaucgugggcaucaucgccggccuggugcugcugggcagcguggugagcggcgccgugguggccgccgugaucuggagaaagaagagcagcggcggcaagggcggcagcuacagcaaggccgaguggagcgacagcgcccagggcagcgagagccacagccuguaa

SEQ ID NO: 18092 - RNA, 765 nt, Artificial Sequence
  HLA-F__Homo_sapiens__NP_001091948
auggcccccagaagccugcugcugcugcugagcggcgcccuggcccugaccgacaccugggccggcagccacagccugagauacuucagcaccgccgugagcagacccggcagaggcgagcccagauacaucgccguggaguacguggacgacacccaguuccugagauucgacagcgacgccgccauccccagaauggagcccagagagcccuggguggagcaggagggcccccaguacugggaguggaccaccggcuacgccaaggccaacgcccagaccgacagaguggcccugagaaaccugcugagaagauacaaccagagcgaggccggcagccacacccugcagggcaugaacggcugcgacaugggccccgacggcagacugcugagaggcuaccaccagcacgccuacgacggcaaggacuacaucagccugaacgaggaccugagaagcuggaccgccgccgacaccguggcccagaucacccagagauucuacgaggccgaggaguacgccgaggaguucagaaccuaccuggagggcgagugccuggagcugcugagaagauaccuggagaacggcaaggagacccugcagagagccgagcagagcccccagcccaccauccccaucgugggcaucguggccggccugguggugcugggcgccguggugaccggcgccgugguggccgccgugauguggagaaagaagagcagcgacagaaacagaggcagcuacagccaggccgccguguaa

SEQ ID NO: 18093 - RNA, 1017 nt, Artificial Sequence
  HLA-G__Homo_sapiens__NP_002118
augguggugauggcccccagaacccuguuccugcugcugagcggcgcccugacccugaccgagaccugggccggcagccacagcaugagauacuucagcgccgccgugagcagacccggcagaggcgagcccagauucaucgccaugggcuacguggacgacacccaguucgugagauucgacagcgacagcgccugccccagaauggagcccagagcccccuggguggagcaggagggccccgaguacugggaggaggagaccagaaacaccaaggcccacgcccagaccgacagaaugaaccugcagacccugagaggcuacuacaaccagagcgaggccagcagccacacccugcaguggaugaucggcugcgaccugggcagcgacggcagacugcugagaggcuacgagcaguacgccuacgacggcaaggacuaccuggcccugaacgaggaccugagaagcuggaccgccgccgacaccgccgcccagaucagcaagagaaagugcgaggccgccaacguggccgagcagagaagagccuaccuggagggcaccugcguggaguggcugcacagauaccuggagaacggcaaggagaugcugcagagagccgacccccccaagacccacgugacccaccaccccguguucgacuacgaggccacccugagaugcugggcccugggcuucuaccccgccgagaucauccugaccuggcagagagacggcgaggaccagacccaggacguggagcugguggagaccagacccgccggcgacggcaccuuccagaagugggccgccgugguggugcccagcggcgaggagcagagauacaccugccacgugcagcacgagggccugcccgagccccugaugcugagauggaagcagagcagccugcccaccauccccaucaugggcaucguggccggccugguggugcuggccgccguggugaccggcgccgccguggccgccgugcuguggagaaagaagagcagcgacuaa

SEQ ID NO: 18094 - RNA, 2622 nt, Artificial Sequence
  HLCS__Homo_sapiens__XP_005261010
augcugaucacccugugcuaccuguaccugugggccagauggggcagaagacccgccgagcuggugagagccaccgugagaagacugagagccagcagaugcagcuucaccuucugcggcgccgccgcccagccccccggcgccagagugugccugagcagaggcggcagaguguucugcgugagcgacagccagagcaucgaggaccugaacaagugggcccuguuccuggugagccccuucauccuggaggccgagcacaucgccuucgugaccgagagcaucugggugcagagcgagaaccugcagagaagcagcagcagcgagaccaucgugaaguggagcgacugcugccugccccuggccugcagacccggcgaccccuacagacugaucgccgaggccagcguggacaacuucagcaagcugggcguggccuucauggaggacagacugcacauggacaacggccuggugccccagaagaucgugagcgugcaccugcaggacagcacccugaaggaggugaaggaccaggugagcaacaagcaggcccagauccuggagcccaagcccgagcccagccuggagaucaagcccgagcaggacggcauggagcacgugggcagagacgaccccaaggcccugggcgaggagcccaagcagagaagaggcagcgccagcggcagcgagcccgccggcgacagcgacagaggcggcggccccguggagcacuaccaccugcaccugagcagcugccacgagugccuggagcuggagaacagcaccaucgagagcgugaaguucgccagcgccgagaacauccccgaccugcccuacgacuacagcagcagccuggagagcguggccgacgagaccagccccgagagagagggcagaagagugaaccugaccggcaaggcccccaacauccugcuguacgugggcagcgacagccaggaggcccugggcagauuccacgaggugagaagcgugcuggccgacugcguggacaucgacagcuacauccuguaccaccugcuggaggacagcgcccugagagaccccuggaccgacaacugccugcugcuggugaucgccaccagagagagcauccccgaggaccuguaccagaaguucauggccuaccugagccagggcggcaaggugcugggccugagcagcagcuucaccuucggcggcuuccaggugaccagcaagggcgcccugcacaagaccgugcagaaccugguguucagcaaggccgaccagagcgaggugaagcugagcgugcugagcagcggcugcagauaccaggagggccccgugagacugagccccggcagacugcagggccaccuggagaacgaggacaaggacagaaugaucgugcacgugcccuucggcaccagaggcggcgaggccgugcugugccaggugcaccuggagcugccccccagcagcaacaucgugcagacccccgaggacuucaaccugcugaagagcagcaacuucagaagauacgaggugcugagagagauccugaccacccugggccugagcugcgacaugaagcaggugcccgcccugaccccccuguaccugcugagcgccgccgaggagaucagagacccccugaugcaguggcugggcaagcacguggacagcgagggcgagaucaagagcggccagcugagccugagauucgugagcagcuacgugagcgagguggagaucacccccagcugcauccccguggugaccaacauggaggccuucagcagcgagcacuucaaccuggagaucuacagacagaaccugcagaccaagcagcugggcaaggugauccuguucgccgaggugacccccaccaccaugagacugcuggacggccugauguuccagaccccccaggagaugggccugaucgugaucgccgccagacagaccgagggcaagggcagaggcggcaacguguggcugagccccgugggcugcgcccugagcacccugcugaucagcaucccccugagaagccagcugggccagagaauccccuucgugcagcaccugaugagcguggccgugguggaggccgugagaagcauccccgaguaccaggacaucaaccugagagugaaguggcccaacgacaucuacuacagcgaccugaugaagaucggcggcgugcuggugaacagcacccugaugggcgagaccuucuacauccugaucggcugcggcuucaacgugaccaacagcaaccccaccaucugcaucaacgaccugaucaccgaguacaacaagcagcacaaggccgagcugaagccccugagagccgacuaccugaucgccagaguggugaccgugcuggagaagcugaucaaggaguuccaggacaagggccccaacagcgugcugccccuguacuacagauacugggugcacagcggccagcaggugcaccugggcagcgccgagggccccaaggugagcaucgugggccuggacgacagcggcuuccugcaggugcaccaggagggcggcgagguggugaccgugcaccccgacggcaacagcuucgacaugcugagaaaccugauccugcccaagagaagauaa

SEQ ID NO: 18095 - RNA, 888 nt, Artificial Sequence
  HLF__Homo_sapiens__NP_002117
auggagaagaugagcagaccccugccccugaaccccaccuucauccccccccccuacggcgugcugagaagccugcuggagaacccccugaagcugccccugcaccacgaggacgccuucagcaaggacaaggacaaggagaagaagcuggacgacgagagcaacagccccaccgugccccagagcgccuuccugggccccacccugugggacaagacccugcccuacgacggcgacaccuuccagcuggaguacauggaccuggaggaguuccugagcgagaacggcaucccccccagccccagccagcacgaccacagcccccacccccccggccugcagcccgccagcagcgccgcccccagcgugauggaccugagcagcagagccagcgccccccugcaccccggcauccccagccccaacugcaugcagagccccaucagacccggccagcugcugcccgccaacagaaacacccccagccccaucgaccccgacaccauccaggugcccgugggcuacgagcccgaccccgccgaccuggcccugagcagcauccccggccaggagauguucgaccccagaaagagaaaguucagcgaggaggagcugaagccccagcccaugaucaagaaggccagaaagguguucauccccgacgaccugaaggacgacaaguacugggccagaagaagaaagaacaacauggccgccaagagaagcagagacgccagaagacugaaggagaaccagaucgccaucagagccagcuuccuggagaaggagaacagcgcccugagacaggagguggccgaccugagaaaggagcugggcaagugcaagaacauccuggccaaguacgaggccagacacggcccccuguaa

SEQ ID NO: 18096 - RNA, 3030 nt, Artificial Sequence
  HLTF__Homo_sapiens__NP_003062
augagcuggauguucaagagagaccccguguggaaguaccugcagaccgugcaguacggcgugcacggcaacuuccccagacugagcuaccccaccuucuuccccagauucgaguuccaggacgugaucccccccgacgacuuccugaccagcgacgaggagguggacagcgugcuguucggcagccugagaggccacguggugggccugagauacuacaccggcguggugaacaacaacgagaugguggcccugcagagagaccccaacaaccccuacgacaagaacgccaucaaggugaacaacgugaacggcaaccaggugggccaccugaagaaggagcuggccggcgcccuggccuacaucauggacaacaagcuggcccagaucgagggcguggugcccuucggcgccaacaacgccuucaccaugccccugcacaugaccuucuggggcaaggaggagaacagaaaggccgugagcgaccagcugaagaagcacggcuucaagcugggccccgcccccaagacccugggcuucaaccuggagagcggcuggggcagcggcagagccggccccagcuacagcaugcccgugcacgccgccgugcagaugaccaccgagcagcugaagaccgaguucgacaagcuguucgaggaccugaaggaggacgacaagacccacgagauggagcccgccgaggccaucgagaccccccugcugccccaccagaagcaggcccuggccuggauggugagcagagagaacagcaaggagcugccccccuucugggagcagagaaacgaccuguacuacaacaccaucaccaacuucagcgagaaggacagacccgagaacgugcacggcggcauccuggccgacgacaugggccugggcaagacccugaccgccaucgccgugauccugaccaacuuccacgacggcagaccccugcccaucgagagagugaagaagaaccugcugaagaaggaguacaacgugaacgacgacagcaugaagcugggcggcaacaacaccagcgagaaggccgacggccugagcaaggacgccagcagaugcagcgagcagcccagcaucagcgacaucaaggagaagagcaaguucagaaugagcgagcugagcagcagcagacccaagagaagaaagaccgccgugcaguacaucgagagcagcgacagcgaggagaucgagaccagcgagcugccccagaagaugaagggcaagcugaagaacgugcagagcgagaccaagggcagagccaaggccggcagcagcaaggugaucgaggacguggccuucgccugcgcccugaccagcagcgugcccaccaccaagaagaagaugcugaagaagggcgccugcgccguggagggcagcaagaagaccgacguggaggagagacccagaaccacccugaucaucugcccccugagcgugcugagcaacuggaucgaccaguucggccagcacaucaagagcgacgugcaccugaacuucuacguguacuacggccccgacagaaucagagagcccgcccugcugagcaagcaggacaucgugcugaccaccuacaacauccugacccacgacuacggcaccaagggcgacagcccccugcacagcaucagauggcugagagugauccuggacgagggccacgccaucagaaaccccaacgcccagcagaccaaggccgugcuggaccuggagagcgagagaagaugggugcugaccggcacccccauccagaacagccugaaggaccuguggagccugcugagcuuccugaagcugaagcccuucaucgacagagagugguggcacagaaccauccagagacccgugaccaugggcgacgagggcggccugagaagacugcagagccugaucaagaacaucacccugagaagaaccaagaccagcaagaucaagggcaagcccgugcuggagcugcccgagagaaagguguucauccagcacaucacccugagcgacgaggagagaaagaucuaccagagcgugaagaacgagggcagagccaccaucggcagauacuucaacgagggcaccgugcuggcccacuacgccgacgugcugggccugcugcugagacugagacagaucugcugccacaccuaccugcugaccaacgccgugagcagcaacggccccagcggcaacgacacccccgaggagcugagaaagaagcugaucagaaagaugaagcugauccugagcagcggcagcgacgaggagugcgccaucugccuggacagccugaccgugcccgugaucacccacugcgcccacguguucugcaagcccugcaucugccaggugauccagaacgagcagccccacgccaagugcccccugugcagaaacgacauccacgaggacaaccugcuggagugcccccccgaggagcuggccagagacagcgagaagaagagcgacauggaguggaccagcagcagcaagaucaacgcccugaugcacgcccugaccgaccugagaaagaagaaccccaacaucaagagccugguggugagccaguucaccaccuuccugagccugaucgagaucccccugaaggccagcggcuucguguucaccagacuggacggcagcauggcccagaagaagagaguggagagcauccagugcuuccagaacaccgaggccggcagccccaccaucaugcugcugagccugaaggccggcggcgugggccugaaccugagcgccgccagcagaguguuccugauggaccccgccuggaaccccgccgccgaggaccagugcuucgacagaugccacagacugggccagaagcaggaggugaucaucaccaaguucaucgugaaggacagcguggaggagaacaugcugaagauccagaacaagaagagagagcuggccgccggcgccuucggcaccaagaagcccaacgccgacgagaugaagcaggccaagaucaacgagaucagaacccugaucgaccuguaa

SEQ ID NO: 18097 - RNA, 1467 nt, Artificial Sequence
  HLX__Homo_sapiens__NP_068777
auguucgccgccggccuggcccccuucuacgccagcaacuucagccuguggagcgccgccuacugcagcagcgccggccccggcggcugcagcuucccccuggaccccgccgccgugaagaagcccagcuucugcaucgccgacauccugcacgccggcgugggcgaccugggcgccgcccccgagggccuggccggcgccagcgccgccgcccugaccgcccaccugggcagcgugcacccccacgccagcuuccaggccgccgccagaagcccccugagacccacccccgugguggcccccagcgaggugcccgccggcuucccccagagacugagcccccugagcgccgccuaccaccaccaccacccccagcagcagcagcagcagcagcagccccagcagcagcagcccccccccccccccagagccggcgcccugcagccccccgccagcggcaccagaguggugcccaacccccaccacagcggcagcgcccccgcccccagcagcaaggaccugaaguucggcaucgacagaauccugagcgccgaguucgaccccaaggugaaggagggcaacacccugagagaccugaccagccugcugaccggcggcagacccgccggcgugcaccugagcggccugcagcccagcgccggccaguucuucgccagccuggaccccaucaacgaggccagcgccauccugagcccccugaacagcaaccccagaaacagcgugcagcaccaguuccaggacaccuuccccggccccuacgccgugcugaccaaggacaccaugccccagaccuacaagagaaagagaagcuggagcagagccguguucagcaaccugcagagaaagggccuggagaagagauucgagauccagaaguacgugaccaagcccgacagaaagcagcuggccgccaugcugggccugaccgacgcccaggugaaggugugguuccagaacagaagaaugaaguggagacacagcaaggaggcccaggcccagaaggacaaggacaaggaggccggcgagaagcccagcggcggcgcccccgccgccgacggcgagcaggacgagagaagccccagcagaagcgagggcgaggccgagagcgagagcagcgacagcgagagccuggacauggcccccagcgacaccgagagaaccgagggcagcgagagaagccugcaccagaccaccgugaucaaggcccccgugaccggcgcccugaucaccgccagcagcgccggcagcggcggcagcagcggcggcggcggcaacagcuucagcuucagcagcgccagcagccugagcagcagcagcaccagcgccggcugcgccagcagccugggcggcggcggcgccagcgagcugcugcccgccacccagcccaccgccagcagcgcccccaagagccccgagcccgcccagggcgcccugggcugccuguaa

SEQ ID NO: 18098 - RNA, 1134 nt, Artificial Sequence
  HM13__Homo_sapiens__NP_110416
auggacagcgcccugagcgacccccacaacggcagcgccgaggccggcggccccaccaacagcaccaccagaccccccagcacccccgagggcaucgcccuggccuacggcagccugcugcugauggcccugcugcccaucuucuucggcgcccugagaagcgugagaugcgccagaggcaagaacgccagcgacaugcccgagaccaucaccagcagagacgccgccagauuccccaucaucgccagcugcacccugcugggccuguaccuguucuucaagaucuucagccaggaguacaucaaccugcugcugagcauguacuucuucgugcugggcauccuggcccugagccacaccaucagccccuucaugaacaaguucuuccccgccagcuuccccaacagacaguaccagcugcuguucacccagggcagcggcgagaacaaggaggagaucaucaacuacgaguucgacaccaaggaccuggugugccugggccugagcagcaucgugggcgugugguaccugcugagaaagcacuggaucgccaacaaccuguucggccuggccuucagccugaacggcguggagcugcugcaccugaacaacgugagcaccggcugcauccugcugggcggccuguucaucuacgacguguucuggguguucggcaccaacgugauggugaccguggccaagagcuucgaggcccccaucaagcugguguucccccaggaccugcuggagaagggccuggaggccaacaacuucgccaugcugggccugggcgacguggugauccccggcaucuucaucgcccugcugcugagauucgacaucagccugaagaagaacacccacaccuacuucuacaccagcuucgccgccuacaucuucggccugggccugaccaucuucaucaugcacaucuucaagcacgcccagcccgcccugcuguaccuggugcccgccugcaucggcuuccccgugcugguggcccuggccaagggcgaggugaccgagauguucagcuacgaggagagcaaccccaaggaccccgccgccgugaccgagagcaaggagggcaccgaggccagcgccagcaagggccuggagaagaaggagaaguaa

SEQ ID NO: 18099 - RNA, 1263 nt, Artificial Sequence
  HMBOX1__Homo_sapiens__NP_001129198
augcugagcagcuuccccguggugcugcuggagaccaugagccacuacaccgacgagcccagauucaccaucgagcagaucgaccugcugcagagacugagaagaaccggcaugaccaagcacgagauccugcacgcccuggagacccuggacagacuggaccaggagcacagcgacaaguucggcagaagaagcagcuacggcggcagcagcuacggcaacagcaccaacaacgugcccgccagcagcagcaccgccaccgccagcacccagacccagcacagcggcaugagccccagccccagcaacagcuacgacaccagcccccagcccugcaccaccaaccagaacggcagagagaacaacgagagacugagcaccagcaacggcaagaugagccccaccagauaccacgccaacagcaugggccagagaagcuacagcuucgaggccagcgaggaggaccuggacguggacgacaagguggaggagcugaugagaagagacagcagcgugaucaaggaggagaucaaggccuuccuggccaacagaagaaucagccaggccgugguggcccaggugaccggcaucagccagagcagaaucagccacuggcugcugcagcagggcagcgaccugagcgagcagaagaagagagccuucuacagaugguaccagcuggagaagaccaaccccggcgccacccugagcaugagacccgcccccauccccaucgaggaccccgaguggagacagacccccccccccgugagcgccaccagcggcaccuucagacugagaagaggcagcagauucaccuggagaaaggagugccuggccgugauggagagcuacuucaacgagaaccaguaccccgacgaggccaagagagaggagaucgccaacgccugcaacgccgugauccagaagcccggcaagaagcugagcgaccuggagagagugaccagccugaagguguacaacugguucgccaacagaagaaaggagaucaagagaagagccaacaucgaggccgccauccuggagagccacggcaucgacgugcagagccccggcggccacagcaacagcgacgacguggacggcaacgacuacagcgagcaggacgacagcaccagccacagcgaccaccaggaccccaucagccuggccguggagauggccgccgugaaccacaccauccuggcccuggccagacagggcgccaacgagaucaagaccgaggcccuggacgacgacuaa

SEQ ID NO: 18100 - RNA, 1086 nt, Artificial Sequence
  HMBS__Homo_sapiens__NP_000181
augagcggcaacggcaacgccgccgccaccgccgaggagaacagccccaagaugagagugaucagagugggcaccagaaagagccagcuggccagaauccagaccgacagcgugguggccacccugaaggccagcuaccccggccugcaguucgagaucaucgccaugagcaccaccggcgacaagauccuggacaccgcccugagcaagaucggcgagaagagccuguucaccaaggagcuggagcacgcccuggagaagaacgagguggaccugguggugcacagccugaaggaccugcccaccgugcugccccccggcuucaccaucggcgccaucugcaagagagagaacccccacgacgccgugguguuccaccccaaguucgugggcaagacccuggagacccugcccgagaagagcguggugggcaccagcagccugagaagagccgcccagcugcagagaaaguucccccaccuggaguucagaagcaucagaggcaaccugaacaccagacugagaaagcuggacgagcagcaggaguucagcgccaucauccuggccaccgccggccugcagagaaugggcuggcacaacagagugggccagauccugcaccccgaggagugcauguacgccgugggccagggcgcccugggcguggaggugagagccaaggaccaggacauccuggaccuggugggcgugcugcacgaccccgagacccugcugagaugcaucgccgagagagccuuccugagacaccuggagggcggcugcagcgugcccguggccgugcacaccgccaugaaggacggccagcuguaccugaccggcggcguguggagccuggacggcagcgacagcauccaggagaccaugcaggccaccauccacgugcccgcccagcacgaggacggccccgaggacgacccccagcuggugggcaucaccgccagaaacauccccagaggcccccagcuggccgcccagaaccugggcaucagccuggccaaccugcugcugagcaagggcgccaagaacauccuggacguggccagacagcugaacgacgcccacuaa

SEQ ID NO: 18101 - RNA, 16908 nt, Artificial Sequence
  HMCN1__Homo_sapiens__NP_114141
augaucagcugggagguggugcacaccguguuccuguucgcccugcuguacagcagccuggcccaggacgccagcccccagagcgagaucagagccgaggagauccccgagggcgccagcacccuggccuucguguucgacgugaccggcagcauguacgacgaccuggugcaggugaucgagggcgccagcaagauccuggagaccagccugaagagacccaagagaccccuguucaacuucgcccuggugcccuuccacgaccccgagaucggccccgugaccaucaccaccgaccccaagaaguuccaguacgagcugagagagcuguacgugcagggcggcggcgacugccccgagaugagcaucggcgccaucaagaucgcccuggagaucagccugcccggcagcuucaucuacguguucaccgacgccagaagcaaggacuacagacugacccacgaggugcugcagcugauccagcagaagcagagccaggugguguucgugcugaccggcgacugcgacgacagaacccacaucggcuacaagguguacgaggagaucgccagcaccagcagcggccagguguuccaccuggacaagaagcaggugaacgaggugcugaaguggguggaggaggccgugcaggccagcaaggugcaccugcugagcaccgaccaccuggagcaggccgugaacaccuggagaauccccuucgaccccagccugaaggaggugaccgugagccugagcggccccagccccaugaucgagaucagaaacccccugggcaagcugaucaagaagggcuucggccugcacgagcugcugaacauccacaacagcgccaagguggugaacgugaaggagcccgaggccggcauguggaccgugaagaccagcagcagcggcagacacagcgugagaaucaccggccugagcaccaucgacuucagagccggcuucagcagaaagcccacccuggacuucaagaagaccgugagcagacccgugcagggcauccccaccuacgugcugcugaacaccagcggcaucagcacccccgccagaaucgaccugcuggagcugcugagcaucagcggcagcagccugaagaccauccccgugaaguacuacccccacagaaagcccuacggcaucuggaacaucagcgacuucgugccccccaacgaggccuucuuccugaaggugaccggcuacgacaaggacgacuaccuguuccagagagugagcagcgugagcuucagcagcaucgugcccgacgcccccaaggugaccaugcccgagaagacccccggcuacuaccugcagcccggccagauccccugcagcguggacagccugcugcccuucacccugagcuucgugagaaacggcgugacccugggcguggaccaguaccugaaggagagcgccagcgugaaccuggacaucgccaaggugacccugagcgacgagggcuucuacgagugcaucgccgugagcagcgccggcaccggcagagcccagaccuucuucgacgugagcgagcccccccccgugauccaggugcccaacaacgugaccgugacccccggcgagagagccgugcugaccugccugaucaucagcgccguggacuacaaccugaccuggcagagaaacgacagagacgugagacuggccgagcccgccagaaucagaacccuggccaaccugagccuggagcugaagagcgugaaguucaacgacgccggcgaguaccacugcauggugagcagcgagggcggcagcagcgccgccagcguguuccugaccgugcaggagccccccaaggugaccgugaugcccaagaaccagagcuucaccggcggcagcgaggugagcaucaugugcagcgccaccggcuaccccaagcccaagaucgccuggaccgugaacgacauguucaucgugggcagccacagauacagaaugaccagcgacggcacccuguucaucaagaacgccgcccccaaggacgccggcaucuacggcugccuggccagcaacagcgccggcaccgacaagcagaacagcacccugagauacaucgaggcccccaagcugaugguggugcagagcgagcugcugguggcccugggcgacaucaccgugauggagugcaagaccagcggcaucccccccccccaggugaagugguucaagggcgaccuggagcugagacccagcaccuuccugaucaucgacccccugcugggccugcugaagauccaggagacccaggaccuggacgccggcgacuacaccugcguggccaucaacgaggccggcagagccaccggcaagaucacccuggacgugggcagcccccccguguucauccaggagcccgccgacgugagcauggagaucggcagcaacgugacccugcccugcuacgugcagggcuaccccgagcccaccaucaaguggagaagacuggacaacaugcccaucuucagcagacccuucagcgugagcagcaucagccagcugagaaccggcgcccuguucauccugaaccugugggccagcgacaagggcaccuacaucugcgaggccgagaaccaguucggcaagauccagagcgagaccaccgugaccgugaccggccugguggccccccugaucggcaucagccccagcguggccaacgugaucgagggccagcagcugacccugcccugcacccugcuggccggcaaccccauccccgagagaagauggaucaagaacagcgccaugcugcugcagaaccccuacaucaccgugagaagcgacggcagccugcacaucgagagagugcagcugcaggacggcggcgaguacaccugcguggccagcaacguggccggcaccaacaacaagaccaccagcgugguggugcacgugcugcccaccauccagcacggccagcagauccugagcaccaucgagggcauccccgugacccugcccugcaaggccagcggcaaccccaagcccagcgugaucuggagcaagaagggcgagcugaucagcaccagcagcgccaaguucagcgccggcgccgacggcagccuguacguggugagccccggcggcgaggagagcggcgaguacgugugcaccgccaccaacaccgccggcuacgccaagagaaaggugcagcugaccguguacgugagacccagaguguucggcgaccagagaggccugagccaggacaagcccguggagaucagcgugcuggccggcgaggaggugacccugcccugcgaggugaagagccugcccccccccaucaucaccugggccaaggagacccagcugaucagccccuucagccccagacacaccuuccugcccagcggcagcaugaagaucaccgagaccagaaccagcgacagcggcauguaccugugcguggccaccaacaucgccggcaacgugacccaggccgugaagcugaacgugcacgugccccccaagauccagagaggccccaagcaccugaaggugcaggugggccagagaguggacauccccugcaacgcccagggcaccccccugcccgugaucaccuggagcaagggcggcagcaccaugcugguggacggcgagcaccacgugagcaaccccgacggcacccugagcaucgaccaggccacccccagcgacgccggcaucuacaccugcguggccaccaacaucgccggcaccgacgagaccgagaucacccugcacgugcaggagccccccaccguggaggaccuggagccccccuacaacaccaccuuccaggagagaguggccaaccagagaaucgaguuccccugccccgccaagggcacccccaagcccaccaucaaguggcugcacaacggcagagagcugaccggcagagagcccggcaucagcauccuggaggacggcacccugcuggugaucgccagcgugacccccuacgacaacggcgaguacaucugcguggccgugaacgaggccggcaccaccgagagaaaguacaaccugaaggugcacgugccccccgugaucaaggacaaggagcaggugaccaacgugagcgugcugcugaaccagcugaccaaccuguucugcgagguggagggcacccccagccccaucaucaugugguacaaggacaacgugcaggugaccgagagcagcaccauccagaccgugaacaacggcaagauccugaagcuguucagagccacccccgaggacgccggcagauacagcugcaaggccaucaacaucgccggcaccagccagaaguacuucaacaucgacgugcuggugccccccaccaucaucggcaccaacuuccccaacgaggugagcguggugcugaacagagacguggcccuggagugccaggugaagggcacccccuuccccgacauccacugguucaaggacggcaagccccuguuccugggcgaccccaacguggagcugcuggacagaggccaggugcugcaccugaagaacgccagaagaaacgacaagggcagauaccagugcaccgugagcaacgccgccggcaagcaggccaaggacaucaagcugaccaucuacaucccccccagcaucaagggcggcaacgugaccaccgacaucagcgugcugaucaacagccugaucaagcuggagugcgagaccagaggccugcccaugcccgccaucaccugguacaaggacggccagcccaucaugagcagcagccaggcccuguacaucgacaagggccaguaccugcacauccccagagcccaggugagcgacagcgccaccuacaccugccacguggccaacguggccggcaccgccgagaagagcuuccacguggacguguacgugccccccaugaucgagggcaaccuggccaccccccugaacaagcagguggugaucgcccacagccugacccuggagugcaaggccgccggcaaccccagccccauccugaccuggcugaaggacggcgugcccgugaaggccaacgacaacaucagaaucgaggccggcggcaagaagcuggagaucaugagcgcccaggagaucgacagaggccaguacaucugcguggccaccagcguggccggcgagaaggagaucaaguacgagguggacgugcuggugccccccgccaucgagggcggcgacgagaccagcuacuucaucgugauggugaacaaccugcuggagcuggacugccacgugaccggcagccccccccccaccaucauguggcugaaggacggccagcugaucgacgagagagacggcuucaagauccugcugaacggcagaaagcuggugaucgcccaggcccaggugagcaacaccggccuguacagaugcauggccgccaacaccgccggcgaccacaagaaggaguucgaggugaccgugcacgugccccccaccaucaagagcagcggccugagcgagagagugguggugaaguacaagcccguggcccugcagugcaucgccaacggcauccccaaccccagcaucaccuggcugaaggacgaccagcccgugaacaccgcccagggcaaccugaagauccagagcagcggcagagugcugcagaucgccaagacccugcuggaggacgccggcagauacaccugcguggccaccaacgccgccggcgagacccagcagcacauccagcugcacgugcacgagccccccagccuggaggacgccggcaagaugcugaacgagaccgugcuggugagcaaccccgugcagcuggagugcaaggccgccggcaaccccgugcccgugaucaccugguacaaggacaacagacugcugagcggcagcaccagcaugaccuuccugaacagaggccagaucaucgacaucgagagcgcccagaucagcgacgccggcaucuacaagugcguggccaucaacagcgccggcgccaccgagcuguucuacagccugcaggugcacguggcccccagcaucagcggcagcaacaacaugguggccgugguggugaacaaccccgugagacuggagugcgaggccagaggcauccccgcccccagccugaccuggcugaaggacggcagccccgugagcagcuucagcaacggccugcaggugcugagcggcggcagaauccuggcccugaccagcgcccagaucagcgacaccggcagauacaccugcguggccgugaacgccgccggcgagaagcagagagacaucgaccugagaguguacgugccccccaacaucaugggcgaggagcagaacgugagcgugcugaucagccaggccguggagcugcugugccagagcgacgccauccccccccccacccugaccuggcugaaggacggccacccccugcugaagaagcccggccugagcaucagcgagaacagaagcgugcugaagaucgaggacgcccaggugcaggacaccggcagauacaccugcgaggccaccaacguggccggcaagaccgagaagaacuacaacgugaacaucugggugccccccaacaucggcggcagcgacgagcugacccagcugaccgugaucgagggcaaccugaucagccugcugugcgagagcagcggcauccccccccccaaccugaucuggaagaagaagggcagccccgugcugaccgacagcaugggcagagugagaauccugagcggcggcagacagcugcagaucagcaucgccgagaagagcgacgccgcccuguacagcugcguggccagcaacguggccggcaccgccaagaaggaguacaaccugcagguguacaucagacccaccaucaccaacagcggcagccaccccaccgagaucaucgugaccagaggcaagagcaucagccuggagugcgaggugcagggcauccccccccccaccgugaccuggaugaaggacggccacccccugaucaaggccaagggcguggagauccuggacgagggccacauccugcagcugaagaacauccacgugagcgacaccggcagauacgugugcguggccgugaacguggccggcaugaccgacaagaaguacgaccugagcgugcacgccccccccagcaucaucggcaaccacagaagccccgagaacaucagcgugguggagaagaacagcgugagccugaccugcgaggccagcggcaucccccugcccagcaucaccugguucaaggacggcuggcccgugagccugagcaacagcgugagaauccugagcggcggcagaaugcugagacugaugcagaccaccauggaggacgccggccaguacaccugcguggugagaaacgccgccggcgaggagagaaagaucuucggccugagcgugcuggugcccccccacaucgugggcgagaacacccuggaggacgugaaggugaaggagaagcagagcgugacccugaccugcgaggugaccggcaaccccgugcccgagaucaccuggcacaaggacggccagccccugcaggaggacgaggcccaccacaucaucagcggcggcagauuccugcagaucaccaacgugcaggugccccacaccggcagauacaccugccuggccagcagccccgccggccacaagagcagaagcuucagccugaacguguucgugagccccaccaucgccggcgugggcagcgacggcaaccccgaggacgugaccgugauccugaacagccccaccagccuggugugcgaggccuacagcuacccccccgccaccaucaccugguucaaggacggcaccccccuggagagcaacagaaacaucagaauccugcccggcggcagaacccugcagauccugaacgcccaggaggacaacgccggcagauacagcugcguggccaccaacgaggccggcgagaugaucaagcacuacgaggugaagguguacaucccccccaucaucaacaagggcgaccuguggggccccggccugagccccaaggaggugaagaucaaggugaacaacacccugacccuggagugcgaggccuacgccauccccagcgccagccugagcugguacaaggacggccagccccugaagagcgacgaccacgugaacaucgccgccaacggccacacccugcagaucaaggaggcccagaucagcgacaccggcagauacaccugcguggccagcaacaucgccggcgaggacgagcuggacuucgacgugaacauccaggugccccccagcuuccagaagcugugggagaucggcaacaugcuggacaccggcagaaacggcgaggccaaggacgugaucaucaacaaccccaucagccuguacugcgagaccaacgccgcccccccccccacccugaccugguacaaggacggccacccccugaccagcagcgacaaggugcugauccugcccggcggcagagugcugcagauccccagagccaagguggaggacgccggcagauacaccugcguggccgugaacgaggccggcgaggacagccugcaguacgacgugagagugcuggugccccccaucaucaagggcgccaacagcgaccugcccgaggaggugaccgugcuggugaacaagagcgcccugaucgagugccugagcagcggcagccccgcccccagaaacagcuggcagaaggacggccagccccugcuggaggacgaccaccacaaguuccugagcaacggcagaauccugcagauccugaacacccagaucaccgacaucggcagauacgugugcguggccgagaacaccgccggcagcgccaagaaguacuucaaccugaacgugcacgugccccccagcgugaucggccccaagagcgagaaccugaccgugguggugaacaacuucaucagccugaccugcgaggugagcggcuuccccccccccgaccugagcuggcugaagaacgagcagcccaucaagcugaacaccaacacccugaucgugcccggcggcagaacccugcagaucaucagagccaaggugagcgacggcggcgaguacaccugcaucgccaucaaccaggccggcgagagcaagaagaaguucagccugaccguguacgugccccccagcaucaaggaccacgacagcgagagccugagcguggugaacgugagagagggcaccagcgugagccuggagugcgagagcaacgccgugcccccccccgugaucaccugguacaagaacggcagaaugaucaccgagagcacccacguggagauccuggccgacggccagaugcugcacaucaagaaggccgaggugagcgacaccggccaguacgugugcagagccaucaacguggccggcagagacgacaagaacuuccaccugaacguguacgugccccccagcaucgagggccccgagagagaggugaucguggagaccaucagcaaccccgugacccugaccugcgacgccaccggcauccccccccccaccaucgccuggcugaagaaccacaagagaaucgagaacagcgacagccuggaggugagaauccugagcggcggcagcaagcugcagaucgccagaagccagcacagcgacagcggcaacuacaccugcaucgccagcaacauggagggcaaggcccagaaguacuacuuccugagcauccaggugccccccagcguggccggcgccgagauccccagcgacgugagcgugcugcugggcgagaacguggagcuggugugcaacgccaacggcauccccaccccccugauccaguggcugaaggacggcaagcccaucgccagcggcgagaccgagagaaucagagugagcgccaacggcagcacccugaacaucuacggcgcccugaccagcgacaccggcaaguacaccugcguggccaccaaccccgccggcgaggaggacagaaucuucaaccugaacguguacgugacccccaccaucagaggcaacaaggacgaggccgagaagcugaugacccugguggacaccagcaucaacaucgagugcagagccaccggcaccccccccccccagaucaacuggcugaagaacggccugccccugccccugagcagccacaucagacugcuggccgccggccaggugaucagaaucgugagagcccaggugagcgacguggccguguacaccugcguggccagcaacagagccggcguggacaacaagcacuacaaccugcagguguucgccccccccaacauggacaacagcaugggcaccgaggagaucaccgugcugaagggcagcagcaccagcauggccugcaucaccgacggcacccccgcccccagcauggccuggcugagagacggccagccccugggccuggacgcccaccugaccgugagcacccacggcauggugcugcagcugcugaaggccgagaccgaggacagcggcaaguacaccugcaucgccagcaacgaggccggcgaggugagcaagcacuucauccugaaggugcuggagcccccccacaucaacggcagcgaggagcacgaggagaucagcgugaucgugaacaacccccuggagcugaccugcaucgccagcggcauccccgcccccaagaugaccuggaugaaggacggcagaccccugccccagaccgaccaggugcagacccugggcggcggcgaggugcugagaaucagcaccgcccagguggaggacaccggcagauacaccugccuggccagcagccccgccggcgacgacgacaaggaguaccuggugagagugcacgugccccccaacaucgccggcaccgacgagcccagagacaucaccgugcugagaaacagacaggugacccuggagugcaagagcgacgccgugcccccccccgugaucaccuggcugagaaacggcgagagacugcaggccacccccagagugagaauccugagcggcggcagauaccugcagaucaacaacgccgaccugggcgacaccgccaacuacaccugcguggccagcaacaucgccggcaagaccaccagagaguucauccugaccgugaacgugccccccaacaucaagggcggcccccagagccuggugauccugcugaacaagagcaccgugcuggagugcaucgccgagggcgugcccacccccagaaucaccuggagaaaggacggcgccgugcuggccggcaaccacgccagauacagcauccuggagaacggcuuccugcacauccagagcgcccacgugaccgacaccggcagauaccugugcauggccaccaacgccgccggcaccgacagaagaagaaucgaccugcaggugcacgugccccccagcaucgcccccggccccaccaacaugaccgugaucgugaacgugcagaccacccuggccugcgaggccaccggcauccccaagcccagcaucaacuggagaaagaacggccaccugcugaacguggaccagaaccagaacagcuacagacugcugagcagcggcagccuggugaucaucagccccagcguggacgacaccgccaccuacgagugcaccgugaccaacggcgccggcgacgacaagagaaccguggaccugaccgugcaggugccccccagcaucgccgacgagcccaccgacuuccuggugaccaagcacgcccccgccgugaucaccugcaccgccagcggcgugcccuuccccagcauccacuggaccaagaacggcaucagacugcugcccagaggcgacggcuacagaauccugagcagcggcgccaucgagauccuggccacccagcugaaccacgccggcagauacaccugcguggccagaaacgccgccggcagcgcccacagacacgugacccugcacgugcacgagccccccgugauccagccccagcccagcgagcugcacgugauccugaacaaccccauccugcugcccugcgaggccaccggcacccccagccccuucaucaccuggcagaaggagggcaucaacgugaacaccagcggcagaaaccacgccgugcugcccagcggcggccugcagaucagcagagccgugagagaggacgccggcaccuacaugugcguggcccagaaccccgccggcaccgcccugggcaagaucaagcugaacgugcaggugccccccgugaucagcccccaccugaaggaguacgugaucgccguggacaagcccaucacccugagcugcgaggccgacggccugcccccccccgacaucaccuggcacaaggacggcagagccaucguggagagcaucagacagagagugcugagcagcggcagccugcagaucgccuucgugcagcccggcgacgccggccacuacaccugcauggccgccaacguggccggcagcagcagcaccagcaccaagcugaccgugcacgugccccccagaaucagaagcaccgagggccacuacaccgugaacgagaacagccaggccauccugcccugcguggccgacggcauccccacccccgccaucaacuggaagaaggacaacgugcugcuggccaaccugcugggcaaguacaccgccgagcccuacggcgagcugauccuggagaacguggugcuggaggacagcggcuucuacaccugcguggccaacaacgccgccggcgaggacacccacaccgugagccugaccgugcacgugcugcccaccuucaccgagcugcccggcgacgugagccugaacaagggcgagcagcugagacugagcugcaaggccaccggcaucccccugcccaagcugaccuggaccuucaacaacaacaucauccccgcccacuucgacagcgugaacggccacagcgagcuggugaucgagagagugagcaaggaggacagcggcaccuacgugugcaccgccgagaacagcgugggcuucgugaaggccaucggcuucguguacgugaaggagccccccguguucaagggcgacuaccccagcaacuggaucgagccccugggcggcaacgccauccugaacugcgaggugaagggcgaccccacccccaccauccaguggaacagaaagggcguggacaucgagaucagccacagaaucagacagcugggcaacggcagccuggccaucuacggcaccgugaacgaggacgccggcgacuacaccugcguggccaccaacgaggccggcgugguggagagaagcaugagccugacccugcagagcccccccaucaucacccuggagcccguggagaccgugaucaacgccggcggcaagaucauccugaacugccaggccaccggcgagccccagcccaccaucaccuggagcagacagggccacagcaucagcugggacgacagagugaacgugcugagcaacaacagccuguacaucgccgacgcccagaaggaggacaccagcgaguucgagugcguggccagaaaccugaugggcagcgugcuggugagagugcccgugaucgugcaggugcacggcggcuucagccaguggagcgccuggagagccugcagcgugaccugcggcaagggcauccagaagagaagcagacugugcaaccagccccugcccgccaacggcggcaagcccugccagggcagcgaccuggagaugagaaacugccagaacaagcccugccccguggacggcagcuggagcgaguggagccugugggaggagugcaccagaagcugcggcagaggcaaccagaccagaaccagaaccugcaacaaccccagcgugcagcacggcggcagacccugcgagggcaacgccguggagaucaucaugugcaacaucagacccugccccgugcacggcgccuggagcgccuggcagcccuggggcaccugcagcgagagcugcggcaagggcacccagaccagagccagacugugcaacaaccccccccccgccuucggcggcagcuacugcgacggcgccgagacccagaugcaggugugcaacgagagaaacugccccauccacggcaagugggccaccugggccagcuggagcgccugcagcgugagcugcggcggcggcgccagacagagaaccagaggcugcagcgaccccgugccccaguacggcggcagaaagugcgagggcagcgacgugcagagcgacuucugcaacagcgaccccugccccacccacggcaacuggagccccuggagcggcuggggcaccugcagcagaaccugcaacggcggccagaugagaagauacagaaccugcgacaaccccccccccagcaacggcggcagagccugcggcggccccgacagccagauccagagaugcaacaccgacaugugccccguggacggcagcuggggcagcuggcacagcuggagccagugcagcgccagcugcggcggcggcgagaagaccagaaagagacugugcgaccaccccgugcccgugaagggcggcagacccugccccggcgacaccacccaggugaccagaugcaacgugcaggccugccccggcggcccccagagagccagaggcagcgugaucggcaacaucaacgacguggaguucggcaucgccuuccugaacgccaccaucaccgacagccccaacagcgacaccagaaucaucagagccaagaucaccaacgugcccagaagccugggcagcgccaugagaaagaucgugagcauccugaaccccaucuacuggaccaccgccaaggagaucggcgaggccgugaacggcuucacccugaccaacgccguguucaagagagagacccagguggaguucgccaccggcgagauccugcagaugagccacaucgccagaggccuggacagcgacggcagccugcugcuggacaucguggugagcggcuacgugcugcagcugcagagccccgccgaggugaccgugaaggacuacaccgaggacuacauccagaccggccccggccagcuguacgccuacagcaccagacuguucaccaucgacggcaucagcauccccuacaccuggaaccacaccguguucuacgaccaggcccagggcagaaugcccuuccugguggagacccugcacgccagcagcguggagagcgacuacaaccagaucgaggagacccugggcuucaagauccacgccagcaucagcaagggcgacagaagcaaccagugccccagcggcuucacccuggacagcgugggccccuucugcgccgacgaggacgagugcgccgccggcaaccccugcagccacagcugccacaacgccaugggcaccuacuacugcagcugccccaagggccugaccaucgccgccgacggcagaaccugccaggacaucgacgagugcgcccugggcagacacaccugccacgccggccaggacugcgacaacaccaucggcagcuacagaugcguggugagaugcggcagcggcuucagaagaaccagcgacggccugagcugccaggacaucaacgagugccaggagagcagccccugccaccagagaugcuucaacgccaucggcagcuuccacugcggcugcgagcccggcuaccagcugaagggcagaaagugcauggacgugaacgagugcagacagaacgugugcagacccgaccagcacugcaagaacaccagaggcggcuacaagugcaucgaccugugccccaacggcaugaccaaggccgagaacggcaccugcaucgacaucgacgagugcaaggacggcacccaccagugcagauacaaccagaucugcgagaacaccagaggcagcuacagaugcgugugccccagaggcuacagaagccagggcgugggcagacccugcauggacaucaacgagugcgagcaggugcccaagcccugcgcccaccagugcagcaacacccccggcagcuucaagugcaucugcccccccggccagcaccugcugggcgacggcaagagcugcgccggccuggagagacugcccaacuacggcacccaguacagcagcuacaaccuggccagauucagccccgugagaaacaacuaccagccccagcagcacuacagacaguacagccaccuguacagcagcuacagcgaguacagaaacagcagaaccagccugagcagaaccagaagaaccaucagaaagaccugccccgagggcagcgaggccagccacgacaccugcguggacaucgacgagugcgagaacaccgacgccugccagcacgagugcaagaacaccuucggcagcuaccagugcaucugcccccccggcuaccagcugacccacaacggcaagaccugccaggacaucgacgagugccuggagcagaacgugcacugcggccccaacagaaugugcuucaacaugagaggcagcuaccagugcaucgacacccccugcccccccaacuaccagagagaccccgugagcggcuucugccugaagaacugcccccccaacgaccuggagugcgcccugagccccuacgcccuggaguacaagcuggugagccugcccuucggcaucgccaccaaccaggaccugaucagacugguggccuacacccaggacggcgugaugcaccccagaaccaccuuccugaugguggacgaggagcagaccgugcccuucgcccugagagacgagaaccugaagggcgugguguacaccaccagaccccugagagaggccgagaccuacagaaugagagugagagccagcagcuacagcgccaacggcaccaucgaguaccagaccaccuucaucguguacaucgccgugagcgccuaccccuacuaa

SEQ ID NO: 18102 - RNA, 1044 nt, Artificial Sequence
  HMG20A__Homo_sapiens__NP_001291433
auggagaaccugaugaccagcagcacccugcccccccuguucgccgacgaggacggcagcaaggagagcaacgaccuggccaccaccggccugaaccaccccgaggugcccuacagcagcggcgccaccagcagcaccaacaaccccgaguucguggaggaccugagccagggccagcugcugcagagcgagagcagcaacgccgccgagggcaacgagcagagacacgaggacgagcagagaagcaagagaggcggcuggagcaagggcagaaagagaaagaagccccugagagacagcaacgcccccaagagcccccugaccggcuacgugagauucaugaacgagagaagagagcagcugagagccaagagacccgaggugcccuuccccgagaucaccagaaugcugggcaacgaguggagcaagcugccccccgaggagaagcagagauaccuggacgaggccgacagagacaaggagagauacaugaaggagcuggagcaguaccagaagaccgaggccuacaagguguucagcagaaagacccaggacagacagaagggcaagagccacagacaggacgccgccagacaggccacccacgaccacgagaaggagaccgaggugaaggagagaagcguguucgacauccccaucuucaccgaggaguuccugaaccacagcaaggccagagaggccgagcugagacagcugagaaagagcaacauggaguucgaggagagaaacgccgcccugcagaagcacguggagagcaugagaaccgccguggagaagcuggagguggacgugauccaggagagaagcagaaacaccgugcugcagcagcaccuggagacccugagacaggugcugaccagcagcuucgccagcaugccccugcccggcagcggcgagacccccaccguggacaccaucgacagcuacaugaacagacugcacagcaucauccuggccaacccccaggacaacgagaacuucaucgccaccgugagagagguggugaacagacuggacagauaa

SEQ ID NO: 18103 - RNA, 954 nt, Artificial Sequence
  HMG20B__Homo_sapiens__NP_006330
augagccacggccccaagcagcccggcgccgccgccgcccccgccggcggcaaggcccccggccagcacggcggcuucguggugaccgugaagcaggagagaggcgagggccccagagccggcgagaagggcagccacgaggaggagcccgugaagaagagaggcuggcccaagggcaagaagagaaagaagauccugcccaacggccccaaggcccccgugaccggcuacgugagauuccugaacgagagaagagagcagaucagaaccagacaccccgaccugcccuuccccgagaucaccaagaugcugggcgccgaguggagcaagcugcagcccaccgagaagcagagauaccuggacgaggccgagagagagaagcagcaguacaugaaggagcugagagccuaccagcagagcgaggccuacaagaugugcaccgagaagauccaggagaagaagaucaagaaggaggacagcagcagcggccugaugaacacccugcugaacggccacaagggcggcgacugcgacggcuucagcaccuucgacgugcccaucuucaccgaggaguuccuggaccagaacaaggccagagaggccgagcugagaagacugagaaagaugaacguggccuucgaggagcagaacgccgugcugcagagacacacccagagcaugagcagcgccagagagagacuggagcaggagcuggcccuggaggagagaagaacccuggcccugcagcagcagcugcaggccgugagacaggcccugaccgccagcuucgccagccugcccgugcccggcaccggcgagacccccacccugggcacccuggacuucuacauggccagacugcacggcgccaucgagagagaccccgcccagcacgagaagcugaucgugagaaucaaggagauccuggcccagguggccagcgagcaccuguaa

SEQ ID NO: 18104 - RNA, 291 nt, Artificial Sequence
  HMGA1__Homo_sapiens__NP_665912
augagcgagagcagcagcaagagcagccagccccuggccagcaagcaggagaaggacggcaccgagaagagaggcagaggcagacccagaaagcagccccccaaggagcccagcgaggugcccacccccaagagacccagaggcagacccaagggcagcaagaacaagggcgccgccaagaccagaaagaccaccaccacccccggcagaaagcccagaggcagacccaagaagcuggagaaggaggaggaggagggcaucagccaggagagcagcgaggaggagcaguaa

SEQ ID NO: 18105 - RNA, 357 nt, Artificial Sequence
  HMGA2__Homo_sapiens__NP_001287847
augagcgccagaggcgagggcgccggccagcccagcaccagcgcccagggccagcccgccgcccccgccccccagaagagaggcagaggcagacccagaaagcagcagcaggagcccaccggcgagcccagccccaagagacccagaggcagacccaagggcagcaagaacaagagccccagcaaggccgcccagaagaaggccgaggccaccggcgagaagagacccagaggcagacccagaaaguggccccagcagguggugcagaagaagcccgcccaggugaacguggcccugcccggcaaggaccaccccggcaaccugaucuaccugcuguucagcaagaacgccaccuaa

SEQ ID NO: 18106 - RNA, 477 nt, Artificial Sequence
  HMGB1__Homo_sapiens__XP_005266425
augggcaagggcgaccccaagaagcccagaggcaagaugagcagcuacgccuucuucgugcagaccugcagagaggagcacaagaagaagcaccccgacgccagcgugaacuucagcgaguucagcaagaagugcagcgagagauggaagaccaugagcgccaaggagaagggcaaguucgaggacauggccaaggccgacaaggccagauacgagagagagaugaagaccuacaucccccccaagggcgagaccaagaagaaguucaaggaccccaacgcccccaagagaccccccagcgccuucuuccuguucugcagcgaguacagacccaagaucaagggcgagcaccccggccugagcaucggcgacguggccaagaagcugggcgagauguggaacaacaccgccgccgacgacaagcagcccuacgagaagaaggccgccaagcugaaggagaaguacgagaaguucuaa

SEQ ID NO: 18107 - RNA, 630 nt, Artificial Sequence
  HMGB2__Homo_sapiens__NP_001124161
augggcaagggcgaccccaacaagcccagaggcaagaugagcagcuacgccuucuucgugcagaccugcagagaggagcacaagaagaagcaccccgacagcagcgugaacuucgccgaguucagcaagaagugcagcgagagauggaagaccaugagcgccaaggagaagagcaaguucgaggacauggccaagagcgacaaggccagauacgacagagagaugaagaacuacgugccccccaagggcgacaagaagggcaagaagaaggaccccaacgcccccaagagaccccccagcgccuucuuccuguucugcagcgagcacagacccaagaucaagagcgagcaccccggccugagcaucggcgacaccgccaagaagcugggcgagauguggagcgagcagagcgccaaggacaagcagcccuacgagcagaaggccgccaagcugaaggagaaguacgagaaggacaucgccgccuacagagccaagggcaagagcgaggccggcaagaagggccccggcagacccaccggcagcaagaagaagaacgagcccgaggacgaggaggaggaggaggaggaggaggacgaggacgaggaggaggaggacgaggacgaggaguaa

SEQ ID NO: 18108 - RNA, 603 nt, Artificial Sequence
  HMGB3__Homo_sapiens__NP_001288157
auggccaagggcgaccccaagaagcccaagggcaagaugagcgccuacgccuucuucgugcagaccugcagagaggagcacaagaagaagaaccccgaggugcccgugaacuucgccgaguucagcaagaagugcagcgagagauggaagaccaugagcggcaaggagaagagcaaguucgacgagauggccaaggccgacaaggugagauacgacagagagaugaaggacuacggccccgccaagggcggcaagaagaagaaggaccccaacgcccccaagagaccccccagcggcuucuuccuguucugcagcgaguucagacccaagaucaagagcaccaaccccggcaucagcaucggcgacguggccaagaagcugggcgagauguggaacaaccugaacgacagcgagaagcagcccuacaucaccaaggccgccaagcugaaggagaaguacgagaaggacguggccgacuacaagagcaagggcaaguucgacggcgccaagggccccgccaagguggccagaaagaagguggaggaggaggacgaggaggaggaggaggaggaggaggaggaggaggaggaggaggacgaguaa

SEQ ID NO: 18109 - RNA, 2667 nt, Artificial Sequence
  HMGCR__Homo_sapiens__NP_000850
augcugagcagacuguucagaaugcacggccuguucguggccagccaccccugggaggugaucgugggcaccgugacccugaccaucugcaugaugagcaugaacauguucaccggcaacaacaagaucugcggcuggaacuacgagugccccaaguucgaggaggacgugcugagcagcgacaucaucauccugaccaucaccagaugcaucgccauccuguacaucuacuuccaguuccagaaccugagacagcugggcagcaaguacauccugggcaucgccggccuguucaccaucuucagcagcuucguguucagcaccguggugauccacuuccuggacaaggagcugaccggccugaacgaggcccugcccuucuuccugcugcugaucgaccugagcagagccagcacccuggccaaguucgcccugagcagcaacagccaggacgaggugagagagaacaucgccagaggcauggccauccugggccccaccuucacccuggacgcccugguggagugccuggugaucggcgugggcaccaugagcggcgugagacagcuggagaucaugugcugcuucggcugcaugagcgugcuggccaacuacuucguguucaugaccuucuuccccgccugcgugagccuggugcuggagcugagcagagagagcagagagggcagacccaucuggcagcugagccacuucgccagagugcuggaggaggaggagaacaagcccaaccccgugacccagagagugaagaugaucaugagccugggccuggugcuggugcacgcccacagcagauggaucgccgaccccagcccccagaacagcaccgccgacaccagcaaggugagccugggccuggacgagaacgugagcaagagaaucgagcccagcgugagccuguggcaguucuaccugagcaagaugaucagcauggacaucgagcaggugaucacccugagccuggcccugcugcuggccgugaaguacaucuucuucgagcagaccgagaccgagagcacccugagccugaagaaccccaucaccagccccguggugacccagaagaaggugcccgacaacugcugcagaagagagcccaugcuggugagaaacaaccagaagugcgacagcguggaggaggagaccggcaucaacagagagagaaagguggaggugaucaagccccugguggccgagaccgacacccccaacagagccaccuucguggugggcaacagcagccugcuggacaccagcagcgugcuggugacccaggagcccgagaucgagcugcccagagagcccagacccaacgaggagugccugcagauccugggcaacgccgagaagggcgccaaguuccugagcgacgccgagaucauccagcuggugaacgccaagcacauccccgccuacaagcuggagacccugauggagacccacgagagaggcgugagcaucagaagacagcugcugagcaagaagcugagcgagcccagcagccugcaguaccugcccuacagagacuacaacuacagccuggugaugggcgccugcugcgagaacgugaucggcuacaugcccauccccgugggcguggccggcccccugugccuggacgagaaggaguuccaggugcccauggccaccaccgagggcugccugguggccagcaccaacagaggcugcagagccaucggccugggcggcggcgccagcagcagagugcuggccgacggcaugaccagaggccccguggugagacugcccagagccugcgacagcgccgaggugaaggccuggcuggagaccagcgagggcuucgccgugaucaaggaggccuucgacagcaccagcagauucgccagacugcagaagcugcacaccagcaucgccggcagaaaccuguacaucagauuccagagcagaagcggcgacgccaugggcaugaacaugaucagcaagggcaccgagaaggcccugagcaagcugcacgaguacuuccccgagaugcagauccuggccgugagcggcaacuacugcaccgacaagaagcccgccgccaucaacuggaucgagggcagaggcaagagcguggugugcgaggccgugauccccgccaagguggugagagaggugcugaagaccaccaccgaggccaugaucgaggugaacaucaacaagaaccuggugggcagcgccauggccggcagcaucggcggcuacaacgcccacgccgccaacaucgugaccgccaucuacaucgccugcggccaggacgccgcccagaacgugggcagcagcaacugcaucacccugauggaggccagcggccccaccaacgaggaccuguacaucagcugcaccaugcccagcaucgagaucggcaccgugggcggcggcaccaaccugcugccccagcaggccugccugcagaugcugggcgugcagggcgccugcaaggacaaccccggcgagaacgccagacagcuggccagaaucgugugcggcaccgugauggccggcgagcugagccugauggccgcccuggccgccggccaccuggugaagagccacaugauccacaacagaagcaagaucaaccugcaggaccugcagggcgccugcaccaagaagaccgccuaa

SEQ ID NO: 18110 - RNA, 1563 nt, Artificial Sequence
  HMGCS1__Homo_sapiens__NP_002121
augcccggcagccugccccugaacgccgaggccugcuggcccaaggacgugggcaucguggcccuggagaucuacuuccccagccaguacguggaccaggccgagcuggagaaguacgacggcguggacgccggcaaguacaccaucggccugggccaggccaagaugggcuucugcaccgacagagaggacaucaacagccugugcaugaccguggugcagaaccugauggagagaaacaaccugagcuacgacugcaucggcagacuggaggugggcaccgagaccaucaucgacaagagcaagagcgugaagaccaaccugaugcagcuguucgaggagagcggcaacaccgacaucgagggcaucgacaccaccaacgccugcuacggcggcaccgccgccguguucaacgccgugaacuggaucgagagcagcagcugggacggcagauacgcccuggugguggccggcgacaucgccguguacgccaccggcaacgccagacccaccggcggcgugggcgccguggcccugcugaucggccccaacgccccccugaucuucgagagaggccugagaggcacccacaugcagcacgccuacgacuucuacaagcccgacaugcugagcgaguaccccaucguggacggcaagcugagcauccagugcuaccugagcgcccuggacagaugcuacagcguguacugcaagaagauccacgcccaguggcagaaggagggcaacgacaaggacuucacccugaacgacuucggcuucaugaucuuccacagccccuacugcaagcuggugcagaagagccuggccagaaugcugcugaacgacuuccugaacgaccagaacagagacaagaacagcaucuacagcggccuggaggccuucggcgacgugaagcuggaggacaccuacuucgacagagacguggagaaggccuucaugaaggccagcagcgagcuguucagccagaagaccaaggccagccugcuggugagcaaccagaacggcaacauguacaccagcagcguguacggcagccuggccagcgugcuggcccaguacagcccccagcagcuggccggcaagagaaucggcguguucagcuacggcagcggccuggccgccacccuguacagccugaaggugacccaggacgccacccccggcagcgcccuggacaagaucaccgccagccugugcgaccugaagagcagacuggacagcagaaccggcguggcccccgacguguucgccgagaacaugaagcugagagaggacacccaccaccuggugaacuacaucccccagggcagcaucgacagccuguucgagggcaccugguaccuggugagaguggacgagaagcacagaagaaccuacgccagaagacccacccccaacgacgacacccuggacgagggcgugggccuggugcacagcaacaucgccaccgagcacauccccagccccgccaagaaggugcccagacugcccgccaccgccgccgagcccgaggccgccgugaucagcaacggcgagcacuaa

SEQ ID NO: 18111 - RNA, 303 nt, Artificial Sequence
  HMGN1__Homo_sapiens__NP_004956
augcccaagagaaaggugagcagcgccgagggcgccgccaaggaggagcccaagagaagaagcgccagacugagcgccaagccccccgccaagguggaggccaagcccaagaaggccgccgccaaggacaagagcagcgacaagaaggugcagaccaagggcaagagaggcgccaagggcaagcaggccgagguggccaaccaggagaccaaggaggaccugcccgccgagaacggcgagaccaagaccgaggagagccccgccagcgacgaggccggcgagaaggaggccaagagcgacuaa

SEQ ID NO: 18112 - RNA, 273 nt, Artificial Sequence
  HMGN4__Homo_sapiens__NP_006344
augcccaagagaaaggccaagggcgacgccaagggcgacaaggccaaggugaaggacgagccccagagaagaagcgccagacugagcgccaagcccgccccccccaagcccgagcccagacccaagaaggccagcgccaagaagggcgagaagcugcccaagggcagaaagggcaaggccgacgccggcaaggacggcaacaaccccgccaagaacagagacgccagcacccugcagagccagaaggccgagggcaccggcgacgccaaguaa

SEQ ID NO: 18113 - RNA, 849 nt, Artificial Sequence
  HMGN5__Homo_sapiens__NP_110390
augcccaagagaaaggccgccggccagggcgacaugagacaggagcccaagagaagaagcgccagacugagcgccaugcuggugcccgugacccccgaggugaagcccaagagaaccagcagcagcagaaagaugaagaccaagagcgacaugauggaggagaacaucgacaccagcgcccaggccguggccgagaccaagcaggaggccgugguggaggaggacuacaacgagaacgccaagaacggcgaggccaagaucaccgaggcccccgccagcgagaaggagaucguggaggugaaggaggagaacaucgaggacgccaccgagaagggcggcgagaagaaggaggccguggccgccgaggugaagaacgaggaggaggaccagaaggaggacgaggaggaccagaacgaggagaagggcgaggccggcaaggaggacaaggacgagaagggcgaggaggacggcaaggaggacaagaacggcaacgagaagggcgaggacgccaaggagaaggaggacggcaagaagggcgaggacggcaagggcaacggcgaggacggcaaggagaagggcgaggacgagaaggaggaggaggacagaaaggagaccggcgacggcaaggagaacgaggacggcaaggagaagggcgacaagaaggagggcaaggacgugaaggugaaggaggacgagaaggagagagaggacggcaaggaggacgagggcggcaacgaggaggaggccggcaaggagaaggaggaccugaaggaggaggaggagggcaaggaggaggacgagaucaaggaggacgacggcaagaaggaggagccccagagcaucguguaa

SEQ ID NO: 18114 - RNA, 3879 nt, Artificial Sequence
  HMGXB3__Homo_sapiens__NP_055798
auggacgccagcuacgacggcaccgaggugaccguggugauggaggagaucgaggaggccuacugcuacaccagccccggcccccccaagaagaagaagaaguacaagauccacggcgagaagaccaagaagcccagaagcgccuaccugcuguacuacuacgacaucuaccugaaggugcagcaggagcugccccaccugccccagagcgagaucaacaagaagaucagcgagagcuggagacugcugagcguggccgagagaagcuacuaccuggagaaggccaagcuggagaaggagggccuggaccccaacagcaagcugagcgcccugaccgccguggugcccgacauccccggcuucagaaagauccugcccagaagcgacuacaucaucauccccaagagcagccugcaggaggacagaagcugcccccagcuggagcugugcguggcccagaaccagaugagccccaagggccccccccuggugagcaacaccgcccccgagaccgugcccagccacgccggcauggccgagcagugccuggccguggaggcccuggccgaggaggugggcgcccugacccagagcggcgccgugcaggagaucgccaccagcgagauccugagccaggacgugcugcuggaggacgccagccuggaggugggcgagagccaccagcccuaccagaccagccuggugaucgaggagacccuggugaacggcagccccgaccugcccaccggcagccuggccgugccccacccccaggugggcgagagcgugagcguggugaccgugaugagagacagcagcgagagcagcagcagcgcccccgccacccaguucaucaugcugccccugcccgccuacagcgugguggagaaccccaccagcaucaagcugaccaccaccuacaccagaagaggccacggcaccugcaccagccccggcugcagcuucaccuacgugaccagacacaagccccccaagugccccaccugcggcaacuuccugggcggcaaguggauccccaaggagaagcccgccaaggugaagguggagcuggccagcggcgugagcagcaagggcagcguggugaagagaaaccagcagcccgugaccaccgagcagaacagcagcaaggagaacgccagcaagcugacccuggagaacagcgaggccgugagccagcugcugaacguggccccccccagagaggugggcgaggagagcgagugggaggaggugaucaucagcgacgcccacgugcuggugaaggaggcccccggcaacugcggcaccgccgugaccaagacccccguggugaagagcggcgugcagcccgaggugacccugggcaccaccgacaacgacagccccggcgccgacgugcccacccccagcgagggcaccagcaccagcagcccccugcccgcccccaagaagcccaccggcguggaccugcugacccccggcagcagagcccccgagcugaagggcagagccagaggcaagcccagccugcuggccgccgccagacccaugagagccauccugcccgcccccgugaacgugggcagaggcagcagcaugggccugcccagagccagacaggccuucagccugagcgacaagacccccagcgugagaaccugcggccugaagcccagcacccugaagcagcugggccagcccauccagcagcccagcggccccggcgaggugaagcugcccagcggccccagcaacagaaccagccaggugaaggugguggaggugaagcccgacauguucccccccuacaaguacagcugcaccgugacccuggaccugggccuggccaccagcagaggcagaggcaagugcaagaaccccagcugcagcuacguguacaccaacagacacaagcccagaaucugccccagcugcggcgugaaccuggccaaggacagaaccgagaagaccaccaaggccaucgaggugagcagcccccugcccgacgugcugaacgccaccgagccccugagcaccgcccagagagagauccagagacagagcacccugcagcugcugagaaaggugcugcagauccccgagaacgagagcgagcuggccgagguguucgcccugauccacgagcugaacagcagcagacugauccugagcaacgugagcgaggagaccgugaccaucgagcagaccagcuggagcaacuacuacgagagccccagcacccagugccugcugugcagcagcccccuguucaagggcggccagaacagccuggccggcccccaggagugcuggcugcugaccgccagcagacugcagaccgugaccgcccaggugaagaugugccugaacccccacugccuggcccugcacagcuucaucgacaucuacaccggccuguucaacgugggcaacaagcugcuggugagccuggaccugcuguucgccaucagaaaccagaucaagcugggcgaggaccccagagugagcaucaacguggugcugaagagcgugcaggagcagaccgagaagacccugaccagcgaggagcugagccagcugcaggagcugcugugcaacggcuacugggccuucgagugccugaccgugagagacuacaacgacaugaucugcggcaucugcggcguggcccccaagguggagauggcccagagaagcgaggagaacgugcuggcccugaagagcguggaguucaccuggcccgaguuccugggcagcaacgaggugaacguggaggacuucugggccaccauggagaccgaggugaucgagcagguggccuuccccgccagcauccccaucaccaaguucgacgccagcgugaucgcccccuucuuccccccccugaugagaggcgccgugguggugaacaccgagaaggacaagaaccuggacgugcagcccgugcccggcagcggcagcgcccuggugagacugcugcaggagggcaccugcaagcuggacgagaucggcagcuacagcgaggagaagcugcagcaccugcugagacagugcggcauccccuucggcgccgaggacagcaaggaccagcugugcuucagccugcuggcccuguacgagagcgugcagaacggcgccagagccaucagaccccccagacacuucaccggcggcaagaucuacaaggugugcccccaccagguggugugcggcagcaaguaccuggugagaggcgagagcgccagagaccacguggaccugcuggccagcagcagacacuggccccccguguacgugguggacauggccaccagcguggcccugugcgccgaccugugcuaccccgagcugaccaaccagauguggggcagaaaccagggcugcuucagcagccccaccgagccccccgugagcgugagcugccccgagcugcuggaccagcacuacaccguggacaugaccgagaccgagcacagcauccagcaccccgugaccaagaccgccaccagaagaaucgugcacgccggccugcagcccaaccccggcgaccccagcgccggccaccacagccuggcccugugccccgagcuggcccccuacgccaccauccuggccagcaucguggacagcaagcccaacggcgugagacagagacccaucgccuucgacaacgccacccacuacuaccuguacaacagacugauggacuuccugaccagcagagagaucgugaacagacagauccacgacaucgugcagagcugccagcccggcgagguggugaucagagacacccuguacagacugggcguggcccagaucaagaccgagaccgaggaggagggcgaggaggaggagguggccgccguggccgaguaa

SEQ ID NO: 18115 - RNA, 1806 nt, Artificial Sequence
  HMGXB4__Homo_sapiens__NP_001003681
auggccuacgacgacagcgugaagaaggaggacugcuucgacggcgaccacaccuucgaggacaucggccuggccgccggcagaagccagagagagaagaagagaagcuacaaggacuuccugagagaggaggaggagaucgccgcccaggugagaaacagcagcaagaagaagcugaaggacagcgagcuguacuuccugggcaccgacacccacaagaagaagagaaagcacagcagcgacgacuacuacuacggcgacaucagcagccuggagagcagccagaagaagaagaagaagagcagcccccagagcaccgacaccgccauggaccugcugaaggccaucaccagcccccuggccgccggcagcaagcccagcaagaagaccggcgagaagagcagcggcagcagcagccacagcgagagcaagaaggagcaccacagaaagaaggugagcggcagcagcggcgagcugccccuggaggacggcggcagccacaagagcaagaagaugaagccccuguacgugaacaccgagacccugacccugagagagcccgacggccugaagaugaagcugauccugagccccaaggagaagggcagcagcagcguggacgaggagagcuuccaguaccccagccagcaggccaccgugaagaagagcagcaagaagagcgccagagacgagcagggcgcccugcugcugggccacgagcugcagagcuuccugaagaccgccagaaagaagcacaagagcagcagcgacgcccacagcagccccggccccgagggcugcggcagcgacgccagccaguucgccgagagccacagcgccaaccuggaccugagcggccuggagcccauccugguggagagcgacagcagcagcggcggcgagcuggaggccggcgagcuggugaucgacgacagcuacagagagaucaagaagaagaagaagagcaagaagagcaagaagaagaaggacaaggagaagcacaaggagaagagacacagcaagagcaagagaagccugggccugagcgccgugcccgugggcgaggugaccgugaccagcggccccccccccagcauccccuacgccggcgccgccgcccccccccugccccugcccggccugcacaccgacggccacagcgagaagaagaagaagaaggaggagaaggacaaggagagagagagaggcgagaagcccaagaagaagaacaugagcgccuaccagguguucugcaaggaguacagagugaccaucguggccgaccaccccggcaucgacuucggcgagcugagcaagaagcuggccgagguguggaagcagcugcccgagaaggacaagcugaucuggaagcagaaggcccaguaccugcagcacaagcagaacaaggccgaggccaccaccgugaagagaaaggccagcagcagcgagggcagcaugaaggugaaggccagcagcgugggcgugcugagcccccagaagaagagcccccccaccaccaugcugcugcccgccagccccgccaaggcccccgagaccgagcccaucgacguggccgcccaccugcagcugcugggcgagagccugagccugaucggccacagacugcaggagaccgagggcaugguggccgugagcggcagccugagcgugcugcuggacagcaucaucugcgcccugggcccccuggccugccugaccacccagcugcccgagcugaacggcugccccaagcaggugcugagcaacacccuggacaacaucgccuacaucaugcccggccuguaa

SEQ ID NO: 18116 - RNA, 3459 nt, Artificial Sequence
  HMHA1__Homo_sapiens__NP_001245257
augagcagaggccagagagugcugaagggccugcugggcugggugugcaccuggaccugggccuggagagccagacugggcgccagaggcugcggccugcacgugcugugccccagagaccugccccugccccccgaggagcugcccagaaaggacggcgccgacgccguguuccccggccccagccuggagccccccgccggcagcagcggcgugaaggccaccggcacccugaagagacccaccagccugagcagacacgccagcgccgccggcuucccccugagcggcgccgccagcuggacccugggcagaagccacagaagcccccugaccgccgccagccccggcgagcugcccaccgagggcgccggccccgacgugguggaggacaucagccaccugcuggccgacguggccagauucgccgagggccuggagaagcugaaggagugcgugcugagagacgaccugcuggaggccagaagacccagagcccacgagugccugggcgaggcccugagagugaugcaccagaucaucagcaaguacccccugcugaacaccguggagacccugaccgccgccggcacccugaucgccaaggugaaggccuuccacuacgagagcaacaacgaccuggagaagcaggaguucgagaaggcccuggagaccaucgccguggccuucagcagcaccgugagcgaguuccugaugggcgagguggacagcagcacccugcuggccgugccccccggcgacagcagccagagcauggagagccuguacggccccggcagcgagggcaccccccccagccuggaggacugcgacgccggcugccugcccgccgaggagguggacgugcugcugcagagaugcgagggcggcguggacgccgcccugcuguacgccaagaacauggccaaguacaugaaggaccugaucagcuaccuggagaagagaaccacccuggagauggaguucgccaagggccugcagaagaucgcccacaacugcagacagagcgugaugcaggagccccacaugccccugcugagcaucuacagccuggcccuggagcaggaccuggaguucggccacagcauggugcaggccgugggcacccugcagacccagaccuucaugcagccccugacccugagaagacuggagcacgagaagagaagaaaggagaucaaggaggccuggcacagagcccagagaaagcugcaggaggccgagagcaaccugagaaaggccaagcagggcuacgugcagagaugcgaggaccacgacaaggccagauuccugguggccaaggccgaggaggagcaggccggcagcgcccccggcgccggcagcaccgccaccaagacccuggacaagagaagaagacuggaggaggaggccaagaacaaggccgaggaggccauggccaccuacagaaccugcguggccgacgccaagacccagaagcaggagcuggaggacaccaaggugaccgcccugagacagauccaggaggugaucagacagagcgaccagaccaucaagagcgccaccaucagcuacuaccagaugaugcacaugcagaccgccccccugcccgugcacuuccagaugcugugcgagagcagcaagcuguacgaccccggccagcaguacgccagccacgugagacagcugcagagagaccaggagcccgacgugcacuacgacuucgagccccacgugagcgccaacgccuggagccccgugaugagagccagaaagagcagcuucaacgugagcgacguggccagacccgaggccgccggcagcccccccgaggagggcggcugcaccgagggcacccccgccaaggaccacagagccggcagaggccaccaggugcacaagagcuggccccugagcaucagcgacagcgacagcggccuggaccccggccccggcgccggcgacuucaagaaguucgagagaaccagcagcagcggcaccaugagcagcaccgaggagcugguggaccccgacggcggcgccggcgccagcgccuucgagcaggccgaccugaacggcaugacccccgagcugcccguggccgugcccagcggccccuucagacacgagggccugagcaaggccgccagaacccacagacugagaaagcugagaacccccgccaagugcagagagugcaacagcuacguguacuuccagggcgccgagugcgaggagugcugccuggccugccacaagaagugccuggagacccuggccauccagugcggccacaagaagcugcagggcagacugcagcuguucggccaggacuucagccacgccgccagaagcgcccccgacggcgugcccuucaucgugaagaagugcgugugcgagaucgagagaagagcccugagaaccaagggcaucuacagagugaacggcgugaagaccagaguggagaagcugugccaggccuucgagaacggcaaggagcugguggagcugagccaggccagcccccacgacaucagcaacgugcugaagcuguaccugagacagcugcccgagccccugaucagcuucagacuguaccacgagcuggugggccuggccaaggacagccugaaggccgaggccgaggccaaggccgccagcagaggcagacaggacggcagcgagagcgaggccguggccguggcccuggccggcagacugagagagcugcugagagaccugccccccgagaacagagccagccugcaguaccugcugagacaccugagaagaaucguggagguggagcaggacaacaagaugacccccggcaaccugggcaucguguucggccccacccugcugagacccagacccaccgaggccaccgugagccugagcagccugguggacuacccccaccaggccagagugaucgagacccugaucgugcacuacggccugguguucgaggaggagcccgaggagacccccggcggccaggacgagagcagcaaccagagagccgaggugguggugcaggugcccuaccuggaggccggcgaggccgugguguacccccugcaggaggccgccgccgacggcugcagagagagcagaguggugagcaacgacagcgacagcgaccuggaggaggccagcgagcugcugagcagcagcgaggccagcgcccugggccaccugagcuuccuggagcagcagcagagcgaggccagccuggagguggccagcggcagccacagcggcagcgaggagcagcuggaggccaccgccagagaggacggcgacggcgacgaggacggccccgcccagcagcugagcggcuucaacaccaaccagagcaacaacgugcugcaggccccccugccccccaugagacugagaggcggcagaaugacccugggcagcugcagagagagacagcccgaguucguguaa

SEQ ID NO: 18117 - RNA, 2178 nt, Artificial Sequence
  HMMR__Homo_sapiens__NP_001136028
augagcuuccccaaggccccccugaagagauucaacgaccccagcggcugcgcccccagccccggcgccuacgacgugaagacccuggaggugcugaagggccccgugagcuuccagaagagccagagauucaagcagcagaaggagagcaagcagaaccugaacguggacaaggacaccacccugcccgccagcgccagaaaggugaagagcagcgagagcaagaaggagagccagaagaacgacaaggaccugaagauccuggagaaggagaucagagugcugcugcaggagagaggcgcccaggacagaagaauccaggaccuggagaccgagcuggagaagauggaggccagacugaacgccgcccugagagagaagaccagccugagcgccaacaacgccacccuggagaagcagcugaucgagcugaccagaaccaacgagcugcugaagagcaaguucagcgagaacggcaaccagaagaaccugagaauccugagccuggagcugaugaagcugagaaacaagagagagaccaagaugagaggcaugauggccaagcaggagggcauggagaugaagcugcaggugacccagagaagccuggaggagagccagggcaagaucgcccagcuggagggcaagcuggugagcaucgagaaggagaagaucgacgagaagagcgagaccgagaagcugcuggaguacaucgaggagaucagcugcgccagcgaccagguggagaaguacaagcuggacaucgcccagcuggaggagaaccugaaggagaagaacgacgagauccugagccugaagcagagccuggaggagaacaucgugauccugagcaagcagguggaggaccugaacgugaagugccagcugcuggagaaggagaaggaggaccacgugaacagaaacagagagcacaacgagaaccugaacgccgagaugcagaaccugaagcagaaguucauccuggagcagcaggagagagagaagcugcagcagaaggagcugcagaucgacagccugcugcagcaggagaaggagcugagcagcagccugcaccagaagcugugcagcuuccaggaggagauggugaaggagaagaaccuguucgaggaggagcugaagcagacccuggacgagcuggacaagcugcagcagaaggaggagcaggccgagagacuggugaagcagcuggaggaggaggccaagagcagagccgaggagcugaagcugcuggaggagaagcugaagggcaaggaggccgagcuggagaagagcagcgccgcccacacccaggccacccugcugcugcaggagaaguacgacagcauggugcagagccuggaggacgugaccgcccaguucgagagcuacaaggcccugaccgccagcgagaucgaggaccugaagcuggagaacagcagccugcaggagaaggccgccaaggccggcaagaacgccgaggacgugcagcaccagauccuggccaccgagagcagcaaccaggaguacgugagaaugcugcuggaccugcagaccaagagcgcccugaaggagaccgagaucaaggagaucaccgugagcuuccugcagaagaucaccgaccugcagaaccagcugaagcagcaggaggaggacuucagaaagcagcuggaggacgaggagggcagaaaggccgagaaggagaacaccaccgccgagcugaccgaggagaucaacaaguggagacugcuguacgaggagcuguacaacaagaccaagcccuuccagcugcagcuggacgccuucgagguggagaagcaggcccugcugaacgagcacggcgccgcccaggagcagcugaacaagaucagagacagcuacgccaagcugcugggccaccagaaccugaagcagaagaucaagcacguggugaagcugaaggacgagaacagccagcugaagagcgaggugagcaagcugagaugccagcuggccaagaagaagcagagcgagaccaagcugcaggaggagcugaacaaggugcugggcaucaagcacuucgaccccagcaaggccuuccaccacgagagcaaggagaacuucgcccugaagaccccccugaaggagggcaacaccaacugcuacagagcccccauggagugccaggagagcuggaaguaa

SEQ ID NO: 18118 - RNA, 867 nt, Artificial Sequence
  HMOX1__Homo_sapiens__NP_002124
auggagagaccccagcccgacagcaugccccaggaccugagcgaggcccugaaggaggccaccaaggaggugcacacccaggccgagaacgccgaguucaugagaaacuuccagaagggccaggugaccagagacggcuucaagcuggugauggccagccuguaccacaucuacguggcccuggaggaggagaucgagagaaacaaggagagccccguguucgcccccguguacuuccccgaggagcugcacagaaaggccgcccuggagcaggaccuggccuucugguacggccccagauggcaggaggugauccccuacacccccgccaugcagagauacgugaagagacugcacgaggugggcagaaccgagcccgagcugcugguggcccacgccuacaccagauaccugggcgaccugagcggcggccaggugcugaagaagaucgcccagaaggcccuggaccugcccagcagcggcgagggccuggccuucuucaccuuccccaacaucgccagcgccaccaaguucaagcagcuguacagaagcagaaugaacagccuggagaugacccccgccgugagacagagagugaucgaggaggccaagaccgccuuccugcugaacauccagcuguucgaggagcugcaggagcugcugacccacgacaccaaggaccagagccccagcagagcccccggccugagacagagagccagcaacaaggugcaggacagcgcccccguggagacccccagaggcaagcccccccugaacaccagaagccaggccccccugcugagaugggugcugacccugagcuuccugguggccaccguggccgugggccuguacgccauguaa

SEQ ID NO: 18119 - RNA, 951 nt, Artificial Sequence
  HMOX2__Homo_sapiens__NP_001120676
augagcgccgagguggagaccagcgagggcguggacgagagcgagaagaagaacagcggcgcccuggagaaggagaaccagaugagaauggccgaccugagcgagcugcugaaggagggcaccaaggaggcccacgacagagccgagaacacccaguucgugaaggacuuccugaagggcaacaucaagaaggagcuguucaagcuggccaccaccgcccuguacuucaccuacagcgcccuggaggaggagauggagagaaacaaggaccaccccgccuucgccccccuguacuuccccauggagcugcacagaaaggaggcccugaccaaggacauggaguacuucuucggcgagaacugggaggagcaggugcagugccccaaggccgcccagaaguacguggagagaauccacuacaucggccagaacgagcccgagcugcugguggcccacgccuacaccagauacaugggcgaccugagcggcggccaggugcugaagaagguggcccagagagcccugaagcugcccagcaccggcgagggcacccaguucuaccuguucgagaacguggacaacgcccagcaguucaagcagcuguacagagccagaaugaacgcccuggaccugaacaugaagaccaaggagagaaucguggaggaggccaacaaggccuucgaguacaacaugcagaucuucaacgagcuggaccaggccggcagcacccuggccagagagacccuggaggacggcuuccccgugcacgacggcaagggcgacaugagaaagugccccuucuacgccgccgagcaggacaagggcgcccuggagggcagcagcugccccuucagaaccgccauggccgugcugagaaagcccagccugcaguucauccuggccgccggcguggcccuggccgccggccugcuggccugguacuacauguaa

SEQ ID NO: 18120 - RNA, 516 nt, Artificial Sequence
  HMP19__Homo_sapiens__NP_057064
auggugaagcugaacagcaaccccagcgagaagggcaccaagccccccagcguggaggacggcuuccagaccgugccccugaucaccccccuggaggugaaccaccugcagcugcccgcccccgagaaggugaucgugaagaccagaaccgaguaccagcccgagcagaagaacaagggcaaguucagagugcccaagaucgccgaguucaccgugaccauccuggugagccuggcccuggccuuccuggccugcaucguguuccuggugguguacaaggccuucaccuacgaccacagcugccccgagggcuucguguacaagcacaagagaugcauccccgccagccuggacgccuacuacagcagccaggaccccaacagcagaagcagauucuacaccgugaucagccacuacagcguggccaagcagagcaccgccagagccaucggccccuggcugagcgccgccgccgugauccacgagcccaagccccccaagacccagggccacuaa

SEQ ID NO: 18121 - RNA, 420 nt, Artificial Sequence
  HMSD__Homo_sapiens__NP_001116838
augagcaucagcagcgcccuggccaugguguucaugggcgccaagggcaacaccgccgcccagaugagccaggcccugugcuucagcaagaucggcggcgaggacggcgacauccacagaggcuuccagagccugcugguggccaucaacagaaccgacaccgaguacgugcugagaaccgccaacggccuguucggcgagaagagcuacgacuuccugaccggcuucaccgacagcugcggcaaguucuaccaggccaccaucaagcagcuggacuucgugaacgacaccgagaagagcaccaccagagugaacagcuggguggccgacaagaccaagggcgagaacauccugcuguucuacuucgacaacauccugaacagcuucaucgugagcagccugcagaacugccagaucuaa

SEQ ID NO: 18122 - RNA, 1047 nt, Artificial Sequence
  HMX1__Homo_sapiens__NP_061815
augcccgacgagcugaccgagcccggcagagccacccccgccagagccagcagcuuccugaucgagaaccugcuggccgccgaggccaagggcgccggcagagccacccagggcgacggcagcagagaggacgaggaggaggacgacgacgaccccgaggacgaggacgccgagcaggccagaagaagaagacugcagagaagaagacagcugcuggccggcaccggccccggcggcgaggccagagccagagcccugcugggccccggcgcccugggccugggccccagacccccccccggccccggcccccccuucgcccugggcugcggcggcgccgccagaugguaccccagagcccacggcggcuacggcggcggccugagccccgacaccagcgacagagacagccccgagaccggcgaggagaugggcagagccgagggcgccuggcccagaggccccggccccggcgccgugcagagagaggccgccgagcuggccgccagaggccccgccgccggcaccgaggaggccagcgagcuggccgaggugcccgccgccgccggcgagaccagaggcggcgugggcgugggcggcggcagaaagaagaagaccagaaccguguucagcagaagccagguguuccagcuggagagcaccuucgaccugaagagauaccugagcagcgccgagagagccggccuggccgccagccugcagcugaccgagacccaggugaagaucugguuccagaacagaagaaacaaguggaagagacagcuggccgccgagcuggaggccgccagccugagcccccccggcgcccagagacuggugagagugcccgugcuguaccacgagagcccccccgccgccgccgccgccggcccccccgccacccugcccuucccccuggcccccgccgcccccgcccccccccccccccugcugggcuucagcggcgcccuggccuacccccuggccgccuuccccgccgccgccagcgugcccuuccugagagcccagaugcccggccugguguaa

SEQ ID NO: 18123 - RNA, 546 nt, Artificial Sequence
  HN1__Homo_sapiens__NP_001002032
augaccaccaccaccaccuucaagggcguggaccccaacagcagaaacagcagcagagugcugagaccccccggcggcggcagcaacuucagccugggcuucgacgagcccaccgagcagcccgugagaaagaacaagauggccagcaacaucuucggcacccccgaggagaaccaggccagcugggccaagagcgccggcgccaagagcagcggcggcagagaggaccuggagagcagcggccugcagagaagaaacagcagcgaggccagcagcggcgacuuccuggaccugaagaagauguggacccagaccugccaggccgccuggggcagagugaagagaagccccugccugcugagacugugccccgccagauggcccagaccccagugccaccccgaggagaucccccuggccgccagccccgccagcagcugggugagcagcgacugccccgagagaugcagaagcgugugcuuccugcacgccugcgagcugcacaaccugagccugaccgugcaccugcuggaccuguuccacuaa

SEQ ID NO: 18124 - RNA, 573 nt, Artificial Sequence
  HN1L__Homo_sapiens__NP_653171
auguuccaggugcccgacagcgagggcggcagagccggcagcagagccaugaagccccccggcggcgagagcagcaaccuguucggcagccccgaggaggccacccccagcagcagacccaacagaauggccagcaacaucuucggccccaccgaggagccccagaacauccccaagagaaccaacccccccggcggcaagggcagcggcaucuucgacgagagcacccccgugcagaccagacagcaccugaacccccccggcggcaagaccagcgacaucuucggcagccccgugaccgccaccagcagacuggcccaccccaacaagcccaaggaccacguguuccugugcgagggcgaggagcccaagagcgaccugaaggccgccagaagcauccccgccggcgccgagcccggcgagaagggcagcgccagaaaggccggccccgccaaggagcaggagcccaugcccaccguggacagccacgagcccagacugggccccagacccagaagccacaacaaggugcugaacccccccggcggcaagagcagcaucagcuucuacuaa

SEQ ID NO: 18125 - RNA, 1896 nt, Artificial Sequence
  HNF1A__Homo_sapiens__NP_000536
auggugagcaagcugagccagcugcagaccgagcugcuggccgcccugcuggagagcggccugagcaaggaggcccugauccaggcccugggcgagcccggccccuaccugcuggccggcgagggcccccuggacaagggcgagagcugcggcggcggcagaggcgagcuggccgagcugcccaacggccugggcgagaccagaggcagcgaggacgagaccgacgacgacggcgaggacuucaccccccccauccugaaggagcuggagaaccugagccccgaggaggccgcccaccagaaggccgugguggagacccugcugcaggaggaccccuggagaguggccaagauggugaagagcuaccugcagcagcacaacaucccccagagagaggugguggacaccaccggccugaaccagagccaccugagccagcaccugaacaagggcacccccaugaagacccagaagagagccgcccuguacaccugguacgugagaaagcagagagagguggcccagcaguucacccacgccggccagggcggccugaucgaggagcccaccggcgacgagcugcccaccaagaagggcagaagaaacagauucaaguggggccccgccagccagcagauccuguuccaggccuacgagagacagaagaaccccagcaaggaggagagagagacccugguggaggagugcaacagagccgagugcauccagagaggcgugagccccagccaggcccagggccugggcagcaaccuggugaccgaggugagaguguacaacugguucgccaacagaagaaaggaggaggccuucagacacaagcuggccauggacaccuacagcggccccccccccggccccggccccggccccgcccugcccgcccacagcagccccggccugcccccccccgcccugagccccagcaaggugcacggcgugagauacggccagcccgccaccagcgagaccgccgaggugcccagcagcagcggcggcccccuggugaccgugagcaccccccugcaccaggugagccccaccggccuggagcccagccacagccugcugagcaccgaggccaagcuggugagcgccgccggcggcccccugccccccgugagcacccugaccgcccugcacagccuggagcagaccagccccggccugaaccagcagccccagaaccugaucauggccagccugcccggcgugaugaccaucggccccggcgagcccgccagccugggccccaccuucaccaacaccggcgccagcacccuggugaucggccuggccagcacccaggcccagagcgugcccgugaucaacagcaugggcagcagccugaccacccugcagcccgugcaguucagccagccccugcaccccagcuaccagcagccccugaugccccccgugcagagccacgugacccagagccccuucauggccaccauggcccagcugcagagcccccacgcccuguacagccacaagcccgagguggcccaguacacccacaccggccugcugccccagaccaugcugaucaccgacaccaccaaccugagcgcccuggccagccugacccccaccaagcagguguucaccagcgacaccgaggccagcagcgagagcggccugcacacccccgccagccaggccaccacccugcacgugcccagccaggaccccgccggcauccagcaccugcagcccgcccacagacugagcgccagccccaccgugagcagcagcagccuggugcuguaccagagcagcgacagcagcaacggccagagccaccugcugcccagcaaccacagcgugaucgagaccuucaucagcacccagauggccagcagcagccaguaa

SEQ ID NO: 18126 - RNA, 1674 nt, Artificial Sequence
  HNF1B__Homo_sapiens__NP_000449
auggugagcaagcugaccagccugcagcaggagcugcugagcgcccugcugagcagcggcgugaccaaggaggugcuggugcaggcccuggaggagcugcugcccagccccaacuucggcgugaagcuggagacccugccccugagccccggcagcggcgccgagcccgacaccaagcccguguuccacacccugaccaacggccacgccaagggcagacugagcggcgacgagggcagcgaggacggcgacgacuacgacaccccccccauccugaaggagcugcaggcccugaacaccgaggaggccgccgagcagagagccgagguggacagaaugcugagcgaggaccccuggagagccgccaagaugaucaagggcuacaugcagcagcacaacaucccccagagagaggugguggacgugaccggccugaaccagagccaccugagccagcaccugaacaagggcacccccaugaagacccagaagagagccgcccuguacaccugguacgugagaaagcagagagagauccugagacaguucaaccagaccgugcagagcagcggcaacaugaccgacaagagcagccaggaccagcugcuguuccuguuccccgaguucagccagcagagccacggccccggccagagcgacgacgccugcagcgagcccaccaacaagaagaugagaagaaacagauucaaguggggccccgccagccagcagauccuguaccaggccuacgacagacagaagaaccccagcaaggaggagagagaggcccugguggaggagugcaacagagccgagugccugcagagaggcgugagccccagcaaggcccacggccugggcagcaaccuggugaccgaggugagaguguacaacugguucgccaacagaagaaaggaggaggccuucagacagaagcuggccauggacgccuacagcagcaaccagacccacagccugaacccccugcugagccacggcagcccccaccaccagcccagcagcagcccccccaacaagcugagcggcgugagauacagccagcagggcaacaacgagaucaccagcagcagcaccaucagccaccacggcaacagcgccauggugaccagccagagcgugcugcagcaggugagccccgccagccuggaccccggccacaaccugcugagccccgacggcaagaugaucagcgugagcggcggcggccugccccccgugagcacccugaccaacauccacagccugagccaccacaacccccagcagagccagaaccugaucaugaccccccugagcggcgugauggccaucgcccagagccugaacaccagccaggcccagagcgugcccgugaucaacagcguggccggcagccuggccgcccugcagcccgugcaguucagccagcagcugcacagcccccaccagcagccccugaugcagcagagccccggcagccacauggcccagcagcccuucauggccgccgugacccagcugcagaacagccacauguacgcccacaagcaggagcccccccaguacagccacaccagcagauuccccagcgccaugguggugaccgacaccagcagcaucagcacccugaccaacaugagcagcagcaagcagugcccccugcaggccugguaa

SEQ ID NO: 18127 - RNA, 1425 nt, Artificial Sequence
  HNF4A__Homo_sapiens__NP_000448
augagacugagcaagacccugguggacauggacauggccgacuacagcgccgcccuggaccccgccuacaccacccuggaguucgagaacgugcaggugcugaccaugggcaacgacaccagccccagcgagggcaccaaccugaacgcccccaacagccugggcgugagcgcccugugcgccaucugcggcgacagagccaccggcaagcacuacggcgccagcagcugcgacggcugcaagggcuucuucagaagaagcgugagaaagaaccacauguacagcugcagauucagcagacagugcgugguggacaaggacaagagaaaccagugcagauacugcagacugaagaagugcuucagagccggcaugaagaaggaggccgugcagaacgagagagacagaaucagcaccagaagaagcagcuacgaggacagcagccugcccagcaucaacgcccugcugcaggccgaggugcugagcagacagaucaccagccccgugagcggcaucaacggcgacaucagagccaagaagaucgccagcaucgccgacgugugcgagagcaugaaggagcagcugcuggugcugguggagugggccaaguacauccccgccuucugcgagcugccccuggacgaccagguggcccugcugagagcccacgccggcgagcaccugcugcugggcgccaccaagagaagcaugguguucaaggacgugcugcugcugggcaacgacuacaucgugcccagacacugccccgagcuggccgagaugagcagagugagcaucagaauccuggacgagcuggugcugcccuuccaggagcugcagaucgacgacaacgaguacgccuaccugaaggccaucaucuucuucgaccccgacgccaagggccugagcgaccccggcaagaucaagagacugagaagccaggugcaggugagccuggaggacuacaucaacgacagacaguacgacagcagaggcagauucggcgagcugcugcugcugcugcccacccugcagagcaucaccuggcagaugaucgagcagauccaguucaucaagcuguucggcauggccaagaucgacaaccugcugcaggagaugcugcugggcggcagccccagcgacgccccccacgcccaccacccccugcacccccaccugaugcaggagcacaugggcaccaacgugaucguggccaacaccaugcccacccaccugagcaacggccagaugugcgaguggcccagacccagaggccaggccgccacccccgagaccccccagcccagcccccccggcggcagcggcagcgagcccuacaagcugcugcccggcgccguggccaccaucgugaagccccugagcgccaucccccagcccaccaucaccaagcaggaggugaucuaa

SEQ ID NO: 18128 - RNA, 1338 nt, Artificial Sequence
  HNF4G__Homo_sapiens__NP_004124
auggacauggccaacuacagcgaggugcuggaccccaccuacaccacccuggaguucgagaccaugcagauccuguacaacagcagcgacagcagcgcccccgagaccagcaugaacaccaccgacaacggcgugaacugccugugcgccaucugcggcgacagagccaccggcaagcacuacggcgccagcagcugcgacggcugcaagggcuucuucagaagaagcaucagaaagagccacguguacagcugcagauucagcagacagugcgugguggacaaggacaagagaaaccagugcagauacugcagacugagaaagugcuucagagccggcaugaagaaggaggccgugcagaacgagagagacagaaucagcaccagaagaagcaccuucgacggcagcaacauccccagcaucaacacccuggcccaggccgaggugagaagcagacagaucagcgugagcagccccggcagcagcaccgacaucaacgugaagaagaucgccagcaucggcgacgugugcgagagcaugaagcagcagcugcuggugcugguggagugggccaaguacauccccgccuucugcgagcugccccuggacgaccagguggcccugcugagagcccacgccggcgagcaccugcugcugggcgccaccaagagaagcaugauguacaaggacauccugcugcugggcaacaacuacgugauccacagaaacagcugcgagguggagaucagcagaguggccaacagagugcuggacgagcuggugagacccuuccaggagauccagaucgacgacaacgaguacgccugccugaaggccaucguguucuucgaccccgacgccaagggccugagcgaccccgugaagaucaagaacaugagauuccaggugcagaucggccuggaggacuacaucaacgacagacaguacgacagcagaggcagauucggcgagcugcugcugcugcugcccacccugcagagcaucaccuggcagaugaucgagcagauccaguucgugaagcuguucggcauggugaagaucgacaaccugcugcaggagaugcugcugggcggcgccagcaacgacggcagccaccugcaccaccccaugcacccccaccugagccaggacccccugaccggccagaccauccugcugggccccaugagcacccuggugcacgccgaccagaucagcacccccgagaccccccugcccagccccccccagggcagcggccaggagcaguacaagaucgccgccaaccaggccagcgugaucagccaccagcaccugagcaagcagaagcagcuguaa

SEQ ID NO: 18129 - RNA, 156 nt, Artificial Sequence
  HNMT__Homo_sapiens__NP_001019245
auggccagcagcaugagaagccuguucagcgaccacggcaaguacguggagagcuucagaagauuccugaaccacagcaccgagcaccagugcaugcaggaguucauggacaagaagcugcccggcaucaucggcagauaccagaacugcugcuaa

SEQ ID NO: 18130 - RNA, 918 nt, Artificial Sequence
  HNRNPA0__Homo_sapiens__NP_006796
auggagaacagccagcugugcaagcuguucaucggcggccugaacgugcagaccagcgagagcggccugagaggccacuucgaggccuucggcacccugaccgacugcguggugguggugaacccccagaccaagagaagcagaugcuucggcuucgugaccuacagcaacguggaggaggccgacgccgccauggccgccagcccccacgccguggacggcaacaccguggagcugaagagagccgugagcagagaggacagcgccagacccggcgcccacgccaaggugaagaagcuguucgugggcggccugaagggcgacguggccgagggcgaccugaucgagcacuucagccaguucggcaccguggagaaggccgagaucaucgccgacaagcagagcggcaagaagagaggcuucggcuucguguacuuccagaaccacgacgccgccgacaaggccgccguggugaaguuccaccccauccagggccacagaguggaggugaagaaggccgugcccaaggaggacaucuacagcggcggcggcggcggcggcagcagaagcagcagaggcggcagaggcggcagaggcagaggcggcggcagagaccagaacggccugagcaagggcggcggcggcggcuacaacagcuacggcggcuacggcggcggcggcggcggcggcuacaacgccuacggcggcggcggcggcggcagcagcuacggcggcagcgacuacggcaacggcuucggcggcuucggcagcuacagccagcaccagagcagcuacggccccaugaagagcggcggcggcggcggcggcggcggcagcagcuggggcggcagaagcaacagcggccccuacagaggcggcuacggcggcggcggcggcuacggcggcagcagcuucuaa

SEQ ID NO: 18131 - RNA, 963 nt, Artificial Sequence
  HNRNPA1__Homo_sapiens__NP_002127
augagcaagagcgagagccccaaggagcccgagcagcugagaaagcuguucaucggcggccugagcuucgagaccaccgacgagagccugagaagccacuucgagcaguggggcacccugaccgacugcguggugaugagagaccccaacaccaagagaagcagaggcuucggcuucgugaccuacgccaccguggaggagguggacgccgccaugaacgccagaccccacaagguggacggcagagugguggagcccaagagagccgugagcagagaggacagccagagacccggcgcccaccugaccgugaagaagaucuucgugggcggcaucaaggaggacaccgaggagcaccaccugagagacuacuucgagcaguacggcaagaucgaggugaucgagaucaugaccgacagaggcagcggcaagaagagaggcuucgccuucgugaccuucgacgaccacgacagcguggacaagaucgugauccagaaguaccacaccgugaacggccacaacugcgaggugagaaaggcccugagcaagcaggagauggccagcgccagcagcagccagagaggcagaagcggcagcggcaacuucggcggcggcagaggcggcggcuucggcggcaacgacaacuucggcagaggcggcaacuucagcggcagaggcggcuucggcggcagcagaggcggcggcggcuacggcggcagcggcgacggcuacaacggcuucggcaacgacggcagcaacuucggcggcggcggcagcuacaacgacuucggcaacuacaacaaccagagcagcaacuucggccccaugaagggcggcaacuucggcggcagaagcagcggccccuacggcggcggcggccaguacuucgccaagcccagaaaccagggcggcuacggcggcagcagcagcagcagcagcuacggcagcggcagaagauucuaa

SEQ ID NO: 18132 - RNA, 1026 nt, Artificial Sequence
  HNRNPA2B1__Homo_sapiens__NP_002128
auggagagagagaaggagcaguucagaaagcuguucaucggcggccugagcuucgagaccaccgaggagagccugagaaacuacuacgagcaguggggcaagcugaccgacugcguggugaugagagaccccgccagcaagagaagcagaggcuucggcuucgugaccuucagcagcauggccgagguggacgccgccauggccgccagaccccacagcaucgacggcagagugguggagcccaagagagccguggccagagaggagagcggcaagcccggcgcccacgugaccgugaagaagcuguucgugggcggcaucaaggaggacaccgaggagcaccaccugagagacuacuucgaggaguacggcaagaucgacaccaucgagaucaucaccgacagacagagcggcaagaagagaggcuucggcuucgugaccuucgacgaccacgaccccguggacaagaucgugcugcagaaguaccacaccaucaacggccacaacgccgaggugagaaaggcccugagcagacaggagaugcaggaggugcagagcagcagaagcggcagaggcggcaacuucggcuucggcgacagcagaggcggcggcggcaacuucggccccggccccggcagcaacuucagaggcggcagcgacggcuacggcagcggcagaggcuucggcgacggcuacaacggcuacggcggcggccccggcggcggcaacuucggcggcagccccggcuacggcggcggcagaggcggcuacggcggcggcggccccggcuacggcaaccagggcggcggcuacggcggcggcuacgacaacuacggcggcggcaacuacggcagcggcaacuacaacgacuucggcaacuacaaccagcagcccagcaacuacggccccaugaagagcggcaacuucggcggcagcagaaacaugggcggccccuacggcggcggcaacuacggccccggcggcagcggcggcagcggcggcuacggcggcagaagcagauacuaa

SEQ ID NO: 18133 - RNA, 1137 nt, Artificial Sequence
  HNRNPA3__Homo_sapiens__XP_005246437
auggaggugaagcccccccccggcagaccccagcccgacagcggcagaagaagaagaagaagaggcgaggagggccacgaccccaaggagcccgagcagcugagaaagcuguucaucggcggccugagcuucgagaccaccgacgacagccugagagagcacuucgagaaguggggcacccugaccgacugcguggugaugagagacccccagaccaagagaagcagaggcuucggcuucgugaccuacagcugcguggaggagguggacgccgccaugugcgccagaccccacaagguggacggcagagugguggagcccaagagagccgugagcagagaggacagcgugaagcccggcgcccaccugaccgugaagaagaucuucgugggcggcaucaaggaggacaccgaggaguacaaccugagagacuacuucgagaaguacggcaagaucgagaccaucgaggugauggaggacagacagagcggcaagaagagaggcuucgccuucgugaccuucgacgaccacgacaccguggacaagaucguggugcagaaguaccacaccaucaacggccacaacugcgaggugaagaaggcccugagcaagcaggagaugcagagcgccggcagccagagaggcagaggcggcggcagcggcaacuucaugggcagaggcggcaacuucggcggcggcggcggcaacuucggcagaggcggcaacuucggcggcagaggcggcuacggcggcggcggcggcggcagcagaggcagcuacggcggcggcgacggcggcuacaacggcuucggcggcgacggcggcaacuacggcggcggccccggcuacagcagcagaggcggcuacggcggcggcggccccggcuacggcaaccagggcggcggcuacggcggcggcggcggcuacgacggcuacaacgagggcggcaacuucggcggcggcaacuacggcggcggcggcaacuacaacgacuucggcaacuacagcggccagcagcagagcaacuacggccccaugaagggcggcagcuucggcggcagaagcagcggcagccccuacggcggcggcuacggcagcggcggcggcagcggcggcuacggcagcagaagauucuaa

SEQ ID NO: 18134 - RNA, 858 nt, Artificial Sequence
  HNRNPAB__Homo_sapiens__NP_004490
augagcgaggccggcgaggagcagcccauggagaccaccggcgccaccgagaacggccacgaggccgugcccgagggcgagagccccgccggcgccggcaccggcgccgccgccggcgccggcggcgccaccgccgccccccccagcggcaaccagaacggcgccgagggcgaccagaucaacgccagcaagaacgaggaggacgccggcaagauguucgugggcggccugagcugggacaccagcaagaaggaccugaaggacuacuucaccaaguucggcgaggugguggacugcaccaucaagauggaccccaacaccggcagaagcagaggcuucggcuucauccuguucaaggacgccgccagcguggagaaggugcuggaccagaaggagcacagacuggacggcagagugaucgaccccaagaaggccauggccaugaagaaggaccccgugaagaagaucuucgugggcggccugaaccccgaggccaccgaggagaagaucagagaguacuucggcgaguucggcgagaucgaggccaucgagcugcccauggaccccaagcugaacaagagaagaggcuucguguucaucaccuucaaggaggaggagcccgugaagaaggugcuggagaagaaguuccacaccgugagcggcagcaagugcgagaucaagguggcccagcccaaggagguguaccagcagcagcaguacggcagcggcggcagaggcaacagaaacagaggcaacagaggcagcggcggcggcggcggcggcggcggccagggcagcaccaacuacggcaagagccagagaagaggcggccaccagaacaacuacaagcccuacuaa

SEQ ID NO: 18135 - RNA, 921 nt, Artificial Sequence
  HNRNPC__Homo_sapiens__XP_011535013
auggccagcaacgugaccaacaagaccgaccccagaagcaugaacagcagaguguucaucggcaaccugaacacccugguggugaagaagagcgacguggaggccaucuucagcaaguacggcaagaucgugggcugcagcgugcacaagggcuucgccuucgugcaguacgugaacgagagaaacgccagagccgccguggccggcgaggacggcagaaugaucgccggccaggugcuggacaucaaccuggccgccgagcccaaggugaacagaggcaaggccggcgugaagagaagcgccgccgagauguacggcagcgugaccgagcaccccagccccagcccccugcugagcagcagcuucgaccuggacuacgacuuccagagagacuacuacgacagaauguacagcuaccccgccagagugcccccccccccccccaucgccagagccguggugcccagcaagagacagagagugagcggcaacaccagcagaagaggcaagagcggcuucaacagcaagagcggccagagaggcagcagcaagagcggcaagcugaagggcgacgaccugcaggccaucaagaaggagcugacccagaucaagcagaagguggacagccugcuggagaaccuggagaagaucgagaaggagcagagcaagcaggccguggagaugaagaacgacaagagcgaggaggagcagagcagcagcagcgugaagaaggacgagaccaacgugaagauggagagcgagggcggcgccgacgacagcgccgaggagggcgaccugcuggacgacgacgacaacgaggacagaggcgacgaccagcuggagcugaucaaggacgacgagaaggaggccgaggagggcgaggacgacagagacagcgccaacggcgaggacgacagcuaa

SEQ ID NO: 18136 - RNA, 864 nt, Artificial Sequence
  HNRNPD__Homo_sapiens__NP_001003810
augagcgaggagcaguucggcggcgacggcgccgccgccgccgccaccgccgccgugggcggcagcgccggcgagcaggagggcgccaugguggccgccacccagggcgccgccgccgccgccggcagcggcgccggcaccggcggcggcaccgccagcggcggcaccgagggcggcagcgccgagagcgagggcgccaagaucgacgccagcaagaacgaggaggacgagggcaagauguucaucggcggccugagcugggacaccaccaagaaggaccugaaggacuacuucagcaaguucggcgaggugguggacugcacccugaagcuggaccccaucaccggcagaagcagaggcuucggcuucgugcuguucaaggagagcgagagcguggacaaggugauggaccagaaggagcacaagcugaacggcaaggugaucgaccccaagagagccaaggccaugaagaccaaggagcccgugaagaagaucuucgugggcggccugagccccgacacccccgaggagaagaucagagaguacuucggcggcuucggcgagguggagagcaucgagcugcccauggacaacaagaccaacaagagaagaggcuucugcuucaucaccuucaaggaggaggagcccgugaagaagaucauggagaagaaguaccacaacgugggccugagcaagugcgagaucaagguggccaugagcaaggagcaguaccagcagcagcagcaguggggcagcagaggcggcuucgccggcagagccagaggcagaggcggcgaccagcagagcggcuacggcaaggugagcagaagaggcggccaccagaacagcuacaagcccuacuaa

SEQ ID NO: 18137 - RNA, 1092 nt, Artificial Sequence
  HNRNPDL__Homo_sapiens__NP_001193929
auggaggugccccccagacugagccacgugccccccccccuguuccccagcgcccccgccacccuggccagcagaagccugagccacuggagacccagaccccccagacagcuggccccccugcugcccagccuggcccccagcagcgccagacagggcgccagaagagcccagagacacgugaccgcccagcagcccagcagacuggccggcggcgccgccaucaagggcggcagaagaagaagacccgaccuguucagaagacacuucaagagcagcagcauccagagaagcgccgccgccgccgccgccaccagaaccgccagacagcacccccccgccgacagcagcgugaccauggaggacaugaacgaguacagcaacaucgaggaguucgccgagggcagcaagaucaacgccagcaagaaccagcaggacgacggcaagauguucaucggcggccugagcugggacaccagcaagaaggaccugaccgaguaccugagcagauucggcgaggugguggacugcaccaucaagaccgaccccgugaccggcagaagcagaggcuucggcuucgugcuguucaaggacgccgccagcguggacaaggugcuggagcugaaggagcacaagcuggacggcaagcugaucgaccccaagagagccaaggcccugaagggcaaggagccccccaagaagguguucgugggcggccugagccccgacaccagcgaggagcagaucaaggaguacuucggcgccuucggcgagaucgagaacaucgagcugcccauggacaccaagaccaacgagagaagaggcuucugcuucaucaccuacaccgacgaggagcccgugaagaagcugcuggagagcagauaccaccagaucggcagcggcaagugcgagaucaagguggcccagcccaaggagguguacagacagcagcagcagcagcagaagggcggcagaggcgccgccgccggcggcagaggcggcaccagaggcagaggcagaggccagcagagcaccuacggcaaggccagcagaggcggcggcaaccaccagaacaacuaccagcccuacuaa

SEQ ID NO: 18138 - RNA, 1248 nt, Artificial Sequence
  HNRNPF__Homo_sapiens__NP_001091676
augaugcugggccccgagggcggcgagggcuucguggugaagcugagaggccugcccuggagcugcagcguggaggacgugcagaacuuccugagcgacugcaccauccacgacggcgccgccggcgugcacuucaucuacaccagagagggcagacagagcggcgaggccuucguggagcugggcagcgaggacgacgugaagauggcccugaagaaggacagagagagcaugggccacagauacaucgagguguucaagagccacagaaccgagauggacugggugcugaagcacagcggccccaacagcgccgacagcgccaacgacggcuucgugagacugagaggccugcccuucggcugcaccaaggaggagaucgugcaguucuucagcggccuggagaucgugcccaacggcaucacccugcccguggaccccgagggcaagaucaccggcgaggccuucgugcaguucgccagccaggagcuggccgagaaggcccugggcaagcacaaggagagaaucggccacagauacaucgagguguucaagagcagccaggaggaggugagaagcuacagcgaccccccccugaaguucaugagcgugcagagacccggccccuacgacagacccggcaccgccagaagauacaucggcaucgugaagcaggccggccuggagagaaugagacccggcgccuacagcaccggcuacggcggcuacgaggaguacagcggccugagcgacggcuacggcuucaccaccgaccuguucggcagagaccugagcuacugccugagcggcauguacgaccacagauacggcgacagcgaguucaccgugcagagcaccaccggccacugcgugcacaugagaggccugcccuacaaggccaccgagaacgacaucuacaacuucuucagcccccugaaccccgugagagugcacaucgagaucggccccgacggcagagugaccggcgaggccgacguggaguucgccacccacgaggaggccguggccgccaugagcaaggacagagccaacaugcagcacagauacaucgagcuguuccugaacagcaccaccggcgccagcaacggcgccuacagcagccaggugaugcagggcaugggcgugagcgccgcccaggccaccuacagcggccuggagagccagagcgugagcggcugcuacggcgccggcuacagcggccagaacagcaugggcggcuacgacuaa

SEQ ID NO: 18139 - RNA, 1350 nt, Artificial Sequence
  HNRNPH1__Homo_sapiens__NP_005511
augaugcugggcaccgagggcggcgagggcuucguggugaaggugagaggccugcccuggagcugcagcgccgacgaggugcagagauucuucagcgacugcaagauccagaacggcgcccagggcaucagauucaucuacaccagagagggcagacccagcggcgaggccuucguggagcuggagagcgaggacgaggugaagcuggcccugaagaaggacagagagaccaugggccacagauacguggagguguucaagagcaacaacguggagauggacugggugcugaagcacaccggccccaacagccccgacaccgccaacgacggcuucgugagacugagaggccugcccuucggcugcagcaaggaggagaucgugcaguucuucagcggccuggagaucgugcccaacggcaucacccugcccguggacuuccagggcagaagcaccggcgaggccuucgugcaguucgccagccaggagaucgccgagaaggcccugaagaagcacaaggagagaaucggccacagauacaucgagaucuucaagagcagcagagccgaggugagaacccacuacgacccccccagaaagcugauggccaugcagagacccggccccuacgacagacccggcgccggcagaggcuacaacagcaucggcagaggcgccggcuucgagagaaugagaagaggcgccuacggcggcggcuacggcggcuacgacgacuacaacggcuacaacgacggcuacggcuucggcagcgacagauucggcagagaccugaacuacugcuucagcggcaugagcgaccacagauacggcgacggcggcagcaccuuccagagcaccaccggccacugcgugcacaugagaggccugcccuacagagccaccgagaacgacaucuacaacuucuucagcccccugaaccccgugagagugcacaucgagaucggccccgacggcagagugaccggcgaggccgacguggaguucgccacccacgaggacgccguggccgccaugagcaaggacaaggccaacaugcagcacagauacguggagcuguuccugaacagcaccgccggcgccagcggcggcgccuacgagcacagauacguggagcuguuccugaacagcaccgccggcgccagcggcggcgccuacggcagccagaugaugggcggcaugggccugagcaaccagagcagcuacggcggccccgccagccagcagcugagcggcggcuacggcggcggcuacggcggccagagcagcaugagcggcuacgaccaggugcugcaggagaacagcagcgacuuccagagcaacaucgccuaa

SEQ ID NO: 18140 - RNA, 1350 nt, Artificial Sequence
  HNRNPH2__Homo_sapiens__NP_001027565
augaugcugagcaccgagggcagagagggcuucguggugaaggugagaggccugcccuggagcugcagcgccgacgaggugaugagauucuucagcgacugcaagauccagaacggcaccagcggcaucagauucaucuacaccagagagggcagacccagcggcgaggccuucguggagcuggagagcgaggaggaggugaagcuggcccugaagaaggacagagagaccaugggccacagauacguggagguguucaagagcaacagcguggagauggacugggugcugaagcacaccggccccaacagccccgacaccgccaacgacggcuucgugagacugagaggccugcccuucggcugcagcaaggaggagaucgugcaguucuucagcggccuggagaucgugcccaacggcaugacccugcccguggacuuccagggcagaagcaccggcgaggccuucgugcaguucgccagccaggagaucgccgagaaggcccugaagaagcacaaggagagaaucggccacagauacaucgagaucuucaagagcagcagagccgaggugagaacccacuacgacccccccagaaagcugauggccaugcagagacccggccccuacgacagacccggcgccggcagaggcuacaacagcaucggcagaggcgccggcuucgagagaaugagaagaggcgccuacggcggcggcuacggcggcuacgacgacuacggcggcuacaacgacggcuacggcuucggcagcgacagauucggcagagaccugaacuacugcuucagcggcaugagcgaccacagauacggcgacggcggcagcagcuuccagagcaccaccggccacugcgugcacaugagaggccugcccuacagagccaccgagaacgacaucuacaacuucuucagcccccugaaccccaugagagugcacaucgagaucggccccgacggcagagugaccggcgaggccgacguggaguucgccacccacgaggacgccguggccgccauggccaaggacaaggccaacaugcagcacagauacguggagcuguuccugaacagcaccgccggcaccagcggcggcgccuacgaccacagcuacguggagcuguuccugaacagcaccgccggcgccagcggcggcgccuacggcagccagaugaugggcggcaugggccugagcaaccagagcagcuacggcggccccgccagccagcagcugagcggcggcuacggcggcggcuacggcggccagagcagcaugagcggcuacgaccaggugcugcaggagaacagcagcgacuaccagagcaaccuggccuaa

SEQ ID NO: 18141 - RNA, 1395 nt, Artificial Sequence
  HNRNPK__Homo_sapiens__NP_112553
auggagaccgagcagcccgaggagaccuuccccaacaccgagaccaacggcgaguucggcaagagacccgccgaggacauggaggaggagcaggccuucaagagaagcagaaacaccgacgagaugguggagcugagaauccugcugcagagcaagaacgccggcgccgugaucggcaagggcggcaagaacaucaaggcccugagaaccgacuacaacgccagcgugagcgugcccgacagcagcggccccgagagaauccugagcaucagcgccgacaucgagaccaucggcgagauccugaagaagaucauccccacccuggaggagggccugcagcugcccagccccaccgccaccagccagcugccccuggagagcgacgccguggagugccugaacuaccagcacuacaagggcagcgacuucgacugcgagcugagacugcugauccaccagagccuggccggcggcaucaucggcgugaagggcgccaagaucaaggagcugagagagaacacccagaccaccaucaagcuguuccaggagugcugcccccacagcaccgacagaguggugcugaucggcggcaagcccgacagagugguggagugcaucaagaucauccuggaccugaucagcgagagccccaucaagggcagagcccagcccuacgaccccaacuucuacgacgagaccuacgacuacggcggcuucaccaugauguucgacgacagaagaggcagacccgugggcuuccccaugagaggcagaggcggcuucgacagaaugccccccggcagaggcggcagacccaugccccccagcagaagagacuacgacgacaugagccccagaagaggcccccccccccccccccccggcagaggcggcagaggcggcagcagagccagaaaccugccccugccccccccccccccccccagaggcggcgaccugauggccuacgacagaagaggcagacccggcgacagauacgacggcauggugggcuucagcgccgacgagaccugggacagcgccaucgacaccuggagccccagcgaguggcagauggccuacgagccccagggcggcagcggcuacgacuacagcuacgccggcggcagaggcagcuacggcgaccugggcggccccaucaucaccacccaggugaccauccccaaggaccuggccggcagcaucaucggcaagggcggccagagaaucaagcagaucagacacgagagcggcgccagcaucaagaucgacgagccccuggagggcagcgaggacagaaucaucaccaucaccggcacccaggaccagauccagaacgcccaguaccugcugcagaacagcgugaagcaguacgccgacguggagggcuucuaa

SEQ ID NO: 18142 - RNA, 1770 nt, Artificial Sequence
  HNRNPL__Homo_sapiens__NP_001524
augagcagaagacugcugcccagagccgagaagagaagaagaagacuggagcagagacagcagcccgacgagcagagaagaagaagcggcgccauggugaagauggccgccgccggcggcggcggcggcggcggcagauacuacggcggcggcagcgagggcggcagagcccccaagagacugaagaccgacaacgccggcgaccagcacggcggcggcggcggcggcggcggcggcgccggcgccgccggcggcggcggcggcggcgagaacuacgacgacccccacaagacccccgccagccccguggugcacaucagaggccugaucgacggcgugguggaggccgaccugguggaggcccugcaggaguucggccccaucagcuacgugguggugaugcccaagaagagacaggcccugguggaguucgaggacgugcugggcgccugcaacgccgugaacuacgccgccgacaaccagaucuacaucgccggccaccccgccuucgugaacuacagcaccagccagaagaucagcagacccggcgacagcgacgacagcagaagcgugaacagcgugcugcuguucaccauccugaaccccaucuacagcaucaccaccgacgugcuguacaccaucugcaaccccugcggccccgugcagagaaucgugaucuucagaaagaacggcgugcaggccaugguggaguucgacagcgugcagagcgcccagagagccaaggccagccugaacggcgccgacaucuacagcggcugcugcacccugaagaucgaguacgccaagcccaccagacugaacguguucaagaacgaccaggacaccugggacuacaccaaccccaaccugagcggccagggcgaccccggcagcaaccccaacaagagacagagacagcccccccugcugggcgaccaccccgccgaguacggcggcccccacggcggcuaccacagccacuaccacgacgagggcuacggccccccccccccccacuacgagggcagaagaaugggcccccccgugggcggccacagaagaggccccagcagauacggcccccaguacggccacccccccccccccccccccccccccgaguacggcccccacgccgacagccccgugcugaugguguacggccuggaccagagcaagaugaacugcgacagaguguucaacguguucugccuguacggcaacguggagaaggugaaguucaugaagagcaagcccggcgccgccaugguggagauggccgacggcuacgccguggacagagccaucacccaccugaacaacaacuucauguucggccagaagcugaacgugugcgugagcaagcagcccgccaucaugcccggccagagcuacggccuggaggacggcagcugcagcuacaaggacuucagcgagagcagaaacaacagauucagcacccccgagcaggccgccaagaacagaauccagcaccccagcaacgugcugcacuucuucaacgccccccuggaggugaccgaggagaacuucuucgagaucugcgacgagcugggcgugaagagacccagcagcgugaagguguucagcggcaagagcgagagaagcagcagcggccugcuggagugggagagcaagagcgacgcccuggagacccugggcuuccugaaccacuaccagaugaagaaccccaacggccccuaccccuacacccugaagcugugcuucagcaccgcccagcacgccagcuaa

SEQ ID NO: 18143 - RNA, 2193 nt, Artificial Sequence
  HNRNPM__Homo_sapiens__NP_005959
auggccgccggcguggaggccgccgccgagguggccgccaccgagaucaagauggaggaggagagcggcgcccccggcgugcccagcggcaacggcgcccccggccccaagggcgagggcgagagacccgcccagaacgagaagagaaaggagaagaacaucaagagaggcggcaacagauucgagcccuacgccaaccccaccaagagauacagagccuucaucaccaacauccccuucgacgugaaguggcagagccugaaggaccuggugaaggagaaggugggcgaggugaccuacguggagcugcugauggacgccgagggcaagagcagaggcugcgccgugguggaguucaagauggaggagagcaugaagaaggccgccgaggugcugaacaagcacagccugagcggcagaccccugaaggugaaggaggaccccgacggcgagcacgccagaagagccaugcagaaggugauggccaccaccggcggcaugggcaugggccccggcggccccggcaugaucaccaucccccccagcauccugaacaaccccaacauccccaacgagaucauccacgcccugcaggccggcagacugggcagcaccguguucguggccaaccuggacuacaaggugggcuggaagaagcugaaggagguguucagcauggccggcgugguggugagagccgacauccuggaggacaaggacggcaagagcagaggcaucggcaccgugaccuucgagcagagcaucgaggccgugcaggccaucagcauguucaacggccagcugcuguucgacagacccaugcacgugaagauggacgagagagcccugcccaagggcgacuucuucccccccgagagaccccagcagcugccccacggccugggcggcaucggcaugggccugggccccggcggccagcccaucgacgccaaccaccugaacaagggcaucggcaugggcaacaucggccccgccggcaugggcauggagggcaucggcuucggcaucaacaagaugggcggcauggagggccccuucggcggcggcauggagaacaugggcagauucggcagcggcaugaacaugggcagaaucaacgagauccugagcaacgcccugaagagaggcgagaucaucgccaagcagggcggcggcggcggcggcggcagcgugcccggcaucgagagaaugggccccggcaucgacagacugggcggcgccggcauggagagaaugggcgccggccugggccacggcauggacagagugggcagcgagaucgagagaaugggccuggugauggacagaaugggcagcguggagagaaugggcagcggcaucgagagaaugggcccccugggccuggaccacauggccagcagcaucgagagaaugggccagaccauggagagaaucggcagcggcguggagagaaugggcgccggcaugggcuucggccuggagagaauggccgcccccaucgacagagugggccagaccaucgagagaaugggcagcggcguggagagaaugggccccgccaucgagagaaugggccugagcauggagagaauggugcccgccggcaugggcgccggccuggagagaaugggccccgugauggacagaauggccaccggccuggagagaaugggcgccaacaaccuggagagaaugggccuggagagaaugggcgccaacagccuggagagaaugggccuggagagaaugggcgccaacagccuggagagaaugggccccgccaugggccccgcccugggcgccggcaucgagagaaugggccuggccaugggcggcggcggcggcgccagcuucgacagagccaucgagauggagagaggcaacuucggcggcagcuucgccggcagcuucggcggcgccggcggccacgcccccggcguggccagaaaggccugccagaucuucgugagaaaccugcccuucgacuucaccuggaagaugcugaaggacaaguucaacgagugcggccacgugcuguacgccgacaucaagauggagaacggcaagagcaagggcugcggcguggugaaguucgagagccccgagguggccgagagagccugcagaaugaugaacggcaugaagcugagcggcagagagaucgacgugagaaucgacagaaacgccuaa

SEQ ID NO: 18144 - RNA, 1788 nt, Artificial Sequence
  HNRNPR__Homo_sapiens__NP_001284549
auggccaaccaggugaacggcaacgccgugcagcugaaggaggaggaggagcccauggacaccagcagcgugacccacaccgagcacuacaagacccugaucgaggccggccugccccagaagguggccgagagacuggacgagaucuuccagaccggccugguggccuacguggaccuggacgagagagccaucgacgcccugagagaguucaacgaggagggcgcccugagcgugcugcagcaguucaaggagagcgaccugagccacgugcagaacaagagcgccuuccugugcggcgugaugaagaccuacagacagagagagaagcagggcagcaaggugcaggagagcaccaagggccccgacgaggccaagaucaagguguucgugggcaagauccccagagaccuguacgaggacgagcuggugccccuguucgagaaggccggccccaucugggaccugagacugaugauggacccccugagcggccagaacagaggcuacgccuucaucaccuucugcggcaaggaggccgcccaggaggccgugaagcugugcgacagcuacgagaucagacccggcaagcaccugggcgugugcaucagcguggccaacaacagacuguucgugggcagcauccccaagaacaagaccaaggagaacauccuggaggaguucagcaaggugaccgagggccugguggacgugauccuguaccaccagcccgacgacaagaagaagaacagaggcuucugcuuccuggaguacgaggaccacaagagcgccgcccaggccagaagaagacugaugagcggcaaggugaagguguggggcaacguggugaccguggagugggccgaccccguggaggagcccgaccccgaggugauggccaaggugaaggugcuguucgugagaaaccuggccaccaccgugaccgaggagauccuggagaagagcuucagcgaguucggcaagcuggagagagugaagaagcugaaggacuacgccuucgugcacuucgaggacagaggcgccgccgugaaggccauggacgagaugaacggcaaggagaucgagggcgaggagaucgagaucgugcuggccaagccccccgacaagaagagaaaggagagacaggccgccagacaggccagcagaagcaccgccuacgaggacuacuacuaccaccccccccccagaaugcccccccccaucagaggcagaggcagaggcggcggcagaggcggcuacggcuacccccccgacuacuacggcuacgaggacuacuacgacgacuacuacggcuacgacuaccacgacuacagaggcggcuacgaggaccccuacuacggcuacgacgacggcuacgccgugagaggcagaggcggcggcagaggcggcagaggcgccccccccccccccagaggcagaggcgcccccccccccagaggcagagccggcuacagccagagaggcgccccccugggcccccccagaggcagcagaggcggcagaggcggccccgcccagcagcagagaggcagaggcagcagaggcagcagaggcaacagaggcggcaacgugggcggcaagagaaaggccgacggcuacaaccagcccgacagcaagagaagacagaccaacaaccagcagaacuggggcagccagcccaucgcccagcagccccugcagcagggcggcgacuacagcggcaacuacggcuacaacaacgacaaccaggaguucuaccaggacaccuacggccagcaguggaaguaa

SEQ ID NO: 18145 - RNA, 2421 nt, Artificial Sequence
  HNRNPU__Homo_sapiens__NP_004492
augagcagcagccccgugaacgugaagaagcugaaggugagcgagcugaaggaggagcugaagaagagaagacugagcgacaagggccugaaggccgagcugauggagagacugcaggccgcccuggacgacgaggaggccggcggcagacccgccauggagcccggcaacggcagccuggaccugggcggcgacagcgccggcagaagcggcgccggccuggagcaggaggccgccgccggcggcgacgaggaggaggaggaggaggaggaggaggaggagggcaucagcgcccuggacggcgaccagauggagcugggcgaggagaacggcgccgccggcgccgccgacagcggccccauggaggaggaggaggccgccagcgaggacgagaacggcgacgaccagggcuuccaggagggcgaggacgagcugggcgacgaggaggagggcgccggcgacgagaacggccacggcgagcagcagccccagccccccgccacccagcagcagcagccccagcagcagagaggcgccgccaaggaggccgccggcaagagcagcggccccaccagccuguucgccgugaccguggccccccccggcgccagacagggccagcagcaggccggcggcgacggcaagaccgagcagaagggcggcgacaagaagagaggcgugaagagacccagagaggaccacggcagaggcuacuucgaguacaucgaggagaacaaguacagcagagccaagagcccccagccccccguggaggaggaggacgagcacuucgacgacaccguggugugccuggacaccuacaacugcgaccugcacuucaagaucagcagagacagacugagcgccagcagccugaccauggagagcuucgccuuccugugggccggcggcagagccagcuacggcgugagcaagggcaaggugugcuucgagaugaaggugaccgagaagauccccgugagacaccuguacaccaaggacaucgacauccacgaggugagaaucggcuggagccugaccaccagcggcaugcugcugggcgaggaggaguucagcuacggcuacagccugaagggcaucaagaccugcaacugcgagaccgaggacuacggcgagaaguucgacgagaacgacgugaucaccugcuucgccaacuucgagagcgacgagguggagcugagcuacgccaagaacggccaggaccugggcguggccuucaagaucagcaaggaggugcuggccggcagaccccuguucccccacgugcugugccacaacugcgccguggaguucaacuucggccagaaggagaagcccuacuuccccauccccgaggaguacaccuucauccagaacgugccccuggaggacagagugagaggccccaagggccccgaggagaagaaggacugcgagguggugaugaugaucggccugcccggcgccggcaagaccaccugggugaccaagcacgccgccgagaaccccggcaaguacaacauccugggcaccaacaccaucauggacaagaugaugguggccggcuucaagaagcagauggccgacaccggcaagcugaacacccugcugcagagagccccccagugccugggcaaguucaucgagaucgccgccagaaagaagagaaacuucauccuggaccagaccaacgugagcgccgccgcccagagaagaaagaugugccuguucgccggcuuccagagaaaggccgugguggugugccccaaggacgaggacuacaagcagagaacccagaagaaggccgagguggagggcaaggaccugcccgagcacgccgugcugaagaugaagggcaacuucacccugcccgagguggccgagugcuucgacgagaucaccuacguggagcugcagaaggaggaggcccagaagcugcuggagcaguacaaggaggagagcaagaaggcccugccccccgagaagaagcagaacaccggcagcaagaagagcaacaagaacaagagcggcaagaaccaguucaacagaggcggcggccacagaggcagaggcggcuucaacaugagaggcggcaacuucagaggcggcgcccccggcaacagaggcggcuacaacagaagaggcaacaugccccagagaggcggcggcggcggcggcagcggcggcaucggcuaccccuaccccagagcccccguguuccccggcagaggcagcuacagcaacagaggcaacuacaacagaggcggcaugcccaacagaggcaacuacaaccagaacuucagaggcagaggcaacaacagaggcuacaagaaccagagccagggcuacaaccaguggcagcagggccaguucuggggccagaagcccuggagccagcacuaccaccagggcuacuacuaa

SEQ ID NO: 18146 - RNA, 2571 nt, Artificial Sequence
  HNRNPUL1__Homo_sapiens__NP_008971
auggacgugagaagacugaaggugaacgagcugagagaggagcugcagagaagaggccuggacaccagaggccugaaggccgagcuggccgagagacugcaggccgcccuggaggccgaggagcccgacgacgagagagagcuggacgccgacgacgagcccggcagacccggccacaucaacgaggagguggagaccgagggcggcagcgagcuggagggcaccgcccagccccccccccccggccugcagccccacgccgagcccggcggcuacagcggccccgacggccacuacgccauggacaacaucaccagacagaaccaguucuacgacacccaggugaucaagcaggagaacgagagcggcuacgagagaagaccccuggagauggagcagcagcaggccuacagacccgagaugaagaccgagaugaagcagggcgcccccaccagcuuccugccccccgaggccagccagcugaagcccgacagacagcaguuccagagcagaaagagacccuacgaggagaacagaggcagaggcuacuucgagcacagagaggacagaagaggcagaagcccccagccccccgccgaggaggacgaggacgacuucgacgacacccugguggccaucgacaccuacaacugcgaccugcacuucaagguggccagagacagaagcagcggcuacccccugaccaucgagggcuucgccuaccuguggagcggcgccagagccagcuacggcgugagaagaggcagagugugcuucgagaugaagaucaacgaggagaucagcgugaagcaccugcccagcaccgagcccgacccccacguggugagaaucggcuggagccuggacagcugcagcacccagcugggcgaggagcccuucagcuacggcuacggcggcaccggcaagaagagcaccaacagcagauucgagaacuacggcgacaaguucgccgagaacgacgugaucggcugcuucgccgacuucgagugcggcaacgacguggagcugagcuucaccaagaacggcaaguggaugggcaucgccuucagaauccagaaggaggcccugggcggccaggcccuguacccccacgugcuggugaagaacugcgccguggaguucaacuucggccagagagccgagcccuacugcagcgugcugcccggcuucaccuucauccagcaccugccccugagcgagagaaucagaggcaccgugggccccaagagcaaggccgagugcgagauccugaugauggugggccugcccgccgccggcaagaccaccugggccaucaagcacgccgccagcaaccccagcaagaaguacaacauccugggcaccaacgccaucauggacaagaugagagugaugggccugagaagacagagaaacuacgccggcagaugggacgugcugauccagcaggccacccagugccugaacagacugauccagaucgccgccagaaagaagagaaacuacauccuggaccagaccaacguguacggcagcgcccagagaagaaagaugagacccuucgagggcuuccagagaaaggccaucgugaucugccccaccgacgaggaccugaaggacagaaccaucaagagaaccgacgaggagggcaaggacgugcccgaccacgccgugcuggagaugaaggccaacuucacccugcccgacgugggcgacuuccuggacgaggugcuguucaucgagcugcagagagaggaggccgacaagcuggugagacaguacaacgaggagggcagaaaggccggccccccccccgagaagagauucgacaacagaggcggcggcggcuucagaggcagaggcggcggcggcggcuuccagagauacgagaacagaggcccccccggcggcaacagaggcggcuuccagaacagaggcggcggcagcggcggcggcggcaacuacagaggcggcuucaacagaagcggcggcggcggcuacagccagaacagauggggcaacaacaacagagacaacaacaacagcaacaacagaggcagcuacaacagagccccccagcagcagccccccccccagcagcccccccccccccagccccccccccagcagcccccccccccccccagcuacagccccgccagaaacccccccggcgccagcaccuacaacaagaacagcaacauccccggcagcagcgccaacaccagcacccccaccgugagcagcuacagccccccccagcccagcuacagccagccccccuacaaccagggcggcuacagccagggcuacaccgcccccccccccccccccccccccccccccgccuacaacuacggcagcuacggcggcuacaaccccgcccccuacacccccccccccccccccaccgcccagaccuacccccagcccagcuacaaccaguaccagcaguacgcccagcaguggaaccaguacuaccagaaccagggccaguggccccccuacuacggcaacuacgacuacggcagcuacagcggcaacacccagggcggcaccagcacccaguaa

SEQ ID NO: 18147 - RNA, 495 nt, Artificial Sequence
  HOGA1__Homo_sapiens__NP_001128142
augcugggcccccagguguggagcagcgugagacagggccugagcagaagccugagcagaaacgugggcgugugggccagcggcgagggcaagaagguggacaucgccggcaucuacccccccgugaccacccccuucaccgccaccgccgagguggacuacggcaagcuggaggagaaccugcacaagcugggcaccuuccccuucagaggcgccgugggcggcgugugcgcccuggccaacgugcugggcgcccaggugugccagcuggagagacugugcugcaccggccagugggaggacgcccagaagcugcagcacagacugaucgagcccaacgccgccgugaccagaagauucggcauccccggccugaagaagaucauggacugguucggcuacuacggcggccccugcagagccccccugcaggagcugagccccgccgaggaggaggcccugagaauggacuucaccagcaacggcuggcuguaa

SEQ ID NO: 18148 - RNA, 675 nt, Artificial Sequence
  HOMER1__Homo_sapiens__NP_001264006
augggcgagcagcccaucuucagcaccagagcccacguguuccagaucgaccccaacaccaagaagaacugggugcccaccagcaagcacgccgugaccgugagcuacuucuacgacagcaccagaaacguguacagaaucaucagccuggacggcagcaaggccaucaucaacagcaccaucacccccaacaugaccuucaccaagaccagccagaaguucggccagugggccgacagcagagccaacaccguguacggccugggcuucagcagcgagcaccaccugagcaaggugaccgagcuggagugcgugagcagccaggccaacgccgugcacacccacaagaccgagcugaaccagaccauccaggagcuggaggagacccugaagcugaaggaggaggagaucgagagacugaagcaggagaucgacaacgccagagagcugcaggagcagagagacagccugacccagaagcugcaggagguggagaucagaaacaaggaccuggagggccagcugagcgaccuggagcagagacuggagaagagccagaacgagcaggaggccuucagaaacaaccugaagacccugcuggagauccuggacggcaagaucuucgagcugaccgagcugagagacaaccuggccaagcugcuggagugcagcuaa

SEQ ID NO: 18149 - RNA, 1032 nt, Artificial Sequence
  HOMER2__Homo_sapiens__NP_004830
augggcgagcagcccaucuucaccaccagagcccacguguuccagaucgaccccaacaccaagaagaacuggaugcccgccagcaagcaggccgugaccgugagcuacuucuacgacgugaccagaaacagcuacagaaucaucagcguggacggcgccaaggugaucaucaacagcaccaucacccccaacaugaccuucaccaagaccagccagaaguucggccagugggccgacagcagagccaacaccguguucggccugggcuucagcagcgagcagcagcugaccaaguucgccgagaaguuccaggaggugaaggaggccgccaagaucgccaaggacaagacccaggagaagaucgagaccagcagcaaccacagccaggccagcagcgugaacggcaccgacgacgagaaggccagccacgccggccccgccaacacccaccugaagagcgagaacgacaagcugaagaucgcccugacccagagcgccgccaacgugaagaagugggagaucgagcugcagacccugagagagagcaacgccagacugaccaccgcccugcaggagagcgccgccagcguggagcaguggaagagacaguucagcaucugcagagacgagaacgacagacugagaaacaagaucgacgagcuggaggagcagugcagcgagaucaacagagagaaggagaagaacacccagcugaagagaagaaucgaggagcuggaggccgagcugagagagaaggagaccgagcugaaggaccugagaaagcagagcgagaucaucccccagcugaugagcgagugcgaguacgugagcgagaagcuggaggccgccgagagagacaaccagaaccuggaggacaaggugagaagccugaagaccgacaucgaggagagcaaguacagacagagacaccugaagguggagcugaagagcuuccuggaggugcuggacggcaagaucgacgaccugcacgacuucagaagaggccugagcaagcugggcaccgacaacuaa

SEQ ID NO: 18150 - RNA, 1077 nt, Artificial Sequence
  HOMER3__Homo_sapiens__NP_001139193
augagcaccgccagagagcagcccaucuucagcaccagagcccacguguuccagaucgaccccgccaccaagagaaacuggauccccgccggcaagcacgcccugaccgugagcuacuucuacgacgccaccagaaacguguacagaaucaucagcaucggcggcgccaaggccaucaucaacagcaccgugacccccaacaugaccuucaccaagaccagccagaaguucggccagugggccgacagcagagccaacaccguguacggccugggcuucgccagcgagcagcaccugacccaguucgccgagaaguuccaggaggugaaggaggccgccagacuggccagagagaagagccaggacggcggcgagcugaccagccccgcccugggccuggccagccaccaggugccccccagcccccuggugagcgccaacggccccggcgaggagaagcuguucagaagccagagcgccgacgcccccggccccaccgagagagagagacugaagaagaugcugagcgagggcagcgugggcgaggugcagugggaggccgaguucuucgcccugcaggacagcaacaacaagcuggccggcgcccugagagaggccaacgccgccgccgcccaguggagacagcagcuggaggcccagagagccgaggccgagagacugagacagagaguggccgagcuggaggcccaggccgccagcgaggugacccccaccggcgagaaggagggccugggccagggccagagccuggagcagcuggaggcccuggugcagaccaaggaccaggagauccagacccugaagagccagaccggcggccccagagaggcccuggaggccgccgagagagaggagacccagcagaaggugcagaccagaaacgccgagcuggagcaccagcugagagccauggagagaagccuggaggaggccagagccgagagagagagagccagagccgaggugggcagagccgcccagcugcuggacgugagccuguucgagcugagcgagcugagagagggccuggccagacuggccgaggccgcccccuaa

SEQ ID NO: 18151 - RNA, 1653 nt, Artificial Sequence
  HOMEZ__Homo_sapiens__NP_065885
auggugagaggcugggagcccccccccggccuggacugcgccaucagcgagggccacaagagcgagggcaccaugccccccaacaaggaggccagcggccugagcagcagccccgccggccugaucugccugccccccaucagcgaggagcugcagcugguguggacccaggccgcccagaccagcgagcuggacagcaacgagcaccugcugaagaccuucagcuacuuccccuaccccagccuggccgacaucgcccugcugugccugagauacggccugcagauggagaaggugaagaccugguucauggcccagagacugagaugcggcaucagcuggagcagcgaggagaucgaggagaccagagccagagugguguacagaagagaccagcugcacuucaagagccugcugagcuucacccaccacgccggcagaccccccgaggaggugccccccccccccgugcccgcccccgagcaggugggcaucggcaucggcccccccacccugagcaagcccacccagaccaagggccugaagguggagcccgaggagcccagccagaugcccccccugccccagagccaccagaagcugaaggagagccugaugacccccggcagcggcgccuuccccuaccagagcgacuucuggcagcaccugcagagcagcggccugagcaaggagcaggccggcagaggccccaaccagagccacggcaucggcaccgccagcuggaaccacagcaccaccgugccccagccccaggccagagacaagcccccccccaucgcccugaucgccagcagcugcaaggaggagagcgccagcagcgugacccccagcagcagcagcaccagcagcagcuuccaggugcuggccaacggcgccaccgccgccagcaagccccugcagccccugggcugcgugccccagagcgugagccccagcgagcaggcccugcccccccaccuggagcccgccuggccccagggccugagacacaacagcgugcccggcagagugggccccaccgaguaccugagccccgacaugcagagacagagaaagaccaagagaaagaccaaggagcagcuggccauccugaagagcuucuuccugcagugccagugggccagaagagaggacuaccagaagcuggagcagaucaccggccugcccagacccgagaucauccagugguucggcgacaccagauacgcccugaagcacggccagcugaagugguucagagacaacgccgugcccggcgcccccagcuuccaggaccccgccauccccacccccccccccagcaccagaagccugaacgagagagccgagacccccccccugcccauccccccccccccccccgacauccagccccuggagagauacugggccgcccaccagcagcugagagagaccgacaucccccagcugagccaggccagcagacugagcacccagcaggugcuggacugguucgacagcagacugccccagcccgccgaggugguggugugccuggacgaggaggaggaggaggaggaggaggagcugcccgaggacgacgaggaggaggaggaggaggaggaggaggacgacgacgacgacgacgacgacgugaucauccaggacuaa

SEQ ID NO: 18152 - RNA, 2154 nt, Artificial Sequence
  HOOK2__Homo_sapiens__NP_001093646
augagcguggacaaggccgagcugugcggcagccugcugaccuggcugcagaccuuccacgugcccagccccugcgccagcccccaggaccugagcagcggccuggccguggccuacgugcugaaccagaucgaccccagcugguucaacgaggccuggcugcagggcaucagcgaggaccccggccccaacuggaagcugaaggugagcaaccugaagauggugcugagaagccugguggaguacagccaggacgugcuggcccaccccgugagcgaggagcaccugcccgacgugagccugaucggcgaguucagcgaccccgccgagcugggcaagcugcugcagcuggugcugggcugcgccaucagcugcgagaagaagcaggaccacauccagagaaucaugacccuggaggagagcgugcagcacguggugauggaggccauccaggagcugaugaccaaggacacccccgacagccugagccccgagaccuacggcaacuucgacagccagagcagaagauacuacuuccugagcgaggaggccgaggagggcgacgagcugcagcagagaugccuggaccuggagagacagcugaugcugcugagcgaggagaagcagagccuggcccaggagaacgccggccugagagagagaaugggcagacccgagggcgagggcacccccggccugaccgccaagaagcugcugcugcugcagagccagcuggagcagcugcaggaggagaacuucagacuggagagcggcagagaggacgagagacugagaugcgccgagcuggagagagagguggccgagcugcagcacagaaaccaggcccugaccagccuggcccaggaggcccaggcccugaaggacgagauggacgagcugagacagagcagcgagagagccggccagcuggaggccacccugaccagcugcagaagaagacugggcgagcugagagagcugagaagacaggugagacagcuggaggagagaaacgccggccacgccgagagaaccagacagcuggaggacgagcugagaagagccggcagccugagagcccagcuggaggcccagagaagacaggugcaggagcugcagggccagagacaggaggaggccaugaaggccgagaaguggcuguucgagugcagaaaccuggaggagaaguacgagagcgugaccaaggagaaggagagacugcuggccgagagagacagccugagagaggccaacgaggagcugagaugcgcccagcugcagcccagaggccugacccaggccgaccccagccuggaccccaccagcacccccguggacaaccuggccgccgagauccugcccgccgagcugagagagacccugcugagacugcagcuggagaacaagagacugugcagacaggaggccgccgacagagagagacaggaggagcugcagagacaccuggaggacgccaacagagccagacacggccuggagacccagcacagacugaaccagcagcagcugagcgagcugagagcccagguggaggaccugcagaaggcccugcaggagcagggcggcaagaccgaggacagcauccugcugaagagaaagcuggaggagcaccugcagaagcugcacgaggccgaccuggagcugcagagaaagagagaguacaucgaggagcuggagccccccaccgacagcagcaccgccagaagaaucgaggagcugcagcacaaccugcagaagaaggacgccgaccugagagccauggaggagagauacagaagauacguggacaaggccagaauggugaugcagaccauggagcccaagcagagacccgccgccggcgccccccccgagcugcacagccugagaacccagcugagagagagagacgugagaaucagacaccuggagauggacuucgagaagagcagaagccagagagagcaggaggagaagcugcugaucagcgccugguacaacaugggcauggcccugcagcagagagccggcgaggagagagcccccgcccacgcccagagcuuccuggcccagcagagacuggccaccaacagcagaagaggcccccugggcagacuggccagccugaaccugagacccaccgacaagcacuaa

SEQ ID NO: 18153 - RNA, 2157 nt, Artificial Sequence
  HOOK3__Homo_sapiens__NP_115786
auguucagcguggagagccuggagagagccgagcugugcgagagccugcugaccuggauccagaccuucaacguggacgcccccugccagaccguggaggaccugaccaacggcguggugauggcccaggugcugcagaagaucgaccccgccuacuucgacgagaacuggcugaacagaaucaagaccgaggugggcgacaacuggagacugaagaucagcaaccugaagaagauccugaagggcauccuggacuacaaccacgagauccugggccagcagaucaacgacuucacccugcccgacgugaaccugaucggcgagcacagcgacgccgccgagcugggcagaaugcugcagcugauccugggcugcgccgugaacugcgagcagaagcaggaguacauccaggccaucaugaugauggaggagagcgugcagcacguggugaugaccgccauccaggagcugaugagcaaggagagccccgugagcgccggcaacgacgccuacguggaccuggacagacagcugaagaagaccaccgaggagcugaacgaggcccugagcgccaaggaggagaucgcccagagaugccacgagcuggacaugcagguggccgcccugcaggaggagaagagcagccugcuggccgagaaccaggugcugauggagagacugaaccagagcgacagcaucgaggaccccaacagccccgccggcagaagacaccugcagcugcagacccagcuggagcagcugcaggaggagaccuucagacuggaggccgccaaggacgacuacagaaucagaugcgaggagcuggagaaggagaucagcgagcugagacagcagaacgacgagcugaccacccuggccgacgaggcccagagccugaaggacgagaucgacgugcugagacacagcagcgacaaggugagcaagcuggagggccagguggagagcuacaagaagaagcuggaggaccugggcgaccugagaagacaggugaagcugcuggaggagaagaacaccauguacaugcagaacaccgugagccuggaggaggagcugagaaaggccaacgccgccagaagccagcuggagaccuacaagagacaggugguggagcugcagaacagacugagcgaggagagcaagaaggccgacaagcuggacuucgaguacaagagacugaaggagaagguggacagccugcagaaggagaaggacagacugagaaccgagagagacagccugaaggagaccaucgaggagcugagaugcgugcaggcccaggagggccagcugaccacccagggccugaugccccugggcagccaggagagcagcgacagccuggccgccgagaucgugacccccgagaucagagagaagcugaucagacugcagcacgagaacaagaugcugaagcugaaccaggagggcagcgacaacgagaagaucgcccugcugcagagccugcuggacgacgccaaccugagaaagaacgagcuggagaccgagaacagacuggugaaccagagacugcuggaggugcagagccagguggaggagcugcagaagagccugcaggaccagggcagcaaggccgaggacagcgugcugcugaagaagaagcuggaggagcaccuggagaagcugcacgaggccaacaacgagcugcagaagaagagagccaucaucgaggaccuggagcccagauucaacaacagcagccugaagaucgaggagcugcaggaggcccugagaaagaaggaggaggagaugaagcagauggaggagagauacaagaaguaccuggagaaggccaagagcgugaucagaacccuggaccccaagcagaaccagggcgccgcccccgagauccaggcccugaagaaccagcugcaggagagagacagacuguuccacagccuggagaaggaguacgagaagaccaagagccagagagagauggaggagaaguacaucgugagcgccugguacaacaugggcaugacccugcacaagaaggccgccgaggacagacuggccagcaccggcagcggccagagcuuccuggccagacagagacaggccaccagcagcagaagaagcuaccccggccacgugcagcccgccaccgccagauaa

SEQ ID NO: 18154 - RNA, 222 nt, Artificial Sequence
  HOPX__Homo_sapiens__NP_001138931
augagcgccgagaccgccagcggccccaccgaggaccagguggagauccuggaguacaacuucaacaagguggacaagcaccccgacagcaccacccugugccugaucgccgccgaggccggccugagcgaggaggagacccagaagugguucaagcagagacuggccaaguggagaagaagcgagggccugcccagcgagugcagaagcgugaccgacuaa

SEQ ID NO: 18155 - RNA, 924 nt, Artificial Sequence
  HORMAD2__Homo_sapiens__NP_689723
auggccaccgcccagcugagccacugcaucaccauccacaaggccagcaaggagaccguguuccccagccagaucaccaacgagcacgagagccugaagauggugaagaagcuguucgccaccagcaucagcugcaucaccuaccugagaggccuguuccccgagagcagcuacggcgagagacaccuggacgaccugagccugaagauccugagagaggacaagaagugccccggcagccugcacaucaucagauggauccagggcugcuucgacgcccuggagaagagauaccugagaauggccgugcugacccuguacaccgaccccaugggcagcgagaaggugaccgagauguaccaguucaaguucaaguacaccaaggagggcgccaccauggacuucgacagccacagcagcagcaccagcuucgagagcggcaccaacaacgaggacaucaagaaggccagcgugcugcugaucagaaagcuguacauccugaugcaggaccuggagccccugcccaacaacguggugcugaccaugaagcugcacuacuacaacgccgugaccccccacgacuaccagccccugggcuucaaggagggcgugaacagccacuuccugcuguucgacaaggagcccaucaacgugcaggugggcuucgugagcaccggcuuccacagcaugaaggugaaggugaugaccgaggccaccaaggugaucgaccuggagaacaaccuguucagagagaacagcaccaccgagaucgcccaccagggccuggacugcgacgaggaggaggagugcaacgaccacauccagagaaugaacuucgugugcagccagcagagcagcgagugcagcagaaagaagagaaaggugagcgagcccgugaagguguucauccccaacagaaaguaa

SEQ ID NO: 18156 - RNA, 1233 nt, Artificial Sequence
  HOXA10__Homo_sapiens__NP_061824
augagcgccagaaagggcuaccugcugcccagccccaacuaccccaccaccaugagcugcagcgagagccccgccgccaacagcuuccugguggacagccugaucagcagcggcagaggcgaggccggcggcggcggcggcggcgccggcggcggcggcggcggcggcuacuacgcccacggcggcguguaccugccccccgccgccgaccugcccuacggccugcagagcugcggccuguuccccacccugggcggcaagagaaacgaggccgccagccccggcagcggcggcggcggcggcggccugggccccggcgcccacggcuacggccccagccccaucgaccuguggcuggacgcccccagaagcugcagaauggagccccccgacggcccccccccccccccccagcagcagccccccccccccccccagcccccccagcccgccccccaggccaccagcugcagcuucgcccagaacaucaaggaggagagcagcuacugccuguacgacagcgccgacaagugccccaaggugagcgccaccgccgccgagcuggcccccuuccccagaggccccccccccgacggcugcgcccugggcaccagcagcggcgugcccgugcccggcuacuucagacugagccaggccuacggcaccgccaagggcuacggcagcggcggcggcggcgcccagcagcugggcgccggccccuuccccgcccagccccccggcagaggcuucgaccugccccccgcccuggccagcggcagcgccgacgccgccagaaaggagagagcccuggacagcccccccccccccacccuggccugcggcagcggcggcggcagccagggcgacgaggaggcccacgccagcagcagcgccgccgaggagcugagccccgcccccagcgagagcagcaaggccagccccgagaaggacagccugggcaacagcaagggcgagaacgccgccaacuggcugaccgccaagagcggcagaaagaagagaugccccuacaccaagcaccagacccuggagcuggagaaggaguuccuguucaacauguaccugaccagagagagaagacuggagaucagcagaagcgugcaccugaccgacagacaggugaagaucugguuccagaacagaagaaugaagcugaagaagaugaacagagagaacagaaucagagagcugaccgccaacuucaacuucagcuaa

SEQ ID NO: 18157 - RNA, 942 nt, Artificial Sequence
  HOXA11__Homo_sapiens__NP_005514
auggacuucgacgagagaggccccugcagcagcaacauguaccugcccagcugcaccuacuacgugagcggccccgacuucagcagccugcccagcuuccugccccagacccccagcagcagacccaugaccuacagcuacagcagcaaccugccccaggugcagcccgugagagaggugaccuucagagaguacgccaucgagcccgccaccaaguggcaccccagaggcaaccuggcccacugcuacagcgccgaggagcuggugcacagagacugccugcaggcccccagcgccgccggcgugcccggcgacgugcuggccaagagcagcgccaacguguaccaccaccccacccccgccgugagcagcaacuucuacagcaccgugggcagaaacggcgugcugccccaggccuucgaccaguucuucgagaccgccuacggcacccccgagaaccuggccagcagcgacuaccccggcgacaagagcgccgagaagggcccccccgccgccaccgccaccagcgccgccgccgccgccgccgccaccggcgcccccgccaccagcagcagcgacagcggcggcggcggcggcugcagagagaccgccgccgccgccgaggagaaggagagaagaagaagacccgagagcagcagcagccccgagagcagcagcggccacaccgaggacaaggccggcggcagcagcggccagagaaccagaaagaagagaugccccuacaccaaguaccagaucagagagcuggagagagaguucuucuucagcguguacaucaacaaggagaagagacugcagcugagcagaaugcugaaccugaccgacagacaggugaagaucugguuccagaacagaagaaugaaggagaagaagaucaacagagacagacugcaguacuacagcgccaacccccugcuguaa

SEQ ID NO: 18158 - RNA, 1167 nt, Artificial Sequence
  HOXA13__Homo_sapiens__XP_011513646
augaccgccagcgugcugcugcaccccagauggaucgagcccaccgugauguuccuguacgacaacggcggcggccugguggccgacgagcugaacaagaacauggagggcgccgccgccgccgccgccgccgccgccgccgccgccgccgccggcgccggcggcggcggcuucccccaccccgccgccgccgccgccggcggcaacuucagcguggccgccgccgccgccgccgccgccgccgccgccgccaaccagugcagaaaccugauggcccaccccgccccccuggcccccggcgccgccagcgccuacagcagcgcccccggcgaggccccccccagcgccgccgccgccgccgccgccgccgccgccgccgccgccgccgccgccgccgccagcagcagcggcggccccggccccgccggccccgccggcgccgaggccgccaagcagugcagccccugcagcgccgccgcccagagcagcagcggccccgccgcccugcccuacggcuacuucggcagcggcuacuaccccugcgccagaaugggcccccaccccaacgccaucaagagcugcgcccagcccgccagcgccgccgccgccgccgccuucgccgacaaguacauggacaccgccggccccgccgccgaggaguucagcagcagagccaaggaguucgccuucuaccaccagggcuacgccgccggccccuaccaccaccaccagcccaugcccggcuaccuggacaugcccguggugcccggccugggcggccccggcgagagcagacacgagccccugggccugcccauggagagcuaccagcccugggcccugcccaacggcuggaacggccagauguacugccccaaggagcaggcccagcccccccaccuguggaagagcacccugcccgacguggugagccaccccagcgacgccagcagcuacagaagaggcagaaagaagagagugcccuacaccaaggugcagcugaaggagcuggagagagaguacgccaccaacaaguucaucaccaaggacaagagaagaagaaucagcgccaccaccaaccugagcgagagacaggugaccaucugguuccagaacagaagagugaaggagaagaaggugaucaacaagcugaagaccaccagcuaa

SEQ ID NO: 18159 - RNA, 1008 nt, Artificial Sequence
  HOXA1__Homo_sapiens__NP_005513
auggacaacgccagaaugaacagcuuccuggaguaccccauccugagcagcggcgacagcggcaccugcagcgccagagccuaccccagcgaccacagaaucaccaccuuccagagcugcgccgugagcgccaacagcugcggcggcgacgacagauuccuggugggcagaggcgugcagaucggcagcccccaccaccaccaccaccaccaccaccaccacccccagcccgccaccuaccagaccagcggcaaccugggcgugagcuacagccacagcagcugcggccccagcuacggcagccagaacuucagcgcccccuacagccccuacgcccugaaccaggaggccgacgugagcggcggcuacccccagugcgcccccgccguguacagcggcaaccugagcagccccauggugcagcaccaccaccaccaccagggcuacgccggcggcgccgugggcagcccccaguacauccaccacagcuacggccaggagcaccagagccuggcccuggccaccuacaacaacagccugagcccccugcacgccagccaccaggaggccugcagaagccccgccagcgagaccagcagccccgcccagaccuucgacuggaugaaggugaagagaaacccccccaagaccggcaaggugggcgaguacggcuaccugggccagcccaacgccgugagaaccaacuucaccaccaagcagcugaccgagcuggagaaggaguuccacuucaacaaguaccugaccagagccagaagaguggagaucgccgccagccugcagcugaacgagacccaggugaagaucugguuccagaacagaagaaugaagcagaagaagagagagaaggagggccugcugcccaucagccccgccaccccccccggcaacgacgagaaggccgaggagagcagcgagaagagcagcagcagccccugcgugcccagccccggcagcagcaccagcgacacccugaccaccagccacuaa

SEQ ID NO: 18160 - RNA, 1131 nt, Artificial Sequence
  HOXA2__Homo_sapiens__NP_006726
augaacuacgaguucgagagagagaucggcuucaucaacagccagcccagccuggccgagugccugaccagcuucccccccguggccgacaccuuccagagcagcagcaucaagaccagcacccugagccacagcacccugauccccccccccuucgagcagaccauccccagccugaaccccggcagccaccccagacacggcgccggcggcagacccaagcccagccccgccggcagcagaggcagccccgugcccgccggcgcccugcagccccccgaguaccccuggaugaaggagaagaaggccgccaagaagaccgcccugcugcccgccgccgccgccgccgccaccgccgccgccaccggccccgccugccugagccacaaggagagccuggagaucgccgacggcagcggcggcggcagcagaagacugagaaccgccuacaccaacacccagcugcuggagcuggagaaggaguuccacuucaacaaguaccugugcagacccagaagaguggagaucgccgcccugcuggaccugaccgagagacaggugaaggugugguuccagaacagaagaaugaagcacaagagacagacccagugcaaggagaaccagaacagcgagggcaagugcaagagccuggaggacagcgagaagguggaggaggacgaggaggagaagacccuguucgagcaggcccugagcgugagcggcgcccugcuggagagagagggcuacaccuuccagcagaacgcccugagccagcagcaggcccccaacggccacaacggcgacagccagagcuuccccgugagcccccugaccagcaacgagaagaaccugaagcacuuccagcaccagagccccaccgugcccaacugccugagcaccaugggccagaacugcggcgccggccugaacaacgacagccccgaggcccuggaggugcccagccugcaggacuucagcguguucagcaccgacagcugccugcagcugagcgacgccgugagccccagccugcccggcagccuggacagccccguggacaucagcgccgacagccuggacuucuucaccgacacccugaccaccaucgaccugcagcaccugaacuacuaa

SEQ ID NO: 18161 - RNA, 1332 nt, Artificial Sequence
  HOXA3__Homo_sapiens__XP_005249788
augcagaaggccaccuacuacgacagcagcgccaucuacggcggcuaccccuaccaggccgccaacggcuucgccuacaacgccaaccagcagcccuaccccgccagcgccgcccugggcgccgacggcgaguaccacagacccgccugcagccugcagagccccagcagcgccggcggccaccccaaggcccacgagcugagcgaggccugccugagaacccugagcgccccccccagccagccccccagccugggcgagcccccccugcaccccccccccccccaggccgccccccccgccccccagcccccccagcccgccccccagccccccgcccccacccccgccgccccccccccccccagcagcgccagccccccccagaacgccagcaacaaccccacccccgccaacgccgccaagagcccccugcugaacagccccaccguggccaagcagaucuuccccuggaugaaggagagcagacagaacaccaagcagaagaccagcagcagcagcagcggcgagagcugcgccggcgacaagagcccccccggccaggccagcagcaagagagccagaaccgccuacaccagcgcccagcugguggagcuggagaaggaguuccacuucaacagauaccugugcagacccagaagaguggagauggccaaccugcugaaccugaccgagagacagaucaagaucugguuccagaacagaagaaugaaguacaagaaggaccagaagggcaagggcaugcugaccagcagcggcggccagagccccagcagaagccccgugccccccggcgccggcggcuaccugaacagcaugcacagccuggugaacagcgugcccuacgagccccagagccccccccccuucagcaagcccccccagggcaccuacggccugccccccgccagcuaccccgccagccugcccagcugcgccccccccccccccccccagaagagauacaccgccgccggcgccggcgccggcggcacccccgacuacgacccccacgcccacggccugcagggcaacggcagcuacggcaccccccacauccagggcagccccguguucgugggcggcagcuacguggagcccaugagcaacagcggccccgcccuguucggccugacccaccugccccacgccgccagcggcgccauggacuacggcggcgccggcccccugggcagcggccaccaccacggccccggccccggcgagccccaccccaccuacaccgaccugaccggccaccaccccagccagggcagaauccaggaggcccccaagcugacccaccuguaa

SEQ ID NO: 18162 - RNA, 963 nt, Artificial Sequence
  HOXA4__Homo_sapiens__NP_002132
augaccaugagcagcuuccugaucaacagcaacuacaucgagcccaaguucccccccuucgaggaguacgcccagcacagcggcagcggcggcgccgacggcggccccggcggcggccccggcuaccagcagccccccgccccccccacccagcaccugccccugcagcagccccagcugccccacgccggcggcggcagagagcccaccgccagcuacuacgcccccagaaccgccagagagcccgccuaccccgccgccgcccuguaccccgcccacggcgccgccgacaccgccuaccccuacggcuacagaggcggcgccagccccggcagacccccccagcccgagcagccccccgcccaggccaagggccccgcccacggccugcacgccagccacgugcugcagccccagcugccccccccccugcagcccagagccgugccccccgccgcccccagaagaugcgaggccgcccccgccacccccggcgugcccgccggcggcagcgcccccgccugcccccugcugcuggccgacaagagcccccugggccugaagggcaaggagcccgugguguaccccuggaugaagaagauccacgugagcgccgugaaccccagcuacaacggcggcgagcccaagagaagcagaaccgccuacaccagacagcaggugcuggagcuggagaaggaguuccacuucaacagauaccugaccagaagaagaagaaucgagaucgcccacacccugugccugagcgagagacaggugaagaucugguuccagaacagaagaaugaaguggaagaaggaccacaagcugcccaacaccaagaugagaagcagcaacagcgccagcgccagcgccggcccccccggcaaggcccagacccagagcccccaccugcacccccacccccaccccagcaccagcacccccgugcccagcagcaucuaa

SEQ ID NO: 18163 - RNA, 813 nt, Artificial Sequence
  HOXA5__Homo_sapiens__NP_061975
augagcagcuacuucgugaacagcuucugcggcagauaccccaacggccccgacuaccagcugcacaacuacggcgaccacagcagcgugagcgagcaguucagagacagcgccagcaugcacagcggcagauacggcuacggcuacaacggcauggaccugagcgugggcagaagcggcagcggccacuucggcagcggcgagagagccagaagcuacgccgccagcgccagcgccgcccccgccgagcccagauacagccagcccgccaccagcacccacagcccccagcccgacccccugcccugcagcgccguggcccccagccccggcagcgacagccaccacggcggcaagaacagccugagcaacagcagcggcgccagcgccgacgccggcagcacccacaucagcagcagagagggcgugggcaccgccagcggcgccgaggaggacgcccccgccagcagcgagcaggccagcgcccagagcgagcccagccccgccccccccgcccagccccagaucuaccccuggaugagaaagcugcacaucagccacgacaacaucggcggccccgagggcaagagagccagaaccgccuacaccagauaccagacccuggagcuggagaaggaguuccacuucaacagauaccugaccagaagaagaagaaucgagaucgcccacgcccugugccugagcgagagacagaucaagaucugguuccagaacagaagaaugaaguggaagaaggacaacaagcugaagagcaugagcauggccgccgccggcggcgccuucagacccuaa

SEQ ID NO: 18164 - RNA, 702 nt, Artificial Sequence
  HOXA6__Homo_sapiens__NP_076919
augagcagcuacuucgugaaccccaccuuccccggcagccugcccagcggccaggacagcuuccugggccagcugccccuguaccaggccggcuacgacgcccugagacccuuccccgccagcuacggcgccagcagccugcccgacaagaccuacaccagccccugcuucuaccagcagagcaacagcgugcuggccugcaacagagccagcuacgaguacggcgccagcugcuucuacagcgacaaggaccugagcggcgccagccccagcggcagcggcaagcagagaggccccggcgacuaccugcacuucagccccgagcagcaguacaagcccgacagcagcagcggccagggcaaggcccugcacgacgagggcgccgacagaaaguacaccagccccguguaccccuggaugcagagaaugaacagcugcgccggcgccguguacggcagccacggcagaagaggcagacagaccuacaccagauaccagacccuggagcuggagaaggaguuccacuucaacagauaccugaccagaagaagaagaaucgagaucgccaacgcccugugccugaccgagagacagaucaagaucugguuccagaacagaagaaugaaguggaagaaggagaacaagcugaucaacagcacccagcccagcggcgaggacagcgaggccaaggccggcgaguaa

SEQ ID NO: 18165 - RNA, 693 nt, Artificial Sequence
  HOXA7__Homo_sapiens__NP_008827
augagcagcagcuacuacgugaacgcccuguucagcaaguacaccgccggcgccagccuguuccagaacgccgagcccaccagcugcagcuucgcccccaacagccagagaagcggcuacggcgccggcgccggcgccuucgccagcaccgugcccggccuguacaacgugaacagcccccuguaccagagccccuucgccagcggcuacggccugggcgccgacgccuacggcaaccugcccugcgccagcuacgaccagaacauccccggccugugcagcgaccuggccaagggcgccugcgacaagaccgacgagggcgcccugcacggcgccgccgaggccaacuucagaaucuaccccuggaugagaagcagcggccccgacagaaagagaggcagacagaccuacaccagauaccagacccuggagcuggagaaggaguuccacuucaacagauaccugaccagaagaagaagaaucgagaucgcccacgcccugugccugaccgagagacagaucaagaucugguuccagaacagaagaaugaaguggaagaaggagcacaaggacgagggccccaccgccgccgccgcccccgagggcgccgugcccagcgccgccgccaccgccgccgccgacaaggccgacgaggaggacgacgacgaggaggaggaggacgaggaggaguaa

SEQ ID NO: 18166 - RNA, 819 nt, Artificial Sequence
  HOXA9__Homo_sapiens__NP_689952
auggccaccaccggcgcccugggcaacuacuacguggacagcuuccugcugggcgccgacgccgccgacgagcugagcgugggcagauacgcccccggcacccugggccagccccccagacaggccgccacccuggccgagcaccccgacuucagccccugcagcuuccagagcaaggccaccguguucggcgccagcuggaaccccgugcacgccgccggcgccaacgccgugcccgccgccguguaccaccaccaccaccaccaccccuacgugcacccccaggcccccguggccgccgccgcccccgacggcagauacaugagaagcuggcuggagcccacccccggcgcccugagcuucgccggccugcccagcagcagacccuacggcaucaagcccgagccccugagcgccagaagaggcgacugccccacccuggacacccacacccugagccugaccgacuacgccugcggcagcccccccguggacagagagaagcagcccagcgagggcgccuucagcgagaacaacgccgagaacgagagcggcggcgacaagccccccaucgaccccaacaaccccgccgccaacuggcugcacgccagaagcaccagaaagaagagaugccccuacaccaagcaccagacccuggagcuggagaaggaguuccuguucaacauguaccugaccagagacagaagauacgagguggccagacugcugaaccugaccgagagacaggugaagaucugguuccagaacagaagaaugaagaugaagaagaucaacaaggacagagccaaggacgaguaa

SEQ ID NO: 18167 - RNA, 855 nt, Artificial Sequence
  HOXB13__Homo_sapiens__NP_006352
auggagcccggcaacuacgccacccuggacggcgccaaggacaucgagggccugcugggcgccggcggcggcagaaaccugguggcccacagcccccugaccagccaccccgccgcccccacccugaugcccgccgugaacuacgccccccuggaccugcccggcagcgccgagccccccaagcagugccaccccugccccggcgugccccagggcaccagccccgcccccgugcccuacggcuacuucggcggcggcuacuacagcugcagagugagcagaagcagccugaagcccugcgcccaggccgccacccuggccgccuaccccgccgagacccccaccgccggcgaggaguaccccagcagacccaccgaguucgccuucuaccccggcuaccccggcaccuaccagcccauggccagcuaccuggacgugagcguggugcagacccugggcgcccccggcgagcccagacacgacagccugcugcccguggacagcuaccagagcugggcccuggccggcggcuggaacagccagaugugcugccagggcgagcagaacccccccggccccuucuggaaggccgccuucgccgacagcagcggccagcacccccccgacgccugcgccuucagaagaggcagaaagaagagaauccccuacagcaagggccagcugagagagcuggagagagaguacgccgccaacaaguucaucaccaaggacaagagaagaaagaucagcgccgccaccagccugagcgagagacagaucaccaucugguuccagaacagaagagugaaggagaagaaggugcuggccaaggugaagaacagcgccacccccuaa

SEQ ID NO: 18168 - RNA, 906 nt, Artificial Sequence
  HOXB1__Homo_sapiens__NP_002135
auggacuacaacagaaugaacagcuuccuggaguacccccugugcaacagaggccccagcgccuacagcgcccacagcgcccccaccagcuucccccccagcagcgcccaggccguggacagcuacgccagcgagggcagauacggcggcggccugagcagccccgccuuccagcagaacagcggcuaccccgcccagcagccccccagcacccugggcgugcccuuccccagcagcgcccccagcggcuacgcccccgccgccugcagccccagcuacggccccagccaguacuacccccugggccagagcgagggcgacggcggcuacuuccaccccagcagcuacggcgcccagcugggcggccugagcgacggcuacggcgccggcggcgccggccccggccccuaccccccccagcacccccccuacggcaacgagcagaccgccagcuucgcccccgccuacgccgaccugcugagcgaggacaaggagacccccugccccagcgagcccaacacccccaccgccagaaccuucgacuggaugaaggugaagagaaacccccccaagaccgccaaggugagcgagcccggccugggcagccccagcggccugagaaccaacuucaccaccagacagcugaccgagcuggagaaggaguuccacuucaacaaguaccugagcagagccagaagaguggagaucgccgccacccuggagcugaacgagacccaggugaagaucugguuccagaacagaagaaugaagcagaagaagagagagagagaggagggcagagugccccccgccccccccggcugccccaaggaggccgccggcgacgccagcgaccagagcaccugcaccagccccgaggccagccccagcagcgugaccagcuaa

SEQ ID NO: 18169 - RNA, 1071 nt, Artificial Sequence
  HOXB2__Homo_sapiens__NP_002136
augaacuucgaguucgagagagagaucggcuucaucaacagccagcccagccuggccgagugccugaccagcuuccccgccgugcuggagaccuuccagaccagcagcaucaaggagagcacccugauccccccccccccccccuucgagcagaccuuccccagccugcagcccggcgccagcacccugcagagacccagaagccagaagagagccgaggacggccccgcccugccccccccccccccccccccccugcccgccgccccccccgcccccgaguuccccuggaugaaggagaagaagagcgccaagaagcccagccagagcgccaccagccccagccccgccgccagcgccgugcccgccagcggcgugggcagccccgccgacggccugggccugcccgaggccggcggcggcggcgccagaagacugagaaccgccuacaccaacacccagcugcuggagcuggagaaggaguuccacuucaacaaguaccugugcagacccagaagaguggagaucgccgcccugcuggaccugaccgagagacaggugaaggugugguuccagaacagaagaaugaagcacaagagacagacccagcacagagagccccccgacggcgagcccgccugccccggcgcccuggaggacaucugcgaccccgccgaggagcccgccgccagccccggcggccccagcgccagcagagccgccugggaggccugcugccacccccccgagguggugcccggcgcccugagcgccgaccccagaccccuggccgugagacuggagggcgccggcgccagcagccccggcugcgcccugagaggcgccggcggccuggagcccggcccccugcccgaggacguguucagcggcagacaggacagccccuuccugcccgaccugaacuucuucgccgccgacagcugccugcagcugagcggcggccugagccccagccugcagggcagccuggacagccccgugcccuucagcgaggaggagcuggacuucuucaccagcacccugugcgccaucgaccugcaguuccccuaa

SEQ ID NO: 18170 - RNA, 900 nt, Artificial Sequence
  HOXB3__Homo_sapiens__XP_005257339
augaaggagagcagacagaccagcaagcugaagaacaacagccccggcaccgccgagggcugcggcggcggcggcggcggcggcggcggcggcggcagcggcggcagcggcggcggcggcggcggcggcggcggcggcgacaagagcccccccggcagcgccgccagcaagagagccagaaccgccuacaccagcgcccagcugguggagcuggagaaggaguuccacuucaacagauaccugugcagacccagaagaguggagauggccaaccugcugaaccugagcgagagacagaucaagaucugguuccagaacagaagaaugaaguacaagaaggaccagaaggccaagggccuggccagcagcagcggcggccccagccccgccggcagccccccccagcccaugcagagcaccgccggcuucaugaacgcccugcacagcaugacccccagcuacgagagccccagcccccccgccuucggcaaggcccaccagaacgccuacgcccugcccagcaacuaccagcccccccugaagggcugcggcgccccccagaaguacccccccacccccgcccccgaguacgagccccacgugcugcaggccaacggcggcgccuacggcacccccaccaugcagggcagccccguguacgugggcggcggcggcuacgccgacccccugcccccccccgccggccccagccuguacggccugaaccaccugagccaccaccccagcggcaaccuggacuacaacggcgccccccccauggcccccagccagcaccacggccccugcgagccccaccccaccuacaccgaccugagcagccaccacgccccccccccccagggcagaauccaggaggcccccaagcugacccaccuguaa

SEQ ID NO: 18171 - RNA, 756 nt, Artificial Sequence
  HOXB4__Homo_sapiens__NP_076920
auggccaugagcagcuuccugaucaacagcaacuacguggaccccaaguucccccccugcgaggaguacagccagagcgacuaccugcccagcgaccacagccccggcuacuacgccggcggccagagaagagagagcagcuuccagcccgaggccggcuucggcagaagagccgccugcaccgugcagagauacgccgccugcagagaccccggccccccccccccccccccccccccccccccccccccccccccccccggccugagccccagagcccccgcccccccccccgccggcgcccugcugcccgagcccggccagagaugcgaggccgugagcagcagccccccccccccccccugcgcccagaacccccugcaccccagccccagccacagcgccugcaaggagcccgugguguaccccuggaugagaaaggugcacgugagcaccgugaaccccaacuacgccggcggcgagcccaagagaagcagaaccgccuacaccagacagcaggugcuggagcuggagaaggaguuccacuacaacagauaccugaccagaagaagaagaguggagaucgcccacgcccugugccugagcgagagacagaucaagaucugguuccagaacagaagaaugaaguggaagaaggaccacaagcugcccaacaccaagaucagaagcggcggcgccgccggcagcgccggcggcccccccggcagacccaacggcggccccagagcccuguaa

SEQ ID NO: 18172 - RNA, 810 nt, Artificial Sequence
  HOXB5__Homo_sapiens__NP_002138
augagcagcuacuucgugaacagcuucagcggcagauaccccaacggccccgacuaccagcugcugaacuacggcagcggcagcagccugagcggcagcuacagagaccccgccgccaugcacaccggcagcuacggcuacaacuacaacggcauggaccugagcgugaacagaagcagcgccagcagcagccacuucggcgccgugggcgagagcagcagagccuuccccgcccccgcccaggagcccagauucagacaggccgccagcagcugcagccugagcagccccgagagccugcccugcaccaacggcgacagccacggcgccaagcccagcgccagcagccccagcgaccaggccaccagcgccagcagcagcgccaacuucaccgagaucgacgaggccagcgccagcagcgagcccgaggaggccgccagccagcugagcagccccagccuggccagagcccagcccgagcccauggccaccagcaccgccgcccccgagggccagaccccccagaucuuccccuggaugagaaagcugcacaucagccacgacaugaccggccccgacggcaagagagccagaaccgccuacaccagauaccagacccuggagcuggagaaggaguuccacuucaacagauaccugaccagaagaagaagaaucgagaucgcccacgcccugugccugagcgagagacagaucaagaucugguuccagaacagaagaaugaaguggaagaaggacaacaagcugaagagcaugagccuggccaccgccggcagcgccuuccagcccuaa

SEQ ID NO: 18173 - RNA, 675 nt, Artificial Sequence
  HOXB6__Homo_sapiens__XP_005257340
augagcagcuacuucgugaacagcaccuuccccgugacccuggccagcggccaggagagcuuccugggccagcugccccuguacagcagcggcuacgccgacccccugagacacuaccccgcccccuacggccccggccccggccaggacaagggcuucgccaccagcagcuacuacccccccgccggcggcggcuacggcagagccgcccccugcgacuacggccccgcccccgccuucuacagagagaaggagagcgccugcgcccugagcggcgccgacgagcagccccccuuccaccccgagcccagaaagagcgacugcgcccaggacaagagcguguucggcgagaccgaggagcagaagugcagcacccccguguaccccuggaugcagagaaugaacagcugcaacagcagcagcuucggccccagcggcagaagaggcagacagaccuacaccagauaccagacccuggagcuggagaaggaguuccacuacaacagauaccugaccagaagaagaagaaucgagaucgcccacgcccugugccugaccgagagacagaucaagaucugguuccagaacagaagaaugaaguggaagaaggagagcaagcugcugagcgccagccagcugagcgccgaggaggaggaggagaagcaggccgaguaa

SEQ ID NO: 18174 - RNA, 654 nt, Artificial Sequence
  HOXB7__Homo_sapiens__NP_004493
augagcagccuguacuacgccaacacccuguucagcaaguaccccgccagcagcagcguguucgccaccggcgccuuccccgagcagaccagcugcgccuucgccagcaacccccagagacccggcuacggcgccggcagcggcgccagcuucgccgccagcaugcagggccuguaccccggcggcggcggcauggccggccagagcgccgccggcguguacgccgccggcuacggccuggagcccagcagcuucaacaugcacugcgcccccuucgagcagaaccugagcggcgugugccccggcgacagcgccaaggccgccggcgccaaggagcagagagacagcgaccuggccgccgagagcaacuucagaaucuaccccuggaugagaagcagcggcaccgacagaaagagaggcagacagaccuacaccagauaccagacccuggagcuggagaaggaguuccacuacaacagauaccugaccagaagaagaagaaucgagaucgcccacacccugugccugaccgagagacagaucaagaucugguuccagaacagaagaaugaaguggaagaaggagaacaagaccgccggccccggcaccaccggccaggacagagccgaggccgaggaggaggaggaggaguaa

SEQ ID NO: 18175 - RNA, 732 nt, Artificial Sequence
  HOXB8__Homo_sapiens__NP_076921
augagcagcuacuucgugaacagccuguucagcaaguacaagaccggcgagagccugagacccaacuacuacgacugcggcuucgcccaggaccugggcggcagacccaccgugguguacggccccagcagcggcggcagcuuccagcaccccagccagauccaggaguucuaccacggccccagcagccugagcaccgcccccuaccagcagaaccccugcgccguggccugccacggcgaccccggcaacuucuacggcuacgacccccugcagagacagagccuguucggcgcccaggaccccgaccuggugcaguacgccgacugcaagcuggccgccgccagcggccugggcgaggaggccgagggcagcgagcagagccccagccccacccagcuguuccccuggaugagaccccaggccgccgccggcagaagaagaggcagacagaccuacagcagauaccagacccuggagcuggagaaggaguuccuguucaaccccuaccugaccagaaagagaagaaucgaggugagccacgcccugggccugaccgagagacaggugaagaucugguuccagaacagaagaaugaaguggaagaaggagaacaacaaggacaaguuccccagcagcaagugcgagcaggaggagcuggagaagcagaagcuggagagagcccccgaggccgccgacgagggcgacgcccagaagggcgacaagaaguaa

SEQ ID NO: 18176 - RNA, 753 nt, Artificial Sequence
  HOXB9__Homo_sapiens__NP_076922
augagcaucagcggcacccugagcagcuacuacguggacagcaucaucagccacgagagcgaggacgccccccccgccaaguuccccagcggccaguacgccagcagcagacagcccggccacgccgagcaccuggaguuccccagcugcagcuuccagcccaaggcccccguguucggcgccagcugggccccccugagcccccacgccagcggcagccugcccagcguguaccaccccuacauccagccccagggcgugccccccgccgagagcagauaccugagaaccuggcuggagcccgcccccagaggcgaggccgcccccggccagggccaggccgccgugaaggccgagccccugcugggcgcccccggcgagcugcugaagcagggcacccccgaguacagccuggagaccagcgccggcagagaggccgugcugagcaaccagagacccggcuacggcgacaacaagaucugcgagggcagcgaggacaaggagagacccgaccagaccaaccccagcgccaacuggcugcacgccagaagcagcagaaagaagagaugccccuacaccaaguaccagacccuggagcuggagaaggaguuccuguucaacauguaccugaccagagacagaagacacgagguggccagacugcugaaccugagcgagagacaggugaagaucugguuccagaacagaagaaugaagaugaagaagaugaacaaggagcagggcaaggaguaa

SEQ ID NO: 18177 - RNA, 1029 nt, Artificial Sequence
  HOXC10__Homo_sapiens__NP_059105
augaccugccccagaaacgugacccccaacagcuacgccgagccccuggccgcccccggcggcggcgagagauacagcagaagcgccggcauguacaugcagagcggcagcgacuucaacugcggcgugaugagaggcugcggccuggcccccagccugagcaagagagacgagggcagcagccccagccuggcccugaacaccuaccccagcuaccugagccagcuggacagcuggggcgaccccaaggccgccuacagacuggagcagcccgugggcagaccccugagcagcugcagcuacccccccagcgugaaggaggagaacgugugcugcauguacagcgccgagaagagagccaagagcggccccgaggccgcccuguacagccacccccugcccgagagcugccugggcgagcacgaggugcccgugcccagcuacuacagagccagccccagcuacagcgcccuggacaagaccccccacugcagcggcgccaacgacuucgaggcccccuucgagcagagagccagccugaaccccagagccgagcaccuggagagcccccagcugggcggcaaggugagcuuccccgagacccccaagagcgacagccagacccccagccccaacgagaucaagaccgagcagagccuggccggccccaagggcagccccagcgagagcgagaaggagagagccaaggccgccgacagcagccccgacaccagcgacaacgaggccaaggaggagaucaaggccgagaacaccaccggcaacuggcugaccgccaagagcggcagaaagaagagaugccccuacaccaagcaccagacccuggagcuggagaaggaguuccuguucaacauguaccugaccagagagagaagacuggagaucagcaagaccaucaaccugaccgacagacaggugaagaucugguuccagaacagaagaaugaagcugaagaagaugaacagagagaacagaaucagagagcugaccagcaacuucaacuucaccuaa

SEQ ID NO: 18178 - RNA, 915 nt, Artificial Sequence
  HOXC11__Homo_sapiens__NP_055027
auguucaacagcgugaaccugggcaacuucugcagccccagcagaaaggagagaggcgccgacuucggcgagagaggcagcugcgccagcaaccuguaccugcccagcugcaccuacuacaugcccgaguucagcaccgugagcagcuuccugccccaggcccccagcagacagaucagcuaccccuacagcgcccaggugccccccgugagagaggugagcuacggccuggagcccagcggcaaguggcaccacagaaacagcuacagcagcugcuacgccgccgccgacgagcugaugcacagagagugccugccccccagcaccgugaccgagauccugaugaagaacgagggcagcuacggcggccaccaccaccccagcgccccccacgccacccccgccggcuucuacagcagcgugaacaagaacagcgugcugccccaggccuucgacagauucuucgacaacgccuacugcggcggcggcgacccccccgccgagccccccugcagcggcaagggcgaggccaagggcgagcccgaggccccccccgccagcggccuggccagcagagccgaggccggcgccgaggccgaggccgaggaggagaacaccaaccccagcagcagcggcagcgcccacagcguggccaaggagcccgccaagggcgccgcccccaacgcccccagaaccagaaagaagagaugccccuacagcaaguuccagaucagagagcuggagagagaguucuucuucaacguguacaucaacaaggagaagagacugcagcugagcagaaugcugaaccugaccgacagacaggugaagaucugguuccagaacagaagaaugaaggagaagaagcugagcagagacagacugcaguacuucagcggcaacccccugcuguaa

SEQ ID NO: 18179 - RNA, 849 nt, Artificial Sequence
  HOXC12__Homo_sapiens__NP_776272
augggcgagcacaaccugcugaaccccggcuucgugggcccccuggugaacauccacaccggcgacaccuucuacuuccccaacuucagagccagcggcgcccagcugcccggccugcccagccugagcuaccccagaagagacaacgugugcagccugagcuggcccagcgccgagcccugcaacggcuacccccagcccuaccugggcagccccgugagccugaacccccccuucggcagaaccugcgagcuggccagaguggaggacggcaagggcuacuacagagagcccugcgccgagggcggcggcggcggccugaagagagaggagagaggcagagaccccggcgccggccccggcgccgcccugcugccccuggagcccagcggcccccccgcccugggcuucaaguacgacuacgccgccggcggcggcggcggcgacggcggcggcggcgccggccccccccacgacccccccagcugccagagccuggagagcgacagcagcagcagccugcugaacgagggcaacaagggcgccggcgccggcgaccccggcagccuggugagcccccugaaccccggcggcggccugagcgccagcggcgcccccugguaccccaucaacagcagaagcagaaagaagagaaagcccuacagcaagcugcagcuggccgagcuggagggcgaguuccuggugaacgaguucaucaccagacagagaagaagagagcugagcgacagacugaaccugagcgaccagcaggugaagaucugguuccagaacagaagaaugaagaagaagagacugcugcugagagagcaggcccugagcuucuucuaa

SEQ ID NO: 18180 - RNA, 993 nt, Artificial Sequence
  HOXC13__Homo_sapiens__NP_059106
augaccaccagccugcugcugcaccccagauggcccgagagccugauguacguguacgaggacagcgccgccgagagcggcaucggcggcggcggcggcggcggcggcggcggcaccggcggcgccggcggcggcugcagcggcgccagccccggcaaggcccccagcauggacggccugggcagcagcugccccgccagccacugcagagaccugcugccccaccccgugcugggcagaccccccgccccccugggcgccccccagggcgccguguacaccgacauccccgcccccgaggccgccagacagugcgcccccccccccgccccccccaccagcagcagcgccacccugggcuacggcuaccccuucggcggcagcuacuacggcugcagacugagccacaacgugaaccugcagcagaagcccugcgccuaccaccccggcgacaaguaccccgagcccagcggcgcccugcccggcgacgaccugagcagcagagccaaggaguucgccuucuaccccagcuucgccagcagcuaccaggccaugcccggcuaccuggacgugagcguggugcccggcaucagcggccaccccgagcccagacacgacgcccugauccccguggagggcuaccagcacugggcccugagcaacggcugggacagccagguguacugcagcaaggagcagagccagagcgcccaccuguggaagagccccuuccccgacguggugccccugcagcccgaggugagcagcuacagaagaggcagaaagaagagagugcccuacaccaaggugcagcugaaggagcuggagaaggaguacgccgccagcaaguucaucaccaaggagaagagaagaagaaucagcgccaccaccaaccugagcgagagacaggugaccaucugguuccagaacagaagagugaaggagaagaagguggugagcaagagcaaggccccccaccugcacagcaccuaa

SEQ ID NO: 18181 - RNA, 795 nt, Artificial Sequence
  HOXC4__Homo_sapiens__NP_705897
augaucaugagcagcuaccugauggacagcaacuacaucgaccccaaguucccccccugcgaggaguacagccagaacagcuacauccccgagcacagccccgaguacuacggcagaaccagagagagcggcuuccagcaccaccaccaggagcuguaccccccccccccccccagacccagcuaccccgagagacaguacagcugcaccagccugcagggccccggcaacagcagaggccacggccccgcccaggccggccaccaccaccccgagaagagccagagccugugcgagcccgccccccugagcggcgccagcgccagccccagccccgccccccccgccugcagccagcccgcccccgaccaccccagcagcgccgccagcaagcagcccaucguguaccccuggaugaagaagauccacgugagcaccgugaaccccaacuacaacggcggcgagcccaagagaagcagaaccgccuacaccagacagcaggugcuggagcuggagaaggaguuccacuacaacagauaccugaccagaagaagaagaaucgagaucgcccacagccugugccugagcgagagacagaucaagaucugguuccagaacagaagaaugaaguggaagaaggaccacagacugcccaacaccaaggugagaagcgccccccccgccggcgccgcccccagcacccugagcgccgccacccccggcaccagcgaggaccacagccagagcgccaccccccccgagcagcagagagccgaggacaucaccagacuguaa

SEQ ID NO: 18182 - RNA, 669 nt, Artificial Sequence
  HOXC5__Homo_sapiens__NP_061826
augagcagcuacguggccaacagcuucuacaagcagagccccaacauccccgccuacaacaugcagaccugcggcaacuacggcagcgccagcgaggugcaggccagcagauacugcuacggcggccuggaccugagcaucaccuuccccccccccgcccccagcaacagccugcacggcguggacauggccgccaaccccagagcccaccccgacagacccgccugcagcgccgccgccgcccccggccacgcccccggcagagacgaggccgccccccugaaccccggcauguacagccagaaggccgccagacccgcccuggaggagagagccaagagcagcggcgagaucaaggaggagcaggcccagaccggccagcccgccggccugagccagccccccgcccccccccagaucuaccccuggaugaccaagcugcacaugagccacgagaccgacggcaagagaagcagaaccagcuacaccagauaccagacccuggagcuggagaaggaguuccacuucaacagauaccugaccagaagaagaagaaucgagaucgccaacaaccugugccugaacgagagacagaucaagaucugguuccagaacagaagaaugaaguggaagaaggacagcaagaugaagagcaaggaggcccuguaa

SEQ ID NO: 18183 - RNA, 708 nt, Artificial Sequence
  HOXC6__Homo_sapiens__NP_004494
augaacagcuacuucaccaaccccagccugagcugccaccuggccggcggccaggacgugcugcccaacguggcccugaacagcaccgccuacgaccccgugagacacuucagcaccuacggcgccgccguggcccagaacagaaucuacagcacccccuucuacagcccccaggagaacgugguguucagcagcagcagaggccccuacgacuacggcagcaacagcuucuaccaggagaaggacaugcugagcaacugcagacagaacacccugggccacaacacccagaccagcaucgcccaggacuucagcagcgagcagggcagaaccgccccccaggaccagaaggccagcauccagaucuaccccuggaugcagagaaugaacagccacagcggcgugggcuacggcgccgacagaagaagaggcagacagaucuacagcagauaccagacccuggagcuggagaaggaguuccacuucaacagauaccugaccagaagaagaagaaucgagaucgccaacgcccugugccugaccgagagacagaucaagaucugguuccagaacagaagaaugaaguggaagaaggagagcaaccugaccagcacccugagcggcggcggcggcggcgccaccgccgacagccugggcggcaaggaggagaagagagaggagaccgaggaggagaagcagaaggaguaa

SEQ ID NO: 18184 - RNA, 729 nt, Artificial Sequence
  HOXC8__Homo_sapiens__NP_073149
augagcagcuacuucgugaacccccuguucagcaaguacaaggccggcgagagccuggagcccgccuacuacgacugcagauucccccagagcgugggcagaagccacgcccugguguacggccccggcggcagcgcccccggcuuccagcacgccagccaccacgugcaggacuucuuccaccacggcaccagcggcaucagcaacagcggcuaccagcagaaccccugcagccugagcugccacggcgacgccagcaaguucuacggcuacgaggcccugcccagacagagccuguacggcgcccagcaggaggccagcguggugcaguaccccgacugcaagagcagcgccaacaccaacagcagcgagggccagggccaccugaaccagaacagcagccccagccugauguuccccuggaugagaccccacgcccccggcagaagaagcggcagacagaccuacagcagauaccagacccuggagcuggagaaggaguuccuguucaaccccuaccugaccagaaagagaagaaucgaggugagccacgcccugggccugaccgagagacaggugaagaucugguuccagaacagaagaaugaaguggaagaaggagaacaacaaggacaagcugcccggcgccagagacgaggagaagguggaggaggagggcaacgaggaggaggagaaggaggaggaggagaaggaggagaacaaggacuaa

SEQ ID NO: 18185 - RNA, 783 nt, Artificial Sequence
  HOXC9__Homo_sapiens__NP_008828
augagcgccaccggccccaucagcaacuacuacguggacagccugaucagccacgacaacgaggaccugcuggccagcagauuccccgccaccggcgcccaccccgccgccgccagacccagcggccuggugcccgacugcagcgacuuccccagcugcagcuucgcccccaagcccgccguguucagcaccagcugggcccccgugcccagccagagcagcgugguguaccaccccuacggcccccagccccaccugggcgccgacaccagauacaugagaaccuggcuggagccccugagcggcgccgugagcuuccccagcuuccccgccggcggcagacacuacgcccugaagcccgacgccuaccccggcagaagagccgacugcggccccggcgagggcagaagcuaccccgacuacauguacggcagccccggcgagcugagagacagagccccccagacccugcccagccccgaggccgacgcccuggccggcagcaagcacaaggaggagaaggccgaccuggaccccagcaaccccguggccaacuggauccacgccagaagcaccagaaagaagagaugccccuacaccaaguaccagacccuggagcuggagaaggaguuccuguucaacauguaccugaccagagacagaagauacgagguggccagagugcugaaccugaccgagagacaggugaagaucugguuccagaacagaagaaugaagaugaagaagaugaacaaggagaagaccgacaaggagcagagcuaa

SEQ ID NO: 18186 - RNA, 1023 nt, Artificial Sequence
  HOXD10__Homo_sapiens__NP_002139
augagcuuccccaacagcagccccgccgccaacaccuuccugguggacagccugaucagcgccugcagaagcgacagcuucuacagcagcagcgccagcauguacaugcccccccccagcgccgacaugggcaccuacggcaugcagaccugcggccugcugcccagccuggccaagagagaggugaaccaccagaacaugggcaugaacgugcaccccuacaucccccagguggacagcuggaccgaccccaacagaagcugcagaaucgagcagcccgugacccagcaggugcccaccugcagcuucaccaccaacaucaaggaggagagcaacugcugcauguacagcgacaagagaaacaagcugaucagcgccgaggugcccagcuaccagagacuggugcccgagagcugccccguggagaaccccgaggugcccgugcccggcuacuucagacugagccagaccuacgccaccggcaagacccaggaguacaacaacagccccgagggcagcagcaccgugaugcugcagcugaaccccagaggcgccgccaagccccagcugagcgccgcccagcugcagauggagaagaagaugaacgagcccgugagcggccaggagcccaccaaggugagccagguggagagccccgaggccaagggcggccugcccgaggagagaagcugccuggccgaggugagcgugagcagccccgaggugcaggagaaggagagcaaggaggagaucaagagcgacacccccaccagcaacuggcugaccgccaagagcggcagaaagaagagaugccccuacaccaagcaccagacccuggagcuggagaaggaguuccuguucaacauguaccugaccagagagagaagacuggagaucagcaagagcgugaaccugaccgacagacaggugaagaucugguuccagaacagaagaaugaagcugaagaagaugagcagagagaacagaaucagagagcugaccgccaaccugaccuucagcuaa

SEQ ID NO: 18187 - RNA, 1017 nt, Artificial Sequence
  HOXD11__Homo_sapiens__NP_067015
augaacgacuucgacgagugcggccagagcgccgccagcauguaccugcccggcugcgccuacuacguggcccccagcgacuucgccagcaagcccagcuuccugagccagcccagcagcugccagaugaccuuccccuacagcagcaaccuggccccccacgugcagcccgugagagagguggccuucagagacuacggccuggagagagccaaguggcccuacagaggcggcggcggcggcggcagcgccggcggcggcagcagcggcggcggccccggcggcggcggcggcggcgccggcggcuacgcccccuacuacgccgccgccgccgccgccgccgccgccgccgccgccgccgaggaggccgccaugcagagagagcugcugccccccgccggcagaagacccgacgugcuguucaaggcccccgagcccgugugcgccgcccccggccccccccacggccccgccggcgccgccagcaacuucuacagcgccgugggcagaaacggcauccugccccagggcuucgaccaguucuacgaggccgcccccggcccccccuucgccggcccccagcccccccccccccccgcccccccccagcccgagggcgccgccgacaagggcgaccccagaaccggcgccggcggcggcggcggcagccccugcaccaaggccacccccggcagcgagcccaagggcgccgccgagggcagcggcggcgacggcgagggcccccccggcgaggccggcgccgagaagagcagcagcgccguggccccccagagaagcagaaagaagagaugccccuacaccaaguaccagaucagagagcuggagagagaguucuucuucaacguguacaucaacaaggagaagagacugcagcugagcagaaugcugaaccugaccgacagacaggugaagaucugguuccagaacagaagaaugaaggagaagaagcugaacagagacagacugcaguacuucaccggcaacccccuguucuaa

SEQ ID NO: 18188 - RNA, 813 nt, Artificial Sequence
  HOXD12__Homo_sapiens__NP_067016
augugcgagagaagccuguacagagccggcuacgugggcagccugcugaaccugcagagccccgacagcuucuacuucagcaaccugagacccaacggcggccagcuggccgcccugccccccaucagcuaccccagaggcgcccugcccugggccgccacccccgccagcugcgcccccgcccagcccgccggcgccaccgccuucggcggcuucagccagcccuaccuggccggcagcggcccccugggccugcagccccccaccgccaaggacggccccgaggagcaggccaaguucuacgcccccgaggccgccgccggccccgaggagagaggcagaaccagacccagcuucgcccccgagagcagccuggcccccgccguggccgcccugaaggccgccaaguacgacuacgccggcgugggcagagccacccccggcagcaccacccugcugcagggcgcccccugcgcccccggcuucaaggacgacaccaagggcccccugaaccugaacaugaccgugcaggccgccggcguggccagcugccugagacccagccugcccgacggccugcccuggggcgccgcccccggcagagccagaaagaagagaaagcccuacaccaagcagcagaucgccgagcuggagaacgaguuccuggugaacgaguucaucaacagacagaagagaaaggagcugagcaacagacugaaccugagcgaccagcaggugaagaucugguuccagaacagaagaaugaagaagaagagaguggugcugagagagcaggcccuggcccuguacuaa

SEQ ID NO: 18189 - RNA, 1032 nt, Artificial Sequence
  HOXD13__Homo_sapiens__NP_000514
augagcagagccggcagcugggacauggacggccugagagccgacggcggcggcgccggcggcgcccccgccagcagcagcagcagcagcguggccgccgccgccgccagcggccagugcagaggcuuccugagcgcccccguguucgccggcacccacagcggcagagccgccgccgccgccgccgccgccgccgccgccgccgccgccgccagcggcuucgccuaccccggcaccagcgagagaaccggcagcagcagcagcagcagcagcagcgccgugguggccgccagacccgaggccccccccgccaaggagugccccgcccccacccccgccgccgccgccgccgccccccccagcgcccccgcccugggcuacggcuaccacuucggcaacggcuacuacagcugcagaaugagccacggcgugggccugcagcagaacgcccugaagagcagcccccacgccagccugggcggcuuccccguggagaaguacauggacgugagcggccuggccagcagcagcgugcccgccaacgaggugcccgccagagccaaggaggugagcuucuaccagggcuacaccagccccuaccagcacgugcccggcuacaucgacauggugagcaccuucggcagcggcgagcccagacacgaggccuacaucagcauggagggcuaccagagcuggacccuggccaacggcuggaacagccagguguacugcaccaaggaccagccccagggcagccacuucuggaagagcagcuuccccggcgacguggcccugaaccagcccgacaugugcguguacagaagaggcagaaagaagagagugcccuacaccaagcugcagcugaaggagcuggagaacgaguacgccaucaacaaguucaucaacaaggacaagagaagaagaaucagcgccgccaccaaccugagcgagagacaggugaccaucugguuccagaacagaagagugaaggacaagaagaucgugagcaagcugaaggacaccgugagcuaa

SEQ ID NO: 18190 - RNA, 987 nt, Artificial Sequence
  HOXD1__Homo_sapiens__NP_078777
augagcagcuaccuggaguacgugagcugcagcagcagcggcggcgugggcggcgacgugcugagccuggcccccaaguucugcagaagcgacgccagacccguggcccugcagcccgccuucccccugggcaacggcgacggcgccuucgugagcugccugccccuggccgccgccagacccagccccagcccccccgccgcccccgccagacccagcgugcccccccccgccgccccccaguacgcccagugcacccuggagggcgccuacgagcccggcgccgcccccgccgccgccgccggcggcgccgacuacggcuuccugggcagcggccccgccuacgacuuccccggcgugcugggcagagccgccgacgacggcggcagccacgugcacuacgccaccagcgccguguucagcggcggcggcagcuuccugcugagcggccagguggacuacgccgccuucggcgagcccggccccuuccccgccugccugaaggccagcgccgacggccaccccggcgccuuccagaccgccagccccgcccccggcaccuaccccaagagcgugagccccgccagcggccugcccgccgccuucagcaccuucgaguggaugaaggugaagagaaacgccagcaagaagggcaagcuggccgaguacggcgccgccagccccagcagcgccaucagaaccaacuucagcaccaagcagcugaccgagcuggagaaggaguuccacuucaacaaguaccugaccagagccagaagaaucgagaucgccaacugccugcaccugaacgacacccaggugaagaucugguuccagaacagaagaaugaagcagaagaagagagagagagagggccugcuggccaccgccauccccguggccccccugcagcugccccugagcggcaccacccccaccaaguucaucaagaaccccggcagccccagccagagccaggagcccagcuaa

SEQ ID NO: 18191 - RNA, 1299 nt, Artificial Sequence
  HOXD3__Homo_sapiens__XP_006712540
augcuguucgagcagggccagcaggcccuggagcugcccgagugcaccaugcagaaggccgccuacuacgagaaccccggccuguucggcggcuacggcuacagcaagaccaccgacaccuacggcuacagcaccccccaccagcccuaccccccccccgccgccgccagcagccuggacaccgacuaccccggcagcgccugcagcauccagagcagcgccccccugagagcccccgcccacaagggcgccgagcugaacggcagcugcaugagacccggcaccggcaacagccagggcggcggcggcggcagccagccccccggccugaacagcgagcagcagcccccccagccccccccccccccccccacccugccccccagcagccccaccaaccccggcggcggcgugcccgccaagaagcccaagggcggccccaacgccagcagcagcagcgccaccaucagcaagcagaucuuccccuggaugaaggagagcagacagaacagcaagcagaagaacagcugcgccaccgccggcgagagcugcgaggacaagagcccccccggccccgccagcaagagagugagaaccgccuacaccagcgcccagcugguggagcuggagaaggaguuccacuucaacagauaccugugcagacccagaagaguggagauggccaaccugcugaaccugaccgagagacagaucaagaucugguuccagaacagaagaaugaaguacaagaaggaccagaaggccaagggcauccugcacagccccgccagccagagccccgagagaagccccccccugggcggcgccgccggccacguggccuacagcggccagcugccccccgugcccggccuggccuacgacgcccccagcccccccgccuucgccaagagccagcccaacauguacggccuggccgccuacaccgccccccugagcagcugccugccccagcagaagagauacgccgcccccgaguucgagccccaccccauggccagcaacggcggcggcuucgccagcgccaaccugcagggcagccccguguacgugggcggcaacuucguggagagcauggcccccgccagcggccccguguucaaccugggccaccugagccaccccagcagcgccagcguggacuacagcugcgccgcccagauccccggcaaccaccaccacggccccugcgacccccaccccaccuacaccgaccugagcgcccaccacagcagccagggcagacugcccgaggcccccaagcugacccaccuguaa

SEQ ID NO: 18192 - RNA, 768 nt, Artificial Sequence
  HOXD4__Homo_sapiens__NP_055436
auggugaugagcagcuacauggugaacagcaaguacguggaccccaaguucccccccugcgaggaguaccugcagggcggcuaccugggcgagcagggcgccgacuacuacggcggcggcgcccagggcgccgacuuccagccccccggccuguaccccagacccgacuucggcgagcagcccuucggcggcagcggccccggccccggcagcgcccugcccgccagaggccacggccaggagcccggcggccccggcggccacuacgccgcccccggcgagcccugccccgccccccccgcccccccccccgccccccugcccggcgccagagccuacagccagagcgaccccaagcagccccccagcggcaccgcccugaagcagcccgccgugguguaccccuggaugaagaaggugcacgugaacagcgugaaccccaacuacaccggcggcgagcccaagagaagcagaaccgccuacaccagacagcaggugcuggagcuggagaaggaguuccacuucaacagauaccugaccagaagaagaagaaucgagaucgcccacacccugugccugagcgagagacagaucaagaucugguuccagaacagaagaaugaaguggaagaaggaccacaagcugcccaacaccaagggcagaagcagcagcagcagcagcagcagcagcugcagcagcagcguggcccccagccagcaccugcagcccauggccaaggaccaccacaccgaccugaccacccuguaa

SEQ ID NO: 18193 - RNA, 870 nt, Artificial Sequence
  HOXD8__Homo_sapiens__NP_001186675
augagcagcuacuucgugaacccccuguacagcaaguacaaggccgccgccgccgccgccgccgccgccggcgaggccaucaaccccaccuacuacgacugccacuucgcccccgaggugggcggcagacacgccgccgccgccgccgcccugcagcuguacggcaacagcgccgccggcuucccccacgcccccccccaggcccacgcccacccccaccccagccccccccccagcggcaccggcugcggcggcagagagggcagaggccaggaguacuuccaccccggcggcggcagccccgccgccgccuaccaggccgccccccccccccccccccaccccccccccccccccccccccccccccugcggcggcaucgccugccacggcgagcccgccaaguucuacggcuacgacaaccugcagagacagcccaucuucaccacccagcaggaggccgagcuggugcaguaccccgacugcaagagcagcagcggcaacaucggcgaggaccccgaccaccugaaccagagcagcagccccagccagauguuccccuggaugagaccccaggcccccggcagaagaagaggcagacagaccuacagcagauuccagacccuggagcuggagaaggaguuccuguucaaccccuaccugaccagaaagagaagaaucgaggugagccacgcccuggcccugaccgagagacaggugaagaucugguuccagaacagaagaaugaaguggaagaaggagaacaacaaggacaaguuccccgugagcagacaggaggugaaggacggcgagaccaagaaggaggcccaggagcuggaggaggacagagccgagggccugaccaacuaa

SEQ ID NO: 18194 - RNA, 1059 nt, Artificial Sequence
  HOXD9__Homo_sapiens__NP_055028
augcugggcggcagcgccggcagacugaagaugagcagcagcggcacccugagcaacuacuacguggacagccugaucggccacgagggcgacgagguguucgccgccagauucggcccccccggccccggcgcccagggcagacccgccggcguggccgacggccccgccgccaccgccgccgaguucgccagcugcagcuucgcccccagaagcgccguguucagcgccagcuggagcgccgugcccagccagccccccgccgccgccgccaugagcggccuguaccaccccuacgugcccccccccccccuggccgccagcgccagcgagcccggcagauacgugagaagcuggauggagccccugcccggcuuccccggcggcgccggcggcggcggcggcggcggcggcggcggccccggcagaggccccagccccggccccagcggccccgccaacggcagacacuacggcaucaagcccgagaccagagccgcccccgcccccgccaccgccgccagcaccaccagcagcagcagcaccagccugagcagcagcagcaagagaaccgagugcagcguggccagagagagccagggcagcagcggccccgaguucagcugcaacagcuuccugcaggagaaggccgccgccgccaccggcggcaccggccccggcgccggcaucggcgccgccaccggcaccggcggcagcagcgagcccagcgccugcagcgaccaccccauccccggcugcagccugaaggaggaggagaagcagcacagccagccccagcagcagcagcuggaccccaacaaccccgccgccaacuggauccacgccagaagcaccagaaagaagagaugccccuacaccaaguaccagacccuggagcuggagaaggaguuccuguucaacauguaccugaccagagacagaagauacgagguggccagaauccugaaccugaccgagagacaggugaagaucugguuccagaacagaagaaugaagaugaagaagaugagcaaggagaagugccccaagggcgacuaa

SEQ ID NO: 18195 - RNA, 1548 nt, Artificial Sequence
  HP1BP3__Homo_sapiens__XP_011539836
augcccaucagaagaaccgugaacagcaccagagagaccccccccaagagcaagcuggccgagggcgaggaggagaagcccgagcccgacaucagcagcgaggagagcgugagcaccguggaggagcaggagaacgagaccccccccgccaccagcagcgaggccgagcagcccaagggcgagcccgagaacgaggagaaggaggagaacaagagcagcgaggagaccaagaaggacgagaaggaccagagcaaggagaaggagaagaaggugaagaagaccauccccagcugggccacccugagcgccagccagcuggccagagcccagaagcagacccccauggccagcagccccagacccaagauggacgccauccugaccgaggccaucaaggccugcuuccagaagagcggcgccagcgugguggccaucagaaaguacaucauccacaaguaccccagccuggagcuggagagaagaggcuaccugcugaagcaggcccugaagagagagcugaacagaggcgugaucaagcaggugaagggcaagggcgccagcggcagcuucgugguggugcagaagagcagaaagaccccccagaagagcagaaacagaaagaacagaagcagcgccguggaccccgagccccaggugaagcuggaggacgugcugccccuggccuucaccagacugugcgagcccaaggaggccagcuacagccugaucagaaaguacgugagccaguacuaccccaagcugagaguggacaucagaccccagcugcugaagaacgcccugcagagagccguggagagaggccagcuggagcagaucaccggcaagggcgccagcggcaccuuccagcugaagaagagcggcgagaagccccugcugggcggcagccugauggaguacgccauccugagcgccaucgccgccaugaacgagcccaagaccugcagcaccaccgcccugaagaaguacgugcuggagaaccaccccggcaccaacagcaacuaccagaugcaccugcugaagaagacccugcagaagugcgagaagaacggcuggauggagcagaucagcggcaagggcuucagcggcaccuuccagcugugcuuccccuacuaccccagccccggcgugcuguuccccaagaaggagcccgacgacagcagagacgaggacgaggacgaggacgagagcagcgaggaggacagcgaggacgaggagcccccccccaagagaagacugcagaagaagacccccgccaagagccccggcaaggccgccagcgugaagcagagaggcagcaagcccgcccccaaggugagcgccgcccagagaggcaaggccagaccccugcccaagaaggccccccccaaggccaagacccccgccaagaagaccagacccagcagcaccgugaucaagaagcccagcggcggcagcagcaagaagcccgccaccagcgccagaaaggaggugaagcugcccggcaagggcaagagcaccaugaagaagagcuucagagugaagaaguaa

SEQ ID NO: 18196 - RNA, 582 nt, Artificial Sequence
  HPCAL1__Homo_sapiens__XP_011508650
augggcaagcagaacagcaagcugagacccgaggugcugcaggaccugagagagaacaccgaguucaccgaccacgagcugcaggagugguacaagggcuuccugaaggacugccccaccggccaccugaccguggacgaguucaagaagaucuacgccaacuucuuccccuacggcgacgccagcaaguucgccgagcacguguucagaaccuucgacaccaacggcgacggcaccaucgacuucagagaguucaucaucgcccugagcgugaccagcagaggcaagcuggagcagaagcugaagugggccuucagcauguacgaccuggacggcaacggcuacaucagcagaagcgagaugcuggagaucgugcaggccaucuacaagauggugagcagcgugaugaagaugcccgaggacgagagcacccccgagaagagaaccgacaagaucuucagacagauggacaccaacaacgacggcaagcugagccuggaggaguucaucagaggcgccaagagcgaccccagcaucgugagacugcugcagugcgaccccagcagcgccagccaguucuaa

SEQ ID NO: 18197 - RNA, 1065 nt, Artificial Sequence
  HPD__Homo_sapiens__NP_001165464
augggcuucgagccccuggccuacagaggccuggagaccggcagcagagagguggugagccacgugaucaagcagggcaagaucguguucgugcugagcagcgcccugaaccccuggaacaaggagaugggcgaccaccuggugaagcacggcgacggcgugaaggacaucgccuucgagguggaggacugcgacuacaucgugcagaaggccagagagagaggcgccaagaucaugagagagcccuggguggagcaggacaaguucggcaaggugaaguucgccgugcugcagaccuacggcgacaccacccacacccugguggagaagaugaacuacaucggccaguuccugcccggcuacgaggcccccgccuucauggacccccugcugcccaagcugcccaagugcagccuggagaugaucgaccacaucgugggcaaccagcccgaccaggagauggugagcgccagcgagugguaccugaagaaccugcaguuccacagauucuggagcguggacgacacccaggugcacaccgaguacagcagccugagaagcaucgugguggccaacuacgaggagagcaucaagaugcccaucaacgagcccgcccccggcaagaagaagagccagauccaggaguacguggacuacaacggcggcgccggcgugcagcacaucgcccugaagaccgaggacaucaucaccgccaucagacaccugagagagagaggccuggaguuccugagcgugcccagcaccuacuacaagcagcugagagagaagcugaagaccgccaagaucaaggugaaggagaacaucgacgcccuggaggagcugaagauccugguggacuacgacgagaagggcuaccugcugcagaucuucaccaagcccgugcaggacagacccacccuguuccuggaggugauccagagacacaaccaccagggcuucggcgccggcaacuucaacagccuguucaaggccuucgaggaggagcagaaccugagaggcaaccugaccaacauggagaccaacggcguggugcccggcauguaa

SEQ ID NO: 18198 - RNA, 801 nt, Artificial Sequence
  HPGD__Homo_sapiens__NP_000851
augcacgugaacggcaagguggcccuggugaccggcgccgcccagggcaucggcagagccuucgccgaggcccugcugcugaagggcgccaagguggcccugguggacuggaaccuggaggccggcgugcagugcaaggccgcccuggacgagcaguucgagccccagaagacccuguucauccagugcgacguggccgaccagcagcagcugagagacaccuucagaaaggugguggaccacuucggcagacuggacauccuggugaacaacgccggcgugaacaacgagaagaacugggagaagacccugcagaucaaccuggugagcgugaucagcggcaccuaccugggccuggacuacaugagcaagcagaacggcggcgagggcggcaucaucaucaacaugagcagccuggccggccugaugcccguggcccagcagcccguguacugcgccagcaagcacggcaucgugggcuucaccagaagcgccgcccuggccgccaaccugaugaacagcggcgugagacugaacgccaucugccccggcuucgugaacaccgccauccuggagagcaucgagaaggaggagaacaugggccaguacaucgaguacaaggaccacaucaaggacaugaucaaguacuacggcauccuggaccccccccugaucgccaacggccugaucacccugaucgaggacgacgcccugaacggcgccaucaugaagaucaccaccagcaagggcauccacuuccaggacuacgacaccacccccuuccaggccaagacccaguaa

SEQ ID NO: 18199 - RNA, 600 nt, Artificial Sequence
  HPGDS__Homo_sapiens__NP_055300
augcccaacuacaagcugaccuacuucaacaugagaggcagagccgagaucaucagauacaucuucgccuaccuggacauccaguacgaggaccacagaaucgagcaggccgacuggcccgagaucaagagcacccugcccuucggcaagauccccauccuggagguggacggccugacccugcaccagagccuggccaucgccagauaccugaccaagaacaccgaccuggccggcaacaccgagauggagcagugccacguggacgccaucguggacacccuggacgacuucaugagcugcuuccccugggccgagaagaagcaggacgugaaggagcagauguucaacgagcugcugaccuacaacgccccccaccugaugcaggaccuggacaccuaccugggcggcagagaguggcugaucggcaacagcgugaccugggccgacuucuacugggagaucugcagcaccacccugcugguguucaagcccgaccugcuggacaaccaccccagacuggugacccugagaaagaaggugcaggccauccccgccguggccaacuggaucaagagaagaccccagaccaagcuguaa

SEQ ID NO: 18200 - RNA, 1044 nt, Artificial Sequence
  HP__Homo_sapiens__NP_001119574
augagcgcccugggcgccgugaucgcccugcugcuguggggccagcuguucgccguggacagcggcaacgacgugaccgacaucgccgacgacggcugccccaagccccccgagaucgcccacggcuacguggagcacagcgugagauaccagugcaagaacuacuacaagcugagaaccgagggcgacggcguguacacccugaacaacgagaagcaguggaucaacaaggccgugggcgacaagcugcccgagugcgaggccgugugcggcaagcccaagaaccccgccaaccccgugcagagaauccugggcggccaccuggacgccaagggcagcuuccccuggcaggccaagauggugagccaccacaaccugaccaccggcgccacccugaucaacgagcaguggcugcugaccaccgccaagaaccuguuccugaaccacagcgagaacgccaccgccaaggacaucgcccccacccugacccuguacgugggcaagaagcagcugguggagaucgagaagguggugcugcaccccaacuacagccagguggacaucggccugaucaagcugaagcagaaggugagcgugaacgagagagugaugcccaucugccugcccagcaaggacuacgccgaggugggcagagugggcuacgugagcggcuggggcagaaacgccaacuucaaguucaccgaccaccugaaguacgugaugcugcccguggccgaccaggaccagugcaucagacacuacgagggcagcaccgugcccgagaagaagacccccaagagccccgugggcgugcagcccauccugaacgagcacaccuucugcgccggcaugagcaaguaccaggaggacaccugcuacggcgacgccggcagcgccuucgccgugcacgaccuggaggaggacaccugguacgccaccggcauccugagcuucgacaagagcugcgccguggccgaguacggcguguacgugaaggugaccagcauccaggacugggugcagaagaccaucgccgagaacuaa

SEQ ID NO: 18201 - RNA, 1254 nt, Artificial Sequence
  HPN__Homo_sapiens__NP_892028
auggcccagaaggagggcggcagaaccgugcccugcugcagcagacccaagguggccgcccugaccgccggcacccugcugcugcugaccgccaucggcgccgccagcugggccaucguggccgugcugcugagaagcgaccaggagccccuguaccccgugcaggugagcagcgccgacgccagacugaugguguucgacaagaccgagggcaccuggagacugcugugcagcagcagaagcaacgccagaguggccggccugagcugcgaggagaugggcuuccugagagcccugacccacagcgagcuggacgugagaaccgccggcgccaacggcaccagcggcuucuucugcguggacgagggcagacugccccacacccagagacugcuggaggugaucagcgugugcgacugccccagaggcagauuccuggccgccaucugccaggacugcggcagaagaaagcugcccguggacagaaucgugggcggcagagacaccagccugggcagauggcccuggcaggugagccugagauacgacggcgcccaccugugcggcggcagccugcugagcggcgacugggugcugaccgccgcccacugcuuccccgagagaaacagagugcugagcagauggagaguguucgccggcgccguggcccaggccagcccccacggccugcagcugggcgugcaggccgugguguaccacggcggcuaccugcccuucagagaccccaacagcgaggagaacagcaacgacaucgcccuggugcaccugagcagcccccugccccugaccgaguacauccagcccgugugccugcccgccgccggccaggcccugguggacggcaagaucugcaccgugaccggcuggggcaacacccaguacuacggccagcaggccggcgugcugcaggaggccagagugcccaucaucagcaacgacgugugcaacggcgccgacuucuacggcaaccagaucaagcccaagauguucugcgccggcuaccccgagggcggcaucgacgccugccagggcgacagcggcggccccuucgugugcgaggacagcaucagcagaacccccagauggagacugugcggcaucgugagcuggggcaccggcugcgcccuggcccagaagcccggcguguacaccaaggugagcgacuucagagaguggaucuuccaggccaucaagacccacagcgaggccagcggcauggugacccagcuguaa

SEQ ID NO: 18202 - RNA, 1047 nt, Artificial Sequence
  HPR__Homo_sapiens__NP_066275
augagcgaccugggcgccgugaucagccugcugcuguggggcagacagcuguucgcccuguacagcggcaacgacgugaccgacaucagcgacgacagauuccccaagccccccgagaucgccaacggcuacguggagcaccuguucagauaccagugcaagaacuacuacagacugagaaccgagggcgacggcguguacacccugaacgacaagaagcaguggaucaacaaggccgugggcgacaagcugcccgagugcgaggccgugugcggcaagcccaagaaccccgccaaccccgugcagagaauccugggcggccaccuggacgccaagggcagcuuccccuggcaggccaagauggugagccaccacaaccugaccaccggcgccacccugaucaacgagcaguggcugcugaccaccgccaagaaccuguuccugaaccacagcgagaacgccaccgccaaggacaucgcccccacccugacccuguacgugggcaagaagcagcugguggagaucgagaagguggugcugcaccccaacuaccaccagguggacaucggccugaucaagcugaagcagaaggugcuggugaacgagagagugaugcccaucugccugcccagcaagaacuacgccgaggugggcagagugggcuacgugagcggcuggggccagagcgacaacuucaagcugaccgaccaccugaaguacgugaugcugcccguggccgaccaguacgacugcaucacccacuacgagggcagcaccugccccaaguggaaggcccccaagagccccgugggcgugcagcccauccugaacgagcacaccuucugcgugggcaugagcaaguaccaggaggacaccugcuacggcgacgccggcagcgccuucgccgugcacgaccuggaggaggacaccugguacgccgccggcauccugagcuucgacaagagcugcgccguggccgaguacggcguguacgugaaggugaccagcauccagcacugggugcagaagaccaucgccgagaacuaa

SEQ ID NO: 18203 - RNA, 657 nt, Artificial Sequence
  HPRT1__Homo_sapiens__NP_000185
auggccaccagaagccccggcguggugaucagcgacgacgagcccggcuacgaccuggaccuguucugcauccccaaccacuacgccgaggaccuggagagaguguucaucccccacggccugaucauggacagaaccgagagacuggccagagacgugaugaaggagaugggcggccaccacaucguggcccugugcgugcugaagggcggcuacaaguucuucgccgaccugcuggacuacaucaaggcccugaacagaaacagcgacagaagcauccccaugaccguggacuucaucagacugaagagcuacugcaacgaccagagcaccggcgacaucaaggugaucggcggcgacgaccugagcacccugaccggcaagaacgugcugaucguggaggacaucaucgacaccggcaagaccaugcagacccugcugagccuggugagacaguacaaccccaagauggugaagguggccagccugcuggugaagagaacccccagaagcgugggcuacaagcccgacuucgugggcuucgagauccccgacaaguucguggugggcuacgcccuggacuacaacgaguacuucagagaccugaaccacgugugcgugaucagcgagaccggcaaggccaaguacaaggccuaa

SEQ ID NO: 18204 - RNA, 2103 nt, Artificial Sequence
  HPS1__Homo_sapiens__NP_000186
augaagugcgugcugguggccaccgagggcgccgaggugcuguucuacuggaccgaccaggaguucgaggagagccugagacugaaguucggccagagcgagaacgaggaggaggagcugcccgcccuggaggaccagcugagcacccugcuggcccccgugaucaucagcagcaugaccaugcuggagaagcugagcgacaccuacaccugcuucagcaccgagaacggcaacuuccuguacgugcugcaccuguucggcgagugccuguucaucgccaucaacggcgaccacaccgagagcgagggcgaccugagaagaaagcuguacgugcugaaguaccuguucgaggugcacuucggccuggugaccguggacggccaccugaucagaaaggagcugagaccccccgaccuggcccagagagugcagcugugggagcacuuccagagccugcuguggaccuacagcagacugagagagcaggagcagugcuucgccguggaggcccuggagagacugauccacccccagcugugcgagcugugcaucgaggcccuggagagacacgugauccaggccgugaacaccagccccgagagaggcggcgaggaggcccugcacgccuuccugcuggugcacagcaagcugcuggccuucuacagcagccacagcgccagcagccugagacccgccgaccugcuggcccugauccugcuggugcaggaccuguaccccagcgagagcaccgccgaggacgacauccagcccagccccagaagagccagaagcagccagaacauccccgugcagcaggccuggagcccccacagcaccggccccaccggcggcagcagcgccgagaccgagaccgacagcuucagccugcccgaggaguacuucacccccgcccccagccccggcgaccagagcagcggcagcaccaucuggcuggagggcggcaccccccccauggacgcccugcagaucgccgaggacacccugcagacccuggugccccacugccccgugcccagcggccccagaagaaucuuccuggacgccaacgugaaggagagcuacugcccccuggugccccacaccauguacugccugccccuguggcagggcaucaaccuggugcugcugaccagaagccccagcgccccccuggcccuggugcugagccagcugauggacggcuucagcaugcuggagaagaagcugaaggagggccccgagcccggcgccagccugagaagccagccccuggugggcgaccugagacagagaauggacaaguucgugaagaacagaggcgcccaggagauccagagcaccuggcuggaguucaaggccaaggccuucagcaagagcgagcccggcagcagcugggagcugcugcaggccugcggcaagcugaagagacagcugugcgccaucuacagacugaacuuccugaccaccgcccccagcagaggcggcccccaccugccccagcaccugcaggaccaggugcagagacugaugagagagaagcugaccgacuggaaggacuuccugcuggugaagagcagaagaaacaucaccauggugagcuaccuggaggacuuccccggccuggugcacuucaucuacguggacagaaccaccggccagaugguggcccccagccugaacugcagccagaagaccagcagcgagcugggcaagggcccccuggccgccuucgugaagaccaagguguggagccugauccagcuggccagaagauaccugcagaagggcuacaccacccugcuguuccaggagggcgacuucuacugcagcuacuuccugugguucgagaacgacaugggcuacaagcugcagaugaucgaggugcccgugcugagcgacgacagcgugcccaucggcaugcugggcggcgacuacuacagaaagcugcugagauacuacagcaagaacagacccaccgaggccgugagaugcuacgagcugcuggcccugcaccugagcgugauccccaccgaccugcuggugcagcaggccggccagcuggccagaagacugugggaggccagcagaaucccccugcuguaa

SEQ ID NO: 18205 - RNA, 3015 nt, Artificial Sequence
  HPS3__Homo_sapiens__NP_115759
auggugcagcuguacaaccugcaccccuucggcagccagcagguggugcccugcaagcuggagcccgacagauucugcggcggcggcagagacgcccuguucguggccgccggcugcaagguggaggccuucgccguggccggccaggagcugugccagcccagaugcgccuucagcacccugggcagagugcugagacuggccuacagcgaggccggcgacuaccugguggccaucgaggagaagaacaaggccaccuuccugagagccuacgugaacuggagaaacaagagaaccgagaacagcagagugugcaucagaaugaucggccacaacguggagggccccuucagcaaggccuucagagaccagauguacaucaucgagaugccccugagcgaggccccccugugcaucagcugcugccccgugaagggcgaccugcuggugggcugcaccaacaagcuggugcuguucagccugaaguaccagaucaucaacgaggaguucagccugcuggacuucgagagaagccugaucauccacaucgacaacaucacccccguggaggugagcuucugcgugggcuacguggccgugaugagcgaccuggaggugcugaucgugaagcuggagagcggccccaagaacggcgagagagugcaccaccacccccacaagaccaacaacagaaucagaagaaccgaggagggcaucagcaacgagaucagccagcuggagagcgacgacuucgugaucugccagaagccccuggagcugcugggcgagaagagcgagcagagcggccugagcgugacccuggagagcaccggccuggccgacgagaagagaaaguacagccacuuccagcaccugcuguacagaagauucgcccccgacaucagcagcuacgugcugagcgacgacaucaagcugcacagccugcagcugcugcccaucuaccagaccggcagccugaccagcgacggcaagaaccugagccaggagaaggagcugcugagccuguucugcuucuucagccugccccacgugggcuaccuguacaugguggugaagagcguggagcugaugagcguguaccaguaccccgagaagagccagcaggccgugcugaccccccaguuccugcacgugaucaccagcaacaaccugcagugcuucaccgugagaugcagcgccgccgccgccagagaggaggaccccuacauggacaccacccugaaggccugcccccccgugagcauggacgugugcgcccugagaauccagcuguucaucggccugaaggccaucugccacuucaagaaccacaucauccugcugaccaaggccgagcccgaggccauccccgagagaagacagagccccaagagacugcugagcagaaaggacaccagcgugaagaucaagaucccccccguggccgaggccggcuggaaccuguacaucgugaacaccaucagccccgugcagcuguacaaggagaugguggacuacagcaacaccuacaagaccgugaagacccagagcugcauccaccugcugagcgaggcccaccugcuggugagagccgcccugauggacgccagccagcuggagcccggcgagaaggccgagcugcuggaggccuucaaggagagcugcggccaccugggcgacugcuacagcagacuggacagccagcacagccaccugacccugcccuacuacaagaugagcggccugagcauggccgaggugcuggccagaaccgacuggaccguggaggacggccugcagaaguacgagagaggccugaucuucuacaucaaccacagccuguacgagaaccuggacgaggagcugaacgaggagcuggccgccaagguggugcagauguucuacguggccgagcccaagcaggugccccacauccugugcagccccagcaugaagaacaucaacccccugaccgccaugagcuaccugagaaagcuggacaccagcggcuucagcagcauccuggugacccugaccaaggccgccguggcccugaagaugggcgaccuggacaugcacagaaacgagaugaagagccacagcgagaugaagcuggugugcggcuucauccuggagcccagacugcugauccagcagagaaagggccagaucgugcccaccgagcuggcccugcaccugaaggagacccagcccggccugcugguggccagcgugcugggccugcagaagaacaacaagaucggcaucgaggaggccgacagcuucuucaaggugcugugcgccaaggacgaggacaccaucccccagcugcugguggacuucugggaggcccagcugguggccugccugcccgacguggugcugcaggagcuguucuucaagcugaccagccaguacaucuggagacugagcaagagacagccccccgacaccaccccccugagaaccagcgaggaccugaucaacgccugcagccacuacggccugaucuaccccugggugcacguggugaucagcagcgacagccuggccgacaagaacuacaccgaggaccugagcaagcugcagagccugaucugcggccccagcuucgacaucgccagcaucauccccuuccuggagccccugagcgaggacaccaucgccggccugagcgugcacgugcugugcagaaccagacugaaggaguacgagcagugcaucgacauccugcuggagagaugccccgaggccgugauccccuacgccaaccacgagcugaaggaggagaacagaacccugugguggaagaagcugcugcccgagcugugccagagaaucaagugcggcggcgagaaguaccagcuguaccugagcagccugaaggagacccugagcaucguggccguggagcuggagcugaaggacuucaugaacgugcugcccgaggacggcaccgccaccuucuuccugcccuaccugcuguacugcagcagaaagaagccccugaccuaa

SEQ ID NO: 18206 - RNA, 2127 nt, Artificial Sequence
  HPS4__Homo_sapiens__NP_071364
auggccaccagcaccagcaccgaggccaagagcgccagcugguggaacuacuucuuccuguacgacggcagcaaggugaaggaggagggcgaccccaccagagccggcaucugcuacuucuaccccagccagacccugcuggaccagcaggagcugcugugcggccagaucgccggcguggugagaugcgugagcgacaucagcgacagcccccccacccuggugagacugagaaagcugaaguucgccaucaagguggacggcgacuaccugugggugcugggcugcgccguggagcugcccgacgugagcugcaagagauuccuggaccagcuggugggcuucuucaacuucuacaacggccccgugagccuggccuacgagaacugcagccaggaggagcugagcaccgagugggacaccuucaucgagcagauccugaagaacaccagcgaccugcacaagaucuucaacagccuguggaaccuggaccagaccaagguggagccccugcugcugcugaaggccgccagaauccugcagaccugccagagaagcccccacauccuggccggcugcauccuguacaagggccugaucgugagcacccagcugccccccagccugaccgccaaggugcugcugcacagaaccgccccccaggagcagagacugcccaccggcgaggacgccccccaggagcacggcgccgcccugccccccaacgugcagaucauccccguguucgugaccaaggaggaggccaucagccugcacgaguuccccguggagcagaugaccagaagccuggccagccccgccggccugcaggacggcagcgcccagcaccaccccaagggcggcagcaccagcgcccugaaggagaacgccaccggccacguggagagcauggccuggaccacccccgaccccaccagccccgacgaggccugccccgacggcagaaaggagaacggcugccugagcggccacgaccuggagagcaucagacccgccggccugcacaacagcgccagaggcgaggugcugggccugagcagcagccugggcaaggagcugguguuccugcaggaggagcuggaccugagcgagauccacauccccgaggcccaggagguggagauggccagcggccacuucgccuuccugcacgugcccgugcccgacggcagagcccccuacugcaaggccagccugagcgccagcagcagccuggagcccaccccccccgaggacaccgccaucagcagccugagaccccccagcgcccccgagaugcugacccagcacggcgcccaggagcagcuggaggaccaccccggccacagcagccaggcccccauccccagagccgacccccugcccagaagaaccagaagaccccugcugcugcccagacuggaccccggccagagaggcaacaagcugcccaccggcgagcagggccuggacgaggacguggacggcgugugcgagagccacgccgcccccggccuggagugcagcagcggcagcgccaacugccagggcgccggccccagcgccgacggcaucagcagcagacugacccccgccgagagcugcaugggccuggugagaaugaaccuguacacccacugcgugaagggccuggugcugagccugcuggccgaggagccccugcugggcgacagcgccgccaucgaggagguguaccacagcagccuggccagccugaacggccuggaggugcaccugaaggagacccugcccagagacgaggccgccagcaccagcagcaccuacaacuucacccacuacgacagaauccagagccugcugauggccaaccugccccagguggccaccccccaggacagaagauuccugcaggccgugagccugaugcacagcgaguucgcccagcugcccgcccuguacgagaugaccgugagaaacgccagcaccgccguguacgccugcugcaaccccauccaggagaccuacuuccagcagcuggcccccgccgccagaagcagcggcuuccccaacccccaggacggcgccuucagccugagcggcaaggccaagcagaagcugcugaagcacggcgugaaccugcuguaa

SEQ ID NO: 18207 - RNA, 3390 nt, Artificial Sequence
  HPS5__Homo_sapiens__NP_852608
auggccuucgugcccgugauccccgagagcuacagccacgugcuggccgaguucgagagccuggacccccugcugagcgcccugagacuggacagcagcagacugaagugcaccagcaucgccgugagcagaaaguggcuggcccugggcagcagcggcggcggccugcaccugauccagaaggagggcuggaagcacagacuguuccugagccacagagagggcgccaucagccagguggccugcugccugcacgacgacgacuacguggccguggccaccagccagggccuggugguggugugggagcugaaccaggagagaagaggcaagcccgagcagauguacgugagcagcgagcacaagggcagaagagugaccgcccugugcugggacaccgccauccugagaguguucgugggcgaccacgccggcaaggugagcgccaucaagcugaacaccagcaagcaggccaaggccgccgccgccuucgugauguuccccgugcagaccaucaccaccguggacagcugcguggugcagcuggacuaccuggacggcagacugcugaucagcagccugaccagaagcuuccugugcgacaccgagagagagaaguucuggaagaucggcaacaaggagagagacggcgaguacggcgccugcuucuuccccggcagaugcagcggcggccagcagccccugaucuacugcgccagacccggcagcagaaugugggaggugaacuucgacggcgaggugaucagcacccaccaguucaagaagcugcugagccugcccccccugcccgugaucacccugagaagcgagccccaguacgaccacaccgccggcagcagccagagccugagcuuccccaagcugcugcaccugagcgagcacugcgugcugaccuggaccgagagaggcaucuacaucuucaucccccagaacgugcaggugcugcuguggagcgaggugaaggacauccaggacguggccgugugcagaaacgagcuguucugccugcaccugaacggcaaggugagccaccugagccugaucagcguggagagaugcguggagagacugcugagaagaggccuguggaaccuggccgccagaaccugcugccuguuccagaacagcgugaucgccagcagagccagaaagacccugaccgccgacaagcuggagcaccugaagagccagcuggaccacggcaccuacaacgaccugaucagccagcuggaggagcugauccugaaguucgagccccuggacagcgccugcagcagcagaagaagcagcaucagcagccacgagagcuucagcauccuggacagcggcaucuacagaaucaucagcagcagaagaggcagccagagcgacgaggacagcugcagccugcacagccagacccugagcgaggacgagagauucaaggaguucaccagccagcaggaggaggaccugcccgaccagugcugcggcagccacggcaacgaggacaacgugagccacgcccccgugauguucgagaccgacaagaacgagaccuuccugcccuucggcaucccccugcccuucagaagccccagcccccuggugagccugcaggccgugaaggagagcgugagcagcuucgugagaaagaccaccgagaagaucggcacccugcacaccagccccgaccugaaggugagacccgagcugagaggcgacgagcagagcugcgaggaggacgugagcagcgacaccugccccaaggaggaggacaccgaggaggagaaggaggugaccagccccccccccgaggaggacagauuccaggagcugaagguggccaccgccgaggccaugaccaagcugcaggacccccuggugcuguucgagagcgagagccugagaauggugcugcaggaguggcugagccaccuggagaagaccuucgccaugaaggacuucagcggcgugagcgacaccgacaacagcagcaugaagcugaaccaggacgugcugcuggugaacgagagcaagaagggcauccuggacgaggacaacgagaaggagaagagagacagccugggcaacgaggagagcguggacaagaccgccugcgagugcgugagaagccccagagagagccuggacgaccuguuccagaucugcagccccugcgccaucgccagcggccugagaaacgaccuggccgagcugaccacccugugccuggagcugaacgugcugaacagcaagaucaagagcaccagcggccacguggaccacacccugcagcaguacagccccgagauccuggccugccaguuccugaagaaguacuucuuccugcugaaccugaagagagccaaggagagcaucaagcugagcuacagcaacagccccagcgugugggacaccuucaucgagggccugaaggagauggccagcagcaaccccguguacauggagauggagaagggcgaccugcccaccagacugaagcugcuggacgacgaggugcccuucgacagcccccugcuggugguguacgccaccagacuguacgagaaguucggcgagagcgcccugagaagccugaucaaguucuuccccagcauccugcccagcgacaucauccagcugugccaccaccaccccgccgaguuccuggccuaccuggacagccuggugaagagcagacccgaggaccagagaagcagcuuccuggagagccugcugcagcccgagagccugagacuggacuggcugcugcuggccgugagccuggacgccccccccagcaccagcaccauggacgacgagggcuaccccagaccccacagccaccugcugagcuggggcuacagccagcugauccugcaccugaucaagcugcccgccgacuucaucaccaaggagaagaugaccgacaucugcagaagcugcggcuucuggcccggcuaccugauccugugccuggagcuggagagaagaagagaggccuucaccaacaucguguaccugaacgacaugagccugauggagggcgacaacggcuggauccccgagaccguggaggaguggaagcugcugcugcaccugauccagagcaagagcaccagacccgccccccaggagagccugaacggcagccugagcgacggccccagccccaucaacguggagaacguggcccugcugcuggccaaggccaugggccccgacagagccuggagccugcugcaggagugcggccuggcccuggagcugagcgagaaguucaccagaaccugcgacauccugagaaucgccgagaagagacagagagcccugauccagagcaugcuggagaagugcgacagauuccuguggagccagcaggccuaa

SEQ ID NO: 18208 - RNA, 2328 nt, Artificial Sequence
  HPS6__Homo_sapiens__NP_079023
augaagagaagcggcacccugagacugcugagcgaccugagcgccuucggcggcgccgccagacugagagagcugguggccggcgacagcgccgugagagugagaggcagccccgacggcagacaccugcugcugcugagaccccccggcgccguggccccccagcugcugguggccagcagaggccccggcgccgagcuggagagagccuggcccgccggccagcccagcccccuggacgccuucuuccugcccuggcccgccagacccgcccuggugcuggugugggagagcggccuggccgagguguggggcgccggcgugggccccggcuggagaccccugcagagcaccgagcugugccccggcggcggcgccagagugguggccguggccgcccugagaggcagacugguguggugcgaggagagacaggccagagccgagggccccagcggcagccccgccgccgccuucagccacugcgugugcgugagaacccuggagcccagcggcgaggccagcaccagccugggcagaacccacgugcugcugcaccacugccccgccuucggccugcuggccagcugcagacagcuguuccuggugcccaccgccaccaccuggcccggcguggcccacgugcugcugaucuggagccccggcaagggcaaggugaugguggccgcccccagacugggccugagcuacagcaagagccugaaccccggcagaggcgacaccugggacuucagaacccugcugagaggccugcccggccugcugagccccagagagccccuggccgugcacaccugggcccccaccccccagggccugcugcugcuggacuucggcggcaccgugagccugcugcagagccacggcggcaccagagccgugggcacccugcaggaggcccccgugggccccuggggcagcgccgcccugggcaccuuccagggcacccuggccugcgugcugggcagcacccuggagcugcuggacaugggcagcggccagcugcuggagagaaaggugcugagcaccgacagagugcaccugcuggagccccccgcccccggcauggaggacgaggaggagcuggagaccagaggcaaccugagacugcugagcgcccugggccuguucugcgugggcugggaggccccccagggcguggagcugcccagcgccaaggaccugguguucgaggaggccugcggcuacuaccagagaagaagccugagaggcgcccagcugacccccgaggagcugagacacagcagcaccuucagagccccccaggcccuggccagcauccugcagggccaccugccccccagcgcccugcugaccaugcugagaaccgagcugagagacuacagaggccuggagcagcugaaggcccagcugguggccggcgacgacgaggaggccggcuggaccgagcuggccgagcaggagguggccagacugcugagaaccgagcugaucggcgaccagcuggcccagcugaacaccguguuccaggcccugcccaccgccgccuggggcgccacccugagagcccugcagcugcagcuggacggcaacggcaagcugagaagccaggccccccccgacguguggaagaaggugcugggcggcaucaccgccggcaaggagccccccaacggcauccugccccccuucgagcugcugugccagugccugugccagcuggagcccagauggcugccccccuucguggagcuggcccagcagcagggcggccccggcuggggcgccggcggccccggccugccccuguacagaagagcccuggccgugcugggcgaggagggcaccagacccgaggcccuggagcuggagcugcugcugagcagcggcagacccaaggccgugcugcaggccgugggccagcuggugcagaaggagcagugggacagagcccuggacgccggccuggcccugggccccagcagcccccugcugagaagcgagaucuucaagcugcugcuggccgaguucgcccagcacagaagacuggacgcccaccugccccugcugugcagacugugcccccccgagcuggcccccgccgagcugcugcugcugcugagaaccuaccugcccgacgaggugggcccccccacccccuuccccgagcccggcgccgagcccccccugaccgugggccugcugaaggcccugcuggagcagaccggcgcccagggcuggcugagcggccccgugcugagccccuacgaggacauccugugggaccccagcacccccccccccaccccccccagagaccuguaa

SEQ ID NO: 18209 - RNA, 1605 nt, Artificial Sequence
  HPSE2__Homo_sapiens__NP_001159716
augagagugcugugcgccuuccccgaggccaugcccagcagcaacagcagaccccccgccugccuggcccccggcgcccuguaccuggcccugcugcugcaccugagccugagcagccaggccggcgacagaagaccccugcccguggacagagccgccggccugaaggagaagacccugauccugcuggacgugagcaccaagaaccccgugagaaccgugaacgagaacuuccugagccugcagcuggaccccagcaucauccacgacggcuggcuggacuuccugagcagcaagagacuggugacccuggccagaggccugagccccgccuuccugagauucggcggcaagagaaccgacuuccugcaguuccagaaccugagaaaccccgccaagagcagaggcggccccggccccgacuacuaccugaagaacuacgaggacgacaucgugagaagcgacguggcccuggacaagcagaagggcugcaagaucgcccagcaccccgacgugaugcuggagcugcagagagagaaggccgcccagaugcaccuggugcugcugaaggagcaguucagcaacaccuacagcaaccugauccugaccgagcccaacaacuacagaaccaugcacggcagagccgugaacggcagccagcugggcaaggacuacauccagcugaagagccugcugcagcccaucagaaucuacagcagagccagccuguacggccccaacaucggcagacccagaaagaacgugaucgcccugcuggacggcuucaugaagguggccggcagcaccguggacgccgugaccuggcagcacugcuacaucgacggcagaguggugaaggugauggacuuccugaagaccagacugcuggacacccugagcgaccagaucagaaagauccagaagguggugaacaccuacacccccggcaagaagaucuggcuggagggcguggugaccaccagcgccggcggcaccaacaaccugagcgacagcuacgccgccggcuuccuguggcugaacacccugggcaugcuggccaaccagggcaucgacguggugaucagacacagcuucuucgaccacggcuacaaccaccugguggaccagaacuucaacccccugcccgacuacuggcugagccugcuguacaagagacugaucggccccaaggugcuggccgugcacguggccggccugcagagaaagcccagacccggcagagugaucagagacaagcugagaaucuacgcccacugcaccaaccaccacaaccacaacuacgugagaggcagcaucacccuguucaucaucaaccugcacagaagcagaaagaagaucaagcuggccggcacccugagagacaagcuggugcaccaguaccugcugcagcccuacggccaggagggccugaagagcaagagcgugcagcugaacggccagccccuggugaugguggacgacggcacccugcccgagcugaagcccagaccccugagagccggcagaacccuggugaucccccccgugaccaugggcuucuacguggugaagaacgugaacgcccuggccugcagauacagauaa

SEQ ID NO: 18210 - RNA, 1632 nt, Artificial Sequence
  HPSE__Homo_sapiens__NP_001092010
augcugcugagaagcaagcccgcccugccccccccccugaugcugcugcugcugggcccccugggcccccugagccccggcgcccugcccagacccgcccaggcccaggacgugguggaccuggacuucuucacccaggagccccugcaccuggugagccccagcuuccugagcgugaccaucgacgccaaccuggccaccgaccccagauuccugauccugcugggcagccccaagcugagaacccuggccagaggccugagccccgccuaccugagauucggcggcaccaagaccgacuuccugaucuucgaccccaagaaggagagcaccuucgaggagagaagcuacuggcagagccaggugaaccaggacaucugcaaguacggcagcaucccccccgacguggaggagaagcugagacuggaguggcccuaccaggagcagcugcugcugagagagcacuaccagaagaaguucaagaacagcaccuacagcagaagcagcguggacgugcuguacaccuucgccaacugcagcggccuggaccugaucuucggccugaacgcccugcugagaaccgccgaccugcaguggaacagcagcaacgcccagcugcugcuggacuacugcagcagcaagggcuacaacaucagcugggagcugggcaacgagcccaacagcuuccugaagaaggccgacaucuucaucaacggcagccagcugggcgaggacuucauccagcugcacaagcugcugagaaagagcaccuucaagaacgccaagcuguacggccccgacgugggccagcccagaagaaagaccgccaagaugcugaagagcuuccugaaggccggcggcgaggugaucgacagcgugaccuggcaccacuacuaccugaacggcagaaccgccaccaaggaggacuuccugaaccccgacgugcuggacaucuucaucagcagcgugcagaagguguuccaggugguggagagcaccagacccggcaagaagguguggcugggcgagaccagcagcgccuacggcggcggcgccccccugcugagcgacaccuucgccgccggcuucauguggcuggacaagcugggccugagcgccagaaugggcaucgagguggugaugagacagguguucuucggcgccggcaacuaccaccugguggacgagaacuucgacccccugcccgacuacuggcugagccugcuguucaagaagcuggugggcaccaaggugcugauggccagcgugcagggcagcaagagaagaaagcugagaguguaccugcacugcaccaacaccgacaaccccagauacaaggagggcgaccugacccuguacgccaucaaccugcacaacgugaccaaguaccugagacugcccuaccccuucagcaacaagcagguggacaaguaccugcugagaccccugggcccccacggccugcugagcaagagcgugcagcugaacggccugacccugaagaugguggacgaccagacccugcccccccugauggagaagccccugagacccggcagcagccugggccugcccgccuucagcuacagcuucuucgugaucagaaacgccaagguggccgccugcaucuaa

SEQ ID NO: 18211 - RNA, 1389 nt, Artificial Sequence
  HPX__Homo_sapiens__XP_005252940
auggccagagugcugggcgcccccguggcccugggccuguggagccugugcuggagccuggccaucgccaccccccugccccccaccagcgcccacggcaacguggccgagggcgagaccaagcccgaccccgacgugaccgagagaugcagcgacggcuggagcuucgacgccaccacccuggacgacaacggcaccaugcuguucuucaagggcgaguucguguggaagagccacaagugggacagagagcugaucagcgagagauggaagaacuuccccagccccguggacgccgccuucagacagggccacaacagcguguuccugaucaagggcgacaagguguggguguacccccccgagaagaaggagaagggcuaccccaagcugcugcaggacgaguuccccggcauccccagcccccuggacgccgccguggagugccacagaggcgagugccaggccgagggcgugcuguucuuccagggcgacagagagugguucugggaccuggccaccggcaccaugaaggagagaagcuggcccgccgugggcaacugcagcagcgcccugagauggcugggcagauacuacugcuuccagggcaaccaguuccugagauucgaccccgugagaggcgaggugccccccagauaccccagagacgugagagacuacuucaugcccugccccggcagaggccacggccacagaaacggcaccggccacggcaacagcacccaccacggccccgaguacaugagaugcagcccccaccuggugcugagcgcccugaccagcgacaaccacggcgccaccuacgccuucagcggcacccacuacuggagacuggacaccagcagagacggcuggcacagcuggcccaucgcccaccaguggccccagggccccagcgccguggacgccgccuucagcugggaggagaagcuguaccuggugcagggcacccagguguacguguuccugaccaagggcggcuacacccuggugagcggcuaccccaagagacuggagaaggaggugggcaccccccacggcaucauccuggacagcguggacgccgccuucaucugccccggcagcagcagacugcacaucauggccggcagaagacugugguggcuggaccugaagagcggcgcccaggccaccuggaccgagcugcccuggccccacgagaagguggacggcgcccugugcauggagaagagccugggccccaacagcugcagcgccaacggccccggccuguaccugauccacggccccaaccuguacugcuacagcgacguggagaagcugaacgccgccaaggcccugccccagccccagaacgugaccagccugcugggcugcacccacuaa

SEQ ID NO: 18212 - RNA, 570 nt, Artificial Sequence
  HRAS__Homo_sapiens__NP_001123914
augaccgaguacaagcuggugguggugggcgccggcggcgugggcaagagcgcccugaccauccagcugauccagaaccacuucguggacgaguacgaccccaccaucgaggacagcuacagaaagcagguggugaucgacggcgagaccugccugcuggacauccuggacaccgccggccaggaggaguacagcgccaugagagaccaguacaugagaaccggcgagggcuuccugugcguguucgccaucaacaacaccaagagcuucgaggacauccaccaguacagagagcagaucaagagagugaaggacagcgacgacgugcccauggugcuggugggcaacaagugcgaccuggccgccagaaccguggagagcagacaggcccaggaccuggccagaagcuacggcauccccuacaucgagaccagcgccaagaccagacagggcguggaggacgccuucuacacccuggugagagagaucagacagcacaagcugagaaagcugaacccccccgacgagagcggccccggcugcaugagcugcaagugcgugcugagcuaa

SEQ ID NO: 18213 - RNA, 822 nt, Artificial Sequence
  HRASLS__Homo_sapiens__NP_065119
auggugagagccagcugcagacugggcagcgccagaacccccagccccgccagaagaccccccggcgugagagccagccagagcagaggcggcgccgccggcaccgugagcgccuggagaagauggugcuggagauggcccuggagaaccgcccccagcgacggcuggagacugccccccggcugccugcccggcaccgacggcguggugcccagaccccccgccgccagaagcgccgccgccagacccagagagacccccggccacacccagcugccccccggcgccagaagaagacccagacuggagagcgagauggccuucaacgacugcuucagccugaacuaccccggcaaccccugccccggcgaccugaucgagguguucagacccggcuaccagcacugggcccuguaccugggcgacggcuacgugaucaacaucgcccccguggacggcauccccgccagcuucaccagcgccaagagcguguucagcagcaaggcccuggugaagaugcagcugcugaaggacguggugggcaacgacaccuacagaaucaacaacaaguacgacgagaccuaccccccccugcccguggaggagaucaucaagagaagcgaguucgugaucggccaggagguggccuacaaccugcuggugaacaacugcgagcacuucgugacccugcugagauacggcgagggcgugagcgagcaggccaacagagccaucagcaccguggaguucgugaccgccgccgugggcguguucagcuuccugggccuguuccccaagggccagagagccaaguacuacuaa

SEQ ID NO: 18214 - RNA, 2100 nt, Artificial Sequence
  HRC__Homo_sapiens__NP_002143
augggccaccacagacccuggcugcacgccagcgugcugugggccggcguggccagccugcugcugccccccgccaugacccagcagcugagaggcgacggccugggcuucagaaacagaaacaacagcaccggcguggccggccugagcgaggaggccagcgccgagcugagacaccaccugcacagccccagagaccaccccgacgagaacaaggacgugagcaccgagaacggccaccacuucuggagccaccccgacagagagaaggaggacgaggacgugagcaaggaguacggccaccugcugcccggccacagaagccaggaccacaaggugggcgacgagggcgugagcggcgaggagguguucgccgagcacggcggccaggccagaggccacagaggccacggcagcgaggacaccgaggacagcgccgagcacagacaccaccugcccagccacagaagccacagccaccaggacgaggacgaggacgagguggugagcagcgagcaccaccaccacauccugagacacggccacagaggccacgacggcgaggacgacgagggcgaggaggaggaggaggaggaggaggaggaggaggaggccagcaccgaguacggccaccaggcccacagacacagaggccacggcagcgaggaggacgaggacgugagcgacggccaccaccaccacggccccagccacagacaccagggccacgaggaggacgacgacgacgacgacgacgacgacgacgacgacgacgacgacgacgugagcaucgaguacagacaccaggcccacagacaccagggccacggcaucgaggaggacgaggacgugagcgacggccaccaccacagagaccccagccacagacacagaagccacgaggaggacgacaacgacgacgacgacgugagcaccgaguacggccaccaggcccacagacaccaggaccacagaaaggaggagguggaggccgugagcggcgagcaccaccaccacgugcccgaccacagacaccagggccacagagacgaggaggaggacgaggacgugagcaccgagagauggcaccagggcccccagcacgugcaccacggccugguggacgaggaggaggaggaggaggagaucaccgugcaguucggccacuacguggccagccaccagcccagaggccacaagagcgacgaggaggacuuccaggacgaguacaagaccgaggugccccaccaccaccaccacagagugcccagagaggaggacgaggaggugagcgccgagcugggccaccaggcccccagccacagacagagccaccaggacgaggagaccggccacggccagagaggcagcaucaaggagaugagccaccacccccccggccacaccguggugaaggacagaagccaccugagaaaggacgacagcgaggaggagaaggagaaggaggaggaccccggcagccacgaggaggacgacgagagcagcgagcagggcgagaagggcacccaccacggcagcagagaccaggaggacgaggaggacgaggaggagggccacggccugagccugaaccaggaggaggaggaggaggaggacaaggaggaggaggaggaggaggaggacgaggagagaagagaggagagagccgaggugggcgccccccugagccccgaccacagcgaggaggaggaggaggaggaggagggccuggaggaggacgagcccagauucaccaucauccccaacccccuggacagaagagaggaggccggcggcgccagcagcgaggaggagagcggcgaggacaccggcccccaggacgcccaggaguacggcaacuaccagcccggcagccugugcggcuacugcagcuucugcaacagaugcaccgagugcgagagcugccacugcgacgaggagaacaugggcgagcacugcgaccagugccagcacugccaguucugcuaccugugcccccuggugugcgagaccgugugcgcccccggcagcuacguggacuacuucagcagcagccuguaccaggcccuggccgacaugcuggagacccccgagcccuaa

SEQ ID NO: 18215 - RNA, 1578 nt, Artificial Sequence
  HRG__Homo_sapiens__NP_000403
augaaggcccugaucgccgcccugcugcugaucacccugcaguacagcugcgccgugagccccaccgacugcagcgccguggagcccgaggccgagaaggcccuggaccugaucaacaagagaagaagagacggcuaccuguuccagcugcugagaaucgccgacgcccaccuggacagaguggagaacaccaccguguacuaccuggugcuggacgugcaggagagcgacugcagcgugcugagcagaaaguacuggaacgacugcgagccccccgacagcagaagacccagcgagaucgugaucggccagugcaaggugaucgccaccagacacagccacgagagccaggaccugagagugaucgacuucaacugcaccaccagcagcgugagcagcgcccuggccaacaccaaggacagccccgugcugaucgacuucuucgaggacaccgagagauacagaaagcaggccaacaaggcccuggagaaguacaaggaggagaacgacgacuucgccagcuucagaguggacagaaucgagagaguggccagagugagaggcggcgagggcaccggcuacuucguggacuucagcgugagaaacugccccagacaccacuuccccagacaccccaacguguucggcuucugcagagccgaccuguucuacgacguggaggcccuggaccuggagagccccaagaaccuggugaucaacugcgagguguucgacccccaggagcacgagaacaucaacggcgugcccccccaccugggccaccccuuccacuggggcggccacgagagaagcagcaccaccaagccccccuucaagccccacggcagcagagaccaccaccacccccacaagccccacgagcacggccccccccccccccccgacgagagagaccacagccacggccccccccugccccagggcccccccccccugcugcccaugagcugcagcagcugccagcacgccaccuucggcaccaacggcgcccagagacacagccacaacaacaacagcagcgaccugcacccccacaagcaccacagccacgagcagcacccccacggccaccacccccacgcccaccacccccacgagcacgacacccacagacagcacccccacggccaccacccccacggccaccacccccacggccaccacccccacggccaccacccccacggccaccacccccacugccacgacuuccaggacuacggccccugcgacccccccccccacaaccagggccacugcugccacggccacggccccccccccggccaccugagaagaagaggccccggcaagggccccagacccuuccacugcagacagaucggcagcguguacagacugcccccccugagaaagggcgaggugcugccccugcccgaggccaacuuccccagcuucccccugccccaccacaagcacccccugaagcccgacaaccagcccuucccccagagcgugagcgagagcugccccggcaaguucaagagcggcuucccccaggugagcauguucuucacccacaccuuccccaaguaa

SEQ ID NO: 18216 - RNA, 1464 nt, Artificial Sequence
  HRH1__Homo_sapiens__NP_001091683
augagccugcccaacagcagcugccugcuggaggacaagaugugcgagggcaacaagaccaccauggccagcccccagcugaugccccuggugguggugcugagcaccaucugccuggugaccgugggccugaaccugcuggugcuguacgccgugagaagcgagagaaagcugcacaccgugggcaaccuguacaucgugagccugagcguggccgaccugaucgugggcgccguggugaugcccaugaacauccuguaccugcugaugagcaaguggagccugggcagaccccugugccuguucuggcugagcauggacuacguggccagcaccgccagcaucuucagcguguucauccugugcaucgacagauacagaagcgugcagcagccccugagauaccugaaguacagaaccaagaccagagccagcgccaccauccugggcgccugguuccugagcuuccugugggugauccccauccugggcuggaaccacuucaugcagcagaccagcgugagaagagaggacaagugcgagaccgacuucuacgacgugaccugguucaaggugaugaccgccaucaucaacuucuaccugcccacccugcugaugcugugguucuacgccaagaucuacaaggccgugagacagcacugccagcacagagagcugaucaacagaagccugcccagcuucagcgagaucaagcugagacccgagaaccccaagggcgacgccaagaagcccggcaaggagagccccugggaggugcugaagagaaagcccaaggacgccggcggcggcagcgugcugaagagccccagccagacccccaaggagaugaagagccccgugguguucagccaggaggacgacagagagguggacaagcuguacugcuucccccuggacaucgugcacaugcaggccgccgccgagggcagcagcagagacuacguggccgugaacagaagccacggccagcugaagaccgacgagcagggccugaacacccacggcgccagcgagaucagcgaggaccagaugcugggcgacagccagagcuucagcagaaccgacagcgacaccaccaccgagaccgcccccggcaagggcaagcugagaagcggcagcaacaccggccuggacuacaucaaguucaccuggaagagacugagaagccacagcagacaguacgugagcggccugcacaugaacagagagagaaaggccgccaagcagcugggcuucaucauggccgccuucauccugugcuggauccccuacuucaucuucuucauggugaucgccuucugcaagaacugcugcaacgagcaccugcacauguucaccaucuggcugggcuacaucaacagcacccugaacccccugaucuacccccugugcaacgagaacuucaagaagaccuucaagagaauccugcacaucagaagcuaa

SEQ ID NO: 18217 - RNA, 1194 nt, Artificial Sequence
  HRH2__Homo_sapiens__NP_001124527
auggcccccaacggcaccgccagcagcuucugccuggacagcaccgccugcaagaucaccaucaccguggugcuggccgugcugauccugaucaccguggccggcaacgugguggugugccuggccgugggccugaacagaagacugagaaaccugaccaacugcuucaucgugagccuggccaucaccgaccugcugcugggccugcuggugcugcccuucagcgccaucuaccagcugagcugcaaguggagcuucggcaagguguucugcaacaucuacaccagccuggacgugaugcugugcaccgccagcauccugaaccuguucaugaucagccuggacagauacugcgccgugauggacccccugagauaccccgugcuggugacccccgugagaguggccaucagccuggugcugaucugggugaucagcaucacccugagcuuccugagcauccaccugggcuggaacagcagaaacgagaccagcaagggcaaccacaccaccagcaagugcaaggugcaggugaacgagguguacggccugguggacggccuggugaccuucuaccugccccugcugaucaugugcaucaccuacuacagaaucuucaagguggccagagaccaggccaagagaaucaaccacaucagcagcuggaaggccgccaccaucagagagcacaaggccaccgugacccuggccgccgugaugggcgccuucaucaucugcugguuccccuacuucaccgccuucguguacagaggccugagaggcgacgacgccaucaacgaggugcuggaggccaucgugcuguggcugggcuacgccaacagcgcccugaaccccauccuguacgccgcccugaacagagacuucagaaccggcuaccagcagcuguucugcugcagacuggccaacagaaacagccacaagaccagccugagaagcaacgccagccagcugagcagaacccagagcagagagcccagacagcaggaggagaagccccugaagcugcagguguggagcggcaccgaggugaccgccccccagggcgccaccgacagacccuggcugugccugcccgagugcuggagcguggagcugacccacagcuucauccaccuguucauccacagcuucgccaacauccaccccauccccaccaccugccaggagcuguaa

SEQ ID NO: 18218 - RNA, 1338 nt, Artificial Sequence
  HRH3__Homo_sapiens__NP_009163
auggagagagccccccccgacggcccccugaacgccagcggcgcccuggccggcgaggccgccgccgccggcggcgccagaggcuucagcgccgccuggaccgccgugcuggccgcccugauggcccugcugaucguggccaccgugcugggcaacgcccuggugaugcuggccuucguggccgacagcagccugagaacccagaacaacuucuuccugcugaaccuggccaucagcgacuuccuggugggcgccuucugcaucccccuguacgugcccuacgugcugaccggcagauggaccuucggcagaggccugugcaagcuguggcuggugguggacuaccugcugugcaccagcagcgccuucaacaucgugcugaucagcuacgacagauuccugagcgugaccagagccgugagcuacagagcccagcagggcgacaccagaagagccgugagaaagaugcugcuggugugggugcuggccuuccugcuguacggccccgccauccugagcugggaguaccugagcggcggcagcagcauccccgagggccacugcuacgccgaguucuucuacaacugguacuuccugaucaccgccagcacccuggaguucuucacccccuuccugagcgugaccuucuucaaccugagcaucuaccugaacauccagagaagaaccagacugagacuggacggcgccagagaggccgccggccccgagcccccccccgaggcccagcccagccccccccccccccccggcugcuggggcugcuggcagaagggccacggcgaggccaugccccugcacagauacggcgugggcgaggccgccgugggcgccgaggccggcgaggccacccugggcggcggcggcggcggcggcagcguggccagccccaccagcagcagcggcagcagcagcagaggcaccgagagacccagaagccugaagagaggcagcaagcccagcgccagcagcgccagccuggagaagagaaugaagauggugagccagagcuucacccagagauucagacugagcagagacagaaagguggccaagagccuggccgugaucgugagcaucuucggccugugcugggcccccuacacccugcugaugaucaucagagccgccugccacggccacugcgugcccgacuacugguacgagaccagcuucuggcugcugugggccaacagcgccgugaaccccgugcuguacccccugugccaccacagcuucagaagagccuucaccaagcugcugugcccccagaagcugaagauccagccccacagcagccuggagcacugcuggaaguaa

SEQ ID NO: 18219 - RNA, 909 nt, Artificial Sequence
  HRH4__Homo_sapiens__NP_001137300
augcccgacaccaacagcaccaucaaccugagccugagcaccagagugacccuggccuucuucaugagccugguggccuucgccaucaugcugggcaacgcccuggugauccuggccuucgugguggacaagaaccugagacacagaagcagcuacuucuuccugaaccuggccaucagcgacuucuucguggugagcgagagcuggaaggacgagggcagcgagugcgagcccggcuucuucagcgagugguacauccuggccaucaccagcuuccuggaguucgugauccccgugauccugguggccuacuucaacaugaacaucuacuggagccuguggaagagagaccaccugagcagaugccagagccaccccggccugaccgccgugagcagcaacaucugcggccacagcuucagaggcagacugagcagcagaagaagccugagcgccagcaccgaggugcccgccagcuuccacagcgagagacagagaagaaagagcagccugauguucagcagcagaaccaagaugaacagcaacaccaucgccagcaagaugggcagcuucagccagagcgacagcguggcccugcaccagagagagcacguggagcugcugagagccagaagacuggccaagagccuggccauccugcugggcguguucgccgugugcugggcccccuacagccuguucaccaucgugcugagcuucuacagcagcgccaccggccccaagagcgugugguacagaaucgccuucuggcugcagugguucaacagcuucgugaacccccugcuguacccccugugccacaagagauuccagaaggccuuccugaagaucuucugcaucaagaagcagccccugcccagccagcacagcagaagcgugagcagcuaa

SEQ ID NO: 18220 - RNA, 3570 nt, Artificial Sequence
  HR__Homo_sapiens__NP_005135
auggagagcacccccagcuuccugaagggcacccccaccugggagaagaccgcccccgagaacggcaucgugagacaggagcccggcagcccccccagagacggccugcaccacggcccccugugccugggcgagcccgcccccuucuggagaggcgugcugagcacccccgacagcuggcugccccccggcuucccccagggccccaaggacaugcugccccugguggagggcgagggcccccagaacggcgagagaaaggugaacuggcugggcagcaaggagggccugagauggaaggaggccaugcugacccacccccuggccuucugcggccccgccugcccccccagaugcggcccccugaugcccgagcacagcggcggccaccugaagagcgaccccguggccuucagacccuggcacugccccuuccugcuggagaccaagauccuggagagagcccccuucugggugcccaccugccugccccccuaccuggugagcggccugccccccgagcaccccugcgacuggccccugaccccccaccccuggguguacagcggcggccagcccaaggugcccagcgccuucagccugggcagcaagggcuucuacuacaaggaccccagcauccccagacuggccaaggagccccuggccgccgccgagcccggccuguucggccugaacagcggcggccaccugcagagagccggcgaggccgagagacccagccugcaccagagagacggcgagaugggcgccggcagacagcagaaccccugcccccuguuccugggccagcccgacaccgugcccuggaccagcuggcccgccugcccccccggccuggugcacacccugggcaacgugugggccggccccggcgacggcaaccugggcuaccagcugggcccccccgccacccccagaugccccagccccgagccccccgugacccagagaggcugcugcagcagcuacccccccaccaagggcggcggccugggccccugcggcaagugccaggagggccuggagggcggcgccagcggcgccagcgagcccagcgaggaggugaacaaggccagcggccccagagccugcccccccagccaccacaccaagcugaagaagaccuggcugaccagacacagcgagcaguucgagugccccagaggcugccccgagguggaggagagacccguggccagacugagagcccugaagagagccggcagccccgaggugcagggcgccaugggcagccccgcccccaagagaccccccgaccccuuccccggcaccgccgagcagggcgccggcggcuggcaggaggugagagacaccagcaucggcaacaaggacguggacagcggccagcacgacgagcagaagggcccccaggacggccaggccagccugcaggaccccggccugcaggacauccccugccuggcccugcccgccaagcuggcccagugccagagcugcgcccaggccgccggcgagggcggcggccacgccugccacagccagcaggugagaagaagcccccugggcggcgagcugcagcaggaggaggacaccgccaccaacagcagcagcgaggagggccccggcagcggccccgacagcagacugagcaccggccuggccaagcaccugcugagcggccugggcgacagacugugcagacugcugagaagagagagagaggcccuggccugggcccagagagagggccagggccccgccgugaccgaggacagccccggcauccccagaugcugcagcagaugccaccacggccuguucaacacccacuggagaugccccagaugcagccacagacugugcguggccugcggcagaguggccggcaccggcagagccagagagaaggccggcuuccaggagcagagcgccgaggagugcacccaggaggccggccacgccgccugcagccugaugcugacccaguucgugagcagccaggcccuggccgagcugagcaccgccaugcaccaggugugggugaaguucgacaucagaggccacugccccugccaggccgacgccagagugugggcccccggcgacgccggccagcagaaggagagcacccagaagaccccccccaccccccagcccagcugcaacggcgacacccacagaaccaagagcaucaaggaggagacccccgacagcgccgagacccccgccgaggacagagccggcagaggcccccugcccugccccagccugugcgagcugcuggccagcaccgccgugaagcugugccugggccacgagagaauccacauggccuucgcccccgugacccccgcccugcccagcgacgacagaaucaccaacauccuggacagcaucaucgcccaggugguggagagaaagauccaggagaaggcccugggccccggccugagagccggccccggccugagaaagggccugggccugccccugagccccgugagacccagacugcccccccccggcgcccugcuguggcugcaggagccccagcccugccccagaagaggcuuccaccuguuccaggagcacuggagacagggccagcccgugcuggugagcggcauccagagaacccugcagggcaaccuguggggcaccgaggcccugggcgcccugggcggccaggugcaggcccugagcccccugggccccccccagcccagcagccugggcagcaccaccuucugggagggcuucagcuggcccgagcugagacccaagagcgacgagggcagcgugcugcugcugcacagagcccugggcgacgaggacaccagcagaguggagaaccuggccgccagccugccccugcccgaguacugcgcccugcacggcaagcugaaccuggccagcuaccugccccccggccuggcccugagaccccuggagccccagcugugggccgccuacggcgugagcccccacagaggccaccugggcaccaagaaccugugcguggagguggccgaccuggugagcauccuggugcacgccgacaccccccugcccgccuggcacagagcccagaaggacuuccugagcggccuggacggcgagggccuguggagccccggcagccaggugagcaccguguggcacguguucagagcccaggacgcccagagaaucagaagauuccugcagauggugugccccgccggcgccggcgcccuggagcccggcgcccccggcagcugcuaccuggacgccggccugagaagaagacugagagaggaguggggcgugagcugcuggacccugcugcaggcccccggcgaggccgugcuggugcccgccggcgccccccaccaggugcagggccuggugagcaccgugagcgugacccagcacuuccugagccccgagaccagcgcccugagcgcccagcugugccaccagggccccagccugccccccgacugccaccugcuguacgcccagauggacugggccguguuccaggccgugaagguggccgugggcacccugcaggaggccaaguaa

SEQ ID NO: 18221 - RNA, 276 nt, Artificial Sequence
  HRK__Homo_sapiens__NP_003797
augugccccugcccccugcacagaggcagaggcccccccgccgugugcgccugcagcgccggcagacugggccugagaagcagcgccgcccagcugaccgccgccagacugaaggcccugggcgacgagcugcaccagagaaccauguggagaagaagagccagaagcagaagagcccccgcccccggcgcccugcccaccuacuggcccuggcugugcgccgccgcccagguggccgcccuggccgccuggcugcugggcagaagaaaccuguaa

SEQ ID NO: 18222 - RNA, 8553 nt, Artificial Sequence
  HRNR__Homo_sapiens__NP_001009931
augcccaagcugcugcagggcgugaucaccgugaucgacguguucuaccaguacgccacccagcacggcgaguacgacacccugaacaaggccgagcugaaggagcugcuggagaacgaguuccaccagauccugaagaaccccaacgaccccgacaccguggacaucauccugcagagccuggacagagaccacaacaagaagguggacuucaccgaguaccugcugaugaucuucaagcuggugcaggccagaaacaagaucaucggcaaggacuacugccaggugagcggcagcaagcugagagacgacacccaccagcaccaggaggagcaggaggagaccgagaaggaggagaacaagagacaggagagcagcuucagccacagcagcuggagcgccggcgagaacgacagcuacagcagaaacgugagaggcagccugaagcccggcaccgagagcaucagcagaagacugagcuuccagagagacuucagcggccagcacaacagcuacagcggccagagcagcagcuacggcgagcagaacagcgacagccaccagagcagcggcagaggccagugcggcagcggcagcggccagagccccaacuacggccagcacggcagcggcagcggccagagcagcagcaacgacacccacggcagcggcagcggccagagcagcggcuucagccagcacaagagcagcagcggccagagcagcggcuacagccagcacggcagcggcagcggccacagcagcggcuacggccagcacggcagcagaagcggccagagcagcagaggcgagagacacagaagcagcagcggcagcagcagcagcuacggccagcacggcagcggcagcagacagagccugggccacggcagacagggcagcggcagcagacagagccccagccacgugagacacggcagcggcagcggccacagcagcagccacggccagcacggcagcggcagcagcuacagcuacagcagaggccacuacgagagcggcagcggccagaccagcggcuucggccagcacgagagcggcagcggccagagcagcggcuacagcaagcacggcagcggcagcggccacagcagcagccagggccagcacggcagcaccagcggccaggccagcagcagcggccagcacggcagcagcagcagacagagcagcagcuacggccagcacgagagcgccagcagacacagcagcggcagaggccagcacagcagcggcagcggccagagccccggccacggccagagaggcagcggcagcggccagagccccagcagcggccagcacggcaccggcuucggcagaagcagcagcagcggccccuacgugagcggcagcggcuacagcagcggcuucggccaccacgagagcagcagcgagcacagcagcggcuacacccagcacggcagcggcagcggccacagcagcggccacggccagcacggcagcagaagcggccagagcagcagaggcgagagacagggcagcagcgccggcagcagcagcagcuacggccagcacggcagcggcagcagacagagccugggccacagcagacacggcagcggcagcggccagagccccagccccagcagaggcagacacgagagcggcagcagacagagcagcagcuacggcccccacggcuacggcagcggcagaagcagcagcagaggccccuacgagagcggcagcggccacagcagcggccugggccaccaggagagcagaagcggccagagcagcggcuacggccagcacggcagcagcagcggccacagcagcacccacggccagcacggcagcaccagcggccagagcagcagcugcggccagcacggcgccaccagcggccagagcagcagccacggccagcacggcagcggcagcagccagagcagcagauacggccagcagggcagcggcagcggccagagccccagcagaggcagacacggcagcgacuucggccacagcagcagcuacggccagcacggcagcggcagcggcuggagcagcagcaacggcccccacggcagcgugagcggccagagcagcggcuucggccacaagagcggcagcggccagagcagcggcuacagccagcacggcagcggcagcagccacagcagcggcuacagaaagcacggcagcagaagcggccagagcagcagaagcgagcagcacggcagcagcagcggccugagcagcagcuacggccagcacggcagcggcagccaccagagcagcggccacggcagacagggcagcggcagcggccacagccccagcagagugagacacggcagcagcagcggccacagcagcagccacggccagcacggcagcggcaccagcugcagcagcagcugcggccacuacgagagcggcagcggccaggccagcggcuucggccagcacgagagcggcagcggccagggcuacagccagcacggcagcgccagcggccacuucagcagccagggcagacacggcagcaccagcggccagagcagcagcagcggccagcacgacagcagcagcggccagagcagcagcuacggccagcacgagagcgccagccaccacgccagcggcagaggcagacacggcagcggcagcggccagagccccggccacggccagagaggcagcggcagcggccagagccccagcuacggcagacacggcagcggcagcggcagaagcagcagcagcggcagacacggcagcggcagcggccagagcagcggcuucggccacaagagcagcagcggccagagcagcggcuacacccagcacggcagcggcagcggccacagcagcagcuacgagcagcacggcagcagaagcggccagagcagcagaagcgagcagcacggcagcagcagcggcagcagcagcagcuacggccagcacggcagcggcagcagacagagccugggccacggccagcacggcagcggcagcggccagagccccagccccagcagaggcagacacggcagcggcagcggccagagcagcagcuacggccccuacagaagcggcagcggcuggagcagcagcagaggccccuacgagagcggcagcggccacagcagcggccugggccacagagagagcagaagcggccagagcagcggcuacggccagcacggcagcagcagcggccacagcagcacccacggccagcacggcagcaccagcggccagagcagcagcugcggccagcacggcgccagcagcggccagagcagcagccacggccagcacggcagcggcagcagccagagcagcggcuacggcagacagggcagcggcagcggccagagccccggccacggccagagaggcagcggcagcagacagagccccagcuacggcagacacggcagcggcagcggcagaagcagcagcagcggccagcacggcagcggccugggcgagagcagcggcuucggccaccacgagagcagcagcggccagagcagcagcuacagccagcacggcagcggcagcggccacagcagcggcuacggccagcacggcagcagaagcggccagagcagcagaggcgagagacacggcagcagcagcggcagcagcagccacuacggccagcacggcagcggcagcagacagagcagcggccacggcagacagggcagcggcagcggccacagccccagcagaggcagacacggcagcggccugggccacagcagcagccacggccagcacggcagcggcagcggcagaagcagcagcagaggccccuacgagagcagaagcggccacagcagcguguucggccagcacgagagcggcagcggccacagcagcgccuacagccagcacggcagcggcagcggccacuucugcagccagggccagcacggcagcaccagcggccagagcagcaccuucgaccaggagggcagcagcaccggccagagcagcagcuacggccacagaggcagcggcagcagccagagcagcggcuacggcagacacggcgccggcagcggccagagccccagcagaggcagacacggcagcggcagcggccacagcagcagcuacggccagcacggcagcggcagcggcuggagcagcagcagcggcagacacggcagcggcagcggccagagcagcggcuucggccaccacgagagcagcagcuggcagagcagcggcugcacccagcacggcagcggcagcggccacagcagcagcuacgagcagcacggcagcagaagcggccagagcagcagaggcgagagacacggcagcagcagcggcagcagcagcagcuacggccagcacggcagcggcagcagacagagccugggccacggccagcacggcagcggcagcggccagagccccagccccagcagaggcagacacggcagcggcagcggccagagcagcagcuacagccccuacggcagcggcagcggcuggagcagcagcagaggccccuacgagagcggcagcagccacagcagcggccugggccacagagagagcagaagcggccagagcagcggcuacggccagcacggcagcagcagcggccacagcagcacccacggccagcacggcagcaccagcggccagagcagcagcugcggccagcacggcgccagcagcggccagagcagcagccacggccagcacggcagcggcagcagccagagcagcggcuacggcagacagggcagcggcagcggccagagccccggccacggccagagaggcagcggcagcagacagagccccagcuacggcagacacggcagcggcagcggcagaagcagcagcagcggccagcacggcagcggccugggcgagagcagcggcuucggccaccacgagagcagcagcggccagagcagcagcuacagccagcacggcagcggcagcggccacagcagcggcuacggccagcacggcagcagaagcggccagagcagcagaggcgagagacacggcagcagcagcagaagcagcagcagauacggccagcacggcagcggcagcagacagagcagcggccacggcagacagggcagcggcagcggccagagccccagcagaggcagacacggcagcggccugggccacagcagcagccacggccagcacggcagcggcagcggcagaagcagcagcagaggccccuacgagagcagaagcggccacagcagcguguucggccagcacgagagcggcagcggccacagcagcgccuacagccagcacggcagcggcagcggccacuucugcagccagggccagcacggcagcaccagcggccagagcagcaccuucgaccaggagggcagcagcaccggccagagcagcagccacggccagcacggcagcggcagcagccagagcagcagcuacggccagcagggcagcggcagcggccagagccccagcagaggcagacacggcagcggcagcggccacagcagcagcuacggccagcacggcagcggcagcggcuggagcagcagcagcggcagacacggcagcggcagcggccagagcagcggcuucggccaccacgagagcagcagcuggcagagcagcggcuacacccagcacggcagcggcagcggccacagcagcagcuacgagcagcacggcagcagaagcggccagagcagcagaggcgagcagcacggcagcagcagcggcagcagcagcagcuacggccagcacggcagcggcagcagacagagccugggccacggccagcacggcagcggcagcggccagagccccagccccagcagaggcagacacggcagcggcagcggccagagcagcagcuacggccccuacggcagcggcagcggcuggagcagcagcagaggccccuacgagagcggcagcggccacagcagcggccugggccacagagagagcagaagcggccagagcagcggcuacggccagcacggcagcagcagcggccacagcagcacccacggccagcacggcagcgccagcggccagagcagcagcugcggccagcacggcgccagcagcggccagagcagcagccacggccagcacggcagcggcagcagccagagcagcggcuacggcagacagggcagcggcagcggccagagccccggccacggccagagaggcagcggcagcagacagagccccagcuacggcagacacggcagcggcagcggcagaagcagcagcagcggccagcacggccccggccugggcgagagcagcggcuucggccaccacgagagcagcagcggccagagcagcagcuacagccagcacggcagcggcagcggccacagcagcggcuacggccagcacggcagcagaagcggccagagcagcagaggcgagagacacggcagcagcagcggcagcagcagcagauacggccagcacggcagcggcagcagacagagcagcggccacggcagacagggcagcggcagcggccacagccccagcagaggcagacacggcagcggcagcggccacagcagcagccacggccagcacggcagcggcagcggcagaagcagcagcagaggccccuacgagagcagaagcggccacagcagcguguucggccagcacgagagcggcagcggccacagcagcgccuacagccagcacggcagcggcagcggccacuucugcagccagggccagcacggcagcaccagcggccagagcagcaccuucgaccaggagggcagcagcaccggccagagcagcagccacggccagcacggcagcggcagcagccagagcagcagcuacggccagcagggcagcggcagcggccagagccccagcagaggcagacacggcagcggcagcggccacagcagcagcuacggccagcacggcagcggcagcggcuggagcagcagcagcggcagacacggcagcggcagcggccagagcagcggcuucggccaccacgagagcagcagcuggcagagcagcggcuacacccagcacggcagcggcagcggccacagcagcagcuacgagcagcacggcagcagaagcggccagagcagcagaggcgagagacacggcagcagcagcggcagcagcagcagcuacggccagcacggcagcggcagcagacagagccugggccacggccagcacggcagcggcagcggccagagccccagccccagcagaggcagacacggcagcggcagcggccagagcagcagcuacagccccuacggcagcggcagcggcuggagcagcagcagaggccccuacgagagcggcagcggccacagcagcggccugggccacagagagagcagaagcggccagagcagcggcuacggccagcacggcagcagcagcggccacagcagcacccacggccagcacggcagcaccagcggccagagcagcagcugcggccagcacggcgccagcagcggccagagcagcagccacggccagcacggcagcggcagcagccagagcagcggcuacggcagacagggcagcggcagcggccagagccccggccacggccagagaggcagcggcagcagacagagccccagcuacggcagacacggcagcggcagcggcagaagcagcagcagcggccagcacggcagcggccugggcgagagcagcggcuucggccaccacgagagcagcagcggccagagcagcagcuacagccagcacggcagcggcagcggccacagcagcggcuacggccagcacggcagcagaagcggccagagcagcagaggcgagagacacggcagcagcagcggcagcagcagccacuacggccagcacggcagcggcagcagacagagcagcggccacggcagacagggcagcggcagcggccagagccccagcagaggcagacacggcagcggccugggccacagcagcagccacggccagcacggcagcggcagcggcagaagcagcagcagaggccccuacgagagcagacugggccacagcagcguguucggccagcacgagagcggcagcggccacagcagcgccuacagccagcacggcagcggcagcggccacuucugcagccagggccagcacggcagcaccagcggccagagcagcaccuucgaccaggagggcagcagcaccggccagagcagcagcuacggccacagaggcagcggcagcagccagagcagcggcuacggcagacacggcgccggcagcggccagagccugagccacggcagacacggcagcggcagcggccagagcagcagcuacggccagcacggcagcggcagcggccagagcagcggcuacagccagcacggcagcggcagcggccaggacggcuacagcuacugcaagggcggcagcaaccacgacggcggcagcagcggcagcuacuuccugagcuuccccagcagcaccagccccuacgaguacgugcaggagcagagaugcuacuucuaccaguaa

SEQ ID NO: 18223 - RNA, 414 nt, Artificial Sequence
  HRSP12__Homo_sapiens__NP_005827
augagcagccugaucagaagagugaucagcaccgccaaggcccccggcgccaucggccccuacagccaggccgugcugguggacagaaccaucuacaucagcggccagaucggcauggaccccagcagcggccagcuggugagcggcggcguggccgaggaggccaagcaggcccugaagaacaugggcgagauccugaaggccgccggcugcgacuucaccaacguggugaagaccaccgugcugcuggccgacaucaacgacuucaacaccgugaacgagaucuacaagcaguacuucaagagcaacuuccccgccagagccgccuaccagguggccgcccugcccaagggcagcagaaucgagaucgaggccguggccauccagggcccccugaccaccgccagccuguaa

SEQ ID NO: 18224 - RNA, 1179 nt, Artificial Sequence
  HS1BP3__Homo_sapiens__NP_071905
augcagagccccgccgugcuggugaccagcagaagacugcagaacgcccacaccggccuggaccugaccgugccccagcaccaggaggugagaggcaagaugaugagcggccacguggaguaccagauccugguggugaccagacuggccgccuucaagagcgccaagcacagacccgaggacguggugcaguuccuggugagcaagaaguacagcgagaucgaggaguucuaccagaagcugagcagcagauacgccgccgccagccugcccccccugcccagaaaggugcuguucgugggcgagagcgacaucagagagagaagagccguguucaacgagauccugagaugcgugagcaaggacgccgagcuggccggcagccccgagcugcuggaguuccugggcaccagaagccccggcgccgccggccugaccagcagagacagcagcgugcuggacggcaccgacagccagaccggcaacgacgaggaggccuucgacuucuucgaggagcaggaccagguggccgaggagggcccccccgugcagagccugaagggcgaggacgccgaggagagccuggaggaggaggaggcccuggacccccugggcaucaugagaagcaagaagcccaagaagcaccccaagguggccgugaaggccaagcccagccccagacugaccaucuucgacgaggagguggaccccgacgagggccuguucggccccggcagaaagcugagcccccaggaccccagcgaggacgugagcagcguggacccccugaagcuguucgacgaccccgaccugggcggcgccaucccccugggcgacagccugcugcugcccgccgccugcgagagcggcggccccacccccagccugagccacagagacgccagcaaggagcuguucagaguggaggaggaccuggaccagauccugaaccugggcgccgagcccaagcccaagccccagcugaagcccaagccccccguggccgccaagcccgugauccccagaaagcccgccgugccccccaaggccggccccgccgaggccguggccggccagcagaagccccaggagcagauccaggccauggacgagauggacauccugcaguacauccaggaccacgacacccccgcccaggccgcccccagccuguucuaa

SEQ ID NO: 18225 - RNA, 924 nt, Artificial Sequence
  HS3ST1__Homo_sapiens__NP_005105
auggccgcccugcugcugggcgccgugcugcugguggcccagccccagcuggugcccagcagacccgccgagcugggccagcaggagcugcugagaaaggccggcacccugcaggacgacgugagagacggcguggcccccaacggcagcgcccagcagcugccccagaccaucaucaucggcgugagaaagggcggcaccagagcccugcuggagaugcugagccugcaccccgacguggccgccgccgagaacgaggugcacuucuucgacugggaggagcacuacagccacggccugggcugguaccugagccagaugcccuucagcuggccccaccagcugaccguggagaagacccccgccuacuucaccagccccaaggugcccgagagaguguacagcaugaaccccagcaucagacugcugcugauccugagagaccccagcgagagagugcugagcgacuacacccagguguucuacaaccacaugcagaagcacaagcccuaccccagcaucgaggaguuccuggugagagacggcagacugaacguggacuacaaggcccugaacagaagccuguaccacgugcacaugcagaacuggcugagauucuucccccugagacacauccacaucguggacggcgacagacugaucagagaccccuuccccgagauccagaagguggagagauuccugaagcugagcccccagaucaacgccagcaacuucuacuucaacaagaccaagggcuucuacugccugagagacagcggcagagacagaugccugcacgagagcaagggcagagcccacccccagguggaccccaagcugcugaacaagcugcacgaguacuuccacgagcccaacaagaaguucuucgagcuggugggcagaaccuucgacuggcacuaa

SEQ ID NO: 18226 - RNA, 1104 nt, Artificial Sequence
  HS3ST2__Homo_sapiens__NP_006034
auggccuacagagugcugggcagagccggccccccccagcccagaagagccagaagacugcuguucgccuucacccugagccugagcugcaccuaccugugcuacagcuuccugugcugcugcgacgaccugggcagaagcagacugcugggcgcccccagaugccugagaggccccagcgccggcggccagaagcugcugcagaagagcagacccugcgaccccagcggccccacccccagcgagcccagcgcccccagcgcccccgccgccgccgugcccgcccccagacugagcggcagcaaccacagcggcagccccaagcugggcaccaagagacugccccaggcccugaucgugggcgugaagaagggcggcaccagagccgugcuggaguucaucagagugcaccccgacgugagagcccugggcaccgagccccacuucuucgacagaaacuacggcagaggccuggacugguacagaagccugaugcccagaacccuggagagccagaucacccuggagaagacccccagcuacuucgugacccaggaggcccccagaagaaucuucaacaugagcagagacaccaagcugaucgugguggugagaaaccccgugaccagagccaucagcgacuacacccagacccugagcaagaagcccgacauccccaccuucgagggccugagcuucagaaacagaacccugggccugguggacgugagcuggaacgccaucagaaucggcauguacgugcugcaccuggagagcuggcugcaguacuucccccuggcccagauccacuucgugagcggcgagagacugaucaccgaccccgccggcgagaugggcagagugcaggacuuccugggcaucaagagauucaucaccgacaagcacuucuacuucaacaagaccaagggcuuccccugccugaagaagaccgagagcagccugcugcccagaugccugggcaagagcaagggcagaacccacgugcagaucgaccccgaggugaucgaccagcugagagaguucuacagacccuacaacaucaaguucuacgagaccgugggccaggacuucagaugggaguaa

SEQ ID NO: 18227 - RNA, 1221 nt, Artificial Sequence
  HS3ST3A1__Homo_sapiens__NP_006033
auggccccccccggccccgccagcgcccugagcaccagcgccgagccccugagcagaagcaucuucagaaaguuccugcugaugcugugcagccugcugaccagccuguacguguucuacugccuggccgagagaugccagacccugagcggccccguggugggccugagcggcggcggcgaggaggccggcgcccccggcggcggcgugcuggccggcggccccagagagcuggccguguggcccgccgccgcccagagaaagagacugcugcagcugccccaguggagaagaagaagaccccccgcccccagagacgacggcgaggaggccgccugggaggaggagagccccggccugagcggcggccccggcggcagcggcgccggcagcaccguggccgaggccccccccggcacccuggcccugcugcuggacgagggcagcaagcagcugccccaggccaucaucaucggcgugaagaagggcggcaccagagcccugcuggaguuccugagagugcaccccgacgugagagccgugggcgccgagccccacuucuucgacagaagcuacgacaagggccuggccugguacagagaccugaugcccagaacccuggacggccagaucaccauggagaagacccccagcuacuucgugaccagagaggcccccgccagaaucagcgccaugagcaaggacaccaagcugaucgugguggugagagaccccgugaccagagccaucagcgacuacacccagacccugagcaagagacccgacauccccaccuucgagagccugaccuucaagaacagaaccgccggccugaucgacaccagcuggagcgccauccagaucggcaucuacgccaagcaccuggagcacuggcugagacacuuccccaucagacagaugcuguucgugagcggcgagagacugaucagcgaccccgccggcgagcugggcagagugcaggacuuccugggccugaagagaaucaucaccgacaagcacuucuacuucaacaagaccaagggcuuccccugccugaagaaggccgagggcagcagcagaccccacugccugggcaagaccaagggcagaacccaccccgagaucgacagagagguggugagaagacugagagaguucuacagacccuucaaccugaaguucuaccagaugaccggccacgacuucggcugggacggcuaa

SEQ ID NO: 18228 - RNA, 1173 nt, Artificial Sequence
  HS3ST3B1__Homo_sapiens__NP_006032
augggccagagacugagcggcggcagaagcugccuggacgugcccggcagacugcugccccagcccccccccccccccccccccgugagaagaaagcuggcccugcuguucgccaugcugugcguguggcuguacauguuccuguacagcugcgccggcagcugcgccgccgcccccggccugcugcugcugggcagcggcagcagagccgcccacgacccccccgcccuggccaccgcccccgacggcaccccccccagacugcccuucagagccccccccgccaccccccuggccagcggcaaggagauggccgagggcgccgccagccccgaggagcagagccccgaggugcccgacagccccagccccaucagcagcuucuucagcggcagcggcagcaagcagcugccccaggccaucaucaucggcgugaagaagggcggcaccagagcccugcuggaguuccugagagugcaccccgacgugagagccgugggcgccgagccccacuucuucgacagaagcuacgacaagggccuggccugguacagagaccugaugcccagaacccuggacggccagaucaccauggagaagacccccagcuacuucgugaccagagaggcccccgccagaaucagcgccaugagcaaggacaccaagcugaucgugguggugagagaccccgugaccagagccaucagcgacuacacccagacccugagcaagagacccgacauccccaccuucgagagccugaccuucaagaacagaaccgccggccugaucgacaccagcuggagcgccauccagaucggcaucuacgccaagcaccuggagcacuggcugagacacuuccccaucagacagaugcuguucgugagcggcgagagacugaucagcgaccccgccggcgagcugggcagagugcaggacuuccugggccugaagagaaucaucaccgacaagcacuucuacuucaacaagaccaagggcuuccccugccugaagaaggccgagggcagcagcagaccccacugccugggcaagaccaagggcagaacccaccccgagaucgacagagagguggugagaagacugagagaguucuacagacccuucaaccugaaguucuaccagaugaccggccacgacuucggcugggacuaa

SEQ ID NO: 18229 - RNA, 1371 nt, Artificial Sequence
  HS3ST4__Homo_sapiens__NP_006031
auggccagauggcccgcccccccccccccccccccccccccccccccccuggccgccccccccccccccggcgccagcgccaagggcccccccgccagaaagcugcuguucaugugcacccugagccugagcgugaccuaccugugcuacagccugcugggcggcagcggcagccugcaguucccccuggcccugcaggagagccccggcgccgccgccgagcccccccccagcccccccccccccagccugcugcccacccccgugagacugggcgcccccagccagccccccgccccccccccccuggacaacgccagccacggcgagccccccgagccccccgagcagcccgccgcccccggcaccgacggcuggggccugcccagcggcggcggcggcgcccaggacgccuggcugagaaccccccuggcccccagcgagaugaucaccgcccagagcgcccugcccgagagagaggcccaggagagcagcaccaccgacgaggaccuggccggcagaagagccgccaacggcagcagcgagagaggcggcgccgugagcacccccgacuacggcgagaagaagcugccccaggcccugaucaucggcgugaagaagggcggcaccagagcccugcuggaggccaucagagugcaccccgacgugagagccgugggcguggagccccacuucuucgacagaaacuacgagaagggccuggagugguacagaaacgugaugcccaagacccuggacggccagaucaccauggagaagacccccagcuacuucgugaccaacgaggcccccaagagaauccacagcauggccaaggacaucaagcugaucgugguggugagaaaccccgugaccagagccaucagcgacuacacccagacccugagcaagaagcccgagauccccaccuucgaggugcuggccuucaagaacagaacccugggccugaucgacgccagcuggagcgccaucagaaucggcaucuacgcccugcaccuggagaacuggcugcaguacuucccccugagccagauccuguucgugagcggcgagagacugaucguggaccccgccggcgagauggccaaggugcaggacuuccugggccugaagagaguggugaccgagaagcacuucuacuucaacaagaccaagggcuuccccugccugaagaagcccgaggacagcagcgcccccagaugccugggcaagagcaagggcagaacccaccccagaaucgaccccgacgugauccacagacugagaaaguucuacaagcccuucaaccugauguucuaccagaugaccggccaggacuuccagugggagcaggaggagggcgacaaguaa

SEQ ID NO: 18230 - RNA, 1041 nt, Artificial Sequence
  HS3ST5__Homo_sapiens__NP_705840
augcuguucaagcagcaggccuggcugagacagaagcugcuggugcugggcagccuggccgugggcagccugcuguaccugguggccagagugggcagccuggacagacugcagcccaucugccccaucgagggcagacugggcggcgccagaacccaggccgaguucccccugagagcccugcaguucaagagaggccugcugcacgaguucagaaagggcaacgccagcaaggagcaggugagacugcacgaccuggugcagcagcugcccaaggccaucaucaucggcgugagaaagggcggcaccagagcccugcuggagaugcugaaccugcaccccgccguggugaaggccagccaggagauccacuucuucgacaacgacgagaacuacggcaagggcaucgagugguacagaaagaagaugcccuucagcuacccccagcagaucaccaucgagaagagccccgccuacuucaucaccgaggaggugcccgagagaaucuacaagaugaacagcagcaucaagcugcugaucaucgugagagagcccaccaccagagccaucagcgacuacacccaggugcuggagggcaaggagagaaagaacaagaccuacuacaaguucgagaagcuggccaucgaccccaacaccugcgaggugaacaccaaguacaaggccgugagaaccagcaucuacaccaagcaccuggagagauggcugaaguacuuccccaucgagcaguuccacgugguggacggcgacagacugaucaccgagccccugcccgagcugcagcugguggagaaguuccugaaccugccccccagaaucagccaguacaaccuguacuucaacgccaccagaggcuucuacugccugagauucaacaucaucuucaacaagugccuggccggcagcaagggcagaauccaccccgagguggaccccagcgugaucaccaagcugagaaaguucuuccaccccuucaaccagaaguucuaccagaucaccggcagaacccugaacuggcccuaa

SEQ ID NO: 18231 - RNA, 1029 nt, Artificial Sequence
  HS3ST6__Homo_sapiens__NP_001009606
auggccggcagcggcggccugggcggcggcgccggcggcggccagggcgccggcgccggccagggcgccgcccugagagccagcagagcccccaugcugcugguggcccuggugcugggcgccuacugccugugcgcccugcccggcagaugcccccccgccgccagagcccccgcccccgcccccgcccccagcgagcccagcagcagcgugcacagacccggcgcccccggccugccccuggccagcggccccggcagaagaagauucccccaggcccugaucgugggcgugaagaagggcggcaccagagcccugcuggaguuccugagacugcaccccgacgugagagcccugggcagcgagccccacuucuucgacagaugcuacgagagaggccuggccugguacagaagccugaugcccagaacccuggacggccagaucaccauggagaagacccccagcuacuucgugaccagagaggcccccagaagaauccacgccaugagccccgacaccaagcugaucgugguggugagaaaccccgugaccagagccaucagcgacuacgcccagacccugagcaagacccccggccugcccagcuucagagcccuggccuucagacacggccugggccccguggacaccgccuggagcgccgugagaaucggccuguacgcccagcaccuggaccacuggcugagauacuucccccugagccacuuccuguucgugagcggcgagagacuggugagcgaccccgccggcgaggugggcagagugcaggacuuccugggccugaagagaguggugaccgacaagcacuucuacuucaacgccaccaagggcuuccccugccugaagaaggcccagggcggcagcagacccagaugccugggcaagagcaagggcagaccccaccccagagugccccaggcccuggugagaagacugcaggaguucuacagacccuucaacagaagauucuaccagaugaccggccaggacuucggcuggggcuaa

SEQ ID NO: 18232 - RNA, 1236 nt, Artificial Sequence
  HS6ST1__Homo_sapiens__NP_004798
augagaagaagaagagccggcggcagaaccaugguggagagagccagcaaguucgugcuggugguggccggcagcgugugcuucaugcugauccuguaccaguacgccggccccggccugagccugggcgcccccggcggcagagccccccccgacgaccuggaccuguuccccacccccgacccccacuacgagaagaaguacuacuuccccgugagagagcuggagagaagccugagauucgacaugaagggcgacgacgugaucguguuccugcacauccagaagaccggcggcaccaccuucggcagacaccuggugcagaacgugagacuggaggugcccugcgacugcagacccggccagaagaagugcaccugcuacagacccaacagaagagagaccuggcuguucagcagauucagcaccggcuggagcugcggccugcacgccgacuggaccgagcugaccaacugcgugcccggcgugcuggacagaagagacagcgccgcccugagaacccccagaaaguucuacuacaucacccugcugagagaccccgugagcagauaccugagcgaguggagacacgugcagagaggcgccaccuggaagaccagccugcacaugugcgacggcagaacccccacccccgaggagcugccccccugcuacgagggcaccgacuggagcggcugcacccugcaggaguucauggacugccccuacaaccuggccaacaacagacaggugagaaugcuggccgaccugagccuggugggcugcuacaaccugagcuucauccccgagggcaagagagcccagcugcugcuggagagcgccaagaagaaccugagaggcauggccuucuucggccugaccgaguuccagagaaagacccaguaccuguucgagagaaccuucaaccugaaguucaucagacccuucaugcaguacaacagcaccagagccggcggcguggagguggacgaggacaccaucagaagaaucgaggagcugaacgaccuggacaugcagcuguacgacuacgccaaggaccuguuccagcagagauaccaguacaagagacagcuggagagaagagagcagagacugagaagcagagaggagagacugcugcacagagccaaggaggcccugcccagagaggacgccgacgagcccggcagagugcccaccgaggacuacaugagccacaucaucgagaagugguaa

SEQ ID NO: 18233 - RNA, 1938 nt, Artificial Sequence
  HS6ST2__Homo_sapiens__NP_001070656
auggcccugcccgccugcgccgugagagaguucgagccccccagacagcccgagagaggcgcccccgugagaaccaccugccccagaagacacagcagaguggaggccgagcuggccgccagcagacccggcagcguggccgccagcgugagagccggcccccccagaggcgugagccacggcuuccacaccagaccccugcuggacaagcccagaaaggccagcagcagccuggccggcgccgccugcgccccccuguucgcccugcugagcagaggcagaagaagaagaaugcacgugcugagaagaagaugggaccugggcagccugugcagagcccugcugaccagaggccuggccgcccugggccacagccugaagcacgugcugggcgccaucuucagcaagaucuucggccccauggccagcgugggcaacauggacgagaagagcaacaagcugcugcuggcccuggugaugcuguuccuguucgccgugaucgugcugcaguacgugugccccggcaccgagugccagcugcugagacugcaggccuucagcagccccgugcccgaccccuacagaagcgaggacgagagcagcgccagauucgugcccagauacaacuucaccagaggcgaccugcugagaaagguggacuucgacaucaagggcgacgaccugaucguguuccugcacauccagaagaccggcggcaccaccuucggcagacaccuggugagaaacauccagcuggagcagcccugcgagugcagagugggccagaagaagugcaccugccacagacccggcaagagagagaccuggcuguucagcagauucagcaccggcuggagcugcggccugcacgccgacuggaccgagcugaccagcugcgugcccagcgugguggacggcaagagagacgccagacugagacccagcagauggagaaucuuccagauccuggacgccgccagcaaggacaagagaggcagccccaacaccaacgccggcgccaacagccccagcagcaccaagaccagaaacaccagcaagagcggcaagaacuuccacuacaucaccauccugagagaccccgugagcagauaccugagcgaguggagacacgugcagagaggcgccaccuggaaggccagccugcacgugugcgacggcagaccccccaccagcgaggagcugcccagcugcuacaccggcgacgacuggagcggcugcccccugaaggaguucauggacugccccuacaaccuggccaacaacagacaggugagaaugcugagcgaccugacccuggugggcugcuacaaccugagcgugaugcccgagaagcagagaaacaaggugcugcuggagagcgccaagagcaaccugaagcacauggccuucuucggccugaccgaguuccagagaaagacccaguaccuguucgagaagaccuucaacaugaacuucaucagccccuucacccaguacaacaccaccagagccagcagcguggagaucaacgaggagauccagaagagaaucgagggccugaacuuccuggacauggagcuguacagcuacgccaaggaccuguuccugcagagauaccaguucaugagacagaaggagcaccaggaggccagaagaaagagacaggagcagagaaaguuccugaagggcagacugcugcagacccacuuccagagccagggccagggccagagccagaaccccaaccagaaccagagccagaaccccaaccccaacgccaaccagaaccugacccagaaccugaugcagaaccugacccagagccugagccagaaggagaacagagagagccccaagcagaacagcggcaaggagcagaacgacaacaccagcaacggcaccaacgacuacaucggcagcguggagaaguggagauaa

SEQ ID NO: 18234 - RNA, 1416 nt, Artificial Sequence
  HS6ST3__Homo_sapiens__NP_703157
auggacgagagauucaacaaguggcugcugacccccgugcugacccugcuguucguggugaucauguaccaguacgugagccccagcugcaccagcagcugcaccaacuucggcgagcagcccagagccggcgaggccggcccccccgccgugcccggccccgccagaagagcccaggccccccccgaggagugggagagaagaccccagcugccccccccccccagaggcccccccgagggccccagaggcgccgccgcccccgaggaggaggacgaggagcccggcgaccccagagagggcgaggaggaggaggaggaggacgagcccgaccccgaggcccccgagaacggcagccugcccagauucgugcccagauucaacuucagccugaaggaccugaccagauucguggacuucaacaucaagggcagagacgugaucguguuccugcacauccagaagaccggcggcaccaccuucggcagacaccuggugaagaacaucagacuggagcagcccugcagcugcaaggccggccagaagaagugcaccugccacagacccggcaagaaggagaccuggcuguucagcagauucagcaccggcuggagcugcggccugcacgccgacuggaccgagcugaccaacugcgugcccgccaucauggagaagaaggacugccccagaaaccacagccacaccagaaacuucuacuacaucaccaugcugagagaccccgugagcagauaccugagcgaguggaagcacgugcagagaggcgccaccuggaagaccagccugcacaugugcgacggcagaagccccacccccgacgagcugcccaccugcuaccccggcgacgacuggagcggcgugagccugagagaguucauggacugcaccuacaaccuggccaacaacagacaggugagaaugcuggccgaccugagccuggugggcugcuacaaccugaccuucaugaacgagagcgagagaaacaccauccugcugcagagcgccaagaacaaccugaagaacauggccuucuucggccugaccgaguuccagagaaagacccaguuccuguucgagagaaccuucaaccugaaguucaucagccccuucacccaguucaacaucaccagagccagcaacguggagaucaacgagggcgccagacagagaaucgaggaccugaacuuccuggacaugcagcuguacgaguacgccaaggaccuguuccagcagagauaccaccacaccaagcagcuggagcaccagagagacagacagaagagaagagaggagagaagacugcagagagagcacagagaccaccaguggcccaaggaggacggcgccgccgagggcaccgugaccgaggacuacaacagccagguggugagaugguaa

SEQ ID NO: 18235 - RNA, 231 nt, Artificial Sequence
  HSBP1__Homo_sapiens__NP_001528
auggccgagaccgaccccaagaccgugcaggaccugaccagcguggugcagacccugcugcagcagaugcaggacaaguuccagaccaugagcgaccagaucaucggcagaaucgacgacaugagcagcagaaucgacgaccuggagaagaacaucgccgaccugaugacccaggccggcguggaggagcuggagagcgagaacaagauccccgccacccagaagagcuaa

SEQ ID NO: 18236 - RNA, 879 nt, Artificial Sequence
  HSD11B1__Homo_sapiens__NP_001193670
auggccuucaugaagaaguaccugcugcccauccugggccuguucauggccuacuacuacuacagcgccaacgaggaguucagacccgagaugcugcagggcaagaaggugaucgugaccggcgccagcaagggcaucggcagagagauggccuaccaccuggccaagaugggcgcccacgugguggugaccgccagaagcaaggagacccugcagaagguggugagccacugccuggagcugggcgccgccagcgcccacuacaucgccggcaccauggaggacaugaccuucgccgagcaguucguggcccaggccggcaagcugaugggcggccuggacaugcugauccugaaccacaucaccaacaccagccugaaccuguuccacgacgacauccaccacgugagaaagagcauggaggugaacuuccugagcuacguggugcugaccguggccgcccugcccaugcugaagcagagcaacggcagcaucgugguggugagcagccuggccggcaagguggccuaccccaugguggccgccuacagcgccagcaaguucgcccuggacggcuucuucagcagcaucagaaaggaguacagcgugagcagagugaacgugagcaucacccugugcgugcugggccugaucgacaccgagaccgccaugaaggccgugagcggcaucgugcacaugcaggccgcccccaaggaggagugcgcccuggagaucaucaagggcggcgcccugagacaggaggagguguacuacgacagcagccuguggaccacccugcugaucagaaaccccugcagaaagauccuggaguuccuguacagcaccagcuacaacauggacagauucaucaacaaguaa

SEQ ID NO: 18237 - RNA, 1002 nt, Artificial Sequence
  HSD11B1L__Homo_sapiens__NP_001254797
auggccaaccugggcacccugcagcugcugccccccagauucaagagauucagcugccugagccugcccaacaucuggaucaccggcaugcccgugcccgccaccagcgugcccugccccagcgccggcccccacagaaccaugaaggugcugcugcugaccggccugggcgcccuguucuucgccuacuacugggacgacaacuucgaccccgccagccugcagggcgccagagugcugcugaccggcgccaacgccggcgugggcgaggagcuggccuaccacuacgccagacugggcagccaccuggugcugaccgcccacaccgaggcccugcugcagaagguggugggcaacugcagaaagcugggcgcccccaagguguucuacaucgccgccgacauggccagccccgaggcccccgagagcguggugcaguucgcccuggacaagcugggcggccuggacuaccuggugcugaaccacaucggcggcgcccccgccggcaccagagccagaagcccccaggccaccagauggcugaugcaggugaacuucgugagcuacgugcagcugaccagcagagcccugcccagccugaccgacagcaagggcagccuggugguggugagcagccugcugggcagagugcccaccagcuucagcacccccuacagcgccgccaaguucgcccuggacggcuucuucggcagccugagaagagagcuggacgugcaggacgugaacguggccaucaccaugugcgugcugggccugagagacagagccagcgccgccgaggccgugagaggcgugaccagagugaaggccgcccccggccccaaggccgcccuggccgugaucagaggcggcgccaccagagccgccggcguguucuaccccuggagauucagacugcugugccugcugagaagauggcugcccagacccagagccugguucaucagacaggagcugaacgugaccgccgccgccgccuaa

SEQ ID NO: 18238 - RNA, 1218 nt, Artificial Sequence
  HSD11B2__Homo_sapiens__NP_000187
auggagagauggcccuggcccagcggcggcgccuggcugcugguggccgccagagcccugcugcagcugcugagaagcgaccugagacugggcagaccccugcuggccgcccuggcccugcuggccgcccuggacuggcugugccagagacugcugcccccccccgccgcccuggccgugcuggccgccgccggcuggaucgcccugagcagacuggccagaccccagagacugcccguggccaccagagccgugcugaucaccggcugcgacagcggcuucggcaaggagaccgccaagaagcuggacagcaugggcuucaccgugcuggccaccgugcuggagcugaacagccccggcgccaucgagcugagaaccugcugcagccccagacugagacugcugcagauggaccugaccaagcccggcgacaucagcagagugcuggaguucaccaaggcccacaccaccagcaccggccuguggggccuggugaacaacgccggccacaacgaggugguggccgacgccgagcugagccccguggccaccuucagaagcugcauggaggugaacuucuucggcgcccuggagcugaccaagggccugcugccccugcugagaagcagcagaggcagaaucgugaccgugggcagccccgccggcgacaugcccuaccccugccugggcgccuacggcaccagcaaggccgccguggcccugcugauggacaccuucagcugcgagcugcugcccuggggcgugaaggugagcaucauccagcccggcugcuucaagaccgagagcgugagaaacgugggccagugggagaagagaaagcagcugcugcuggccaaccugccccaggagcugcugcaggccuacggcaaggacuacaucgagcaccugcacggccaguuccugcacagccugagacuggccaugagcgaccugacccccgugguggacgccaucaccgacgcccugcuggccgccagacccagaagaagauacuaccccggccagggccugggccugauguacuucauccacuacuaccugcccgagggccugagaagaagauuccugcaggccuucuucaucagccacugccugcccagagcccugcagcccggccagcccggcaccacccccccccaggacgccgcccaggaccccaaccugagccccggccccagccccgccguggccagauaa

SEQ ID NO: 18239 - RNA, 759 nt, Artificial Sequence
  HSD17B10__Homo_sapiens__NP_001032900
auggccgccgccugcagaagcgugaagggccugguggccgugaucaccggcggcgccagcggccugggccuggccaccgccgagagacuggugggccagggcgccagcgccgugcugcuggaccugcccaacagcggcggcgaggcccaggccaagaagcugggcaacaacugcguguucgcccccgccgacgugaccagcgagaaggacgugcagaccgcccuggcccuggccaagggcaaguucggcagaguggacguggccgugaacugcgccggcaucgccguggccagcaagaccuacaaccugaagaagggccagacccacacccuggaggacuuccagagagugcuggacgugaaccugaugggcaccuucaacgugaucagacugguggccggcgagaugggccagaacgagcccgaccagggcggccagagaggcgugaucaucaacaccgccagcguggccgccuucgagggccaggugggccaggccgccuacagcgccagcaagggcggcaucgugggcaugacccugcccaucgccagagaccuggcccccaucggccuguucggcaccccccugcugaccagccugcccgagaaggugugcaacuuccuggccagccaggugcccuuccccagcagacugggcgaccccgccgaguacgcccaccuggugcaggccaucaucgagaaccccuuccugaacggcgaggugaucagacuggacggcgccaucagaaugcagcccuaa

SEQ ID NO: 18240 - RNA, 903 nt, Artificial Sequence
  HSD17B11__Homo_sapiens__NP_057329
augaaguuccugcuggacauccugcugcugcugccccugcugaucgugugcagccuggagagcuucgugaagcuguucauccccaagagaagaaagagcgugaccggcgagaucgugcugaucaccggcgccggccacggcaucggcagacugaccgccuacgaguucgccaagcugaagagcaagcuggugcugugggacaucaacaagcacggccuggaggagaccgccgccaagugcaagggccugggcgccaaggugcacaccuucgugguggacugcagcaacagagaggacaucuacagcagcgccaagaaggugaaggccgagaucggcgacgugagcauccuggugaacaacgccggcgugguguacaccagcgaccuguucgccacccaggacccccagaucgagaagaccuucgaggugaacgugcuggcccacuucuggaccaccaaggccuuccugcccgccaugaccaagaacaaccacggccacaucgugaccguggccagcgccgccggccacgugagcgugcccuuccugcuggccuacugcagcagcaaguucgccgccgugggcuuccacaagacccugaccgacgagcuggccgcccugcagaucaccggcgugaagaccaccugccugugccccaacuucgugaacaccggcuucaucaagaaccccagcaccagccugggccccacccuggagcccgaggagguggugaacagacugaugcacggcauccugaccgagcagaagaugaucuucauccccagcagcaucgccuuccugaccacccuggagagaauccugcccgagagauuccuggccgugcugaagagaaagaucagcgugaaguucgacgccgugaucggcuacaagaugaaggcccaguaa

SEQ ID NO: 18241 - RNA, 939 nt, Artificial Sequence
  HSD17B12__Homo_sapiens__NP_057226
auggagagcgcccugcccgccgccggcuuccuguacugggugggcgccggcaccguggccuaccuggcccugagaaucagcuacagccuguucaccgcccugagaguguggggcgugggcaacgaggccggcgugggccccggccugggcgagugggccguggugaccggcagcaccgacggcaucggcaagagcuacgccgaggagcuggccaagcacggcaugaagguggugcugaucagcagaagcaaggacaagcuggaccaggugagcagcgagaucaaggagaaguucaagguggagaccagaaccaucgccguggacuucgccagcgaggacaucuacgacaagaucaagaccggccuggccggccuggagaucggcauccuggugaacaacgugggcaugagcuacgaguaccccgaguacuuccuggacgugcccgaccuggacaacgugaucaagaagaugaucaacaucaacauccugagcgugugcaagaugacccagcuggugcugcccggcaugguggagagaagcaagggcgccauccugaacaucagcagcggcagcggcaugcugcccgugccccugcugaccaucuacagcgccaccaagaccuucguggacuucuucagccagugccugcacgaggaguacagaagcaagggcguguucgugcagagcgugcugcccuacuucguggccaccaagcuggccaagaucagaaagcccacccuggacaagcccagccccgagaccuucgugaagagcgccaucaagaccgugggccugcagagcagaaccaacggcuaccugauccacgcccugaugggcagcaucaucagcaaccugcccagcuggaucuaccugaagaucgugaugaacaugaacaagagcaccagagcccacuaccugaagaagaccaagaagaacuaa

SEQ ID NO: 18242 - RNA, 795 nt, Artificial Sequence
  HSD17B13__Homo_sapiens__NP_001129702
augaacaucauccuggagauccugcugcugcugaucaccaucaucuacagcuaccuggagagccuggugaaguucuucaucccccagagaagaaagagcguggccggcgagaucgugcugaucaccggcgccggccacggcaucggcagacagaccaccuacgaguucgccaagagacagagcauccuggugcugugggacaucaacaaggugaagaaggaggugggcgacgugaccaucguggugaacaacgccggcaccguguaccccgccgaccugcugagcaccaaggacgaggagaucaccaagaccuucgaggugaacauccugggccacuucuggaucaccaaggcccugcugcccagcaugauggagagaaaccacggccacaucgugaccguggccagcgugugcggccacgagggcauccccuaccugauccccuacugcagcagcaaguucgccgccgugggcuuccacagaggccugaccagcgagcugcaggcccugggcaagaccggcaucaagaccagcugccugugccccguguucgugaacaccggcuucaccaagaaccccagcaccagacuguggcccgugcuggagaccgacgagguggugagaagccugaucgacggcauccugaccaacaagaagaugaucuucgugcccagcuacaucaacaucuuccugagacugcagaaguuccugcccgagagagccagcgccauccugaacagaaugcagaacauccaguucgaggccguggugggccacaagaucaagaugaaguaa

SEQ ID NO: 18243 - RNA, 813 nt, Artificial Sequence
  HSD17B14__Homo_sapiens__NP_057330
auggccaccggcaccagauacgccggcaagguggugguggugaccggcggcggcagaggcaucggcgccggcaucgugagagccuucgugaacagcggcgccagaguggugaucugcgacaaggacgagagcggcggcagagcccuggagcaggagcugcccggcgccguguucauccugugcgacgugacccaggaggacgacgugaagacccuggugagcgagaccaucagaagauucggcagacuggacugcguggugaacaacgccggccaccacccccccccccagagacccgaggagaccagcgcccagggcuucagacagcugcuggagcugaaccugcugggcaccuacacccugaccaagcuggcccugcccuaccugagaaagagccagggcaacgugaucaacaucagcagccuggugggcgccaucggccaggcccaggccgugcccuacguggccaccaagggcgccgugaccgccaugaccaaggcccuggcccuggacgagagccccuacggcgugagagugaacugcaucagccccggcaacaucuggaccccccugugggaggagcuggccgcccugaugcccgaccccagagccaccaucagagagggcaugcuggcccagccccugggcagaaugggccagcccgccgaggugggcgccgccgccguguuccuggccagcgaggccaacuucugcaccggcaucgagcugcuggugaccggcggcgccgagcugggcuacggcugcaaggccagcagaagcacccccguggacgcccccgacauccccagcuaa

SEQ ID NO: 18244 - RNA, 987 nt, Artificial Sequence
  HSD17B1__Homo_sapiens__NP_000404
auggccagaaccguggugcugaucaccggcugcagcagcggcaucggccugcaccuggccgugagacuggccagcgaccccagccagagcuucaagguguacgccacccugagagaccugaagacccagggcagacugugggaggccgccagagcccuggccugcccccccggcagccuggagacccugcagcuggacgugagagacagcaagagcguggccgccgccagagagagagugaccgagggcagaguggacgugcuggugugcaacgccggccugggccugcugggcccccuggaggcccugggcgaggacgccguggccagcgugcuggacgugaacguggugggcaccgugagaaugcugcaggccuuccugcccgacaugaagagaagaggcagcggcagagugcuggugaccggcagcgugggcggccugaugggccugcccuucaacgacguguacugcgccagcaaguucgcccuggagggccugugcgagagccuggccgugcugcugcugcccuucggcgugcaccugagccugaucgagugcggccccgugcacaccgccuucauggagaaggugcugggcagccccgaggaggugcuggacagaaccgacauccacaccuuccacagauucuaccaguaccuggcccacagcaagcagguguucagagaggccgcccagaaccccgaggagguggccgagguguuccugaccgcccugagagcccccaagcccacccugagauacuucaccaccgagagauuccugccccugcugagaaugagacuggacgaccccagcggcagcaacuacgugaccgccaugcacagagagguguucggcgacgugcccgccaaggccgaggccggcgccgaggccggcggcggcgccggccccggcgccgaggacgaggccggcagaggcgccgugggcgaccccgagcugggcgacccccccgccgccccccaguaa

SEQ ID NO: 18245 - RNA, 1164 nt, Artificial Sequence
  HSD17B2__Homo_sapiens__NP_002144
augagcaccuucuucagcgacaccgccuggaucugccuggccgugcccaccgugcugugcggcaccguguucugcaaguacaagaagagcagcggccagcuguggagcuggauggugugccuggccggccugugcgccgugugccugcugauccugagccccuucuggggccugauccuguucagcgugagcugcuuccugauguacaccuaccugagcggccaggagcugcugcccguggaccagaaggccgugcuggugaccggcggcgacugcggccugggccacgcccugugcaaguaccuggacgagcugggcuucaccguguucgccggcgugcugaacgagaacggccccggcgccgaggagcugagaagaaccugcagccccagacugagcgugcugcagauggacaucaccaagcccgugcagaucaaggacgccuacagcaagguggccgccaugcugcaggacagaggccugugggccgugaucaacaacgccggcgugcugggcuuccccaccgacggcgagcugcugcugaugaccgacuacaagcagugcauggccgugaacuucuucggcaccguggaggugaccaagaccuuccugccccugcugagaaagagcaagggcagacuggugaacgugagcagcaugggcggcggcgcccccauggagagacuggccagcuacggcagcagcaaggccgccgugaccauguucagcagcgugaugagacuggagcugagcaaguggggcaucaagguggccagcauccagcccggcggcuuccugaccaacaucgccggcaccagcgacaagugggagaagcuggagaaggacauccuggaccaccugcccgccgaggugcaggaggacuacggccaggacuacauccuggcccagagaaacuuccugcugcugaucaacagccuggccagcaaggacuucagccccgugcugagagacauccagcacgccauccuggccaagagccccuucgccuacuacacccccggcaagggcgccuaccuguggaucugccuggcccacuaccugcccaucggcaucuacgacuacuucgccaagagacacuucggccaggacaagcccaugcccagagcccugagaaugcccaacuacaagaagaaggccaccuaa

SEQ ID NO: 18246 - RNA, 933 nt, Artificial Sequence
  HSD17B3__Homo_sapiens__NP_000188
augggcgacgugcuggagcaguucuucauccugaccggccugcuggugugccuggccugccuggccaagugcgugagauucagcagaugcgugcugcugaacuacuggaaggugcugcccaagagcuuccugagaagcaugggccagugggccgugaucaccggcgccggcgacggcaucggcaaggccuacagcuucgagcuggccaagagaggccugaacguggugcugaucagcagaacccuggagaagcuggaggccaucgccaccgagaucgagagaaccaccggcagaagcgugaagaucauccaggccgacuucaccaaggacgacaucuacgagcacaucaaggagaagcuggccggccuggagaucggcauccuggugaacaacgugggcaugcugcccaaccugcugcccagccacuuccugaacgcccccgacgagauccagagccugauccacugcaacaucaccagcguggugaagaugacccagcugauccugaagcacauggagagcagacagaagggccugauccugaacaucagcagcggcaucgcccuguuccccuggccccuguacagcauguacagcgccagcaaggccuucgugugcgccuucagcaaggcccugcaggaggaguacaaggccaaggaggugaucauccaggugcugacccccuacgccgugagcaccgccaugaccaaguaccugaacaccaacgugaucaccaagaccgccgacgaguucgugaaggagagccugaacuacgugaccaucggcggcgagaccugcggcugccuggcccacgagauccuggccggcuuccugagccugauccccgccugggccuucuacagcggcgccuuccagagacugcugcugacccacuacguggccuaccugaagcugaacaccaaggugagauaa

SEQ ID NO: 18247 - RNA, 2211 nt, Artificial Sequence
  HSD17B4__Homo_sapiens__NP_000405
augggcagcccccugagauucgacggcagaguggugcuggugaccggcgccggcgccggccugggcagagccuacgcccuggccuucgccgagagaggcgcccuggugguggugaacgaccugggcggcgacuucaagggcgugggcaagggcagccuggccgccgacaaggugguggaggagaucagaagaagaggcggcaaggccguggccaacuacgacagcguggaggagggcgagaagguggugaagaccgcccuggacgccuucggcagaaucgacgugguggugaacaacgccggcauccugagagacagaagcuucgccagaaucagcgacgaggacugggacaucauccacagagugcaccugagaggcagcuuccaggugaccagagccgccugggagcacaugaagaagcagaaguacggcagaaucaucaugaccagcagcgccagcggcaucuacggcaacuucggccaggccaacuacagcgccgccaagcugggccugcugggccuggccaacagccuggccaucgagggcagaaagagcaacauccacugcaacaccaucgcccccaacgccggcagcagaaugacccagaccgugaugcccgaggaccugguggaggcccugaagcccgaguacguggccccccuggugcuguggcugugccacgagagcugcgaggagaacggcggccuguucgaggugggcgccggcuggaucggcaagcugagaugggagagaacccugggcgccaucgugagacagaagaaccaccccaugacccccgaggccgugaaggccaacuggaagaagaucugcgacuucgagaacgccagcaagccccagagcauccaggagagcaccggcagcaucaucgaggugcugagcaagaucgacagcgagggcggcgugagcgccaaccacaccagcagagccaccagcaccgccaccagcggcuucgccggcgccaucggccagaagcugccccccuucagcuacgccuacaccgagcuggaggccaucauguacgcccugggcgugggcgccagcaucaaggaccccaaggaccugaaguucaucuacgagggcagcagcgacuucagcugccugcccaccuucggcgugaucaucggccagaagagcaugaugggcggcggccuggccgagauccccggccugagcaucaacuucgccaaggugcugcacggcgagcaguaccuggagcuguacaagccccugcccagagccggcaagcugaagugcgaggccgugguggccgacgugcuggacaagggcagcggcguggugaucaucauggacguguacagcuacagcgagaaggagcugaucugccacaaccaguucagccuguuccuggugggcagcggcggcuucggcggcaagagaaccagcgacaaggugaagguggccguggccauccccaacagaccccccgacgccgugcugaccgacaccaccagccugaaccaggccgcccuguacagacugagcggcgacuggaacccccugcacaucgaccccaacuucgccagccuggccggcuucgacaagcccauccugcacggccugugcaccuucggcuucagcgccagaagagugcugcagcaguucgccgacaacgacgugagcagauucaaggccaucaaggccagauucgccaagcccguguaccccggccagacccugcagaccgagauguggaaggagggcaacagaauccacuuccagaccaaggugcaggagaccggcgacaucgugaucagcaacgccuacguggaccuggcccccaccagcggcaccagcgccaagacccccagcgagggcggcaagcugcagagcaccuucguguucgaggagaucggcagaagacugaaggacaucggccccgagguggugaagaaggugaacgccguguucgaguggcacaucaccaagggcggcaacaucggcgccaaguggaccaucgaccugaagagcggcagcggcaagguguaccagggccccgccaagggcgccgccgacaccaccaucauccugagcgacgaggacuucauggagguggugcugggcaagcuggacccccagaaggccuucuucagcggcagacugaaggccagaggcaacaucaugcugagccagaagcugcagaugauccugaaggacuacgccaagcuguaa

SEQ ID NO: 18248 - RNA, 954 nt, Artificial Sequence
  HSD17B6__Homo_sapiens__XP_006719735
auguggcuguaccuggccgccuucgugggccuguacuaccugcugcacugguacagagagagacagguggugagccaccugcaggacaaguacguguucaucaccggcugcgacagcggcuucggcaaccugcuggccagacagcuggacgccagaggccugagagugcuggccgccugccugaccgagaagggcgccgagcagcugagaggccagaccagcgacagacuggagaccgugacccuggacgugaccaagauggagagcaucgccgccgccacccagugggugaaggagcacgugggcgacagaggccuguggggccuggugaacaacgccggcauccugacccccaucacccugugcgaguggcugaacaccgaggacagcaugaacaugcugaaggugaaccugaucggcgugauccaggugacccugagcaugcugccccuggugagaagagccagaggcagaaucgugaacgugagcagcauccugggcagaguggccuucuucgugggcggcuacugcgugagcaaguacggcguggaggccuucagcgacauccugagaagagagauccagcacuucggcgugaagaucagcaucguggagcccggcuacuucagaaccggcaugaccaacaugacccagagccuggagagaaugaagcagagcuggaaggaggcccccaagcacaucaaggagaccuacggccagcaguacuucgacgcccuguacaacaucaugaaggagggccugcugaacugcagcaccaaccugaaccuggugaccgacugcauggagcacgcccugaccagcgugcaccccagaaccagauacagcgccggcugggacgccaaguucuucuucaucccccugagcuaccugcccaccagccuggccgacuacauccugaccagaagcuggcccaagcccgcccaggccguguaa

SEQ ID NO: 18249 - RNA, 468 nt, Artificial Sequence
  HSD17B7__Homo_sapiens__NP_001291441
augagaaagguggugcugaucaccggcgccagcagcggcaucggccuggcccugugcaagagacugcuggccgaggacgacgagcugcaccugugccuggccugcagaaacaugagcaaggccgaggccgugugcgccgcccugcuggccagccaccccaccgccgaggugaccaucgugcagguggacgugagcaaccugcagagcguguucagagccagcaaggagcugaagcagagauuccagagacuggacugcaucuaccugaacgccggcaucaugcccaacccccagcugaacaucaaggcccuguucuucggccuguucagcagaaaggugauccacauguucagcaccgccgagggccugcugacccagggcgacaagaucaccgccgacggccugcaggagguguucgagaccaacguguucggccacuucauccuggugaagaagcugugggccuaa

SEQ ID NO: 18250 - RNA, 786 nt, Artificial Sequence
  HSD17B8__Homo_sapiens__NP_055049
auggccagccagcugcagaacagacugagaagcgcccuggcccuggugaccggcgccggcagcggcaucggcagagccgugagcgugagacuggccggcgagggcgccaccguggccgccugcgaccuggacagagccgccgcccaggagaccgugagacugcugggcggccccggcagcaaggagggcccccccagaggcaaccacgccgccuuccaggccgacgugagcgaggccagagccgccagaugccugcuggagcaggugcaggccugcuucagcagaccccccagcgugguggugagcugcgccggcaucacccaggacgaguuccugcugcacaugagcgaggacgacugggacaaggugaucgccgugaaccugaagggcaccuuccuggugacccaggccgccgcccaggcccuggugagcaacggcugcagaggcagcaucaucaacaucagcagcaucgugggcaaggugggcaacgugggccagaccaacuacgccgccagcaaggccggcgugaucggccugacccagaccgccgccagagagcugggcagacacggcaucagaugcaacagcgugcugcccggcuucaucgccacccccaugacccagaaggugccccagaaggugguggacaagaucaccgagaugauccccaugggccaccugggcgaccccgaggacguggccgacgugguggccuuccuggccagcgaggacagcggcuacaucaccggcaccagcguggaggugaccggcggccuguucauguaa

SEQ ID NO: 18251 - RNA, 1128 nt, Artificial Sequence
  HSD3B1__Homo_sapiens__XP_011539616
auggccaugaccggcuggagcugccuggugaccggcgccggcggcuuccugggccagagaaucaucagacugcuggugaaggagaaggagcugaaggagaucagagugcuggacaaggccuucggccccgagcugagagaggaguucagcaagcugcagaacaagaccaagcugaccgugcuggagggcgacauccuggacgagcccuuccugaagagagccugccaggacgugagcgugaucauccacaccgccugcaucaucgacguguucggcgugacccacagagagagcaucaugaacgugaacgugaagggcacccagcugcugcuggaggccugcgugcaggccagcgugcccguguucaucuacaccagcagcaucgagguggccggccccaacagcuacaaggagaucauccagaacggccacgaggaggagccccuggagaacaccuggcccgcccccuacccccacagcaagaagcuggccgagaaggccgugcuggccgccaacggcuggaaccugaagaacggcggcacccuguacaccugcgcccugagacccauguacaucuacggcgagggcagcagauuccugagcgccagcaucaacgaggcccugaacaacaacggcauccugagcagcgugggcaaguucagcaccgugaaccccguguacgugggcaacguggccugggcccacauccuggcccugagagcccugcaggaccccaagaaggcccccagcaucagaggccaguucuacuacaucagcgacgacaccccccaccagagcuacgacaaccugaacuacacccugagcaaggaguucggccugagacuggacagcagauggagcuucccccugagccugauguacuggaucggcuuccugcuggagaucgugagcuuccugcugagacccaucuacaccuacagaccccccuucaacagacacaucgugacccugagcaacagcguguucaccuucagcuacaagaaggcccagagagaccuggccuacaagccccuguacagcugggaggaggccaagcagaagaccguggagugggugggcagccugguggacagacacaaggagacccugaagagcaagacccaguaa

SEQ ID NO: 18252 - RNA, 591 nt, Artificial Sequence
  HSD3B7__Homo_sapiens__NP_001136250
auggccgacagcgcccaggcccagaagcugguguaccuggugaccggcggcugcggcuuccugggcgagcacguggugagaaugcugcugcagagagagcccagacugggcgagcugagaguguucgaccagcaccugggccccuggcuggaggagcugaagaccggccccgugagagugaccgccauccagggcgacgugacccaggcccacgagguggccgccgccguggccggcgcccacguggugauccacaccgccggccugguggacguguucggcagagccagccccaagaccauccacgaggugaacgugcagggcaccagaaacgugaucgaggccugcgugcagaccggcaccagauuccugguguacaccagcagcauggagguggugggccccaacaccaagggccaccccuucuacagaggcaacgaggacacccccuacgaggccgugcacagacaccccuaccccugcagcaaggcccuggccgaguggcuggugcuggaggccaacggcagaaaggccaugcugcccggcugcaccugcuggcagcccggcagcuggagcagcggccagcccuaa

SEQ ID NO: 18253 - RNA, 828 nt, Artificial Sequence
  HSDL1__Homo_sapiens__NP_001139523
auggccgccguggacagcuucuaccugcuguacagagagaucgccagaagcugcaacugcuacauggaggcccuggcccuggugggcgccugguacaccgccagaaagagcaucaccgugaucugcgacuucuacagccugaucagacugcacuucauccccagacugggcagcagagccgaccugaucaagcaguacggcagaugggccguggugagcggcgccaccgacggcaucggcaaggccuacgccgaggagcuggccagcagaggccugaacaucauccugaucagcagaaacgaggagaagcugcaguacuucacccagcugagcgaggacaagcugugggacaucaucaacgugaacaucgccgccgccagccugauggugcacguggugcugcccggcaugguggagagaaagaagggcgccaucgugaccaucagcagcggcagcugcugcaagcccaccccccagcuggccgccuucagcgccagcaaggccuaccuggaccacuucagcagagcccugcaguacgaguacgccagcaagggcaucuucgugcagagccugauccccuucuacguggccaccagcaugaccgcccccagcaacuuccugcacagaugcagcuggcuggugcccagccccaagguguacgcccaccacgccgugagcacccugggcaucagcaagagaaccaccggcuacuggagccacagcauccaguuccuguucgcccaguacaugcccgaguggcuguggguguggggcgccaacauccugaacagaagccugagaaaggaggcccugagcugcaccgccuaa

SEQ ID NO: 18254 - RNA, 1038 nt, Artificial Sequence
  HSDL2__Homo_sapiens__NP_001182751
augcugcccaacaccggcagacuggccggcugcaccguguucaucaccggcgccagcagaggcaucggcaaggccaucgcccugaaggccgccaaggacggcgccaacaucgugaucgccgccaagaccgcccagccccaccccaagcugcugggcaccaucuacaccgccgccgaggagaucgaggccgugggcggcaaggcccugcccugcaucguggacgugagagacgagcagcagaucagcgccgccguggagaaggccaucaagaaguucggcgccuacaccaucgccaaguacggcaugagcauguacgugcugggcauggccgaggaguucaagggcgagaucgccgugaacgcccuguggcccaagaccgccauccacaccgccgccauggacaugcugggcggccccggcaucgagagccagugcagaaagguggacaucaucgccgacgccgccuacagcaucuuccagaagcccaagagcuucaccggcaacuucgugaucgacgagaacauccugaaggaggagggcaucgagaacuucgacguguacgccaucaagcccggccacccccugcagcccgacuucuuccuggacgaguaccccgaggccgugagcaagaagguggagagcaccggcgccgugcccgaguucaaggaggagaagcugcagcugcagcccaagcccagaagcggcgccguggaggagaccuucagaaucgugaaggacagccugagcgacgacguggugaaggccacccaggccaucuaccuguucgagcugagcggcgaggacggcggcaccugguuccuggaccugaagagcaagggcggcaacgugggcuacggcgagcccagcgaccaggccgacguggugaugagcaugaccaccgacgacuucgugaagauguucagcggcaagcugaagcccaccauggccuucaugagcggcaagcugaagaucaagggcaacauggcccuggccaucaagcuggagaagcugaugaaccagaugaacgccagacuguaa

SEQ ID NO: 18255 - RNA, 1590 nt, Artificial Sequence
  HSF1__Homo_sapiens__NP_005517
auggaccugcccgugggccccggcgccgccggccccagcaacgugcccgccuuccugaccaagcuguggacccuggugagcgaccccgacaccgacgcccugaucugcuggagccccagcggcaacagcuuccacguguucgaccagggccaguucgccaaggaggugcugcccaaguacuucaagcacaacaacauggccagcuucgugagacagcugaacauguacggcuucagaaagguggugcacaucgagcagggcggccuggugaagcccgagagagacgacaccgaguuccagcaccccugcuuccugagaggccaggagcagcugcuggagaacaucaagagaaaggugaccagcgugagcacccugaagagcgaggacaucaagaucagacaggacagcgugaccaagcugcugaccgacgugcagcugaugaagggcaagcaggagugcauggacagcaagcugcuggccaugaagcacgagaacgaggcccuguggagagagguggccagccugagacagaagcacgcccagcagcagaagguggugaacaagcugauccaguuccugaucagccuggugcagagcaacagaauccugggcgugaagagaaagaucccccugaugcugaacgacagcggcagcgcccacagcaugcccaaguacagcagacaguucagccuggagcacgugcacggcagcggccccuacagcgcccccagccccgccuacagcagcagcagccuguacgcccccgacgccguggccagcagcggccccaucaucagcgacaucaccgagcuggcccccgccagccccauggccagccccggcggcagcaucgacgagagaccccugagcagcagcccccuggugagagugaaggaggagccccccagccccccccagagccccagaguggaggaggccagccccggcagacccagcagcguggacacccugcugagccccaccgcccugaucgacagcauccugagagagagcgagcccgcccccgccagcgugaccgcccugaccgacgccagaggccacaccgacaccgagggcagaccccccagccccccccccaccagcacccccgagaagugccugagcguggccugccuggacaagaacgagcugagcgaccaccuggacgccauggacagcaaccuggacaaccugcagaccaugcugagcagccacggcuucagcguggacaccagcgcccugcuggaccuguucagccccagcgugaccgugcccgacaugagccugcccgaccuggacagcagccuggccagcauccaggagcugcugagcccccaggagccccccagaccccccgaggccgagaacagcagccccgacagcggcaagcagcuggugcacuacaccgcccagccccuguuccugcuggaccccggcagcguggacaccggcagcaacgaccugcccgugcuguucgagcugggcgagggcagcuacuucagcgagggcgacggcuucgccgaggaccccaccaucagccugcugaccggcagcgagccccccaaggccaaggaccccaccgugagcuaa

SEQ ID NO: 18256 - RNA, 1557 nt, Artificial Sequence
  HSF2__Homo_sapiens__NP_001129036
augaagcagagcagcaacgugcccgccuuccugagcaagcuguggacccugguggaggagacccacaccaacgaguucaucaccuggagccagaacggccagagcuuccuggugcuggacgagcagagauucgccaaggagauccugcccaaguacuucaagcacaacaacauggccagcuucgugagacagcugaacauguacggcuucagaaagguggugcacaucgacagcggcaucgugaagcaggagagagacggccccguggaguuccagcaccccuacuucaagcagggccaggacgaccugcuggagaacaucaagagaaaggugagcagcagcaagcccgaggagaacaagaucagacaggaggaccugaccaagaucaucagcagcgcccagaaggugcagaucaagcaggagaccaucgagagcagacugagcgagcugaagagcgagaacgagagccuguggaaggaggugagcgagcugagagccaagcacgcccagcagcagcaggugaucagaaagaucgugcaguucaucgugacccuggugcagaacaaccagcuggugagccugaagagaaagagaccccugcugcugaacaccaacggcgcccagaagaagaaccuguuccagcacaucgugaaggagcccaccgacaaccaccaccacaaggugccccacagcagaaccgagggccugaagcccagagagagaaucagcgacgacaucaucaucuacgacgugaccgacgacaacgccgacgaggagaacauccccgugauccccgagaccaacgaggacgugaucagcgaccccagcaacugcagccaguaccccgacaucgugaucguggaggacgacaacgaggacgaguacgcccccgugauccagagcggcgagcagaacgagcccgccagagagagccugagcagcggcagcgacggcagcagcccccugaugagcagcgccgugcagcugaacggcagcagcagccugaccagcgaggaccccgugaccaugauggacagcauccugaacgacaacaucaaccugcugggcaagguggagcugcuggacuaccuggacagcaucgacugcagccuggaggacuuccaggccaugcugagcggcagacaguucagcaucgaccccgaccugcugguggacagcgagaacaagggccuggagaccaccaagaacaacguggugcagcccgugagcgaggagggcagaaagagcaagagcaagcccgacaagcagcugauccaguacaccgccuucccccugcuggccuuccuggacggcaaccccgccagcagcguggagcaggccagcaccaccgccagcagcgaggugcugagcagcguggacaagcccaucgagguggacgagcugcuggacagcagccuggaccccgagcccacccagagcaagcuggugagacuggagccccugaccgaggccgaggccagcgaggccacccuguucuaccugugcgagcuggcccccgccccccuggacagcgacaugccccugcuggacagcuaa

SEQ ID NO: 18257 - RNA, 1479 nt, Artificial Sequence
  HSF4__Homo_sapiens__NP_001035757
augcaggaggcccccgccgcccugcccaccgagcccggccccagccccgugcccgccuuccugggcaagcugugggcccuggugggcgaccccggcaccgaccaccugaucagauggagccccagcggcaccagcuuccuggugagcgaccagagcagauucgccaaggaggugcugccccaguacuucaagcacagcaacauggccagcuucgugagacagcugaacauguacggcuucagaaagguggugagcaucgagcagggcggccugcugagacccgagagagaccacguggaguuccagcaccccagcuucgugagaggcagagagcagcugcuggagagagugagaagaaaggugcccgcccugagaggcgacgacggcagauggagacccgaggaccugggcagacugcugggcgaggugcaggcccugagaggcgugcaggagagcaccgaggccagacugagagagcugagacagcagaacgagauccuguggagagagguggugacccugagacagagccacggccagcagcacagagugaucggcaagcugauccagugccuguucggcccccugcaggccggccccagcaacgccggcggcaagagaaagcugagccugaugcuggacgagggcagcagcugccccacccccgccaaguucaacaccugcccccugcccggcgcccugcugcaggaccccuacuucauccagagcccccugcccgagaccaaccugggccugagcccccacagagccagaggccccaucaucagcgacauccccgaggacagccccagccccgagggcaccagacugagccccagcagcgacggcagaagagagaagggccuggcccugcugaaggaggagcccgccagccccggcggcgacggcgaggccggccuggcccuggcccccaacgagugcgacuucugcgugaccgccccccccccccugcccguggccguggugcaggccauccuggagggcaagggcagcuucagccccgagggccccagaaacgcccagcagcccgagcccggcgaccccagagagauccccgacagaggcccccugggccuggagagcggcgacagaagccccgagagccugcugccccccaugcugcugcagcccccccaggagagcguggagcccgccggcccccuggacgugcugggccccagccugcagggcagagaguggacccugauggaccuggacauggagcugagccugaugcagccccuggugcccgagagaggcgagcccgagcuggccgugaagggccugaacagccccagccccggcaaggaccccacccugggcgccccccugcugcuggacgugcaggccgcccugggcggccccgcccugggccugcccggcgcccugaccaucuacagcacccccgagagcagaaccgccagcuaccugggccccgaggccagccccagccccuaa

SEQ ID NO: 18258 - RNA, 1791 nt, Artificial Sequence
  HSF5__Homo_sapiens__NP_001073908
auggaggcccugcugagcacccccaucaaccccaacaacuuccccgccaagcuguggagacuggugaacagccccagauacagaagcaucagaugggacggcagaggcgagggccugcugaucgaccagccccuguucgaggccgagcugcugagcccccccggccccggcggcggcggcggcaccgccggcgccggcgccgagcccgagcuguucaagaccaccagcuucaccagcuucaucagacagcugaaccuguacggcuucagaaagguggugcugggcggccccggcggcggcaagcccgccggcaacggcccccugcaccacuuccacaacccccacuucagaagagaccagccccagcugcuggugcaccugaagagacugaccagcgccaacaaggccaagcuggccgccggccuggaggugcccugcagaccccccaacagauuccagagacugcugaucaccagcgccagcgccgccaccgccccccugcagcaccagcagccccccccccccgccggccccagacccgagccccacggccccguggccgugggccaguuccacagaagcuucagaagagacagccugagccccuacagcugcgugagcacccccagccacgaccacagcaccuacccccugaagggccuggacagaacccccgugccccacagaaucuggcagaacagccugggcaugcaccccggccagguggagaccagccccaccuucagcgacaagggcgugcccuuccccgugcugcagagauuccccaccgaggugaccuacacccugcagcccagcaccaccagcgugcacgugcagcagggcccccagaccauggugagcagcagccagaaguacagcaacuacacccccagcgcccaguacagccaggccuacuaccccaccgccgugcugcagugcugcagccccacccacauggacgcccugagcagcugcgugacccccaccgccagcagcuacgcccacugcaacuacuuccagaaccccagcaugcagagcagcuaccccguggaguuccugcccagcaacuggcccugcagcaccaccgacgagaacaccaagaccgaggugaaccuggaggccguguuccagaucguggacgagcugcacagcagccccaagcuggagauggugaagguggagcccguggagaaccagugccccaccagccccagcuacagaggccagcacauccuggccaacagcaacaacagcaaccccugcagcgccagccaggccagccagcuggagccccugacccccgugggcagcgacaucaugagcuucguggugggcaccgagcaggccguggccugcagccugccccagagccccgaguacaucuacaccauccacaccgcccagcccguggagaacagcaccauccaggagagcgccgccauccagcaggcccacgugaagcugaaggagcaccugaaccacaaccccagccccagcagcgugguguucgugcaggagggcccccccuucagcacccaccagguggacgccaacaucaagugccagaccagcagcagagagaacauccugcccagcgagcagaugggcuuccugaucagcgagaugggccccgccagcaagcccagcgaggacaccggccuggccacccccgccagauacagagagcacagaagcaacagccagcagggcaagagccccgaccugcaccugcugguggacguggccugcaagcaggagagauuccccaaggaggaggagcugaaggaguaa

SEQ ID NO: 18259 - RNA, 612 nt, Artificial Sequence
  HSFY2__Homo_sapiens__NP_001001877
auggcccacgugagcagcgagacccaggacgugagccccaaggacgagcugaccgccagcgaggccagcaccagaagcccccugugcgagcacaccuuccccggcgacagcgaccugagaagcaugaucgaggagcacgccuuccaggugcugagccagggcagccugcuggagagccccagcuacaccgugugcgugagcgagcccgacaaggacgacgacuuccugagccugaacuuccccagaaagcuguggaagaucguggagagcgaccaguucaagagcaucagcugggacgagaacggcaccugcaucgugaucaacgaggagcuguucaagaaggagauccuggagaccaaggcccccuacagaaucuuccagaccgacgccaucaagagcuucgugagacagcugaaccuguacggcuucagcaagauccagcagaacuuccagagaagcgccuuccuggccaccuuccugagcgaggagaaggagagcagcgugcugagcaagaucagauucaccaagaugaagcugagcagaagcagcaccuacgagaacagauaccugugcugcaaccugcaccugaaggacgagagcaacuacagcuaa

SEQ ID NO: 18260 - RNA, 888 nt, Artificial Sequence
  HSH2D__Homo_sapiens__NP_001278203
augagaggcagcagaaugagccagcccccccagugccugagaagagcccagagcagcugcugccacuucauggugaagcugcuggacgacggcaccuucaugauccccggcgagaagguggcccacaccagccuggacgcccuggugaccuuccaccagcagaagcccaucgagcccagaagagagcugcugacccagcccugcagacagaaggaccccgccaacguggacuacgaggaccuguuccuguacagcaacgccguggccgaggaggccgccugccccgugagcgcccccgaggaggccagccccaagcccgugcugugccaccagagcaaggagagaaagcccagcgccgagaugaacagaaucaccaccaaggaggccaccagcagcugcccccccaagagcccccugggcgagaccagacagaagcuguggagaagccugaagaugcugcccgagagaggccagagagugagacagcagcugaagagccaccuggccaccgugaaccugagcagccugcuggacgugagaagaagcaccgugaucagcggccccggcaccggcaagggcagccaggaccacagcggcgaccccaccagcggcgacagaggcuacaccgaccccugcguggccaccagccugaagagccccagccagccccaggcccccaaggacagaaaggugcccaccagaaaggccgagagaagcgugagcugcaucgaggugacccccggcgacagaagcuggcaccagaugguggugagagcccugagcagccaggagagcaagcccgagcaccagggccuggccgagcccgagaacgaccagcugcccgaggaguaccagcagcccccccccuucgcccccggcuacugcuaa

SEQ ID NO: 18261 - RNA, 2565 nt, Artificial Sequence
  HSP90AA1__Homo_sapiens__NP_001017963
augccccccugcagcggcggcgacggcagcaccccccccggccccagccugagagacagagacugccccgcccagagcgccgaguaccccagagacagacuggaccccagacccggcagccccagcgaggccagcagcccccccuuccugagaagcagagcccccgugaacugguaccaggagaaggcccagguguuccuguggcaccugauggugagcggcagcaccacccugcugugccuguggaagcagcccuuccacgugagcgccuuccccgugaccgccagccuggccuucagacagagccagggcgccggccagcaccuguacaaggaccugcagcccuucauccugcugagacugcugaugcccgaggagacccagacccaggaccagcccauggaggaggaggagguggagaccuucgccuuccaggccgagaucgcccagcugaugagccugaucaucaacaccuucuacagcaacaaggagaucuuccugagagagcugaucagcaacagcagcgacgcccuggacaagaucagauacgagagccugaccgaccccagcaagcuggacagcggcaaggagcugcacaucaaccugauccccaacaagcaggacagaacccugaccaucguggacaccggcaucggcaugaccaaggccgaccugaucaacaaccugggcaccaucgccaagagcggcaccaaggccuucauggaggcccugcaggccggcgccgacaucagcaugaucggccaguucggcgugggcuucuacagcgccuaccugguggccgagaaggugaccgugaucaccaagcacaacgacgacgagcaguacgccugggagagcagcgccggcggcagcuucaccgugagaaccgacaccggcgagcccaugggcagaggcaccaaggugauccugcaccugaaggaggaccagaccgaguaccuggaggagagaagaaucaaggagaucgugaagaagcacagccaguucaucggcuaccccaucacccuguucguggagaaggagagagacaaggaggugagcgacgacgaggccgaggagaaggaggacaaggaggaggagaaggagaaggaggagaaggagagcgaggacaagcccgagaucgaggacgugggcagcgacgaggaggaggagaagaaggacggcgacaagaagaagaagaagaagaucaaggagaaguacaucgaccaggaggagcugaacaagaccaagcccaucuggaccagaaaccccgacgacaucaccaacgaggaguacggcgaguucuacaagagccugaccaacgacugggaggaccaccuggccgugaagcacuucagcguggagggccagcuggaguucagagcccugcuguucgugcccagaagagcccccuucgaccuguucgagaacagaaagaagaagaacaacaucaagcuguacgugagaagaguguucaucauggacaacugcgaggagcugauccccgaguaccugaacuucaucagaggcgugguggacagcgaggaccugccccugaacaucagcagagagaugcugcagcagagcaagauccugaaggugaucagaaagaaccuggugaagaagugccuggagcuguucaccgagcuggccgaggacaaggagaacuacaagaaguucuacgagcaguucagcaagaacaucaagcugggcauccacgaggacagccagaacagaaagaagcugagcgagcugcugagauacuacaccagcgccagcggcgacgagauggugagccugaaggacuacugcaccagaaugaaggagaaccagaagcacaucuacuacaucaccggcgagaccaaggaccagguggccaacagcgccuucguggagagacugagaaagcacggccuggaggugaucuacaugaucgagcccaucgacgaguacugcgugcagcagcugaaggaguucgagggcaagacccuggugagcgugaccaaggagggccuggagcugcccgaggacgaggaggagaagaagaagcaggaggagaagaagaccaaguucgagaaccugugcaagaucaugaaggacauccuggagaagaagguggagaaggugguggugagcaacagacuggugaccagccccugcugcaucgugaccagcaccuacggcuggaccgccaacauggagagaaucaugaaggcccaggcccugagagacaacagcaccaugggcuacauggccgccaagaagcaccuggagaucaaccccgaccacagcaucaucgagacccugagacagaaggccgaggccgacaagaacgacaagagcgugaaggaccuggugauccugcuguacgagaccgcccugcugagcagcggcuucagccuggaggacccccagacccacgccaacagaaucuacagaaugaucaagcugggccugggcaucgacgaggacgaccccaccgccgacgacaccagcgccgccgugaccgaggagaugcccccccuggagggcgacgacgacaccagcagaauggaggagguggacuaa

SEQ ID NO: 18262 - RNA, 2175 nt, Artificial Sequence
  HSP90AB1__Homo_sapiens__NP_001258898
augcccgaggaggugcaccacggcgaggaggagguggagaccuucgccuuccaggccgagaucgcccagcugaugagccugaucaucaacaccuucuacagcaacaaggagaucuuccugagagagcugaucagcaacgccagcgacgcccuggacaagaucagauacgagagccugaccgaccccagcaagcuggacagcggcaaggagcugaagaucgacaucauccccaacccccaggagagaacccugacccugguggacaccggcaucggcaugaccaaggccgaccugaucaacaaccugggcaccaucgccaagagcggcaccaaggccuucauggaggcccugcaggccggcgccgacaucagcaugaucggccaguucggcgugggcuucuacagcgccuaccugguggccgagaaggugguggugaucaccaagcacaacgacgacgagcaguacgccugggagagcagcgccggcggcagcuucaccgugagagccgaccacggcgagcccaucggcagaggcaccaaggugauccugcaccugaaggaggaccagaccgaguaccuggaggagagaagagugaaggagguggugaagaagcacagccaguucaucggcuaccccaucacccuguaccuggagaaggagagagagaaggagaucagcgacgacgaggccgaggaggagaagggcgagaaggaggaggaggacaaggacgacgaggagaagcccaagaucgaggacgugggcagcgacgaggaggacgacagcggcaaggacaagaagaagaagaccaagaagaucaaggagaaguacaucgaccaggaggagcugaacaagaccaagcccaucuggaccagaaaccccgacgacaucacccaggaggaguacggcgaguucuacaagagccugaccaacgacugggaggaccaccuggccgugaagcacuucagcguggagggccagcuggaguucagagcccugcuguucauccccagaagagcccccuucgaccuguucgagaacaagaagaagaagaacaacaucaagcuguacgugagaagaguguucaucauggacagcugcgacgagcugauccccgaguaccugaacuucaucagaggcgugguggacagcgaggaccugccccugaacaucagcagagagaugcugcagcagagcaagauccugaaggugaucagaaagaacaucgugaagaagugccuggagcuguucagcgagcuggccgaggacaaggagaacuacaagaaguucuacgaggccuucagcaagaaccugaagcugggcauccacgaggacagcaccaacagaagaagacugagcgagcugcugagauaccacaccagccagagcggcgacgagaugaccagccugagcgaguacgugagcagaaugaaggagacccagaagagcaucuacuacaucaccggcgagagcaaggagcagguggccaacagcgccuucguggagagagugagaaagagaggcuucgaggugguguacaugaccgagcccaucgacgaguacugcgugcagcagcugaaggaguucgacggcaagagccuggugagcgugaccaaggagggccuggagcugcccgaggacgaggaggagaagaagaagauggaggagagcaaggccaaguucgagaaccugugcaagcugaugaaggagauccuggacaagaagguggagaaggugaccaucagcaacagacuggugagcagccccugcugcaucgugaccagcaccuacggcuggaccgccaacauggagagaaucaugaaggcccaggcccugagagacaacagcaccaugggcuacaugauggccaagaagcaccuggagaucaaccccgaccaccccaucguggagacccugagacagaaggccgaggccgacaagaacgacaaggccgugaaggaccugguggugcugcuguucgagaccgcccugcugagcagcggcuucagccuggaggacccccagacccacagcaacagaaucuacagaaugaucaagcugggccugggcaucgacgaggacgagguggccgccgaggagcccaacgccgccgugcccgacgagauccccccccuggagggcgacgaggacgccagcagaauggaggagguggacuaa

SEQ ID NO: 18263 - RNA, 2412 nt, Artificial Sequence
  HSP90B1__Homo_sapiens__NP_003290
augagagcccugugggugcugggccugugcugcgugcugcugaccuucggcagcgugagagccgacgacgagguggacguggacggcaccguggaggaggaccugggcaagagcagagagggcagcagaaccgacgacgagguggugcagagagaggaggaggccauccagcuggacggccugaacgccagccagaucagagagcugagagagaagagcgagaaguucgccuuccaggccgaggugaacagaaugaugaagcugaucaucaacagccuguacaagaacaaggagaucuuccugagagagcugaucagcaacgccagcgacgcccuggacaagaucagacugaucagccugaccgacgagaacgcccugagcggcaacgaggagcugaccgugaagaucaagugcgacaaggagaagaaccugcugcacgugaccgacaccggcgugggcaugaccagagaggagcuggugaagaaccugggcaccaucgccaagagcggcaccagcgaguuccugaacaagaugaccgaggcccaggaggacggccagagcaccagcgagcugaucggccaguucggcgugggcuucuacagcgccuuccugguggccgacaaggugaucgugaccagcaagcacaacaacgacacccagcacaucugggagagcgacagcaacgaguucagcgugaucgccgaccccagaggcaacacccugggcagaggcaccaccaucacccuggugcugaaggaggaggccagcgacuaccuggagcuggacaccaucaagaaccuggugaagaaguacagccaguucaucaacuuccccaucuacguguggagcagcaagaccgagaccguggaggagcccauggaggaggaggaggccgccaaggaggagaaggaggagagcgacgacgaggccgccguggaggaggaggaggaggagaagaagcccaagaccaagaagguggagaagaccgugugggacugggagcugaugaacgacaucaagcccaucuggcagagacccagcaaggagguggaggaggacgaguacaaggccuucuacaagagcuucagcaaggagagcgacgaccccauggccuacauccacuucaccgccgagggcgaggugaccuucaagagcauccuguucgugcccaccagcgcccccagaggccuguucgacgaguacggcagcaagaagagcgacuacaucaagcuguacgugagaagaguguucaucaccgacgacuuccacgacaugaugcccaaguaccugaacuucgugaagggcgugguggacagcgacgaccugccccugaacgugagcagagagacccugcagcagcacaagcugcugaaggugaucagaaagaagcuggugagaaagacccuggacaugaucaagaagaucgccgacgacaaguacaacgacaccuucuggaaggaguucggcaccaacaucaagcugggcgugaucgaggaccacagcaacagaaccagacuggccaagcugcugagauuccagagcagccaccaccccaccgacaucaccagccuggaccaguacguggagagaaugaaggagaagcaggacaagaucuacuucauggccggcagcagcagaaaggaggccgagagcagccccuucguggagagacugcugaagaagggcuacgaggugaucuaccugaccgagcccguggacgaguacugcauccaggcccugcccgaguucgacggcaagagauuccagaacguggccaaggagggcgugaaguucgacgagagcgagaagaccaaggagagcagagaggccguggagaaggaguucgagccccugcugaacuggaugaaggacaaggcccugaaggacaagaucgagaaggccguggugagccagagacugaccgagagccccugcgcccugguggccagccaguacggcuggagcggcaacauggagagaaucaugaaggcccaggccuaccagaccggcaaggacaucagcaccaacuacuacgccagccagaagaagaccuucgagaucaaccccagacacccccugaucagagacaugcugagaagaaucaaggaggacgaggacgacaagaccgugcuggaccuggccguggugcuguucgagaccgccacccugagaagcggcuaccugcugcccgacaccaaggccuacggcgacagaaucgagagaaugcugagacugagccugaacaucgaccccgacgccaagguggaggaggagcccgaggaggagcccgaggagaccgccgaggacaccaccgaggacaccgagcaggacgaggacgaggagauggacgugggcaccgacgaggaggaggagaccgccaaggagagcaccgccgagaaggacgagcuguaa

SEQ ID NO: 18264 - RNA, 2028 nt, Artificial Sequence
  HSPA12A__Homo_sapiens__NP_079291
auggccgacaaggaggccggcggcagcgacggccccagagagaccgcccccaccagcgccuacagcagccccgccagaagccugggcgacaccggcaucaccccccugagccccagccacaucgugaacgacaccgacagcaacgugagcgagcagcagagcuuccugguggugguggccguggacuucggcaccaccagcagcggcuacgccuacagcuucaccaaggagcccgagugcauccacgugaugagaagaugggagggcggcgaccccggcgugagcaaccagaagacccccaccaccauccugcugacccccgagagaaaguuccacagcuucggcuacgccgccagagacuucuaccacgaccuggaccccaacgaggccaagcaguggcuguaccuggagaaguucaagaugaagcugcacaccaccggcgaccugaccauggacaccgaccugaccgccgccaacggcaagaaggugaaggcccuggagaucuucgccuacgcccugcaguacuucaaggagcaggcccugaaggagcugagcgaccaggccggcagcgaguucgagaacagcgacgugagaugggugaucaccgugcccgccaucuggaagcagcccgccaagcaguucaugagacaggccgccuaccaggccggccuggccagccccgagaacagcgagcagcugaucaucgcccuggagcccgaggccgccagcaucuacugcagaaagcugagacugcaccagaugaucgagcugagcagcaaggccgccgugaacggcuacagcggcagcgacaccgugggcgccggcuucacccaggccaaggagcacaucagaagaaacagacagagcagaaccuuccugguggagaacgugaucggcgagaucuggagcgagcuggaggagggcgacaaguacguggugguggacagcggcggcggcaccguggaccugaccgugcaccagaucagacugcccgagggccaccugaaggagcuguacaaggccaccggcggccccuacggcagccugggcguggacuacgaguucgagaagcugcuguacaagaucuucggcgaggacuucaucgagcaguucaagaucaagagacccgccgccuggguggaccugaugaucgccuucgagagcagaaagagagccgccgcccccgacagaaccaacccccugaacaucacccugcccuucagcuucaucgacuacuacaagaaguucagaggccacagcguggagcacgcccugagaaagagcaacguggacuucgugaaguggagcagccagggcaugcugagaaugagccccgacgccaugaacgcccuguucaagcccaccaucgacagcaucaucgagcaccugagagaccuguuccagaagcccgaggugagcaccgugaaguuccuguuccuggugggcggcuucgccgaggccccccugcugcagcaggccgugcaggccgccuucggcgaccagugcagaaucaucaucccccaggacgugggccugaccauccugaagggcgccgugcuguucggccuggaccccgccgugaucaaggugagaagaagcccccugaccuacggcgugggcgugcugaacagauacguggagggcaagcacccccccgagaagcugcuggugaaggacggcaccagauggugcaccgacguguucgacaaguucaucagcgccgaccagagcguggcccugggcgagcuggugaagagaagcuacacccccgccaagcccagccagcuggugaucgugaucaacaucuacagcagcgagcacgacaacgugagcuucaucaccgaccccggcgugaagaagugcggcacccugagacuggaccugaccggcaccagcggcaccgccgugcccgccagaagagagauccagacccugaugcaguucggcgacaccgagaucaaggccaccgccaucgacaucgccaccagcaagagcgugaaggugggcaucgacuuccugaacuacuaa

SEQ ID NO: 18265 - RNA, 2061 nt, Artificial Sequence
  HSPA12B__Homo_sapiens__NP_443202
augcuggccgugcccgagaugggccugcagggccuguacaucggcagcagccccgagagaagccccgugcccagcccccccggcagccccagaacccaggagagcugcggcaucgccccccugacccccagccagagccccaagcccgaggugagagccccccagcaggccagcuucagcguggugguggccaucgacuucggcaccaccagcagcggcuacgccuucagcuucgccagcgaccccgaggccauccacaugaugagaaagugggagggcggcgaccccggcguggcccaccagaagacccccaccugccugcugcugacccccgagggcgccuuccacagcuucggcuacaccgccagagacuacuaccacgaccuggaccccgaggaggccagagacuggcuguacuucgagaaguucaagaugaagauccacagcgccaccgaccugacccugaagacccagcuggaggccgugaacggcaagaccaugcccgcccuggagguguucgcccacgcccugagauucuucagagagcacgcccugcaggagcugagagagcagagccccagccugcccgagaaggacaccgugagaugggugcugaccgugcccgccaucuggaagcagcccgccaagcaguucaugagagaggccgccuaccuggccggccuggugagcagagagaacgccgagcagcugcugaucgcccuggagcccgaggccgccagcguguacugcagaaagcugagacugcaccagcugcuggaccugagcggcagagcccccggcggcggcagacugggcgagagaagaagcaucgacagcagcuucagacaggccagagagcagcugagaagaagcagacacagcagaaccuuccugguggagagcggcgugggcgagcugugggccgagaugcaggccggcgacagauacgugguggccgacugcggcggcggcaccguggaccugaccgugcaccagcuggagcagccccacggcacccugaaggagcuguacaaggccagcggcggccccuacggcgccgugggcguggaccuggccuucgagcagcugcugugcagaaucuucggcgaggacuucaucgccaccuucaagagacagagacccgccgccuggguggaccugaccaucgccuucgaggccagaaagagaaccgccggcccccacagagccggcgcccugaacaucagccugcccuucagcuucaucgacuucuacagaaagcagagaggccacaacguggagaccgcccugagaagaagcagcgugaacuucgugaaguggagcagccagggcaugcugagaaugagcugcgaggccaugaacgagcuguuccagcccaccgugagcggcaucauccagcacaucgaggcccugcuggccagacccgaggugcagggcgugaagcugcuguuccuggugggcggcuucgccgagagcgccgugcugcagcacgccgugcaggccgcccugggcgccagaggccugagagugguggugccccacgacgugggccugaccauccugaagggcgccgugcuguucggccaggcccccggcguggugagagugagaagaagcccccugaccuacggcgugggcgugcugaacagauucgugcccggcagacacccccccgagaagcugcuggugagagacggcagaagauggugcaccgacguguucgagagauucguggccgccgagcagagcguggcccugggcgaggaggugagaagaagcuacugccccgccagacccggccagagaagagugcugaucaaccuguacugcugcgccgccgaggacgccagauucaucaccgaccccggcgugagaaagugcggcgcccugagccuggagcuggagcccgccgacugcggccaggacaccgccggcgccccccccggcagaagagagaucagagccgccaugcaguucggcgacaccgagaucaaggugaccgccguggacgugagcaccaacagaagcgugagagccagcaucgacuuccugagcaacuaa

SEQ ID NO: 18266 - RNA, 1416 nt, Artificial Sequence
  HSPA13__Homo_sapiens__NP_008879
auggccagagagaugaccauccugggcagcgccgugcugacccugcugcuggccggcuaccuggcccagcaguaccugccccugcccacccccaaggugaucggcaucgaccugggcaccaccuacugcagcgugggcguguucuuccccggcaccggcaaggugaaggugauccccgacgagaacggccacaucagcauccccagcauggugagcuucaccgacaacgacguguacgugggcuacgagagcguggagcuggccgacagcaacccccagaacaccaucuacgacgccaagagauucaucggcaagaucuucaccgccgaggagcuggaggccgagaucggcagauaccccuucaaggugcugaacaagaacggcaugguggaguucagcgugaccagcaacgagaccaucaccgugagccccgaguacgugggcagcagacugcugcugaagcugaaggagauggccgaggccuaccugggcaugcccguggccaacgccgugaucagcgugcccgccgaguucgaccugaagcagagaaacagcaccaucgaggccgccaaccuggccggccugaagauccugagagugaucaacgagcccaccgccgccgccauggccuacggccugcacaaggccgacguguuccacgugcuggugaucgaccugggcggcggcacccuggacgugagccugcugaacaagcagggcggcauguuccugaccagagccaugagcggcaacaacaagcugggcggccaggacuucaaccagagacugcugcaguaccuguacaagcagaucuaccagaccuacggcuucgugcccagcagaaaggaggagauccacagacugagacaggccguggagauggugaagcugaaccugacccugcaccagagcgcccagcugagcgugcugcugaccguggaggagcaggacagaaaggagccccacagcagcgacaccgagcugcccaaggacaagcugagcagcgccgacgaccacagagugaacagcggcuucggcagaggccugagcgacaagaagagcggcgagagccaggugcuguucgagaccgagaucagcagaaagcuguucgacacccugaacgaggaccuguuccagaagauccuggugcccauccagcaggugcugaaggagggccaccuggagaagaccgagaucgacgagguggugcuggugggcggcagcaccagaauccccagaaucagacaggugauccaggaguucuucggcaaggaccccaacaccagcguggaccccgaccuggccguggugaccggcguggccauccaggccggcaucgacggcggcagcuggccccugcaggugagcgcccuggagauccccaacaagcaccugcagaagaccaacuucaacuaa

SEQ ID NO: 18267 - RNA, 432 nt, Artificial Sequence
  HSPA14__Homo_sapiens__NP_001265134
auggccgccaucggcgugcaccugggcugcaccagcgccugcguggccguguacaaggacggcagagccggcgugguggccaacgacgccggcgacagagugacccccgccgugguggccuacagcgagaacgaggagaucgugggccuggccgccaagcagagcagaaucagaaacaucagcaacaccgugaugaaggugaagcagauccugggcagaagagugcugagcagagacccccagcugcagcagcugccccagcccuuccagagaugcagcugcagccugagcgagcagccccacggccagaccggcugcgugagaggcgcccagccccugcaccagcaccagccccagcacagcuggggcagccugcacaccgccgacagcagccugcuguucgagagcugguucugcuucugguggggcuaa

SEQ ID NO: 18268 - RNA, 1926 nt, Artificial Sequence
  HSPA1A__Homo_sapiens__NP_005336
auggccaaggccgccgccaucggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggcccugaacccccagaacaccguguucgacgccaagagacugaucggcagaaaguucggcgaccccguggugcagagcgacaugaagcacuggcccuuccaggugaucaacgacggcgacaagcccaaggugcaggugagcuacaagggcgagaccaaggccuucuaccccgaggagaucagcagcauggugcugaccaagaugaaggagaucgccgaggccuaccugggcuaccccgugaccaacgccgugaucaccgugcccgccuacuucaacgacagccagagacaggccaccaaggacgccggcgugaucgccggccugaacgugcugagaaucaucaacgagcccaccgccgccgccaucgccuacggccuggacagaaccggcaagggcgagagaaacgugcugaucuucgaccugggcggcggcaccuucgacgugagcauccugaccaucgacgacggcaucuucgaggugaaggccaccgccggcgacacccaccugggcggcgaggacuucgacaacagacuggugaaccacuucguggaggaguucaagagaaagcacaagaaggacaucagccagaacaagagagccgugagaagacugagaaccgccugcgagagagccaagagaacccugagcagcagcacccaggccagccuggagaucgacagccuguucgagggcaucgacuucuacaccagcaucaccagagccagauucgaggagcugugcagcgaccuguucagaagcacccuggagcccguggagaaggcccugagagacgccaagcuggacaaggcccagauccacgaccuggugcuggugggcggcagcaccagaauccccaaggugcagaagcugcugcaggacuucuucaacggcagagaccugaacaagagcaucaaccccgacgaggccguggccuacggcgccgccgugcaggccgccauccugaugggcgacaagagcgagaacgugcaggaccugcugcugcuggacguggccccccugagccugggccuggagaccgccggcggcgugaugaccgcccugaucaagagaaacagcaccauccccaccaagcagacccagaucuucaccaccuacagcgacaaccagcccggcgugcugauccagguguacgagggcgagagagccaugaccaaggacaacaaccugcugggcagauucgagcugagcggcaucccccccgcccccagaggcgugccccagaucgaggugaccuucgacaucgacgccaacggcauccugaacgugaccgccaccgacaagagcaccggcaaggccaacaagaucaccaucaccaacgacaagggcagacugagcaaggaggagaucgagagaauggugcaggaggccgagaaguacaaggccgaggacgaggugcagagagagagagugagcgccaagaacgcccuggagagcuacgccuucaacaugaagagcgccguggaggacgagggccugaagggcaagaucagcgaggccgacaagaagaaggugcuggacaagugccaggaggugaucagcuggcuggacgccaacacccuggccgagaaggacgaguucgagcacaagagaaaggagcuggagcaggugugcaaccccaucaucagcggccuguaccagggcgccggcggccccggccccggcggcuucggcgcccagggccccaagggcggcagcggcagcggccccaccaucgaggagguggacuaa

SEQ ID NO: 18269 - RNA, 1926 nt, Artificial Sequence
  HSPA1L__Homo_sapiens__NP_005518
auggccaccgccaagggcaucgccaucggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggccaugaacccccagaacaccguguucgacgccaagagacugaucggcagaaaguucaacgaccccguggugcaggccgacaugaagcuguggcccuuccaggugaucaacgagggcggcaagcccaaggugcuggugagcuacaagggcgagaacaaggccuucuaccccgaggagaucagcagcauggugcugaccaagcugaaggagaccgccgaggccuuccugggccaccccgugaccaacgccgugaucaccgugcccgccuacuucaacgacagccagagacaggccaccaaggacgccggcgugaucgccggccugaacgugcugagaaucaucaacgagcccaccgccgccgccaucgccuacggccuggacaagggcggccagggcgagagacacgugcugaucuucgaccugggcggcggcaccuucgacgugagcauccugaccaucgacgacggcaucuucgaggugaaggccaccgccggcgacacccaccugggcggcgaggacuucgacaacagacuggugagccacuucguggaggaguucaagagaaagcacaagaaggacaucagccagaacaagagagccgugagaagacugagaaccgccugcgagagagccaagagaacccugagcagcagcacccaggccaaccuggagaucgacagccuguacgagggcaucgacuucuacaccagcaucaccagagccagauucgaggagcugugcgccgaccuguucagaggcacccuggagcccguggagaaggcccugagagacgccaagauggacaaggccaagauccacgacaucgugcuggugggcggcagcaccagaauccccaaggugcagagacugcugcaggacuacuucaacggcagagaccugaacaagagcaucaaccccgacgaggccguggccuacggcgccgccgugcaggccgccauccugaugggcgacaagagcgagaaggugcaggaccugcugcugcuggacguggccccccugagccugggccuggagaccgccggcggcgugaugaccgcccugaucaagagaaacagcaccauccccaccaagcagacccagaucuucaccaccuacagcgacaaccagcccggcgugcugauccagguguacgagggcgagagagccaugaccaaggacaacaaccugcugggcagauucgaccugaccggcaucccccccgcccccagaggcgugccccagaucgaggugaccuucgacaucgacgccaacggcauccugaacgugaccgccaccgacaagagcaccggcaaggugaacaagaucaccaucaccaacgacaagggcagacugagcaaggaggagaucgagagaauggugcuggacgccgagaaguacaaggccgaggacgaggugcagagagagaagaucgccgccaagaacgcccuggagagcuacgccuucaacaugaagagcguggugagcgacgagggccugaagggcaagaucagcgagagcgacaagaacaagauccuggacaagugcaacgagcugcugagcuggcuggaggugaaccagcuggccgagaaggacgaguucgaccacaagagaaaggagcuggagcagaugugcaaccccaucaucaccaagcuguaccagggcggcugcaccggccccgccugcggcaccggcuacgugcccggcagacccgccaccggccccaccaucgaggagguggacuaa

SEQ ID NO: 18270 - RNA, 1920 nt, Artificial Sequence
  HSPA2__Homo_sapiens__NP_068814
augagcgccagaggccccgccaucggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggccaugaaccccaccaacaccaucuucgacgccaagagacugaucggcagaaaguucgaggacgccaccgugcagagcgacaugaagcacuggcccuucagaguggugagcgagggcggcaagcccaaggugcagguggaguacaagggcgagaccaagaccuucuuccccgaggagaucagcagcauggugcugaccaagaugaaggagaucgccgaggccuaccugggcggcaaggugcacagcgccgugaucaccgugcccgccuacuucaacgacagccagagacaggccaccaaggacgccggcaccaucaccggccugaacgugcugagaaucaucaacgagcccaccgccgccgccaucgccuacggccuggacaagaagggcugcgccggcggcgagaagaacgugcugaucuucgaccugggcggcggcaccuucgacgugagcauccugaccaucgaggacggcaucuucgaggugaagagcaccgccggcgacacccaccugggcggcgaggacuucgacaacagaauggugagccaccuggccgaggaguucaagagaaagcacaagaaggacaucggccccaacaagagagccgugagaagacugagaaccgccugcgagagagccaagagaacccugagcagcagcacccaggccagcaucgagaucgacagccuguacgagggcguggacuucuacaccagcaucaccagagccagauucgaggagcugaacgccgaccuguucagaggcacccuggagcccguggagaaggcccugagagacgccaagcuggacaagggccagauccaggagaucgugcuggugggcggcagcaccagaauccccaagauccagaagcugcugcaggacuucuucaacggcaaggagcugaacaagagcaucaaccccgacgaggccguggccuacggcgccgccgugcaggccgccauccugaucggcgacaagagcgagaacgugcaggaccugcugcugcuggacgugaccccccugagccugggcaucgagaccgccggcggcgugaugaccccccugaucaagagaaacaccaccauccccaccaagcagacccagaccuucaccaccuacagcgacaaccagagcagcgugcuggugcagguguacgagggcgagagagccaugaccaaggacaacaaccugcugggcaaguucgaccugaccggcaucccccccgcccccagaggcgugccccagaucgaggugaccuucgacaucgacgccaacggcauccugaacgugaccgccgccgacaagagcaccggcaaggagaacaagaucaccaucaccaacgacaagggcagacugagcaaggacgacaucgacagaauggugcaggaggccgagagauacaagagcgaggacgaggccaacagagacagaguggccgccaagaacgcccuggagagcuacaccuacaacaucaagcagaccguggaggacgagaagcugagaggcaagaucagcgagcaggacaagaacaagauccuggacaagugccaggaggugaucaacuggcuggacagaaaccagauggccgagaaggacgaguacgagcacaagcagaaggagcuggagagagugugcaaccccaucaucagcaagcuguaccagggcggccccggcggcggcagcggcggcggcggcagcggcgccagcggcggccccaccaucgaggagguggacuaa

SEQ ID NO: 18271 - RNA, 2523 nt, Artificial Sequence
  HSPA4__Homo_sapiens__NP_002145
augagcguggugggcaucgaccugggcuuccagagcugcuacguggccguggccagagccggcggcaucgagaccaucgccaacgaguacagcgacagaugcacccccgccugcaucagcuucggccccaagaacagaagcaucggcgccgccgccaagagccaggugaucagcaacgccaagaacaccgugcagggcuucaagagauuccacggcagagccuucagcgaccccuucguggaggccgagaagagcaaccuggccuacgacaucgugcagcugcccaccggccugaccggcaucaaggugaccuacauggaggaggagagaaacuucaccaccgagcaggugaccgccaugcugcugagcaagcugaaggagaccgccgagagcgugcugaagaagcccgugguggacugcguggugagcgugcccugcuucuacaccgacgccgagagaagaagcgugauggacgccacccagaucgccggccugaacugccugagacugaugaacgagaccaccgccguggcccuggccuacggcaucuacaagcaggaccugcccgcccuggaggagaagcccagaaacgugguguucguggacaugggccacagcgccuaccaggugagcgugugcgccuucaacagaggcaagcugaaggugcuggccaccgccuucgacaccacccugggcggcagaaaguucgacgaggugcuggugaaccacuucugcgaggaguucggcaagaaguacaagcuggacaucaagagcaagaucagagcccugcugagacugagccaggagugcgagaagcugaagaagcugaugagcgccaacgccagcgaccugccccugagcaucgagugcuucaugaacgacguggacgugagcggcaccaugaacagaggcaaguuccuggagaugugcaacgaccugcuggccagaguggagcccccccugagaagcgugcuggagcagaccaagcugaagaaggaggacaucuacgccguggagaucgugggcggcgccaccagaauccccgccgugaaggagaagaucagcaaguucuucggcaaggagcugagcaccacccugaacgccgacgaggccgugaccagaggcugcgcccugcagugcgccauccugagccccgccuucaaggugagagaguucagcaucaccgacguggugcccuaccccaucagccugagauggaacagccccgccgaggagggcagcagcgacugcgagguguucagcaagaaccacgccgcccccuucagcaaggugcugaccuucuacagaaaggagcccuucacccuggaggccuacuacagcagcccccaggaccugcccuaccccgaccccgccaucgcccaguucagcgugcagaaggugaccccccagagcgacggcagcagcagcaaggugaaggugaaggugagagugaacgugcacggcaucuucagcgugagcagcgccagccugguggaggugcacaagagcgaggagaacgaggagcccauggagaccgaccagaacgccaaggaggaggagaagaugcagguggaccaggaggagccccacguggaggagcagcagcagcagacccccgccgagaacaaggccgagagcgaggagauggagaccagccaggccggcagcaaggacaagaagauggaccagcccccccaggccaagaaggccaaggugaagaccagcaccguggaccugcccaucgagaaccagcugcuguggcagaucgacagagagaugcugaaccuguacaucgagaacgagggcaagaugaucaugcaggacaagcuggagaaggagagaaacgacgccaagaacgccguggaggaguacguguacgagaugagagacaagcugagcggcgaguacgagaaguucgugagcgaggacgacagaaacagcuucacccugaagcuggaggacaccgagaacuggcuguacgaggacggcgaggaccagcccaagcagguguacguggacaagcuggccgagcugaagaaccugggccagcccaucaagaucagauuccaggagagcgaggagagacccaagcuguucgaggagcugggcaagcagauccagcaguacaugaagaucaucagcagcuucaagaacaaggaggaccaguacgaccaccuggacgccgccgacaugaccaagguggagaagagcaccaacgaggccauggaguggaugaacaacaagcugaaccugcagaacaagcagagccugaccauggaccccguggugaagagcaaggagaucgaggccaagaucaaggagcugaccagcaccugcagccccaucaucagcaagcccaagcccaagguggagccccccaaggaggagcagaagaacgccgagcagaacggccccguggacggccagggcgacaaccccggcccccaggccgccgagcagggcaccgacaccgccgugcccagcgacagcgacaagaagcugcccgagauggacaucgacuaa

SEQ ID NO: 18272 - RNA, 2520 nt, Artificial Sequence
  HSPA4L__Homo_sapiens__NP_055093
augagcguggugggcaucgaccugggcuuccugaacugcuacaucgccguggccagaagcggcggcaucgagaccaucgccaacgaguacagcgacagaugcacccccgccugcaucagccugggcagcagaaccagagccaucggcaacgccgccaagagccagaucgugaccaacgugagaaacaccauccacggcuucaagaagcugcacggcagaagcuucgacgaccccaucgugcagaccgagagaaucagacugcccuacgagcugcagaagaugcccaacggcagcgccggcgugaaggugagauaccuggaggaggagagacccuucgccaucgagcaggugaccggcaugcugcuggccaagcugaaggagaccagcgagaacgcccugaagaagcccguggccgacugcgugaucagcauccccagcuucuucaccgacgccgagagaagaagcgugauggccgccgcccagguggccggccugaacugccugagacugaugaacgagaccaccgccguggcccuggccuacggcaucuacaagcaggaccugcccccccuggacgagaagcccagaaacgugguguucaucgacaugggccacagcgccuaccaggugcuggugugcgccuucaacaagggcaagcugaaggugcuggccaccaccuucgaccccuaccugggcggcagaaacuucgacgaggcccugguggacuacuucugcgacgaguucaagaccaaguacaagaucaacgugaaggagaacagcagagcccugcugagacuguaccaggagugcgagaagcugaagaagcugaugagcgccaacgccagcgaccugccccugaacaucgagugcuucaugaacgaccuggacgugagcagcaagaugaacagagcccaguucgagcagcugugcgccagccugcuggccagaguggagcccccccugaaggccgugauggagcaggccaaccugcagagagaggacaucagcagcaucgagaucgugggcggcgccaccagaauccccgccgugaaggagcagaucaccaaguucuuccugaaggacaucagcaccacccugaacgccgacgaggccguggccagaggcugcgcccugcagugcgccauccugagccccgccuucaaggugagagaguucagcaucaccgaccuggugcccuacagcaucacccugagauggaagaccagcuucgaggacggcagcggcgagugcgagguguucugcaagaaccaccccgcccccuucagcaaggugaucaccuuccacaagaaggagcccuucgagcuggaggccuucuacaccaaccugcacgaggugcccuaccccgacgccagaaucggcagcuucaccauccagaacguguucccccagagcgacggcgacagcagcaaggugaaggugaaggugagagugaacauccacggcaucuucagcguggccagcgccagcgugaucgagaagcagaaccuggagggcgaccacagcgacgcccccauggagaccgagaccagcuucaagaacgagaacaaggacaacauggacaagaugcagguggaccaggaggagggccaccagaagugccacgccgagcacacccccgaggaggagaucgaccacaccggcgccaagaccaagagcgccgugagcgacaagcaggacagacugaaccagacccugaagaagggcaaggugaagagcaucgaccugcccauccagagcagccugugcagacagcugggccaggaccugcugaacagcuacaucgagaacgagggcaagaugaucaugcaggacaagcuggagaaggagagaaacgacgccaagaacgccguggaggaguacguguacgacuucagagacagacugggcaccguguacgagaaguucaucacccccgaggaccugagcaagcugagcgccgugcuggaggacaccgagaacuggcuguacgaggacggcgaggaccagcccaagcagguguacguggacaagcugcaggagcugaagaaguacggccagcccauccagaugaaguacauggagcacgaggagagacccaaggcccugaacgaccugggcaagaagauccagcuggugaugaaggugaucgaggccuacagaaacaaggacgagagauacgaccaccuggaccccaccgagauggagaagguggagaagugcaucagcgacgccaugagcuggcugaacagcaagaugaacgcccagaacaagcugagccugacccaggaccccguggugaaggugagcgagaucguggccaagagcaaggagcuggacaacuucugcaaccccaucaucuacaagcccaagcccaaggccgaggugcccgaggacaagcccaaggccaacagcgagcacaacggccccauggacggccagagcggcaccgagaccaagagcgacagcaccaaggacagcagccagcacaccaagagcagcggcgagauggagguggacuaa

SEQ ID NO: 18273 - RNA, 1965 nt, Artificial Sequence
  HSPA5__Homo_sapiens__NP_005338
augaagcugagccugguggccgccaugcugcugcugcugagcgccgccagagccgaggaggaggacaagaaggaggacgugggcaccguggugggcaucgaccugggcaccaccuacagcugcgugggcguguucaagaacggcagaguggagaucaucgccaacgaccagggcaacagaaucacccccagcuacguggccuucacccccgagggcgagagacugaucggcgacgccgccaagaaccagcugaccagcaaccccgagaacaccguguucgacgccaagagacugaucggcagaaccuggaacgaccccagcgugcagcaggacaucaaguuccugcccuucaaggugguggagaagaagaccaagcccuacauccagguggacaucggcggcggccagaccaagaccuucgcccccgaggagaucagcgccauggugcugaccaagaugaaggagaccgccgaggccuaccugggcaagaaggugacccacgccguggugaccgugcccgccuacuucaacgacgcccagagacaggccaccaaggacgccggcaccaucgccggccugaacgugaugagaaucaucaacgagcccaccgccgccgccaucgccuacggccuggacaagagagagggcgagaagaacauccugguguucgaccugggcggcggcaccuucgacgugagccugcugaccaucgacaacggcguguucgaggugguggccaccaacggcgacacccaccugggcggcgaggacuucgaccagagagugauggagcacuucaucaagcuguacaagaagaagaccggcaaggacgugagaaaggacaacagagccgugcagaagcugagaagagagguggagaaggccaagagagcccugagcagccagcaccaggccagaaucgagaucgagagcuucuacgagggcgaggacuucagcgagacccugaccagagccaaguucgaggagcugaacauggaccuguucagaagcaccaugaagcccgugcagaaggugcuggaggacagcgaccugaagaagagcgacaucgacgagaucgugcuggugggcggcagcaccagaauccccaagauccagcagcuggugaaggaguucuucaacggcaaggagcccagcagaggcaucaaccccgacgaggccguggccuacggcgccgccgugcaggccggcgugcugagcggcgaccaggacaccggcgaccuggugcugcuggacgugugcccccugacccugggcaucgagaccgugggcggcgugaugaccaagcugauccccagaaacaccguggugcccaccaagaagagccagaucuucagcaccgccagcgacaaccagcccaccgugaccaucaagguguacgagggcgagagaccccugaccaaggacaaccaccugcugggcaccuucgaccugaccggcaucccccccgcccccagaggcgugccccagaucgaggugaccuucgagaucgacgugaacggcauccugagagugaccgccgaggacaagggcaccggcaacaagaacaagaucaccaucaccaacgaccagaacagacugacccccgaggagaucgagagaauggugaacgacgccgagaaguucgccgaggaggacaagaagcugaaggagagaaucgacaccagaaacgagcuggagagcuacgccuacagccugaagaaccagaucggcgacaaggagaagcugggcggcaagcugagcagcgaggacaaggagaccauggagaaggccguggaggagaagaucgaguggcuggagagccaccaggacgccgacaucgaggacuucaaggccaagaagaaggagcuggaggagaucgugcagcccaucaucagcaagcuguacggcagcgccggccccccccccaccggcgaggaggacaccgccgagaaggacgagcuguaa

SEQ ID NO: 18274 - RNA, 1932 nt, Artificial Sequence
  HSPA6__Homo_sapiens__NP_002146
augcaggcccccagagagcuggccgugggcaucgaccugggcaccaccuacagcugcgugggcguguuccagcagggcagaguggagauccuggccaacgaccagggcaacagaaccacccccagcuacguggccuucaccgacaccgagagacuggugggcgacgccgccaagagccaggccgcccugaacccccacaacaccguguucgacgccaagagacugaucggcagaaaguucgccgacaccaccgugcagagcgacaugaagcacuggcccuucagaguggugagcgagggcggcaagcccaaggugagagugugcuacagaggcgaggacaagaccuucuaccccgaggagaucagcagcauggugcugagcaagaugaaggagaccgccgaggccuaccugggccagcccgugaagcacgccgugaucaccgugcccgccuacuucaacgacagccagagacaggccaccaaggacgccggcgccaucgccggccugaacgugcugagaaucaucaacgagcccaccgccgccgccaucgccuacggccuggacagaagaggcgccggcgagagaaacgugcugaucuucgaccugggcggcggcaccuucgacgugagcgugcugagcaucgacgccggcguguucgaggugaaggccaccgccggcgacacccaccugggcggcgaggacuucgacaacagacuggugaaccacuucauggaggaguucagaagaaagcacggcaaggaccugagcggcaacaagagagcccugagaagacugagaaccgccugcgagagagccaagagaacccugagcagcagcacccaggccacccuggagaucgacagccuguucgagggcguggacuucuacaccagcaucaccagagccagauucgaggagcugugcagcgaccuguucagaagcacccuggagcccguggagaaggcccugagagacgccaagcuggacaaggcccagauccacgacguggugcuggugggcggcagcaccagaauccccaaggugcagaagcugcugcaggacuucuucaacggcaaggagcugaacaagagcaucaaccccgacgaggccguggccuacggcgccgccgugcaggccgccgugcugaugggcgacaagugcgagaaggugcaggaccugcugcugcuggacguggccccccugagccugggccuggagaccgccggcggcgugaugaccacccugauccagagaaacgccaccauccccaccaagcagacccagaccuucaccaccuacagcgacaaccagcccggcguguucauccagguguacgagggcgagagagccaugaccaaggacaacaaccugcugggcagauucgagcugagcggcaucccccccgcccccagaggcgugccccagaucgaggugaccuucgacaucgacgccaacggcauccugagcgugaccgccaccgacagaagcaccggcaaggccaacaagaucaccaucaccaacgacaagggcagacugagcaaggaggagguggagagaauggugcacgaggccgagcaguacaaggccgaggacgaggcccagagagacagaguggccgccaagaacagccuggaggcccacguguuccacgugaagggcagccugcaggaggagagccugagagacaagauccccgaggaggacagaagaaagaugcaggacaagugcagagaggugcuggccuggcuggagcacaaccagcuggccgagaaggaggaguacgagcaccagaagagagagcuggagcagaucugcagacccaucuucagcagacuguacggcggccccggcgugcccggcggcagcagcugcggcacccaggccagacagggcgaccccagcaccggccccaucaucgaggagguggacuaa

SEQ ID NO: 18275 - RNA, 1941 nt, Artificial Sequence
  HSPA8__Homo_sapiens__NP_006588
augagcaagggccccgccgugggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggccaugaaccccaccaacaccguguucgacgccaagagacugaucggcagaagauucgacgacgccguggugcagagcgacaugaagcacuggcccuucaugguggugaacgacgccggcagacccaaggugcagguggaguacaagggcgagaccaagagcuucuaccccgaggaggugagcagcauggugcugaccaagaugaaggagaucgccgaggccuaccugggcaagaccgugaccaacgccguggugaccgugcccgccuacuucaacgacagccagagacaggccaccaaggacgccggcaccaucgccggccugaacgugcugagaaucaucaacgagcccaccgccgccgccaucgccuacggccuggacaagaaggugggcgccgagagaaacgugcugaucuucgaccugggcggcggcaccuucgacgugagcauccugaccaucgaggacggcaucuucgaggugaagagcaccgccggcgacacccaccugggcggcgaggacuucgacaacagaauggugaaccacuucaucgccgaguucaagagaaagcacaagaaggacaucagcgagaacaagagagccgugagaagacugagaaccgccugcgagagagccaagagaacccugagcagcagcacccaggccagcaucgagaucgacagccuguacgagggcaucgacuucuacaccagcaucaccagagccagauucgaggagcugaacgccgaccuguucagaggcacccuggaccccguggagaaggcccugagagacgccaagcuggacaagagccagauccacgacaucgugcuggugggcggcagcaccagaauccccaagauccagaagcugcugcaggacuucuucaacggcaaggagcugaacaagagcaucaaccccgacgaggccguggccuacggcgccgccgugcaggccgccauccugagcggcgacaagagcgagaacgugcaggaccugcugcugcuggacgugaccccccugagccugggcaucgagaccgccggcggcgugaugaccgugcugaucaagagaaacaccaccauccccaccaagcagacccagaccuucaccaccuacagcgacaaccagcccggcgugcugauccagguguacgagggcgagagagccaugaccaaggacaacaaccugcugggcaaguucgagcugaccggcaucccccccgcccccagaggcgugccccagaucgaggugaccuucgacaucgacgccaacggcauccugaacgugagcgccguggacaagagcaccggcaaggagaacaagaucaccaucaccaacgacaagggcagacugagcaaggaggacaucgagagaauggugcaggaggccgagaaguacaaggccgaggacgagaagcagagagacaaggugagcagcaagaacagccuggagagcuacgccuucaacaugaaggccaccguggaggacgagaagcugcagggcaagaucaacgacgaggacaagcagaagauccuggacaagugcaacgagaucaucaacuggcuggacaagaaccagaccgccgagaaggaggaguucgagcaccagcagaaggagcuggagaaggugugcaaccccaucaucaccaagcuguaccagagcgccggcggcaugcccggcggcaugcccggcggcuuccccggcggcggcgccccccccagcggcggcgccagcagcggccccaccaucgaggagguggacuaa

SEQ ID NO: 18276 - RNA, 2040 nt, Artificial Sequence
  HSPA9__Homo_sapiens__NP_004125
augaucagcgccagcagagccgccgccgccagacuggugggcgccgccgccagcagaggccccaccgccgccagacaccaggacagcuggaacggccugagccacgaggccuucagacuggugagcagaagagacuacgccagcgaggccaucaagggcgccguggugggcaucgaccugggcaccaccaacagcugcguggccgugauggagggcaagcaggccaaggugcuggagaacgccgagggcgccagaaccacccccagcgugguggccuucaccgccgacggcgagagacuggugggcaugcccgccaagagacaggccgugaccaaccccaacaacaccuucuacgccaccaagagacugaucggcagaagauacgacgaccccgaggugcagaaggacaucaagaacgugcccuucaagaucgugagagccagcaacggcgacgccuggguggaggcccacggcaagcuguacagccccagccagaucggcgccuucgugcugaugaagaugaaggagaccgccgagaacuaccugggccacaccgccaagaacgccgugaucaccgugcccgccuacuucaacgacagccagagacaggccaccaaggacgccggccagaucagcggccugaacgugcugagagugaucaacgagcccaccgccgccgcccuggccuacggccuggacaagagcgaggacaaggugaucgccguguacgaccugggcggcggcaccuucgacaucagcauccuggagauccagaagggcguguucgaggugaagagcaccaacggcgacaccuuccugggcggcgaggacuucgaccaggcccugcugagacacaucgugaaggaguucaagagagagaccggcguggaccugaccaaggacaacauggcccugcagagagugagagaggccgccgagaaggccaagugcgagcugagcagcagcgugcagaccgacaucaaccugcccuaccugaccauggacagcagcggccccaagcaccugaacaugaagcugaccagagcccaguucgagggcaucgugaccgaccugaucagaagaaccaucgcccccugccagaaggccaugcaggacgccgaggugagcaagagcgacaucggcgaggugauccuggugggcggcaugaccagaaugcccaaggugcagcagaccgugcaggaccuguucggcagagcccccagcaaggccgugaaccccgacgaggccguggccaucggcgccgccauccagggcggcgugcuggccggcgacgugaccgacgugcugcugcuggacgugaccccccugagccugggcaucgagacccugggcggcguguucaccaagcugaucaacagaaacaccaccauccccaccaagaagagccagguguucagcaccgccgccgacggccagacccagguggagaucaaggugugccagggcgagagagagauggccggcgacaacaagcugcugggccaguucacccugaucggcaucccccccgcccccagaggcgugccccagaucgaggugaccuucgacaucgacgccaacggcaucgugcacgugagcgccaaggacaagggcaccggcagagagcagcagaucgugauccagagcagcggcggccugagcaaggacgacaucgagaacauggugaagaacgccgagaaguacgccgaggaggacagaagaaagaaggagagaguggaggccgugaacauggccgagggcaucauccacgacaccgagaccaagauggaggaguucaaggaccagcugcccgccgacgagugcaacaagcugaaggaggagaucagcaagaugagagagcugcuggccagaaaggacagcgagaccggcgagaacaucagacaggccgccagcagccugcagcaggccagccugaagcuguucgagauggccuacaagaagauggccagcgagagagagggcagcggcagcagcggcaccggcgagcagaaggaggaccagaaggaggagaagcaguaa

SEQ ID NO: 18277 - RNA, 618 nt, Artificial Sequence
  HSPB1__Homo_sapiens__NP_001531
augaccgagagaagagugcccuucagccugcugagaggccccagcugggaccccuucagagacugguacccccacagcagacuguucgaccaggccuucggccugcccagacugcccgaggaguggagccaguggcugggcggcagcagcuggcccggcuacgugagaccccugccccccgccgccaucgagagccccgccguggccgcccccgccuacagcagagcccugagcagacagcugagcagcggcgugagcgagaucagacacaccgccgacagauggagagugagccuggacgugaaccacuucgcccccgacgagcugaccgugaagaccaaggacggcgugguggagaucaccggcaagcacgaggagagacaggacgagcacggcuacaucagcagaugcuucaccagaaaguacacccugccccccggcguggaccccacccaggugagcagcagccugagccccgagggcacccugaccguggaggcccccaugcccaagcuggccacccagagcaacgagaucaccauccccgugaccuucgagagcagagcccagcugggcggccccgaggccgccaagagcgacgagaccgccgccaaguaa

SEQ ID NO: 18278 - RNA, 549 nt, Artificial Sequence
  HSPB2__Homo_sapiens__NP_001532
augagcggcagaagcgugccccacgcccaccccgccaccgccgaguacgaguucgccaaccccagcagacugggcgagcagagauucggcgagggccugcugcccgaggagauccugacccccacccuguaccacggcuacuacgugagacccagagccgcccccgccggcgagggcagcagagccggcgccagcgagcugagacugagcgagggcaaguuccaggccuuccuggacgugagccacuucacccccgacgaggugaccgugagaaccguggacaaccugcuggaggugagcgccagacacccccagagacuggacagacacggcuucgugagcagagaguucugcagaaccuacgugcugcccgccgacguggaccccuggagagugagagccgcccugagccacgacggcauccugaaccuggaggcccccagaggcggcagacaccuggacaccgaggugaacgagguguacaucagccugcugcccgccccccccgaccccgaggaggaggaggaggccgccaucguggagcccuaa

SEQ ID NO: 18279 - RNA, 453 nt, Artificial Sequence
  HSPB3__Homo_sapiens__NP_006299
auggccaagaucauccugagacaccugaucgagauccccgugagauaccaggaggaguucgaggccagaggccuggaggacugcagacuggaccacgcccuguacgcccugcccggccccaccaucguggaccugagaaagaccagagccgcccagagcccccccguggacagcgccgccgagaccccccccagagagggcaagagccacuuccagauccugcuggacguggugcaguuccugcccgaggacaucaucauccagaccuucgagggcuggcugcugaucaaggcccagcacggcaccagaauggacgagcacggcuucaucagcagaagcuucaccagacaguacaagcugcccgacggcguggagaucaaggaccugagcgccgugcugugccacgacggcauccuggugguggaggugaaggaccccgugggcaccaaguaa

SEQ ID NO: 18280 - RNA, 483 nt, Artificial Sequence
  HSPB6__Homo_sapiens__NP_653218
auggagauccccgugcccgugcagcccagcuggcugagaagagccagcgccccccugcccggccugagcgcccccggcagacuguucgaccagagauucggcgagggccugcuggaggccgagcuggccgcccugugccccaccacccuggcccccuacuaccugagagcccccagcguggcccugcccguggcccaggugcccaccgaccccggccacuucagcgugcugcuggacgugaagcacuucagccccgaggagaucgccgugaagguggugggcgagcacguggaggugcacgccagacacgaggagagacccgacgagcacggcuucguggccagagaguuccacagaagauacagacugccccccggcguggaccccgccgccgugaccagcgcccugagccccgagggcgugcugagcauccaggccgcccccgccagcgcccaggcccccccccccgccgccgccaaguaa

SEQ ID NO: 18281 - RNA, 792 nt, Artificial Sequence
  HSPB7__Homo_sapiens__XP_011539551
augagcggcugcgagcugagcccccugggccugagagugggccugagcgccggccccgcccacggcagaagauuccccgcccccagcggccccuggagaggccugaaccuggccagcagacagggcgccggccccaagcccagagacagcagacccuacaaggccgccgccgugggcgccuggcacgccagacccgaggccugcgcccacacccugagcugccccgcccuggccagacugggcagagccagaagaagacccuggaugagccacagaaccagcagcaccuucagagccgagagaagcuuccacagcagcagcagcagcagcagcagcagcaccagcagcagcgccagcagagcccugcccgcccaggacccccccauggagaaggcccugagcauguucagcgacgacuucggcagcuucaugagaccccacagcgagccccuggccuuccccgccgcccaccccaccgccagacccggcggcgccggcaacaucaagacccugggcgacgccuacgaguucgccguggacgugagagacuucagccccgaggacaucaucgugaccaccagcaacaaccacaucgaggugagagccgagaagcuggccgccgacggcaccgugaugaacaccuucgcccacaagugccagcugcccgaggacguggaccccaccagcgugaccagcgcccugagagaggacggcagccugaccaucagagccagaagacacccccacaccgagcacgugcagcagaccuucagaaccgagaucaagaucuaa

SEQ ID NO: 18282 - RNA, 591 nt, Artificial Sequence
  HSPB8__Homo_sapiens__NP_055180
auggccgacggccagaugcccuucagcugccacuaccccagcagacugagaagagaccccuucagagacagcccccugagcagcagacugcuggacgacggcuucggcauggaccccuuccccgacgaccugaccgccagcuggcccgacugggcccugcccagacugagcagcgccuggcccggcacccugagaagcggcauggugcccagaggccccaccgccaccgccagauucggcgugcccgccgagggcagaacccccccccccuuccccggcgagcccuggaaggugugcgugaacgugcacagcuucaagcccgaggagcugauggugaagaccaaggacggcuacguggaggugagcggcaagcacgaggagaagcagcaggagggcggcaucgugagcaagaacuucaccaagaagauccagcugcccgccgagguggaccccgugaccguguucgccagccugagccccgagggccugcugaucaucgaggccccccaggugccccccuacagcaccuucggcgagagcagcuucaacaacgagcugccccaggacagccaggaggugaccugcaccuaa

SEQ ID NO: 18283 - RNA, 480 nt, Artificial Sequence
  HSPB9__Homo_sapiens__NP_149971
augcagagagugggcaacaccuucagcaacgagagcagaguggccagcagaugccccagcgugggccuggccgagagaaacagaguggccaccaugcccgugagacugcugagagacagccccgccgcccaggaggacaacgaccacgccagagacggcuuccagaugaagcuggacgcccacggcuucgcccccgaggagcugguggugcagguggacggccaguggcugauggugaccggccagcagcagcuggacgugagagaccccgagagagugagcuacagaaugagccagaaggugcacagaaagaugcugcccagcaaccugagccccaccgccaugaccugcugccugacccccagcggccagcugugggugagaggccagugcguggcccuggcccugcccgaggcccagaccggccccagccccagacugggcagccugggcagcaaggccagcaaccugaccagauaa

SEQ ID NO: 18284 - RNA, 1467 nt, Artificial Sequence
  HSPBAP1__Homo_sapiens__NP_078886
auggccgccggcagcgaggccaccacccccgugaucguggccgccggcgccggcggcgaggagggcgagcacgugaagcccuucaagcccgagaaggccaaggagaucaucaugagccugcagcagcccgccaucuucugcaacaugguguucgacuggcccgccagacacuggaacgccaaguaccugagccaggugcugcacggcaagcagaucagauucagaaugggcaugaagagcaugagcaccgugccccaguucgagaccaccugcaacuacguggaggccacccuggaggaguuccugaccuggaacugcgaccagagcagcaucagcggccccuucagagacuacgaccacagcaaguucugggccuacgccgacuacaaguacuucgugagccuguucgaggacaagaccgaccuguuccaggacgugaaguggagcgacuucggcuuccccggcagaaacggccaggagagcacccuguggaucggcagccugggcgcccacacccccugccaccuggacagcuacggcugcaaccugguguuccaggugcagggcagaaagagauggcaccuguucccccccgaggacacccccuuccuguaccccaccagaauccccuacgaggagagcagcguguucagcaagaucaacguggugaaccccgaccugaagagauucccccaguucagaaaggcccagagacacgccgugacccugagccccggccaggugcuguucgugcccagacacugguggcacuacguggagagcaucgaccccgugaccgugagcaucaacagcuggaucgagcuggaggaggaccaccuggccagaguggaggaggccaucaccagaaugcuggugugcgcccugaagaccgccgagaacccccagaacaccagagccuggcugaaccccaccgagguggaggagaccagccacgccgugaacugcugcuaccugaacgccgccgugagcgccuucuucgacagaugcagaaccagcgaggugguggagauccaggcccugagaaccgacggcgagcacaugaagaaggaggagcugaacgugugcaaccacauggaggugggccagaccggcagccagaaccugaccaccggcaccgacaagcccgaggccgccagccccuucggccccgaccuggugcccguggcccagagaagcgaggagccccccagcgagagaggcggcaucuucggcagcgacggcaaggacuucguggacaaggacggcgagcacuucggcaagcugcacugcgccaagagacagcagaucaugagcaacagcgagaacgccaucgaggagcagaucgccagcaacaccaccaccaccccccagaccuucaucagcaccgacgaccugcuggacugccuggugaacccccaggugaccagaaucguggcccagcugcugauccagggcagaagccuguaa

SEQ ID NO: 18285 - RNA, 1080 nt, Artificial Sequence
  HSPBP1__Homo_sapiens__NP_001123578
augagcgacgagggcagcagaggcagcagacugccccuggcccugccccccgccagccagggcugcagcagcggcggcggcggcggcggcagcagcgccggcggcagcggcaacagcagaccccccagaaaccugcagggccugcugcagauggccaucaccgccggcagcgaggagcccgaccccccccccgagcccaugagcgaggagagaagacaguggcugcaggaggccaugagcgccgccuucagaggccagagagaggagguggagcagaugaagagcugccugagagugcugagccagcccaugccccccaccgccggcgaggccgagcaggccgccgaccagcaggagagagagggcgcccuggagcugcuggccgaccugugcgagaacauggacaacgccgccgacuucugccagcugagcggcaugcaccugcuggugggcagauaccuggaggccggcgccgccggccugagauggagagccgcccagcugaucggcaccugcagccagaacguggccgccauccaggagcaggugcugggccugggcgcccugagaaagcugcugagacugcuggacagagacgccugcgacaccgugagagugaaggcccuguucgccaucagcugccuggugagagagcaggaggccggccugcugcaguuccugagacuggacggcuucagcgugcugaugagagccaugcagcagcaggugcagaagcugaaggugaagagcgccuuccugcugcagaaccugcuggugggccaccccgagcacaagggcacccugugcagcaugggcauggugcagcagcugguggcccuggugagaaccgagcacagccccuuccacgagcacgugcugggcgcccugugcagccuggugaccgacuucccccagggcgugagagagugcagagagcccgagcugggccuggaggagcugcugagacacagaugccagcugcugcagcagcacgaggaguaccaggaggagcuggaguucugcgagaagcugcugcagaccugcuucagcagccccgccgacgacagcauggacagauaa

SEQ ID NO: 18286 - RNA, 1722 nt, Artificial Sequence
  HSPD1__Homo_sapiens__NP_002147
augcugagacugcccaccguguucagacagaugagacccgugagcagagugcuggccccccaccugaccagagccuacgccaaggacgugaaguucggcgccgacgccagagcccugaugcugcagggcguggaccugcuggccgacgccguggccgugaccaugggccccaagggcagaaccgugaucaucgagcagagcuggggcagccccaaggugaccaaggacggcgugaccguggccaagagcaucgaccugaaggacaaguacaagaacaucggcgccaagcuggugcaggacguggccaacaacaccaacgaggaggccggcgacggcaccaccaccgccaccgugcuggccagaagcaucgccaaggagggcuucgagaagaucagcaagggcgccaaccccguggagaucagaagaggcgugaugcuggccguggacgccgugaucgccgagcugaagaagcagagcaagcccgugaccacccccgaggagaucgcccagguggccaccaucagcgccaacggcgacaaggagaucggcaacaucaucagcgacgccaugaagaaggugggcagaaagggcgugaucaccgugaaggacggcaagacccugaacgacgagcuggagaucaucgagggcaugaaguucgacagaggcuacaucagccccuacuucaucaacaccagcaagggccagaagugcgaguuccaggacgccuacgugcugcugagcgagaagaagaucagcagcauccagagcaucgugcccgcccuggagaucgccaacgcccacagaaagccccuggugaucaucgccgaggacguggacggcgaggcccugagcacccuggugcugaacagacugaaggugggccugcaggugguggccgugaaggcccccggcuucggcgacaacagaaagaaccagcugaaggacauggccaucgccaccggcggcgccguguucggcgaggagggccugacccugaaccuggaggacgugcagccccacgaccugggcaaggugggcgaggugaucgugaccaaggacgacgccaugcugcugaagggcaagggcgacaaggcccagaucgagaagagaauccaggagaucaucgagcagcuggacgugaccaccagcgaguacgagaaggagaagcugaacgagagacuggccaagcugagcgacggcguggccgugcugaaggugggcggcaccagcgacguggaggugaacgagaagaaggacagagugaccgacgcccugaacgccaccagagccgccguggaggagggcaucgugcugggcggcggcugcgcccugcugagaugcauccccgcccuggacagccugacccccgccaacgaggaccagaagaucggcaucgagaucaucaagagaacccugaagauccccgccaugaccaucgccaagaacgccggcguggagggcagccugaucguggagaagaucaugcagagcagcagcgaggugggcuacgacgccauggccggcgacuucgugaacaugguggagaagggcaucaucgaccccaccaagguggugagaaccgcccugcuggacgccgccggcguggccagccugcugaccaccgccgaggugguggugaccgagauccccaaggaggagaaggaccccggcaugggcgccaugggcggcaugggcggcggcaugggcggcggcauguucuaa

SEQ ID NO: 18287 - RNA, 309 nt, Artificial Sequence
  HSPE1__Homo_sapiens__NP_002148
auggccggccaggccuucagaaaguuccugccccuguucgacagagugcugguggagagaagcgccgccgagaccgugaccaagggcggcaucaugcugcccgagaagagccagggcaaggugcugcaggccaccgugguggccgugggcagcggcagcaagggcaagggcggcgagauccagcccgugagcgugaaggugggcgacaaggugcugcugcccgaguacggcggcaccaagguggugcuggacgacaaggacuacuuccuguucagagacggcgacauccugggcaaguacguggacuaa

SEQ ID NO: 18288 - RNA, 13179 nt, Artificial Sequence
  HSPG2__Homo_sapiens__NP_001278789
augggcuggagagccgccggcgcccugcugcuggcccugcugcugcacggcagacugcuggccgugacccacggccugagagccuacgacggccugagccugcccgaggacaucgagaccgugaccgccagccagaugagauggacccacagcuaccugagcgacgacgaggacaugcuggccgacagcaucagcggcgacgaccugggcagcggcgaccugggcagcggcgacuuccagaugguguacuucagagcccuggugaacuucaccagaagcaucgaguacagcccccagcuggaggacgccggcagcagagaguucagagaggugagcgaggccgugguggacacccuggagagcgaguaccugaagauccccggcgaccagguggugagcgugguguucaucaaggagcuggacggcuggguguucguggagcuggacgugggcagcgagggcaacgccgacggcgcccagauccaggagaugcugcugagagugaucagcagcggcagcguggccagcuacgugaccagcccccagggcuuccaguucagaagacugggcaccgugccccaguuccccagagccugcaccgaggccgaguucgccugccacagcuacaacgagugcguggcccuggaguacagaugcgacagaagacccgacugcagagacaugagcgacgagcugaacugcgaggagcccgugcugggcaucagccccaccuucagccugcugguggagaccaccagccugccccccagacccgagaccaccaucaugagacagccccccgugacccacgccccccagccccugcugcccggcagcgugagaccccugcccugcggcccccaggaggccgccugcagaaacggccacugcauccccagagacuaccugugcgacggccaggaggacugcgaggacggcagcgacgagcuggacugcggcccccccccccccugcgagcccaacgaguuccccugcggcaacggccacugcgcccugaagcuguggagaugcgacggcgacuucgacugcgaggacagaaccgacgaggccaacugccccaccaagagacccgaggaggugugcggccccacccaguucagaugcgugagcaccaacaugugcauccccgccagcuuccacugcgacgaggagagcgacugccccgacagaagcgacgaguucggcugcaugcccccccagguggugaccccccccagagagagcauccaggccagcagaggccagaccgugaccuucaccugcguggccaucggcgugcccacccccaucaucaacuggagacugaacuggggccacauccccagccaccccagagugaccgugaccagcgagggcggcagaggcacccugaucaucagagacgugaaggagagcgaccagggcgccuacaccugcgaggccaugaacgccagaggcaugguguucggcauccccgacggcgugcuggagcuggugccccagagagccggccccugccccgacggccacuucuaccuggagcacagcgccgccugccugcccugcuucugcuucggcaucaccagcgugugccagagcaccagaagauucagagaccagaucagacugagauucgaccagcccgacgacuucaagggcgugaacgugaccaugcccgcccagcccggcacccccccccugagcagcacccagcugcagaucgaccccagccugcacgaguuccagcugguggaccugagcagaagauuccuggugcacgacagcuucugggcccugcccgagcaguuccugggcaacaagguggacagcuacggcggcagccugagauacaacgugagauacgagcuggccagaggcaugcuggagcccgugcagagacccgacguggugcugaugggcgccggcuacagacugcugagcagaggccacacccccacccagcccggcgcccugaaccagagacaggugcaguucagcgaggagcacugggugcacgagagcggcagacccgugcagagagccgagcugcugcaggugcugcagagccuggaggccgugcugauccagaccguguacaacaccaagauggccagcgugggccugagcgacaucgccauggacaccaccgugacccacgccaccagccacggcagagcccacagcguggaggagugcagaugccccaucggcuacagcggccugagcugcgagagcugcgacgcccacuucaccagagugcccggcggccccuaccugggcaccugcagcggcugcaacugcaacggccacgccagcagcugcgaccccguguacggccacugccugaacugccagcacaacaccgagggcccccagugcaacaagugcaaggccggcuucuucggcgacgccaugaaggccaccgccaccagcugcagacccugccccugccccuacaucgacgccagcagaagauucagcgacaccugcuuccuggacaccgacggccaggccaccugcgacgccugcgcccccggcuacaccggcagaagaugcgagagcugcgcccccggcuacgagggcaaccccauccagcccggcggcaagugcagacccgugaaccaggagaucgugagaugcgacgagagaggcagcaugggcaccagcggcgaggccugcagaugcaagaacaacguggugggcagacugugcaacgagugcgccgacggcagcuuccaccugagcaccagaaaccccgacggcugccugaagugcuucugcaugggcgugagcagacacugcaccagcagcagcuggagcagagcccagcugcacggcgccagcgaggagcccggccacuucagccugaccaacgccgccagcacccacaccaccaacgagggcaucuucagccccacccccggcgagcugggcuucagcagcuuccacagacugcugagcggccccuacuucuggagccugcccagcagauuccugggcgacaaggugaccagcuacggcggcgagcugagauucaccgugacccagagaagccagcccggcagcaccccccugcacggccagccccugguggugcugcagggcaacaacaucauccuggagcaccacguggcccaggagcccagccccggccagcccagcaccuucaucgugcccuucagagagcaggccuggcagagacccgacggccagcccgccaccagagagcaccugcugauggcccuggccggcaucgacacccugcugaucagagccagcuacgcccagcagcccgccgagagcagagugagcggcaucagcauggacguggccgugcccgaggagaccggccaggaccccgcccuggagguggagcagugcagcugcccccccggcuacagaggccccagcugccaggacugcgacaccggcuacaccagaacccccagcggccuguaccugggcaccugcgagagaugcagcugccacggccacagcgaggccugcgagcccgagaccggcgccugccagggcugccagcaccacaccgagggccccagaugcgagcagugccagcccggcuacuacggcgacgcccagagaggcaccccccaggacugccagcugugccccugcuacggcgaccccgccgccggccaggccgcccacaccugcuuccuggacaccgacggccaccccaccugcgacgccugcagccccggccacagcggcagacacugcgagagaugcgcccccggcuacuacggcaaccccagccagggccagcccugccagagagacagccaggugcccggccccaucggcugcaacugcgacccccagggcagcgugagcagccagugcgacgccgccggccagugccagugcaaggcccagguggagggccugaccugcagccacugcagaccccaccacuuccaccugagcgccagcaaccccgacggcugccugcccugcuucugcaugggcaucacccagcagugcgccagcagcgccuacaccagacaccugaucagcacccacuucgcccccggcgacuuccagggcuucgcccuggugaacccccagagaaacagcagacugaccggcgaguucaccguggagcccgugcccgagggcgcccagcugagcuucggcaacuucgcccagcugggccacgagagcuucuacuggcagcugcccgagaccuaccagggcgacaagguggccgccuacggcggcaagcugagauacacccugagcuacaccgccggcccccagggcagcccccugagcgaccccgacgugcagaucaccggcaacaacaucaugcugguggccagccagcccgcccugcagggccccgagagaagaagcuacgagaucauguucagagaggaguucuggagaagacccgacggccagcccgccaccagagagcaccugcugauggcccuggccgaccuggacgagcugcugaucagagccaccuucagcagcgugccccuggccgccagcaucagcgccgugagccuggagguggcccagcccggccccagcaacagacccagagcccuggagguggaggagugcagaugcccccccggcuacaucggccugagcugccaggacugcgcccccggcuacaccagaaccggcagcggccuguaccugggccacugcgagcugugcgagugcaacggccacagcgaccugugccaccccgagaccggcgccugcagccagugccagcacaacgccgccggcgaguucugcgagcugugcgcccccggcuacuacggcgacgccaccgccggcacccccgaggacugccagcccugcgccugcccccugaccaaccccgagaacauguucagcagaaccugcgagagccugggcgccggcggcuacagaugcaccgccugcgagcccggcuacaccggccaguacugcgagcagugcggccccggcuacgugggcaaccccagcgugcagggcggccagugccugcccgagaccaaccaggccccccuggugguggaggugcaccccgccagaagcaucgugccccagggcggcagccacagccugagaugccaggugagcggcagccccccccacuacuucuacuggagcagagaggacggcagacccgugcccagcggcacccagcagagacaccagggcagcgagcugcacuuccccagcgugcagcccagcgacgccggcguguacaucugcaccugcagaaaccugcaccagagcaacaccagcagagccgagcugcuggugaccgaggcccccagcaagcccaucaccgugaccguggaggagcagagaagccagagcgugagacccggcgccgacgugaccuucaucugcaccgccaagagcaagagccccgccuacacccugguguggaccagacugcacaacggcaagcugcccaccagagccauggacuucaacggcauccugaccaucagaaacgugcagcugagcgacgccggcaccuacgugugcaccggcagcaacauguucgccauggaccagggcaccgccacccugcacgugcaggccagcggcacccugagcgcccccguggugagcauccaccccccccagcugaccgugcagcccggccagcuggccgaguucagaugcagcgccaccggcagccccacccccacccuggaguggaccggcggccccggcggccagcugcccgccaaggcccagauccacggcggcauccugagacugcccgccguggagcccaccgaccaggcccaguaccugugcagagcccacagcagcgccggccagcagguggccagagccgugcugcacgugcacggcggcggcggccccagagugcaggugagccccgagagaacccaggugcacgccggcagaaccgugagacuguacugcagagccgccggcgugcccagcgccaccaucaccuggagaaaggagggcggcagccugcccccccaggccagaagcgagagaaccgacaucgccacccugcugauccccgccaucaccaccgccgacgccggcuucuaccugugcguggccaccagccccgccggcaccgcccaggccagaauccaggugguggugcugagcgccagcgacgccagccccccccccgugaagaucgagagcagcagccccagcgugaccgagggccagacccuggaccugaacugcgugguggccggcagcgcccacgcccaggugaccugguacagaagaggcggcagccugcccccccacacccaggugcacggcagcagacugagacugccccaggugagccccgccgacagcggcgaguacgugugcagaguggagaacggcagcggccccaaggaggccagcaucaccgugagcgugcugcacggcacccacagcggccccagcuacacccccgugcccggcagcaccagacccaucagaaucgagcccagcagcagccacguggccgagggccagacccuggaccugaacugcguggugcccggccaggcccacgcccaggugaccuggcacaagagaggcggcagccugcccgccagacaccagacccacggcagccugcugagacugcaccaggugacccccgccgacagcggcgaguacgugugccacguggugggcaccagcggcccccuggaggccagcgugcuggugaccaucgaggccagcgugauccccggccccaucccccccgugagaaucgagagcagcagcagcaccguggccgagggccagacccuggaccugagcugcgugguggccggccaggcccacgcccaggugaccugguacaagagaggcggcagccugcccgccagacaccaggugagaggcagcagacuguacaucuuccaggccagccccgccgacgccggccaguacgugugcagagccagcaacggcauggaggccagcaucaccgugaccgugaccggcacccagggcgccaaccuggccuaccccgccggcagcacccagcccaucagaaucgagcccagcagcagccagguggccgagggccagacccuggaccugaacugcguggugcccggccagagccacgcccaggugaccuggcacaagagaggcggcagccugcccgugagacaccagacccacggcagccugcugagacuguaccaggccagccccgccgacagcggcgaguacgugugcagagugcugggcagcagcgugccccuggaggccagcgugcuggugaccaucgagcccgccggcagcgugcccgcccugggcgugacccccaccgugagaaucgagagcagcagcagccagguggccgagggccagacccuggaccugaacugccugguggccggccaggcccacgcccaggugaccuggcacaagagaggcggcagccugcccgccagacaccaggugcacggcagcagacugagacugcugcaggugacccccgccgacagcggcgaguacgugugcagaguggugggcagcagcggcacccaggaggccagcgugcuggugaccauccagcagagacugagcggcagccacagccagggcguggccuaccccgugagaaucgagagcagcagcgccagccuggccaacggccacacccuggaccugaacugccugguggccagccaggccccccacaccaucaccugguacaagagaggcggcagccugcccagcagacaccagaucgugggcagcagacugagaaucccccaggugacccccgccgacagcggcgaguacgugugccacgugagcaacggcgccggcagcagagagaccagccugaucgugaccauccagggcagcggcagcagccacgugcccagcgugagcccccccaucagaaucgagagcagcagccccaccgugguggagggccagacccuggaccugaacugcgugguggccagacagccccaggccaucaucaccugguacaagagaggcggcagccugcccagcagacaccagacccacggcagccaccugagacugcaccagaugagcguggccgacagcggcgaguacgugugcagagccaacaacaacaucgacgcccuggaggccagcaucgugaucagcgugagccccagcgccggcagccccagcgcccccggcagcagcaugcccaucagaaucgagagcagcagcagccacguggccgagggcgagacccuggaccugaacugcguggugcccggccaggcccacgcccaggugaccuggcacaagagaggcggcagccugcccagccaccaccagaccagaggcagcagacugagacugcaccacgugagccccgccgacagcggcgaguacgugugcagagugaugggcagcagcggcccccuggaggccagcgugcuggugaccaucgaggccagcggcagcagcgccgugcacgugcccgcccccggcggcgccccccccaucagaaucgagcccagcagcagcagaguggccgagggccagacccuggaccugaagugcguggugcccggccaggcccacgcccaggugaccuggcacaagagaggcggcaaccugcccgccagacaccaggugcacggcccccugcugagacugaaccaggugagccccgccgacagcggcgaguacagcugccaggugaccggcagcagcggcacccuggaggccagcgugcuggugaccaucgagcccagcagccccggccccauccccgcccccggccuggcccagcccaucuacaucgaggccagcagcagccacgugaccgagggccagacccuggaccugaacugcguggugcccggccaggcccacgcccaggugaccugguacaagagaggcggcagccugcccgccagacaccagacccacggcagccagcugagacugcaccuggugagccccgccgacagcggcgaguacgugugcagagccgccagcggccccggccccgagcaggaggccagcuucaccgugaccgugccccccagcgagggcagcagcuacagacugagaagccccgugaucagcaucgacccccccagcagcaccgugcagcagggccaggacgccagcuucaagugccugauccacgacggcgccgcccccaucagccuggaguggaagaccagaaaccaggagcuggaggacaacgugcacaucagccccaacggcagcaucaucaccaucgugggcaccagacccagcaaccacggcaccuacagaugcguggccagcaacgccuacggcguggcccagagcguggugaaccugagcgugcacggcccccccaccgugagcgugcugcccgagggccccgugugggugaaggugggcaaggccgugacccuggagugcgugagcgccggcgagcccagaagcagcgccagauggaccagaaucagcagcacccccgccaagcuggagcagagaaccuacggccugauggacagccacgccgugcugcagaucagcagcgccaagcccagcgacgccggcaccuacgugugccuggcccagaacgcccugggcaccgcccagaagcagguggaggugaucguggacaccggcgccauggcccccggcgccccccaggugcaggccgaggaggccgagcugaccguggaggccggccacaccgccacccugagaugcagcgccaccggcagccccgcccccaccauccacuggagcaagcugagaagcccccugcccuggcagcacagacuggagggcgacacccugaucauccccagaguggcccagcaggacagcggccaguacaucugcaacgccaccagccccgccggccacgccgaggccaccaucauccugcacguggagagcccccccuacgccaccaccgugcccgagcacgccagcgugcaggccggcgagaccgugcagcugcagugccuggcccacggcacccccccccugaccuuccaguggagcagagugggcagcagccugcccggcagagccaccgccagaaacgagcugcugcacuucgagagagccgcccccgaggacagcggcagauacagaugcagagugaccaacaaggugggcagcgccgaggccuucgcccagcugcuggugcagggcccccccggcagccugcccgccaccagcauccccgccggcagcacccccaccgugcaggugaccccccagcuggagaccaagagcaucggcgccagcguggaguuccacugcgccgugcccagcgacagaggcacccagcugagaugguucaaggagggcggccagcugccccccggccacagcgugcaggacggcgugcugagaauccagaaccuggaccagagcugccagggcaccuacaucugccaggcccacggccccuggggcaaggcccaggccagcgcccagcuggugauccaggcccugcccagcgugcugaucaacaucagaaccagcgugcagaccgugguggugggccacgccguggaguucgagugccuggcccugggcgaccccaagccccaggugaccuggagcaaggugggcggccaccugagacccggcaucgugcagagcggcggcguggugagaaucgcccacguggagcuggccgacgccggccaguacagaugcaccgccaccaacgccgccggcaccacccagagccacgugcugcugcuggugcaggcccugccccagaucagcaugccccaggaggugagagugcccgccggcagcgccgccguguuccccugcaucgccagcggcuaccccacccccgacaucagcuggagcaagcuggacggcagccugccccccgacagcagacuggagaacaacaugcugaugcugcccagcgugagaccccaggacgccggcaccuacgugugcaccgccaccaacagacagggcaaggugaaggccuucgcccaccugcaggugcccgagagaguggugcccuacuucacccagacccccuacagcuuccugccccugcccaccaucaaggacgccuacagaaaguucgagaucaagaucaccuucagacccgacagcgccgacggcaugcugcuguacaacggccagaagagagugcccggcagccccaccaaccuggccaacagacagcccgacuucaucagcuucggccuggugggcggcagacccgaguucagauucgacgccggcagcggcauggccaccaucagacaccccaccccccuggcccugggccacuuccacaccgugacccugcugagaagccugacccagggcagccugaucgugggcgaccuggcccccgugaacggcaccagccagggcaaguuccagggccuggaccugaacgaggagcuguaccugggcggcuaccccgacuacggcgccauccccaaggccggccugagcagcggcuucaucggcugcgugagagagcugagaauccagggcgaggagaucguguuccacgaccugaaccugaccgcccacggcaucagccacugccccaccugcagagacagacccugccagaacggcggccagugccacgacagcgagagcagcagcuacgugugcgugugccccgccggcuucaccggcagcagaugcgagcacagccaggcccugcacugccaccccgaggccugcggccccgacgccaccugcgugaacagacccgacggcagaggcuacaccugcagaugccaccugggcagaagcggccugagaugcgaggagggcgugaccgugaccacccccagccugagcggcgccggcagcuaccuggcccugcccgcccugaccaacacccaccacgagcugagacuggacguggaguucaagccccuggcccccgacggcgugcugcuguucagcggcggcaagagcggccccguggaggacuucgugagccuggccauggugggcggccaccuggaguucagauacgagcugggcagcggccuggccgugcugagaagcgccgagccccuggcccugggcagauggcacagagugagcgccgagagacugaacaaggacggcagccugagagugaacggcggcagacccgugcugagaagcagccccggcaagagccagggccugaaccugcacacccugcuguaccugggcggcguggagcccagcgugccccugagccccgccaccaacaugagcgcccacuucagaggcugcgugggcgaggugagcgugaacggcaagagacuggaccugaccuacagcuuccugggcagccagggcaucggccagugcuacgacagcagccccugcgagagacagcccugccagcacggcgccaccugcaugcccgccggcgaguacgaguuccagugccugugcagagacggcuucaagggcgaccugugcgagcacgaggagaaccccugccagcugagagagcccugccugcacggcggcaccugccagggcaccagaugccugugccugcccggcuucagcggccccagaugccagcagggcagcggccacggcaucgccgagagcgacuggcaccuggagggcagcggcggcaacgacgcccccggccaguacggcgccuacuuccacgacgacggcuuccuggccuuccccggccacguguucagcagaagccugcccgaggugcccgagaccaucgagcuggaggugagaaccagcaccgccagcggccugcugcuguggcagggcguggaggugggcgaggccggccagggcaaggacuucaucagccugggccugcaggacggccaccugguguucagauaccagcugggcagcggcgaggccagacuggugagcgaggaccccaucaacgacggcgaguggcacagagugaccgcccugagagagggcagaagaggcagcauccagguggacggcgaggagcuggugagcggcagaagccccggccccaacguggccgugaacgccaagggcagcguguacaucggcggcgcccccgacguggccacccugaccggcggcagauucagcagcggcaucaccggcugcgugaagaaccuggugcugcacagcgccagacccggcgccccccccccccagccccuggaccugcagcacagagcccaggccggcgccaacaccagacccugccccagcuaa

SEQ ID NO: 18289 - RNA, 2445 nt, Artificial Sequence
  HSPH1__Homo_sapiens__NP_001273432
augagcguggugggccuggacgugggcagccagagcugcuacaucgccguggccagagccggcggcaucgagaccaucgccaacgaguucagcgacagaugcacccccagcgugaucagcuucggcagcaagaacagaaccaucggcguggccgccaagaaccagcagaucacccacgccaacaacaccgugagcaacuucaagagauuccacggcagagccuucaacgaccccuucauccagaaggagaaggagaaccugagcuacgaccuggugccccugaagaacggcggcgugggcaucaaggugauguacaugggcgaggagcaccuguucagcguggagcagaucaccgccaugcugcugaccaagcugaaggagaccgccgagaacagccugaagaagcccgugaccgacugcgugaucagcgugcccagcuucuucaccgacgccgagagaagaagcgugcuggacgccgcccagaucgugggccugaacugccugagacugaugaacgacaugaccgccguggcccugaacuacggcaucuacaagcaggaccugcccagccuggacgagaagcccagaaucgugguguucguggacaugggccacagcgccuuccaggugagcgccugcgccuucaacaagggcaagcugaaggugcugggcaccgccuucgaccccuuccugggcggcaagaacuucgacgagaagcugguggagcacuucugcgccgaguucaagaccaaguacaagcuggacgccaagagcaagaucagagcccugcugagacuguaccaggagugcgagaagcugaagaagcugaugagcagcaacagcaccgaccugccccugaacaucgagugcuucaugaacgacaaggacgugagcggcaagaugaacagaagccaguucgaggagcugugcgccgagcugcugcagaagaucgaggugccccuguacagccugcuggagcagacccaccugaagguggaggacgugagcgccguggagaucgugggcggcgccaccagaauccccgccgugaaggagagaaucgccaaguucuucggcaaggacaucagcaccacccugaacgccgacgaggccguggccagaggcugcgcccugcagugcgccauccugagccccgccuucaaggugagagaguucagcgugaccgacgccgugcccuuccccaucagccugaucuggaaccacgacagcgaggacaccgagggcgugcacgagguguucagcagaaaccacgccgcccccuucagcaaggugcugaccuuccugagaagaggccccuucgagcuggaggccuucuacagcgacccccagggcgugcccuaccccgaggccaagaucggcagauucguggugcagaacgugagcgcccagaaggacggcgagaagagcagagugaaggugaaggugagagugaacacccacggcaucuucaccaucagcaccgccagcaugguggagaaggugcccaccgaggagaacgagaugagcagcgaggccgacauggagugccugaaccagagaccccccgagaaccccgacaccgacgccaacgagaagaagguggaccagccccccgaggccaagaagcccaagaucaagguggugaacguggagcugcccaucgaggccaaccugguguggcagcugggcaaggaccugcugaacauguacaucgagaccgagggcaagaugaucaugcaggacaagcuggagaaggagagaaacgacgccaagaacgccguggaggaguacguguacgaguucagagacaagcugugcggccccuacgagaaguucaucugcgagcaggaccaccagaacuuccugagacugcugaccgagaccgaggacuggcuguacgaggagggcgaggaccaggccaagcaggccuacguggacaagcuggaggagcugaugaagaucggcacccccgugaaggugagauuccaggaggccgaggagagacccaagauguucgaggagcugggccagagacugcagcacuacgccaagaucgccgccgacuucagaaacaaggacgagaaguacaaccacaucgacgagagcgagaugaagaagguggagaagagcgugaacgaggugauggaguggaugaacaacgugaugaacgcccaggccaagaagagccuggaccaggaccccguggugagagcccaggagaucaagaccaagaucaaggagcugaacaacaccugcgagcccguggugacccagcccaagcccaagaucgagagccccaagcuggagagaacccccaacggccccaacaucgacaagaaggaggaggaccuggaggacaagaacaacuucggcgccgagcccccccaccagaacggcgagugcuaccccaacgagaagaacagcgugaacauggaccuggacuaa

SEQ ID NO: 18290 - RNA, 831 nt, Artificial Sequence
  HTATIP2__Homo_sapiens__NP_001091990
auggccggccccgccgcccugagcgccgccgccgccgccgcccuggccgccgcccugcugcugcugagaagagaggaccccggccccggcgccggccccagcauggccgagaccgaggcccugagcaagcugagagaggacuucagaaugcagaacaagagcguguucauccugggcgccagcggcgagaccggcagagugcugcugaaggagauccuggagcagggccuguucagcaaggugacccugaucggcagaagaaagcugaccuucgacgaggaggccuacaagaacgugaaccaggaggugguggacuucgagaagcuggacgacuacgccagcgccuuccagggccacgacgugggcuucugcugccugggcaccaccagaggcaaggccggcgccgagggcuucgugagaguggacagagacuacgugcugaagagcgccgagcuggccaaggccggcggcugcaagcacuucaaccugcugagcagcaagggcgccgacaagagcagcaacuuccuguaccugcaggugaagggcgagguggaggccaagguggaggagcugaaguucgacagauacagcguguucagacccggcgugcugcugugcgacagacaggagagcagacccggcgaguggcuggugagaaaguucuucggcagccugcccgacagcugggccagcggccacagcgugcccguggugaccguggugagagccaugcugaacaacguggugagacccagagacaagcagauggagcugcuggagaacaaggccauccacgaccugggcaaggcccacggcagccugaagcccuaa

SEQ ID NO: 18291 - RNA, 174 nt, Artificial Sequence
  HTN1__Homo_sapiens__NP_002150
augaaguucuucguguucgcccuggugcuggcccugaugaucagcaugaucagcgccgacagccacgagaagagacaccacggcuacagaagaaaguuccacgagaagcaccacagccacagagaguuccccuucuacggcgacuacggcagcaacuaccuguacgacaacuaa

SEQ ID NO: 18292 - RNA, 156 nt, Artificial Sequence
  HTN3__Homo_sapiens__NP_000191
augaaguucuucguguucgcccugauccuggcccugaugcugagcaugaccggcgccgacagccacgccaagagacaccacggcuacaagagaaaguuccacgagaagcaccacagccacagaggcuacagaagcaacuaccuguacgacaacuaa

SEQ ID NO: 18293 - RNA, 1269 nt, Artificial Sequence
  HTR1A__Homo_sapiens__NP_000515
auggacgugcugagccccggccagggcaacaacaccaccagcccccccgcccccuucgagaccggcggcaacaccaccggcaucagcgacgugaccgugagcuaccaggugaucaccagccugcugcugggcacccugaucuucugcgccgugcugggcaacgccugcgugguggccgccaucgcccuggagagaagccugcagaacguggccaacuaccugaucggcagccuggccgugaccgaccugauggugagcgugcuggugcugcccauggccgcccuguaccaggugcugaacaaguggacccugggccaggugaccugcgaccuguucaucgcccuggacgugcugugcugcaccagcagcauccugcaccugugcgccaucgcccuggacagauacugggccaucaccgaccccaucgacuacgugaacaagagaacccccagaagagccgccgcccugaucagccugaccuggcugaucggcuuccugaucagcaucccccccaugcugggcuggagaacccccgaggacagaagcgaccccgacgccugcaccaucagcaaggaccacggcuacaccaucuacagcaccuucggcgccuucuacaucccccugcugcugaugcuggugcuguacggcagaaucuucagagccgccagauucagaaucagaaagaccgugaagaagguggagaagaccggcgccgacaccagacacggcgccagccccgccccccagcccaagaagagcgugaacggcgagagcggcagcagaaacuggagacugggcguggagagcaaggccggcggcgcccugugcgccaacggcgccgugagacagggcgacgacggcgccgcccuggaggugaucgaggugcacagagugggcaacagcaaggagcaccugccccugcccagcgaggccggccccacccccugcgcccccgccagcuucgagagaaagaacgagagaaacgccgaggccaagagaaagauggcccuggccagagagagaaagaccgugaagacccugggcaucaucaugggcaccuucauccugugcuggcugcccuucuucaucguggcccuggugcugcccuucugcgagagcagcugccacaugcccacccugcugggcgccaucaucaacuggcugggcuacagcaacagccugcugaaccccgugaucuacgccuacuucaacaaggacuuccagaacgccuucaagaagaucaucaagugcaaguucugcagacaguaa

SEQ ID NO: 18294 - RNA, 1173 nt, Artificial Sequence
  HTR1B__Homo_sapiens__NP_000854
auggaggagcccggcgcccagugcgccccccccccccccgccggcagcgagaccugggugccccaggccaaccugagcagcgcccccagccagaacugcagcgccaaggacuacaucuaccaggacagcaucagccugcccuggaaggugcugcuggugaugcugcuggcccugaucacccuggccaccacccugagcaacgccuucgugaucgccaccguguacagaaccagaaagcugcacacccccgccaacuaccugaucgccagccuggccgugaccgaccugcuggugagcauccuggugaugcccaucagcaccauguacaccgugaccggcagauggacccugggccagguggugugcgacuucuggcugagcagcgacaucaccugcugcaccgccagcauccugcaccugugcgugaucgcccuggacagauacugggccaucaccgacgccguggaguacagcgccaagagaacccccaagagagccgccgugaugaucgcccugguguggguguucagcaucagcaucagccugccccccuucuucuggagacaggccaaggccgaggaggaggugagcgagugcguggugaacaccgaccacauccuguacaccguguacagcaccgugggcgccuucuacuuccccacccugcugcugaucgcccuguacggcagaaucuacguggaggccagaagcagaauccugaagcagacccccaacagaaccggcaagagacugaccagagcccagcugaucaccgacagccccggcagcaccagcagcgugaccagcaucaacagcagagugcccgacgugcccagcgagagcggcagccccguguacgugaaccaggugaaggugagagugagcgacgcccugcuggagaagaagaagcugauggccgccagagagagaaaggccaccaagacccugggcaucauccugggcgccuucaucgugugcuggcugcccuucuucaucaucagccuggugaugcccaucugcaaggacgccugcugguuccaccuggccaucuucgacuucuucaccuggcugggcuaccugaacagccugaucaaccccaucaucuacaccaugagcaacgaggacuucaagcaggccuuccacaagcugaucagauucaagugcaccagcuaa

SEQ ID NO: 18295 - RNA, 1098 nt, Artificial Sequence
  HTR1E__Homo_sapiens__XP_011534092
augaacaucaccaacugcaccaccgaggccagcauggccaucagacccaagaccaucaccgagaagaugcugaucugcaugacccugguggugaucaccacccugaccacccugcugaaccuggccgugaucauggccaucggcaccaccaagaagcugcaccagcccgccaacuaccugaucugcagccuggccgugaccgaccugcugguggccgugcuggugaugccccugagcaucaucuacaucgugauggacagauggaagcugggcuacuuccugugcgagguguggcugagcguggacaugaccugcugcaccugcagcauccugcaccugugcgugaucgcccuggacagauacugggccaucaccaacgccaucgaguacgccagaaagagaaccgccaagagagccgcccugaugauccugaccguguggaccaucagcaucuucaucagcaugcccccccuguucuggagaagccacagaagacugagccccccccccagccagugcaccauccagcacgaccacgugaucuacaccaucuacagcacccugggcgccuucuacaucccccugacccugauccugauccuguacuacagaaucuaccacgccgccaagagccuguaccagaagagaggcagcagcagacaccugagcaacagaagcaccgacagccagaacagcuucgccagcugcaagcugacccagaccuucugcgugagcgacuucagcaccagcgaccccaccaccgaguucgagaaguuccacgccagcaucagaaucccccccuucgacaacgaccuggaccaccccggcgagagacagcagaucagcagcaccagagagagaaaggccgccagaauccugggccugauccugggcgccuucauccugagcuggcugcccuucuucaucaaggagcugaucgugggccugagcaucuacaccgugagcagcgagguggccgacuuccugaccuggcugggcuacgugaacagccugaucaacccccugcuguacaccagcuucaacgaggacuucaagcuggccuucaagaagcugaucagaugcagagagcacaccuaa

SEQ ID NO: 18296 - RNA, 1101 nt, Artificial Sequence
  HTR1F__Homo_sapiens__NP_000857
auggacuuccugaacagcagcgaccagaaccugaccagcgaggagcugcugaacagaaugcccagcaagauccuggugagccugacccugagcggccuggcccugaugaccaccaccaucaacagccuggugaucgccgccaucaucgugaccagaaagcugcaccaccccgccaacuaccugaucugcagccuggccgugaccgacuuccugguggccgugcuggugaugcccuucagcaucguguacaucgugagagagagcuggaucaugggccagguggugugcgacaucuggcugagcguggacaucaccugcugcaccugcagcauccugcaccugagcgccaucgcccuggacagauacagagccaucaccgacgccguggaguacgccagaaagagaacccccaagcacgccggcaucaugaucaccaucguguggaucaucagcguguucaucagcaugcccccccuguucuggagacaccagggcaccagcagagacgacgagugcaucaucaagcacgaccacaucgugagcaccaucuacagcaccuucggcgccuucuacaucccccuggcccugauccugauccuguacuacaagaucuacagagccgccaagacccuguaccacaagagacaggccagcagaaucgccaaggaggaggugaacggccaggugcugcuggagagcggcgagaagagcaccaagagcgugagcaccagcuacgugcuggagaagagccugagcgaccccagcaccgacuucgacaagauccacagcaccgugagaagccugagaagcgaguucaagcacgagaagagcuggagaagacagaagaucagcggcaccagagagagaaaggccgccaccacccugggccugauccugggcgccuucgugaucugcuggcugcccuucuucgugaaggagcugguggugaacgugugcgacaagugcaagaucagcgaggagaugagcaacuuccuggccuggcugggcuaccugaacagccugaucaacccccugaucuacaccaucuucaacgaggacuucaagaaggccuuccagaagcuggugagaugcagaugcuaa

SEQ ID NO: 18297 - RNA, 1416 nt, Artificial Sequence
  HTR2A__Homo_sapiens__NP_000612
auggacauccugugcgaggagaacaccagccugagcagcaccaccaacagccugaugcagcugaacgacgacaccagacuguacagcaacgacuucaacagcggcgaggccaacaccagcgacgccuucaacuggaccguggacagcgagaacagaaccaaccugagcugcgagggcugccugagccccagcugccugagccugcugcaccugcaggagaagaacuggagcgcccugcugaccgccguggugaucauccugaccaucgccggcaacauccuggugaucauggccgugagccuggagaagaagcugcagaacgccaccaacuacuuccugaugagccuggccaucgccgacaugcugcugggcuuccuggugaugcccgugagcaugcugaccauccuguacggcuacagauggccccugcccagcaagcugugcgccguguggaucuaccuggacgugcuguucagcaccgccagcaucaugcaccugugcgccaucagccuggacagauacguggccauccagaaccccauccaccacagcagauucaacagcagaaccaaggccuuccugaagaucaucgccguguggaccaucagcgugggcaucagcaugcccauccccguguucggccugcaggacgacagcaagguguucaaggagggcagcugccugcuggccgacgacaacuucgugcugaucggcagcuucgugagcuucuucaucccccugaccaucauggugaucaccuacuuccugaccaucaagagccugcagaaggaggccacccugugcgugagcgaccugggcaccagagccaagcuggccagcuucagcuuccugccccagagcagccugagcagcgagaagcuguuccagagaagcauccacagagagcccggcagcuacaccggcagaagaaccaugcagagcaucagcaacgagcagaaggccugcaaggugcugggcaucguguucuuccuguucguggugauguggugccccuucuucaucaccaacaucauggccgugaucugcaaggagagcugcaacgaggacgugaucggcgcccugcugaacguguucguguggaucggcuaccugagcagcgccgugaacccccugguguacacccuguucaacaagaccuacagaagcgccuucagcagauacauccagugccaguacaaggagaacaagaagccccugcagcugauccuggugaacaccauccccgcccuggccuacaagagcagccagcugcagaugggccagaagaagaacagcaagcaggacgccaagaccaccgacaacgacugcagcaugguggcccugggcaagcagcacagcgaggaggccagcaaggacaacagcgacggcgugaacgagaaggugagcugcguguaa

SEQ ID NO: 18298 - RNA, 1446 nt, Artificial Sequence
  HTR2B__Homo_sapiens__NP_000858
auggcccugagcuacagagugagcgagcugcagagcaccauccccgagcacauccugcagagcaccuucgugcacgugaucagcagcaacuggagcggccugcagaccgagagcauccccgaggagaugaagcagaucguggaggagcagggcaacaagcugcacugggccgcccugcugauccugauggugaucauccccaccaucggcggcaacacccuggugauccuggccgugagccuggagaagaagcugcaguacgccaccaacuacuuccugaugagccuggccguggccgaccugcuggugggccuguucgugaugcccaucgcccugcugaccaucauguucgaggccauguggccccugccccuggugcugugccccgccuggcuguuccuggacgugcuguucagcaccgccagcaucaugcaccugugcgccaucagcguggacagauacaucgccaucaagaagcccauccaggccaaccaguacaacagcagagccaccgccuucaucaagaucaccgugguguggcugaucagcaucggcaucgccauccccgugcccaucaagggcaucgagaccgacguggacaaccccaacaacaucaccugcgugcugaccaaggagagauucggcgacuucaugcuguucggcagccuggccgccuucuucaccccccuggccaucaugaucgugaccuacuuccugaccauccacgcccugcagaagaaggccuaccuggugaagaacaagcccccccagagacugaccuggcugaccgugagcaccguguuccagagagacgagacccccugcagcagccccgagaagguggccaugcuggacggcagcagaaaggacaaggcccugcccaacagcggcgacgagacccugaugagaagaaccagcaccaucggcaagaagagcgugcagaccaucagcaacgagcagagagccagcaaggugcugggcaucguguucuuccuguuccugcugauguggugccccuucuucaucaccaacaucacccuggugcugugcgacagcugcaaccagaccacccugcagaugcugcuggagaucuucguguggaucggcuacgugagcagcggcgugaacccccugguguacacccuguucaacaagaccuucagagacgccuucggcagauacaucaccugcaacuacagagccaccaagagcgugaagacccugagaaagagaagcagcaagaucuacuucagaaaccccauggccgagaacagcaaguucuucaagaagcacggcaucagaaacggcaucaaccccgccauguaccagagccccaugagacugagaagcagcaccauccagagcagcagcaucauccugcuggacacccugcugcugaccgagaacgagggcgacaagaccgaggagcaggugagcuacguguaa

SEQ ID NO: 18299 - RNA, 1377 nt, Artificial Sequence
  HTR2C__Homo_sapiens__NP_001243689
auggugaaccugagaaacgccgugcacagcuuccuggugcaccugaucggccugcugguguggcagugcgacaucagcgugagccccguggccgccaucgugaccgacaucuucaacaccagcgacggcggcagauucaaguuccccgacggcgugcagaacuggcccgcccugagcaucgugaucaucaucaucaugaccaucggcggcaacauccuggugaucauggccgugagcauggagaagaagcugcacaacgccaccaacuacuuccugaugagccuggccaucgccgacaugcuggugggccugcuggugaugccccugagccugcuggccauccuguacgacuacguguggccccugcccagauaccugugccccguguggaucagccuggacgugcuguucagcaccgccagcaucaugcaccugugcgccaucagccuggacagauacguggccaucagaaaccccaucgagcacagcagauucaacagcagaaccaaggccaucaugaagaucgccaucgugugggccaucagcaucggcgugagcgugcccauccccgugaucggccugagagacgaggagaagguguucgugaacaacaccaccugcgugcugaacgaccccaacuucgugcugaucggcagcuucguggccuucuucaucccccugaccaucauggugaucaccuacugccugaccaucuacgugcugagaagacaggcccugaugcugcugcacggccacaccgaggagccccccggccugagccuggacuuccugaagugcugcaagagaaacaccgccgaggaggagaacagcgccaaccccaaccaggaccagaacgccagaagaagaaagaagaaggagagaagacccagaggcaccaugcaggccaucaacaacgagagaaaggccagcaaggugcugggcaucguguucuucguguuccugaucauguggugccccuucuucaucaccaacauccugagcgugcugugcgagaagagcugcaaccagaagcugauggagaagcugcugaacguguucguguggaucggcuacgugugcagcggcaucaacccccugguguacacccuguucaacaagaucuacagaagagccuucagcaacuaccugagaugcaacuacaagguggagaagaagccccccgugagacagauccccagaguggccgccaccgcccugagcggcagagagcugaacgugaacaucuacagacacaccaacgagcccgugaucgagaaggccagcgacaacgagcccggcaucgagaugcagguggagaaccuggagcugcccgugaaccccagcagcguggugagcgagagaaucagcagcguguaa

SEQ ID NO: 18300 - RNA, 1455 nt, Artificial Sequence
  HTR3A__Homo_sapiens__NP_000860
augcugggcaagcuggccaugcugcugugggugcagcaggcccugcuggcccugcugcugcccacccugcuggcccagggcgaggccagaagaagcagaaacaccaccagacccgcccugcugagacugagcgacuaccugcugaccaacuacagaaagggcgugagacccgugagagacuggagaaagcccaccaccgugagcaucgacgugaucguguacgccauccugaacguggacgagaagaaccaggugcugaccaccuacaucugguacagacaguacuggaccgacgaguuccugcaguggaaccccgaggacuucgacaacaucaccaagcugagcauccccaccgacagcaucugggugcccgacauccugaucaacgaguucguggacgugggcaagagccccaacauccccuacguguacaucagacaccagggcgaggugcagaacuacaagccccugcagguggugaccgccugcagccuggacaucuacaacuuccccuucgacgugcagaacugcagccugaccuucaccagcuggcugcacaccauccaggacaucaacaucagccuguggagacugcccgagaaggugaagagcgacagaagcguguucaugaaccagggcgagugggagcugcugggcgugcugcccuacuucagagaguucagcauggagagcagcaacuacuacgccgagaugaaguucuacguggugaucagaagaagaccccuguucuacguggugagccugcugcugcccagcaucuuccugauggugauggacaucgugggcuucuaccugccccccaacagcggcgagagagugagcuucaagaucacccugcugcugggcuacagcguguuccugaucaucgugagcgacacccugcccgccaccgccaucggcaccccccugaucggcguguacuucguggugugcauggcccugcuggugaucagccuggccgagaccaucuucaucgugagacuggugcacaagcaggaccugcagcagcccgugcccgccuggcugagacaccuggugcuggagagaaucgccuggcugcugugccugagagagcagagcaccagccagagaccccccgccaccagccaggccaccaagaccgacgacugcagcgccaugggcaaccacugcagccacaugggcggcccccaggacuucgagaagagccccagagacagaugcagccccccccccccccccagagaggccagccuggccgugugcggccugcugcaggagcugagcagcaucagacaguuccuggagaagagagacgagaucagagagguggccagagacuggcugagagugggcagcgugcuggacaagcugcuguuccacaucuaccugcuggccgugcuggccuacagcaucacccuggugaugcuguggagcaucuggcaguacgccuaa

SEQ ID NO: 18301 - RNA, 1326 nt, Artificial Sequence
  HTR3B__Homo_sapiens__NP_006019
augcugagcagcgugauggccccccugugggccugcauccugguggccgccggcauccuggccaccgacacccaccacccccaggacagcgcccuguaccaccugagcaagcagcugcugcagaaguaccacaaggaggugagacccguguacaacuggaccaaggccaccaccguguaccuggaccuguucgugcacgccauccuggacguggacgccgagaaccagauccugaagaccagcgugugguaccaggagguguggaacgacgaguuccugagcuggaacagcagcauguucgacgagaucagagagaucagccugccccugagcgccaucugggcccccgacaucaucaucaacgaguucguggacaucgagagauaccccgaccugcccuacguguacgugaacagcagcggcaccaucgagaacuacaagcccauccagguggugagcgccugcagccuggagaccuacgccuuccccuucgacgugcagaacugcagccugaccuucaagagcauccugcacaccguggaggacguggaccuggccuuccugagaagccccgaggacauccagcacgacaagaaggccuuccugaacgacagcgagugggagcugcugagcgugagcagcaccuacagcauccugcagagcagcgccggcggcuucgcccagauccaguucaacguggugaugagaagacacccccugguguacguggugagccugcugauccccagcaucuuccugaugcugguggaccugggcagcuucuaccugccccccaacugcagagccagaaucguguucaagaccagcgugcuggugggcuacaccguguucagagugaacaugagcaaccaggugcccagaagcgugggcagcaccccccugaucggccacuucuucaccaucugcauggccuuccuggugcugagccuggccaagagcaucgugcuggugaaguuccugcacgacgagcagagaggcggccaggagcagcccuuccugugccugagaggcgacaccgacgccgacagacccagaguggagcccagagcccagagagccguggugaccgagagcagccuguacggcgagcaccuggcccagcccggcacccugaaggagguguggagccagcugcagagcaucagcaacuaccugcagacccaggaccagaccgaccagcaggaggccgaguggcuggugcugcugagcagauucgacagacugcuguuccagagcuaccuguucaugcugggcaucuacaccaucacccugugcagccugugggcccuguggggcggcguguaa

SEQ ID NO: 18302 - RNA, 1344 nt, Artificial Sequence
  HTR3C__Homo_sapiens__NP_570126
auggagggcggcuggcccgccagacagagcgcccugcugugccugaccgugagccugcugcugcagggcagaggcgacgccuucaccaucaacugcagcggcuucgaccagcacggcguggaccccgccguguuccaggccguguucgacagaaaggccuucagacccuucaccaacuacagcauccccaccagagugaacaucagcuucacccugagcgccauccugggcguggacgcccagcugcagcugcugaccagcuuccuguggauggaccuggugugggacaaccccuucaucaacuggaaccccaaggagugcgugggcaucaacaagcugaccgugcuggccgagaaccuguggcugcccgacaucuucaucguggagagcauggacguggaccagacccccagcggccugaccgccuacaucagcagcgagggcagaaucaaguacgacaagcccaugagagugaccagcaucugcaaccuggacaucuucuacuuccccuucgaccagcagaacugcaccuucaccuucagcagcuuccuguacaccguggacagcaugcugcugggcauggacaaggaggugugggagaucaccgacaccagcagaaaggugauccagacccagggcgagugggagcugcugggcaucaacaaggccacccccaagaugagcaugggcaacaaccuguacgaccagaucauguucuacguggccaucagaagaagacccagccuguacaucaucaaccugcuggugcccagcagcuuccugguggccaucgacgcccugagcuucuaccugcccgccgagagcgagaacagagcccccuucaagaucacccugcugcugggcuacaacguguuccugcugaugaugaacgaccugcugcccgccagcggcaccccccugaucagcguguacuucgcccugugccugagccugaugguggugagccugcuggagaccguguucaucaccuaccugcugcacguggccaccacccagcccccccccaugcccagauggcugcacagccugcugcugcacugcaccagccccggcagaugcugccccaccgccccccagaagggcaacaagggccugggccugacccugacccaccugcccggccccaaggagcccggcgagcuggccggcaagaagcugggccccagagagaccgagcccgacggcggcagcggcuggaccaagacccagcugauggagcugugggugcaguucagccacgccauggacacccugcuguucagacuguaccugcuguucauggccagcagcauccugaccgugaucgugcuguggaacaccuaa

SEQ ID NO: 18303 - RNA, 1215 nt, Artificial Sequence
  HTR3D__Homo_sapiens__NP_001138615
auggagagaggcugguuccacggcaagggcuuccugcugggcuucauccugcaccugcugcugcaggacagccaccugcagcuggugaccagcuuccuguggcugaacauguggaaccccgacgagugcggcggcaucaagaagagcggcauggccaccgagaaccuguggcugagcgacguguucaucgaggagagcguggaccagacccccgccggccugauggccagcaugagcaucgugaaggccaccagcaacaccaucagccagugcggcuggagcgccagcgccaacuggacccccagcaucagccccagcauggacagaggcgagagaagccccagcgcccugagccccacccaggugaccagagccuggagaagaaugagcagaagcuuccagauccaccacagaaccagcuucagaaccagaagagagugggugcugcugggcauccagaagagaaccaucaaggugaccguggccaccaaccaguacgagcaggccaucuuccacguggccaucagaagaagaugcagacccagccccuacguggugaacuuccuggugcccagcggcauccugaucgccaucgacgcccugagcuucuaccugccccuggagagcggcaacugcgcccccuucaagaugaccgugcugcugggcuacagcguguuccugcugaugaugaacgaccugcugcccgccaccagcaccagcagccacgccagccuggugagaccccaccccagcagagaccagaagagaggcguguacuucgcccugugccugagccugauggugggcagccugcuggagaccaucuucaucacccaccugcugcacguggccaccacccagccccugccccugcccagauggcugcacagccugcugcugcacugcaccggccagggcagaugcugccccaccgccccccagaagggcaacaagggccccggccugacccccacccaccugcccggcgugaaggagcccgaggugagcgccggccagaugcccggccccggcgaggccgagcugaccggcggcagcgaguggaccagagcccagagagagcacgaggcccagaagcagcacagcguggagcugugggugcaguucagccacgccauggacgcccugcuguucagacuguaccugcuguucauggccagcagcaucaucaccgugaucugccuguggaacaccuaa

SEQ ID NO: 18304 - RNA, 1371 nt, Artificial Sequence
  HTR3E__Homo_sapiens__NP_001243542
auggagggcagcugguuccacagaaagagauucagcuucuaccugcugcugggcuuccugcugcagggcagaggcgugaccuucaccaucaacugcagcggcuucggccagcacggcgccgaccccaccgcccugaacagcguguucaacagaaagcccuucagacccgugaccaacaucagcgugcccacccaggugaacaucagcuucgccaugagcgccauccuggacgugaacgagcagcugcaccugcugagcagcuuccuguggcuggagauggugugggacaaccccuucaucagcuggaaccccgaggagugcgagggcaucaccaagaugagcauggccgccaagaaccuguggcugcccgacaucuucaucaucgagcugauggacguggacaagacccccaagggccugaccgccuacgugagcaacgagggcagaaucagauacaagaagcccaugaagguggacagcaucugcaaccuggacaucuucuacuuccccuucgaccagcagaacugcacccugaccuucagcagcuuccuguacaccguggacagcaugcugcuggacauggagaaggaggugugggagaucaccgacgccagcagaaacauccugcagacccacggcgagugggagcugcugggccugagcaaggccaccgccaagcugagcagaggcggcaaccuguacgaccagaucguguucuacguggccaucagaagaagacccagccuguacgugaucaaccugcuggugcccagcggcuuccugguggccaucgacgcccugagcuucuaccugcccgugaagagcggcaacagagugcccuucaagaucacccugcugcugggcuacaacguguuccugcugaugaugagcgaccugcugcccaccagcggcaccccccugaucggcguguacuucgcccugugccugagccugauggugggcagccugcuggagaccaucuucaucacccaccugcugcacguggccaccacccagccccccccccugcccagauggcugcacagccugcugcugcacugcaacagccccggcagaugcugccccaccgccccccagaaggagaacaagggccccggccugacccccacccaccugcccggcgugaaggagcccgaggugagcgccggccagaugcccggccccgccgaggccgagcugaccggcggcagcgaguggaccagagcccagagagagcacgaggcccagaagcagcacagcguggagcuguggcugcaguucagccacgccauggacgccaugcuguucagacuguaccugcuguucauggccagcagcaucaucaccgugaucugccuguggaacaccuaa

SEQ ID NO: 18305 - RNA, 1167 nt, Artificial Sequence
  HTR4__Homo_sapiens__NP_000861
auggacaagcuggacgccaacgugagcagcgaggagggcuucggcagcguggagaagguggugcugcugaccuuccugagcaccgugauccugauggccauccugggcaaccugcuggugaugguggccgugugcugggacagacagcugagaaagaucaagaccaacuacuucaucgugagccuggccuucgccgaccugcuggugagcgugcuggugaugcccuucggcgccaucgagcuggugcaggacaucuggaucuacggcgagguguucugccuggugagaaccagccuggacgugcugcugaccaccgccagcaucuuccaccugugcugcaucagccuggacagauacuacgccaucugcugccagccccugguguacagaaacaagaugaccccccugagaaucgcccugaugcugggcggcugcugggugauccccaccuucaucagcuuccugcccaucaugcagggcuggaacaacaucggcaucaucgaccugaucgagaagagaaaguucaaccagaacagcaacagcaccuacugcguguucauggugaacaagcccuacgccaucaccugcagcgugguggccuucuacauccccuuccugcugauggugcuggccuacuacagaaucuacgugaccgccaaggagcacgcccaccagauccagaugcugcagagagccggcgccagcagcgagagcagaccccagagcgccgaccagcacagcacccacagaaugagaaccgagaccaaggccgccaagacccugugcaucaucaugggcugcuucugccugugcugggcccccuucuucgugaccaacaucguggaccccuucaucgacuacaccgugcccggccagguguggaccgccuuccuguggcugggcuacaucaacagcggccugaaccccuuccuguacgccuuccugaacaagagcuucagaagagccuuccugaucauccugugcugcgacgacgagagauacagaagacccagcauccugggccagaccgugcccugcagcaccaccaccaucaacggcagcacccacgugcugagagacgccguggagugcggcggccagugggagagccagugccacccccccgccaccagcccccugguggccgcccagcccagcgacaccuaa

SEQ ID NO: 18306 - RNA, 1074 nt, Artificial Sequence
  HTR5A__Homo_sapiens__NP_076917
auggaccugcccgugaaccugaccagcuucagccugagcacccccagcccccuggagaccaaccacagccugggcaaggacgaccugagacccagcagcccccugcugagcguguucggcgugcugauccugacccugcugggcuuccugguggccgccaccuucgccuggaaccugcuggugcuggccaccauccugagagugagaaccuuccacagagugccccacaaccugguggccagcauggccgugagcgacgugcugguggccgcccuggugaugccccugagccuggugcacgagcugagcggcagaagauggcagcugggcagaagacugugccagcuguggaucgccugcgacgugcugugcugcaccgccagcaucuggaacgugaccgccaucgcccuggacagauacuggagcaucaccagacacauggaguacacccugagaaccagaaagugcgugagcaacgugaugaucgcccugaccugggcccugagcgccgugaucagccuggccccccugcuguucggcuggggcgagaccuacagcgagggcagcgaggagugccaggugagcagagagcccagcuacgccguguucagcaccgugggcgccuucuaccugccccugugcguggugcuguucguguacuggaagaucuacaaggccgccaaguucagagugggcagcagaaagaccaacagcgugagccccaucagcgaggccguggaggugaaggacagcgccaagcagccccagaugguguucaccgugagacacgccaccgugaccuuccagcccgagggcgacaccuggagagagcagaaggagcagagagccgcccugauggugggcauccugaucggcguguucgugcugugcuggauccccuucuuccugaccgagcugaucagcccccugugcagcugcgacauccccgccaucuggaagagcaucuuccuguggcugggcuacagcaacagcuucuucaacccccugaucuacaccgccuucaacaagaacuacaacagcgccuucaagaacuucuucagcagacagcacuaa

SEQ ID NO: 18307 - RNA, 1338 nt, Artificial Sequence
  HTR7__Homo_sapiens__NP_000863
augauggacgugaacagcagcggcagacccgaccuguacggccaccugagaagcuuccugcugcccgaggugggcagaggccugcccgaccugagccccgacggcggcgccgaccccguggccggcagcugggccccccaccugcugagcgaggugaccgccagccccgcccccaccugggacgccccccccgacaacgccagcggcugcggcgagcagaucaacuacggcagaguggagaagguggugaucggcagcauccugacccugaucacccugcugaccaucgccggcaacugccugguggugaucagcgugugcuucgugaagaagcugagacagcccagcaacuaccugaucgugagccuggcccuggccgaccugagcguggccguggccgugaugcccuucgugagcgugaccgaccugaucggcggcaaguggaucuucggccacuucuucugcaacguguucaucgccauggacgugaugugcugcaccgccagcaucaugacccugugcgugaucagcaucgacagauaccugggcaucaccagaccccugaccuaccccgugagacagaacggcaagugcauggccaagaugauccugagcguguggcugcugagcgccagcaucacccugcccccccuguucggcugggcccagaacgugaacgacgacaaggugugccugaucagccaggacuucggcuacaccaucuacagcaccgccguggccuucuacauccccaugagcgugaugcuguucauguacuaccagaucuacaaggccgccagaaagagcgccgccaagcacaaguuccccggcuuccccagaguggagcccgacagcgugaucgcccugaacggcaucgugaagcugcagaaggagguggaggagugcgccaaccugagcagacugcugaagcacgagagaaagaacaucagcaucuucaagagagagcagaaggccgccaccacccugggcaucaucgugggcgccuucaccgugugcuggcugcccuucuuccugcugagcaccgccagacccuucaucugcggcaccagcugcagcugcaucccccuguggguggagagaaccuuccuguggcugggcuacgccaacagccugaucaaccccuucaucuacgccuucuucaacagagaccugagaaccaccuacagaagccugcugcagugccaguacagaaacaucaacagaaagcugagcgccgccggcaugcacgaggcccugaagcuggccgagagacccgagagacccgaguucgugcugcagaacgccgacuacugcagaaagaagggccacgacagcuaa

SEQ ID NO: 18308 - RNA, 1443 nt, Artificial Sequence
  HTRA1__Homo_sapiens__NP_002766
augcagauccccagagccgcccugcugccccugcugcugcugcugcuggccgcccccgccagcgcccagcugagcagagccggcagaagcgccccccuggccgccggcugccccgacagaugcgagcccgccagaugccccccccagcccgagcacugcgagggcggcagagccagagacgccugcggcugcugcgaggugugcggcgcccccgagggcgccgccugcggccugcaggagggccccugcggcgagggccugcagugcguggugcccuucggcgugcccgccagcgccaccgugagaagaagagcccaggccggccugugcgugugcgccagcagcgagcccgugugcggcagcgacgccaacaccuacgccaaccugugccagcugagagccgccagcagaagaagcgagagacugcacagaccccccgugaucgugcugcagagaggcgccugcggccagggccaggaggaccccaacagccugagacacaaguacaacuucaucgccgacgugguggagaagaucgcccccgccguggugcacaucgagcuguucagaaagcugcccuucagcaagagagaggugcccguggccagcggcagcggcuucaucgugagcgaggacggccugaucgugaccaacgcccacguggugaccaacaagcacagagugaagguggagcugaagaacggcgccaccuacgaggccaagaucaaggacguggacgagaaggccgacaucgcccugaucaagaucgaccaccagggcaagcugcccgugcugcugcugggcagaagcagcgagcugagacccggcgaguucgugguggccaucggcagccccuucagccugcagaacaccgugaccaccggcaucgugagcaccacccagagaggcggcaaggagcugggccugagaaacagcgacauggacuacauccagaccgacgccaucaucaacuacggcaacagcggcggcccccuggugaaccuggacggcgaggugaucggcaucaacacccugaaggugaccgccggcaucagcuucgccauccccagcgacaagaucaagaaguuccugaccgagagccacgacagacaggccaagggcaaggccaucaccaagaagaaguacaucggcaucagaaugaugagccugaccagcagcaaggccaaggagcugaaggacagacacagagacuuccccgacgugaucagcggcgccuacaucaucgaggugauccccgacacccccgccgaggccggcggccugaaggagaacgacgugaucaucagcaucaacggccagagcguggugagcgccaacgacgugagcgacgugaucaagagagagagcacccugaacaugguggugagaagaggcaacgaggacaucaugaucaccgugauccccgaggagaucgaccccuaa

SEQ ID NO: 18309 - RNA, 1377 nt, Artificial Sequence
  HTRA2__Homo_sapiens__NP_037379
auggccgcccccagagccggcagaggcgccggcuggagccugagagccuggagagcccugggcggcaucagauggggcagaagacccagacugacccccgaccugagagcccugcugaccagcggcaccagcgaccccagagccagagugaccuacggcacccccagccugugggccagacugagcgugggcgugaccgagcccagagccugccugaccagcggcacccccggccccagagcccagcugaccgccgugacccccgacaccagaaccagagaggccagcgagaacagcggcaccagaagcagagccuggcuggccguggcccugggcgccggcggcgccgugcugcugcugcuguggggcggcggcagaggcccccccgccgugcuggccgccgugcccagccccccccccgccagccccagaagccaguacaacuucaucgccgacgugguggagaagaccgcccccgccgugguguacaucgagauccuggacagacaccccuuccugggcagagaggugcccaucagcaacggcagcggcuucgugguggccgccgacggccugaucgugaccaacgcccacgugguggccgacagaagaagagugagagugagacugcugagcggcgacaccuacgaggccguggugaccgccguggaccccguggccgacaucgccacccugagaauccagaccaaggagccccugcccacccugccccugggcagaagcgccgacgugagacagggcgaguucgugguggccaugggcagccccuucgcccugcagaacaccaucaccagcggcaucgugagcagcgcccagagacccgccagagaccugggccugccccagaccaacguggaguacauccagaccgacgccgccaucgacuucggcaacagcggcggcccccuggugaaccuggacggcgaggugaucggcgugaacaccaugaaggugaccgccggcaucagcuucgccauccccagcgacagacugagagaguuccugcacagaggcgagaagaagaacagcagcagcggcaucagcggcagccagagaagauacaucggcgugaugaugcugacccugagccccagcauccuggccgagcugcagcugagagagcccagcuuccccgacgugcagcacggcgugcugauccacaaggugauccugggcagccccgcccacagagccggccugagacccggcgacgugauccuggccaucggcgagcagauggugcagaacgccgaggacguguacgaggccgugagaacccagagccagcuggccgugcagaucagaagaggcagagagacccugacccuguacgugacccccgaggugaccgaguaa

SEQ ID NO: 18310 - RNA, 1074 nt, Artificial Sequence
  HTRA3__Homo_sapiens__NP_001284488
augcaggccagagcccugcugcuggccgcccuggccgcccuggcccuggccagagagccccccgccgcccccugccccgccagaugcgacgugagcagaugccccagccccagaugccccggcggcuacgugcccgaccugugcaacugcugccuggugugcgccgccagcgagggcgagcccugcggcggcccccuggacagccccugcggcgagagccuggagugcgugagaggccugugcagaugcagauggagccacgccgugugcggcaccgacggccacaccuacgccaacgugugcgcccugcaggccgccagcagaagagcccugcagcugagcggcacccccgugagacagcugcagaagggcgccugcccccugggccugcaccagcugagcagccccagauacaaguucaacuucaucgccgacgugguggagaagaucgcccccgccguggugcacaucgagcuguuccugagacacccccuguucggcagaaacgugccccugagcagcggcagcggcuucaucaugagcgaggccggccugaucaucaccaacgcccacguggugagcagcaacagcgccgcccccggcagacagcagcugaaggugcagcugcagaacggcgacagcuacgaggccaccaucaaggacaucgacaagaagagcgacaucgccaccaucaagauccaccccaagaagaagcugcccgugcugcugcugggccacagcgccgaccugagacccggcgaguucgugguggccaucggcagccccuucgcccugcagaacaccgugaccaccggcaucgugagcaccgcccagagagagggcagagagcugggccugagagacagcgacauggacuacauccagaccgacgccaucaucaacuacggcaacagcggcggcccccuggugaaccuggacggcgaggugaucggcaucaacacccugaaggugaccgccggcaucagcuucgccauccccagcgacagaaucaccagauuccugaccgaguuccaggacaagcagaucaaggcccccagccuggccgugcacuaa

SEQ ID NO: 18311 - RNA, 1431 nt, Artificial Sequence
  HTRA4__Homo_sapiens__NP_710159
augaucagaccccagcugagaaccgccggccugggcagaugccugcugcccggccugcugcugcugcuggugcccgugcugugggccggcgccgagaagcugcacacccagcccagcugccccgccgugugccagcccaccagaugccccgcccugcccaccugcgcccugggcaccacccccguguucgaccugugcagaugcugcagagugugccccgccgccgagagagaggugugcggcggcgcccagggccagcccugcgcccccggccugcagugccugcagccccugagacccggcuuccccagcaccugcggcugccccacccugggcggcgccgugugcggcagcgacagaagaaccuaccccagcaugugcgcccugagagccgagaacagagccgccagaagacugggcaaggugcccgccgugcccgugcaguggggcaacugcggcgacaccggcaccagaagcgccggcccccugagaagaaacuacaacuucaucgccgccgugguggagaagguggcccccagcguggugcacgugcagcuguggggcagacugcugcacggcagcagacuggugcccguguacagcggcagcggcuucaucgugagcgaggacggccugaucaucaccaacgcccacguggugagaaaccagcaguggaucgagguggugcugcagaacggcgccagauacgaggccguggugaaggacaucgaccugaagcuggaccuggccgugaucaagaucgagagcaacgccgagcugcccgugcugaugcugggcagaagcagcgaccugagagccggcgaguucgugguggcccugggcagccccuucagccugcagaacaccgccaccgccggcaucgugagcaccaagcagagaggcggcaaggagcugggcaugaaggacagcgacauggacuacgugcagaucgacgccaccaucaacuacggcaacagcggcggcccccuggugaaccuggacggcgacgugaucggcgugaacagccugagagugaccgacggcaucagcuucgccauccccagcgacagagugagacaguuccuggccgaguaccacgagcaccagaugaagggcaaggccuucagcaacaagaaguaccugggccugcagaugcugagccugaccgugccccugagcgaggagcugaagaugcacuaccccgacuuccccgacgugagcagcggcguguacgugugcaaggugguggagggcaccgccgcccagagcagcggccugagagaccacgacgugaucgugaacaucaacggcaagcccaucaccaccaccaccgacguggugaaggcccuggacagcgacagccugagcauggccgugcugagaggcaaggacaaccugcugcugaccgugauccccgagaccaucaacuaa

SEQ ID NO: 18312 - RNA, 9435 nt, Artificial Sequence
  HTT__Homo_sapiens__NP_002102
auggccacccuggagaagcugaugaaggccuucgagagccugaagagcuuccagcagcagcagcagcagcagcagcagcagcagcagcagcagcagcagcagcagcagcagcagcagcagccccccccccccccccccccccccccccccccccagcugccccagccccccccccaggcccagccccugcugccccagccccagccccccccccccccccccccccccccccccggccccgccguggccgaggagccccugcacagacccaagaaggagcugagcgccaccaagaaggacagagugaaccacugccugaccaucugcgagaacaucguggcccagagcgugagaaacagccccgaguuccagaagcugcugggcaucgccauggagcuguuccugcugugcagcgacgacgccgagagcgacgugagaaugguggccgacgagugccugaacaaggugaucaaggcccugauggacagcaaccugcccagacugcagcuggagcuguacaaggagaucaagaagaacggcgcccccagaagccugagagccgcccuguggagauucgccgagcuggcccaccuggugagaccccagaagugcagacccuaccuggugaaccugcugcccugccugaccagaaccagcaagagacccgaggagagcgugcaggagacccuggccgccgccgugcccaagaucauggccagcuucggcaacuucgccaacgacaacgagaucaaggugcugcugaaggccuucaucgccaaccugaagagcagcagccccaccaucagaagaaccgccgccggcagcgccgugagcaucugccagcacagcagaagaacccaguacuucuacagcuggcugcugaacgugcugcugggccugcuggugcccguggaggacgagcacagcacccugcugauccugggcgugcugcugacccugagauaccuggugccccugcugcagcagcaggugaaggacaccagccugaagggcagcuucggcgugaccagaaaggagauggaggugagccccagcgccgagcagcuggugcagguguacgagcugacccugcaccacacccagcaccaggaccacaacguggugaccggcgcccuggagcugcugcagcagcuguucagaacccccccccccgagcugcugcagacccugaccgccgugggcggcaucggccagcugaccgccgccaaggaggagagcggcggcagaagcagaagcggcagcaucguggagcugaucgccggcggcggcagcagcugcagccccgugcugagcagaaagcagaagggcaaggugcugcugggcgaggaggaggcccuggaggacgacagcgagagcagaagcgacgugagcagcagcgcccugaccgccagcgugaaggacgagaucagcggcgagcuggccgccagcagcggcgugagcacccccggcagcgccggccacgacaucaucaccgagcagcccagaagccagcacacccugcaggccgacagcguggaccuggccagcugcgaccugaccagcagcgccaccgacggcgacgaggaggacauccugagccacagcagcagccaggugagcgccgugcccagcgaccccgccauggaccugaacgacggcacccaggccagcagccccaucagcgacagcagccagaccaccaccgagggccccgacagcgccgugacccccagcgacagcagcgagaucgugcuggacggcaccgacaaccaguaccugggccugcagaucggccagccccaggacgaggacgaggaggccaccggcauccugcccgacgaggccagcgaggccuucagaaacagcagcauggcccugcagcaggcccaccugcugaagaacaugagccacugcagacagcccagcgacagcagcguggacaaguucgugcugagagacgaggccaccgagcccggcgaccaggagaacaagcccugcagaaucaagggcgacaucggccagagcaccgacgacgacagcgccccccuggugcacugcgugagacugcugagcgccagcuuccugcugaccggcggcaagaacgugcuggugcccgacagagacgugagagugagcgugaaggcccuggcccugagcugcgugggcgccgccguggcccugcaccccgagagcuucuucagcaagcuguacaaggugccccuggacaccaccgaguaccccgaggagcaguacgugagcgacauccugaacuacaucgaccacggcgacccccaggugagaggcgccaccgccauccugugcggcacccugaucugcagcauccugagcagaagcagauuccacgugggcgacuggaugggcaccaucagaacccugaccggcaacaccuucagccuggccgacugcaucccccugcugagaaagacccugaaggacgagagcagcgugaccugcaagcuggccugcaccgccgugagaaacugcgugaugagccugugcagcagcagcuacagcgagcugggccugcagcugaucaucgacgugcugacccugagaaacagcagcuacuggcuggugagaaccgagcugcuggagacccuggccgagaucgacuucagacuggugagcuuccuggaggccaaggccgagaaccugcacagaggcgcccaccacuacaccggccugcugaagcugcaggagagagugcugaacaacguggugauccaccugcugggcgacgaggaccccagagugagacacguggccgccgccagccugaucagacuggugcccaagcuguucuacaagugcgaccagggccaggccgaccccgugguggccguggccagagaccagagcagcguguaccugaagcugcugaugcacgagacccagccccccagccacuucagcgugagcaccaucaccagaaucuacagaggcuacaaccugcugcccagcaucaccgacgugaccauggagaacaaccugagcagagugaucgccgccgugagccacgagcugaucaccagcaccaccagagcccugaccuucggcugcugcgaggcccugugccugcugagcaccgccuuccccgugugcaucuggagccugggcuggcacugcggcgugcccccccugagcgccagcgacgagagcagaaagagcugcaccgugggcauggccaccaugauccugacccugcugagcagcgccugguucccccuggaccugagcgcccaccaggacgcccugauccuggccggcaaccugcuggccgccagcgcccccaagagccugagaagcagcugggccagcgaggaggaggccaaccccgccgccaccaagcaggaggagguguggcccgcccugggcgacagagcccuggugcccaugguggagcagcuguucagccaccugcugaaggugaucaacaucugcgcccacgugcuggacgacguggcccccggccccgccaucaaggccgcccugcccagccugaccaacccccccagccugagccccaucagaagaaagggcaaggagaaggagcccggcgagcaggccagcgugccccugagccccaagaagggcagcgaggccagcgccgccagcagacagagcgacaccagcggccccgugaccaccagcaagagcagcagccugggcagcuucuaccaccugcccagcuaccugaagcugcacgacgugcugaaggccacccacgccaacuacaaggugacccuggaccugcagaacagcaccgagaaguucggcggcuuccugagaagcgcccuggacgugcugagccagauccuggagcuggccacccugcaggacaucggcaagugcguggaggagauccugggcuaccugaagagcugcuucagcagagagcccaugauggccaccgugugcgugcagcagcugcugaagacccuguucggcaccaaccuggccagccaguucgacggccugagcagcaaccccagcaagagccagggcagagcccagagacugggcagcagcagcgugagacccggccuguaccacuacugcuucauggcccccuacacccacuucacccaggcccuggccgacgccagccugagaaacauggugcaggccgagcaggagaacgacaccagcggcugguucgacgugcugcagaaggugagcacccagcugaagaccaaccugaccagcgugaccaagaacagagccgacaagaacgccauccacaaccacaucagacuguucgagccccuggugaucaaggcccugaagcaguacaccaccaccaccugcgugcagcugcagaagcaggugcuggaccugcuggcccagcuggugcagcugagagugaacuacugccugcuggacagcgaccagguguucaucggcuucgugcugaagcaguucgaguacaucgaggugggccaguucagagagagcgaggccaucauccccaacaucuucuucuuccuggugcugcugagcuacgagagauaccacagcaagcagaucaucggcauccccaagaucauccagcugugcgacggcaucauggccagcggcagaaaggccgugacccacgccauccccgcccugcagcccaucgugcacgaccuguucgugcugagaggcaccaacaaggccgacgccggcaaggagcuggagacccagaaggaggugguggugagcaugcugcugagacugauccaguaccaccaggugcuggagauguucauccuggugcugcagcagugccacaaggagaacgaggacaaguggaagagacugagcagacagaucgccgacaucauccugcccaugcuggccaagcagcagaugcacaucgacagccacgaggcccugggcgugcugaacacccuguucgagauccuggcccccagcagccugagacccguggacaugcugcugagaagcauguucgugacccccaacaccauggccagcgugagcaccgugcagcuguggaucagcggcauccuggccauccugagagugcugaucagccagagcaccgaggacaucgugcugagcagaauccaggagcugagcuucagccccuaccugaucagcugcaccgugaucaacagacugagagacggcgacagcaccagcacccuggaggagcacagcgagggcaagcagaucaagaaccugcccgaggagaccuucagcagauuccugcugcagcuggugggcauccugcuggaggacaucgugaccaagcagcugaagguggagaugagcgagcagcagcacaccuucuacugccaggagcugggcacccugcugaugugccugauccacaucuucaagagcggcauguucagaagaaucaccgccgccgccaccagacuguucagaagcgacggcugcggcggcagcuucuacacccuggacagccugaaccugagagccagaagcaugaucaccacccaccccgcccuggugcugcuguggugccagauccugcugcuggugaaccacaccgacuacagauggugggccgaggugcagcagacccccaagagacacagccugagcagcaccaagcugcugagcccccagaugagcggcgaggaggaggacagcgaccuggccgccaagcugggcaugugcaacagagagaucgugagaagaggcgcccugauccuguucugcgacuacgugugccagaaccugcacgacagcgagcaccugaccuggcugaucgugaaccacauccaggaccugaucagccugagccacgagccccccgugcaggacuucaucagcgccgugcacagaaacagcgccgccagcggccuguucauccaggccauccagagcagaugcgagaaccugagcacccccaccaugcugaagaagacccugcagugccuggagggcauccaccugagccagagcggcgccgugcugacccuguacguggacagacugcugugcacccccuucagagugcuggccagaaugguggacauccuggccugcagaagaguggagaugcugcuggccgccaaccugcagagcagcauggcccagcugcccauggaggagcugaacagaauccaggaguaccugcagagcagcggccuggcccagagacaccagagacuguacagccugcuggacagauucagacugagcaccaugcaggacagccugagccccagcccccccgugagcagccacccccuggacggcgacggccacgugagccuggagaccgugagccccgacaaggacugguacgugcaccuggugaagagccagugcuggaccagaagcgacagcgcccugcuggagggcgccgagcuggugaacagaauccccgccgaggacaugaacgccuucaugaugaacagcgaguucaaccugagccugcuggcccccugccugagccugggcaugagcgagaucagcggcggccagaagagcgcccuguucgaggccgccagagaggugacccuggccagagugagcggcaccgugcagcagcugcccgccgugcaccacguguuccagcccgagcugcccgccgagcccgccgccuacuggagcaagcugaacgaccuguucggcgacgccgcccuguaccagagccugcccacccuggccagagcccuggcccaguaccuggugguggugagcaagcugcccagccaccugcaccugccccccgagaaggagaaggacaucgugaaguucgugguggccacccuggaggcccugagcuggcaccugauccacgagcagaucccccugagccuggaccugcaggccggccuggacugcugcugccuggcccugcagcugcccggccuguggagcguggugagcagcaccgaguucgugacccacgccugcagccugaucuacugcgugcacuucauccuggaggccguggccgugcagcccggcgagcagcugcugagccccgagagaagaaccaacacccccaaggccaucagcgaggaggaggaggagguggaccccaacacccagaaccccaaguacaucaccgccgccugcgagaugguggccgagaugguggagagccugcagagcgugcuggcccugggccacaagagaaacagcggcgugcccgccuuccugaccccccugcugagaaacaucaucaucagccuggccagacugccccuggugaacagcuacaccagagugcccccccugguguggaagcugggcuggagccccaagcccggcggcgacuucggcaccgccuuccccgagauccccguggaguuccugcaggagaaggagguguucaaggaguucaucuacagaaucaacacccugggcuggaccagcagaacccaguucgaggagaccugggccacccugcugggcgugcuggugacccagccccuggugauggagcaggaggagagcccccccgaggaggacaccgagagaacccagaucaacgugcuggccgugcaggccaucaccagccuggugcugagcgccaugaccgugcccguggccggcaaccccgccgugagcugccuggagcagcagcccagaaacaagccccugaaggcccuggacaccagauucggcagaaagcugagcaucaucagaggcaucguggagcaggagauccaggccauggugagcaagagagagaacaucgccacccaccaccuguaccaggccugggaccccgugcccagccugagccccgccaccaccggcgcccugaucagccacgagaagcugcugcugcagaucaaccccgagagagagcugggcagcaugagcuacaagcugggccaggugagcauccacagcguguggcugggcaacagcaucaccccccugagagaggaggagugggacgaggaggaggaggaggaggccgacgcccccgcccccagcagcccccccaccagccccgugaacagcagaaagcacagagccggcguggacauccacagcugcagccaguuccugcuggagcuguacagcagauggauccugcccagcagcagcgccagaagaacccccgccauccugaucagcgagguggugagaagccugcugguggugagcgaccuguucaccgagagaaaccaguucgagcugauguacgugacccugaccgagcugagaagagugcaccccagcgaggacgagauccuggcccaguaccuggugcccgccaccugcaaggccgccgccgugcugggcauggacaaggccguggccgagcccgugagcagacugcuggagagcacccugagaagcagccaccugcccagcagagugggcgcccugcacggcgugcuguacgugcuggagugcgaccugcuggacgacaccgccaagcagcugauccccgugaucagcgacuaccugcugagcaaccugaagggcaucgcccacugcgugaacauccacagccagcagcacgugcuggugaugugcgccaccgccuucuaccugaucgagaacuacccccuggacgugggccccgaguucagcgccagcaucauccagaugugcggcgugaugcugagcggcagcgaggagagcacccccagcaucaucuaccacugcgcccugagaggccuggagagacugcugcugagcgagcagcugagcagacuggacgccgagagccuggugaagcugagcguggacagagugaacgugcacagcccccacagagccauggccgcccugggccugaugcugaccugcauguacaccggcaaggagaaggugagccccggcagaaccagcgaccccaaccccgccgcccccgacagcgagagcgugaucguggccauggagagagugagcgugcuguucgacagaaucagaaagggcuuccccugcgaggccagagugguggccagaauccugccccaguuccuggacgacuucuuccccccccaggacaucaugaacaaggugaucggcgaguuccugagcaaccagcagcccuacccccaguucauggccaccgugguguacaagguguuccagacccugcacagcaccggccagagcagcauggugagagacugggugaugcugagccugagcaacuucacccagagagcccccguggccauggccaccuggagccugagcugcuucuucgugagcgccagcaccagccccuggguggccgccauccugccccacgugaucagcagaaugggcaagcuggagcagguggacgugaaccuguucugccugguggccaccgacuucuacagacaccagaucgaggaggagcuggacagaagagccuuccagagcgugcuggaggugguggccgcccccggcagccccuaccacagacugcugaccugccugagaaacgugcacaaggugaccaccugcuaa

SEQ ID NO: 18313 - RNA, 2145 nt, Artificial Sequence
  HUNK__Homo_sapiens__NP_055401
augcccgccgccgccggcgacggccugcugggcgagcccgccgcccccggcggcggcggcggcgccgaggacgccgccagacccgccgccgccugcgagggcagcuuccugcccgccugggugagcggcgugcccagagagagacugagagacuuccagcaccacaagagagugggcaacuaccugaucggcagcagaaagcugggcgagggcagcuucgccaaggugagagagggccugcacgugcugaccggcgagaagguggccaucaaggugaucgacaagaagagagccaagaaggacaccuacgugaccaagaaccugagaagagagggccagauccagcagaugaucagacaccccaacaucacccagcugcuggacauccuggagaccgagaacagcuacuaccuggugauggagcugugccccggcggcaaccugaugcacaagaucuacgagaagaagagacuggaggagagcgaggccagaagauacaucagacagcugaucagcgccguggagcaccugcacagagccggcguggugcacagagaccugaagaucgagaaccugcugcuggacgaggacaacaacaucaagcugaucgacuucggccugagcaacugcgccggcauccugggcuacagcgaccccuucagcacccagugcggcagccccgccuacgccgcccccgagcugcuggccagaaagaaguacggccccaagaucgacguguggagcaucggcgugaacauguacgccaugcugaccggcacccugcccuucaccguggagcccuucagccugagagcccuguaccagaagaugguggacaaggagaugaacccccugcccacccagcugagcaccggcgccaucagcuuccugagaagccugcuggagcccgaccccgugaagagacccaacauccagcaggcccuggccaacagauggcugaacgagaacuacaccggcaaggugcccugcaacgugaccuaccccaacagaaucagccuggaggaccugagccccagcguggugcugcacaugaccgagaagcugggcuacaagaacagcgacgugaucaacaccgugcugagcaacagagccugccacauccuggccaucuacuuccugcugaacaagaagcuggagagauaccugagcggcaagagcgacauccaggacagccugugcuacaagaccagacuguaccagaucgagaaguacagagcccccaaggagagcuacgaggccagccuggacaccuggaccagagaccuggaguuccacgccgugcaggacaagaagcccaaggagcaggagaagagaggcgacuuccugcacagacccuucagcaagaagcuggacaagaaccugcccagccacaagcagcccagcggcagccugaugacccagauccagaacaccaaggcccugcugaaggacagaaaggccagcaagagcagcuuccccgacaaggacagcuucggcugcagaaacaucuucagaaagaccagcgacagcaacugcguggccagcagcagcauggaguucauccccgugcccccccccagaacccccagaaucgugaagaagcccgagccccaccagcccggccccggcagcaccggcaucccccacaaggaggacccccugaugcuggacauggugagaagcuucgagagcguggacagagacgaccacguggaggugcugagccccagccaccacuacagaauccugaacagccccgugagccuggccagaagaaacagcagcgagagaacccugagccccggccugcccagcggcagcaugagcccccugcacaccccccugcaccccacccuggugagcuucgcccacgaggacaagaacagcccccccaaggaggagggccugugcugccccccccccgugcccagcaacggccccaugcagccccugggcagccccaacugcgugaagagcagaggcagauuccccaugaugggcaucggccagaugcugagaaagagacaccagagccugcagcccagcgccgacagaccccuggaggccagccugcccccccugcagccccuggcccccgugaaccuggccuucgacauggccgacggcgugaagacccagugcuaa

SEQ ID NO: 18314 - RNA, 837 nt, Artificial Sequence
  HUS1B__Homo_sapiens__NP_683762
augaaguucagagccaagaucaccggcaagggcugccuggagcuguucauccacgugagcggcaccguggccagacuggccaaggugugcgugcugagagugagacccgacagccugugcuucggccccgccggcagcggcggccugcacgaggccagacuguggugcgaggugagacagggcgccuuccagcaguucagaauggagggcgugagcgaggaccuggacgagauccaccuggagcugaccgccgagcaccugagcagagccgccagaagcgccgccggcgccagcagccugaagcugcagcugacccacaagagaagacccagccugaccguggccguggagcuggugagcagccugggcagagccagaagcguggugcacgaccugcccgugagagugcugcccagaagaguguggagagacugccugccccccagccugagagccagcgacgccagcaucagacugcccagauggagaacccugagaagcaucguggagagaauggccaacgugggcagccacgugcugguggaggccaaccugagcggcagaaugacccugagcaucgagaccgagguggugagcauccagagcuacuucaagaaccugggcaaccccccccagagcgccgugggcgugcccgagaacagagaccuggagagcauggugcaggugagaguggacaacagaaagcugcugcaguuccuggagggccagcagauccaccccaccaccgcccugugcaacaucugggacaacacccugcugcagcuggugcuggugcaggaggacgugagccugcaguacuucauccccgcccuguaa

SEQ ID NO: 18315 - RNA, 843 nt, Artificial Sequence
  HUS1__Homo_sapiens__NP_004498
augaaguucagagccaagaucguggacggcgccugccugaaccacuucaccagaaucagcaacaugaucgccaagcuggccaagaccugcacccugagaaucagccccgacaagcugaacuucauccugugcgacaagcuggccaacggcggcgugagcauguggugcgagcuggagcaggagaacuucuucaacgaguuccagauggagggcgugagcgccgagaacaacgagaucuaccuggagcugaccagcgagaaccugagcagagcccugaagaccgcccagaacgccagagcccugaagaucaagcugaccaacaagcacuuccccugccugaccgugagcguggagcugcugagcaugagcagcagcagcagaaucgugacccacgacauccccaucaaggugauccccagaaagcuguggaaggaccugcaggagcccguggugcccgaccccgacgugagcaucuaccugcccgugcugaagaccaugaagagcgugguggagaagaugaagaacaucagcaaccaccuggugaucgaggccaaccuggacggcgagcugaaccugaagaucgagaccgagcuggugugcgugaccacccacuucaaggaccugggcaaccccccccuggccagcgagagcacccacgaggacagaaacguggagcacauggccgaggugcacaucgacaucagaaagcugcugcaguuccuggccggccagcaggugaaccccaccaaggcccugugcaacaucgugaacaacaagauggugcacuucgaccugcugcacgaggacgugagccugcaguacuucauccccgcccugagcuaa

SEQ ID NO: 18316 - RNA, 13125 nt, Artificial Sequence
  HUWE1__Homo_sapiens__XP_005262022
augaagguggacagaaccaagcugaagaagacccccaccgaggcccccgccgacugcagagcccugaucgacaagcugaaggugugcaacgacgagcagcugcugcuggagcugcagcagaucaagaccuggaacaucggcaagugcgagcuguaccacuggguggaccugcuggacagauucgacggcauccuggccgacgccggccagaccguggagaacaugagcuggaugcuggugugcgacagacccgagagagagcagcugaagaugcugcugcuggccgugcugaacuucaccgcccugcugaucgaguacagcuucagcagacaccuguacagcagcaucgagcaccugaccacccugcuggccagcagcgacaugcagguggugcuggccgugcugaaccugcuguacguguucagcaagagaagcaacuacaucaccagacugggcagcgacaagagaaccccccugcugaccagacugcagcaccuggccgagagcuggggcggcaaggagaacggcuucggccuggccgagugcugcagagaccugcacaugaugaaguacccccccagcgccaccacccugcacuucgaguucuacgccgaccccggcgccgaggugaagaucgagaagagaaccaccagcaacacccugcacuacauccacaucgagcagcuggacaagaucagcgagagccccagcgagaucauggagagccugaccaagauguacagcauccccaaggacaagcagaugcugcuguucacccacaucagacuggcccacggcuucagcaaccacagaaagagacugcaggccgugcaggccagacugcacgccaucagcauccugguguacagcaacgcccugcaggagagcgccaacagcauccuguacaacggccugaucgaggagcugguggacgugcugcagaucaccgacaagcagcugauggagaucaaggccgccagccugagaacccugaccagcaucgugcaccuggagagaacccccaagcugagcagcaucaucgacugcaccggcaccgccagcuaccacggcuuccugcccgugcuggugagaaacugcauccaggccaugaucgaccccagcauggaccccuacccccaccaguucgccaccgcccuguucagcuuccuguaccaccuggccagcuacgacgccggcggcgaggcccuggugagcugcggcaugauggaggcccugcugaaggugaucaaguuccugggcgacgagcaggaccagaucaccuucgugaccagagccgugagagugguggaccugaucaccaaccuggacauggccgccuuccagagccacagcggccugagcaucuucaucuacagacuggagcacgagguggaccugugcagaaaggagugccccuucgugaucaagcccaagauccagagacccaacaccacccaggagggcgaggagauggagaccgacauggacggcgugcagugcaucccccagagagccgcccugcugaagagcaugcugaacuuccugaagaaggccauccaggaccccgccuucagcgacggcaucagacacgugauggacggcagccugcccaccagccugaagcacaucaucagcaacgccgaguacuacggccccagccuguuccugcuggccaccgagguggugaccguguucguguuccaggagcccagccugcugagcagccugcaggacaacggccugaccgacgugaugcugcacgcccugcugaucaaggacgugcccgccaccagagaggugcugggcagccugcccaacguguucagcgcccugugccugaacgccagaggccugcagagcuucgugcagugccagcccuucgagagacuguucaaggugcugcugagccccgacuaccugcccgccaugagaagaagaagaagcagcgacccccugggcgacaccgccagcaaccugggcagcgccguggacgagcugaugagacaccagcccacccugaagaccgacgccaccaccgccaucaucaagcugcuggaggagaucugcaaccugggcagagaccccaaguacaucugccagaagcccagcauccagaaggccgacggcaccgccaccgcccccccccccagaagcaaccacgccgccgaggaggccagcagcgaggacgaggaggaggaggaggugcaggccaugcagagcuucaacagcacccagcagaacgagaccgagcccaaccagcagguggugggcaccgaggagagaauccccaucccccugauggacuacauccugaacgugaugaaguucguggagagcauccugagcaacaacaccaccgacgaccacugccaggaguucgugaaccagaagggccugcugccccuggugaccauccugggccugcccaaccugcccaucgacuuccccaccagcgccgccugccaggccguggccggcgugugcaagagcauccugacccugagccacgagcccaaggugcugcaggagggccugcugcagcuggacagcauccugagcagccuggagccccugcacagacccaucgagagccccggcggcagcgugcugcugagagagcuggccugcgccggcaacguggccgacgccacccugagcgcccaggccaccccccugcugcacgcccugaccgccgcccacgccuacaucaugauguucgugcacaccugcagagugggccagagcgagaucagaagcaucagcgugaaccaguggggcagccagcugggccugagcgugcugagcaagcugagccagcuguacugcagccuggugugggagagcaccgugcugcugagccugugcacccccaacagccugcccagcggcugcgaguucggccaggccgacaugcagaagcuggugcccaaggacgagaaggccggcaccacccagggcggcaagagaagcgacggcgagcaggacggcgccgccggcagcauggacgccagcacccagggccugcuggagggcaucggccuggacggcgacacccuggcccccauggagaccgacgagcccaccgccagcgacagcaagggcaagagcaagaucacccccgccauggccgccagaaucaagcagaucaagccccugcugagcgccagcagcagacugggcagagcccuggccgagcuguucggccugcuggugaagcugugcgugggcagccccgugagacagagaagaagccaccacgccgccagcaccaccaccgcccccacccccgccgccagaagcaccgccagcgcccugaccaagcugcugaccaagggccugagcuggcagcccccccccuacacccccacccccagauucagacugaccuucuucaucugcagcgugggcuucaccagccccaugcuguucgacgagagaaaguaccccuaccaccugaugcugcagaaguuccugugcagcggcggccacaacgcccuguucgagaccuucaacugggcccugagcaugggcggcaaggugcccgugagcgagggccuggagcacagcgaccugcccgacggcaccggcgaguuccuggacgccuggcugaugcugguggagaagauggugaaccccaccaccgugcuggagagcccccacagccugcccgccaagcugcccggcggcgugcagaacuucccccaguucagcgcccugagauuccugguggugacccagaaggccgccuucaccugcaucaagaaccuguggaacagaaagccccugaagguguacggcggcagaauggccgagagcaugcuggccauccugugccacauccugagaggcgagcccgugaucagagagagacugagcaaggagaaggagggcagcagaggcgaggaggacaccggccaggaggagggcggcagcagaagagagccccaggugaaccagcagcagcugcagcagcugauggacaugggcuucaccagagagcacgccauggaggcccugcugaacaccagcaccauggagcaggccaccgaguaccugcugacccaccccccccccaucaugggcggcguggugagagaccugagcaugagcgaggaggaccagaugaugagagccaucgccaugagccugggccaggacauccccauggaccagagagccgagagccccgaggagguggccugcagaaaggaggaggaggagagaaaggccagagagaagcaggaggaggaggaggccaagugccuggagaaguuccaggacgccgacccccuggagcaggacgagcugcacaccuucaccgacaccaugcugcccggcugcuuccaccugcuggacgagcugcccgacaccguguacagagugugcgaccugaucaugaccgccaucaagagaaacggcgccgacuacagagacaugauccugaagcagguggugaaccaggugugggaggccgccgacgugcugaucaaggccgcccugccccugaccaccagcgacaccaagaccgugagcgaguggaucagccagauggccacccugccccaggccagcaaccuggccaccagaauccugcugcugacccugcuguucgaggagcugaagcugcccugcgccugggugguggagagcagcggcauccugaacgugcugaucaagcugcuggagguggugcagcccugccugcaggccgccaaggagcagaaggaggugcagacccccaaguggaucacccccgugcugcugcugaucgacuucuacgagaagaccgccaucagcagcaagagaagagcccagaugaccaaguaccugcagagcaacagcaacaacuggagaugguucgacgacagaagcggcagauggugcagcuacagcgccagcaacaacagcaccaucgacagcgccuggaagagcggcgagaccagcgugagauucaccgccggcagaagaagauacaccgugcaguucaccaccauggugcaggugaacgaggagaccggcaacagaagacccgugaugcugacccugcugagagugcccagacugaacaagaacagcaagaacagcaacggccaggagcuggagaagacccuggaggagagcaaggagauggacaucaagagaaaggagaacaagggcaacgacaccccccuggcccuggagagcaccaacaccgagaaggagaccagccuggaggagaccaagaucggcgagauccugauccagggccugaccgaggacauggugaccgugcugaucagagccugcgugagcaugcugggcgugcccguggaccccgacacccugcacgccacccugagacugugccugagacugaccagagaccacaaguacgccaugauguucgccgagcugaagagcaccagaaugauccugaaccugacccagagcagcggcuucaacggcuucaccccccuggugacccugcugcugagacacaucaucgaggaccccugcacccugagacacaccauggagaagguggugagaagcgccgccaccagcggcgccggcagcaccaccagcggcguggugagcggcagccugggcagcagagagaucaacuacauccugagagugcugggccccgccgccugcagaaaccccgacaucuucaccgagguggccaacugcugcaucagaaucgcccugcccgcccccagaggcagcggcaccgccagcgacgacgaguucgagaaccugagaaucaagggccccaacgccgugcagcuggugaagaccaccccccugaagcccagcccccugcccgugauccccgacaccaucaaggaggugaucuacgacaugcugaacgcccuggccgccuaccacgcccccgaggaggccgacaagagcgaccccaagcccggcgugaugacccaggaggugggccagcugcugcaggacaugggcgacgacguguaccagcaguacagaagccugaccagacagagcagcgacuucgacacccagagcggcuucagcaucaacagccagguguucgccgccgacggcgccagcaccgagaccagcgccagcggcaccagccagggcgaggccagcacccccgaggagagcagagacggcaagaaggacaaggagggcgacagagccagcgaggagggcaagcagaagggcaagggcagcaagccccugaugcccaccagcaccauccugagacugcuggccgagcuggugagaagcuacgugggcaucgccacccugaucgccaacuacagcuacaccgugggccagagcgagcugaucaaggaggacugcagcgugcuggccuucgugcuggaccaccugcugccccacacccagaacgccgaggacaaggacacccccgcccuggccagacuguuccuggccagccuggccgccgccggcagcggcaccgacgcccagguggcccuggugaacgaggugaaggccgcccugggcagagcccuggccauggccgagagcaccgagaagcacgccagacugcaggccgugaugugcaucaucagcaccaucauggagagcugccccagcaccagcagcuucuacagcagcgccaccgccaagacccagcacaacggcaugaacaacaucaucagacuguuccugaagaagggccuggugaacgaccuggccagagugccccacagccuggaccugagcagccccaacauggccaacaccgugaacgccgcccugaagccccuggagacccugagcagaaucgugaaccagcccagcagccuguucggcagcaagagcgccagcagcaagaacaagagcgagcaggacgcccagggcgccagccaggacagcagcagcaaccagcaggaccccggcgagcccggcgaggccgaggugcaggaggaggaccacgacgugacccagaccgagguggccgacggcgacaucauggacggcgaggccgagaccgacagcguggugaucgccggccagcccgaggugcugagcagccaggagaugcagguggagaacgagcuggaggaccugaucgacgagcugcuggagagagacggcggcagcggcaacagcaccaucaucgugagcagaagcggcgaggacgagagccaggaggacgugcugauggacgaggcccccagcaaccugagccaggccagcacccugcaggccaacagagaggacagcaugaacauccuggaccccgaggacgaggaggagcacacccaggaggaggacagcagcggcagcaacgaggacgaggacgacagccaggacgaggaggaggaggaggaggaggacgaggaggacgaccaggaggacgacgagggcgaggagggcgacgaggacgacgacgacgacggcagcgagauggagcuggacgaggacuaccccgacaugaacgccagcccccuggugagauucgagagauucgacagagaggacgaccugaucaucgaguucgacaacauguucagcagcgccaccgacaucccccccagccccggcaacauccccaccacccacccccugauggugagacacgccgaccacagcagccugacccugggcagcggcagcagcaccaccagacugacccagggcaucggcagaagccagagaacccugagacagcugaccgccaacaccggccacaccauccacgugcacuaccccggcaacagacagcccaaccccccccugauccugcagagacugcugggccccagcgccgccgccgacauccugcagcugagcagcagccugccccugcagagcagaggcagagccagacugcuggugggcaacgacgacgugcacaucaucgccagaagcgacgacgagcugcuggacgacuucuuccacgaccagagcaccgccaccagccaggccggcacccugagcagcauccccaccgcccugaccagauggaccgaggagugcaaggugcuggacgccgagagcaugcacgacugcgugagcguggugaaggugagcaucgugaaccaccuggaguuccugagagacgaggagcuggaggagagaagagagaagagaagaaagcagcuggccgaggaggagaccaagaucaccgacaagggcaaggaggacaaggagaacagagaccagagcgcccagugcaccgccagcaagagcaacgacagcaccgagcagaaccugagcgacggcacccccaugcccgacagcuaccccaccacccccagcagcaccgacgccgccaccagcgagagcaaggagacccugggcacccugcagagcagccagcagcagcccacccugcccaccccccccgcccugggcgaggugccccaggagcugcagagccccgccggcgagggcggcagcagcacccagcugcugaugcccguggagcccgaggagcugggccccaccagacccagcggcgaggccgagaccacccagauggagcugagccccgcccccaccaucaccagccugagccccgagagagccgaggacagcgacgcccugaccgccgugagcagccagcuggagggcagccccauggacaccagcagccuggccagcugcacccuggaggaggccgugggcgacaccagcgccgccggcagcagcgagcagcccagagccggcagcagcacccccggcgacgccccccccgccguggccgaggugcagggcagaagcgacggcagcggcgagagcgcccagccccccgaggacagcagcccccccgccagcagcgagagcagcagcaccagagacagcgccguggccaucagcggcgccgacagcagaggcauccuggaggagccccugcccagcaccagcagcgaggaggaggacccccuggccggcaucagccugcccgagggcguggaccccagcuuccuggccgcccugcccgacgacaucagaagagaggugcugcagaaccagcugggcaucagaccccccaccagaaccgcccccagcaccaacagcagcgcccccgccguggugggcaaccccggcgugaccgaggugagccccgaguuccuggccgcccugccccccgccauccaggaggaggugcuggcccagcagagagccgagcagcagagaagagagcuggcccagaacgccagcagcgacacccccauggaccccgugaccuucauccagacccugcccagcgaccugagaagaagcgugcuggaggacauggaggacagcgugcuggccgugaugccccccgacaucgccgccgaggcccaggcccugagaagagagcaggaggccagacagagacagcugaugcacgagagacuguucggccacagcagcaccagcgcccugagcgccauccugagaagccccgccuucaccagcagacugagcggcaacagaggcgugcaguacaccagacuggccgugcagagaggcggcaccuuccagaugggcggcagcagcagccacaacagacccagcggcagcaacguggacacccugcugagacugagaggcagacugcugcuggaccacgaggcccugagcugccugcuggugcugcuguucguggacgagcccaagcugaacaccagcagacugcacagagugcugagaaaccugugcuaccacgcccagaccagacacugggugaucagaagccugcugagcauccugcagagaagcagcgagagcgagcugugcaucgagacccccaagcugaccaccagcgaggagaagggcaagaagagcagcaagagcugcggcagcagcagccacgagaacagaccccuggaccugcugcacaagauggagagcaagagcagcaaccagcugagcuggcugagcgugagcauggacgccgcccugggcugcagaaccaacaucuuccagauccagagaagcggcggcagaaagcacaccgagaagcacgccagcggcggcagcaccgugcacauccacccccaggccgcccccguggugugcagacacgugcuggacacccugauccagcuggccaagguguuccccagccacuucacccagcagagaaccaaggagaccaacugcgagagcgacagagagagaggcaacaaggccugcagccccugcagcagccagagcagcagcagcggcaucugcaccgacuucugggaccugcuggugaagcuggacaacaugaacgugagcagaaagggcaagaacagcgugaagagcgugcccgugagcgccggcggcgagggcgagaccagccccuacagccuggaggccagcccccugggccagcugaugaacaugcugagccaccccgugaucagaagaagcagccugcugaccgagaagcugcugagacugcugagccugaucagcaucgcccugcccgagaacaaggugagcgaggcccaggccaacagcggcagcggcgccagcagcaccaccaccgccaccagcaccaccagcaccaccaccaccaccgccgccagcaccacccccaccccccccaccgcccccacccccgugaccagcgcccccgcccugguggccgccaccgccaucagcaccaucgugguggccgccagcaccaccgugaccacccccaccaccgccaccaccaccgugagcaucagccccaccaccaagggcagcaagagccccgccaaggugagcgacggcggcagcagcagcaccgacuucaagauggugagcagcggccugaccgagaaccagcugcagcugagcguggaggugcugaccagccacagcugcagcgaggagggccuggaggacgccgccaacgugcugcugcagcugagcagaggcgacagcggcaccagagacaccgugcugaagcugcugcugaacggcgccagacaccugggcuacacccugugcaagcagaucggcacccugcuggccgagcugagagaguacaaccuggagcagcagagaagagcccagugcgagacccugagccccgacggccugcccgaggagcagccccagaccaccaagcugaagggcaagaugcagagcagauucgacauggccgagaacguggugaucguggccagccagaagagaccccugggcggcagagagcugcagcugcccagcaugagcaugcugaccagcaagaccagcacccagaaguucuuccugagagugcugcaggugaucauccagcugagagacgacaccagaagagccaacaagaaggccaagcagaccggcagacugggcagcagcggccugggcagcgccagcagcauccaggccgccgugagacagcuggaggccgaggccgacgccaucauccagauggugagagagggccagagagccagaagacagcagcaggccgccaccagcgagagcagccagagcgaggccagcgugagaagagaggagagccccauggacguggaccagcccagccccagcgcccaggacacccagagcaucgccagcgacggcaccccccagggcgagaaggagaaggaggagagaccccccgagcugccccugcugagcgagcagcugagccuggacgagcugugggacaugcugggcgagugccugaaggagcuggaggagagccacgaccagcacgccgugcuggugcugcagcccgccguggaggccuucuuccuggugcacgccaccgagagagagagcaagccccccgugagagacaccagagagagccagcuggcccacaucaaggacgagccccccccccugagccccgccccccugacccccgccacccccagcagccuggaccccuucuucagcagagagcccagcagcaugcacaucagcagcagccugccccccgacacccagaaguuccugagauucgccgagacccacagaaccgugcugaaccagauccugagacagagcaccacccaccuggccgacggccccuucgccgugcugguggacuacaucagagugcuggacuucgacgugaagagaaaguacuucagacaggagcuggagagacuggacgagggccugagaaaggaggacauggccgugcacgugagaagagaccacguguucgaggacagcuacagagagcugcacagaaagagccccgaggagaugaagaacagacuguacaucguguucgagggcgaggagggccaggacgccggcggccugcugagagagugguacaugaucaucagcagagagauguucaaccccauguacgcccuguucagaaccagccccggcgacagagugaccuacaccaucaaccccagcagccacugcaaccccaaccaccugagcuacuucaaguucgugggcagaaucguggccaaggccguguacgacaacagacugcuggagugcuacuucaccagaagcuucuacaagcacauccugggcaagagcgugagauacaccgacauggagagcgaggacuaccacuucuaccagggccugguguaccugcuggagaacgacgugagcacccugggcuacgaccugaccuucagcaccgaggugcaggaguucggcgugugcgaggugagagaccugaagcccaacggcgccaacauccuggugaccgaggagaacaagaaggaguacgugcaccuggugugccagaugagaaugaccggcgccaucagaaagcagcuggccgccuuccuggagggcuucuacgagaucauccccaagagacugaucagcaucuucaccgagcaggagcuggagcugcugaucagcggccugcccaccaucgacaucgacgaccugaagagcaacaccgaguaccacaaguaccagagcaacagcauccagauccagugguucuggagagcccugagaagcuucgaccaggccgacagagccaaguuccugcaguucgugaccggcaccagcaaggugccccugcagggcuucgccgcccuggagggcaugaacggcauccagaaguuccagauccacagagacgacagaagcaccgacagacugcccagcgcccacaccugcuucaaccagcuggaccugcccgccuacgagagcuucgagaagcugagacacaugcugcugcuggccauccaggagugcagcgagggcuucggccuggccuaa

SEQ ID NO: 18317 - RNA, 822 nt, Artificial Sequence
  HVCN1__Homo_sapiens__XP_011537150
auggccaccugggacgagaaggccgugaccagaagagccaagguggcccccgccgagagaaugagcaaguuccugagacacuucaccguggugggcgacgacuaccacgccuggaacaucaacuacaagaagugggagaacgaggaggaggaggaggaggaggagcagcccccccccacccccgugagcggcgaggagggcagagccgccgcccccgacguggcccccgcccccggccccgcccccagagccccccuggacuucagaggcaugcugagaaagcuguucagcagccacagauuccaggugaucaucaucugccugguggugcuggacgcccugcuggugcuggccgagcugauccuggaccugaagaucauccagcccgacaagaacaacuacgccgccaugguguuccacuacaugagcaucaccauccugguguucuucaugauggagaucaucuucaagcuguucguguucagacuggaguucuuccaccacaaguucgagauccuggacgccgugguggugguggugagcuucauccuggacaucgugcugcuguuccaggagcaccaguucgaggcccugggccugcugauccugcugagacuguggagaguggccagaaucaucaacggcaucaucaucagcgugaagaccagaagcgagagacagcugcugagacugaagcagaugaacgugcagcuggccgccaagauccagcaccuggaguucagcugcagcgagaaggagcaggagaucgagagacugaacaagcugcugagacagcacggccugcugggcgaggugaacuaa

SEQ ID NO: 18318 - RNA, 1308 nt, Artificial Sequence
  HYAL1__Homo_sapiens__NP_149349
auggccgcccaccugcugcccaucugcgcccuguuccugacccugcuggacauggcccagggcuucagaggcccccugcugcccaacagacccuucaccaccguguggaacgccaacacccaguggugccuggagagacacggcguggacguggacgugagcguguucgacgugguggccaaccccggccagaccuucagaggccccgacaugaccaucuucuacagcagccagcugggcaccuaccccuacuacacccccaccggcgagcccguguucggcggccugccccagaacgccagccugaucgcccaccuggccagaaccuuccaggacauccuggccgccauccccgcccccgacuucagcggccuggccgugaucgacugggaggccuggagacccagaugggccuucaacugggacaccaaggacaucuacagacagagaagcagagcccuggugcaggcccagcaccccgacuggcccgccccccagguggaggccguggcccaggaccaguuccagggcgccgccagagccuggauggccggcacccugcagcugggcagagcccugagacccagaggccuguggggcuucuacggcuuccccgacugcuacaacuacgacuuccugagccccaacuacaccggccagugccccagcggcaucagagcccagaacgaccagcugggcuggcuguggggccagagcagagcccuguaccccagcaucuacaugcccgccgugcuggagggcaccggcaagagccagauguacgugcagcacagaguggccgaggccuucagaguggccguggccgccggcgaccccaaccugcccgugcugcccuacgugcagaucuucuacgacaccaccaaccacuuccugccccuggacgagcuggagcacagccugggcgagagcgccgcccagggcgccgccggcguggugcugugggugagcugggagaacaccagaaccaaggagagcugccaggccaucaaggaguacauggacaccacccugggccccuucauccugaacgugaccagcggcgcccugcugugcagccaggcccugugcagcggccacggcagaugcgugagaagaaccagccaccccaaggcccugcugcugcugaaccccgccagcuucagcauccagcugacccccggcggcggcccccugagccugagaggcgcccugagccuggaggaccaggcccagauggccguggaguucaagugcagaugcuaccccggcuggcaggcccccuggugcgagagaaagagcaugugguaa

SEQ ID NO: 18319 - RNA, 1422 nt, Artificial Sequence
  HYAL2__Homo_sapiens__XP_005265582
augagagccggccccggccccaccgugacccuggcccuggugcuggccgugagcugggccauggagcugaagcccaccgccccccccaucuucaccggcagacccuucgugguggccugggacgugcccacccaggacugcggccccagacugaaggugccccuggaccugaacgccuucgacgugcaggccagccccaacgagggcuucgugaaccagaacaucaccaucuucuacagagacagacugggccuguaccccagauucgacagcgccggcagaagcgugcacggcggcgugccccagaacgugagccugugggcccacagaaagaugcugcagaagagaguggagcacuacaucagaacccaggagagcgccggccuggccgugaucgacugggaggacuggagacccgugugggugagaaacuggcaggacaaggacguguacagaagacugagcagacagcugguggccagcagacaccccgacuggccccccgacagaaucgugaagcaggcccaguacgaguucgaguucgccgcccagcaguucaugcuggagacccugagauacgugaaggccgugagacccagacaccuguggggcuucuaccuguuccccgacugcuacaaccacgacuacgugcagaacugggagagcuacaccggcagaugccccgacguggagguggccagaaacgaccagcuggccuggcugugggccgagagcaccgcccuguuccccagcguguaccuggacgagacccuggccagcagcagacacggcagaaacuucgugagcuucagagugcaggaggcccugagaguggccagaacccaccacgccaaccacgcccugcccguguacguguucaccagacccaccuacagcagaagacugaccggccugagcgagauggaccugaucagcaccaucggcgagagcgccgcccugggcgccgccggcgugauccuguggggcgacgccggcuacaccaccagcaccgagaccugccaguaccugaaggacuaccugaccagacugcuggugcccuacguggugaacgugagcugggccacccaguacugcagcagagcccagugccacggccacggcagaugcgugagaagaaaccccagcgccagcaccuuccugcaccugagcaccaacagcuucagacuggugcccggccacgcccccggcgagccccagcugagacccgugggcgagcugagcugggccgacaucgaccaccugcagacccacuucagaugccagugcuaccugggcuggagcggcgagcagugccagugggaccacagacaggccgccggcggcgccagcgaggccugggccggcagccaccugaccagccugcuggcccuggccgcccuggccuucaccuggacccuguaa

SEQ ID NO: 18320 - RNA, 1164 nt, Artificial Sequence
  HYAL3__Homo_sapiens__NP_001186959
augaccacccagcugggccccgcccuggugcugggcguggcccugugccugggcugcggccagccccugccccaggugcccgagagacccuucagcgugcuguggaacgugcccagcgcccacugcgaggccagauucggcgugcaccugccccugaacgcccugggcaucaucgccaacagaggccagcacuuccacggccagaacaugaccaucuucuacaagaaccagcugggccuguaccccuacuucggccccagaggcaccgcccacaacggcggcaucccccaggcccugccccuggacagacaccuggcccuggccgccuaccagauccaccacagccugagacccggcuucgccggccccgccgugcuggacugggaggaguggugcccccugugggccggcaacuggggcagaagaagagccuaccaggccgccagcugggccugggcccagcagguguuccccgaccuggacccccaggagcagcuguacaaggccuacaccggcuucgagcaggccgccagagcccugauggaggacacccugagaguggcccaggcccugagaccccacggccuguggggcuucuaccacuaccccgccugcggcaacggcuggcacagcauggccagcaacuacaccggcagaugccacgccgccacccuggccagaaacacccagcugcacuggcugugggccgccagcagcgcccuguuccccagcaucuaccugccccccagacugccccccgcccaccaccaggccuucgugagacacagacuggaggaggccuucagaguggcccuggugggccacagacacccccugcccgugcuggccuacgugagacugacccacagaagaagcggcagauuccugagccaggaggagugcuggcaccugcacgacuaccugguggacacccugggccccuacgugaucaacgugaccagagccgccauggccugcagccaccagagaugccacggccacggcagaugcgccagaagagaccccggccagauggaggccuuccugcaccuguggcccgacggcagccugggcgacuggaagagcuucagcugccacugcuacuggggcugggccggccccaccugccaggagcccagacccggccccaaggaggccguguaa

SEQ ID NO: 18321 - RNA, 1446 nt, Artificial Sequence
  HYAL4__Homo_sapiens__XP_011514292
augaaggugcugagcgagggccagcugaagcugugcguggugcagcccgugcaccugaccagcuggcugcugaucuucuucauccugaagagcaucagcugccugaagcccgccagacugcccaucuaccagagaaagcccuucaucgccgccuggaacgcccccaccgaccagugccugaucaaguacaaccugagacugaaccugaagauguuccccgugaucggcagcccccuggccaaggccagaggccagaacgugaccaucuucuacgugaacagacugggcuacuaccccugguacaccagccagggcgugcccaucaacggcggccugccccagaacaucagccugcaggugcaccuggagaaggccgaccaggacaucaacuacuacauccccgccgaggacuucagcggccuggccgugaucgacugggaguacuggagaccccagugggccagaaacuggaacagcaaggacguguacagacagaagagcagaaagcugaucagcgacaugggcaagaacgugagcgccaccgacaucgaguaccuggccaaggugaccuucgaggagagcgccaaggccuucaugaaggagaccaucaagcugggcaucaagagcagacccaagggccuguggggcuacuaccuguaccccgacugccacaacuacaacguguacgcccccaacuacagcggcagcugccccgaggacgaggugcugagaaacaacgagcugagcuggcuguggaacagcagcgccgcccuguaccccagcaucggcguguggaagagccugggcgacagcgagaacauccugagauucagcaaguucagagugcacgagagcaugagaaucagcaccaugaccagccacgacuacgcccugcccguguucguguacaccagacugggcuacagagacgagccccuguucuuccugagcaagcaggaccuggugagcaccaucggcgagagcgccgcccugggcgccgccggcaucgugaucuggggcgacaugaaccugaccgccagcaaggccaacugcaccaaggugaagcaguucgugagcagcgaccugggcagcuacaucgccaacgugaccagagccgccgaggugugcagccugcaccugugcagaaacaacggcagaugcaucagaaagauguggaacgcccccagcuaccugcaccugaaccccgccagcuaccacaucgaggccagcgaggacggcgaguucaccgugaagggcaaggccagcgacaccgaccuggccgugauggccgacaccuucagcugccacugcuaccagggcuacgagggcgccgacugcagagagaucaagaccgccgacggcugcagcggcgugagccccagccccggcagccugaugacccugugccugcugcugcuggccagcuacagaagcauccagcuguaa

SEQ ID NO: 18322 - RNA, 2853 nt, Artificial Sequence
  HYDIN__Homo_sapiens__NP_001185471
auggagagcgccggcggcuucaagcugggcauggagccccugagcggcggcggcgugugcgagaagaagaagcugcugaagaugaccagcagaagacuggaggagagcaugggcgccgugcagaugggccuggugaacauguucaagggcuuccagagcaaggugcugcccccccugagccccaagguggugaccgaggaggaggugaacagaaugcugacccccagcgaguuccugaaggagaugagccugaccaccgagcagagacuggccaagaccagacugaugugcagaccccagaucaucgagcugcuggacaugggcgagaccacccaccagaaguucagcggcaucgaccuggaccaggcccuguuccagcccuuccccagcgagaucaucuuccagaacuacacccccugcgagguguacgaggugccccugauccugagaaacaacgacaagauccccagacuggugaaggugguggaggagagcagccccuacuucaaggugaucagccccaaggacaucggccacaagguggcccccggcgugcccagcaucuucagaauccuguucacccccgaggagaacaaggacuacgcccacacccugaccugcgugaccgagagagagaaguucaucgugcccaucaaggccagaggcgccagagccauccuggacuuccccgacaagcugaacuucagcaccugccccgugaaguacagcacccagaagauccugcuggugagaaacaucggcaacaagaacgccguguuccacaucaagaccugcagacccuucagcaucgagcccgccaucggcacccugaacgugggcgagagcaugcagcuggagguggaguucgagccccagagcgugggcgaccacagcggcagacugaucgugugcuacgacaccggcgagaagguguucgugagccuguacggcgccgccaucgacaugaacaucagacuggacaagaacagccugaccaucgagaagaccuacaucagccuggccaaccagagaaccaucaccauccacaacagaagcaacaucaucgcccacuuccuguggaagguguucgccacccagcaggaggaggacagagagaaguacagagccugcgacgaccugaucaaggaggagaaggacgagaccgacgaguucuucgaggagugcaucaccgacccccugcugagagagcaccugagcgugcugagcagaaccuucgccaaccagagaagacuggugcagggcgacagcaagcuguucuucaacaacguguucaccguggagccccuggagggcgacguguggcccaacagcagcgccgagaucaccguguacuucaacccccuggaggccaagcuguaccagcagaccaucuacugcgacauccugggcagagagaucagacugccccugagaaucaagggcgagggcaugggccccaagauccacuucaacuucgagcugcuggacaucggcaagguguucaccggcagcgcccacugcuacgaggccauccuguacaacaagggcagcaucgacgcccuguucaacaugaccccccccaccagcgcccugggcgccugcuucguguucagccccaaggagggcaucaucgagcccagcggcgugcaggccauccagaucagcuucagcagcaccauccugggcaacuucgaggaggaguuccuggugaacgugaacggcagccccgagcccgugaagcugaccaucagaggcugcgugaucggccccaccuuccacuucaacgugcccgcccugcacuucggcgacgugagcuucggcuucccccacacccugaucugcagccugaacaacaccagccugauccccaugaccuacaagcugagaauccccggcgacggccugggccacaagagcaucagcuacugcgagcagcacguggacuacaagagacccagcuggaccaaggaggagaucagcagcaugaagcccaaggaguucaccaucagccccgacugcggcaccaucagaccccagggcuucgccgccaucagagugacccugugcagcaacaccgugcagaaguacgagcuggcccuggugguggacguggagggcaucggcgaggaggugcuggcccugcugaucaccgccagaugcguggugcccgcccugcaccuggugaacaccgagguggacuucggccacugcuuccugaaguaccccuacgagaagacccugcagcuggccaaccaggacgaccugcccggcuucuacgaggugcagccccaggugugcgaggaggugcccaccgugcuguucagcagccccacccccagcggcgugaucagccccagcagcaccauccacaucccccuggugcuggagacccaggugaccggcgagcacagaagcaccguguacaucagcaucuucggcagccaggaccccccccuggugugccaccugaagagcgccggcgagggccccgugaucuacgugcaccccaaccagguggacuucggcaacaucuacgugcugaaggacagcagcagaauccugaaccugugcaaccagagcuucauccccgccuucuuccaggcccacauggcccacaagaagagccuguggaccaucgagcccaacgagggcauggugccccccgagaccgacgugcagcuggcccugaccgccaaccugaacgacacccugaccuucaaggacugcgugauccuggacaucgagaacagcagcaccuacagaauccccgugcaggccagcggcaccggcagcaccaucgugagcgacaagcccuucgcccccgagcugaaccugggcgcccacuucagauaa

SEQ ID NO: 18323 - RNA, 1122 nt, Artificial Sequence
  HYKK__Homo_sapiens__NP_001013641
augagcagcggcaacuaccagcagagcgaggcccugagcaagcccaccuucagcgaggagcaggccagcgcccugguggagagcguguucggccugaaggugagcaaggugagaccccugcccagcuacgacgaccagaacuuccacguguacgugagcaagaccaaggacggccccaccgaguacgugcugaagaucagcaacaccaaggccagcaagaaccccgaccugaucgaggugcagaaccacaucaucauguuccugaaggccgccggcuuccccaccgccagcgugugccacaccaagggcgacaacaccgccagccuggugagcguggacagcggcagcgagaucaagagcuaccuggugagacugcugaccuaccugcccggcagacccaucgccgagcugcccgugagcccccagcugcuguacgagaucggcaagcuggccgccaagcuggacaagacccugcagagauuccaccaccccaagcugagcagccugcacagagagaacuucaucuggaaccugaagaacgugccccugcuggagaaguaccuguacgcccugggccagaacagaaacagagagaucguggagcacgugauccaccuguucaaggaggaggugaugaccaagcugagccacuucagagagugcaucaaccacggcgaccugaacgaccacaacauccugaucgagagcagcaagagcgccagcggcaacgccgaguaccaggugagcggcauccuggacuucggcgacaugagcuacggcuacuacguguucgagguggccaucaccaucauguacaugaugaucgagagcaagagccccauccaggugggcggccacgugcuggccggcuucgagagcaucaccccccugaccgccguggagaagggcgcccuguuccugcuggugugcagcagauucugccagagccuggugauggccgccuacagcugccagcuguaccccgagaacaaggacuaccugauggugaccgccaagaccggcuggaagcaccugcagcagauguucgacaugggccagaaggccguggaggagaucugguucgagaccgccaagagcuacgagagcggcaucagcauguaa

SEQ ID NO: 18324 - RNA, 900 nt, Artificial Sequence
  HYLS1__Homo_sapiens__NP_659451
auggaggagcugcugcccgacggccagaucugggccaacauggaccccgaggagagaaugcuggccgccgccaccgccuucacccacaucugcgccggccagggcgagggcgacgugagaagagaggcccagagcauccaguacgaccccuacagcaaggccagcguggcccccggcaagagacccgcccugcccgugcagcugcaguacccccacguggagagcaacgugcccagcgagaccgugagcgaggccagccagagacugagaaagcccgugaugaagagaaaggugcugagaagaaagcccgacggcgaggugcuggugaccgacgagagcaucaucagcgagagcgagagcggcaccgagaacgaccaggaccugugggaccugagacagagacugaugaacgugcaguuccaggaggacaaggagagcagcuucgacgugagccagaaguucaaccugccccacgaguaccagggcaucagccaggaccagcugaucugcagccugcagagagagggcaugggcagccccgccuacgagcaggaccugaucguggccagcagacccaagagcuucauccugcccaagcuggaccagcugagcagaaacagaggcaagaccgacagaguggccagauacuucgaguacaagagagacugggacagcaucagacugcccggcgaggaccacagaaaggagcugagauggggcgugagagagcagaugcugugcagagccgagccccagagcaagccccagcacaucuacgugcccaacaacuaccuggugcccaccgagaagaagagaagcgcccugagauggggcgugagaugcgaccuggccaacggcgugauccccagaaagcugcccuucccccugagccccagcuaa

SEQ ID NO: 18325 - RNA, 3000 nt, Artificial Sequence
  HYOU1__Homo_sapiens__NP_001124463
auggccgacaaggugagaagacagagacccagaagaagagugugcugggcccugguggccgugcugcuggccgaccugcuggcccugagcgacacccuggccgugaugagcguggaccugggcagcgagagcaugaagguggccaucgugaagcccggcgugcccauggagaucgugcugaacaaggagagcagaagaaagacccccgugaucgugacccugaaggagaacgagagauucuucggcgacagcgccgccagcauggccaucaagaaccccaaggccacccugagauacuuccagcaccugcugggcaagcaggccgacaacccccacguggcccuguaccaggccagauuccccgagcacgagcugaccuucgacccccagagacagaccgugcacuuccagaucagcagccagcugcaguucagccccgaggaggugcugggcauggugcugaacuacagcagaagccuggccgaggacuucgccgagcagcccaucaaggacgccgugaucaccgugcccguguucuucaaccaggccgagagaagagccgugcugcaggccgccagaauggccggccugaaggugcugcagcugaucaacgacaacaccgccaccgcccugagcuacggcguguucagaagaaaggacaucaacaccaccgcccagaacaucauguucuacgacaugggcagcggcagcaccgugugcaccaucgugaccuaccagauggugaagaccaaggaggccggcaugcagccccagcugcagaucagaggcgugggcuucgacagaacccugggcggccuggagauggagcugagacugagagagagacuggccggccuguucaacgagcagagaaagggccagagagccaaggacgugagagagaaccccagagccauggccaagcugcugagagaggccaacagacugaagaccgugcugagcgccaacgccgaccacauggcccagaucgagggccugauggacgacguggacuucaaggccaaggugaccagaguggaguucgaggagcugugcgccgaccuguucgagagagugcccggccccgugcagcaggcccugcagagcgccgagaugagccuggacgagaucgagcaggugauccuggugggcggcgccaccagagugcccagagugcaggaggugcugcugaaggccgugggcaaggaggagcugggcaagaacaucaacgccgacgaggccgccgccaugggcgccguguaccaggccgccgcccugagcaaggccuucaaggugaagcccuucguggugagagacgccgugguguaccccauccugguggaguucaccagagagguggaggaggagcccggcauccacagccugaagcacaacaagagagugcuguucagcagaaugggccccuacccccagagaaaggugaucaccuucaacagauacagccacgacuucaacuuccacaucaacuacggcgaccugggcuuccugggccccgaggaccugagaguguucggcagccagaaccugaccaccgugaagcugaagggcgugggcgacagcuucaagaaguaccccgacuacgagagcaagggcaucaaggcccacuucaaccuggacgagagcggcgugcugagccuggacagaguggagagcguguucgagacccugguggaggacagcgccgaggaggagagcacccugaccaagcugggcaacaccaucagcagccuguucggcggcggcaccacccccgacgccaaggagaacggcaccgacaccgugcaggaggaggaggagagccccgccgagggcagcaaggacgagcccggcgagcagguggagcugaaggaggaggccgaggcccccguggaggacggcagccagccccccccccccgagcccaagggcgacgccacccccgagggcgagaaggccaccgagaaggagaacggcgacaagagcgaggcccagaagcccagcgagaaggccgaggccggccccgagggcguggcccccgcccccgagggcgagaagaagcagaagcccgccagaaagagaagaaugguggaggagaucggcguggagcugguggugcuggaccugcccgaccugcccgaggacaagcuggcccagagcgugcagaagcugcaggaccugacccugagagaccuggagaagcaggagagagagaaggccgccaacagccuggaggccuucaucuucgagacccaggacaagcuguaccagcccgaguaccaggaggugagcaccgaggagcagagagaggagaucagcggcaagcugagcgccgccagcaccuggcuggaggacgagggcgugggcgccaccaccgugaugcugaaggagaagcuggccgagcugagaaagcugugccagggccuguucuucagaguggaggagagaaagaaguggcccgagagacugagcgcccuggacaaccugcugaaccacagcagcauguuccugaagggcgccagacugauccccgagauggaccagaucuucaccgagguggagaugaccacccuggagaaggugaucaacgagaccugggccuggaagaacgccacccuggccgagcaggccaagcugcccgccaccgagaagcccgugcugcugagcaaggacaucgaggccaagaugauggcccuggacagagaggugcaguaccugcugaacaaggccaaguucaccaagcccagacccagacccaaggacaagaacggcaccagagccgagcccccccugaacgccagcgccagcgaccagggcgagaaggugaucccccccgccggccagaccgaggacgccgagcccaucagcgagcccgagaagguggagaccggcagcgagcccggcgacaccgagccccuggagcugggcggccccggcgccgagcccgagcagaaggagcagagcaccggccagaagagaccccugaagaacgacgagcuguaa

SEQ ID NO: 18326 - RNA, 354 nt, Artificial Sequence
  HYPM__Homo_sapiens__NP_036406
augagcgagaagaagaacugcaagaacagcagcaccaacaacaaccagacccaggaccccagcagaaacgagcugcaggugcccagaagcuucguggacagaguggugcaggacgagagagacgugcagagccagagcagcagcaccaucaacacccugcugacccugcuggacugccuggccgacuacaucauggagagagugggccuggaggccagcaacaacggcagcaugagaaacaccagccaggacagagagagagagguggacaacaacagagagccccacagcgccgagagcgacgugaccagauuccuguucgacgagaugcccaagagcagaaagaacgacuaa

SEQ ID NO: 18327 - RNA, 270 nt, Artificial Sequence
  IAPP__Homo_sapiens__NP_000406
augggcauccugaagcugcagguguuccugaucgugcugagcguggcccugaaccaccugaaggccacccccaucgagagccaccagguggagaagagaaagugcaacaccgccaccugcgccacccagagacuggccaacuuccuggugcacagcagcaacaacuucggcgccauccugagcagcaccaacgugggcagcaacaccuacggcaagagaaacgccguggaggugcugaagagagagccccugaacuaccugccccuguaa

SEQ ID NO: 18328 - RNA, 3039 nt, Artificial Sequence
  IARS2__Homo_sapiens__NP_060530
augagauggggccugagacccagaggccccggcgccgccgcccuggccaccgccagaagccuguggggcacccccagacugcccugcagccccggcuggcagggcgccaccaagagacugcuggugagaagcgugagcggcgccagcaaccaccagcccaacagcaacagcggcagauacagagacaccgugcugcugccccagaccagcuuccccaugaagcugcugggcagacagcagcccgacaccgagcuggagauccagcagaagugcggcuucagcgagcuguacagcuggcagagagagagaaaggugaagaccgaguucugccugcacgacggcccccccuacgccaacggcgacccccacgugggccacgcccugaacaagauccugaaggacaucgccaacagauuccacaugaugaacggcagcaagauccacuucgugcccggcugggacugccacggccugcccaucgagaucaaggugcugagcgagcugggcagagaggcccagaaccugagcgccauggagaucagaaagaaggccagaagcuucgccaaggccgccaucgagaagcagaagagcgccuucaucagauggggcaucauggccgacuggaacaacugcuacuacaccuucgacggcaaguacgaggccaagcagcugagaaccuucuaccagauguacgacaagggccugguguacagaagcuacaagcccguguucuggagccccagcagcagaaccgcccuggccgaggccgagcuggaguacaaccccgagcacgugagcagaagcaucuacgugaaguucccccugcugaagcccagccccaagcuggccagccugaucgacggcagcagccccgugagcauccugguguggaccacccagcccuggaccauccccgccaacgaggccgugugcuacaugcccgagagcaaguacgccguggugaagugcagcaagagcggcgaccuguacgugcuggccgccgacaagguggccagcguggccagcacccuggagaccaccuucgagaccaucagcacccugagcggcguggaccuggagaacggcaccugcagccacccccugauccccgacaaggccagcccccugcugcccgccaaccacgugaccauggccaagggcaccggccuggugcacaccgcccccgcccacggcauggaggacuacggcguggccagccagcacaaccugcccauggacugccugguggacgaggacggcguguucaccgacguggccggccccgagcugcagaacaaggccgugcuggaggagggcaccgacguggugaucaagaugcugcagaccgccaagaaccugcugaaggaggagaagcuggugcacagcuaccccuacgacuggagaaccaagaagcccguggugaucagagccagcaagcagugguucaucaacaucaccgacaucaagaccgccgccaaggagcugcugaagaaggugaaguucauccccggcagcgcccugaacggcaugguggagaugauggacagaagacccuacuggugcaucagcagacagagaguguggggcgugcccauccccguguuccaccacaagaccaaggacgaguaccugaucaacagccagaccaccgagcacaucgugaagcugguggagcagcacggcagcgacaucugguggacccugccccccgagcagcugcugcccaaggaggugcugagcgaggugggcggccccgacgcccuggaguacgugcccggccaggacauccuggacaucugguucgacagcggcaccagcuggagcuacgugcugcccggccccgaccagagagccgaccuguaccuggagggcaaggaccagcugggcggcugguuccagagcagccugcugaccagcguggccgccagaaagagagcccccuacaagaccgugaucgugcacggcuucacccugggcgagaagggcgagaagaugagcaagagccugggcaacgugauccaccccgacgugguggugaacggcggccaggaccagagcaaggagccccccuacggcgccgacgugcugagaugguggguggccgacagcaacguguucaccgagguggccaucggccccagcgugcugaacgccgccagagacgacaucagcaagcugagaaacacccugagauuccugcugggcaacguggccgacuucaaccccgagaccgacagcauccccgugaacgacauguacgugaucgaccaguacaugcugcaccugcugcaggaccuggccaacaagaucaccgagcuguacaagcaguacgacuucggcaagguggugagacugcugagaaccuucuacaccagagagcugagcaacuucuacuucagcaucaucaaggacagacuguacugcgagaaggagaacgaccccaagagaagaagcugccagaccgcccugguggagauccuggacgugaucgugagaagcuucgcccccauccugccccaccuggccgaggagguguuccagcacauccccuacaucaaggagcccaagagcguguucagaaccggcuggaucagcaccagcagcaucuggaagaagcccggccuggaggaggccguggagagcgccugcgccaugagagacagcuuccugggcagcauccccggcaagaacgccgccgaguacaaggugaucaccgugaucgagcccggccugcuguucgagaucaucgagaugcugcagagcgaggagaccagcagcaccagccagcugaacgagcugaugauggccagcgagagcacccugcuggcccaggagcccagagagaugaccgccgacgugaucgagcugaagggcaaguuccugaucaaccuggagggcggcgacaucagagaggagagcagcuacaaggugaucgugaugcccaccaccaaggagaagugccccagaugcuggaaguacaccgccgagagcagcgacacccugugccccagaugcgccgagguggugagcggcaaguaa

SEQ ID NO: 18329 - RNA, 3789 nt, Artificial Sequence
  IARS__Homo_sapiens__NP_038203
augcugcagcaggugcccgagaacaucaacuuccccgccgaggaggagaagauccuggaguucuggaccgaguucaacugcuuccaggagugccugaagcagagcaagcacaagcccaaguucaccuucuacgacggcccccccuucgccaccggccugccccacuacggccacauccuggccggcaccaucaaggacaucgugaccagauacgcccaccagagcggcuuccacguggacagaagauucggcugggacugccacggccugcccguggaguacgagaucgacaagacccugggcaucagaggccccgaggacguggccaagaugggcaucaccgaguacaacaaccagugcagagccaucgugaugagauacagcgccgaguggaagagcaccgugagcagacugggcagauggaucgacuucgacaacgacuacaagacccuguacccccaguucauggagagcgugugguggguguucaagcagcuguacgacaagggccugguguacagaggcgugaaggugaugcccuucagcaccgccugcaacaccccccugagcaacuucgagagccaccagaacuacaaggacgugcaggaccccagcguguucgugaccuucccccuggaggaggacgagaccgugagccugguggccuggaccaccacccccuggacccugcccagcaaccuggccgugugcgugaaccccgagaugcaguacgugaagaucaaggacguggccagaggcagacugcugauccugauggaggccagacugagcgcccuguacaagcuggagagcgacuacgagauccuggagagauuccccggcgccuaccugaagggcaagaaguacagaccccuguucgacuacuuccugaagugcaaggagaacggcgccuucaccgugcugguggacaacuacgugaaggaggaggagggcaccggcguggugcaccaggcccccuacuucggcgccgaggacuacagagugugcauggacuucaacaucaucagaaaggacagccugcccgugugccccguggacgccagcggcugcuucaccaccgaggugaccgacuucgccggccaguacgugaaggacgccgacaagagcaucaucagaacccugaaggagcagggcagacugcugguggccaccaccuucacccacagcuaccccuucugcuggagaagcgacaccccccugaucuacaaggccgugcccagcugguucgugagaguggagaacaugguggaccagcugcugagaaacaacgaccugugcuacugggugcccgagcuggugagagagaagagauucggcaacuggcugaaggacgccagagacuggaccaucagcagaaacagauacuggggcacccccaucccccugugggugagcgacgacuucgaggagguggugugcaucggcagcguggccgagcuggaggagcugagcggcgccaagaucagcgaccugcacagagagagcguggaccaccugaccauccccagcagaugcggcaagggcagccugcacagaaucagcgagguguucgacugcugguucgagagcggcagcaugcccuacgcccaggugcacuaccccuucgagaacaagagagaguucgaggacgccuuccccgccgacuucaucgccgagggcaucgaccagaccagaggcugguucuacacccugcuggugcuggccaccgcccuguucggccagccccccuucaagaacgugaucgugaacggccuggugcuggccagcgacggccagaagaugagcaagagaaagaagaacuaccccgaccccgugagcaucauccagaaguacggcgccgacgcccugagacuguaccugaucaacagccccguggugagagccgagaaccugagauucaaggaggagggcgugagagacgugcugaaggacgugcugcugcccugguacaacgccuacagauuccugauccagaacgugcugagacugcagaaggaggaggagaucgaguuccuguacaacgagaacaccgugagagagagccccaacaucaccgacagauggauccugagcuucaugcagagccugaucggcuucuucgagaccgagauggccgccuacagacuguacaccguggugcccagacuggugaaguucguggacauccugaccaacugguacgugagaaugaacagaagaagacugaagggcgagaacggcauggaggacugcgugauggcccuggagacccuguucagcgugcugcugagccugugcagacugauggcccccuacacccccuuccugaccgagcugauguaccagaaccugaaggugcugaucgaccccgugagcgugcaggacaaggacacccugagcauccacuaccugaugcugcccagagugagagaggagcugaucgacaagaagaccgagagcgccgugagccagaugcagagcgugaucgagcugggcagagugaucagagacagaaagaccauccccaucaaguacccccugaaggagaucguggugauccaccaggaccccgaggcccugaaggacaucaagagccuggagaaguacaucaucgaggagcugaacgugagaaaggugacccugagcaccgacaagaacaaguacggcaucagacugagagccgagcccgaccacauggugcugggcaagagacugaagggcgccuucaaggccgugaugaccagcaucaagcagcugagcagcgaggagcuggagcaguuccagaagaccggcaccaucgugguggagggccacgagcugcacgacgaggacaucagacugauguacaccuucgaccaggccaccggcggcaccgcccaguucgaggcccacagcgacgcccaggcccuggugcugcuggacgugacccccgaccagagcaugguggacgagggcauggccagagaggugaucaacagaauccagaagcugagaaagaagugcaaccuggugcccaccgacgagaucaccguguacuacaaggccaagagcgagggcaccuaccugaacagcgugaucgagagccacaccgaguucaucuucaccaccaucaaggccccccugaagcccuaccccgugagccccagcgacaaggugcugauccaggagaagacccagcugaagggcagcgagcuggagaucacccugaccagaggcagcagccugcccggccccgccugcgccuacgugaaccugaacaucugcgccaacggcagcgagcagggcggcgugcugcugcuggagaaccccaagggcgacaacagacuggaccugcugaagcugaagagcguggugaccagcaucuucggcgugaagaacaccgagcuggccguguuccacgacgagaccgagauccagaaccagaccgaccugcugagccugagcggcaagacccugugcgugaccgccggcagcgcccccagccugaucaacagcagcagcacccugcugugccaguacaucaaccugcagcugcugaacgccaagccccaggagugccugaugggcaccgugggcacccugcugcuggagaacccccugggccagaacggccugacccaccagggccugcuguacgaggccgccaagguguucggccugagaagcagaaagcugaagcuguuccugaacgagacccagacccaggagaucaccgaggacauccccgugaagacccugaacaugaagaccguguacgugagcgugcugcccaccaccgccgacuucuaa

SEQ ID NO: 18330 - RNA, 1071 nt, Artificial Sequence
  IBA57__Homo_sapiens__NP_001010867
auggccaccgccgcccugcugagaggcgccacccccggcagaggcggccccguguggagauggagacugagagccgcccccagaugcagacuggcccacagcagcugcagccccggcggcgaccccaccgccggcgccgccugggccugcuucagacuggacggcagaacccugcugagagugagaggccccgacgccgcccccuuccugcugggccugcugaccaacgagcugccccugcccagccccgccgccgccggcgccccccccgccgccagagccggcuacgcccacuuccugaacgugcagggcagaacccuguacgacgugauccuguacggccugcaggagcacagcgaggugagcggcuuccugcuggagugcgacagcagcgugcagggcgcccugcagaagcaccuggcccuguacagaaucagaagaaaggugaccguggagccccaccccgagcugagagugugggccgugcugcccagcagccccgaggccugcggcgccgccagccugcaggagagagccggcgccgccgccauccugaucagagaccccagaaccgccagaaugggcuggagacugcugacccaggacgagggccccgcccuggugcccggcggcagacugggcgaccugugggacuaccaccagcacagauaccugcagggcgugcccgagggcgugagagaccugccccccggcguggcccugccccuggagagcaaccuggccuucaugaacggcgugagcuucaccaagggcugcuacaucggccaggagcugaccgccagaacccaccacaugggcgugaucagaaagagacuguuccccgugagauuccuggacccccugcccaccagcggcaucacccccggcgccaccgugcugaccgccagcggccagaccgugggcaaguucagagccggccagggcaacgugggccuggcccugcuguggagcgagaagaucaagggcccccugcacaucagagccagcgagggcgcccagguggcccuggccgccagcgugcccgacugguggcccaccgugagcaaguaa

SEQ ID NO: 18331 - RNA, 954 nt, Artificial Sequence
  IBSP__Homo_sapiens__NP_004958
augaagaccgcccugauccugcugagcauccugggcauggccugcgccuucagcaugaagaaccugcacagaagagugaagaucgaggacagcgaggagaacggcguguucaaguacagacccagauacuaccuguacaagcacgccuacuucuacccccaccugaagagauuccccgugcagggcagcagcgacagcagcgaggagaacggcgacgacagcagcgaggaggaggaggaggaggaggagaccagcaacgagggcgagaacaacgaggagagcaacgaggacgaggacagcgaggccgagaacaccacccugagcgccaccacccugggcuacggcgaggacgccacccccggcaccggcuacaccggccuggccgccauccagcugcccaagaaggccggcgacaucaccaacaaggccaccaaggagaaggagagcgacgaggaggaggaggaggaggaggagggcaacgagaacgaggagagcgaggccgagguggacgagaacgagcagggcaucaacggcaccagcaccaacagcaccgaggccgagaacggcaacggcagcagcggcggcgacaacggcgaggagggcgaggaggagagcgugaccggcgccaacgccgaggacaccaccgagaccggcagacagggcaagggcaccagcaagaccaccaccagccccaacggcggcuucgagcccaccacccccccccagguguacagaaccaccagcccccccuucggcaagaccaccaccguggaguacgagggcgaguacgaguacaccggcgccaacgaguacgacaacggcuacgagaucuacgagagcgagaacggcgagcccagaggcgacaacuacagagccuacgaggacgaguacagcuacuucaagggccagggcuacgacggcuacgacggccagaacuacuaccaccaccaguaa

SEQ ID NO: 18332 - RNA, 4062 nt, Artificial Sequence
  IBTK__Homo_sapiens__NP_056340
augagcagccccaugcccgacugcaccagcaagugcagaagccugaagcacgcccuggacgugcugagcguggugaccaagggcagcgagaaccagaucaaggccuuccugagcagccacugcuacaacgccgccaccaucaaggacguguucggcagaaacgcccugcaccuggugagcagcugcggcaagaagggcgugcuggacuggcugauccagaagggcguggaccugcuggugaaggacaaggagagcggcuggaccgcccugcacagaagcaucuucuacggccacaucgacugcguguggagccugcugaagcacggcgugagccuguacauccaggacaaggagggccugagcgcccuggaccuggugaugaaggacagacccacccacgugguguucaagaacaccgaccccaccgacguguacaccuggggcgacaacaccaacuucacccugggccacggcagccagaacagcaagcaccaccccgagcugguggaccuguucagcagaagcggcaucuacaucaagcagguggugcugugcaaguuccacagcguguuccugagccagaagggccagguguacaccugcggccacggccccggcggcagacugggccacggcgacgagcagaccugccuggugcccagacugguggagggccugaacggccacaacugcagccagguggccgccgccaaggaccacaccguggugcugaccgaggacggcugcguguacaccuucggccugaacaucuuccaccagcugggcaucauccccccccccagcagcugcaacgugcccagacagauccaggccaaguaccugaagggcagaaccaucaucggcguggccgccggcagauuccacaccgugcuguggaccagagaggccguguacaccaugggccugaacggcggccagcugggcugccugcuggaccccaacggcgagaagugcgugaccgcccccagacaggugagcgcccugcaccacaaggacaucgcccugagccugguggccgccagcgacggcgccaccgugugcgugaccaccagaggcgacaucuaccugcuggccgacuaccagugcaagaagauggccagcaagcagcugaaccugaagaaggugcuggugagcggcggccacauggaguacaagguggaccccgagcaccugaaggagaacggcggccagaagaucugcauccuggccauggacggcgccggcagaguguucugcuggagaagcgugaacagcagccugaagcagugcagaugggccuaccccagacagguguucaucagcgacaucgcccugaacagaaacgagauccuguucgugacccaggacggcgagggcuucagaggcagaugguucgaggagaagagaaagagcagcgagaagaaggagauccugagcaaccugcacaacagcagcagcgacgugagcuacgugagcgacaucaacagcguguacgagagaaucagacuggagaagcugaccuucgcccacagagccgugagcgugagcaccgaccccagcggcugcaacuucgccauccugcagagcgaccccaagaccagccuguacgagauccccgccgugagcagcagcagcuucuucgaggaguucggcaagcugcugagagaggccgacgagauggacagcauccacgacgugaccuuccaggugggcaacagacuguuccccgcccacaaguacauccuggccgugcacagcgacuucuuccagaagcuguuccugagcgacggcaacaccagcgaguucaccgacaucuaccagaaggacgaggacagcgccggcugccaccuguucgugguggagaaggugcaccccgacauguucgaguaccugcugcaguucaucuacaccgacaccugcgacuuccugacccacggcuucaagcccagaauccaccugaacaagaaccccgaggaguaccagggcacccugaacagccaccugaacaaggugaacuuccacgaggacgacaaccagaagagcgccuucgagguguacaagagcaaccaggcccagaccgugagcgagagacagaagagcaagcccaagagcugcaagaagggcaagaacaucagagaggacgaccccgugagaaugcugcagaccguggccaagaaguucgacuucagcaaccugagcagcagacuggacggcgugagauucgagaacgagaagaucaacgugaucgccaagaacaccggcaacaagcugaagcugagccagaagaagugcagcuuccugugcgacgugaccaugaagagcguggacggcaaggaguuccccugccacaagugcgugcugugcgccagacuggaguacuuccacagcaugcugagcagcagcuggaucgaggccagcagcugcgccgcccuggagaugcccauccacagcgacauccugaaggugauccuggacuaccuguacaccgacgaggccguggugaucaaggagagccagaacguggacuucaucugcagcgugcuggugguggccgaccagcugcugaucaccagacugaaggagaucugcgagguggcccugaccgagaagcugacccugaagaacgccgccaugcugcuggaguucgccgccauguacagcgccaagcagcugaagcugagcugccugcaguucaucggccugaacauggccgcccugcuggaggccagaagccuggacgugcugagcgacggcgugcugaaggaccugagcgaguucuacagaaagaugauccccgccauggacagaagagugaucacccccuaccaggacggccccgacaucagcuaccuggagguggaggacggcgacaucuuccugaaggaggagaucaacauggagcagaaccacagcgagaccauguucaagaaggccaagaccaaggccaagaagaagcccagaaagagaagcgacagcagcggcggcuacaaccugagcgacaucauccagagccccagcagcaccggccugcugaagagcggcaagaccaacagcguggagagccugcccgagcugcugaccagcgacagcgagggcagcuacgccggcgugggcagccccagagaccugcagagccccgacuucaccaccggcuuccacagcgacaagaucgaggccaaggugaagcccuacgugaacggcaccagccccguguacagcagagaggaccugaagcccugggagaagagccccauccugaagaucagcgccccccagcccauccccagcaacagaaucgacaccaccagcagcgccagcuggguggccggcagcuucagccccgugagcccccccgugguggaccugagaaccaucauggagaucgaggagagcagacagaagugcggcgccacccccaagagccaccugggcaagaccgugagccacggcgugaagcugagccagaagcagagaaagaugaucgcccugaccaccaaggagaacaacagcggcaugaacagcauggagaccgugcuguucacccccagcaaggcccccaagcccgugaacgccugggccagcagccugcacagcgugagcagcaagagcuucagagacuuccugcuggaggagaagaagagcgugaccagccacagcagcggcgaccacgugaagaaggugagcuucaagggcaucgagaacagccaggcccccaagaucgugagaugcagcacccacggcacccccggccccgagggcaaccacaucagcgaccugccccugcuggacagccccaaccccuggcugagcagcagcgugaccgcccccagcaugguggcccccgugaccuucgccagcaucguggaggaggagcugcagcaggaggccgcccugaucagaagcagagagaagccccuggcccugauccagaucgaggagcacgccauccaggaccugcugguguucuacgaggccuucggcaaccccgaggaguucgugaucguggagagaaccccccagggcccccuggccgugcccauguggaacaagcacggcugcuaa

SEQ ID NO: 18333 - RNA, 1449 nt, Artificial Sequence
  ICA1__Homo_sapiens__NP_001263407
augagcggccacaagugcuaccccugggaccugcaggacagauacgcccaggacaagagcguggugaacaagaugcagcagaaguacugggagaccaagcaggccuucaucaaggccaccggcaagaaggaggacgagcacgugguggccagcgacgccgaccuggacgccaagcuggagcuguuccacagcauccagagaaccugccuggaccugagcaaggccaucgugcuguaccagaagagaaucugcuuccugagccaggaggagaacgagcugggcaaguuccugagaagccagggcuuccaggacaagaccagagccggcaagaugaugcaggccaccggcaaggcccugugcuucagcagccagcagagacuggcccugagaaacccccugugcagauuccaccaggagguggagaccuucagacacagagccaucagcgacaccuggcugaccgugaacagaauggagcagugcagaaccgaguacagaggcgcccugcuguggaugaaggacgugagccaggagcuggaccccgaccuguacaagcagauggagaaguucagaaaggugcagacccaggugagacuggccaagaagaacuucgacaagcugaagauggacgugugccagaagguggaccugcugggcgccagcagaugcaaccugcugagccacaugcuggccaccuaccagaccacccugcugcacuucugggagaagaccagccacaccauggccgccauccacgagagcuucaagggcuaccagcccuacgaguucaccacccugaagagccugcaggaccccaugaagaagcugguggagaaggaggagaagaagaagaucaaccagcaggagagcaccgacgccgccgugcaggagcccagccagcugaucagccuggaggaggagaaccagagaaaggagagcagcagcuucaagaccgaggacggcaagagcauccugagcgcccuggacaagggcagcacccacaccgccugcagcggccccaucgacgagcugcuggacaugaagagcgaggagggcgccugccugggccccguggccggcacccccgagcccgagggcgccgacaaggacgaccugcugcugcugagcgagaucuucaacgccagcagccuggaggagggcgaguucagcaaggagugggccgccguguucggcgacggccaggugaaggagcccgugcccaccauggcccugggcgagcccgaccccaaggcccagaccggcagcggcuuccugcccagccagcugcuggaccagaacaugaaggaccugcaggccagccugcaggagcccgccaaggccgccagcgaccugaccgccugguucagccuguucgccgaccuggacccccugagcaaccccgacgccgugggcaagaccgacaaggagcacgagcugcugaacgccuaa

SEQ ID NO: 18334 - RNA, 1599 nt, Artificial Sequence
  ICAM1__Homo_sapiens__NP_000192
auggcccccagcagccccagacccgcccugcccgcccugcuggugcugcugggcgcccuguuccccggccccggcaacgcccagaccagcgugagccccagcaaggugauccugcccagaggcggcagcgugcuggugaccugcagcaccagcugcgaccagcccaagcugcugggcaucgagaccccccugcccaagaaggagcugcugcugcccggcaacaacagaaagguguacgagcugagcaacgugcaggaggacagccagcccaugugcuacagcaacugccccgacggccagagcaccgccaagaccuuccugaccguguacuggacccccgagagaguggagcuggccccccugcccagcuggcagcccgugggcaagaaccugacccugagaugccagguggagggcggcgcccccagagccaaccugaccguggugcugcugagaggcgagaaggagcugaagagagagcccgccgugggcgagcccgccgaggugaccaccaccgugcuggugagaagagaccaccacggcgccaacuucagcugcagaaccgagcuggaccugagaccccagggccuggagcuguucgagaacaccagcgcccccuaccagcugcagaccuucgugcugcccgccacccccccccagcuggugagccccagagugcuggagguggacacccagggcaccguggugugcagccuggacggccuguuccccgugagcgaggcccaggugcaccuggcccugggcgaccagagacugaaccccaccgugaccuacggcaacgacagcuucagcgccaaggccagcgugagcgugaccgccgaggacgagggcacccagagacugaccugcgccgugauccugggcaaccagagccaggagacccugcagaccgugaccaucuacagcuuccccgcccccaacgugauccugaccaagcccgaggugagcgagggcaccgaggugaccgugaagugcgaggcccaccccagagccaaggugacccugaacggcgugcccgcccagccccugggccccagagcccagcugcugcugaaggccacccccgaggacaacggcagaagcuucagcugcagcgccacccuggagguggccggccagcugauccacaagaaccagaccagagagcugagagugcuguacggccccagacuggacgagagagacugccccggcaacuggaccuggcccgagaacagccagcagacccccaugugccaggccuggggcaacccccugcccgagcugaagugccugaaggacggcaccuucccccugcccaucggcgagagcgugaccgugaccagagaccuggagggcaccuaccugugcagagccagaagcacccagggcgaggugaccagaaaggugaccgugaacgugcugagccccagauacgagaucgugaucaucaccgugguggccgccgccgugaucaugggcaccgccggccugagcaccuaccuguacaacagacagagaaagaucaagaaguacagacugcagcaggcccagaagggcacccccaugaagcccaacacccaggccaccccccccuaa

SEQ ID NO: 18335 - RNA, 828 nt, Artificial Sequence
  ICAM2__Homo_sapiens__NP_001093259
augagcagcuucggcuacagaacccugaccguggcccuguucacccugaucugcugccccggcagcgacgagaagguguucgaggugcacgugagacccaagaagcuggccguggagcccaagggcagccuggaggugaacugcagcaccaccugcaaccagcccgaggugggcggccuggagaccagccuggacaagauccugcuggacgagcaggcccaguggaagcacuaccuggugagcaacaucagccacgacaccgugcugcagugccacuucaccugcagcggcaagcaggagagcaugaacagcaacgugagcguguaccagccccccagacaggugauccugacccugcagcccacccugguggccgugggcaagagcuucaccaucgagugcagagugcccaccguggagccccuggacagccugacccuguuccuguucagaggcaacgagacccugcacuacgagaccuucggcaaggccgcccccgccccccaggaggccaccgccaccuucaacagcaccgccgacagagaggacggccacagaaacuucagcugccuggccgugcuggaccugaugagcagaggcggcaacaucuuccacaagcacagcgcccccaagaugcuggagaucuacgagcccgugagcgacagccagauggugaucaucgugaccguggugagcgugcugcugagccuguucgugaccagcgugcugcugugcuucaucuucggccagcaccugagacagcagagaaugggcaccuacggcgugagagccgccuggagaagacugccccaggccuucagacccuaa

SEQ ID NO: 18336 - RNA, 1644 nt, Artificial Sequence
  ICAM3__Homo_sapiens__NP_002153
auggccaccauggugcccagcgugcuguggcccagagccugcuggacccugcuggugugcugccugcugacccccggcgugcagggccaggaguuccugcugagaguggagccccagaaccccgugcugagcgccggcggcagccuguucgugaacugcagcaccgacugccccagcagcgagaagaucgcccuggagaccagccugagcaaggagcugguggccagcggcaugggcugggccgccuucaaccugagcaacgugaccggcaacagcagaauccugugcagcguguacugcaacggcagccagaucaccggcagcagcaacaucaccguguacagacugcccgagagaguggagcuggccccccugccccccuggcagcccgugggccagaacuucacccugagaugccagguggaggacggcagccccagaaccagccugaccguggugcugcugagaugggaggaggagcugagcagacagcccgccguggaggagcccgccgaggugaccgccaccgugcuggccagcagagacgaccacggcgcccccuucagcugcagaaccgagcuggacaugcagccccagggccugggccuguucgugaacaccagcgcccccagacagcugagaaccuucgugcugcccgugaccccccccagacugguggcccccagauuccuggagguggagaccagcuggcccguggacugcacccuggacggccuguuccccgccagcgaggcccagguguaccuggcccugggcgaccagaugcugaacgccaccgugaugaaccacggcgacacccugaccgccaccgccaccgccaccgccagagccgaccaggagggcgccagagagaucgugugcaacgugacccugggcggcgagagaagagaggccagagagaaccugaccguguucagcuuccugggccccaucgugaaccugagcgagcccaccgcccacgagggcagcaccgugaccgugagcugcauggccggcgccagagugcaggugacccuggacggcgugcccgccgccgcccccggccagcccgcccagcugcagcugaacgccaccgagagcgacgacggcagaagcuucuucugcagcgccacccuggagguggacggcgaguuccugcacagaaacagcagcgugcagcugagagugcuguacggccccaagaucgacagagccaccugcccccagcaccugaaguggaaggacaagaccagacacgugcugcagugccaggccagaggcaaccccuaccccgagcugagaugccugaaggagggcagcagcagagaggugcccgugggcauccccuucuucgugaacgugacccacaacggcaccuaccagugccaggccagcagcagcagaggcaaguacacccuggugguggugauggacaucgaggccggcagcagccacuucgugcccguguucguggccgugcugcugacccugggcguggugaccaucgugcuggcccugauguacguguucagagagcaccagagaagcggcagcuaccacgugagagaggagagcaccuaccugccccugaccagcaugcagcccaccgaggccaugggcgaggagcccagcagagccgaguaa

SEQ ID NO: 18337 - RNA, 819 nt, Artificial Sequence
  ICAM4__Homo_sapiens__NP_001034221
augggcagccuguucccccugagccugcuguucuuccuggccgccgccuaccccggcgugggcagcgcccugggcagaagaaccaagagagcccagagccccaagggcagcccccuggcccccagcggcaccagcgugcccuucugggugagaaugagccccgaguucguggccgugcagcccggcaagagcgugcagcugaacugcagcaacagcugcccccagccccagaacagcagccugagaaccccccugagacagggcaagacccugagaggccccggcugggugagcuaccagcugcuggacgugagagccuggagcagccuggcccacugccuggugaccugcgccggcaagaccagaugggccaccagcagaaucaccgccuacagcgugcccggcggccugcugggcggcgaccccgaggccuggaagcccggccaccuguucagaaagcccggcgcccugcacagacccggcagcggccagagagaccuggaccugagagugugcugcuggacccccagacugcuggccgccagagaccugcccagagccccccagagcagaagacccggcggcccccagcagcugggcacccacuacaccgacgccagacuggagcccagagcccacagcuucggccugagauuccacagaugccccugcagagaccccccccacugcggcagaugcgugcccaugcaggugcccagcuacgaggugcccggcgugaagggcgacgugcugugcagacugagcgagaagaagagaaacaugaagcagagcggcgagauggccauccacggcggcuaa

SEQ ID NO: 18338 - RNA, 2775 nt, Artificial Sequence
  ICAM5__Homo_sapiens__NP_003250
augcccggccccagccccggccugagaagagcccugcugggccugugggccgcccugggccugggccuguucggccugagcgccgugagccaggagcccuucugggccgaccugcagcccagaguggccuucguggagagaggcggcagccuguggcugaacugcagcaccaacugccccagacccgagagaggcggccuggagaccagccugagaagaaacggcacccagagaggccugagauggcuggccagacagcugguggacaucagagagcccgagacccagcccgugugcuucuucagaugcgccagaagaacccugcaggccagaggccugaucagaaccuuccagagacccgacagaguggagcugaugccccugccccccuggcagcccgugggcgagaacuucacccugagcugcagagugcccggcgccggccccagagccagccugacccugacccugcugagaggcgcccaggagcugaucagaagaagcuucgccggcgagccccccagagccagaggcgccgugcugaccgccaccgugcuggccagaagagaggaccacggcgccaacuucagcugcagagccgagcuggaccugagaccccacggccugggccuguucgagaacagcagcgcccccagagagcugagaaccuucagccugagccccgacgcccccagacuggccgcccccagacugcuggaggugggcagcgagagacccgugagcugcacccuggacggccuguuccccgccagcgaggccagaguguaccuggcccugggcgaccagaaccugagccccgacgugacccuggagggcgacgccuucguggccaccgccaccgccaccgccagcgccgagcaggagggcgccagacagcuggugugcaacgugacccugggcggcgagaacagagagaccagagagaacgugaccaucuacagcuuccccgccccccugcugacccugagcgagcccagcgugagcgagggccagauggugaccgugaccugcgccgccggcgcccaggcccuggugacccuggagggcgugcccgccgccgugcccggccagcccgcccagcugcagcugaacgccaccgagaacgacgacagaagaagcuucuucugcgacgccacccuggacguggacggcgagacccugaucaagaacagaagcgccgagcugagagugcuguacgcccccagacuggacgacagcgacugccccagaagcuggaccuggcccgagggccccgagcagacccugagaugcgaggccagaggcaaccccgagcccagcgugcacugcgccagaagcgacggcggcgccgugcuggcccugggccugcugggccccgugaccagagcccugagcggcaccuacagaugcaaggccgccaacgaccagggcgaggccgugaaggacgugacccugaccguggaguacgcccccgcccuggacagcgugggcugccccgagagaaucaccuggcuggagggcaccgaggccagccugagcugcguggcccacggcgugcccccccccgacgugaucugcgugagaagcggcgagcugggcgccgugaucgagggccugcugagaguggccagagagcacgccggcaccuacagaugcgaggccaccaaccccagaggcagcgccgccaagaacguggccgugaccguggaguacggccccagauucgaggagcccagcugccccagcaacuggaccuggguggagggcagcggcagacuguucagcugcgagguggacggcaagccccagcccagcgugaagugcgugggcagcggcggcgccaccgagggcgugcugcugccccuggccccccccgaccccagccccagagcccccagaauccccagagugcuggcccccggcaucuacgugugcaacgccaccaacagacacggcagcguggccaagaccgugguggugagcgccgagagcccccccgagauggacgagagcaccugccccagccaccagaccuggcuggagggcgccgaggccagcgcccuggccugcgccgccagaggcagacccagccccggcgugagaugcagcagagagggcauccccuggcccgagcagcagagagugagcagagaggacgccggcaccuaccacugcguggccaccaacgcccacggcaccgacagcagaaccgugaccgugggcguggaguacagacccgugguggccgagcuggccgccagcccccccggcggcgugagacccggcggcaacuucacccugaccugcagagccgaggccuggccccccgcccagaucagcuggagagccccccccggcgcccugaacaucggccugagcagcaacaacagcacccugagcguggccggcgccaugggcagccacggcggcgaguacgagugcgccgccaccaacgcccacggcagacacgccagaagaaucaccgugagaguggccggccccuggcuguggguggccgugggcggcgccgccggcggcgccgcccugcuggccgccggcgccggccuggccuucuacgugcagagcaccgccugcaagaagggcgaguacaacgugcaggaggccgagagcagcggcgaggccgugugccugaacggcgccggcggcggcgccggcggcgccgccggcgccgagggcggccccgaggccgccggcggcgccgccgagagccccgccgagggcgagguguucgccauccagcugaccagcgccuaa

SEQ ID NO: 18339 - RNA, 6801 nt, Artificial Sequence
  ICE1__Homo_sapiens__NP_056140
augaugcccggcgagacccacagcgccgcccccggcaccgccgccgaccugagcagaugccagggcugcgccagccugcagcagaaccugaacgaguacguggaggcccugaucacccugaagcagaagaucaucaacaccgacaaccugcugaccgaguaccagaagaagugcgacgagcugcaguucgccagaagagagaacagcaaccugcaccaccagguggaggagaugcugcagaagaucagcccccugcagaagugccaggaggagcugggcagccugaaggccgagcuggaggagaagaagagcagccugaagcuguaccaggacacccaccaggaguacgccagagugaaggaggagugccugaagagcgacgcccagaagaagaagcuggaggccaaggugaagaagcugcaggaggccgccgugaagcagacccaggacuucaagcagcugagaaacgagaagaagauccuggagaaggaguucaagaagacccaggagagacuggacgaguucagcaagcagaagaacgagaaggagcugagacacaucggcacccagaucagcagcgacagcuacggcagcaucgacaagagaaaggugaagcugcugcugaaggagcuguggcugugcgugaacaccacccacagacugcccggcgagggcagcagaugcgugcccgagaagcccgccaaggccaucaccagcagcagagugcccggcgaggacggcacccugccccccacccagggcagcccccugagaaccagcaacgugcagaccugccugaccaagcugagcauggagaucaaggaggacuuccugugccagaacguggagaagcagagcagcagcggcaccaacugcagcagcgaccacguguucaacgagaacggcaaccuggaggugcuggugcagagccacagagacggcggcagcaccgaguucguggaccacgaccacuucuucgacgaggaccugcaggccgccaucgacuucuucaagcugccccccccccugcugagccccgugcccagccccccccccaugagcagcccccaccccggcagccugcccagcagcuucgcccccgagaccuacuucggcgaguacaccgacagcagcgacaacgacagcgugcagcugagaaacagcgccgagugcgugagcgaggacgacaccaccgagagccagaacuacuucggcagccugagaaagaacaagggcagcggcaccugggaggagaagcccaagagccacgaggccauccaggcccugaacaccugggaggugaacaaggugaccaccagcggccuggagaccuucaccgccacccugagagagagcagcgccacccacagccuggugggcgagaagcacuggaccaccgccagcagaagcaugagcgacagaaagagagacauccugcacgagaccaagacccagauggaggugagagagauggacaagagcgugcagaccgagaagaccauccacaagcugaccagaggccugugcaucgagagacugagcgccagccccgcccaggagaaggaggccgcccccggcaagagcgagcugugcagcagcccccugggcaagagaccccugaacgagcugauggagagcgagggcaagaccgugcugagcaagaugaugggcagccccaagagcgaguucaccaaguggaccagaaucaacgagaucaccagcgagcccgacagaaucaccgugagcggccacuuccacagacugagcagagagcuggagaaggagaaggaggacacccagggcuucacccugggcgagagccccgagagcgaggacgacgacagcggcgacggcauggacguggccggccuggacaucgagaccagcuucagcagcagcagcacccugguggcccugagcgugggcagcaacccccagagcagcagcggccuggacugcggcaacgacaccgacaucaccaccaagguguucagcaccgagccccaccacagcgagcacaagcugcagaccaagacccugaacacccugcaccugcagagcgagccccccgagugcagcaucggcggcaacaaccuggagaacagccugugcgcccugagccccgagcugggcgccagcaacuucaacgaccagaagagcagcggcaucgaguacaccaagguggugaagggccugaccaagauccacagccugcccagaagcguguucaugaaggccaccaaggacggccagugcgagagccaggaccccagaaucgagcugacccugaacaagcccgacuucaccagccugaucggcagccaggccgcccugaucaagagcggccugggcuucgugaagagcaccagcuggcaccacagcgaccugcugagaaagggcggcgaggagagccugagagccaagagcgagcacgagcagaagaccagccaccagcugcagaaggccaugcccuuccugcagaacagaggccccacccccaagcccgaccugcugagagagaacaacaaccccguggaguucaagaccaccgccagcgugcugcccaaccaggugagcgugaucaccaagcagaccagacccgagaaggugcagagcgccaagcuggagcaccugagaccccacagaguggagcccacccuggugaccgagaacagcggcaacaagaccggcaugagcaccguggccaagugcgacggcgagagagacgacaccacccagaacaucaccgagguggccgccgugaagagcaucagccccgaggugagcgccagcagaagaaagcuggacuucaacagccccggcggcagcagccccguggagaacagcgacugcagcaccaacagcagacugagcuucagccccgagaacauccugauccagaaccaggacaucgugagagaggccgccgugcagggcgacggccagaagcagagacagccccaggccaccgaccuggacagcagcggcacccacggcagcgagaugcugcccgccaccgaggugaccgugagcggcggcuucagcguggaggagaccagcugcggcgacaccggcagaagcggcggcgaggcccuggccguggccaacgacagcaccagcaccccccagaacgccaacggccuguggaagcugaagagcaccacccccggcggcgcccugcccgagugcuucggcaccaccgacaccaccuucagcagcgccuucugcagaaagcacggcgagacccaggacaccagccagagcagccugcccggcacccugcacugcuacaccggcaucagagagggcggcgacgacaccgagguggagagcgaggccuucagcugcagcgagggcagcgagcagcaggacgcccccgacgacagccagaagaaccugggcgacaccgacgccgccguggccgaggugagacccagccuggaggugggcuaccugaccagcgcccugcaggacuucaacaucagcaccuucagcgagcuggacagacugagcaccagcgagguggugauguuccuggagagcugccagcugggcgacuacagcagcggcgacagcgugagcgagugcagcagcaagggcacccugagcaaggagaugaacaaggagcugaaggccagcgagaucggcgagaaguacagaaagcagcccugcgaggaggagacccugggcaccugcgaggaguggaucgagagcgaggaggacgacuacagccugaagaacaccagccagcugacccagugcagccuggagacccugagcgaggugcugaccaagaucagacaggagcugcagaccaacagcgaggacugcaacggcaaggacaccggcagccugcugcugcugaacgugaacaacaacaugaccaccgagaaccugaaggagaagagccccuucagagagaccaccggcagcagcagccacgccagcgagcccaccccccaggccgccgcccuggacaccgagggcagcagccccaucagcggcaugccccagaacgagaacccccagagcagacccgaggccagaagcgacgccggcagacagaccgacggcggcgaggaggaccugcccgagcccguggagcccagcgcccugugcagcgacagcgugauggagcccagcaucgagcagagcagcaacugcgaggccgagaccaccuuccagugccagaucgccaccgugaccagcgaggugaucaacgugcugaucaacaaggaccagaaccuggugaucgagaagggcgacaacuggaccaucaucagcggcguggccgugcugccccacguggaccaggugacccugugcgacauccccggcgacauccccaucagccaggaccagggcgagcuggaggccggcugcauccccgugaccagcgccgagaagagccccgaggccagccacaccggccccgccuuccaggaggcccccugcggcaacaaccugagcugcccccaggaggacgugagcagcagcggccagagcaccaacuucgacaagagcagacugagaaacagacccgugaagcccagcaucuggaucagcagccagaucuacgaccagaacuucgagacccagaucguggccagcgaccacaccuacuacaacagcaagcuggagcccagcggcaagaacaagaacagaagcaagaucagcaacaaggaccagagcaacaagcccgugaagaccagcgccagcagcagaguggagacccaccagagcgagguggcccagagcuucagcggcgagaaggccaacaccaagacccagagaagccagacccagaccauccuggccaacgccgacaccagcacccccaccgacugcagccccgacacccugagcaagaucagacaggaggugggccccccccugcccccccugcuggccccccugaucgccaccccccccagaaccagccagccccugagcccccugaucagcagcagcagccccagcagccccgccagccccgugggccaggugagccccuucagagagacccccgugccccccgccaugagccccuggcccgaggaccccagaagagccagcccccccgaccccagccccagccccagcgccgccagcgccagcgagagaguggugcccagcccccugcaguucugcgccgccacccccaagcacgcccugcccgugcccggcagacugccccccugcgccagcggccacgccgccgugggcggcccccaggagaacagcgugaagauccuggacaccauguaccccgagcugagcgccagagccagaacccugaacauccugaagggcaacauccagcugaccagaggcccccccgccgacugcaagaaccugcccggccccgccagcgccaugaucggcuucaagaccaucaccagcgccgccaccgccuucgugaagaccggcagcagcagcggcggcgacugcaaccaggacaagagcagagaccugggcacccagcaggacagcagcggcaagagaacccugagcaccagcacccugagaagcgccaagagacugagacuggacaccggcagccccgagcccgagaccagaggcgugaccgccgagggcauccacaagaaccugcccggcaaccugccccccgccgagguggccaccaccaacgaggagagaagcugcagcagccccgccgugagcgccgugagccagcugccccugagccccaaggagaccguggagagccacgacaaggccaucgccaacgcccugaagaagaucgccgaguucagcuucgaccugcugcccgugaucagaagccacguguacgugggcaacaucagcaagaagcccgugaugagagaccaggagaaggaggugguguacgaguucagcaccaccaagaagcaccuggccgagugccugcugcacagcauccugagcgagcugaagauccagaagaucagcauggaccacaacuacauccacgcccugugcagaguguacgugggcaucugcagacagcugggcgaccuggagagagccagacuguucugcuacagccugcugaaggaggacuuccccgagagcgagaagcugacccuguucaucgccaacauguggcacgacaucuuccugagccagagcgugaucaacaaggccaugcagcugguggccagacagagagccaagggcgaggugcugaacugccugagagccuuccugaacugggagaagaacgcccccguggacgugggcuucauggugagcaagcugcugcugaccauccagcugugccccaagaccgaguuccagcccagcgagaaguucggcgaggaccugagcgacaacaccugggaguacaucuucgccaucgaccugcugugcugccaccagaaguggaucuggacccacgacaacaucaucagcaaggagcuguggcccgugauggacaaguggaucaaguacagaaagggccacgccaacaucgccuacacccccgacaucaucaucgccagcauccugagacugaucggcagacugggccagcugggccugaaggagggcuuccccagcgccgugaagaacaucagcagcgugaucggcauguucauccagcacgcccacgacgaggacauccccuggggcauccagcuggccgccguguacgcccugugcgaccugagccccagcaaccccgccgagaucagcaagauccuggaggccuggagaagagaggccagcaagagcgugcccagcgccaucgugagcugccuggaggaggugagcgcccugagcaccgaggagcugggcuaa

SEQ ID NO: 18340 - RNA, 1152 nt, Artificial Sequence
  ICE2__Homo_sapiens__NP_001263314
augagcagcaagauggugaucagcgagcccggccugaacugggacaucagccccaagaacggccugaagaccuucuucagcagagagaacuacaaggaccacagcauggcccccagccugaaggagcugagagugcugagcaacagaagaaucggcgagaaccugaacgccagcgccagcagcguggagaacgagcccgccgugagcagcgccacccaggccaaggagaaggugaagaccaccaucggcauggugcugcugcccaagcccagagugcccuaccccagauucagcagauucagccagagagagcagagaagcuacguggaccugcuggugaaguacgccaagauccccgccaacagcaaggccgugggcaucaacaagaacgacuaccugcaguaccuggacaugaagaagcacgugaacgaggaggugaccgaguuccugaaguuccugcagaacagcgccaagaagugcgcccaggacuacaacaugcugagcgacgacgccagacuguucaccgagaagauccugagagccugcaucgagcaggugaagaaguacagcgaguucuacacccugcacgaggugaccagccugaugggcuucuuccccuucagaguggagaugggccugaagcuggagaagacccugcuggcccugggcagcgugaaguacgugaagaccguguuccccagcaugcccaucaagcugcagcugagcaaggacgacaucgccaccaucgagaccagcgagcagaccgccgaggccaugcacuacgacaucagcaaggaccccaacgccgagaagcuggugagcagauaccacccccagaucgcccugaccagccagagccuguucacccugcugaacaaccacggccccaccuacaaggagcagugggagauccccgugugcauccaggugauccccguggccggcagcaagcccgugaaggugaucuacaucaacagcccccugccccagaagaagaugaccaugagagagagaaaccagaucuuccacgaggugccccugaaguucaugaugagcaagaacaccagcgugcccgugagcgccguguucauggacaagcccgaggaguucaucagcgagauggacgugugcaacgccuucuucuuccccuaa

SEQ ID NO: 18341 - RNA, 1899 nt, Artificial Sequence
  ICK__Homo_sapiens__NP_057597
augaacagauacaccaccaucagacagcugggcgacggcaccuacggcagcgugcugcugggcagaagcaucgagagcggcgagcugaucgccaucaagaagaugaagagaaaguucuacagcugggaggagugcaugaaccugagagaggugaagagccugaagaagcugaaccacgccaacguggugaagcugaaggaggugaucagagagaacgaccaccuguacuucaucuucgaguacaugaaggagaaccuguaccagcugaucaaggagagaaacaagcuguuccccgagagcgccaucagaaacaucauguaccagauccugcagggccuggccuucauccacaagcacggcuucuuccacagagaccugaagcccgagaaccugcugugcaugggccccgagcuggugaagaucgccgacuucggccuggccagagagaucagaagcaagccccccuacaccgacuacgugagcaccagaugguacagagcccccgaggugcugcugagaagcaccaacuacagcagccccaucgacgugugggccgugggcugcaucauggccgagguguacacccugagaccccuguuccccggcgccagcgagaucgacaccaucuucaagaucugccaggugcugggcacccccaagaagaccgacuggcccgagggcuaccagcugagcagcgccaugaacuucagauggccccagugcgugcccaacaaccugaagacccugauccccaacgccagcagcgaggccgugcagcugcugagagacaugcugcagugggaccccaagaagagacccaccgccagccaggcccugagauaccccuacuuccaggugggccacccccugggcagcaccacccagaaccugcaggacagcgagaagccccagaagggcauccuggagaaggccggccccccccccuacaucaagcccgugccccccgcccagccccccgccaagccccacaccagaaucagcagcagacagcaccaggccagccagcccccccugcaccugaccuaccccuacaaggccgaggugagcagaaccgaccaccccagccaccugcaggaggacaagcccagcccccugcuguuccccagccugcacaacaagcacccccagagcaagaucaccgccggccuggagcacaagaacggcgagaucaagcccaagagcagaagaagauggggccugaucagcagaagcaccaaggacagcgacgacugggccgaccuggacgaccuggacuucagccccagccugagcagaaucgaccugaagaacaagaagagacagagcgacgacacccugugcagauucgagagcgugcuggaccugaagcccagcgagcccgugggcaccggcaacagcgcccccacccagaccagcuaccagagaagagacacccccacccugagaagcgccgccaagcagcacuaccugaagcacagcagauaccugcccggcaucagcaucagaaacggcauccugagcaaccccggcaaggaguucaucccccccaaccccuggagcagcagcggccugagcggcaagagcagcggcaccaugagcgugaucagcaaggugaacagcgugggcagcagcagcaccagcagcagcggccugaccggcaacuacgugcccagcuuccugaagaaggagaucggcagcgccaugcagagagugcaccuggcccccauccccgaccccagccccggcuacagcagccugaaggccaugagaccccaccccggcagacccuucuuccacacccagcccagaagcacccccggccugauccccagaccccccgccgcccagcccgugcacggcagaaccgacugggccagcaaguacgccagcagaagauaa

SEQ ID NO: 18342 - RNA, 567 nt, Artificial Sequence
  ICMT__Homo_sapiens__XP_011539442
augugcagccugagccuguuccacuacagcgaguaccuggugaccgccgugaacaaccccaagagccugagccuggacagcuuccugcugaaccacagccuggaguacaccguggccgcccugagcagcuggcuggaguucacccuggagaacaucuucuggcccgagcugaagcagaucaccuggcugagcgugaccggccugcugauggugguguucggcgagugccugagaaaggccgccauguucaccgccggcagcaacuucaaccacguggugcagaacgagaagagcgacacccacacccuggugaccagcggcguguacgccugguucagacaccccagcuacgugggcugguucuacuggagcaucggcacccaggugaugcugugcaaccccaucugcggcgugagcuacgcccugaccguguggagauucuucagagacagaaccgaggaggaggagaucagccugauccacuucuucggcgaggaguaccuggaguacaagaagagagugcccaccggccugcccuucaucaagggcgugaagguggaccuguaa

SEQ ID NO: 18343 - RNA, 600 nt, Artificial Sequence
  ICOS__Homo_sapiens__NP_036224
augaagagcggccugugguacuucuuccuguucugccugagaaucaaggugcugaccggcgagaucaacggcagcgccaacuacgagauguucaucuuccacaacggcggcgugcagauccugugcaaguaccccgacaucgugcagcaguucaagaugcagcugcugaagggcggccagauccugugcgaccugaccaagaccaagggcagcggcaacaccgugagcaucaagagccugaaguucugccacagccagcugagcaacaacagcgugagcuucuuccuguacaaccuggaccacagccacgccaacuacuacuucugcaaccugagcaucuucgaccccccccccuucaaggugacccugaccggcggcuaccugcacaucuacgagagccagcugugcugccagcugaaguucuggcugcccaucggcugcgccgccuucgugguggugugcauccugggcugcauccugaucugcuggcugaccaagaagaaguacagcagcagcgugcacgaccccaacggcgaguacauguucaugagagccgugaacaccgccaagaagagcagacugaccgacgugacccuguaa

SEQ ID NO: 18344 - RNA, 930 nt, Artificial Sequence
  ICOSLG__Homo_sapiens__NP_001269979
augagacugggcagccccggccugcuguuccugcuguucagcagccugagagccgacacccaggagaaggaggugagagccauggugggcagcgacguggagcugagcugcgccugccccgagggcagcagauucgaccugaacgacguguacguguacuggcagaccagcgagagcaagaccguggugaccuaccacaucccccagaacagcagccuggagaacguggacagcagauacagaaacagagcccugaugagccccgccggcaugcugagaggcgacuucagccugagacuguucaacgugaccccccaggacgagcagaaguuccacugccuggugcugagccagagccugggcuuccaggaggugcugagcguggaggugacccugcacguggccgccaacuucagcgugcccguggugagcgccccccacagccccagccaggacgagcugaccuucaccugcaccagcaucaacggcuaccccagacccaacguguacuggaucaacaagaccgacaacagccugcuggaccaggcccugcagaacgacaccguguuccugaacaugagaggccuguacgacguggugagcgugcugagaaucgccagaacccccagcgugaacaucggcugcugcaucgagaacgugcugcugcagcagaaccugaccgugggcagccagaccggcaacgacaucggcgagagagacaagaucaccgagaaccccgugagcaccggcgagaagaacgccgccaccuggagcauccuggccgugcugugccugcugguggugguggccguggccaucggcugggugugcagagacagaugccugcagcacagcuacgccggcgccugggccgugagccccgagaccgagcugaccgagagcuggaaccugcugcugcugcugagcuaa

SEQ ID NO: 18345 - RNA, 468 nt, Artificial Sequence
  ID1__Homo_sapiens__NP_002156
augaagguggccagcggcagcaccgccaccgccgccgccggccccagcugcgcccugaaggccggcaagaccgccagcggcgccggcgagguggugagaugccugagcgagcagagcguggccaucagcagaugcgccggcggcgccggcgccagacugcccgcccugcuggacgagcagcaggugaacgugcugcuguacgacaugaacggcugcuacagcagacugaaggagcuggugcccacccugccccagaacagaaaggugagcaagguggagauccugcagcacgugaucgacuacaucagagaccugcagcuggagcugaacagcgagagcgaggugggcacccccggcggcagaggccugcccgugagagccccccugagcacccugaacggcgagaucagcgcccugaccgccgaggccgccugcgugcccgccgacgacagaauccugugcagauaa

SEQ ID NO: 18346 - RNA, 405 nt, Artificial Sequence
  ID2__Homo_sapiens__NP_002157
augaaggccuucagccccgugagaagcgugagaaagaacagccugagcgaccacagccugggcaucagcagaagcaagacccccguggacgaccccaugagccugcuguacaacaugaacgacugcuacagcaagcugaaggagcuggugcccagcaucccccagaacaagaaggugagcaagauggagauccugcagcacgugaucgacuacauccuggaccugcagaucgcccuggacagccaccccaccaucgugagccugcaccaccagagacccggccagaaccaggccagcagaaccccccugaccacccugaacaccgacaucagcauccugagccugcaggccagcgaguuccccagcgagcugaugagcaacgacagcaaggcccugugcggcuaa

SEQ ID NO: 18347 - RNA, 486 nt, Artificial Sequence
  ID4__Homo_sapiens__NP_001537
augaaggccgugagccccgugagacccagcggcagaaaggcccccagcggcugcggcggcggcgagcuggcccugagaugccuggccgagcacggccacagccugggcggcagcgccgccgccgccgccgccgccgccgccgccagaugcaaggccgccgaggccgccgccgacgagcccgcccugugccugcagugcgacaugaacgacugcuacagcagacugagaagacuggugcccaccaucccccccaacaagaaggugagcaagguggagauccugcagcacgugaucgacuacauccuggaccugcagcuggcccuggagacccaccccgcccugcugagacagccccccccccccgcccccccccaccaccccgccggcaccugccccgccgccccccccagaaccccccugaccgcccugaacaccgaccccgccggcgccgugaacaagcagggcgacagcauccugugcagauaa

SEQ ID NO: 18348 - RNA, 1395 nt, Artificial Sequence
  IDE__Homo_sapiens__NP_001159418
augagcaagcugugguucaagcaggacgacaaguucuuccugcccaaggccugccugaacuucgaguucuucagccccuucgccuacguggacccccugcacugcaacauggccuaccuguaccuggagcugcugaaggacagccugaacgaguacgccuacgccgccgagcuggccggccugagcuacgaccugcagaacaccaucuacggcauguaccugagcgugaagggcuacaacgacaagcagcccauccugcugaagaagaucaucgagaagauggccaccuucgagaucgacgagaagagauucgagaucaucaaggaggccuacaugagaagccugaacaacuucagagccgagcagccccaccagcacgccauguacuaccugagacugcugaugaccgagguggccuggaccaaggacgagcugaaggaggcccuggacgacgugacccugcccagacugaaggccuucaucccccagcugcugagcagacugcacaucgaggcccugcugcacggcaacaucaccaagcaggccgcccugggcaucaugcagaugguggaggacacccugaucgagcacgcccacaccaagccccugcugcccagccagcuggugagauacagagaggugcagcugcccgacagaggcugguucguguaccagcagagaaacgaggugcacaacaacugcggcaucgagaucuacuaccagaccgacaugcagagcaccagcgagaacauguuccuggagcuguucugccagaucaucagcgagcccugcuucaacacccugagaaccaaggagcagcugggcuacaucguguucagcggccccagaagagccaacggcauccagggccugagauucaucauccagagcgagaagcccccccacuaccuggagagcagaguggaggccuuccugaucaccauggagaagagcaucgaggacaugaccgaggaggccuuccagaagcacauccaggcccuggccaucagaagacuggacaagcccaagaagcugagcgccgagugcgccaaguacuggggcgagaucaucagccagcaguacaacuucgacagagacaacaccgagguggccuaccugaagacccugaccaaggaggacaucaucaaguucuacaaggagaugcuggccguggacgcccccagaagacacaaggugagcgugcacgugcuggccagagagauggacagcugccccguggugggcgaguuccccugccagaacgacaucaaccugagccaggcccccgcccugccccagcccgaggugauccagaacaugaccgaguucaagagaggccugccccuguucccccuggugaagccccacaucaacuucauggccgccaagcuguaa

SEQ ID NO: 18349 - RNA, 1245 nt, Artificial Sequence
  IDH1__Homo_sapiens__NP_001269315
augagcaagaagaucagcggcggcagcgugguggagaugcagggcgacgagaugaccagaaucaucugggagcugaucaaggagaagcugaucuuccccuacguggagcuggaccugcacagcuacgaccugggcaucgagaacagagacgccaccaacgaccaggugaccaaggacgccgccgaggccaucaagaagcacaacgugggcgugaagugcgccaccaucacccccgacgagaagagaguggaggaguucaagcugaagcagauguggaagagccccaacggcaccaucagaaacauccugggcggcaccguguucagagaggccaucaucugcaagaacauccccagacuggugagcggcugggugaagcccaucaucaucggcagacacgccuacggcgaccaguacagagccaccgacuucguggugcccggccccggcaagguggagaucaccuacacccccagcgacggcacccagaaggugaccuaccuggugcacaacuucgaggagggcggcggcguggccaugggcauguacaaccaggacaagagcaucgaggacuucgcccacagcagcuuccagauggcccugagcaagggcuggccccuguaccugagcaccaagaacaccauccugaagaaguacgacggcagauucaaggacaucuuccaggagaucuacgacaagcaguacaagagccaguucgaggcccagaagaucugguacgagcacagacugaucgacgacaugguggcccaggccaugaagagcgagggcggcuucaucugggccugcaagaacuacgacggcgacgugcagagcgacagcguggcccagggcuacggcagccugggcaugaugaccagcgugcuggugugccccgacggcaagaccguggaggccgaggccgcccacggcaccgugaccagacacuacagaauguaccagaagggccaggagaccagcaccaaccccaucgccagcaucuucgccuggaccagaggccuggcccacagagccaagcuggacaacaacaaggagcuggccuucuucgccaacgcccuggaggaggugagcaucgagaccaucgaggccggcuucaugaccaaggaccuggccgccugcaucaagggccugcccaacgugcagagaagcgacuaccugaacaccuucgaguucauggacaagcugggcgagaaccugaagaucaagcuggcccaggccaagcuguaa

SEQ ID NO: 18350 - RNA, 1203 nt, Artificial Sequence
  IDH2__Homo_sapiens__NP_001276839
auggacggcgacgagaugaccagaaucaucuggcaguucaucaaggagaagcugauccugccccacguggacauccagcugaaguacuucgaccugggccugcccaacagagaccagaccgacgaccaggugaccaucgacagcgcccuggccacccagaaguacagcguggccgugaagugcgccaccaucacccccgacgaggccagaguggaggaguucaagcugaagaagauguggaagagccccaacggcaccaucagaaacauccugggcggcaccguguucagagagcccaucaucugcaagaacauccccagacuggugcccggcuggaccaagcccaucaccaucggcagacacgcccacggcgaccaguacaaggccaccgacuucguggccgacagagccggcaccuucaagaugguguucacccccaaggacggcagcggcgugaaggagugggagguguacaacuuccccgccggcggcgugggcaugggcauguacaacaccgacgagagcaucagcggcuucgcccacagcugcuuccaguacgccauccagaagaaguggccccuguacaugagcaccaagaacaccauccugaaggccuacgacggcagauucaaggacaucuuccaggagaucuucgacaagcacuacaagaccgacuucgacaagaacaagaucugguacgagcacagacugaucgacgacaugguggcccaggugcugaagagcagcggcggcuucgugugggccugcaagaacuacgacggcgacgugcagagcgacauccuggcccagggcuucggcagccugggccugaugaccagcgugcuggugugccccgacggcaagaccaucgaggccgaggccgcccacggcaccgugaccagacacuacagagagcaccagaagggcagacccaccagcaccaaccccaucgccagcaucuucgccuggaccagaggccuggagcacagaggcaagcuggacggcaaccaggaccugaucagauucgcccagaugcuggagaaggugugcguggagaccguggagagcggcgccaugaccaaggaccuggccggcugcauccacggccugagcaacgugaagcugaacgagcacuuccugaacaccaccgacuuccuggacaccaucaagagcaaccuggacagagcccugggcagacaguaa

SEQ ID NO: 18351 - RNA, 1131 nt, Artificial Sequence
  IDH3B__Homo_sapiens__NP_001245313
auggccgcccugagcggcgugagauggcugaccagagcccuggugagcgccggcaaccccggcgccuggagaggccugagcaccagcgccgccgcccacgccgccagcagaagccaggccgaggacgugagaguggagggcagcuuccccgugaccaugcugcccggcgacggcgugggccccgagcugaugcacgccgugaaggagguguucaaggccgccgccgugcccguggaguuccaggagcaccaccugagcgaggugcagaacauggccagcgaggagaagcuggagcaggugcugagcagcaugaaggagaacaagguggccaucaucggcaagauccacacccccauggaguacaagggcgagcuggccagcuacgacaugagacugagaagaaagcuggaccuguucgccaacguggugcacgugaagagccugcccggcuacaugaccagacacaacaaccuggaccuggugaucaucagagagcagaccgagggcgaguacagcagccuggagcacgagagcgccagaggcgugaucgagugccugaagaucgugaccagagccaagagccagagaaucgccaaguucgccuucgacuacgccaccaagaagggcagaggcaaggugaccgccgugcacaaggccaacaucaugaagcugggcgacggccuguuccugcagugcugcgaggagguggccgagcuguaccccaagaucaaguucgagaccaugaucaucgacaacugcugcaugcagcuggugcagaaccccuaccaguucgacgugcuggugaugcccaaccuguacggcaacaucaucgacaaccuggccgccggccuggugggcggcgccggcguggugcccggcgagagcuacagcgccgaguacgccguguucgagaccggcgccagacaccccuucgcccaggccgugggcagaaacaucgccaaccccaccgccaugcugcugagcgccagcaacaugcugagacaccugaaccuggaguaccacagcagcaugaucgccgacgccgugaagaaggugaucaaggugggcaagauccccagcgccgugcccagcuuccugcugcacccccugcccuucagcugggccaucuaa

SEQ ID NO: 18352 - RNA, 564 nt, Artificial Sequence
  IDNK__Homo_sapiens__NP_001001551
auggccgcccccggcgcccugcuggugaugggcgugagcggcagcggcaagagcaccgugggcgcccugcuggccagcgagcugggcuggaaguucuacgacgccgacgacuaccaccccgaggagaacagaagaaagaugggcaagggcaucccccugaacgaccaggacagaauccccuggcugugcaaccugcacgacauccugcugagagacguggccagcggccagagaguggugcuggccugcagcgcccugaagaagaccuacagagacauccugacccagggcaaggacggcguggcccugaagugcgaggagagcggcaaggaggccaagcaggccgagaugcagcugcugguggugcaccugagcggcagcuucgaggugaucagcggcagacugcugaagagagagggccacuucaugccccccgagcugcugcagagccaguucgagacccuggagccccccgccgcccccgagaacuucauccagaucagcguggacaagaacgugagcgagaucaucgccaccaucauggagacccugaagaugaaguaa

SEQ ID NO: 18353 - RNA, 1212 nt, Artificial Sequence
  IDO1__Homo_sapiens__NP_002155
auggcccacgccauggagaacagcuggaccaucagcaaggaguaccacaucgacgaggaggugggcuucgcccugcccaacccccaggagaaccugcccgacuucuacaacgacuggauguucaucgccaagcaccugcccgaccugaucgagagcggccagcugagagagagaguggagaagcugaacaugcugagcaucgaccaccugaccgaccacaagagccagagacuggccagacuggugcugggcugcaucaccauggccuacguguggggcaagggccacggcgacgugagaaaggugcugcccagaaacaucgccgugcccuacugccagcugagcaagaagcuggagcugccccccauccugguguacgccgacugcgugcuggccaacuggaagaagaaggaccccaacaagccccugaccuacgagaacauggacgugcuguucagcuucagagacggcgacugcagcaagggcuucuuccuggugagccugcugguggagaucgccgccgccagcgccaucaaggugauccccaccguguucaaggccaugcagaugcaggagagagacacccugcugaaggcccugcuggagaucgccagcugccuggagaaggcccugcagguguuccaccagauccacgaccacgugaaccccaaggccuucuucagcgugcugagaaucuaccugagcggcuggaagggcaacccccagcugagcgacggccugguguacgagggcuucugggaggaccccaaggaguucgccggcggcagcgccggccagagcagcguguuccagugcuucgacgugcugcugggcauccagcagaccgccggcggcggccacgccgcccaguuccugcaggacaugagaagauacaugccccccgcccacagaaacuuccugugcagccuggagagcaaccccagcgugagagaguucgugcugagcaagggcgacgccggccugagagaggccuacgacgccugcgugaaggcccuggugagccugagaagcuaccaccugcagaucgugaccaaguacauccugauccccgccagccagcagcccaaggagaacaagaccagcgaggaccccagcaagcuggaggccaagggcaccggcggcaccgaccugaugaacuuccugaagaccgugagaagcaccaccgagaagagccugcugaaggagggcuaa

SEQ ID NO: 18354 - RNA, 1263 nt, Artificial Sequence
  IDO2__Homo_sapiens__NP_919270
augcugcacuuccacuacuacgacaccagcaacaagaucauggagccccacagacccaacgugaagaccgccgugccccugagccuggagagcuaccacaucagcgaggaguacggcuuccugcugcccgacagccugaaggagcugcccgaccacuacagacccuggauggagaucgccaacaagcugccccagcugaucgacgcccaccagcugcaggcccacguggacaagaugccccugcugagcugccaguuccugaagggccacagagagcagagacuggcccaccuggugcugagcuuccugaccaugggcuacguguggcaggagggcgaggcccagcccgccgaggugcugcccagaaaccuggcccugcccuucguggaggugagcagaaaccugggccugccccccauccuggugcacagcgaccuggugcugaccaacuggaccaagaaggaccccgacggcuuccuggagaucggcaaccuggagaccaucaucagcuuccccggcggcgagagccugcacggcuucauccuggugaccgcccugguggagaaggaggccgugcccggcaucaaggcccuggugcaggccaccaacgccauccugcagcccaaccaggaggcccugcugcaggcccugcagagacugagacugagcauccaggacaucaccaagacccugggccagaugcacgacuacguggaccccgacaucuucuacgccggcaucagaaucuuccugagcggcuggaaggacaaccccgccaugcccgccggccugauguacgagggcgugagccaggagccccugaaguacagcggcggcagcgccgcccagagcaccgugcugcacgccuucgacgaguuccugggcaucagacacagcaaggagagcggcgacuuccuguacagaaugagagacuacaugccccccagccacaaggccuucaucgaggacauccacagcgcccccagccugagagacuacauccugagcagcggccaggaccaccugcugaccgccuacaaccagugcgugcaggcccuggccgagcugagaagcuaccacaucaccauggugaccaaguaccugaucaccgccgccgccaaggccaagcacggcaagcccaaccaccugcccggccccccccaggcccugaaggacagaggcaccggcggcaccgccgugaugagcuuccugaagagcgugagagacaagacccuggagagcauccugcaccccagaggcuaa

SEQ ID NO: 18355 - RNA, 1653 nt, Artificial Sequence
  IDS__Homo_sapiens__NP_000193
augcccccccccagaaccggcagaggccugcuguggcugggccuggugcugagcagcgugugcguggcccugggcagcgagacccaggccaacagcaccaccgacgcccugaacgugcugcugaucaucguggacgaccugagacccagccugggcugcuacggcgacaagcuggugagaagccccaacaucgaccagcuggccagccacagccugcuguuccagaacgccuucgcccagcaggccgugugcgcccccagcagagugagcuuccugaccggcagaagacccgacaccaccagacuguacgacuucaacagcuacuggagagugcacgccggcaacuucagcaccaucccccaguacuucaaggagaacggcuacgugaccaugagcgugggcaagguguuccaccccggcaucagcagcaaccacaccgacgacagccccuacagcuggagcuucccccccuaccaccccagcagcgagaaguacgagaacaccaagaccugcagaggccccgacggcgagcugcacgccaaccugcugugccccguggacgugcuggacgugcccgagggcacccugcccgacaagcagagcaccgagcaggccauccagcugcuggagaagaugaagaccagcgccagccccuucuuccuggccgugggcuaccacaagccccacauccccuucagauaccccaaggaguuccagaagcuguacccccuggagaacaucacccuggcccccgaccccgaggugcccgacggccugccccccguggccuacaaccccuggauggacaucagacagagagaggacgugcaggcccugaacaucagcgugcccuacggccccauccccguggacuuccagagaaagaucagacagagcuacuucgccagcgugagcuaccuggacacccaggugggcagacugcugagcgcccuggacgaccugcagcuggccaacagcaccaucaucgccuucaccagcgaccacggcugggcccugggcgagcacggcgagugggccaaguacagcaacuucgacguggccacccacgugccccugaucuucuacgugcccggcagaaccgccagccugcccgaggccggcgagaagcuguuccccuaccuggaccccuucgacagcgccagccagcugauggagcccggcagacagagcauggaccugguggagcuggugagccuguuccccacccuggccggccuggccggccugcaggugccccccagaugccccgugcccagcuuccacguggagcugugcagagagggcaagaaccugcugaagcacuucagauucagagaccuggaggaggaccccuaccugcccggcaaccccagagagcugaucgccuacagccaguaccccagacccagcgacaucccccaguggaacagcgacaagcccagccugaaggacaucaagaucaugggcuacagcaucagaaccaucgacuacagauacaccgugugggugggcuucaaccccgacgaguuccuggccaacuucagcgacauccacgccggcgagcuguacuucguggacagcgacccccugcaggaccacaacauguacaacgacagccagggcggcgaccuguuccagcugcugaugcccuaa

SEQ ID NO: 18356 - RNA, 1962 nt, Artificial Sequence
  IDUA__Homo_sapiens__NP_000194
augagaccccugagacccagagccgcccugcuggcccugcuggccagccugcuggccgccccccccguggcccccgccgaggccccccaccuggugcacguggacgccgccagagcccuguggccccugagaagauucuggagaagcaccggcuucugccccccccugccccacagccaggccgaccaguacgugcugagcugggaccagcagcugaaccuggccuacgugggcgccgugccccacagaggcaucaagcaggugagaacccacuggcugcuggagcuggugaccaccagaggcagcaccggcagaggccugagcuacaacuucacccaccuggacggcuaccuggaccugcugagagagaaccagcugcugcccggcuucgagcugaugggcagcgccagcggccacuucaccgacuucgaggacaagcagcagguguucgaguggaaggaccuggugagcagccuggccagaagauacaucggcagauacggccuggcccacgugagcaaguggaacuucgagaccuggaacgagcccgaccaccacgacuucgacaacgugagcaugaccaugcagggcuuccugaacuacuacgacgccugcagcgagggccugagagccgccagccccgcccugagacugggcggccccggcgacagcuuccacaccccccccagaagcccccugagcuggggccugcugagacacugccacgacggcaccaacuucuucaccggcgaggccggcgugagacuggacuacaucagccugcacagaaagggcgccagaagcagcaucagcauccuggagcaggagaaggugguggcccagcagaucagacagcuguuccccaaguucgccgacacccccaucuacaacgacgaggccgacccccuggugggcuggagccugccccagcccuggagagccgacgugaccuacgccgccaugguggugaaggugaucgcccagcaccagaaccugcugcuggccaacaccaccagcgccuuccccuacgcccugcugagcaacgacaacgccuuccugagcuaccacccccaccccuucgcccagagaacccugaccgccagauuccaggugaacaacaccagacccccccacgugcagcugcugagaaagcccgugcugaccgccaugggccugcuggcccugcuggacgaggagcagcugugggccgaggugagccaggccggcaccgugcuggacagcaaccacaccgugggcgugcuggccagcgcccacagaccccagggccccgccgacgccuggagagccgccgugcugaucuacgccagcgacgacaccagagcccaccccaacagaagcguggccgugacccugagacugagaggcgugccccccggccccggccugguguacgugaccagauaccuggacaacggccugugcagccccgacggcgaguggagaagacugggcagacccguguuccccaccgccgagcaguucagaagaaugagagccgccgaggaccccguggccgccgcccccagaccccugcccgccggcggcagacugacccugagacccgcccugagacugcccagccugcugcuggugcacgugugcgccagacccgagaagccccccggccaggugaccagacugagagcccugccccugacccagggccagcuggugcugguguggagcgacgagcacgugggcagcaagugccuguggaccuacgagauccaguucagccaggacggcaaggccuacacccccgugagcagaaagcccagcaccuucaaccuguucguguucagccccgacaccggcgccgugagcggcagcuacagagugagagcccuggacuacugggccagacccggccccuucagcgaccccgugcccuaccuggaggugcccgugcccagaggcccccccagccccggcaaccccuaa

SEQ ID NO: 18357 - RNA, 672 nt, Artificial Sequence
  IER2__Homo_sapiens__NP_004898
auggaggugcagaaggaggcccagagaaucaugacccugagcguguggaagauguaccacagcagaaugcagagaggcggccugagacugcacagaagccugcagcugagccuggugaugagaagcgccagagagcuguaccugagcgccaagguggaggcccuggagcccgaggugagccugcccgccgcccugcccagcgaccccagacugcacccccccagagaggccgagagcaccgccgagaccgccacccccgacggcgagcaccccuuccccgagcccauggacacccaggaggcccccaccgccgaggagaccagcgccugcugcgcccccagacccgccaaggugagcagaaagagaagaagcagcagccugagcgacggcggcgacgccggccuggugcccagcaagaaggccagacuggaggagaaggaggaggaggagggcgccagcagcgagguggccgacagacugcagcccccccccgcccaggccgagggcgccuuccccaaccuggccagagugcugcagagaagauucagcggccugcugaacugcagccccgccgccccccccaccgccccccccgccugcgaggccaagcccgccugcagacccgccgacagcaugcugaacgugcuggugagagccgugguggccuucuaa

SEQ ID NO: 18358 - RNA, 471 nt, Artificial Sequence
  IER3__Homo_sapiens__NP_003888
augugccacagcagaagcugccaccccaccaugaccauccugcaggcccccacccccgcccccagcaccauccccggccccagaagaggcagcggccccgagaucuucaccuucgacccccugcccgagcccgccgccgcccccgccggcagacccagcgccagcagaggccacagaaagagaagcagaagagugcuguaccccagaguggugagaagacagcugcccguggaggagcccaaccccgccaagagacugcuguuccugcugcugaccaucguguucugccagauccugauggccgaggagggcgugcccgccccccugccccccgaggacgcccccaacgccgccagccuggcccccacccccgugagcgccgugcuggagcccuucaaccugaccagcgagcccagcgacuacgcccuggaccugagcaccuuccugcagcagcaccccgccgccuucuaa

SEQ ID NO: 18359 - RNA, 249 nt, Artificial Sequence
  IER3IP1__Homo_sapiens__NP_057181
auggccuucacccuguacagccugcugcaggccgcccugcugugcgugaacgccaucgccgugcugcacgaggagagauuccugaagaacaucggcuggggcaccgaccagggcaucggcggcuucggcgaggagcccggcaucaagagccagcugaugaaccugaucagaagcgugagaaccgugaugagagugccccugaucaucgugaacagcaucgccaucgugcugcugcugcuguucggcuaa

SEQ ID NO: 18360 - RNA, 984 nt, Artificial Sequence
  IER5__Homo_sapiens__NP_057629
auggaguucaagcuggaggcccacagaaucgugagcaucagccugggcaagaucuacaacagcagagugcagagaggcggcaucaagcugcacaagaaccugcuggugagccuggugcugagaagcgccagacagguguaccugagcgaccccugccccggccuguaccuggccggccccgccggcacccccgccccccccccccagcagcagcccggcgagcccgccgccggcccccccgccggcuggggcgagccccccccccccgccgccagagccagcuggcccgagaccgagccccagcccgagagaagcagcgugagcgacgcccccagagugggcgacgaggugcccguggccaccgugaccggcgugggcgacguguuccagggcggcgaggccgacgccaccgaggccgccuggagcagaguggagggccccagacaggccgccgccagagaggccgagggcaccgccggcggcuggggcguguuccccgaggugagcagagccgccagaagacccugcggcugcccccugggcggcgaggacccccccggcacccccgccgccacccccagagccgccugcugcugcgccccccagcccgccgaggacgagccccccgccccccccgccgugugccccagaaagagaugcgccgccggcgugggcggcggccccgccggcugccccgcccccggcagcaccccccugaagaagcccagaagaaaccuggagcagccccccagcggcggcgaggacgacgacgccgaggagauggagaccggcaacguggccaaccugaucagcaucuucggcagcagcuucagcggccugcugagaaagagccccggcggcggcagagaggaggaggagggcgaggagagcggccccgaggccgccgagcccggccagaucugcugcgacaagcccgugcugagagacaugaaccccuggagcaccgccaucguggccuucuaa

SEQ ID NO: 18361 - RNA, 1692 nt, Artificial Sequence
  IFFO1__Homo_sapiens__NP_001034759
augaacccccuguucggccccaaccuguuccugcugcagcaggagcagcagggccuggccggcccccugggcgacagccugggcggcgaccacuucgccggcggcggcgaccugccccccgccccccugagccccgccggccccgccgccuacagcccccccggccccggccccgccccccccgccgccauggcccugagaaacgaccugggcagcaacaucaacgugcugaagacccugaaccugagauucagaugcuuccuggccaaggugcacgagcuggagagaagaaacagacugcuggagaagcagcugcagcaggcccuggaggagggcaagcagggcagaagaggccugggcagaagagaccaggccgugcagaccggcuucgugagccccaucagaccccugggccugcagcugggcgccagacccgccgccgugugcagccccagcgccagagugcugggcagccccgccagaagccccgccggcccccuggcccccagcgccgccagccugagcagcagcagcaccagcaccagcaccaccuacagcagcagcgccagauucaugcccggcaccaucuggagcuucagccacgccagaagacugggccccggccuggagcccacccuggugcagggccccggccugagcugggugcaccccgacggcgugggcgugcagaucgacaccaucacccccgagaucagagcccuguacaacgugcuggccaaggugaagagagagagagacgaguacaagagaagaugggaggaggaguacaccgugagaauccagcugcaggacagagugaacgagcugcaggaggaggcccaggaggccgacgccugccaggaggagcuggcccugaagguggagcagcugaaggccgagcuggugguguucaagggccugaugagcaacaaccugagcgagcuggacaccaagauccaggagaaggccaugaagguggacauggacaucugcagaagaaucgacaucaccgccaagcugugcgacguggcccagcagagaaacugcgaggacaugauccagauguuccagaagaagcuggugcccagcaugggcggcagaaagagagagagaaaggccgccguggaggaggacaccagccugagcgagagcgagggccccagacagcccgacggcgacgaggaggagagcaccgcccugagcaucaacgaggagaugcagagaaugcugaaccagcugagagaguacgacuucgaggacgacugcgacagccugaccugggaggagaccgaggagacccugcugcugugggaggacuucagcggcuacgccauggccgccgccgaggcccagggcgagcagcaggaggacagccuggagaaggugaucaaggacaccgagagccuguucaagaccagagagaaggaguaccaggagaccaucgaccagaucgagcuggagcuggccaccgccaagaacgacaugaacagacaccugcacgaguacauggagaugugcagcaugaagagaggccuggacgugcagauggagaccugcagaagacugaucacccagagcggcgacagaaagagccccgccuucaccgccgugccccugagcgaccccccccccccccccagcgaggccgaggacagcgacagagacgugagcagcgacagcagcaugagauaa

SEQ ID NO: 18362 - RNA, 1413 nt, Artificial Sequence
  IFFO2__Homo_sapiens__XP_011538932
auggugaacagccugcuguucggcgagauggcccuggccuucggcugcccccccggcggcggcggcggcggcugccccggcggcggcggcggcggcggcggcgccggccccggccccagccccgugaccgccgcccugagagacgaccugggcagcaacauccaccugcugaagggccugaacgugagauucagaugcuuccuggccaaggugcacgagcuggagagaagaaacagacugcuggagaagcagcuggagcagcagcagagcgagagagagagaagacugagauacaagaccuucagcagagagcaggccgugcagaccggccccgagcugcugagaccccccgcccccggcggcggccacggccugagcagcggcgccgccgccggcgccaacgccaacgccguggcccugggcggccugccccccggcggcggcagccacccccagcacuacggcagacugcccggcaccaucuggagcuacacccaggugagaagaaccggcggcggcggcguggagaccgugcagggccccggcgugagcugggugcaccccgacggcgugggcgugcagaucgacaccaucacccccgagaucagagcccuguacaacgugcuggccaaggugaagagagagagagacgaguacaagagaagaugggaggaggagcuggccaagagaaugaaccugcagaccaugguggacacccugcaggaggccgcccaggaggccgacgccauccaggaggagaugaacgagaagaucgagagacugaaggccgagcuggugguguucaagggccugaugagcgacguggugcccaagaagaaggagagaaagguggccagcgacgacgacaucagcgagcaggacggcgaggugaacagauucagcgacgacgaggugggcagcaugaacaucaccgacgagaugaagagaauguucaaccagcugagagagaccuucgacuucgacgacgacugcgacagccugaccugggaggagaacgaggacacccugcugcugugggaggacuucaccaacugcaaccccaccaucgaccugcagggcgagcaggaggagaaccugggcaaccugauccacgagaccgagagcuucuucaagaccagagacaaggaguaccaggagaccaucggccagaucgagcuggagcuggccaccgccaagagcgacaugaacagacaccugcacgaguacauggagaugugcagcaugaagagaggccuggacgugcagauggagaccugcagaagacugaucaagggcagcgccgacagaaacagccccagccccagcagcguggccagcagcgacagcggcagcaccgacgagauccaggacgaguucgagagagaggccgacguggagcccauggugagcuaa

SEQ ID NO: 18363 - RNA, 2190 nt, Artificial Sequence
  IFI16__Homo_sapiens__NP_001193496
augggcaagaaguacaagaacaucgugcugcugaagggccuggaggugaucaacgacuaccacuucagaauggugaagagccugcugagcaacgaccugaagcugaaccugaagaugagagaggaguacgacaagauccagaucgccgaccugauggaggagaaguucagaggcgacgccggccugggcaagcugaucaagaucuucgaggacauccccacccuggaggaccuggccgagacccugaagaaggagaagcugaaggugaagggccccgcccugagcagaaagagaaagaaggagguggacgccaccagccccgcccccagcaccagcagcaccgugaagaccgagggcgccgaggccacccccggcgcccagaaccccaagaccguggccaagugccaggugacccccagaagaaacgugcugcagaagagacccgugaucgugaaggugcugagcaccaccaagcccuucgaguacgagacccccgagauggagaagaagaucauguuccacgccaccguggccacccagacccaguucuuccacgugaaggugcugaacaccagccugaaggagaaguucaacggcaagaagaucaucaucaucagcgacuaccuggaguacgacagccugcuggaggugaacgaggagagcaccgugagcgaggccggccccaaccagaccuucgaggugcccaacaagaucaucaacagagccaaggagacccugaagaucgacauccugcacaagcaggccagcggcaacaucguguacggcguguucaugcugcacaagaagaccgugaaccagaagaccaccaucuacgagauccaggacgacagaggcaagauggacguggugggcaccggccagugccacaacauccccugcgaggagggcgacaagcugcagcuguucugcuucagacugagaaagaagaaccagaugagcaagcugaucagcgagaugcacagcuucauccagaucaagaagaagaccaaccccagaaacaacgaccccaagagcaugaagcugccccaggagcagagacagcugcccuaccccagcgaggccagcaccaccuuccccgagagccaccugagaaccccccagaugccccccaccacccccagcagcagcuucuucaccaagaagagcgaggacaccaucagcaagaugaacgacuucaugagaaugcagauccugaaggagggcagccacuuccccggccccuucaugaccagcaucggccccgccgagagccacccccacaccccccagaugccccccagcacccccagcagcagcuuccugaccaccaagagcgaggacaccaucagcaagaugaacgacuucaugagaaugcagauccugaaggagggcagccacuuccccggccccuucaugaccagcaucggccccgccgagagccacccccacaccccccagaugccccccagcacccccagcagcagcuuccugaccacccugaagcccagacugaagaccgagcccgaggaggugagcaucgaggacagcgcccagagcgaccugaaggaggugauggugcugaacgccaccgagagcuucguguacgagcccaaggagcagaagaagauguuccacgccaccguggccaccgagaacgagguguucagagugaagguguucaacaucgaccugaaggagaaguucacccccaagaagaucaucgccaucgccaacuacgugugcagaaacggcuuccuggagguguaccccuucacccugguggccgacgugaacgccgacagaaacauggagauccccaagggccugaucagaagcgccagcgugacccccaagaucaaccagcugugcagccagaccaagggcagcuucgugaacggcguguucgaggugcacaagaagaacgugagaggcgaguucaccuacuacgagauccaggacaacaccggcaagauggaggugguggugcacggcagacugaccaccaucaacugcgaggagggcgacaagcugaagcugaccugcuucgagcuggcccccaagagcggcaacaccggcgagcugagaagcgugauccacagccacaucaaggugaucaagaccagaaagaacaagaaggacauccugaaccccgacagcagcauggagaccagccccgacuucuucuucuaa

SEQ ID NO: 18364 - RNA, 369 nt, Artificial Sequence
  IFI27__Homo_sapiens__NP_001275885
auggaggccagcgcccugaccagcagcgccgugaccagcguggccaagguggugagaguggccagcggcagcgccguggugcugccccuggccagaaucgccaccguggugaucggcggcgugguggccauggccgccgugcccauggugcugagcgccaugggcuucaccgccgccggcaucgccagcagcagcaucgccgccaagaugaugagcgccgccgccaucgccaacggcggcggcguggccagcggcagccugguggccacccugcagagccugggcgccaccggccugagcggccugaccaaguucauccugggcagcaucggcagcgccaucgccgccgugaucgccagauucuacuaa

SEQ ID NO: 18365 - RNA, 753 nt, Artificial Sequence
  IFI30__Homo_sapiens__NP_006323
augacccugagcccccugcugcuguuccugcccccccugcugcugcugcuggacgugcccaccgccgccgugcaggccagcccccugcaggcccuggacuucuucggcaacggcccccccgugaacuacaagaccggcaaccuguaccugagaggcccccugaagaagagcaacgccccccuggugaacgugacccuguacuacgaggcccugugcggcggcugcagagccuuccugaucagagagcuguuccccaccuggcugcuggugauggagauccugaacgugacccuggugcccuacggcaacgcccaggagcagaacgugagcggcagaugggaguucaagugccagcacggcgaggaggagugcaaguucaacaagguggaggccugcgugcuggacgagcuggacauggagcuggccuuccugaccaucgugugcauggaggaguucgaggacauggagagaagccugccccugugccugcagcuguacgcccccggccugagccccgacaccaucauggagugcgccaugggcgacagaggcaugcagcugaugcacgccaacgcccagagaaccgacgcccugcagcccccccacgaguacgugcccugggugaccgugaacggcaagccccuggaggaccagacccagcugcugacccuggugugccagcuguaccagggcaagaagcccgacgugugccccagcagcaccagcagccugagaagcgugugcuucaaguaa

SEQ ID NO: 18366 - RNA, 867 nt, Artificial Sequence
  IFI35__Homo_sapiens__NP_005524
augagcgccccccuggacgccgcccugcacgcccugcaggaggagcaggccagacugaagaugagacugugggaccugcagcagcugagaaaggagcugggcgacagccccaaggacaaggugcccuucagcgugcccaagaucccccugguguucagaggccacacccagcaggaccccgaggugcccaagagccuggugagcaaccugagaauccacugcccccugcuggccggcagcgcccugaucaccuucgacgaccccaagguggccgagcaggugcugcagcagaaggagcacaccaucaacauggaggagugcagacugagagugcaggugcagccccuggagcugcccauggugaccaccauccaggugaugaugagcagccagcugagcggcagaagagugcuggugaccggcuuccccgccagccugagacugagcgaggaggagcugcuggacaagcuggagaucuucuucggcaagaccagaaacggcggcggcgacguggacgugagagagcugcugcccggcagcgugaugcugggcuucgccagagacggcguggcccagagacugugccagaucggccaguucaccgugccccugggcggccagcaggugccccugagagugagccccuacgugaacggcgagauccagaaggccgagaucagaagccagcccgugcccagaagcgugcuggugcugaacauccccgacauccuggacggccccgagcugcacgacgugcuggagauccacuuccagaagcccaccagaggcggcggcgagguggaggcccugaccguggugccccagggccagcagggccuggccguguucaccagcgagagcggcuaa

SEQ ID NO: 18367 - RNA, 1374 nt, Artificial Sequence
  IFI44__Homo_sapiens__XP_011538818
auggccgugaccaccagacugaccuggcugcacgagaagauccugcagaaccacuucggcggcaagagacugagccugcuguacaagggcagcgugcacggcuucagaaacggcgugcugcuggacagaugcugcaaccagggccccacccugaccgugaucuacagcgaggaccacaucaucggcgccuacgccgaggagagcuaccaggagggcaaguacgccagcaucauccuguucgcccugcaggacaccaagaucagcgaguggaagcugggccugugcacccccgagacccuguucugcugcgacgugaccaaguacaacagccccaccaacuuccagaucgacggcagaaacagaaaggugaucauggaccugaagaccauggagaaccugggccuggcccagaacugcaccaucagcauccaggacuacgagguguucagaugcgaggacagccuggacgagagaaagaucaagggcgugaucgagcugagaaagagccugcugagcgcccugagaaccuacgagcccuacggcagccuggugcagcagaucagaauccugcugcugggccccaucggcgccggcaagagcagcuucuucaacagcgugagaagcguguuccagggccacgugacccaccaggcccuggugggcaccaacaccaccggcaucagcgagaaguacagaaccuacagcaucagagacggcaaggacggcaaguaccugcccuucauccugugcgacagccugggccugagcgagaaggagggcggccugugcagagacgacaucuucuacauccugaacggcaacaucagagacagauaccaguucaaccccauggagagcaucaagcugaaccaccacgacuacaucgacagccccagccugaaggacagaauccacugcguggccuucguguucgacgccagcagcauccaguacuucagcagccagaugaucgugaagaucaagagaaucagaagagagcuggugaacgccggcguggugcacguggcccugcugacccacguggacagcauggaccugaucaccaagggcgaccugaucgagaucgagagaugcgagcccgugagaagcaagcuggaggaggugcagagaaagcugggcuucgcccugagcgacaucagcguggugagcaacuacagcagcgagugggagcuggaccccgugaaggacgugcugauccugagcgcccugagaagaaugcugugggccgccgacgacuuccuggaggaccugcccuucgagcagaucggcagaugguucggcggcguggaggccuggaagagaagcggcaaccugagagaggagaucaucaacugcgcccagggcaagaaguaa

SEQ ID NO: 18368 - RNA, 3078 nt, Artificial Sequence
  IFIH1__Homo_sapiens__NP_071451
augagcaacggcuacagcaccgacgagaacuucagauaccugaucagcugcuucagagccagagugaagauguacauccagguggagcccgugcuggacuaccugaccuuccugcccgccgaggugaaggagcagauccagagaaccguggccaccagcggcaacaugcaggccguggagcugcugcugagcacccuggagaagggcguguggcaccugggcuggaccagagaguucguggaggcccugagaagaaccggcagcccccuggccgccagauacaugaaccccgagcugaccgaccugcccagccccagcuucgagaacgcccacgacgaguaccugcagcugcugaaccugcugcagcccacccugguggacaagcugcuggugagagacgugcuggacaagugcauggaggaggagcugcugaccaucgaggacagaaacagaaucgccgccgccgagaacaacggcaacgagagcggcgugagagagcugcugaagagaaucgugcagaaggagaacugguucagcgccuuccugaacgugcugagacagaccggcaacaacgagcuggugcaggagcugaccggcagcgacugcagcgagagcaacgccgagaucgagaaccugagccagguggacggcccccagguggaggagcagcugcugagcaccaccgugcagcccaaccuggagaaggagguguggggcauggagaacaacagcagcgagagcagcuucgccgacagcagcguggugagcgagagcgacaccagccuggccgagggcagcgugagcugccuggacgagagccugggccacaacagcaacaugggcagcgacagcggcaccaugggcagcgacagcgacgaggagaacguggccgccagagccagccccgagcccgagcugcagcugagacccuaccagauggagguggcccagcccgcccuggagggcaagaacaucaucaucugccugcccaccggcagcggcaagaccagaguggccguguacaucgccaaggaccaccuggacaagaagaagaaggccagcgagcccggcaaggugaucgugcuggugaacaaggugcugcugguggagcagcuguucagaaaggaguuccagcccuuccugaagaagugguacagagugaucggccugagcggcgacacccagcugaagaucagcuuccccgagguggugaagagcugcgacaucaucaucagcaccgcccagauccuggagaacagccugcugaaccuggagaacggcgaggacgccggcgugcagcugagcgacuucagccugaucaucaucgacgagugccaccacaccaacaaggaggccguguacaacaacaucaugagacacuaccugaugcagaagcugaagaacaacagacugaagaaggagaacaagcccgugaucccccugccccagauccugggccugaccgccagccccggcgugggcggcgccaccaagcaggccaaggccgaggagcacauccugaagcugugcgccaaccuggacgccuucaccaucaagaccgugaaggagaaccuggaccagcugaagaaccagauccaggagcccugcaagaaguucgccaucgccgacgccaccagagaggaccccuucaaggagaagcugcuggagaucaugaccagaauccagaccuacugccagaugagccccaugagcgacuucggcacccagcccuacgagcagugggccauccagauggagaagaaggccgccaaggagggcaacagaaaggagagagugugcgccgagcaccugagaaaguacaacgaggcccugcagaucaacgacaccaucagaaugaucgacgccuacacccaccuggagaccuucuacaacgaggagaaggacaagaaguucgccgugaucgaggacgacagcgacgagggcggcgacgacgaguacugcgacggcgacgaggacgaggacgaccugaagaagccccugaagcuggacgagaccgacagauuccugaugacccuguucuucgagaacaacaagaugcugaagagacuggccgagaaccccgaguacgagaacgagaagcugaccaagcugagaaacaccaucauggagcaguacaccagaaccgaggagagcgccagaggcaucaucuucaccaagaccagacagagcgccuacgcccugagccaguggaucaccgagaacgagaaguucgccgaggugggcgugaaggcccaccaccugaucggcgccggccacagcagcgaguucaagcccaugacccagaacgagcagaaggaggugaucagcaaguucagaaccggcaagaucaaccugcugaucgccaccaccguggccgaggagggccuggacaucaaggagugcaacaucgugaucagauacggccuggugaccaacgagaucgccauggugcaggccagaggcagagccagagccgacgagagcaccuacgugcugguggcccacagcggcagcggcgugaucgagcacgagaccgugaacgacuucagagagaagaugauguacaaggccauccacugcgugcagaacaugaagcccgaggaguacgcccacaagauccuggagcugcagaugcagagcaucauggagaagaagaugaagaccaagagaaacaucgccaagcacuacaagaacaaccccagccugaucaccuuccugugcaagaacugcagcgugcuggccugcagcggcgaggacauccacgugaucgagaagaugcaccacgugaacaugacccccgaguucaaggagcuguacaucgugagagagaacaaggcccugcagaagaagugcgccgacuaccagaucaacggcgagaucaucugcaagugcggccaggccuggggcaccaugauggugcacaagggccuggaccugcccugccugaagaucagaaacuucguggugguguucaagaacaacagcaccaagaagcaguacaagaaguggguggagcugcccaucaccuuccccaaccuggacuacagcgagugcugccuguucagcgacgaggacuaa

SEQ ID NO: 18369 - RNA, 1344 nt, Artificial Sequence
  IFIT1__Homo_sapiens__NP_001257858
augcccgaccuggagaacagagugcuggaccagaucgaguuccuggacaccaaguacagcgugggcauccacaaccugcuggccuacgugaagcaccugaagggccagaacgaggaggcccugaagagccugaaggaggccgagaaccugaugcaggaggagcacgacaaccaggccaacgugagaagccuggugaccuggggcaacuucgccuggauguacuaccacaugggcagacuggccgaggcccagaccuaccuggacaagguggagaacaucugcaagaagcugagcaaccccuucagauacagaauggagugccccgagaucgacugcgaggagggcugggcccugcugaagugcggcggcaagaacuacgagagagccaaggccugcuucgagaaggugcuggagguggaccccgagaaccccgagagcagcgccggcuacgccaucagcgccuacagacuggacggcuucaagcuggccaccaagaaccacaagcccuucagccugcugccccugagacaggccgugagacugaaccccgacaacggcuacaucaaggugcugcuggcccugaagcugcaggacgagggccaggaggccgagggcgagaaguacaucgaggaggcccuggccaacaugagcagccagaccuacguguucagauacgccgccaaguucuacagaagaaagggcagcguggacaaggcccuggagcugcugaagaaggcccugcaggagacccccaccagcgugcugcugcaccaccagaucggccugugcuacaaggcccagaugauccagaucaaggaggccaccaagggccagcccagaggccagaacagagagaagcuggacaagaugaucagaagcgccaucuuccacuucgagagcgccguggagaagaagcccaccuucgagguggcccaccuggaccuggccagaauguacaucgaggccggcaaccacagaaaggccgaggagaacuuccagaagcugcugugcaugaagcccgugguggaggagaccaugcaggacauccacuuccacuacggcagauuccaggaguuccagaagaagagcgacgugaacgccaucauccacuaccugaaggccaucaagaucgagcaggccagccugaccagagacaagagcaucaacagccugaagaagcuggugcugagaaagcugagaagaaaggcccuggaccuggagagccugagccugcugggcuucguguacaagcuggagggcaacaugaacgaggcccuggaguacuacgagagagcccugagacuggccgccgacuucgagaacagcgugagacagggccccuaa

SEQ ID NO: 18370 - RNA, 1419 nt, Artificial Sequence
  IFIT2__Homo_sapiens__NP_001538
augagcgagaacaacaagaacagccuggagagcagccugagacagcugaagugccacuucaccuggaaccugauggagggcgagaacagccuggacgacuucgaggacaagguguucuacagaaccgaguuccagaacagagaguucaaggccaccaugugcaaccugcuggccuaccugaagcaccugaagggccagaacgaggccgcccuggagugccugagaaaggccgaggagcugauccagcaggagcacgccgaccaggccgagaucagaagccuggugaccuggggcaacuacgccuggguguacuaccacaugggcagacugagcgacgugcagaucuacguggacaaggugaagcacgugugcgagaaguucagcagccccuacagaaucgagagccccgagcuggacugcgaggagggcuggaccagacugaagugcggcggcaaccagaacgagagagccaaggugugcuucgagaaggcccuggagaagaagcccaagaaccccgaguucaccagcggccuggccaucgccagcuacagacuggacaacuggccccccagccagaacgccaucgacccccugagacaggccaucagacugaaccccgacaaccaguaccugaaggugcugcuggcccugaagcugcacaagaugagagaggagggcgaggaggagggcgagggcgagaagcugguggaggaggcccuggagaaggcccccggcgugaccgacgugcugagaagcgccgccaaguucuacagaagaaaggacgagcccgacaaggccaucgagcugcugaagaaggcccuggaguacauccccaacaacgccuaccugcacugccagaucggcugcugcuacagagccaagguguuccaggugaugaaccugagagagaacggcauguacggcaagagaaagcugcuggagcugaucggccacgccguggcccaccugaagaaggccgacgaggccaacgacaaccuguucagagugugcagcauccuggccagccugcacgcccuggccgaccaguacgaggacgccgaguacuacuuccagaaggaguucagcaaggagcugacccccguggccaagcagcugcugcaccugagauacggcaacuuccagcuguaccagaugaagugcgaggacaaggccauccaccacuucaucgagggcgugaagaucaaccagaagagcagagagaaggagaagaugaaggacaagcugcagaagaucgccaagaugagacugagcaagaacggcgccgacagcgaggcccugcacgugcuggccuuccugcaggagcugaacgagaagaugcagcaggccgacgaggacagcgagagaggccuggagagcggcagccugauccccagcgccagcagcuggaacggcgaguaa

SEQ ID NO: 18371 - RNA, 1317 nt, Artificial Sequence
  IFIT3__Homo_sapiens__NP_001276687
auguacaaccugcuggccuacaucaagcaccuggacggcaacaacgaggccgcccuggagugccugagacaggccgaggagcugauccagcaggagcacgccgaccaggccgagaucagaagccuggugaccuggggcaacuacgccuggguguacuaccaccugggcagacugagcgacgcccagaucuacguggacaaggugaagcagaccugcaagaaguucagcaaccccuacagcaucgaguacagcgagcuggacugcgaggagggcuggacccagcugaagugcggcagaaacgagagagccaaggugugcuucgagaaggcccuggaggagaagcccaacaaccccgaguucagcagcggccuggccaucgccauguaccaccuggacaaccaccccgagaagcaguucagcaccgacgugcugaagcaggccaucgagcugagccccgacaaccaguacgugaaggugcugcugggccugaagcugcagaagaugaacaaggaggccgagggcgagcaguucguggaggaggcccuggagaagagccccugccagaccgacgugcugagaagcgccgccaaguucuacagaagaaagggcgaccuggacaaggccaucgagcuguuccagagagugcuggagagcacccccaacaacggcuaccuguaccaccagaucggcugcugcuacaaggccaaggugagacagaugcagaacaccggcgagagcgaggccagcggcaacaaggagaugaucgaggcccugaagcaguacgccauggacuacagcaacaaggcccuggagaagggccugaacccccugaacgccuacagcgaccuggccgaguuccuggagaccgagugcuaccagacccccuucaacaaggaggugcccgacgccgagaagcagcagagccaccagagauacugcaaccugcagaaguacaacggcaagagcgaggacaccgccgugcagcacggccuggagggccugagcaucagcaagaagagcaccgacaaggaggagaucaaggaccagccccagaacgugagcgagaaccugcugccccagaacgcccccaacuacugguaccugcagggccugauccacaagcagaacggcgaccugcugcaggccgccaagugcuacgagaaggagcugggcagacugcugagagacgcccccagcggcaucggcagcaucuuccugagcgccagcgagcuggaggacggcagcgaggagaugggccagggcgccgugagcagcagccccagagagcugcugagcaacagcgagcagcugaacuaa

SEQ ID NO: 18372 - RNA, 1449 nt, Artificial Sequence
  IFIT5__Homo_sapiens__NP_036552
augagcgagaucagaaaggacacccugaaggccauccugcuggagcuggagugccacuucaccuggaaccugcugaaggaggacaucgaccuguucgagguggaggacaccaucggccagcagcuggaguuccugaccaccaagagcagacuggcccuguacaaccugcuggccuacgugaagcaccugaagggccagaacaaggacgcccuggagugccuggagcaggccgaggagaucauccagcaggagcacagcgacaaggaggaggugagaagccuggugaccuggggcaacuacgccuggguguacuaccacauggaccagcuggaggaggcccagaaguacaccggcaagaucggcaacgugugcaagaagcugagcagccccagcaacuacaagcuggagugccccgagaccgacugcgagaagggcugggcccugcugaaguucggcggcaaguacuaccagaaggccaaggccgccuucgagaaggcccuggagguggagcccgacaaccccgaguucaacaucggcuacgccaucaccguguacagacuggacgacagcgacagagagggcagcgugaagagcuucagccugggcccccugagaaaggccgugacccugaaccccgacaacagcuacaucaagguguuccuggcccugaagcugcaggacgugcacgccgaggccgagggcgagaaguacaucgaggagauccuggaccagaucagcagccagcccuacgugcugagauacgccgccaaguucuacagaagaaagaacagcuggaacaaggcccuggagcugcugaagaaggcccuggaggugacccccaccagcagcuuccugcaccaccagaugggccugugcuacagagcccagaugauccagaucaagaaggccacccacaacagacccaagggcaaggacaagcugaagguggacgagcugaucagcagcgccaucuuccacuucaaggccgccauggagagagacagcauguucgccuucgccuacaccgaccuggccaacauguacgccgagggcggccaguacagcaacgccgaggacaucuucagaaaggcccugagacuggagaacaucaccgacgaccacaagcaccagauccacuaccacuacggcagauuccaggaguuccacagaaagagcgagaacaccgccauccaccacuaccuggaggcccugaaggugaaggacagaagcccccugagaaccaagcugaccagcgcccugaagaagcugagcaccaagagacugugccacaacgcccuggacgugcagagccugagcgcccugggcuucguguacaagcuggagggcgagaagagacaggccgccgaguacuacgagaaggcccagaagaucgaccccgagaacgccgaguuccugaccgcccugugcgagcugagacugagcaucuaa

SEQ ID NO: 18373 - RNA, 378 nt, Artificial Sequence
  IFITM1__Homo_sapiens__NP_003632
augcacaaggaggagcacgagguggccgugcugggcgccccccccagcaccauccugcccagaagcaccgugaucaacauccacagcgagaccagcgugcccgaccacgugguguggagccuguucaacacccuguuccugaacuggugcugccugggcuucaucgccuucgccuacagcgugaagagcagagacagaaagauggugggcgacgugaccggcgcccaggccuacgccagcaccgccaagugccugaacaucugggcccugauccugggcauccugaugaccaucggcuucauccugcugcugguguucggcagcgugaccguguaccacaucaugcugcagaucauccaggagaagagaggcuacuaa

SEQ ID NO: 18374 - RNA, 399 nt, Artificial Sequence
  IFITM2__Homo_sapiens__NP_006426
augaaccacaucgugcagaccuucagccccgugaacagcggccagccccccaacuacgagaugcugaaggaggagcaggagguggccaugcugggcgugccccacaaccccgccccccccaugagcaccgugauccacaucagaagcgagaccagcgugcccgaccacgugguguggagccuguucaacacccuguucaugaacaccugcugccugggcuucaucgccuucgccuacagcgugaagagcagagacagaaagauggugggcgacgugaccggcgcccaggccuacgccagcaccgccaagugccugaacaucugggcccugauccugggcaucuucaugaccauccugcugaucaucauccccgugcugguggugcaggcccagagauaa

SEQ ID NO: 18375 - RNA, 402 nt, Artificial Sequence
  IFITM3__Homo_sapiens__NP_066362
augaaccacaccgugcagaccuucuucagccccgugaacagcggccagccccccaacuacgagaugcugaaggaggagcacgagguggccgugcugggcgccccccacaaccccgccccccccaccagcaccgugauccacaucagaagcgagaccagcgugcccgaccacgugguguggagccuguucaacacccuguucaugaaccccugcugccugggcuucaucgccuucgccuacagcgugaagagcagagacagaaagauggugggcgacgugaccggcgcccaggccuacgccagcaccgccaagugccugaacaucugggcccugauccugggcauccugaugaccauccugcugaucgugauccccgugcugaucuuccaggccuacggcuaa

SEQ ID NO: 18376 - RNA, 399 nt, Artificial Sequence
  IFITM5__Homo_sapiens__NP_001020466
auggacaccgccuaccccagagaggacaccagagcccccacccccagcaaggccggcgcccacaccgcccugacccugggcgccccccaccccccccccagagaccaccugaucuggagcguguucagcacccuguaccugaaccugugcugccugggcuuccuggcccuggccuacagcaucaaggccagagaccagaagguggugggcgaccuggaggccgccagaagauucggcagcaaggccaagugcuacaacauccuggccgccauguggacccuggugcccccccugcugcugcugggccugguggugaccggcgcccugcaccuggccagacuggccaaggacagcgccgccuucuucagcaccaaguucgacgacgccgacuacgacuaa

SEQ ID NO: 18377 - RNA, 570 nt, Artificial Sequence
  IFNA10__Homo_sapiens__NP_002162
auggcccugagcuucagccugcugauggccgugcuggugcugagcuacaagagcaucugcagccugggcugcgaccugccccagacccacagccugggcaacagaagagcccugauccugcugggccagaugggcagaaucagccccuucagcugccugaaggacagacacgacuucagaaucccccaggaggaguucgacggcaaccaguuccagaaggcccaggccaucagcgugcugcacgagaugauccagcagaccuucaaccuguucagcaccgaggacagcagcgccgccugggagcagagccugcuggagaaguucagcaccgagcuguaccagcagcugaacgaccuggaggccugcgugauccaggaggugggcguggaggagaccccccugaugaacgaggacagcauccuggccgugagaaaguacuuccagagaaucacccuguaccugaucgagagaaaguacagccccugcgccugggagguggugagagccgagaucaugagaagccugagcuucagcaccaaccugcagaagagacugagaagaaaggacuaa

SEQ ID NO: 18378 - RNA, 573 nt, Artificial Sequence
  IFNA13__Homo_sapiens__NP_008831
augauggccagccccuucgcccugcugauggcccugguggugcugagcugcaagagcagcugcagccugggcugcgaccugcccgagacccacagccuggacaacagaagaacccugaugcugcuggcccagaugagcagaaucagccccagcagcugccugauggacagacacgacuucggcuucccccaggaggaguucgacggcaaccaguuccagaaggcccccgccaucagcgugcugcacgagcugauccagcagaucuucaaccuguucaccaccaaggacagcagcgccgccugggacgaggaccugcuggacaaguucugcaccgagcuguaccagcagcugaacgaccuggaggccugcgugaugcaggaggagagagugggcgagaccccccugaugaacgccgacagcauccuggccgugaagaaguacuucagaagaaucacccuguaccugaccgagaagaaguacagccccugcgccugggagguggugagagccgagaucaugagaagccugagccugagcaccaaccugcaggagagacugagaagaaaggaguaa

SEQ ID NO: 18379 - RNA, 570 nt, Artificial Sequence
  IFNA14__Homo_sapiens__NP_002163
auggcccugcccuucgcccugaugauggcccugguggugcugagcugcaagagcagcugcagccugggcugcaaccugagccagacccacagccugaacaacagaagaacccugaugcugauggcccagaugagaagaaucagccccuucagcugccugaaggacagacacgacuucgaguucccccaggaggaguucgacggcaaccaguuccagaaggcccaggccaucagcgugcugcacgagaugaugcagcagaccuucaaccuguucagcaccaagaacagcagcgccgccugggacgagacccugcuggagaaguucuacaucgagcuguuccagcagaugaacgaccuggaggccugcgugauccaggaggugggcguggaggagaccccccugaugaacgaggacagcauccuggccgugaagaaguacuuccagagaaucacccuguaccugauggagaagaaguacagccccugcgccugggagguggugagagccgagaucaugagaagccugagcuucagcaccaaccugcagaagagacugagaagaaaggacuaa

SEQ ID NO: 18380 - RNA, 570 nt, Artificial Sequence
  IFNA16__Homo_sapiens__NP_002164
auggcccugagcuucagccugcugauggccgugcuggugcugagcuacaagagcaucugcagccugggcugcgaccugccccagacccacagccugggcaacagaagagcccugauccugcuggcccagaugggcagaaucagccacuucagcugccugaaggacagauacgacuucggcuucccccaggagguguucgacggcaaccaguuccagaaggcccaggccaucagcgccuuccacgagaugauccagcagaccuucaaccuguucagcaccaaggacagcagcgccgccugggacgagacccugcuggacaaguucuacaucgagcuguuccagcagcugaacgaccuggaggccugcgugacccaggaggugggcguggaggagaucgcccugaugaacgaggacagcauccuggccgugagaaaguacuuccagagaaucacccuguaccugaugggcaagaaguacagccccugcgccugggagguggugagagccgagaucaugagaagcuucagcuucagcaccaaccugcagaagggccugagaagaaaggacuaa

SEQ ID NO: 18381 - RNA, 570 nt, Artificial Sequence
  IFNA17__Homo_sapiens__NP_067091
auggcccugagcuucagccugcugauggccgugcuggugcugagcuacaagagcaucugcagccugggcugcgaccugccccagacccacagccugggcaacagaagagcccugauccugcuggcccagaugggcagaaucagccccuucagcugccugaaggacagacacgacuucggccugccccaggaggaguucgacggcaaccaguuccagaagacccaggccaucagcgugcugcacgagaugauccagcagaccuucaaccuguucagcaccgaggacagcagcgccgccugggagcagagccugcuggagaaguucagcaccgagcuguaccagcagcugaacaaccuggaggccugcgugauccaggaggugggcauggaggagaccccccugaugaacgaggacagcauccuggccgugagaaaguacuuccagagaaucacccuguaccugaccgagaagaaguacagccccugcgccugggagguggugagagccgagaucaugagaagccugagcuucagcaccaaccugcagaagauccugagaagaaaggacuaa

SEQ ID NO: 18382 - RNA, 570 nt, Artificial Sequence
  IFNA1__Homo_sapiens__NP_076918
auggccagccccuucgcccugcugauggugcugguggugcugagcugcaagagcagcugcagccugggcugcgaccugcccgagacccacagccuggacaacagaagaacccugaugcugcuggcccagaugagcagaaucagccccagcagcugccugauggacagacacgacuucggcuucccccaggaggaguucgacggcaaccaguuccagaaggcccccgccaucagcgugcugcacgagcugauccagcagaucuucaaccuguucaccaccaaggacagcagcgccgccugggacgaggaccugcuggacaaguucugcaccgagcuguaccagcagcugaacgaccuggaggccugcgugaugcaggaggagagagugggcgagaccccccugaugaacgccgacagcauccuggccgugaagaaguacuucagaagaaucacccuguaccugaccgagaagaaguacagccccugcgccugggagguggugagagccgagaucaugagaagccugagccugagcaccaaccugcaggagagacugagaagaaaggaguaa

SEQ ID NO: 18383 - RNA, 570 nt, Artificial Sequence
  IFNA21__Homo_sapiens__NP_002166
auggcccugagcuucagccugcugauggccgugcuggugcugagcuacaagagcaucugcagccugggcugcgaccugccccagacccacagccugggcaacagaagagcccugauccugcuggcccagaugggcagaaucagccccuucagcugccugaaggacagacacgacuucggcuucccccaggaggaguucgacggcaaccaguuccagaaggcccaggccaucagcgugcugcacgagaugauccagcagaccuucaaccuguucagcaccaaggacagcagcgccaccugggagcagagccugcuggagaaguucagcaccgagcugaaccagcagcugaacgaccuggaggccugcgugauccaggaggugggcguggaggagaccccccugaugaacguggacagcauccuggccgugaagaaguacuuccagagaaucacccuguaccugaccgagaagaaguacagccccugcgccugggagguggugagagccgagaucaugagaagcuucagccugagcaagaucuuccaggagagacugagaagaaaggaguaa

SEQ ID NO: 18384 - RNA, 567 nt, Artificial Sequence
  IFNA2__Homo_sapiens__NP_000596
auggcccugaccuucgcccugcugguggcccugcuggugcugagcugcaagagcagcugcagcgugggcugcgaccugccccagacccacagccugggcagcagaagaacccugaugcugcuggcccagaugagaagaaucagccuguucagcugccugaaggacagacacgacuucggcuucccccaggaggaguucggcaaccaguuccagaaggccgagaccauccccgugcugcacgagaugauccagcagaucuucaaccuguucagcaccaaggacagcagcgccgccugggacgagacccugcuggacaaguucuacaccgagcuguaccagcagcugaacgaccuggaggccugcgugauccagggcgugggcgugaccgagaccccccugaugaaggaggacagcauccuggccgugagaaaguacuuccagagaaucacccuguaccugaaggagaagaaguacagccccugcgccugggagguggugagagccgagaucaugagaagcuucagccugagcaccaaccugcaggagagccugagaagcaaggaguaa

SEQ ID NO: 18385 - RNA, 570 nt, Artificial Sequence
  IFNA4__Homo_sapiens__NP_066546
auggcccugagcuucagccugcugauggccgugcuggugcugagcuacaagagcaucugcagccugggcugcgaccugccccagacccacagccugggcaacagaagagcccugauccugcuggcccagaugggcagaaucagccacuucagcugccugaaggacagacacgacuucggcuuccccgaggaggaguucgacggccaccaguuccagaaggcccaggccaucagcgugcugcacgagaugauccagcagaccuucaaccuguucagcaccgaggacagcagcgccgccugggagcagagccugcuggagaaguucagcaccgagcuguaccagcagcugaacgaccuggaggccugcgugauccaggaggugggcguggaggagaccccccugaugaacgaggacagcauccuggccgugagaaaguacuuccagagaaucacccuguaccugaccgagaagaaguacagccccugcgccugggagguggugagagccgagaucaugagaagccugagcuucagcaccaaccugcagaagagacugagaagaaaggacuaa

SEQ ID NO: 18386 - RNA, 570 nt, Artificial Sequence
  IFNA5__Homo_sapiens__NP_002160
auggcccugcccuucgugcugcugauggcccugguggugcugaacugcaagagcaucugcagccugggcugcgaccugccccagacccacagccugagcaacagaagaacccugaugaucauggcccagaugggcagaaucagccccuucagcugccugaaggacagacacgacuucggcuucccccaggaggaguucgacggcaaccaguuccagaaggcccaggccaucagcgugcugcacgagaugauccagcagaccuucaaccuguucagcaccaaggacagcagcgccaccugggacgagacccugcuggacaaguucuacaccgagcuguaccagcagcugaacgaccuggaggccugcaugaugcaggaggugggcguggaggacaccccccugaugaacguggacagcauccugaccgugagaaaguacuuccagagaaucacccuguaccugaccgagaagaaguacagccccugcgccugggagguggugagagccgagaucaugagaagcuucagccugagcgccaaccugcaggagagacugagaagaaaggaguaa

SEQ ID NO: 18387 - RNA, 570 nt, Artificial Sequence
  IFNA6__Homo_sapiens__NP_066282
auggcccugcccuucgcccugcugauggcccugguggugcugagcugcaagagcagcugcagccuggacugcgaccugccccagacccacagccugggccacagaagaaccaugaugcugcuggcccagaugagaagaaucagccuguucagcugccugaaggacagacacgacuucagauucccccaggaggaguucgacggcaaccaguuccagaaggccgaggccaucagcgugcugcacgaggugauccagcagaccuucaaccuguucagcaccaaggacagcagcguggccugggacgagagacugcuggacaagcuguacaccgagcuguaccagcagcugaacgaccuggaggccugcgugaugcaggaggugugggugggcggcaccccccugaugaacgaggacagcauccuggccgugagaaaguacuuccagagaaucacccuguaccugaccgagaagaaguacagccccugcgccugggagguggugagagccgagaucaugagaagcuucagcagcagcagaaaccugcaggagagacugagaagaaaggaguaa

SEQ ID NO: 18388 - RNA, 570 nt, Artificial Sequence
  IFNA7__Homo_sapiens__NP_066401
auggccagaagcuucagccugcugaugguggugcuggugcugagcuacaagagcaucugcagccugggcugcgaccugccccagacccacagccugagaaacagaagagcccugauccugcuggcccagaugggcagaaucagccccuucagcugccugaaggacagacacgaguucagauuccccgaggaggaguucgacggccaccaguuccagaagacccaggccaucagcgugcugcacgagaugauccagcagaccuucaaccuguucagcaccgaggacagcagcgccgccugggagcagagccugcuggagaaguucagcaccgagcuguaccagcagcugaacgaccuggaggccugcgugauccaggaggugggcguggaggagaccccccugaugaacgaggacuucauccuggccgugagaaaguacuuccagagaaucacccuguaccugauggagaagaaguacagccccugcgccugggagguggugagagccgagaucaugagaagcuucagcuucagcaccaaccugaagaagggccugagaagaaaggacuaa

SEQ ID NO: 18389 - RNA, 570 nt, Artificial Sequence
  IFNA8__Homo_sapiens__NP_002161
auggcccugaccuucuaccugcugguggcccugguggugcugagcuacaagagcuucagcagccugggcugcgaccugccccagacccacagccugggcaacagaagagcccugauccugcuggcccagaugagaagaaucagccccuucagcugccugaaggacagacacgacuucgaguucccccaggaggaguucgacgacaagcaguuccagaaggcccaggccaucagcgugcugcacgagaugauccagcagaccuucaaccuguucagcaccaaggacagcagcgccgcccuggacgagacccugcuggacgaguucuacaucgagcuggaccagcagcugaacgaccuggagagcugcgugaugcaggaggugggcgugaucgagagcccccugauguacgaggacagcauccuggccgugagaaaguacuuccagagaaucacccuguaccugaccgagaagaaguacagcagcugcgccugggagguggugagagccgagaucaugagaagcuucagccugagcaucaaccugcagaagagacugaagagcaaggaguaa

SEQ ID NO: 18390 - RNA, 1674 nt, Artificial Sequence
  IFNAR1__Homo_sapiens__NP_000620
augaugguggugcugcugggcgccaccacccuggugcugguggccguggcccccugggugcugagcgccgccgccggcggcaagaaccugaagagcccccagaagguggagguggacaucaucgacgacaacuucauccugagauggaacagaagcgacgagagcgugggcaacgugaccuucagcuucgacuaccagaagaccggcauggacaacuggaucaagcugagcggcugccagaacaucaccagcaccaagugcaacuucagcagccugaagcugaacguguacgaggagaucaagcugagaaucagagccgagaaggagaacaccagcagcugguacgagguggacagcuucacccccuucagaaaggcccagaucggcccccccgaggugcaccuggaggccgaggacaaggccaucgugauccacaucagccccggcaccaaggacagcgugaugugggcccuggacggccugagcuucaccuacagccuggugaucuggaagaacagcagcggcguggaggagagaaucgagaacaucuacagcagacacaagaucuacaagcugagccccgagaccaccuacugccugaaggugaaggccgcccugcugaccagcuggaagaucggcguguacagccccgugcacugcaucaagaccaccguggagaacgagcugcccccccccgagaacaucgaggugagcgugcagaaccagaacuacgugcugaagugggacuacaccuacgccaacaugaccuuccaggugcaguggcugcacgccuuccugaagagaaaccccggcaaccaccuguacaaguggaagcagauccccgacugcgagaacgugaagaccacccagugcguguucccccagaacguguuccagaagggcaucuaccugcugagagugcaggccagcgacggcaacaacaccagcuucuggagcgaggagaucaaguucgacaccgagauccaggccuuccugcugccccccguguucaacaucagaagccugagcgacagcuuccacaucuacaucggcgcccccaagcagagcggcaacacccccgugauccaggacuacccccugaucuacgagaucaucuucugggagaacaccagcaacgccgagagaaagaucaucgagaagaagaccgacgugaccgugcccaaccugaagccccugaccguguacugcgugaaggccagagcccacaccauggacgagaagcugaacaagagcagcguguucagcgacgccgugugcgagaagaccaagcccggcaacaccagcaagaucuggcugaucgugggcaucugcaucgcccuguucgcccugcccuucgugaucuacgccgccaagguguuccugagaugcaucaacuacguguucuuccccagccugaagcccagcagcagcaucgacgaguacuucagcgagcagccccugaagaaccugcugcugagcaccagcgaggagcagaucgagaagugcuucaucaucgagaacaucagcaccaucgccaccguggaggagaccaaccagaccgacgaggaccacaagaaguacagcagccagaccagccaggacagcggcaacuacagcaacgaggacgagagcgagagcaagaccagcgaggagcugcagcaggacuucguguaa

SEQ ID NO: 18391 - RNA, 996 nt, Artificial Sequence
  IFNAR2__Homo_sapiens__NP_997467
augcugcugagccagaacgccuucaucuucagaagccugaaccuggugcugaugguguacaucagccugguguucggcaucagcuacgacagccccgacuacaccgacgagagcugcaccuucaagaucagccugagaaacuucagaagcauccugagcugggagcugaagaaccacagcaucgugcccacccacuacacccugcuguacaccaucaugagcaagcccgaggaccugaagguggugaagaacugcgccaacaccaccagaagcuucugcgaccugaccgacgaguggagaagcacccacgaggccuacgugaccgugcuggagggcuucagcggcaacaccacccuguucagcugcagccacaacuucuggcuggccaucgacaugagcuucgagccccccgaguucgagaucgugggcuucaccaaccacaucaacgugauggugaaguuccccagcaucguggaggaggagcugcaguucgaccugagccuggugaucgaggagcagagcgagggcaucgugaagaagcacaagcccgagaucaagggcaacaugagcggcaacuucaccuacaucaucgacaagcugauccccaacaccaacuacugcgugagcguguaccuggagcacagcgacgagcaggccgugaucaagagcccccugaagugcacccugcugccccccggccaggagagcgagagcgccgagagcgccaagaucggcggcaucaucaccguguuccugaucgcccuggugcugaccagcaccaucgugacccugaaguggaucggcuacaucugccugagaaacagccugcccaaggugcugagacagggccuggccaagggcuggaacgccguggccauccacagaugcagccacaacgcccugcagagcgagacccccgagcugaagcagagcagcugccugagcuuccccagcagcugggacuacaagagagccagccugugccccagcgacuaa

SEQ ID NO: 18392 - RNA, 564 nt, Artificial Sequence
  IFNB1__Homo_sapiens__NP_002167
augaccaacaagugccugcugcagaucgcccugcugcugugcuucagcaccaccgcccugagcaugagcuacaaccugcugggcuuccugcagagaagcagcaacuuccagugccagaagcugcuguggcagcugaacggcagacuggaguacugccugaaggacagaaugaacuucgacauccccgaggagaucaagcagcugcagcaguuccagaaggaggacgccgcccugaccaucuacgagaugcugcagaacaucuucgccaucuucagacaggacagcagcagcaccggcuggaacgagaccaucguggagaaccugcuggccaacguguaccaccagaucaaccaccugaagaccgugcuggaggagaagcuggagaaggaggacuucaccagaggcaagcugaugagcagccugcaccugaagagauacuacggcagaauccugcacuaccugaaggccaaggaguacagccacugcgccuggaccaucgugagaguggagauccugagaaacuucuacuucaucaacagacugaccggcuaccugagaaacuaa

SEQ ID NO: 18393 - RNA, 627 nt, Artificial Sequence
  IFNE__Homo_sapiens__NP_795372
augaucaucaagcacuucuucggcaccgugcuggugcugcuggccagcaccaccaucuucagccuggaccugaagcugaucaucuuccagcagagacaggugaaccaggagagccugaagcugcugaacaagcugcagacccugagcauccagcagugccugccccacagaaagaacuuccugcugccccagaagagccugagcccccagcaguaccagaagggccacacccuggccauccugcacgagaugcugcagcagaucuucagccuguucagagccaacaucagccuggacggcugggaggagaaccacaccgagaaguuccugauccagcugcaccagcagcuggaguaccuggaggcccugaugggccuggaggccgagaagcugagcggcacccugggcagcgacaaccugagacugcaggugaagauguacuucagaagaauccacgacuaccuggagaaccaggacuacagcaccugcgccugggccaucgugcagguggagaucagcagaugccuguucuucguguucagccugaccgagaagcugagcaagcagggcagaccccugaacgacaugaagcaggagcugaccaccgaguucagaagccccagauaa

SEQ ID NO: 18394 - RNA, 501 nt, Artificial Sequence
  IFNG__Homo_sapiens__NP_000610
augaaguacaccagcuacauccuggccuuccagcugugcaucgugcugggcagccugggcugcuacugccaggaccccuacgugaaggaggccgagaaccugaagaaguacuucaacgccggccacagcgacguggccgacaacggcacccuguuccugggcauccugaagaacuggaaggaggagagcgacagaaagaucaugcagagccagaucgugagcuucuacuucaagcuguucaagaacuucaaggacgaccagagcauccagaagagcguggagaccaucaaggaggacaugaacgugaaguucuucaacagcaacaagaagaagagagacgacuucgagaagcugaccaacuacagcgugaccgaccugaacgugcagagaaaggccauccacgagcugauccaggugauggccgagcugagccccgccgccaagaccggcaagagaaagagaagccagaugcuguucagaggcagaagagccagccaguaa

SEQ ID NO: 18395 - RNA, 1470 nt, Artificial Sequence
  IFNGR1__Homo_sapiens__NP_000407
auggcccugcuguuccugcugccccuggugaugcagggcgugagcagagccgagaugggcaccgccgaccugggccccagcagcgugcccacccccaccaacgugaccaucgagagcuacaacaugaaccccaucguguacugggaguaccagaucaugccccaggugcccguguucaccguggaggugaagaacuacggcgugaagaacagcgaguggaucgacgccugcaucaacaucagccaccacuacugcaacaucagcgaccacgugggcgaccccagcaacagccugugggugagagugaaggccagagugggccagaaggagagcgccuacgccaagagcgaggaguucgccgugugcagagacggcaagaucggcccccccaagcuggacaucagaaaggaggagaagcagaucaugaucgacaucuuccaccccagcguguucgugaacggcgacgagcaggagguggacuacgaccccgagaccaccugcuacaucagaguguacaacguguacgugagaaugaacggcagcgagauccaguacaagauccugacccagaaggaggacgacugcgacgagauccagugccagcuggccauccccgugagcagccugaacagccaguacugcgugagcgccgagggcgugcugcacguguggggcgugaccaccgagaagagcaaggaggugugcaucaccaucuucaacagcagcaucaagggcagccuguggauccccgugguggccgcccugcugcuguuccuggugcugagccugguguucaucugcuucuacaucaagaagaucaacccccugaaggagaagagcaucauccugcccaagagccugaucagcguggugagaagcgccacccuggagaccaagcccgagagcaaguacgugagccugaucaccagcuaccagcccuucagccuggagaaggagguggugugcgaggagccccugagccccgccaccgugcccggcaugcacaccgaggacaaccccggcaagguggagcacaccgaggagcugagcagcaucaccgagguggugaccaccgaggagaacauccccgacguggugcccggcagccaccugacccccaucgagagagagagcagcagcccccugagcagcaaccagagcgagcccggcagcaucgcccugaacagcuaccacagcagaaacugcagcgagagcgaccacagcagaaacggcuucgacaccgacagcagcugccuggagagccacagcagccugagcgacagcgaguucccccccaacaacaagggcgagaucaagaccgagggccaggagcugaucaccgugaucaaggcccccaccagcuucggcuacgacaagccccacgugcugguggaccugcugguggacgacagcggcaaggagagccugaucggcuacagacccaccgaggacagcaaggaguucagcuaa

SEQ ID NO: 18396 - RNA, 1014 nt, Artificial Sequence
  IFNGR2__Homo_sapiens__NP_005525
augagacccacccugcuguggagccugcugcugcugcugggcguguucgccgccgccgccgccgccccccccgacccccugagccagcugcccgccccccagcaccccaagaucagacuguacaacgccgagcaggugcugagcugggagcccguggcccugagcaacagcaccagacccgugguguaccaggugcaguucaaguacaccgacagcaagugguucaccgccgacaucaugagcaucggcgugaacugcacccagaucaccgccaccgagugcgacuucaccgccgccagccccagcgccggcuuccccauggacuucaacgugacccugagacugagagccgagcugggcgcccugcacagcgccugggugaccaugcccugguuccagcacuacagaaacgugaccgugggcccccccgagaacaucgaggugacccccggcgagggcagccugaucaucagauucagcagccccuucgacaucgccgacaccagcaccgccuucuucugcuacuacgugcacuacugggagaagggcggcauccagcaggugaagggccccuucagaagcaacagcaucagccuggacaaccugaagcccagcagaguguacugccugcaggugcaggcccagcugcuguggaacaagagcaacaucuucagagugggccaccugagcaacaucagcugcuacgagaccauggccgacgccagcaccgagcugcagcaggugauccugaucagcgugggcaccuucagccugcugagcgugcuggccggcgccugcuucuuccuggugcugaaguacagaggccugaucaaguacugguuccacaccccccccagcaucccccugcagaucgaggaguaccugaaggaccccacccagcccauccuggaggcccuggacaaggacagcagccccaaggacgacgugugggacagcgugagcaucaucagcuuccccgagaaggagcaggaggacgugcugcagacccuguaa

SEQ ID NO: 18397 - RNA, 624 nt, Artificial Sequence
  IFNK__Homo_sapiens__NP_064509
augagcaccaagcccgacaugauccagaagugccuguggcuggagauccugaugggcaucuucaucgccggcacccugagccuggacugcaaccugcugaacgugcaccugagaagagugaccuggcagaaccugagacaccugagcagcaugagcaacagcuuccccguggagugccugagagagaacaucgccuucgagcugccccaggaguuccugcaguacacccagcccaugaagagagacaucaagaaggccuucuacgagaugagccugcaggccuucaacaucuucagccagcacaccuucaaguacuggaaggagagacaccugaagcagauccagaucggccuggaccagcaggccgaguaccugaaccagugccuggaggaggacaagaacgagaacgaggacaugaaggagaugaaggagaacgagaugaagcccagcgaggccagagugccccagcugagcagccuggagcugagaagauacuuccacagaaucgacaacuuccugaaggagaagaaguacagcgacugcgccugggagaucgugagaguggagaucagaagaugccuguacuacuucuacaaguucaccgcccuguucagaagaaaguaa

SEQ ID NO: 18398 - RNA, 603 nt, Artificial Sequence
  IFNL1__Homo_sapiens__NP_742152
auggccgccgccuggaccguggugcuggugacccuggugcugggccuggccguggccggccccgugcccaccagcaagcccaccaccaccggcaagggcugccacaucggcagauucaagagccugagcccccaggagcuggccagcuucaagaaggccagagacgcccuggaggagagccugaagcugaagaacuggagcugcagcagccccguguuccccggcaacugggaccugagacugcugcaggugagagagagacccguggcccuggaggccgagcuggcccugacccugaaggugcuggaggccgccgccggccccgcccuggaggacgugcuggaccagccccugcacacccugcaccacauccugagccagcugcaggccugcauccagccccagcccaccgccggccccagacccagaggcagacugcaccacuggcugcacagacugcaggaggcccccaagaaggagagcgccggcugccuggaggccagcgugaccuucaaccuguucagacugcugaccagagaccugaaguacguggccgacggcaaccugugccugagaaccagcacccaccccgagagcaccuaa

SEQ ID NO: 18399 - RNA, 603 nt, Artificial Sequence
  IFNL2__Homo_sapiens__XP_011525058
augaagcuggacaugaccggcgacugcacccccgugcuggugcugauggccgccgugcugaccgugaccggcgccgugcccguggccagacugcacggcgcccugcccgacgccagaggcugccacaucgcccaguucaagagccugagcccccaggagcugcaggccuucaagagagccaaggacgcccuggaggagagccugcugcugaaggacugcagaugccacagcagacuguuccccagaaccugggaccugagacagcugcaggugagagagagacccauggcccuggaggccgagcuggcccugacccugaaggugcuggaggccaccgccgacaccgaccccgcccugguggacgugcuggaccagccccugcacacccugcaccacauccugagccaguucagagccugcauccagccccagcccaccgccggccccagaaccagaggcagacugcaccacuggcuguacagacugcaggaggcccccaagaaggagagccccggcugccuggaggccagcgugaccuucaaccuguucagacugcugaccagagaccugaacugcguggccagcggcgaccugugcguguaa

SEQ ID NO: 18400 - RNA, 591 nt, Artificial Sequence
  IFNL3__Homo_sapiens__NP_742151
augaccggcgacugcaugcccgugcuggugcugauggccgccgugcugaccgugaccggcgccgugcccguggccagacugagaggcgcccugcccgacgccagaggcugccacaucgcccaguucaagagccugagcccccaggagcugcaggccuucaagagagccaaggacgcccuggaggagagccugcugcugaaggacugcaagugcagaagcagacuguuccccagaaccugggaccugagacagcugcaggugagagagagacccguggcccuggaggccgagcuggcccugacccugaaggugcuggaggccaccgccgacaccgaccccgcccugggcgacgugcuggaccagccccugcacacccugcaccacauccugagccagcugagagccugcauccagccccagcccaccgccggccccagaaccagaggcagacugcaccacuggcugcacagacugcaggaggcccccaagaaggagagccccggcugccuggaggccagcgugaccuucaaccuguucagacugcugaccagagaccugaacugcguggccagcggcgaccugugcguguaa

SEQ ID NO: 18401 - RNA, 588 nt, Artificial Sequence
  IFNW1__Homo_sapiens__NP_002168
auggcccugcuguucccccugcuggccgcccuggugaugaccagcuacagccccgugggcagccugggcugcgaccugccccagaaccacggccugcugagcagaaacacccuggugcugcugcaccagaugagaagaaucagccccuuccugugccugaaggacagaagagacuucagauucccccaggagauggugaagggcagccagcugcagaaggcccacgugaugagcgugcugcacgagaugcugcagcagaucuucagccuguuccacaccgagagaagcagcgccgccuggaacaugacccugcuggaccagcugcacaccggccugcaccagcagcugcagcaccuggagaccugccugcugcagguggugggcgagggcgagagcgccggcgccaucagcagccccgcccugacccugagaagauacuuccagggcaucagaguguaccugaaggagaagaaguacagcgacugcgccugggagguggugagaauggagaucaugaagagccuguuccugagcaccaacaugcaggagagacugagaagcaaggacagagaccugggcagcagcuaa

SEQ ID NO: 18402 - RNA, 1356 nt, Artificial Sequence
  IFRD1__Homo_sapiens__NP_001007246
augcccaagaacaagaagagaaacaccccccacagaggcagcagcgccggcggcggcggcagcggcgccgccgccgccaccgccgccaccgccggcggccagcacagaaacgugcagcccuucagcgacgaggacgccagcaucgagaccaugagccacugcagcggcuacagcgaccccagcagcuucgccgaggacggccccgaggugcuggacgaggagggcacccaggaggaccuggaguacaagcugaagggccugaucgaccugacccuggacaagagcgccaagaccagacaggccgcccuggagggcaucaagaacgcccuggccagcaagaugcuguacgaguucauccuggagagaagaaugacccugaccgacagcaucgagagaugccugaagaagggcaagagcgacgagcagagagccgccgccgcccuggccagcgugcugugcauccagcugggccccggcaucgagagcgaggagauccugaagacccugggccccauccugaagaagaucaucugcgacggcagcgccagcaugcaggccagacagaccugcgccaccugcuucggcgugugcugcuucaucgccaccgacgacaucaccgagcuguacagcacccuggagugccuggagaacaucuucaccaagagcuaccugaaggagaaggacaccaccgugaucugcagcacccccaacaccgugcugcacaucagcagccugcuggccuggacccugcugcugaccaucugccccaucaacgaggugaagaagaagcuggagaugcacuuccacaagcugcccagccugcugagcugcgacgacgugaacaugagaaucgccgccggcgagagccuggcccugcuguucgagcuggccagaggcaucgagagcgacuucuucuacgaggacauggagagccugacccagaugcugagagcccuggccaccgacggcaacaagcacagagccaagguggacaagagaaagcagagaagcguguucagagacgugcugagagccguggaggagagagacuuccccaccgagaccaucaaguucggccccgagagaauguacaucgacugcugggugaagaagcacaccuacgacaccuucaaggaggugcugggcagcggcaugcaguaccaccugcagagcaacgaguuccugagaaacguguucgagcugggcccccccgugaugcuggacgccgccacccugaagaccaugaagaucagcagauucgagagacaccuguacaacagcgccgccuucaaggccagaaccaaggccagaagcaagugcagagacaagagagccgacgugggcgaguucuucuaa

SEQ ID NO: 18403 - RNA, 3099 nt, Artificial Sequence
  IFT122__Homo_sapiens__NP_001267475
auguucaacggcaucaucagcaucagaaacaagaacggcgaggagaaggugaagaucgagagacccggcggcagccugagccccaucuggagcaucugcuggaaccccagcagagaggagagaaacgacauccuggccguggccgacuggggccagaaggugagcuucuaccagcugagcggcaagcagaucggcaaggacagagcccugaacuucgaccccugcugcaucagcuacuucaccaagggcgaguacauccugcugggcggcagcgacaagcaggugagccuguucaccaaggacggcgugagacugggcaccgugggcgagcagaacagcuggguguggaccugccaggccaagcccgacagcaacuacgugguggugggcugccaggacggcaccaucagcuucuaccagcugaucuucagcaccgugcacggccuguacaaggacagauacgccuacagagacagcaugaccgacgugaucgugcagcaccugaucaccgagcagaaggugagaaucaagugcaaggagcuggugaagaagaucgccaucuacagaaacagacuggccauccagcugcccgagaagauccugaucuacgagcuguacagcgaggaccugagcgacaugcacuacagagugaaggagaagaucaucaagaaguucgagugcaaccugcugguggugugcgccaaccacaucauccugugccaggagaagagacugcagugccugagcuucagcggcgugaaggagagagaguggcagauggagagccugaucagauacaucaaggugaucggcggcccccccggcagagagggccugcuggugggccugaagaacggccagauccugaagaucuucguggacaaccuguucgccaucgugcugcugaagcaggccaccgccgugagaugccuggacaugagcgccagcagaaagaagcuggccgugguggacgagaacgacaccugccugguguacgacaucgacaccaaggagcugcuguuccaggagcccaacgccaacagcguggccuggaacacccagugcgaggacaugcugugcuucagcggcggcggcuaccugaacaucaaggccagcaccuuccccgugcacagacagaagcugcagggcuucguggugggcuacaacggcagcaagaucuucugccugcacguguucagcaucagcgccguggaggugccccagagcgcccccauguaccaguaccuggacagaaagcuguucaaggaggccuaccagaucgccugccugggcgugaccgacaccgacuggagagagcuggccauggaggcccuggagggccuggacuucgagaccgccaagaaggccuucaucagagugcaggaccugagauaccuggagcugaucagcagcaucgaggagagaaagaagagaggcgagaccaacaacgaccuguuccuggccgacguguucagcuaccagggcaaguuccacgaggccgccaagcuguacaagagaagcggccacgagaaccuggcccuggagauguacaccgaccugugcauguucgaguacgccaaggacuuccugggcagcggcgaccccaaggagaccaagaugcugaucaccaagcaggccgacugggccagaaacaucaaggagcccaaggccgccguggagauguacaucagcgccggcgagcacgugaaggccaucgagaucugcggcgaccacggcuggguggacaugcugaucgacaucgccagaaagcuggacaaggccgagagagagccccugcugcugugcgccaccuaccugaagaagcuggacagccccggcuacgccgccgagaccuaccugaagaugggcgaccugaagagccuggugcagcugcacguggagacccagagaugggacgaggccuucgcccugggcgagaagcaccccgaguucaaggacgacaucuacaugcccuacgcccaguggcuggccgagaacgacagauucgaggaggcccagaaggccuuccacaaggccggcagacagagagaggccgugcaggugcuggagcagcugaccaacaacgccguggccgagagcagauucaacgacgccgccuacuacuacuggaugcugagcaugcagugccuggacaucgcccaggaccccgcccagaaggacaccaugcugggcaaguucuaccacuuccagagacuggccgagcuguaccacggcuaccacgccauccacagacacaccgaggaccccuucagcgugcacagacccgagacccuguucaacaucagcagauuccugcugcacagccugcccaaggacacccccagcggcaucagcaaggugaagauccuguucacccuggccaagcagagcaaggcccugggcgccuacagacuggccagacacgccuacgacaagcugagaggccuguacauccccgccagauuccagaagagcaucgagcugggcacccugaccaucagagccaagcccuuccacgacagcgaggagcuggugccccugugcuacagaugcagcaccaacaacccccugcugaacaaccugggcaacgugugcaucaacugcagacagcccuucaucuucagcgccagcagcuacgacgugcugcaccugguggaguucuaccuggaggagggcaucaccgacgaggaggccaucagccugaucgaccuggaggugcugagacccaagagagacgacagacagcuggagaucgccaacaacagcagccagauccugagacugguggagaccaaggacagcaucggcgacgaggaccccuucaccgccaagcugagcuucgagcagggcggcagcgaguucgugcccgugguggugagcagacuggugcugagaagcaugagcagaagagacgugcugaucaagagauggccccccccccugagauggcaguacuucagaagccugcugcccgacgccagcaucaccaugugccccagcugcuuccagauguuccacagcgaggacuacgagcugcuggugcugcagcacggcugcugccccuacugcagaagaugcaaggacgaccccggccccuaa

SEQ ID NO: 18404 - RNA, 4389 nt, Artificial Sequence
  IFT140__Homo_sapiens__NP_055529
auggcccuguacuacgaccaccagaucgaggcccccgacgccgccggcagccccagcuucaucagcuggcaccccgugcaccccuuccuggccguggccuacaucagcaccaccagcaccggcagcguggacaucuaccuggagcagggcgagugcgugcccgacacccacguggagagacccuucagaguggccagccugugcuggcaccccaccagacuggugcuggccgugggcugggagaccggcgaggugaccguguucaacaagcaggacaaggagcagcacaccaugccccugacccacaccgccgacaucaccgugcugagauggagccccagcggcaacugccugcugagcggcgacagacugggcgugcugcugcuguggagacuggaccagagaggcagagugcagggcaccccccugcugaagcacgaguacggcaagcaccugacccacugcaucuucagacugcccccccccggcgaggaccuggugcagcuggccaaggccgccgugagcggcgacgagaaggcccuggacauguucaacuggaagaagagcagcagcggcagccugcugaagaugggcagccacgagggccugcuguucuucgugagccugauggacggcaccgugcacuacguggacgagaagggcaagaccacccagguggugagcgccgacagcaccauccagaugcuguucuacauggagaagagagaggcccuggugguggugaccgagaaccugagacugagccuguacaccgugccccccgagggcaaggccgaggaggugaugaaggugaagcugagcggcaagaccggcagaagagccgacaucgcccugaucgagggcagccugcuggugauggccgugggcgaggccgcccugagauucugggacaucgagagaggcgagaacuacauccugagccccgacgagaaguucggcuucgagaagggcgagaacaugaacugcgugugcuacugcaaggugaagggccugcuggccgccggcaccgacagaggcagaguggccauguggagaaaggugcccgacuuccugggcagccccggcgccgagggcaaggacagaugggcccugcagacccccaccgagcugcagggcaacaucacccagauccaguggggcagcagaaagaaccugcuggccgugaacagcgugaucagcguggccauccugagcgagagagccaugagcagccacuuccaccagcagguggccgccaugcaggugagccccagccugcugaacgugugcuuccugagcaccggcguggcccacagccugagaaccgacaugcacaucagcggcguguucgccaccaaggacgccguggccguguggaacggcagacagguggccaucuucgagcugagcggcgccgccaucagaagcgccggcaccuuccugugcgagacccccgugcuggccaugcacgaggagaacguguacaccguggagagcaacagagugcaggugagaaccuggcagggcaccgugaagcagcugcugcuguucagcgagaccgagggcaaccccugcuuccuggacaucugcggcaacuuccugguggugggcaccgaccuggcccacuucaagagcuucgaccugagcagaagagaggccaaggcccacugcagcugcagaagccuggccgagcuggugcccggcgugggcggcaucgccagccugagaugcagcagcagcggcagcaccaucagcauccugcccagcaaggccgacaacagccccgacagcaagaucugcuucuacgacguggagauggacaccgugaccguguucgacuucaagaccggccagaucgacagaagagagacccugagcuucaacgagcaggagaccaacaagagccaccuguucguggacgagggccugaagaacuacgugcccgugaaccacuucugggaccagagcgagcccagacuguucgugugcgaggccgugcaggagacccccagaagccagccccagagcgccaacggccagccccaggacggcagagccggccccgccgccgacgugcugauccugagcuucuucaucagcgaggagcacggcuuccugcugcacgagagcuuccccagacccgccaccagccacagccugcugggcauggaggugcccuacuacuacuucaccagaaagcccgaggaggccgacagagaggacgagguggagcccggcugccaccacaucccccagauggugagcagaagaccccugagagacuucgugggccuggaggacugcgacaaggccaccagagacgccaugcugcacuucagcuucuucgugaccaucggcgacauggacgaggccuucaagagcaucaagcugaucaagagcgaggccgugugggagaacauggccagaaugugcgugaagacccagagacuggacguggccaaggugugccugggcaacaugggccacgccagaggcgccagagcccugagagaggccgagcaggagcccgagcuggaggccagaguggccgugcuggccacccagcugggcaugcuggaggacgccgagcagcuguacagaaagugcaagagacacgaccugcugaacaaguucuaccaggccgccggcagauggcaggaggcccugcagguggccgagcaccacgacagagugcaccugagaagcaccuaccacagauacgccggccaccuggaggccagcgccgacugcagcagagcccugagcuacuacgagaagagcgacacccacagauucgaggugcccagaaugcugagcgaggaccugcccagccuggagcuguacgugaacaagaugaaggacaagacccuguggagauggugggcccaguaccuggagagccagggcgagauggacgccgcccugcacuacuacgagcuggccagagaccacuucagccuggugagaauccacugcuuccagggcaacgugcagaaggccgcccagaucgccaacgagaccggcaaccuggccgccagcuaccaccuggccagacaguacgagagccaggaggaggugggccaggccgugcacuucuacaccagagcccaggccuucaagaacgccaucagacugugcaaggagaacggccuggacgaccagcugaugaaccuggcccugcugagcagccccgaggacaugaucgaggccgccagauacuacgaggagaagggcgugcagauggacagagccgugaugcuguaccacaaggccggccacuucagcaaggcccuggagcuggccuucgccacccagcaguucguggcccugcagcugaucgccgaggaccuggacgagaccagcgaccccgcccugcuggccagaugcagcgacuucuucaucgagcacagccaguacgagagagccguggagcugcugcuggccgccagaaaguaccaggaggcccugcagcugugccugggccagaacaugagcaucaccgaggagauggccgagaagaugaccguggccaaggacagcagcgaccugcccgaggagagcagaagagagcugcuggagcagaucgccgacugcugcaugagacagggcagcuaccaccuggccaccaagaaguacacccaggccggcaacaagcugaaggccaugagagcccugcugaagagcggcgacaccgagaagaucaccuucuucgccagcgugagcagacagaaggagaucuacaucauggccgccaacuaccugcagagccuggacuggagaaaggagcccgagaucaugaagaacaucaucggcuucuacaccaagggcagagcccuggaccugcuggccggcuucuacgacgccugcgcccagguggagaucgacgaguaccagaacuacgacaaggcccacggcgcccugaccgaggccuacaagugccuggccaaggccaaggccaagagcccccuggaccaggagaccagacuggcccagcugcagagcagaauggcccuggugaagagauucauccaggccagaagaaccuacaccgaggaccccaaggagagcaucaagcagugcgagcugcugcuggaggagcccgaccuggacagcaccaucagaaucggcgacguguacggcuuccugguggagcacuacgugagaaaggaggaguaccagaccgccuacagauuccuggaggagaugagaagaagacugccccuggccaacaugagcuacuacgugagcccccaggccguggacgccgugcacagaggccugggccugccccugcccagaaccgugcccgagcaggugagacacaacagcauggaggacgccagagagcuggacgaggaggugguggaggaggccgacgacgaccccuaa

SEQ ID NO: 18405 - RNA, 5250 nt, Artificial Sequence
  IFT172__Homo_sapiens__NP_056477
augcaccugaagcaccugagaacccugcugagcccccaggacggcgccgccaaggugaccugcauggccuggagccagaacaacgccaaguucgccgugugcaccguggacagaguggugcugcuguacgacgagcacggcgagagaagagacaaguucagcaccaagcccgccgacaugaaguacggcagaaagagcuacauggugaagggcauggccuucagccccgacagcaccaagaucgccaucggccagaccgacaacaucaucuacguguacaagaucggcgaggacuggggcgacaagaaggugaucugcaacaaguucauccagaccagcgccgugaccugccugcaguggcccgccgaguacaucaucguguucggccuggccgagggcaaggugagacuggccaacaccaagaccaacaagagcagcaccaucuacggcaccgagagcuacguggugagccugaccaccaacugcagcggcaagggcauccugagcggccacgccgacggcaccaucgugagauacuucuucgacgacgagggcagcggcgagagccagggcaagcuggugaaccaccccugcccccccuacgcccuggccugggccaccaacagcaucguggccgccggcugcgacagaaagaucguggccuacggcaaggagggccacaugcugcagaccuucgacuacagcagagacccccaggagagagaguucaccaccgccgugagcagccccggcggccagagcguggugcugggcagcuacgacagacugagaguguucaacuggauccccagaagaagcaucugggaggaggccaagcccaaggagaucaccaaccuguacaccaucaccgcccuggccuggaagagagacggcagcagacugugcgugggcacccugugcggcggcguggagcaguucgacugcugccugagaagaagcaucuacaagaacaaguucgagcugaccuacgugggccccagccaggugaucgugaagaaccugagcagcggcaccagaguggugcugaagagccacuacggcuacgagguggaggaggugaagauccugggcaaggagagauaccugguggcccacaccagcgagacccugcugcugggcgaccugaacaccaacagacugagcgagaucgccuggcagggcagcggcggcaacgagaaguacuucuucgagaacgagaacgugugcaugaucuucaacgccggcgagcugacccugguggaguacggcaacaacgacacccugggcagcgugagaaccgaguucaugaacccccaccugaucagcgugagaaucaacgagagaugccagagaggcaccgaggacaacaagaagcuggccuaccugaucgacaucaagaccaucgccaucguggaccugaucggcggcuacaacaucggcaccgugagccacgagagcagaguggacuggcuggagcugaacgagaccggccacaagcugcuguucagagacagaaagcugagacugcaccuguacgacaucgagagcugcagcaagaccaugauccugaacuucugcagcuacaugcagugggugcccggcagcgacgugcugguggcccagaacagaaacagccugugcgugugguacaacaucgaggcccccgagagagugaccauguucaccaucagaggcgacgugaucggccuggagagaggcggcggcaagaccgaggugauggugauggagggcgugaccaccguggccuacacccuggacgagggccugaucgaguucggcaccgccaucgacgacggcaacuacaucagagccaccgccuuccuggagacccuggagaugacccccgagaccgaggccauguggaagacccugagcaagcuggcccuggaggccagacagcugcacaucgccgagagaugcuucagcgcccugggccagguggccaaggccagauuccugcacgagaccaacgagaucgccgaccaggugagcagagaguacggcggcgagggcaccgacuucuaccaggugagagccagacuggccaugcuggagaagaacuacaagcuggccgagaugaucuuccuggagcagaacgccguggaggaggccaugggcauguaccaggagcugcacagaugggacgagugcaucgccguggccgaggccaagggccaccccgcccuggagaagcugagaagaagcuacuaccaguggcugauggacacccagcaggaggagagagccggcgagcugcaggagagccagggcgacggccuggccgccaucagccuguaccugaaggccggccugcccgccaaggccgccagacuggugcugaccagagaggagcugcuggccaacaccgagcugguggagcacaucaccgccgcccugaucaagggcgagcuguacgagagagccggcgaccuguucgagaagauccacaacccccagaaggcccuggagugcuacagaaagggcaacgccuucaugaaggccguggagcuggccagacuggccuuccccguggagguggugaagcuggaggaggccuggggcgaccaccuggugcagcagaagcagcuggacgccgccaucaaccacuacaucgaggccagaugcagcaucaaggccaucgaggccgcccugggcgccagacaguggaagaaggccaucuacauccuggaccugcaggacagaaacaccgccagcaaguacuacccccugguggcccagcacuacgccagccugcaggaguacgagaucgccgaggagcuguacaccaagggcgacagaaccaaggacgccaucgacauguacacccaggccggcagaugggagcaggcccacaagcuggccaugaagugcaugagacccgaggacgugagcgugcuguacaucacccaggcccaggagauggagaagcagggcaaguacagagaggccgagagacuguacgugaccgugcaggagcccgaccuggccaucaccauguacaagaagcacaagcuguacgacgacaugaucagacuggugggcaagcaccaccccgaccugcugagcgacacccaccugcaccugggcaaggagcuggaggccgagggcagacugcaggaggccgaguaccacuaccuggaggcccaggaguggaaggccaccgugaacauguacagagccagcggccugugggaggaggccuacagaguggccagaacccagggcggcgccaacgcccacaagcacguggccuaccugugggccaagagccugggcggcgaggccgccgugagacugcugaacaagcugggccugcuggaggccgccguggaccacgccgccgacaacugcagcuucgaguucgccuucgagcugagcagacuggcccugaagcacaagacccccgaggugcaccugaaguacgccauguuccuggaggacgagggcaaguucgaggaggccgaggccgaguucaucagagccggcaagcccaaggaggccgugcugauguucgugcacaaccaggacugggaggccgcccagagaguggccgaggcccacgaccccgacagcguggccgaggugcuggugggccaggccagaggcgcccuggaggagaaggacuuccagaaggccgagggccugcugcugagagcccagagacccggccuggcccugaacuacuacaaggaggccggccuguggagcgacgcccugagaaucugcaaggacuacgugcccagccagcuggaggcccugcaggaggaguacgagagagaggccaccaagaagggcgccagaggcguggagggcuucguggagcaggccagacacugggagcaggccggcgaguacagcagagccguggacugcuaccugaaggugagagacagcggcaacagcggccuggccgagaagugcuggaugaaggccgccgagcugagcaucaaguuccugcccccccagagaaacauggagguggugcuggccgugggcccccagcugaucggcaucggcaagcacagcgccgccgccgagcuguaccugaaccuggaccuggugaaggaggccaucgacgccuucaucgagggcgaggaguggaacaaggccaagagaguggccaaggagcuggaccccagauacgaggacuacguggaccagcacuacaaggaguuccugaagaaccagggcaagguggacagccuggugggcguggacgugaucgccgcccuggaccuguacguggagcagggccagugggacaagugcaucgagaccgccaccaagcagaacuacaagauccugcacaaguacguggcccuguacgccacccaccugaucagagagggcagcagcgcccaggcccuggcccuguacgugcagcacggcgcccccgccaacccccagaacuucaacaucuacaagagaaucuucaccgacauggugagcagccccggcaccaacugcgccgaggccuaccacagcugggccgaccugagagacgugcuguucaaccugugcgagaaccuggugaagagcagcgaggccaacagccccgcccacgaggaguucaagaccaugcugcugaucgcccacuacuacgccaccagaagcgccgcccagagcgugaagcagcuggagaccguggccgccagacugagcgugagccugcugagacacacccagcugcugcccguggacaaggccuucuacgaggccggcaucgccgccaaggccgugggcugggacaacauggccuucaucuuccugaacagauuccuggaccugaccgacgccaucgaggagggcacccuggacggccuggaccacagcgacuuccaggacaccgacauccccuucgaggugccccugcccgccaagcagcacgugcccgaggccgagagagaggaggugagagacugggugcugaccgugagcauggaccagagacuggagcaggugcugcccagagacgagagaggcgccuacgaggccagccugguggccgccagcaccggcgugagagcccugcccugccugaucaccggcuaccccauccugagaaacaagaucgaguucaagagacccggcaaggccgccaacaaggacaacuggaacaaguuccugauggccaucaagaccagccacagccccgugugccaggacgugcugaaguucaucagccaguggugcggcggccugcccagcaccagcuucagcuuccaguaa

SEQ ID NO: 18406 - RNA, 561 nt, Artificial Sequence
  IFT27__Homo_sapiens__NP_001171172
auggugaagcuggccgccaagugcauccuggccggcgaccccgccgugggcaagaccgcccuggcccagaucuucagaagcgacggcgcccacuuccagaagagcuacacccugaccaccggcauggaccugguggugaagaccgugcccgugcccgacaccggcgacagcguggagcuguucaucuucgacagcgccggcaaggagcuguucagcgagaugcuggacaagcugugggagagccccaacgugcugugccugguguacgacgugaccaacgaggagagcuucaacaacugcagcaaguggcuggagaaggccagaagccaggcccccggcaucagccugcccggcgugcuggugggcaacaagaccgaccuggccggcagaagagccguggacagcgccgaggccagagccugggcccugggccagggccuggagugcuucgagaccagcgugaaggagauggagaacuucgaggcccccuuccacugccuggccaagcaguuccaccagcuguacagagagaagguggagguguucagagcccuggccuaa

SEQ ID NO: 18407 - RNA, 627 nt, Artificial Sequence
  IFT43__Homo_sapiens__NP_001096034
auggaggaccugcuggaccuggacgaggagcugagauacagccuggccaccagcagagccaagaugggcagaagagcccagcaggagagcgcccaggccgagaaccaccugaacggcaagaacagcagccugacccugaccggcgagaccagcagcgccaagcugcccagaugcagacagggcggcugggccggcgacagcgugaaggccagcaaguucagaagaaaggccagcgaggagaucgaggacuucagacugagaccccagagccugaacggcagcgacuacggcggcgacauccccaucauccccgaccuggaggaggugcaggaggaggacuucgugcugcagguggccgccccccccagcauccagaucaagagagugaugaccuacagagaccuggacaacgaccugaugaaguacagcgccauccagacccuggacggcgagaucgaccugaagcugcugaccaaggugcuggcccccgagcacgaggugagagaggacgacgugggcugggacugggaccaccuguucaccgaggugagcagcgaggugcugaccgagugggacccccugcagaccgagaaggaggaccccgccggccaggccagacacaccuaa

SEQ ID NO: 18408 - RNA, 1290 nt, Artificial Sequence
  IFT57__Homo_sapiens__NP_060480
augaccgccgcccuggccguggugaccaccagcggccuggaggacggcgugcccagaagcagaggcgagggcaccggcgagguggugcuggagagaggccccggcgccgccuaccacauguucguggugauggaggaccugguggagaagcugaagcugcugagauacgaggaggaguuccugagaaagagcaaccugaaggcccccagcagacacuacuucgcccugcccaccaaccccggcgagcaguucuacauguucugcacccuggccgccuggcugaucaacaaggccggcagacccuucgagcagccccaggaguacgacgaccccaacgccaccaucagcaacauccugagcgagcugagaagcuucggcagaaccgccgacuucccccccagcaagcugaagagcggcuacggcgagcacgugugcuacgugcuggacugcuucgccgaggaggcccugaaguacaucggcuucaccuggaagagacccaucuaccccguggaggagcuggaggaggagagcguggccgaggacgacgccgagcugacccugaacaagguggacgaggaguucguggaggaggagaccgacaacgaggagaacuucaucgaccugaacgugcugaaggcccagaccuaccaccuggacaugaacgagaccgccaagcaggaggacauccuggagagcaccaccgacgccgccgaguggagccuggagguggagagagugcugccccagcugaaggugaccaucagaaccgacaacaaggacuggagaauccacguggaccagaugcaccagcacagaagcggcaucgagagcgcccugaaggagaccaagggcuuccuggacaagcugcacaacgagaucaccagaacccuggagaagaucagcagcagagagaaguacaucaacaaccagcuggagaaccuggugcaggaguacagagccgcccaggcccagcugagcgaggccaaggagagauaccagcagggcaacggcggcgugaccgagagaaccagacugcugagcgaggugauggaggagcuggagaaggugaagcaggagauggaggagaagggcagcagcaugaccgacggcgccccccuggugaagaucaagcagagccugaccaagcugaagcaggagaccguggagauggacaucagaaucggcaucguggagcacacccugcugcagagcaagcugaaggagaagagcaacaugaccagaaacaugcacgccaccgugauccccgagcccgccaccggcuucuacuaa

SEQ ID NO: 18409 - RNA, 1803 nt, Artificial Sequence
  IFT74__Homo_sapiens__NP_001092693
auggccagcaaccacaagagcagcgccgccagacccgugagcagaggcggcgugggccugaccggcagaccccccagcggcaucagaccccugagcggcaacaucagaguggccaccgccaugccccccggcaccgccagacccggcagcagaggcugccccaucggcaccggcggcgugcugagcagccagaucaagguggcccacagacccgugacccagcagggccugaccggcaugaagaccggcaccaagggcccccagagacagauccuggacaagagcuacuaccugggccugcugagaagcaagaucagcgagcugaccaccgaggugaacaagcugcagaagggcaucgagauguacaaccaggagaacagcguguaccugagcuacgagaagagagccgagacccuggccguggagaucaaggagcugcagggccagcuggccgacuacaacaugcugguggacaagcugaacaccaacaccgagauggaggaggugaugaacgacuacaacaugcugaaggcccagaacgacagagagacccagagccuggacgugaucuucaccgagagacaggccaaggagaagcagaucagaagcguggaggaggagaucgagcaggagaagcaggccaccgacgacaucaucaagaacaugagcuucgagaaccaggugaaguaccuggagaugaagaccaccaacgagaagcugcugcaggagcuggacacccugcagcagcagcuggacagccagaacaugaagaaggagagccuggaggccgagaucgcccacagccaggugaagcaggaggccgugcugcugcacgagaagcuguacgagcuggagagccacagagaccagaugaucgccgaggacaagagcaucggcagccccauggaggagagagagaagcugcugaagcagaucaaggacgacaaccaggagaucgccagcauggagagacagcugaccgacaccaaggagaagaucaaccaguucaucgaggagaucagacagcuggacauggaccuggaggagcaccagggcgagaugaaccagaaguacaaggagcugaagaagagagaggagcacauggacaccuucaucgagaccuucgaggagaccaagaaccaggagcugaagagaaaggcccagaucgaggccaacaucguggcccugcuggagcacugcagcagaaacaucaacagaaucgagcagaucagcagcaucaccaaccaggagcugaagaugaugcaggacgaccugaacuucaagagcaccgaggugcagaagagccagagcaccgcccagaaccugaccagcgacauccagagacugcagcuggaccugcagaagauggagcugcuggagagcaagaugaccgaggagcagcacagccugaagagcaagaucaagcagaugaccaccgaccuggagaucuacaacgaccugcccgcccugaagagcagcggcgaggagaagaucaagaagcugcaccaggagagaaugauccugagcacccacagaaacgccuucaagaagaucauggagaagcagaacaucgaguacgaggcccugaagacccagcugcaggagaacgagacccacagccagcugaccaaccuggagagaaaguggcagcaccuggagcagaacaacuucgccaugaaggaguucaucgccaccaagagccaggagagcgacuaccagcccaucaagaagaacgugaccaagcagaucgccgaguacaacaagaccaucguggacgcccugcacagcaccagcggcaacuaa

SEQ ID NO: 18410 - RNA, 1923 nt, Artificial Sequence
  IFT80__Homo_sapiens__NP_001177171
augcugagaagcacccuggcccagcagggcacccccguguacagcguggccuggggccccgacagcgagaaggugcuguacaccgccggcaagcagcugaucaucaagccccugcagcccaacgccaaggugcugcaguggaaggcccacgacggcaucauccugaagguggacuggaacagcgugaacgaccugauccugagcgccggcgaggacugcaaguacaaggugugggacagcuacggcagaccccuguacaacagccagccccacgagcaccccaucaccagcguggccugggcccccgacggcgagcuguucgccgugggcagcuuccacacccugagacugugcgacaagaccggcuggagcuacgcccuggagaagcccaacaccggcagcaucuucaacaucgccuggagcaucgacggcacccagaucgccggcgccugcggcaacggccacgugguguucgcccacgugguggagcagcacugggaguggaagaacuuccaggugacccugaccaagagaagagccaugcaggugagaaacgugcugaacgacgccguggaccugcuggaguucagagacagagugaucaaggccagccugaacuacgcccaccugguggugagcaccagccugcagugcuacguguucagcaccaagaacuggaacacccccaucaucuucgaccugaaggagggcaccgugagccugauccugcaggccgagagacacuuccugcugguggacggcagcagcaucuaccuguacagcuacgagggcagauucaucagcagccccaaguuccccggcaugagaaccgacauccugaacgcccagaccgugagccugagcaacgacaccaucgccaucagagacaaggccgacgagaagaucaucuuccuguucgaggccagcaccggcaagccccugggcgacggcaaguuccugagccacaagaacgagauccuggagaucgcccuggaccagaagggccugaccaacgacagaaagaucgccuucaucgacaagaacagagaccugugcaucaccagcgugaagagauucggcaaggaggagcagaucaucaagcugggcaccauggugcacacccuggccuggaacgacaccugcaacauccugugcggccugcaggacaccagauucaucgugugguacuaccccaacaccguguacguggacagagacauccugcccaagacccuguacgagagagacgccagcgaguucagcaagaacccccacaucgugagcuucgugggcaaccaggugaccaucagaagagccgacggcagccuggugcacaucagcaucacccccuaccccgccauccugcacgaguacgugagcagcagcaagugggaggacgccgugagacugugcagauucgugaaggagcagaccaugugggccugccuggccgccauggccguggccaacagagacaugaccaccgccgagaucgccuacgccgccaucggcgagaucgacaaggugcaguacaucaacagcaucaagaaccugcccagcaaggagagcaagauggcccacauccugcuguucagcggcaacauccaggaggccgagaucgugcugcugcaggccggccugguguaccaggccauccagaucaacaucaaccuguacaacugggagagagcccuggagcuggccgugaaguacaagacccacguggacaccgugcuggccuacagacagaaguuccuggagaccuucggcaagcaggagaccaacaagagauaccugcacuacgccgagggccugcagaucgacugggagaagaucaaggccaagaucgagauggagaucaccaaggagagagagcagagcagcagcagccagagcagcaagagcaucggccugaagcccuaa

SEQ ID NO: 18411 - RNA, 2646 nt, Artificial Sequence
  IFT88__Homo_sapiens__XP_005266603
augaagguggagagcggcaugaagaucaaggugcacaacaacgccgagagcgagaccgccgugggcuuccuggagguggaccagggcugccccaucuucggcuuccccggcccccacagaaagaagaacugccugggcccccacaugaaguucaccaacaccaaggugcagaugaugcagaacgugcaccuggcccccgagaccgacgaggacgaccuguacagcggcuacaacgacuacaaccccaucuacgacaucgaggagcuggagaacgacgccgccuuccagcaggccgugagaaccagccacggcagaagaccccccaucaccgccaagaucagcagcaccgccgugaccagacccaucgccaccggcuacggcagcaagaccagccuggccagcagcaucggcagacccaugaccggcgccauccaggacggcgugaccagacccaugaccgccgugagagccgccggcuucaccaaggccgcccugagaggcagcgccuucgacccccugagccagagcagaggccccgccagcccccuggaggccaagaagaaggacagccccgaggagaagaucaagcagcuggagaaggaggugaacgagcugguggaggagagcugcaucgccaacagcugcggcgaccugaagcuggcccuggagaaggccaaggacgccggcagaaaggagagagugcuggugagacagagagagcaggugaccacccccgagaacaucaaccuggaccugaccuacagcgugcuguucaaccuggccagccaguacagcgugaacgagauguacgccgaggcccugaacaccuaccaggugaucgugaagaacaagauguucagcaacgccggcauccugaagaugaacaugggcaacaucuaccugaagcagagaaacuacagcaaggccaucaaguucuacagaauggcccuggaccaggugcccagcgugaacaagcagaugagaaucaagaucaugcagaacaucggcgugaccuucauccaggccggccaguacagcgacgccaucaacagcuacgagcacaucaugagcauggcccccaaccugaaggccggcuacaaccugaccaucugcuacuucgccaucggcgacagagagaagaugaagaaggccuuccagaagcugaucaccgugccccuggagaucgacgaggacaaguacaucagccccagcgacgacccccacaccaaccuggugaccgaggccaucaagaacgaccaccugagacagauggagagagagagaaaggccauggccgagaaguacaucaugaccagcgccaagcugaucgcccccgugaucgagaccagcuucgccgccggcuacgacuggugcguggagguggugaaggccagccaguacguggagcuggccaacgaccuggagaucaacaaggccgugaccuaccugagacagaaggacuacaaccaggccguggagauccugaaggugcuggagaagaaggacagcagagugaagagcgccgccgccaccaaccugagcgcccuguacuacaugggcaaggacuucgcccaggccagcagcuacgccgacaucgccgugaacagcgacagauacaaccccgccgcccugaccaacaagggcaacaccguguucgccaacggcgacuacgagaaggccgccgaguucuacaaggaggcccugagaaacgacagcagcugcaccgaggcccuguacaacaucggccugaccuacgagaagcugaacagacuggacgaggcccuggacugcuuccugaagcugcacgccauccugagaaacagcgccgaggugcuguaccagaucgccaacaucuacgagcugauggagaaccccagccaggccaucgaguggcugaugcagguggugagcgugauccccaccgacccccaggugcugagcaagcugggcgagcuguacgacagagagggcgacaagagccaggccuuccaguacuacuacgagagcuacagauacuuccccugcaacaucgaggugaucgaguggcugggcgccuacuacaucgacacccaguucugggagaaggccauccaguacuucgagagagccagccugauccagcccacccaggugaaguggcagcugaugguggccagcugcuucagaagaagcggcaacuaccagaaggcccuggacaccuacaaggacacccacagaaaguuccccgagaacguggagugccugagauuccuggugagacugugcaccgaccugggccugaaggacgcccaggaguacgccagaaagcugaagagacuggagaagaugaaggagaucagagagcagagaaucaagagcggcagagacggcagcggcggcagcagaggcaagagagagggcagcgccagcggcgacagcggccagaacuacagcgccagcagcaagggcgagagacugagcgccagacugagagcccugcccggcaccaacgagcccuacgagagcagcagcaacaaggagaucgacgccagcuacguggacccccugggcccccagaucgagagacccaagaccgccgccaagaagagaaucgacgaggacgacuucgccgacgaggagcugggcgacgaccugcugcccgaguaa

SEQ ID NO: 18412 - RNA, 1020 nt, Artificial Sequence
  IGBP1__Homo_sapiens__NP_001542
auggccgccgaggacgagcugcagcugcccagacugcccgagcuguucgagaccggcagacagcugcuggacgagguggagguggccaccgagcccgccggcagcagaaucgugcaggagaagguguucaagggccuggaccugcuggagaaggccgccgagaugcugagccagcuggaccuguucagcagaaacgaggaccuggaggagaucgccagcaccgaccugaaguaccugcuggugcccgccuuccagggcgcccugaccaugaagcaggugaaccccagcaagagacuggaccaccugcagagagccagagagcacuucaucaacuaccugacccagugccacugcuaccacguggccgaguucgagcugcccaagaccaugaacaacagcgccgagaaccacaccgccaacagcagcauggccuaccccagccugguggccauggccagccagagacaggccaagauccagagauacaagcagaagaaggagcuggagcacagacugagcgccaugaagagcgccguggagagcggccaggccgacgacgagagagugagagaguacuaccugcugcaccugcagagauggaucgacaucagccuggaggagaucgagagcaucgaccaggagaucaagauccugagagagagagacagcagcagagaggccagcaccagcaacagcagcagacaggagagaccccccgugaagcccuucauccugaccagaaacauggcccaggccaagguguucggcgccggcuaccccagccugcccaccaugaccgugagcgacugguacgagcagcacagaaaguacggcgcccugcccgaccagggcaucgccaaggccgcccccgaggaguucagaaaggccgcccagcagcaggaggagcaggaggagaaggaggaggaggacgacgagcagacccugcacagagccagagagugggacgacuggaaggacacccaccccagaggcuacggcaacagacagaacaugggcuaa

SEQ ID NO: 18413 - RNA, 2445 nt, Artificial Sequence
  IGDCC3__Homo_sapiens__NP_004875
auggccgugcagagagccgccagccccagaagaccccccgccccccuguggcccagacugcugcugccccugcugcugcugcugcugcccgcccccagcgagggccugggccacagcgccgagcuggccuucgccguggagcccagcgacgacguggccgugcccggccagcccaucgugcuggacugcagaguggagggcaccccccccgugagaaucaccuggagaaagaacggcguggagcugcccgagagcacccacagcacccugcuggccaacggcagccugaugaucagacacuucagacuggagcccggcggcagccccagcgacgagggcgacuacgagugcguggcccagaacagauucggccugguggugagcagaaaggccagaauccaggccgccaccaugagcgacuuccacgugcacccccaggccaccgugggcgaggagggcggcguggccagauuccagugccagauccacggccugcccaagccccugaucaccugggagaagaacagagugcccaucgacaccgacaacgagagauacacccugcugcccaagggcgugcugcagaucaccggccugagagccgaggacggcggcaucuuccacugcguggccagcaacaucgccagcaucagaaucagccacggcgccagacugaccgugagcggcagcggcagcggcgccuacaaggagcccgccauccuggugggccccgagaaccugacccugaccgugcaccagaccgccgugcuggagugcguggccaccggcaaccccagacccaucgugagcuggagcagacuggacggcagacccaucggcguggagggcauccaggugcugggcaccggcaaccugaucaucagcgacgugaccgugcagcacagcggcguguacgugugcgccgccaacagacccggcaccagagugagaagaaccgcccagggcagacugguggugcaggcccccgccgaguucgugcagcacccccagagcaucagcagacccgccggcaccaccgccauguucaccugccaggcccagggcgagccccccccccacgugaccuggcugaagaacggccaggugcugggccccggcggccacgugagacugaagaacaacaacagcacccugaccaucagcggcaucggccccgaggacgaggccaucuaccagugcguggccgagaacagcgccggcagcagccaggccagcgccagacugaccgugcugugggccgagggccugcccggcccccccagaaacgugagagccgugagcgugagcagcaccgaggugagagugagcuggagcgagccccuggccaacaccaaggagaucaucggcuacgugcugcacaucagaaaggccgccgacccccccgagcuggaguaccaggaggccgugagcaagagcaccuuccagcaccuggugagcgaccuggagcccagcaccgccuacagcuucuacaucaaggccuacacccccagaggcgccagcagcgccagcgugcccacccuggccagcacccugggcgaggcccccgccccccccccccugagcgugagagugcugggcagcagcagccugcagcugcugugggagcccuggcccagacuggcccagcacgagggcggcuucaagcuguucuacagacccgccagcaagaccagcuucaccggccccauccugcugcccggcaccgugagcagcuacaaccugagccagcuggaccccaccgccguguacgaggugaagcugcuggccuacaaccagcacggcgacggcaacgccaccgugagauucgugagccugagaggcgccagcgagagaaccgcccugagcccccccugcgacugcagaaaggaggaggccgccaaccagaccagcaccaccggcaucgugaucggcauccacaucggcgugaccugcaucaucuucugcgugcuguuccugcuguucggccagagaggcagagugcugcugugcaaggacguggagaaccagcugagccccccccagggccccagaagccagagagaccccggcauccuggcccugaacggcgccagaagaggccagagaggccagcugggcagagacgagaagagaguggacaugaaggagcuggagcagcuguucccccccgccagcgccgccggccagcccgaccccagacccacccaggaccccgccgcccccgcccccugcgaggagacccagcugagcgugcugccccugcagggcugcggccugauggagggcaagaccaccgaggccaagaccaccgaggccaccgcccccugcgccggccuggccgccgccccccccccccccgacggcggccccggccugcugagcgagggccaggccagcagacccgccgccgccagagugacccagcccgcccacagcgagcaguaa

SEQ ID NO: 18414 - RNA, 462 nt, Artificial Sequence
  IGF1__Homo_sapiens__NP_000609
augggcaagaucagcagccugcccacccagcuguucaagugcugcuucugcgacuuccugaaggugaagaugcacaccaugagcagcagccaccuguucuaccuggcccugugccugcugaccuucaccagcagcgccaccgccggccccgagacccugugcggcgccgagcugguggacgcccugcaguucgugugcggcgacagaggcuucuacuucaacaagcccaccggcuacggcagcagcagcagaagagccccccagaccggcaucguggacgagugcugcuucagaagcugcgaccugagaagacuggagauguacugcgccccccugaagcccgccaagagcgccagaagcgugagagcccagagacacaccgacaugcccaagacccagaaggaggugcaccugaagaacgccagcagaggcagcgccggcaacaagaacuacagaauguaa

SEQ ID NO: 18415 - RNA, 4104 nt, Artificial Sequence
  IGF1R__Homo_sapiens__NP_000866
augaagagcggcagcggcggcggcagccccaccagccuguggggccugcuguuccugagcgccgcccugagccuguggcccaccagcggcgagaucugcggccccggcaucgacaucagaaacgacuaccagcagcugaagagacuggagaacugcaccgugaucgagggcuaccugcacauccugcugaucagcaaggccgaggacuacagaagcuacagauuccccaagcugaccgugaucaccgaguaccugcugcuguucagaguggccggccuggagagccugggcgaccuguuccccaaccugaccgugaucagaggcuggaagcuguucuacaacuacgcccuggugaucuucgagaugaccaaccugaaggacaucggccuguacaaccugagaaacaucaccagaggcgccaucagaaucgagaagaacgccgaccugugcuaccugagcaccguggacuggagccugauccuggacgccgugagcaacaacuacaucgugggcaacaagccccccaaggagugcggcgaccugugccccggcaccauggaggagaagcccaugugcgagaagaccaccaucaacaacgaguacaacuacagaugcuggaccaccaacagaugccagaagaugugccccagcaccugcggcaagagagccugcaccgagaacaacgagugcugccaccccgagugccugggcagcugcagcgcccccgacaacgacaccgccugcguggccugcagacacuacuacuacgccggcgugugcgugcccgccugcccccccaacaccuacagauucgagggcuggagaugcguggacagagacuucugcgccaacauccugagcgccgagagcagcgacagcgagggcuucgugauccacgacggcgagugcaugcaggagugccccagcggcuucaucagaaacggcagccagagcauguacugcauccccugcgagggccccugccccaaggugugcgaggaggagaagaagaccaagaccaucgacagcgugaccagcgcccagaugcugcagggcugcaccaucuucaagggcaaccugcugaucaacaucagaagaggcaacaacaucgccagcgagcuggagaacuucaugggccugaucgagguggugaccggcuacgugaagaucagacacagccacgcccuggugagccugagcuuccugaagaaccugagacugauccugggcgaggagcagcuggagggcaacuacagcuucuacgugcuggacaaccagaaccugcagcagcugugggacugggaccacagaaaccugaccaucaaggccggcaagauguacuucgccuucaaccccaagcugugcgugagcgagaucuacagaauggaggaggugaccggcaccaagggcagacagagcaagggcgacaucaacaccagaaacaacggcgagagagccagcugcgagagcgacgugcugcacuucaccagcaccaccaccagcaagaacagaaucaucaucaccuggcacagauacagaccccccgacuacagagaccugaucagcuucaccguguacuacaaggaggcccccuucaagaacgugaccgaguacgacggccaggacgccugcggcagcaacagcuggaacaugguggacguggaccugccccccaacaaggacguggagcccggcauccugcugcacggccugaagcccuggacccaguacgccguguacgugaaggccgugacccugaccaugguggagaacgaccacaucagaggcgccaagagcgagauccuguacaucagaaccaacgccagcgugcccagcaucccccuggacgugcugagcgccagcaacagcagcagccagcugaucgugaaguggaacccccccagccugcccaacggcaaccugagcuacuacaucgugagauggcagagacagccccaggacggcuaccuguacagacacaacuacugcagcaaggacaagauccccaucagaaaguacgccgacggcaccaucgacaucgaggaggugaccgagaaccccaagaccgaggugugcggcggcgagaagggccccugcugcgccugccccaagaccgaggccgagaagcaggccgagaaggaggaggccgaguacagaaagguguucgagaacuuccugcacaacagcaucuucgugcccagacccgagagaaagagaagagacgugaugcagguggccaacaccaccaugagcagcagaagcagaaacaccaccgccgccgacaccuacaacaucaccgaccccgaggagcuggagaccgaguaccccuucuucgagagcagaguggacaacaaggagagaaccgugaucagcaaccugagacccuucacccuguacagaaucgacauccacagcugcaaccacgaggccgagaagcugggcugcagcgccagcaacuucguguucgccagaaccaugcccgccgagggcgccgacgacauccccggccccgugaccugggagcccagacccgagaacagcaucuuccugaaguggcccgagcccgagaaccccaacggccugauccugauguacgagaucaaguacggcagccagguggaggaccagagagagugcgugagcagacaggaguacagaaaguacggcggcgccaagcugaacagacugaaccccggcaacuacaccgccagaauccaggccaccagccugagcggcaacggcagcuggaccgaccccguguucuucuacgugcaggccaagaccggcuacgagaacuucauccaccugaucaucgcccugcccguggccgugcugcugaucgugggcggccuggugaucaugcuguacguguuccacagaaagagaaacaacagcagacugggcaacggcgugcuguacgccagcgugaaccccgaguacuucagcgccgccgacguguacgugcccgacgagugggagguggccagagagaagaucaccaugagcagagagcugggccagggcagcuucggcaugguguacgagggcguggccaagggcguggugaaggacgagcccgagaccagaguggccaucaagaccgugaacgaggccgccagcaugagagagagaaucgaguuccugaacgaggccagcgugaugaaggaguucaacugccaccacguggugagacugcugggcguggugagccagggccagcccacccuggugaucauggagcugaugaccagaggcgaccugaagagcuaccugagaagccugagacccgagauggagaacaaccccgugcuggccccccccagccugagcaagaugauccagauggccggcgagaucgccgacggcauggccuaccugaacgccaacaaguucgugcacagagaccuggccgccagaaacugcaugguggccgaggacuucaccgugaagaucggcgacuucggcaugaccagagacaucuacgagaccgacuacuacagaaagggcggcaagggccugcugcccgugagauggaugagccccgagagccugaaggacggcguguucaccaccuacagcgacguguggagcuucggcguggugcugugggagaucgccacccuggccgagcagcccuaccagggccugagcaacgagcaggugcugagauucgugauggagggcggccugcuggacaagcccgacaacugccccgacaugcuguucgagcugaugagaaugugcuggcaguacaaccccaagaugagacccagcuuccuggagaucaucagcagcaucaaggaggagauggagcccggcuucagagaggugagcuucuacuacagcgaggagaacaagcugcccgagcccgaggagcuggaccuggagcccgagaacauggagagcgugccccuggaccccagcgccagcagcagcagccugccccugcccgacagacacagcggccacaaggccgagaacggccccggccccggcgugcuggugcugagagccagcuucgacgagagacagcccuacgcccacaugaacggcggcagaaagaacgagagagcccugccccugccccagagcagcaccugcuaa

SEQ ID NO: 18416 - RNA, 1317 nt, Artificial Sequence
  IGF2BP1__Homo_sapiens__NP_001153895
augaacaagcuguacaucggcaaccugaacgagagcgugacccccgccgaccuggagaagguguucgccgagcacaagaucagcuacagcggccaguuccuggugaagagcggcuacgccuucguggacugccccgacgagcacugggccaugaaggccaucgagaccuucagcggcaagguggagcugcagggcaagagacuggagaucgagcacagcgugcccaagaagcagagaagcagaaagauccagaucagaaacauccccccccagcugagaugggaggugcuggacagccugcuggcccaguacggcaccguggagaacugcgagcaggugaacaccgagagcgagaccgccguggugaacgugaccuacagcaacagagagcagaccagacaggccgacgaggugccccugaagauccuggcccacaacaacuucgugggcagacugaucggcaaggagggcagaaaccugaagaagguggagcaggacaccgagaccaagaucaccaucagcagccugcaggaccugacccuguacaaccccgagagaaccaucaccgugaagggcgccaucgagaacugcugcagagccgagcaggagaucaugaagaaggugagagaggccuacgagaacgacguggccgccaugagccugcagagccaccugauccccggccugaaccuggccgccgugggccuguuccccgccagcagcagcgccgugccccccccccccagcagcgugaccggcgccgcccccuacagcagcuucaugcaggcccccgagcaggagauggugcagguguucauccccgcccaggccgugggcgccaucaucggcaagaagggccagcacaucaagcagcugagcagauucgccagcgccagcaucaagaucgccccccccgagacccccgacagcaaggugagaauggugaucaucaccggcccccccgaggcccaguucaaggcccagggcagaaucuacggcaagcugaaggaggagaacuucuucggccccaaggaggaggugaagcuggagacccacaucagagugcccgccagcgccgccggcagagugaucggcaagggcggcaagaccgugaacgagcugcagaaccugaccgccgccgaggugguggugcccagagaccagacccccgacgagaacgaccaggugaucgugaagaucaucggccacuucuacgccagccagauggcccagagaaagaucagagacauccuggcccaggugaagcagcagcaccagaagggccagagcaaccaggcccaggccagaagaaaguaa

SEQ ID NO: 18417 - RNA, 1671 nt, Artificial Sequence
  IGF2BP2__Homo_sapiens__NP_001007226
augaugaacaagcuguacaucggcaaccugagccccgccgugaccgccgacgaccugagacagcuguucggcgacagaaagcugccccuggccggccaggugcugcugaagagcggcuacgccuucguggacuaccccgaccagaacugggccaucagagccaucgagacccugagcggcaagguggagcugcacggcaagaucauggagguggacuacagcgugagcaagaagcugagaagcagaaagauccagaucagaaacauccccccccaccugcagugggaggugcuggacggccugcuggcccaguacggcaccguggagaacguggagcaggugaacaccgacaccgagaccgccguggugaacgugaccuacgccaccagagaggaggccaagaucgccauggagaagcugagcggccaccaguucgagaacuacagcuucaagaucagcuacauccccgacgaggaggugagcagccccagccccccccagagagcccagagaggcgaccacagcagcagagagcagggccacgcccccggcggcaccagccaggccagacagaucgacuucccccugagaauccuggugcccacccaguucgugggcgccaucaucggcaaggagggccugaccaucaagaacaucaccaagcagacccagagcagaguggacauccacagaaaggagaacagcggcgccgccgagaagcccgugaccauccacgccacccccgagggcaccagcgaggccugcagaaugauccuggagaucaugcagaaggaggccgacgagaccaagcuggccgaggagaucccccugaagauccuggcccacaacggccuggugggcagacugaucggcaaggagggcagaaaccugaagaagaucgagcacgagaccggcaccaagaucaccaucagcagccugcaggaccugagcaucuacaaccccgagagaaccaucaccgugaagggcaccguggaggccugcgccagcgccgagaucgagaucaugaagaagcugagagaggccuucgagaacgacaugcuggccgugaacacccacagcggcuacuucagcagccuguacccccaccaccaguucggccccuucccccaccaccacagcuaccccgagcaggagaucgugaaccuguucauccccacccaggccgugggcgccaucaucggcaagaagggcgcccacaucaagcagcuggccagauucgccggcgccagcaucaagaucgcccccgccgagggccccgacgugagcgagagaauggugaucaucaccggcccccccgaggcccaguucaaggcccagggcagaaucuucggcaagcugaaggaggagaacuucuucaaccccaaggaggaggugaagcuggaggcccacaucagagugcccagcagcaccgccggcagagugaucggcaagggcggcaagaccgugaacgagcugcagaaccugaccagcgccgaggugaucgugcccagagaccagacccccgacgagaacgaggaggugaucgugagaaucaucggccacuucuucgccagccagaccgcccagagaaagaucagagagaucgugcagcaggugaagcagcaggagcagaaguacccccagggcguggccagccagagaagcaaguaa

SEQ ID NO: 18418 - RNA, 1740 nt, Artificial Sequence
  IGF2BP3__Homo_sapiens__NP_006538
augaacaagcuguacaucggcaaccugagcgagaacgccgcccccagcgaccuggagagcaucuucaaggacgccaagauccccgugagcggccccuuccuggugaagaccggcuacgccuucguggacugccccgacgagagcugggcccugaaggccaucgaggcccugagcggcaagaucgagcugcacggcaagcccaucgagguggagcacagcgugcccaagagacagagaaucagaaagcugcagaucagaaacauccccccccaccugcagugggaggugcuggacagccugcuggugcaguacggcgugguggagagcugcgagcaggugaacaccgacagcgagaccgccguggugaacgugaccuacagcagcaaggaccaggccagacaggcccuggacaagcugaacggcuuccagcuggagaacuucacccugaagguggccuacauccccgacgagauggccgcccagcagaacccccugcagcagcccagaggcagaagaggccugggccagagaggcagcagcagacagggcagccccggcagcgugagcaagcagaagcccugcgaccugccccugagacugcuggugcccacccaguucgugggcgccaucaucggcaaggagggcgccaccaucagaaacaucaccaagcagacccagagcaagaucgacgugcacagaaaggagaacgccggcgccgccgagaagagcaucaccauccugagcacccccgagggcaccagcgccgccugcaagagcauccuggagaucaugcacaaggaggcccaggacaucaaguucaccgaggagaucccccugaagauccuggcccacaacaacuucgugggcagacugaucggcaaggagggcagaaaccugaagaagaucgagcaggacaccgacaccaagaucaccaucagcccccugcaggagcugacccuguacaaccccgagagaaccaucaccgugaagggcaacguggagaccugcgccaaggccgaggaggagaucaugaagaagaucagagagagcuacgagaacgacaucgccagcaugaaccugcaggcccaccugauccccggccugaaccugaacgcccugggccuguucccccccaccagcggcaugcccccccccaccagcggcccccccagcgccaugaccccccccuacccccaguucgagcagagcgagaccgagaccgugcaccuguucauccccgcccugagcgugggcgccaucaucggcaagcagggccagcacaucaagcagcugagcagauucgccggcgccagcaucaagaucgcccccgccgaggcccccgacgccaaggugagaauggugaucaucaccggcccccccgaggcccaguucaaggcccagggcagaaucuacggcaagaucaaggaggagaacuucgugagccccaaggaggaggugaagcuggaggcccacaucagagugcccagcuucgccgccggcagagugaucggcaagggcggcaagaccgugaacgagcugcagaaccugagcagcgccgaggugguggugcccagagaccagacccccgacgagaacgaccaggugguggugaagaucaccggccacuucuacgccugccagguggcccagagaaagauccaggagauccugacccaggugaagcagcaccagcagcagaaggcccugcagagcggccccccccagagcagaagaaaguaa

SEQ ID NO: 18419 - RNA, 711 nt, Artificial Sequence
  IGF2__Homo_sapiens__NP_001121070
auggugagccccgacccccagaucaucgugguggcccccgagaccgagcuggccagcaugcaggugcagagaaccgaggacggcgugaccaucauccagaucuucugggugggcagaaagggcgagcugcugagaagaacccccgugagcagcgccaugcagacccccaugggcauccccaugggcaagagcaugcuggugcugcugaccuuccuggccuucgccagcugcugcaucgccgccuacagacccagcgagacccugugcggcggcgagcugguggacacccugcaguucgugugcggcgacagaggcuucuacuucagcagacccgccagcagagugagcagaagaagcagaggcaucguggaggagugcugcuucagaagcugcgaccuggcccugcuggagaccuacugcgccacccccgccaagagcgagagagacgugagcaccccccccaccgugcugcccgacaacuuccccagauaccccgugggcaaguucuuccaguacgacaccuggaagcagagcacccagagacugagaagaggccugcccgcccugcugagagccagaagaggccacgugcuggccaaggagcuggaggccuucagagaggccaagagacacagaccccugaucgcccugcccacccaggaccccgcccacggcggcgccccccccgagauggccagcaacagaaaguaa

SEQ ID NO: 18420 - RNA, 7476 nt, Artificial Sequence
  IGF2R__Homo_sapiens__NP_000867
augggcgccgccgccggcagaagcccccaccugggccccgcccccgccagaagaccccagagaagccugcugcugcugcagcugcugcugcugguggccgcccccggcagcacccaggcccaggccgcccccuuccccgagcugugcagcuacaccugggaggccguggacaccaagaacaacgugcuguacaagaucaacaucugcggcagcguggacaucgugcagugcggccccagcagcgccgugugcaugcacgaccugaagaccagaaccuaccacagcgugggcgacagcgugcugagaagcgccaccagaagccugcuggaguucaacaccaccgugagcugcgaccagcagggcaccaaccacagagugcagagcagcaucgccuuccugugcggcaagacccugggcacccccgaguucgugaccgccaccgagugcgugcacuacuucgaguggagaaccaccgccgccugcaagaaggacaucuucaaggccaacaaggaggugcccugcuacguguucgacgaggagcugagaaagcacgaccugaacccccugaucaagcugagcggcgccuaccugguggacgacagcgaccccgacaccagccuguucaucaacgugugcagagacaucgacacccugagagaccccggcagccagcugagagccugcccccccggcaccgccgccugccuggugagaggccaccaggccuucgacgugggccagcccagagacggccugaagcuggugagaaaggacagacuggugcugagcuacgugagagaggaggccggcaagcuggacuucugcgacggccacagccccgccgugaccaucaccuucgugugccccagcgagagaagagagggcaccauccccaagcugaccgccaagagcaacugcagauacgagaucgaguggaucaccgaguacgccugccacagagacuaccuggagagcaagaccugcagccugagcggcgagcagcaggacgugagcaucgaccugaccccccuggcccagagcggcggcagcagcuacaucagcgacggcaaggaguaccuguucuaccugaacgugugcggcgagaccgagauccaguucugcaacaagaagcaggccgccgugugccaggugaagaagagcgacaccagccaggugaaggccgccggcagauaccacaaccagacccugagauacagcgacggcgaccugacccugaucuacuucggcggcgacgagugcagcagcggcuuccagagaaugagcgugaucaacuucgagugcaacaagaccgccggcaacgacggcaagggcacccccguguucaccggcgagguggacugcaccuacuucuucaccugggacaccgaguacgccugcgugaaggagaaggaggaccugcugugcggcgccaccgacggcaagaagagauacgaccugagcgcccuggugagacacgccgagcccgagcagaacugggaggccguggacggcagccagaccgagaccgagaagaagcacuucuucaucaacaucugccacagagugcugcaggagggcaaggccagaggcugccccgaggacgccgccgugugcgccguggacaagaacggcagcaagaaccugggcaaguucaucagcagccccaugaaggagaagggcaacauccagcugagcuacagcgacggcgacgacugcggccacggcaagaagaucaagaccaacaucacccuggugugcaagcccggcgaccuggagagcgcccccgugcugagaaccagcggcgagggcggcugcuucuacgaguucgaguggcacaccgccgccgccugcgugcugagcaagaccgagggcgagaacugcaccguguucgacagccaggccggcuucagcuucgaccugagcccccugaccaagaagaacggcgccuacaagguggagaccaagaaguacgacuucuacaucaacgugugcggccccgugagcgugagccccugccagcccgacagcggcgccugccagguggccaagagcgacgagaagaccuggaaccugggccugagcaacgccaagcugagcuacuacgacggcaugauccagcugaacuacagaggcggcacccccuacaacaacgagagacacacccccagagccacccugaucaccuuccugugcgacagagacgccggcgugggcuuccccgaguaccaggaggaggacaacagcaccuacaacuucagaugguacaccagcuacgccugccccgaggagccccuggagugcguggugaccgaccccagcacccuggagcaguacgaccugagcagccuggccaagagcgagggcggccugggcggcaacugguacgccauggacaacagcggcgagcacgugaccuggagaaaguacuacaucaacgugugcagaccccugaaccccgugcccggcugcaacagauacgccagcgccugccagaugaaguacgagaaggaccagggcagcuucaccgagguggugagcaucagcaaccugggcauggccaagaccggccccgugguggaggacagcggcagccugcugcuggaguacgugaacggcagcgccugcaccaccagcgacggcagacagaccaccuacaccaccagaauccaccuggugugcagcagaggcagacugaacagccaccccaucuucagccugaacugggagugcguggugagcuuccuguggaacaccgaggccgccugccccauccagaccaccaccgacaccgaccaggccugcagcaucagagaccccaacagcggcuucguguucaaccugaacccccugaacagcagccagggcuacaacgugagcggcaucggcaagaucuucauguucaacgugugcggcaccaugcccgugugcggcaccauccugggcaagcccgccagcggcugcgaggccgagacccagaccgaggagcugaagaacuggaagcccgccagacccgugggcaucgagaagagccugcagcugagcaccgagggcuucaucacccugaccuacaagggcccccugagcgccaagggcaccgccgacgccuucaucgugagauucgugugcaacgacgacguguacagcggcccccugaaguuccugcaccaggacaucgacagcggccagggcaucagaaacaccuacuucgaguucgagaccgcccuggccugcgugcccagccccguggacugccaggugaccgaccuggccggcaacgaguacgaccugaccggccugagcaccgugagaaagcccuggaccgccguggacaccagcguggacggcagaaagagaaccuucuaccugagcgugugcaacccccugcccuacauccccggcugccagggcagcgccgugggcagcugccuggugagcgagggcaacagcuggaaccugggcguggugcagaugagcccccaggccgccgccaacggcagccugagcaucauguacgugaacggcgacaagugcggcaaccagagauucagcaccagaaucaccuucgagugcgcccagaucagcggcagccccgccuuccagcugcaggacggcugcgaguacguguucaucuggagaaccguggaggccugccccguggugagaguggagggcgacaacugcgaggugaaggaccccagacacggcaaccuguacgaccugaagccccugggccugaacgacaccaucgugagcgccggcgaguacaccuacuacuucagagugugcggcaagcugagcagcgacgugugccccaccagcgacaagagcaagguggugagcagcugccaggagaagagagagccccagggcuuccacaagguggccggccugcugacccagaagcugaccuacgagaacggccugcugaagaugaacuucaccggcggcgacaccugccacaagguguaccagagaagcaccgccaucuucuucuacugcgacagaggcacccagagacccguguuccugaaggagaccagcgacugcagcuaccuguucgaguggagaacccaguacgccugcccccccuucgaccugaccgagugcagcuucaaggacggcgccggcaacagcuucgaccugagcagccugagcagauacagcgacaacugggaggccaucaccggcaccggcgaccccgagcacuaccugaucaacgugugcaagagccuggccccccaggccggcaccgagcccugcccccccgaggccgccgccugccugcugggcggcagcaagcccgugaaccugggcagagugagagacggcccccaguggagagacggcaucaucgugcugaaguacguggacggcgaccugugccccgacggcaucagaaagaagagcaccaccaucagauucaccugcagcgagagccaggugaacagcagacccauguucaucagcgccguggaggacugcgaguacaccuucgccuggcccaccgccaccgccugccccaugaagagcaacgagcacgacgacugccaggugaccaaccccagcaccggccaccuguucgaccugagcagccugagcggcagagccggcuucaccgccgccuacagcgagaagggccugguguacaugagcaucugcggcgagaacgagaacugcccccccggcgugggcgccugcuucggccagaccagaaucagcgugggcaaggccaacaagagacugagauacguggaccaggugcugcagcugguguacaaggacggcagccccugccccagcaagagcggccugagcuacaagagcgugaucagcuucgugugcagacccgaggccggccccaccaacagacccaugcugaucagccuggacaagcagaccugcacccuguucuucagcuggcacaccccccuggccugcgagcaggccaccgagugcagcgugagaaacggcagcagcaucguggaccugagcccccugauccacagaaccggcggcuacgaggccuacgacgagagcgaggacgacgccagcgacaccaaccccgacuucuacaucaacaucugccagccccugaaccccaugcacggcgugcccugccccgccggcgccgccgugugcaaggugcccaucgacggcccccccaucgacaucggcagaguggccggcccccccauccugaaccccaucgccaacgagaucuaccugaacuucgagagcagcacccccugccuggccgacaagcacuucaacuacaccagccugaucgccuuccacugcaagagaggcgugagcaugggcacccccaagcugcugagaaccagcgagugcgacuucguguucgagugggagacccccguggugugccccgacgaggugagaauggacggcugcacccugaccgacgagcagcugcuguacagcuucaaccugagcagccugagcaccagcaccuucaaggugaccagagacagcagaaccuacagcgugggcgugugcaccuucgccgugggccccgagcagggcggcugcaaggacggcggcgugugccugcugagcggcaccaagggcgccagcuucggcagacugcagagcaugaagcuggacuacagacaccaggacgaggccguggugcugagcuacgugaacggcgacagaugcccccccgagaccgacgacggcgugcccugcguguuccccuucaucuucaacggcaagagcuacgaggagugcaucaucgagagcagagccaagcuguggugcagcaccaccgccgacuacgacagagaccacgaguggggcuucugcagacacagcaacagcuacagaaccagcagcaucaucuucaagugcgacgaggacgaggacaucggcagaccccagguguucagcgaggugagaggcugcgacgugaccuucgaguggaagaccaagguggugugcccccccaagaagcuggagugcaaguucgugcagaagcacaagaccuacgaccugagacugcugagcagccugaccggcagcuggagccuggugcacaacggcgugagcuacuacaucaaccugugccagaagaucuacaagggcccccugggcugcagcgagagagccagcaucugcagaagaaccaccaccggcgacgugcaggugcugggccuggugcacacccagaagcugggcgugaucggcgacaaggugguggugaccuacagcaagggcuaccccugcggcggcaacaagaccgccagcagcgugaucgagcugaccugcaccaagaccgugggcagacccgccuucaagagauucgacaucgacagcugcaccuacuacuucagcugggacagcagagccgccugcgccgugaagccccaggaggugcagauggugaacggcaccaucaccaaccccaucaacggcaagagcuucagccugggcgacaucuacuucaagcuguucagagccagcggcgacaugagaaccaacggcgacaacuaccuguacgagauccagcugagcagcaucaccagcagcagaaaccccgccugcagcggcgccaacaucugccaggugaagcccaacgaccagcacuucagcagaaaggugggcaccagcgacaagaccaaguacuaccugcaggacggcgaccuggacgugguguucgccagcagcagcaagugcggcaaggacaagaccaagagcgugagcagcaccaucuucuuccacugcgacccccugguggaggacggcauccccgaguucagccacgagaccgccgacugccaguaccuguucagcugguacaccagcgccgugugcccccugggcgugggcuucgacagcgagaaccccggcgacgacggccagaugcacaagggccugagcgagagaagccaggccgugggcgccgugcugagccugcugcugguggcccugaccugcugccugcuggcccugcugcuguacaagaaggagagaagagagaccgugaucagcaagcugaccaccugcugcagaagaagcagcaacgugagcuacaaguacagcaaggugaacaaggaggaggagaccgacgagaacgagaccgaguggcugauggaggagauccagcugcccccccccagacagggcaaggagggccaggagaacggccacaucaccaccaagagcgugaaggcccugagcagccugcacggcgacgaccaggacagcgaggacgaggugcugaccauccccgaggugaaggugcacagcggcagaggcgccggcgccgagagcagccaccccgugagaaacgcccagagcaacgcccugcaggagagagaggacgacagagugggccuggugagaggcgagaaggccagaaagggcaagagcagcagcgcccagcagaagaccgugagcagcaccaagcuggugagcuuccacgacgacagcgacgaggaccugcugcacaucuaa

SEQ ID NO: 18421 - RNA, 1932 nt, Artificial Sequence
  IGFALS__Homo_sapiens__NP_001139478
auggcccugagaaaggccggcgaccuggagccccaguucacccccgagagaagauucagacugugcugguaccaggcccacagcggcagagcccugcugggcccccccccccaggccagcccccccgccggcggccuggcccuggcccugcugcugcugagcuggguggcccugggccccagaagccuggagggcgccgaccccggcacccccggcgaggccgagggccccgccugccccgccgccugcgugugcagcuacgacgacgacgccgacgagcugagcguguucugcagcagcagaaaccugaccagacugcccgacggcgugcccggcggcacccaggcccuguggcuggacggcaacaaccugagcagcgugccccccgccgccuuccagaaccugagcagccugggcuuccugaaccugcagggcggccagcugggcagccuggagccccaggcccugcugggccuggagaaccugugccaccugcaccuggagagaaaccagcugagaagccuggcccugggcaccuucgcccacacccccgcccuggccagccugggccugagcaacaacagacugagcagacuggaggacggccuguucgagggccugggcagccugugggaccugaaccugggcuggaacagccuggccgugcugcccgacgccgccuucagaggccugggcagccugagagagcuggugcuggccggcaacagacuggccuaccugcagcccgcccuguucagcggccuggccgagcugagagagcuggaccugagcagaaacgcccugagagccaucaaggccaacguguucgugcagcugcccagacugcagaagcuguaccuggacagaaaccugaucgccgccguggcccccggcgccuuccugggccugaaggcccugagauggcuggaccugagccacaacagaguggccggccugcuggaggacaccuuccccggccugcugggccugagagugcugagacugagccacaacgccaucgccagccugagacccagaaccuucaaggaccugcacuuccuggaggagcugcagcugggccacaacagaaucagacagcuggccgagagaagcuucgagggccugggccagcuggaggugcugacccuggaccacaaccagcugcaggaggugaaggccggcgccuuccugggccugaccaacguggccgugaugaaccugagcggcaacugccugagaaaccugcccgagcagguguucagaggccugggcaagcugcacagccugcaccuggagggcagcugccugggcagaaucagaccccacaccuucaccggccugagcggccugagaagacuguuccugaaggacaacggccuggugggcaucgaggagcagagccuguggggccuggccgagcugcuggagcuggaccugaccagcaaccagcugacccaccugccccacagacuguuccagggccugggcaagcuggaguaccugcugcugagcagaaacagacuggccgagcugcccgccgacgcccugggcccccugcagagagccuucuggcuggacgugagccacaacagacuggaggcccugcccaacagccugcuggccccccugggcagacugagauaccugagccugagaaacaacagccugagaaccuucaccccccagccccccggccuggagagacuguggcuggagggcaaccccugggacugcggcugcccccugaaggcccugagagacuucgcccugcagaaccccagcgccgugcccagauucgugcaggccaucugcgagggcgacgacugccagccccccgccuacaccuacaacaacaucaccugcgccagcccccccgagguggugggccuggaccugagagaccugagcgaggcccacuucgcccccugcuaa

SEQ ID NO: 18422 - RNA, 780 nt, Artificial Sequence
  IGFBP1__Homo_sapiens__NP_000587
augagcgaggugcccguggccagaguguggcuggugcugcugcugcugaccgugcaggugggcgugaccgccggcgcccccuggcagugcgcccccugcagcgccgagaagcuggcccugugcccccccgugagcgccagcugcagcgaggugaccagaagcgccggcugcggcugcugccccaugugcgcccugccccugggcgccgccugcggcguggccaccgccagaugcgccagaggccugagcugcagagcccugcccggcgagcagcagccccugcacgcccugaccagaggccagggcgccugcgugcaggagagcgacgccagcgccccccacgccgccgaggccggcagccccgagagccccgagagcaccgagaucaccgaggaggagcugcuggacaacuuccaccugauggcccccagcgaggaggaccacagcauccugugggacgccaucagcaccuacgacggcagcaaggcccugcacgugaccaacaucaagaaguggaaggagcccugcagaaucgagcuguacagagugguggagagccuggccaaggcccaggagaccagcggcgaggagaucagcaaguucuaccugcccaacugcaacaagaacggcuucuaccacagcagacagugcgagaccagcauggacggcgaggccggccugugcuggugcguguaccccuggaacggcaagagaauccccggcagccccgagaucagaggcgaccccaacugccagaucuacuucaacgugcagaacuaa

SEQ ID NO: 18423 - RNA, 987 nt, Artificial Sequence
  IGFBP2__Homo_sapiens__NP_000588
augcugcccagagugggcugccccgcccugccccugcccccccccccccugcugccccugcugccccugcugcugcugcugcugggcgccagcggcggcggcggcggcgccagagccgaggugcuguucagaugcccccccugcacccccgagagacuggccgccugcggccccccccccguggccccccccgccgccguggccgccguggccggcggcgccagaaugcccugcgccgagcuggugagagagcccggcugcggcugcugcagcgugugcgccagacuggagggcgaggccugcggcguguacacccccagaugcggccagggccugagaugcuacccccaccccggcagcgagcugccccugcaggcccuggugaugggcgagggcaccugcgagaagagaagagacgccgaguacggcgccagccccgagcagguggccgacaacggcgacgaccacagcgagggcggccugguggagaaccacguggacagcaccaugaacaugcugggcggcggcggcagcgccggcagaaagccccugaagagcggcaugaaggagcuggccguguucagagagaaggugaccgagcagcacagacagaugggcaagggcggcaagcaccaccugggccuggaggagcccaagaagcugagacccccccccgccagaacccccugccagcaggagcuggaccaggugcuggagagaaucagcaccaugagacugcccgacgagagaggcccccuggagcaccuguacagccugcacauccccaacugcgacaagcacggccuguacaaccugaagcagugcaagaugagccugaacggccagagaggcgagugcuggugcgugaaccccaacaccggcaagcugauccagggcgcccccaccaucagaggcgaccccgagugccaccuguucuacaacgagcagcaggaggccagaggcgugcacacccagagaaugcaguaa

SEQ ID NO: 18424 - RNA, 876 nt, Artificial Sequence
  IGFBP3__Homo_sapiens__NP_000589
augcagagagccagacccacccugugggccgccgcccugacccugcuggugcugcugagaggcccccccguggccagagccggcgccagcagcgccggccugggccccguggugagaugcgagcccugcgacgccagagcccuggcccagugcgcccccccccccgccgugugcgccgagcuggugagagagcccggcugcggcugcugccugaccugcgcccugagcgagggccagcccugcggcaucuacaccgagagaugcggcagcggccugagaugccagcccagccccgacgaggccagaccccugcaggcccugcuggacggcagaggccugugcgugaacgccagcgccgugagcagacugagagccuaccugcugcccgccccccccgcccccggcaacgccagcgagagcgaggaggacagaagcgccggcagcguggagagccccagcgugagcagcacccacagagugagcgaccccaaguuccacccccugcacagcaagaucaucaucaucaagaagggccacgccaaggacagccagagauacaagguggacuacgagagccagagcaccgacacccagaacuucagcagcgagagcaagagagagaccgaguacggccccugcagaagagagauggaggacacccugaaccaccugaaguuccugaacgugcugagccccagaggcgugcacauccccaacugcgacaagaagggcuucuacaagaagaagcagugcagacccagcaagggcagaaagagaggcuucugcuggugcguggacaaguacggccagccccugcccggcuacaccaccaagggcaaggaggacgugcacugcuacagcaugcagagcaaguaa

SEQ ID NO: 18425 - RNA, 777 nt, Artificial Sequence
  IGFBP4__Homo_sapiens__NP_001543
augcugccccugugccugguggccgcccugcugcuggccgccggccccggccccagccugggcgacgaggccauccacugcccccccugcagcgaggagaagcuggccagaugcagaccccccgugggcugcgaggagcuggugagagagcccggcugcggcugcugcgccaccugcgcccugggccugggcaugcccugcggcguguacacccccagaugcggcagcggccugagaugcuacccccccagaggcguggagaagccccugcacacccugaugcacggccagggcgugugcauggagcuggccgagaucgaggccauccaggagagccugcagcccagcgacaaggacgagggcgaccaccccaacaacagcuucagccccugcagcgcccacgacagaagaugccugcagaagcacuucgccaagaucagagacagaagcaccagcggcggcaagaugaaggugaacggcgcccccagagaggacgccagacccgugccccagggcagcugccagagcgagcugcacagagcccuggagagacuggccgccagccagagcagaacccacgaggaccuguacaucauccccauccccaacugcgacagaaacggcaacuuccaccccaagcagugccaccccgcccuggacggccagagaggcaagugcuggugcguggacagaaagaccggcgugaagcugcccggcggccuggagcccaagggcgagcuggacugccaccagcuggccgacagcuucagagaguaa

SEQ ID NO: 18426 - RNA, 819 nt, Artificial Sequence
  IGFBP5__Homo_sapiens__NP_000590
auggugcugcugaccgccgugcugcugcugcuggccgccuacgccggccccgcccagagccugggcagcuucgugcacugcgagcccugcgacgagaaggcccugagcaugugcccccccagcccccugggcugcgagcuggugaaggagcccggcugcggcugcugcaugaccugcgcccuggccgagggccagagcugcggcguguacaccgagagaugcgcccagggccugagaugccugcccagacaggacgaggagaagccccugcacgcccugcugcacggcagaggcgugugccugaacgagaagagcuacagagagcaggugaagaucgagagagacagcagagagcacgaggagcccaccaccagcgagauggccgaggagaccuacagccccaagaucuucagacccaagcacaccagaaucagcgagcugaaggccgaggccgugaagaaggacagaagaaagaagcugacccagagcaaguucgugggcggcgccgagaacaccgcccaccccagaaucaucagcgcccccgagaugagacaggagagcgagcagggccccugcagaagacacauggaggccagccugcaggagcugaaggccagccccagaauggugcccagagccguguaccugcccaacugcgacagaaagggcuucuacaagagaaagcagugcaagcccagcagaggcagaaagagaggcaucugcuggugcguggacaaguacggcaugaagcugcccggcauggaguacguggacggcgacuuccagugccacaccuucgacagcagcaacguggaguaa

SEQ ID NO: 18427 - RNA, 723 nt, Artificial Sequence
  IGFBP6__Homo_sapiens__NP_002169
augaccccccacagacugcugcccccccugcugcugcugcuggcccugcugcuggccgccagccccggcggcgcccuggccagaugccccggcugcggccagggcgugcaggccggcugccccggcggcugcguggaggaggaggacggcggcagccccgccgagggcugcgccgaggccgagggcugccugagaagagagggccaggagugcggcguguacacccccaacugcgcccccggccugcagugccacccccccaaggacgacgaggccccccugagagcccugcugcugggcagaggcagaugccugcccgccagagcccccgccguggccgaggagaaccccaaggagagcaagccccaggccggcaccgccagaccccaggacgugaacagaagagaccagcagagaaaccccggcaccagcaccacccccagccagcccaacagcgccggcgugcaggacaccgagaugggccccugcagaagacaccuggacagcgugcugcagcagcugcagaccgagguguacagaggcgcccagacccuguacgugcccaacugcgaccacagaggcuucuacagaaagagacagugcagaagcagccagggccagagaagaggccccugcuggugcguggacagaaugggcaagagccugcccggcagccccgacggcaacggcagcagcagcugccccaccggcagcagcggcuaa

SEQ ID NO: 18428 - RNA, 840 nt, Artificial Sequence
  IGFBP7__Homo_sapiens__NP_001240764
auggagagacccagccugagagcccugcugcugggcgccgccggccugcugcugcugcugcugccccugagcagcagcagcagcagcgacaccugcggccccugcgagcccgccagcugccccccccugcccccccugggcugccugcugggcgagaccagagacgccugcggcugcugccccaugugcgccagaggcgagggcgagcccugcggcggcggcggcgccggcagaggcuacugcgcccccggcauggagugcgugaagagcagaaagagaagaaagggcaaggccggcgccgccgccggcggccccggcgugagcggcgugugcgugugcaagagcagauaccccgugugcggcagcgacggcaccaccuaccccagcggcugccagcugagagccgccagccagagagccgagagcagaggcgagaaggccaucacccaggugagcaagggcaccugcgagcagggccccagcaucgugaccccccccaaggacaucuggaacgugaccggcgcccagguguaccugagcugcgaggugaucggcauccccacccccgugcugaucuggaacaaggugaagagaggccacuacggcgugcagagaaccgagcugcugcccggcgacagagacaaccuggccauccagaccagaggcggccccgagaagcacgaggugaccggcugggugcuggugagcccccugagcaaggaggacgccggcgaguacgagugccacgccagcaacagccagggccaggccagcgccagcgccaagaucaccgugguggacgcccugcacgagauccccgugaagaagggcacccaguaa

SEQ ID NO: 18429 - RNA, 837 nt, Artificial Sequence
  IGFBPL1__Homo_sapiens__NP_001007564
augcccagacugagccugcugcugccccugcugcugcugcugcugcugccccugcugcccccccugagccccagccugggcaucagagacgugggcggcagaagacccaagugcggccccugcagacccgagggcugccccgcccccgcccccugccccgcccccggcaucagcgcccuggacgagugcggcugcugcgccagaugccugggcgccgagggcgccagcugcggcggcagagccggcggcagaugcggccccggccuggugugcgccagccaggccgccggcgccgcccccgagggcaccggccugugcgugugcgcccagagaggcaccgugugcggcagcgacggcagaagcuaccccagcgugugcgcccugagacugagagccagacacacccccagagcccaccccggccaccugcacaaggccagagacggccccugcgaguucgcccccguggugguggugccccccagaagcgugcacaacgugaccggcgcccaggugggccugagcugcgaggugagagccgugcccacccccgugaucaccuggagaaaggugaccaagagccccgagggcacccaggcccuggaggagcugcccggcgaccacgugaacaucgccgugcaggugagaggcggccccagcgaccacgaggccaccgccuggauccugaucaacccccugagaaaggaggacgagggcguguaccagugccacgccgccaacauggugggcgaggccgagagccacagcaccgugaccgugcuggaccugagcaaguacagaagcuuccacuuccccgcccccgacgacagaauguaa

SEQ ID NO: 18430 - RNA, 333 nt, Artificial Sequence
  IGFL1__Homo_sapiens__NP_940943
auggcccccagaggcugcaucguggccguguucgccaucuucugcaucagcagacugcugugcagccacggcgcccccguggcccccaugacccccuaccugaugcugugccagccccacaagagaugcggcgacaaguucuacgacccccugcagcacugcugcuacgacgacgccguggugccccuggccagaacccagaccugcggcaacugcaccuucagagugugcuucgagcagugcugccccuggaccuucauggugaagcugaucaaccagaacugcgacagcgccagaaccagcgacgacagacugugcagaagcgugagcuaa

SEQ ID NO: 18431 - RNA, 1068 nt, Artificial Sequence
  IGFLR1__Homo_sapiens__NP_078936
augggccccggcagaugccugcugaccgcccugcugcugcuggcccuggcccccccccccgaggccagccaguacugcggcagacuggaguacuggaaccccgacaacaagugcugcagcagcugccugcagagauucggccccccccccugccccgacuacgaguucagagagaacugcggccugaacgaccacggcgacuucgugaccccccccuucagaaagugcagcagcggccagugcaaccccgacggcgccgagcugugcagccccugcggcggcggcgccgugacccccacccccgccgccggcggcggcagaacccccuggagaugcagagagagacccgugcccgccaagggccacugcccccugacccccggcaaccccggcgcccccagcagccaggagagaagcagccccgccagcagcaucgccuggagaacccccgagcccgugccccagcaggccuggcccaacuuccugccccugguggugcuggugcugcugcugacccuggccgugaucgccauccugcuguucauccugcuguggcaccugugcuggcccaaggagaaggccgaccccuaccccuaccccggccuggugugcggcgugcccaacacccacacccccagcagcagccaccugagcagccccggcgcccuggagaccggcgacaccuggaaggaggccagccugcugccccugcugagcagagagcugagcagccuggccagccagccccugagcagacugcuggacgagcuggaggugcuggaggagcugaucgugcugcuggaccccgagcccggccccggcggcggcauggcccacggcaccaccagacaccuggccgccagauacggccugcccgccgccuggagcaccuucgccuacagccugagacccagcagaagcccccugagagcccugaucgagauggugguggccagagagcccagcgccagccugggccagcugggcacccaccuggcccagcugggcagagccgacgcccugagagugcugagcaagcugggcagcagcggcgugugcugggccuaa

SEQ ID NO: 18432 - RNA, 2982 nt, Artificial Sequence
  IGHMBP2__Homo_sapiens__NP_002171
auggccagcgccgccguggagagcuucgugaccaagcagcuggaccugcuggagcuggagagagacgccgagguggaggagagaagaagcuggcaggagaacaucagccugaaggagcugcagagcagaggcgugugccugcugaagcugcaggugagcagccagagaaccggccuguacggcagacugcuggugaccuucgagcccagaagauacggcagcgccgccgcccugcccagcaacagcuucaccagcggcgacaucgugggccuguacgacgccgccaacgagggcagccagcuggccaccggcauccugaccagagugacccagaagagcgugaccguggccuucgacgagagccacgacuuccagcugagccuggacagagagaacagcuacagacugcugaagcuggccaacgacgugaccuacagaagacugaagaaggcccugaucgcccugaagaaguaccacagcggccccgccagcagccugaucgaggugcuguucggcagaagcgcccccagccccgccagcgagauccacccccugaccuucuucaacaccugccuggacaccagccagaaggaggccgugcuguucgcccugagccagaaggagcuggccaucauccacggcccccccggcaccggcaagaccaccaccgugguggagaucauccugcaggccgugaagcagggccugaaggugcugugcugcgcccccagcaacaucgccguggacaaccugguggagagacuggcccugugcaagcagagaauccugagacugggccaccccgccagacugcuggagagcauccagcagcacagccuggacgccgugcuggccagaagcgacagcgcccagaucguggccgacaucagaaaggacaucgaccagguguucgugaagaacaagaagacccaggacaagagagagaagagcaacuucagaaacgagaucaagcugcugagaaaggagcugaaggagagagaggaggccgccaugcuggagagccugaccagcgccaacguggugcuggccaccaacaccggcgccagcgccgacggcccccugaagcugcugcccgagagcuacuucgacgugguggugaucgacgagugcgcccaggcccuggaggccagcugcuggaucccccugcugaaggccagaaagugcauccuggccggcgaccacaagcagcugccccccaccaccgugagccacaaggccgcccuggccggccugagccugagccugauggagagacuggccgaggaguacggcgccagaguggugagaacccugaccgugcaguacagaaugcaccaggccaucaugagaugggccagcgacaccauguaccugggccagcugaccgcccacagcagcguggccagacaccugcugagagaccugcccggcguggccgccaccgaggagaccggcgugccccugcugcugguggacaccgccggcugcggccuguucgagcuggaggaggaggacgagcagagcaagggcaaccccggcgaggugagacuggugagccugcacauccaggcccugguggacgccggcgugcccgccagagacaucgccguggugagccccuacaaccugcagguggaccugcugagacagagccuggugcacagacaccccgagcuggagaucaagagcguggacggcuuccagggcagagagaaggaggccgugauccugagcuucgugagaagcaacagaaagggcgaggugggcuuccuggccgaggacagaagaaucaacguggccgugaccagagccagaagacacguggccgugaucugcgacagcagaaccgugaacaaccacgccuuccugaagacccugguggaguacuucacccagcacggcgaggugagaaccgccuucgaguaccuggacgacaucgugcccgagaacuacagccacgagaacagccagggcagcagccacgccgccaccaagccccagggccccgccaccagcaccagaaccggcagccagagacaggagggcggccaggaggccgccgcccccgccagacagggcagaaagaagcccgccggcaagagccuggccagcgaggcccccagccagcccagccugaacggcggcagccccgagggcguggagagccaggacggcguggaccacuucagagccaugaucguggaguucauggccagcaagaagaugcagcuggaguucccccccagccugaacagccacgacagacugagagugcaccagaucgccgaggagcacggccugagacacgacagcagcggcgagggcaagagaagauucaucaccgugagcaagagagcccccagacccagagccgcccugggcccccccgccggcaccggcggccccgccccccugcagcccgugccccccacccccgcccagaccgagcagccccccagagagcagagaggccccgaccagcccgaccugagaacccugcaccuggagagacugcagagagugagaagcgcccagggccagcccgccagcaaggagcagcaggccagcggccagcagaagcugcccgagaagaagaagaagaaggccaagggccaccccgccaccgaccugcccaccgaggaggacuucgaggcccuggugagcgccgccgugaaggccgacaacaccugcggcuucgccaagugcaccgccggcgugaccacccugggccaguucugccagcugugcagcagaagauacugccugagccaccaccugcccgagauccacggcugcggcgagagagccagagcccacgccagacagagaaucagcagagagggcgugcuguacgccggcagcggcaccaagaacggcagccuggaccccgccaagagagcccagcugcagagaagacuggacaagaagcugagcgagcugagcaaccagagaaccagcagaagaaaggagagaggcaccuaa

SEQ ID NO: 18433 - RNA, 480 nt, Artificial Sequence
  IGJ__Homo_sapiens__NP_653247
augaagaaccaccugcuguucuggggcgugcuggccguguucaucaaggccgugcacgugaaggcccaggaggacgagagaaucgugcugguggacaacaagugcaagugcgccagaaucaccagcagaaucaucagaagcagcgaggaccccaacgaggacaucguggagagaaacaucagaaucaucgugccccugaacaacagagagaacaucagcgaccccaccagcccccugagaaccagauucguguaccaccugagcgaccugugcaagaagugcgaccccaccgagguggagcuggacaaccagaucgugaccgccacccagagcaacaucugcgacgaggacagcgccaccgagaccugcuacaccuacgacagaaacaagugcuacaccgccguggugccccugguguacggcggcgagaccaagaugguggagaccgcccugacccccgacgccugcuaccccgacuaa

SEQ ID NO: 18434 - RNA, 642 nt, Artificial Sequence
  IGLL1__Homo_sapiens__NP_064455
augagacccggcaccggccagggcggccuggaggcccccggcgagcccggccccaaccugagacagagauggccccugcugcugcugggccuggccguggugacccacggccugcugagacccaccgccgccagccagagcagagcccugggccccggcgcccccggcggcagcagcagaagcagccugagaagcagauggggcagauuccugcugcagagaggcagcuggaccggccccagaugcuggcccagaggcuuccagagcaagcacaacagcgugacccacguguucggcagcggcacccagcugaccgugcugagccagcccaaggccacccccagcgugacccuguucccccccagcagcgaggagcugcaggccaacaaggccacccuggugugccugaugaacgacuucuaccccggcauccugaccgugaccuggaaggccgacggcacccccaucacccagggcguggagaugaccacccccagcaagcagagcaacaacaaguacgccgccagcagcuaccugagccugacccccgagcaguggagaagcagaagaagcuacagcugccaggugaugcacgagggcagcaccguggagaagaccguggcccccgccgagugcagcuaa

SEQ ID NO: 18435 - RNA, 7872 nt, Artificial Sequence
  IGSF10__Homo_sapiens__NP_849144
augaaggugaagggcagaggcaucaccugccugcuggugagcuucgccgugaucugccugguggccacccccggcggcaaggccugccccagaagaugcgccugcuacaugcccaccgaggugcacugcaccuucagauaccugaccagcauccccgacagcaucccccccaacguggagagaaucaaccugggcuacaacagccuggugagacugauggagaccgacuucagcggccugaccaagcuggagcugcugaugcugcacagcaacggcauccacaccauccccgacaagaccuucagcgaccugcaggcccugcaggugcugaagaugagcuacaacaaggugagaaagcugcagaaggacaccuucuacggccugagaagccugaccagacugcacauggaccacaacaacaucgaguucaucaaccccgagguguucuacggccugaacuuccugagacuggugcaccuggagggcaaccagcugaccaagcugcaccccgacaccuucgugagccugagcuaccugcagaucuucaagaucagcuucaucaaguuccuguaccugagcgacaacuuccugaccagccugccccaggagauggugagcuacaugcccgaccuggacagccuguaccugcacggcaaccccuggaccugcgacugccaccugaaguggcugagcgacuggauccaggagaagcccgacgugaucaagugcaagaaggacagaagccccagcagcgcccagcagugcccccugugcaugaaccccagaaccagcaagggcaagccccuggccauggugagcgccgccgccuuccagugcgccaagcccaccaucgacagcagccugaagagcaagagccugaccauccuggaggacagcagcagcgccuucaucagcccccagggcuucauggcccccuucggcagccugacccugaacaugaccgaccagagcggcaacgaggccaacauggugugcagcauccagaagcccagcagaaccagccccaucgccuucaccgaggagaacgacuacaucgugcugaacaccagcuucagcaccuuccuggugugcaacaucgacuacggccacauccagcccguguggcagauccuggcccuguacagcgacagcccccugauccuggagagaagccaccugcugagcgagaccccccagcuguacuacaaguacaagcagguggcccccaagcccgaggacaucuucaccaacaucgaggccgaccugagagccgaccccagcuggcugaugcaggaccagaucagccugcagcugaacagaaccgccaccaccuucagcacccugcagauccaguacagcagcgacgcccagaucacccugcccagagccgagaugagacccgugaagcacaaguggaccaugaucagcagagacaacaacaccaagcuggagcacaccgugcuggugggcggcaccgugggccugaacugccccggccagggcgaccccaccccccacguggacuggcugcuggccgacggcagcaaggugagagcccccuacgugagcgaggacggcagaauccugaucgacaagagcggcaagcuggagcugcagauggccgacagcuucgacaccggcguguaccacugcaucagcagcaacuacgacgacgccgacauccugaccuacagaaucaccgugguggagccccugguggaggccuaccaggagaacggcauccaccacaccguguucaucggcgagacccuggaccugcccugccacagcaccggcauccccgacgccagcaucagcugggugauccccggcaacaacgugcuguaccagagcagcagagacaagaaggugcugaacaacggcacccugagaauccugcaggugacccccaaggaccagggcuacuacagaugcguggccgccaaccccagcggcguggacuuccugaucuuccaggugagcgugaagaugaagggccagagaccccuggagcacgacggcgagaccgagggcagcggccuggacgagagcaaccccaucgcccaccugaaggagccccccggcgcccagcugagaaccagcgcccugauggaggccgaggugggcaagcacaccagcagcaccagcaagagacacaacuacagagagcugacccugcagagaagaggcgacagcacccacagaagauucagagagaacagaagacacuucccccccagcgccagaagaaucgacccccagcacugggccgcccugcuggagaaggccaagaagaacgccaugcccgacaagagagagaacaccaccgugagccccccccccguggugacccagcugcccaacauccccggcgaggaggacgacagcagcggcaugcuggcccugcacgaggaguucauggugcccgccaccaaggcccugaaccugcccgccagaaccgugaccgccgacagcagaaccaucagcgacagccccaugaccaacaucaacuacggcaccgaguucagccccguggugaacagccagauccugccccccgaggagcccaccgacuucaagcugagcaccgccaucaagaccaccgccaugagcaagaacaucaaccccaccaugagcagccagauccagggcaccaccaaccagcacagcagcaccguguucccccugcugcugggcgccaccgaguuccaggacagcgaccagaugggcagaggcagagagcacuuccagagcagaccccccaucaccgugagaaccaugaucaaggacgugaacgugaagaugcugagcagcaccaccaacaagcugcugcuggagagcgugaacaccaccaacagccaccagaccagcgugagagaggugagcgagcccagacacaaccacuucuacagccacaccacccagauccugagcaccagcaccuuccccagcgacccccacaccgccgcccacagccaguuccccauccccagaaacagcaccgugaacaucccccuguucagaagauucggcagacagagaaagaucggcggcagaggcagaaucaucagccccuacagaacccccgugcugagaagacacagauacagcaucuucagaagcaccaccagaggcagcagcgagaagagcaccaccgccuucagcgccaccgugcugaacgugaccugccugagcugccugcccagagagagacugaccaccgccaccgccgcccugagcuuccccagcgccgcccccaucaccuuccccaaggccgacaucgccagagugcccagcgaggagagcaccacccuggugcagaacccccugcugcugcuggagaacaagcccagcguggagaagaccacccccaccaucaaguacuucagaaccgagaucagccaggugacccccaccggcgccgugaugaccuacgcccccaccagcauccccauggagaagacccacaaggugaacgccagcuaccccagagugagcagcaccaacgaggccaagagagacagcgugaucaccagcagccugagcggcgccaucaccaagccccccaugaccaucaucgccaucaccagauucagcagaagaaagauccccuggcagcagaacuucgugaacaaccacaaccccaagggcagacugagaaaccagcacaaggugagccugcagaagagcaccgccgugaugcugcccaagaccagccccgcccugcccagagacaaggugagccccuuccacuucaccacccugagcaccagcgugaugcagauccccagcaacacccugaccaccgcccaccacaccaccaccaagacccacaaccccggcagccugcccaccaagaaggagcugcccuuccccccccugaaccccaugcugcccagcaucaucagcaaggacagcagcaccaagagcaucaucagcacccagaccgccauccccgccaccacccccaccuuccccgccagcgugaucaccuacgagacccagaccgagagaagcagagcccagaccauccagagagagcaggagccccagaagaagaacagaaccgaccccaacaucagccccgaccagagcagcggcuucaccacccccaccgccaugaccccccccgugcugaccaccgccgagaccagcgugaagcccagcgugagcgccuucacccacagcccccccgagaacaccaccggcaucagcagcaccaucagcuuccacagcagaacccugaaccugaccgacgugaucgaggagcuggcccaggccagcacccagacccugaagagcaccaucgccagcgagaccacccugagcagcaagagccaccagagcaccaccaccagaaaggccaucaucagacacagcaccaucccccccuuccugagcagcagcgccacccugaugcccgugcccaucagcccccccuucacccagagagccgugaccgacaacguggccacccccaucagcggccugaugaccaacaccguggugaagcugcacgagagcagcagacacaacgccaagccccagcagcugguggccgagguggccaccagccccaaggugcaccccaacgccaaguucaccaucggcaccacccacuucaucuacagcaaccugcugcacagcacccccaugcccgcccugaccaccgugaagagccagaacagcaagcugacccccagccccugggccgagaaccaguucuggcacaagcccuacagcgagaucgccgagaagggcaagaagcccgaggugagcaugcuggccaccaccggccugagcgaggccaccacccuggugagcgacugggacggccagaagaacaccaagaagagcgacuucgacaagaagcccgugcaggaggccaccaccagcaagcugcugcccuucgacagccugagcagauacaucuucgagaagcccagaaucgugggcggcaaggccgccagcuucaccauccccgccaacagcgacgccuuccugcccugcgaggccgugggcaacccccugcccaccauccacuggaccagagugcccagcggccuggaccugagcaagagaaagcagaacagcagagugcaggugcugcccaacggcacccugagcauccagagaguggagauccaggacagaggccaguaccugugcagcgccagcaaccuguucggcaccgaccaccugcacgugacccugagcguggugagcuacccccccagaauccuggagagaagaaccaaggagaucaccgugcacagcggcagcaccguggagcugaagugcagagccgagggcagacccagccccaccgugaccuggauccuggccaaccagaccguggugagcgagagcagccagggcagcagacaggccguggugaccguggacggcacccuggugcugcacaaccugagcaucuacgacagaggcuucuacaagugcguggccagcaaccccggcggccaggacagccugcuggugaagauccaggugaucgccgccccccccgugauccuggagcagagaagacaggugaucgugggcaccuggggcgagagccugaagcugcccugcaccgccaagggcaccccccagcccagcguguacugggugcugagcgacggcaccgaggugaagccccugcaguucaccaacagcaagcuguuccuguucagcaacggcacccuguacaucagaaaccuggccagcagcgacagaggcaccuacgagugcaucgccaccagcagcaccggcagcgagagaagaguggugaugcugaccauggaggagagagugaccagccccagaaucgaggccgccagccagaagagaaccgaggugaacuucggcgacaagcugcugcugaacugcagcgccaccggcgagcccaagccccagaucauguggagacugcccagcaaggccgugguggaccagcagcacagagugggcagcuggauccacguguaccccaacggcagccuguucaucggcagcgugaccgagaaggacagcggcguguaccugugcguggccagaaacaagaugggcgacgaccugauccugaugcacgugagccugagacugaagcccgccaagaucgaccacaagcaguacuucagaaagcaggugcugcacggcaaggacuuccagguggacugcaaggccagcggcagccccgugcccgagaucagcuggagccugcccgacggcaccaugaucaacaacgccaugcaggccgacgacagcggccacagaaccagaagauacacccuguucaacaacggcacccuguacuucaacaaggugggcguggccgaggagggcgacuacaccugcuacgcccagaacacccugggcaaggacgagaugaaggugcaccugaccgugaucaccgccgcccccagaaucagacagagcaacaagaccaacaagagaaucaaggccggcgacaccgccgugcuggacugcgaggugaccggcgaccccaagcccaagaucuucuggcugcugcccagcaacgacaugaucagcuucagcaucgacagauacaccuuccacgccaacggcagccugaccaucaacaaggugaagcugcuggacagcggcgaguacgugugcguggccagaaaccccagcggcgacgacaccaagauguacaagcuggacguggugagcaagcccccccugaucaacggccuguacaccaacagaaccgugaucaaggccaccgccgugagacacagcaagaagcacuucgacugcagagccgagggcacccccagccccgaggugauguggaucaugcccgacaacaucuuccugaccgcccccuacuacggcagcagaaucaccgugcacaagaacggcacccuggagaucagaaacgugagacugagcgacagcgccgacuucaucugcguggccagaaacgagggcggcgagagcgugcugguggugcagcuggaggugcuggagaugcugagaagacccaccuucagaaaccccuucaacgagaagaucguggcccagcugggcaagagcaccgcccugaacugcagcguggacggcaaccccccccccgagaucaucuggauccugcccaacggcaccagauucagcaacggcccccagagcuaccaguaccugaucgccagcaacggcagcuucaucaucagcaagaccaccagagaggacgccggcaaguacagaugcgccgccagaaacaaggugggcuacaucgagaagcuggugauccuggagaucggccagaagcccgugauccugaccuacgcccccggcaccgugaagggcaucagcggcgagagccugagccugcacugcgugagcgacggcauccccaagcccaacaucaaguggaccaugcccagcggcuacgugguggacagaccccagaucaacggcaaguacauccugcacgacaacggcacccuggugaucaaggaggccaccgccuacgacagaggcaacuacaucugcaaggcccagaacagcgugggccacacccugaucaccgugcccgugaugaucguggccuacccccccagaaucaccaacagaccccccagaagcaucgugaccagaaccggcgccgccuuccagcugcacugcguggcccugggcgugcccaagcccgagaucaccugggagaugcccgaccacagccugcugagcaccgccagcaaggagagaacccacggcagcgagcagcugcaccugcagggcacccuggugauccagaacccccagaccagcgacagcggcaucuacaagugcaccgccaagaacccccugggcagcgacuacgccgccaccuacauccaggugaucuaa

SEQ ID NO: 18436 - RNA, 1296 nt, Artificial Sequence
  IGSF11__Homo_sapiens__NP_001015887
augaccagccagagaagcccccuggccccccugcugcugcugagccugcacggcguggccgccagccuggaggugagcgagagccccggcagcauccagguggccagaggccagcccgccgugcugcccugcaccuucaccaccagcgccgcccugaucaaccugaacgugaucuggauggugaccccccugagcaacgccaaccagcccgagcaggugauccuguaccagggcggccagauguucgacggcgcccccagauuccacggcagagugggcuucaccggcaccaugcccgccaccaacgugagcaucuucaucaacaacacccagcugagcgacaccggcaccuaccagugccuggugaacaaccugcccgacaucggcggcagaaacaucggcgugaccggccugaccgugcuggugccccccagcgccccccacugccagauccagggcagccaggacaucggcagcgacgugauccugcugugcagcagcgaggagggcauccccagacccaccuaccugugggagaagcuggacaacacccugaagcugccccccaccgccacccaggaccaggugcagggcaccgugaccaucagaaacaucagcgcccugagcagcggccuguaccagugcguggccagcaacgccaucggcaccagcaccugccugcuggaccugcaggugaucagcccccagcccagaaacaucggccugaucgccggcgccaucggcaccggcgccgugaucaucaucuucugcaucgcccugauccugggcgccuucuucuacuggagaagcaagaacaaggaggaggaggaggaggagauccccaacgagaucagagaggacgaccugccccccaagugcagcagcgccaaggccuuccacaccgagaucagcagcagcgacaacaacacccugaccagcagcaacgccuacaacagcagauacuggagcaacaaccccaaggugcacagaaacaccgagagcgugagccacuucagcgaccugggccagagcuucagcuuccacagcggcaacgccaacauccccagcaucuacgccaacggcacccaccuggugcccggccagcacaagacccugguggugaccgccaacagaggcagcagcccccaggugaugagcagaagcaacggcagcgugagcagaaagcccagacccccccacacccacagcuacaccaucagccacgccacccuggagagaaucggcgccgugcccgugauggugcccgcccagagcagagccggcagccugguguaa

SEQ ID NO: 18437 - RNA, 4026 nt, Artificial Sequence
  IGSF1__Homo_sapiens__NP_001164432
augacccuggacagacccggcgagggcgccaccaugcugaagaccuucaccgugcugcuguucugcaucagaaugagccugggcaugaccagcaucgugauggacccccagcccgagcuguggaucgagagcaacuacccccaggcccccugggagaacaucacccuguggugcagaagccccagcagaaucagcagcaaguuccugcugcugaaggacaagacccagaugaccuggaucagacccagccacaagaccuuccaggugagcuuccugaucggcgcccugaccgagagcaacgccggccuguacagaugcugcuacuggaaggagaccggcuggagcaagcccagcaaggugcuggagcuggaggcccccggccagcugcccaagcccaucuucuggauccaggccgagacccccgcccugcccggcugcaacgugaacauccugugccacggcuggcugcaggaccugguguucaugcuguucaaggagggcuacgccgagcccguggacuaccaggugcccaccggcaccauggccaucuucagcaucgacaaccugacccccgaggacgagggcguguacaucugcagaacccacauccagaugcugcccacccuguggagcgagcccagcaacccccugaagcuggugguggccggccuguaccccaagcccacccugaccgcccaccccggccccaucauggcccccggcgagagccugaaccugagaugccagggccccaucuacggcaugaccuucgcccugaugagaguggaggaccuggagaagagcuucuaccacaagaagaccaucaagaacgaggccaacuucuucuuccagagccugaagauccaggacaccggccacuaccugugcuucuacuacgacgccagcuacagaggcagccugcugagcgacgugcugaagaucugggugaccgacaccuuccccaagaccuggcugcuggccagacccagcgccguggugcagaugggccagaacgugagccugagaugcagaggccccguggacggcgugggccuggcccuguacaagaagggcgaggacaagccccugcaguuccuggacgccaccagcaucgacgacaacaccagcuucuuccugaacaacgugaccuacagcgacaccggcaucuacagcugccacuaccugcugaccuggaagaccagcaucagaaugcccagccacaacaccguggagcugauggugguggacaagccccccaagcccagccugagcgccuggcccagcaccguguucaagcugggcaaggccaucacccugcagugcagagugagccaccccgugcuggaguucagccuggagugggaggagagagagaccuuccagaaguucagcgugaacggcgacuucaucaucagcaacguggacggcaagggcaccggcaccuacagcugcagcuacagaguggagacccaccccaacaucuggagccacagaagcgagccccugaagcugaugggccccgccggcuaccugaccuggaacuacgugcugaacgaggccaucagacugagccugaucaugcagcugguggcccugcugcugguggugcuguggaucagauggaagugcagaagacugagaaucagagaggccuggcugcugggcaccgcccagggcgugaccaugcuguucaucgugaccgcccugcugugcugcgccaucagcuucgccggccugugcaacggcgugcugaucgaggagaccgagaucgugaugcccacccccaagcccgagcugugggccgagaccaacuucccccuggcccccuggaagaaccugacccuguggugcagaagccccagcggcagcaccaaggaguucgugcugcugaaggacggcaccggcuggaucgccaccagacccgccagcgagcaggugagagccgccuucccccugggcgcccugacccagagccacaccggcagcuaccacugccacagcugggaggagauggccgugagcgagcccagcgaggcccuggagcuggugggcaccgacauccugcccaagcccgugaucagcgccagccccaccaucagaggccaggagcugcagcugagaugcaagggcuggcuggccggcaugggcuucgcccuguacaaggagggcgagcaggagcccgugcagcagcugggcgccgugggcagagaggccuucuucaccauccagagaauggaggacaaggacgagggcaacuacagcugcagaacccacaccgagaagagacccuucaaguggagcgagcccagcgagccccuggagcuggugaucaaggagauguaccccaagcccuucuucaagaccugggccagccccguggugacccccggcgccagagugaccuucaacugcagcaccccccaccagcacaugagcuucauccuguacaaggacggcagcgagaucgccagcagcgacagaagcugggccagccccggcgccagcgccgcccacuuccugaucaucagcgugggcaucggcgacggcggcaacuacagcugcagauacuacgacuucagcaucuggagcgagcccagcgaccccguggagcugguggugaccgaguucuaccccaagcccacccugcuggcccagcccggccccgugguguuccccggcaagagcgugauccugagaugccagggcaccuuccagggcaugagauucgcccugcugcaggagggcgcccacgugccccugcaguucagaagcgugagcggcaacagcgccgacuuccugcugcacaccgugggcgccgaggacagcggcaacuacagcugcaucuacuacgagaccaccaugagcaacagaggcagcuaccugagcaugccccugaugaucugggugaccgacaccuuccccaagcccuggcuguucgccgagcccagcagcguggugcccaugggccagaacgugacccuguggugcagaggccccgugcacggcgugggcuacauccugcacaaggagggcgaggccaccagcaugcagcuguggggcagcaccagcaacgacggcgccuuccccaucaccaacaucagcggcaccagcaugggcagauacagcugcugcuaccaccccgacuggaccagcagcaucaagauccagcccagcaacacccuggagcugcuggugaccggccugcugcccaagcccagccugcuggcccagcccggccccaugguggcccccggcgagaacaugacccugcagugccagggcgagcugcccgacagcaccuucgugcugcugaaggagggcgcccaggagccccuggagcagcagagacccagcggcuacagagccgacuucuggaugcccgccgugagaggcgaggacagcggcaucuacagcugcguguacuaccuggacagcacccccuucgccgccagcaaccacagcgacagccuggagaucugggugaccgacaagccccccaagcccagccugagcgccuggcccagcaccauguucaagcugggcaaggacaucacccugcagugcagaggcccccugcccggcguggaguucgugcuggagcacgacggcgaggaggccccccagcaguucagcgaggacggcgacuucgugaucaacaacguggagggcaagggcaucggcaacuacagcugcagcuacagacugcaggccuaccccgacaucuggagcgagcccagcgacccccuggagcuggugggcgccgccggccccguggcccaggagugcaccgugggcaacaucgugagaagcagccugaucguggugguggugguggcccugggcguggugcuggccaucgaguggaagaaguggcccagacugagaaccagaggcagcgagaccgacggcagagaccagaccaucgcccuggaggagugcaaccaggagggcgagcccggcacccccgccaacagccccagcagcaccagccagagaaucagcguggagcugcccgugcccaucuaa

SEQ ID NO: 18438 - RNA, 1224 nt, Artificial Sequence
  IGSF5__Homo_sapiens__NP_001073913
augggccagaaggagagaagcaccgccgacacccugcccgaccuggaggaguggaagagcgccgccggccugagaugguggcagaccgccgugguggacggcagcggcagcggcaacgaggugaucgagggcccccagaacgccagagugcugaagggcagccaggccagauucaacugcaccgugagccagggcuggaagcugaucaugugggcccugagcgacaugguggugcugagcgugagacccauggagcccaucaucaccaacgacagauucaccagccagagauacgaccagggcggcaacuucaccagcgagaugaucauccacaacguggagcccagcgacagcggcaacaucagaugcagccugcagaacagcagacugcacggcagcgccuaccugaccgugcaggugaugggcgagcuguucauccccagcgugaaccuggugguggccgagaacgagcccugcgaggugaccugccugcccagccacuggaccagacugcccgacaucagcugggagcugggccugcuggugagccacagcagcuacuacuucgugcccgagcccagcgaccugcagagcgccgugagcauccuggcccugaccccccagagcaacggcacccugaccugcguggccaccuggaagagccugaaggccagaaagagcgccaccgugaaccugaccgugaucagaugcccccaggacaccggcggcggcaucaacauccccggcgugcugagcagccugcccagccugggcuucagccugcccaccuggggcaaggugggccugggccuggccggcaccaugcugcugacccccaccugcacccugaccaucagaugcugcugcugcagaagaagaugcugcggcugcaacugcugcugcagaugcugcuucugcugcagaagaaagagaggcuucagaauccaguuccagaagaagagcgagaaggagaagaccaacaaggagaccgagaccgagagcggcaacgagaacagcggcuacaacagcgacgagcagaagaccaccgacaccgccagccugccccccaagagcugcgagagcagcgaccccgagcagagaaacagcagcugcggccccccccaccagagagccgaccagagaccccccagacccgccagccacccccaggccagcuucaaccuggccagccccgagaaggugagcaacaccaccgugguguaa

SEQ ID NO: 18439 - RNA, 726 nt, Artificial Sequence
  IGSF6__Homo_sapiens__NP_005840
augggcaccgccagcagaagcaacaucgccagacaccugcagaccaaccugauccuguucugcgugggcgccgugggcgccugcacccugagcgugacccagcccugguaccuggagguggacuacacccacgaggccgugaccaucaagugcaccuucagcgccaccggcugccccagcgagcagcccaccugccugugguucagauacggcgcccaccagcccgagaaccugugccuggacggcugcaagagcgaggccgacaaguucaccgugagagaggcccugaaggagaaccaggugagccugaccgugaacagagugaccagcaacgacagcgccaucuacaucugcggcaucgccuuccccagcgugcccgaggccagagccaagcagaccggcggcggcaccacccugguggugagagagaucaagcugcugagcaaggagcugagaagcuuccugaccgcccuggugagccugcugagcguguacgugaccggcgugugcguggccuucauccugcugagcaagagcaagagcaacccccugagaaacaaggagaucaaggaggacagccagaagaagaagagcgccagaagaaucuuccaggagaucgcccaggagcuguaccacaagagacacguggagaccaaccagcagagcgagaaggacaacaacaccuacgagaacagaagagugcugagcaacuacgagagacccuaa

SEQ ID NO: 18440 - RNA, 1842 nt, Artificial Sequence
  IGSF8__Homo_sapiens__NP_001193594
augggcgcccugagacccacccugcugccccccagccugccccugcugcugcugcugaugcugggcaugggcugcugggccagagaggugcuggugcccgagggcccccuguacagaguggccggcaccgccgugagcaucagcugcaacgugaccggcuacgagggccccgcccagcagaacuucgagugguuccuguacagacccgaggcccccgacaccgcccugggcaucgugagcaccaaggacacccaguucagcuacgccguguucaagagcagagugguggccggcgaggugcaggugcagagacugcagggcgacgccguggugcugaagaucgccagacugcaggcccaggacgccggcaucuacgagugccacacccccagcaccgacaccagauaccugggcagcuacagcggcaagguggagcugagagugcugcccgacgugcugcaggugagcgccgccccccccggccccagaggcagacaggcccccaccagcccccccagaaugaccgugcacgagggccaggagcuggcccugggcugccuggccagaaccagcacccagaagcacacccaccuggccgugagcuucggcagaagcgugcccgaggcccccgugggcagaagcacccugcaggagguggugggcaucagaagcgaccuggccguggaggccggcgcccccuacgccgagagacuggccgccggcgagcugagacugggcaaggagggcaccgacagauacagaaugguggugggcggcgcccaggccggcgacgccggcaccuaccacugcaccgccgccgaguggauccaggaccccgacggcagcugggcccagaucgccgagaagagagccgugcuggcccacguggacgugcagacccugagcagccagcuggccgugaccgugggccccggcgagagaagaaucggccccggcgagccccuggagcugcugugcaacgugagcggcgcccugccccccgccggcagacacgccgccuacagcgugggcugggagauggcccccgccggcgcccccggccccggcagacugguggcccagcuggacaccgagggcgugggcagccugggccccggcuacgagggcagacacaucgccauggagaagguggccagcagaaccuacagacugagacuggaggccgccagacccggcgacgccggcaccuacagaugccuggccaaggccuacgugagaggcagcggcaccagacugagagaggccgccagcgccagaagcagaccccugcccgugcacgugagagaggagggcguggugcuggaggccguggccuggcuggccggcggcaccguguacagaggcgagaccgccagccugcugugcaacaucagcgugagaggcggcccccccggccugagacuggccgccagcugguggguggagagacccgaggacggcgagcugagcagcgugcccgcccagcuggugggcggcgugggccaggacggcguggccgagcugggcgugagacccggcggcggccccgugagcguggagcuggugggccccagaagccacagacugagacugcacagccugggccccgaggacgagggcguguaccacugcgcccccagcgccugggugcagcacgccgacuacagcugguaccaggccggcagcgccagaagcggccccgugaccguguaccccuacaugcacgcccuggacacccuguucgugccccugcuggugggcaccggcguggcccuggugaccggcgccaccgugcugggcaccaucaccugcugcuucaugaagagacugagaaagagauaa

SEQ ID NO: 18441 - RNA, 1236 nt, Artificial Sequence
  IHH__Homo_sapiens__NP_002172
augagccccgccagacugagacccagacugcacuucugccuggugcugcugcugcugcugguggugcccgccgccuggggcugcggccccggcagaguggugggcagcagaagaagaccccccagaaagcuggugccccuggccuacaagcaguucagccccaacgugcccgagaagacccugggcgccagcggcagauacgagggcaagaucgccagaagcagcgagagauucaaggagcugacccccaacuacaaccccgacaucaucuucaaggacgaggagaacaccggcgccgacagacugaugacccagagaugcaaggacagacugaacagccuggccaucagcgugaugaaccaguggcccggcgugaagcugagagugaccgagggcugggacgaggacggccaccacagcgaggagagccugcacuacgagggcagagccguggacaucaccaccagcgacagagacagaaacaaguacggccugcuggccagacuggccguggaggccggcuucgacuggguguacuacgagagcaaggcccacgugcacugcagcgugaagagcgagcacagcgccgccgccaagaccggcggcugcuuccccgccggcgcccaggugagacuggagagcggcgccagaguggcccugagcgccgugagacccggcgacagagugcuggccaugggcgaggacggcagccccaccuucagcgacgugcugaucuuccuggacagagagccccacagacugagagccuuccaggugaucgagacccaggacccccccagaagacuggcccugacccccgcccaccugcuguucaccgccgacaaccacaccgagcccgccgccagauucagagccaccuucgccagccacgugcagcccggccaguacgugcugguggccggcgugcccggccugcagcccgccagaguggccgccgugagcacccacguggcccugggcgccuacgccccccugaccaagcacggcacccuggugguggaggacgugguggccagcugcuucgccgccguggccgaccaccaccuggcccagcuggccuucuggccccugagacuguuccacagccuggccuggggcagcuggacccccggcgagggcgugcacugguacccccagcugcuguacagacugggcagacugcugcuggaggagggcagcuuccacccccugggcaugagcggcgccggcagcuaa

SEQ ID NO: 18442 - RNA, 3999 nt, Artificial Sequence
  IKBKAP__Homo_sapiens__NP_003631
augagaaaccugaagcuguucagaacccuggaguucagagacauccagggccccggcaacccccagugcuucagccugagaaccgagcagggcaccgugcugaucggcagcgagcacggccugaucgagguggaccccgugagcagagaggugaagaacgaggugagccugguggccgagggcuuccugcccgaggacggcagcggcagaaucgugggcgugcaggaccugcuggaccaggagagcgugugcguggccaccgccagcggcgacgugauccugugcagccugagcacccagcagcuggagugcgugggcagcguggccagcggcaucagcgugaugagcuggagccccgaccaggagcuggugcugcuggccaccggccagcagacccugaucaugaugaccaaggacuucgagcccauccuggagcagcagauccaccaggacgacuucggcgagagcaaguucaucaccgugggcuggggcagaaaggagacccaguuccacggcagcgagggcagacaggccgccuuccagaugcagaugcacgagagcgcccugcccugggacgaccacagaccccaggugaccuggagaggcgacggccaguucuucgccgugagcguggugugccccgagaccggcgccagaaaggugagaguguggaacagagaguucgcccugcagagcaccagcgagcccguggccggccugggccccgcccuggccuggaagcccagcggcagccugaucgccagcacccaggacaagcccaaccagcaggacaucguguucuucgagaagaacggccugcugcacggccacuucacccugcccuuccugaaggacgaggugaaggugaacgaccugcuguggaacgccgacagcagcgugcuggccguguggcuggaggaccugcagagagaggagagcagcauccccaagaccugcgugcagcuguggaccgugggcaacuaccacugguaccugaagcagagccugagcuucagcaccugcggcaagagcaagaucgugagccugaugugggaccccgugacccccuacagacugcacgugcugugccagggcuggcacuaccuggccuacgacuggcacuggaccaccgacagaagcgugggcgacaacagcagcgaccugagcaacguggccgugaucgacggcaacagagugcuggugaccguguucagacagaccguggugcccccccccaugugcaccuaccagcugcuguucccccaccccgugaaccaggugaccuuccuggcccacccccagaagagcaacgaccuggccgugcuggacgccagcaaccagaucagcguguacaagugcggcgacugccccagcgccgaccccaccgugaagcugggcgccgugggcggcagcggcuucaaggugugccugagaaccccccaccuggagaagagauacaagauccaguucgagaacaacgaggaccaggacgugaacccccugaagcugggccugcugaccuggaucgaggaggacguguuccuggccgugagccacagcgaguucagccccagaagcgugauccaccaccugaccgccgccagcagcgagauggacgaggagcacggccagcugaacgugagcagcagcgccgccguggacggcgugaucaucagccugugcugcaacagcaagaccaagagcguggugcugcagcuggccgacggccagaucuucaaguaccugugggagagccccagccuggccaucaagcccuggaagaacagcggcggcuuccccgugagauuccccuaccccugcacccagaccgagcuggccaugaucggcgaggaggagugcgugcugggccugaccgacagaugcagauucuucaucaacgacaucgagguggccagcaacaucaccagcuucgccguguacgacgaguuccugcugcugaccacccacagccacaccugccagugcuucugccugagagacgccagcuucaagacccugcaggccggccugagcagcaaccacgugagccacggcgaggugcugagaaagguggagagaggcagcagaaucgugaccguggugccccaggacaccaagcuggugcugcagaugcccagaggcaaccuggagguggugcaccacagagcccuggugcuggcccagaucagaaaguggcuggacaagcugauguucaaggaggccuucgagugcaugagaaagcugagaaucaaccugaaccugaucuacgaccacaaccccaagguguuccugggcaacguggagaccuucaucaagcagaucgacagcgugaaccacaucaaccuguucuucaccgagcugaaggaggaggacgugaccaagaccauguaccccgcccccgugaccagcagcguguaccugagcagagaccccgacggcaacaagaucgaccuggugugcgacgccaugagagccgugauggagagcaucaacccccacaaguacugccugagcauccugaccagccacgugaagaagaccacccccgagcuggagaucgugcugcagaaggugcacgagcugcagggcaacgcccccagcgaccccgacgccgugagcgccgaggaggcccugaaguaccugcugcaccugguggacgugaacgagcuguacgaccacagccugggcaccuacgacuucgaccuggugcugaugguggccgagaagagccagaaggaccccaaggaguaccugcccuuccugaacacccugaagaagauggagaccaacuaccagagauucaccaucgacaaguaccugaagagauacgagaaggccaucggccaccugagcaagugcggccccgaguacuuccccgagugccugaaccugaucaaggacaagaaccuguacaacgaggcccugaagcuguacagccccagcagccagcaguaccaggacaucagcaucgccuacggcgagcaccugaugcaggagcacauguacgagcccgccggccugauguucgccagaugcggcgcccacgagaaggcccugagcgccuuccugaccugcggcaacuggaagcaggcccugugcguggccgcccagcugaacuucaccaaggaccagcuggugggccugggcagaacccuggccggcaagcugguggagcagagaaagcacaucgacgccgccauggugcuggaggagugcgcccaggacuacgaggaggccgugcugcugcugcuggagggcgccgccugggaggaggcccugagacugguguacaaguacaacagacuggacaucaucgagaccaacgugaagcccagcauccuggaggcccagaagaacuacauggccuuccuggacagccagaccgccaccuucagcagacacaagaagagacugcugguggugagagagcugaaggagcaggcccagcaggccggccuggacgacgaggugccccacggccaggagagcgaccuguucagcgagaccagcagcguggugagcggcagcgagaugagcggcaaguacagccacagcaacagcagaaucagcgccagaagcagcaagaacagaagaaaggccgagagaaagaagcacagccugaaggagggcagcccccuggaggaccuggcccugcuggaggcccugagcgagguggugcagaacaccgagaaccugaaggacgagguguaccacauccugaaggugcuguuccuguucgaguucgacgagcagggcagagagcugcagaaggccuucgaggacacccugcagcugauggagagaagccugcccgagaucuggacccugaccuaccagcagaacagcgccacccccgugcugggccccaacagcaccgccaacagcaucauggccagcuaccagcagcagaagaccagcgugcccgugcuggacgccgagcuguucaucccccccaagaucaacagaagaacccaguggaagcugagccugcuggacuaa

SEQ ID NO: 18443 - RNA, 2265 nt, Artificial Sequence
  IKBKB__Homo_sapiens__NP_001177649
auguucagcggcggcugccacagccccggcuucggcagacccagccccgccuuccccgcccccggcagccccccccccgcccccagacccugcagacaggagaccggcgagcagaucgccaucaagcagugcagacaggagcugagccccagaaacagagagagauggugccuggagauccagaucaugagaagacugacccaccccaacgugguggccgccagagacgugcccgagggcaugcagaaccuggcccccaacgaccugccccugcuggccauggaguacugccagggcggcgaccugagaaaguaccugaaccaguucgagaacugcugcggccugagagagggcgccauccugacccugcugagcgacaucgccagcgcccugagauaccugcacgagaacagaaucauccacagagaccugaagcccgagaacaucgugcugcagcagggcgagcagagacugauccacaagaucaucgaccugggcuacgccaaggagcuggaccagggcagccugugcaccagcuucgugggcacccugcaguaccuggcccccgagcugcuggagcagcagaaguacaccgugaccguggacuacuggagcuucggcacccuggccuucgagugcaucaccggcuucagacccuuccugcccaacuggcagcccgugcaguggcacagcaaggugagacagaagagcgagguggacaucguggugagcgaggaccugaacggcaccgugaaguucagcagcagccugcccuaccccaacaaccugaacagcgugcuggccgagagacuggagaaguggcugcagcugaugcugauguggcaccccagacagagaggcaccgaccccaccuacggccccaacggcugcuucaaggcccuggacgacauccugaaccugaagcuggugcacauccugaacauggugaccggcaccauccacaccuaccccgugaccgaggacgagagccugcagagccugaaggccagaauccagcaggacaccggcauccccgaggaggaccaggagcugcugcaggaggccggccuggcccugauccccgacaagcccgccacccagugcaucagcgacggcaagcugaacgagggccacacccuggacauggaccugguguuccuguucgacaacagcaagaucaccuacgagacccagaucagccccagaccccagcccgagagcgugagcugcauccugcaggagcccaagagaaaccuggccuucuuccagcugagaaagguguggggccagguguggcacagcauccagacccugaaggaggacugcaacagacugcagcagggccagagagccgccaugaugaaccugcugagaaacaacagcugccugagcaagaugaagaacagcauggccagcaugagccagcagcugaaggccaagcuggacuucuucaagaccagcauccagaucgaccuggagaaguacagcgagcagaccgaguucggcaucaccagcgacaagcugcugcuggccuggagagagauggagcaggccguggagcugugcggcagagagaacgaggugaagcugcugguggagagaaugauggcccugcagaccgacaucguggaccugcagagaagccccaugggcagaaagcagggcggcacccuggacgaccuggaggagcaggccagagagcuguacagaagacugagagagaagcccagagaccagagaaccgagggcgacagccaggagauggugagacugcugcugcaggccauccagagcuucgagaagaaggugagagugaucuacacccagcugagcaagaccguggugugcaagcagaaggcccuggagcugcugcccaagguggaggagguggugagccugaugaacgaggacgagaagaccguggugagacugcaggagaagagacagaaggagcuguggaaccugcugaagaucgccugcagcaaggugagaggccccgugagcggcagccccgacagcaugaacgccagcagacugagccagcccggccagcugaugagccagcccagcaccgccagcaacagccugcccgagcccgccaagaagagcgaggagcugguggccgaggcccacaaccugugcacccugcuggagaacgccauccaggacaccgugagagagcaggaccagagcuucaccgcccuggacuggagcuggcugcagaccgaggaggaggagcacagcugccuggagcaggccagcuaa

SEQ ID NO: 18444 - RNA, 1896 nt, Artificial Sequence
  IKBKE__Homo_sapiens__NP_001180250
auggaguacugcagcagcggcagccugcugagcgugcuggagagccccgagaacgccuucggccugcccgaggacgaguuccugguggugcugagaugcgugguggccggcaugaaccaccugagagagaacggcaucgugcacagagacaucaagcccggcaacaucaugagacuggugggcgaggagggccagagcaucuacaagcugaccgacuucggcgccgccagagagcuggacgacgacgagaaguucgugagcguguacggcaccgaggaguaccugcaccccgacauguacgagagagccgugcugagaaagccccagcagaaggccuucggcgugaccguggaccuguggagcaucggcgugacccuguaccacgccgccaccggcagccugcccuucauccccuucggcggccccagaagaaacaaggagaucauguacagaaucaccaccgagaagcccgccggcgccaucgccggcgcccagagaagagagaacggcccccuggaguggagcuacacccugcccaucaccugccagcugagccugggccugcagagccagcuggugcccauccuggccaacauccuggagguggagcaggccaagugcuggggcuucgaccaguucuucgccgagaccagcgacauccugcagagagugguggugcacguguucagccugagccaggccgugcugcaccacaucuacauccacgcccacaacaccaucgccaucuuccaggaggccgugcacaagcagaccagcguggcccccagacaccaggaguaccuguucgagggccaccugugcgugcuggagcccagcgugagcgcccagcacaucgcccacaccaccgccagcagcccccugacccuguucagcaccgccauccccaagggccuggccuucagagaccccgcccuggacgugcccaaguucgugcccaagguggaccugcaggccgacuacaacaccgccaagggcgugcugggcgccggcuaccaggcccugagacuggccagagcccugcuggacggccaggagcugauguucagaggccugcacugggugauggaggugcugcaggccaccugcagaagaacccuggagguggccagaaccagccugcuguaccugagcagcagccugggcaccgagagauucagcagcguggccggcacccccgagauccaggagcugaaggccgccgccgagcugagaagcagacugagaacccuggccgaggugcugagcagaugcagccagaacaucaccgagacccaggagagccugagcagccugaacagagagcuggugaagagcagagaccaggugcacgaggacagaagcauccagcagauccagugcugccuggacaagaugaacuucaucuacaagcaguucaagaagagcagaaugagacccggccugggcuacaacgaggagcagauccacaagcuggacaaggugaacuucagccaccuggccaagagacugcugcagguguuccaggaggagugcgugcagaaguaccaggccagccuggugacccacggcaagagaaugagaguggugcacgagaccagaaaccaccugagacuggugggcugcagcguggccgccugcaacaccgaggcccagggcgugcaggagagccugagcaagcugcuggaggagcugagccaccagcugcugcaggacagagccaagggcgcccaggccagccccccccccaucgcccccuaccccagccccaccagaaaggaccugcugcugcacaugcaggagcugugcgagggcaugaagcugcuggccagcgaccugcuggacaacaacagaaucaucgagagacugaacagagugcccgccccccccgacguguaa

SEQ ID NO: 18445 - RNA, 1464 nt, Artificial Sequence
  IKBKG__Homo_sapiens__NP_001093326
auggcccuggugauccaggugggcaagcugagacccagagaggugagaaccccccagaccaucaaccccagccuguuccccagccugcccgugaagcugagcagcaucaucgaggugcccagcggcggcgagagaugcugcagcagaagaacccugguguacaaggccagagccuucuggaagggcgccccccugcccugcuggaugaacagacaccuguggaagagccagcugugcgagauggugcagcccagcggcggccccgccgccgaccaggacgugcugggcgaggagagcccccugggcaagcccgccaugcugcaccugcccagcgagcagggcgcccccgagacccugcagagaugccuggaggagaaccaggagcugagagacgccaucagacagagcaaccagauccugagagagagaugcgaggagcugcugcacuuccaggccagccagagagaggagaaggaguuccugaugugcaaguuccaggaggccagaaagcugguggagagacugggccuggagaagcuggaccugaagagacagaaggagcaggcccugagagagguggagcaccugaagagaugccagcagcagauggccgaggacaaggccagcgugaaggcccaggugaccagccugcugggcgagcugcaggagagccagagcagacuggaggccgccaccaaggagugccaggcccuggagggcagagccagagccgccagcgagcaggccagacagcuggagagcgagagagaggcccugcagcagcagcacagcgugcagguggaccagcugagaaugcagggccagagcguggaggccgcccugagaauggagagacaggccgccagcgaggagaagagaaagcuggcccagcugcagguggccuaccaccagcuguuccaggaguacgacaaccacaucaagagcagcguggugggcagcgagagaaagagaggcaugcagcuggaggaccugaagcagcagcugcagcaggccgaggaggcccugguggccaagcaggaggugaucgacaagcugaaggaggaggccgagcagcacaagaucgugauggagaccgugcccgugcugaaggcccaggccgacaucuacaaggccgacuuccaggccgagagacaggccagagagaagcuggccgagaagaaggagcugcugcaggagcagcuggagcagcugcagagagaguacagcaagcugaaggccagcugccaggagagcgccagaaucgaggacaugagaaagagacacguggaggugagccaggccccccugccccccgcccccgccuaccugagcagcccccuggcccugcccagccagagaagaagcccccccgaggagccccccgacuucugcugccccaagugccaguaccaggcccccgacauggacacccugcagauccacgugauggagugcaucgaguaa

SEQ ID NO: 18446 - RNA, 1674 nt, Artificial Sequence
  IK__Homo_sapiens__NP_006074
augcccgagagagacagcgagcccuucagcaacccccuggcccccgacggccacgacguggacgacccccacagcuuccaccagagcaagcugaccaacgaggacuucagaaagcugcugaugacccccagagccgcccccaccagcgccccccccagcaagagcagacaccacgagaugcccagagaguacaacgaggacgaggaccccgccgccagaagaagaaagaagaagagcuacuacgccaagcugagacagcaggagaucgagagagagagagagcuggccgagaaguacagagacagagccaaggagagaagagacggcgugaacaaggacuacgaggagaccgagcugaucagcaccaccgccaacuacagagccgugggccccaccgccgaggccgacaagagcgccgccgagaagagaagacagcugauccaggagagcaaguuccugggcggcgacauggagcacacccaccuggugaagggccuggacuucgcccugcugcagaaggugagagccgagaucgccagcaaggagaaggaggaggaggagcugauggagaagccccagaaggagaccaagaaggacgaggaccccgagaacaagaucgaguucaagaccagacugggcagaaacguguacagaaugcuguucaagagcaaggccuacgagagaaacgagcuguuccugcccggcagaauggccuacgugguggaccuggacgacgaguacgccgacaccgacauccccaccacccugaucagaagcaaggccgacugccccaccauggaggcccagaccacccugaccaccaacgacaucgugaucagcaagcugacccagauccugagcuaccugagacagggcaccagaaacaagaagcugaagaagaaggacaagggcaagcuggaggagaagaagccccccgaggccgacaugaacaucuucgaggacaucggcgacuacgugcccagcaccaccaagacccccagagacaaggagagagagagauacagagagagagagagagacagagagagagacagagacagagacagagagagagagagagagagagacagagagagagagagagagagagacagagagagagaggaggagaagaagagacacagcuacuucgagaagcccaagguggacgacgagcccauggacguggacaagggccccggcagcaccaaggagcugaucaagagcaucaacgagaaguucgccggcagcgccggcugggagggcaccgagagccugaagaagcccgaggacaagaagcagcugggcgacuucuucggcaugagcaacagcuacgccgagugcuaccccgccaccauggacgacauggccguggacagcgacgaggagguggacuacagcaagauggaccagggcaacaagaagggcccccugggcagaugggacuucgacacccaggaggaguacagcgaguacaugaacaacaaggaggcccugcccaaggccgccuuccaguacggcaucaagaugagcgagggcagaaagaccagaagauucaaggagaccaacgacaaggccgagcuggacagacaguggaagaagaucagcgccaucaucgagaagagaaagaagauggaggccgacggcguggaggugaagagacccaaguacuaa

SEQ ID NO: 18447 - RNA, 1299 nt, Artificial Sequence
  IKZF1__Homo_sapiens__NP_001207697
auggacgccgacgagggccaggacaugagccaggugagcggcaaggagagcccccccgugagcgacacccccgacgagggcgacgagcccaugcccauccccgaggaccugagcaccaccagcggcggccagcagagcagcaagagcgacagagugguggccagcaacgugaagguggagacccagagcgacgaggagaacggcagagccugcgagaugaacggcgaggagugcgccgaggaccugagaaugcuggacgccagcggcgagaagaugaacggcagccacagagaccagggcagcagcgcccugagcggcgugggcggcaucagacugcccaacggcaagcugaagugcgacaucugcggcaucaucugcaucggccccaacgugcugauggugcacaagagaagccacaccggcgagagacccuuccagugcaaccagugcggcgccagcuucacccagaagggcaaccugcugagacacaucaagcugcacagcggcgagaagcccuucaagugccaccugugcaacuacgccugcagaagaagagacgcccugaccggccaccugagaacccacagcggcgacaagggccugagcgacacccccuacgacagcagcgccagcuacgagaaggagaacgagaugaugaagagccacgugauggaccaggccaucaacaacgccaucaacuaccugggcgccgagagccugagaccccuggugcagaccccccccggcggcagcgagguggugcccgugaucagccccauguaccagcugcacaagccccuggccgagggcacccccagaagcaaccacagcgcccaggacagcgccguggagaaccugcugcugcugagcaaggccaagcuggugcccagcgagagagaggccagccccagcaacagcugccaggacagcaccgacaccgagagcaacaacgaggagcagagaagcggccugaucuaccugaccaaccacaucgccccccacgccagaaacggccugagccugaaggaggagcacagagccuacgaccugcugagagccgccagcgagaacagccaggacgcccugagaguggugagcaccagcggcgagcagaugaagguguacaagugcgagcacugcagagugcuguuccuggaccacgugauguacaccauccacaugggcugccacggcuucagagaccccuucgagugcaacaugugcggcuaccacagccaggacagauacgaguucagcagccacaucaccagaggcgagcacagauuccacaugagcuaa

SEQ ID NO: 18448 - RNA, 1503 nt, Artificial Sequence
  IKZF2__Homo_sapiens__NP_001072994
auggagaccgaggccaucgacggcuacaucaccugcgacaacgagcugagccccgagagagagcacagcaacauggccaucgaccugaccagcagcacccccaacggccagcacgccagccccagccacaugaccagcaccaacagcgugaagcuggagaugcagagcgacgaggagugcgacagaaagccccugagcagagaggacgagaucagaggccacgacgagggcagcagccuggaggagccccugaucgagagcagcgagguggccgacaacagaaaggugcaggagcugcagggcgagggcggcaucagacugcccaacggcgagagacccuuccacugcaaccagugcggcgccagcuucacccagaagggcaaccugcugagacacaucaagcugcacagcggcgagaagcccuucaagugccccuucugcagcuacgccugcagaagaagagacgcccugaccggccaccugagaacccacagcgugggcaagccccacaagugcaacuacugcggcagaagcuacaagcagagaagcagccuggaggagcacaaggagagaugccacaacuaccugcagaacgugagcauggaggccgccggccaggugaugagccaccacgugccccccauggaggacugcaaggagcaggagcccaucauggacaacaacaucagccuggugcccuucgagagacccgccgugaucgagaagcugaccggcaacaugggcaagagaaagagcagcaccccccagaaguucgugggcgagaagcugaugagauucagcuaccccgacauccacuucgacaugaaccugaccuacgagaaggaggccgagcugaugcagagccacaugauggaccaggccaucaacaacgccaucaccuaccugggcgccgaggcccugcacccccugaugcagcacccccccagcaccaucgccgagguggcccccgugaucagcagcgccuacagccagguguaccaccccaacagaaucgagagacccaucagcagagagaccgccgacagccacgagaacaacauggacggccccaucagccugaucagacccaagagcagaccccaggagagagaggccagccccagcaacagcugccuggacagcaccgacagcgagagcagccacgacgaccaccagagcuaccagggccaccccgcccugaaccccaagagaaagcagagccccgccuacaugaaggaggacgugaaggcccuggacaccaccaaggcccccaagggcagccugaaggacaucuacaagguguucaacggcgagggcgagcagaucagagccuucaagugcgagcacugcagagugcuguuccuggaccacgugauguacaccauccacaugggcugccacggcuacagagacccccuggagugcaacaucugcggcuacagaagccaggacagauacgaguucagcagccacaucgugagaggcgagcacaccuuccacuaa

SEQ ID NO: 18449 - RNA, 1428 nt, Artificial Sequence
  IKZF3__Homo_sapiens__NP_001244337
auggaggacauccagaccaacgccgagcugaagagcacccaggagcagagcgugcccgccgacgacagcaugaaggugaaggacgaguacagcgagagagacgagaacgugcugaagagcgagcccaugggcaacgccgaggagcccgagauccccuacagcuacagcagagaguacaacgaguacgagaacaucaagcuggagagacacguggugagcuucgacagcagcagacccaccagcggcaagaugaacugcgacgugugcggccugagcugcaucagcuucaacgugcugauggugcacaagagaagccacaccggcgagagacccuuccagugcaaccagugcggcgccagcuucacccagaagggcaaccugcugagacacaucaagcugcacaccggcgagaagcccuucaagugccaccugugcaacuacgccugccagagaagagacgcccugaccggccaccugagaacccacagcguggagaagcccuacaagugcgaguucugcggcagaagcuacaagcagagaagcagccuggaggagcacaaggagagaugcagaaccuuccugcagagcaccgaccccggcgacaccgccagcgccgaggccagacacaucaaggccgagaugggcagcgagagagcccuggugcuggacagacuggccagcaacguggccaagagaaagagcagcaugccccagaaguucaucggcgagaagagacacugcuucgacgugaacuacaacagcagcuacauguacgagaaggagagcgagcugauccagaccagaaugauggaccaggccaucaacaacgccaucagcuaccugggcgccgaggcccugagaccccuggugcagaccccccccgcccccaccagcgagauggugcccgugaucagcagcauguaccccaucgcccugaccagagccgagaugagcaacggcgccccccaggagcuggagaagaagagcauccaccugcccgagaagagcgugcccagcgagagaggccugagccccaacaacagcggccacgacagcaccgacaccgacagcaaccacgaggagagacagaaccacaucuaccagcagaaccacauggugcugagcagagccagaaacggcaugccccugcugaaggaggugcccagaagcuacgagcugcugaagcccccccccaucugccccagagacagcgugaaggugaucaacaaggagggcgaggugauggacguguacagaugcgaccacugcagagugcuguuccuggacuacgugauguucaccauccacaugggcugccacggcuucagagaccccuucgagugcaacaugugcggcuacagaagccacgacagauacgaguucagcagccacaucgccagaggcgagcacagagcccugcugaaguaa

SEQ ID NO: 18450 - RNA, 1758 nt, Artificial Sequence
  IKZF4__Homo_sapiens__NP_071910
augcacaccccccccgcccugcccagaagauuccagggcggcggcagagugagaacccccggcagccacagacagggcaaggacaaccuggagagagaccccagcggcggcugcgugcccgacuuccugccccaggcccaggacagcaaccacuucaucauggagagccuguucugcgagagcagcggcgacagcagccuggagaaggaguuccugggcgcccccgugggccccagcgugagcacccccaacagccagcacagcagccccagcagaagccugagcgccaacagcaucaagguggagauguacagcgacgaggagagcagcagacugcugggccccgacgagagacugcuggagaaggacgacagcgugaucguggaggacagccugagcgagccccugggcuacugcgacggcagcggccccgagccccacagccccggcggcaucagacugcccaacggcaagcugaagugcgacgugugcggcauggugugcaucggccccaacgugcugauggugcacaagagaagccacaccggcgagagacccuuccacugcaaccagugcggcgccagcuucacccagaagggcaaccugcugagacacaucaagcugcacagcggcgagaagcccuucaagugccccuucugcaacuacgccugcagaagaagagacgcccugaccggccaccugagaacccacagcgugagcagccccaccgugggcaagcccuacaagugcaacuacugcggcagaagcuacaagcagcagagcacccuggaggagcacaaggagagaugccacaacuaccugcagagccugagcaccgaggcccaggcccuggccggccagcccggcgacgagaucagagaccuggagauggugcccgacagcaugcugcacagcagcagcgagagacccaccuucaucgacagacuggccaacagccugaccaagagaaagagaagcaccccccagaaguucgugggcgagaagcagaugagauucagccugagcgaccugcccuacgacgugaacagcggcggcuacgagaaggacguggagcugguggcccaccacagccuggagcccggcuucggcagcagccuggccuucgugggcgccgagcaccugagaccccugagacugccccccaccaacugcaucagcgagcugacccccgugaucagcagcguguacacccagaugcagccccugcccggcagacuggagcugcccggcagcagagaggccggcgagggccccgaggaccuggccgacggcggcccccugcuguacagacccagaggcccccugaccgaccccggcgccagccccagcaacggcugccaggacagcaccgacaccgagagcaaccacgaggacagaguggccggcguggugagccugccccagggcccccccccccagcccccccccaccaucguggugggcagacacagccccgccuacgccaaggaggaccccaagccccaggagggccugcugagaggcacccccggccccagcaaggaggugcugagaguggugggcgagagcggcgagcccgugaaggccuucaagugcgagcacugcagaauccuguuccuggaccacgugauguucaccauccacaugggcugccacggcuucagagaccccuucgagugcaacaucugcggcuaccacagccaggacagauacgaguucagcagccacaucgugagaggcgagcacaaggugggcuaa

SEQ ID NO: 18451 - RNA, 537 nt, Artificial Sequence
  IL10__Homo_sapiens__XP_011507808
augcacagcagcgcccugcugugcugccuggugcugcugaccggcgugagagccagccccggccagggcacccagagcgagaacagcugcacccacuuccccggcaaccugcccaacaugcugagagaccugagagacgccuucagcagagugaagaccuucuuccagaugaaggaccagcuggacaaccugcugcugaaggagagccugcuggaggacuucaagggcuaccugggcugccaggcccugagcgagaugauccaguucuaccuggaggaggugaugccccaggccgagaaccaggaccccgacaucaaggcccacgugaacagccugggcgagaaccugaagacccugagacugagacugagaagaugccacagauuccugcccugcgagaacaagagcaaggccguggagcaggugaagaacgccuucaacaagcugcaggagaagggcaucuacaaggccaugagcgaguucgacaucuucaucaacuacaucgaggccuacaugaccaugaagaucagaaacuaa

SEQ ID NO: 18452 - RNA, 1737 nt, Artificial Sequence
  IL10RA__Homo_sapiens__NP_001549
augcugcccugccugguggugcugcuggccgcccugcugagccugagacugggcagcgacgcccacggcaccgagcugcccagcccccccagcgugugguucgaggccgaguucuuccaccacauccugcacuggacccccauccccaaccagagcgagagcaccugcuacgagguggcccugcugagauacggcaucgagagcuggaacagcaucagcaacugcagccagacccugagcuacgaccugaccgccgugacccuggaccuguaccacagcaacggcuacagagccagagugagagccguggacggcagcagacacagcaacuggaccgugaccaacaccagauucagcguggacgaggugacccugaccgugggcagcgugaaccuggagauccacaacggcuucauccugggcaagauccagcugcccagacccaagauggcccccgccaacgacaccuacgagagcaucuucagccacuucagagaguacgagaucgccaucagaaaggugcccggcaacuucaccuucacccacaagaaggugaagcacgagaacuucagccugcugaccagcggcgaggugggcgaguucugcgugcaggugaagcccagcguggccagcagaagcaacaagggcauguggagcaaggaggagugcaucagccugaccagacaguacuucaccgugaccaacgugaucaucuucuucgccuucgugcugcugcugagcggcgcccuggccuacugccuggcccugcagcuguacgugagaagaagaaagaagcugcccagcgugcugcuguucaagaagcccagccccuucaucuucaucagccagagacccagccccgagacccaggacaccauccacccccuggacgaggaggccuuccugaaggugagccccgagcugaagaaccuggaccugcacggcagcaccgacagcggcuucggcagcaccaagcccagccugcagaccgaggagccccaguuccugcugcccgacccccacccccaggccgacagaacccugggcaacagagagccccccgugcugggcgacagcugcagcagcggcagcagcaacagcaccgacagcggcaucugccugcaggagcccagccugagccccagcaccggccccaccugggagcagcaggugggcagcaacagcagaggccaggacgacagcggcaucgaccuggugcagaacagcgagggcagagccggcgacacccagggcggcagcgcccugggccaccacagcccccccgagcccgaggugcccggcgaggaggaccccgccgccguggccuuccagggcuaccugagacagaccagaugcgccgaggagaaggccaccaagaccggcugccuggaggaggagagcccccugaccgacggccugggccccaaguucggcagaugccugguggacgaggccggccugcacccccccgcccuggccaagggcuaccugaagcaggacccccuggagaugacccuggccagcagcggcgcccccaccggccaguggaaccagcccaccgaggaguggagccugcuggcccugagcagcugcagcgaccugggcaucagcgacuggagcuucgcccacgaccuggccccccugggcugcguggccgcccccggcggccugcugggcagcuucaacagcgaccuggugacccugccccugaucagcagccugcagagcagcgaguaa

SEQ ID NO: 18453 - RNA, 978 nt, Artificial Sequence
  IL10RB__Homo_sapiens__NP_000619
auggccuggagccugggcagcuggcugggcggcugccugcuggugagcgcccugggcauggugcccccccccgagaacgugagaaugaacagcgugaacuucaagaacauccugcagugggagagccccgccuucgccaagggcaaccugaccuucaccgcccaguaccugagcuacagaaucuuccaggacaagugcaugaacaccacccugaccgagugcgacuucagcagccugagcaaguacggcgaccacacccugagagugagagccgaguucgccgacgagcacagcgacugggugaacaucaccuucugccccguggacgacaccaucaucggcccccccggcaugcagguggaggugcuggccgacagccugcacaugagauuccuggcccccaagaucgagaacgaguacgagaccuggaccaugaagaacguguacaacagcuggaccuacaacgugcaguacuggaagaacggcaccgacgagaaguuccagaucaccccccaguacgacuucgaggugcugagaaaccuggagcccuggaccaccuacugcgugcaggugagaggcuuccugcccgacagaaacaaggccggcgaguggagcgagcccgugugcgagcagaccacccacgacgagaccgugcccagcuggaugguggccgugauccugauggccagcguguucauggugugccuggcccugcugggcugcuucgcccugcuguggugcguguacaagaagaccaaguacgccuucagccccagaaacagccugccccagcaccugaaggaguuccugggccacccccaccacaacacccugcuguucuucagcuucccccugagcgacgagaacgacguguucgacaagcugagcgugaucgccgaggacagcgagagcggcaagcagaaccccggcgacagcugcagccugggcaccccccccggccagggcccccagagcuaa

SEQ ID NO: 18454 - RNA, 600 nt, Artificial Sequence
  IL11__Homo_sapiens__NP_000632
augaacugcgugugcagacuggugcugguggugcugagccuguggcccgacaccgccguggcccccggccccccccccggcccccccagagugagccccgaccccagagccgagcuggacagcaccgugcugcugaccagaagccugcuggccgacaccagacagcuggccgcccagcugagagacaaguuccccgccgacggcgaccacaaccuggacagccugcccacccuggccaugagcgccggcgcccugggcgcccugcagcugcccggcgugcugaccagacugagagccgaccugcugagcuaccugagacacgugcaguggcugagaagagccggcggcagcagccugaagacccuggagcccgagcugggcacccugcaggccagacuggacagacugcugagaagacugcagcugcugaugagcagacuggcccugccccagcccccccccgacccccccgcccccccccuggccccccccagcagcgccuggggcggcaucagagccgcccacgccauccugggcggccugcaccugacccuggacugggccgugagaggccugcugcugcugaagaccagacuguaa

SEQ ID NO: 18455 - RNA, 1269 nt, Artificial Sequence
  IL11RA__Homo_sapiens__NP_001136256
augagcagcagcugcagcggccugagcagagugcugguggccguggccaccgcccuggugagcgccagcagccccugcccccaggccuggggcccccccggcgugcaguacggccagcccggcagaagcgugaagcugugcugccccggcgugaccgccggcgaccccgugagcugguucagagacggcgagcccaagcugcugcagggccccgacagcggccugggccacgagcuggugcuggcccaggccgacagcaccgacgagggcaccuacaucugccagacccuggacggcgcccugggcggcaccgugacccugcagcugggcuacccccccgccagacccguggugagcugccaggccgccgacuacgagaacuucagcugcaccuggagccccagccagaucagcggccugcccaccagauaccugaccagcuacagaaagaagaccgugcugggcgccgacagccagagaagaagccccagcaccggccccuggcccugcccccaggacccccugggcgccgccagaugcguggugcacggcgccgaguucuggagccaguacagaaucaacgugaccgaggugaacccccugggcgccagcaccagacugcuggacgugagccugcagagcauccugagacccgaccccccccagggccugagaguggagagcgugcccggcuaccccagaagacugagagccagcuggaccuaccccgccagcuggcccugccagccccacuuccugcugaaguucagacugcaguacagacccgcccagcaccccgccuggagcaccguggagcccgccggccuggaggaggugaucaccgacgccguggccggccugccccacgccgugagagugagcgccagagacuuccuggacgccggcaccuggagcaccuggagccccgaggccuggggcacccccagcaccggcaccauccccaaggagauccccgccuggggccagcugcacacccagcccgagguggagccccagguggacagccccgccccccccagacccagccugcagccccaccccagacugcuggaccacagagacagcguggagcagguggccgugcuggccagccugggcauccugagcuuccugggccugguggccggcgcccuggcccugggccuguggcugagacugagaagaggcggcaaggacggcagccccaagcccggcuuccuggccagcgugauccccguggacagaagacccggcgcccccaaccuguaa

SEQ ID NO: 18456 - RNA, 762 nt, Artificial Sequence
  IL12A__Homo_sapiens__NP_000873
auguggccccccggcagcgccagccagcccccccccagccccgccgccgccaccggccugcaccccgccgccagacccgugagccugcagugcagacugagcaugugccccgccagaagccugcugcugguggccacccuggugcugcuggaccaccugagccuggccagaaaccugcccguggccacccccgaccccggcauguuccccugccugcaccacagccagaaccugcugagagccgugagcaacaugcugcagaaggccagacagacccuggaguucuaccccugcaccagcgaggagaucgaccacgaggacaucaccaaggacaagaccagcaccguggaggccugccugccccuggagcugaccaagaacgagagcugccugaacagcagagagaccagcuucaucaccaacggcagcugccuggccagcagaaagaccagcuucaugauggcccugugccugagcagcaucuacgaggaccugaagauguaccagguggaguucaagaccaugaacgccaagcugcugauggaccccaagagacagaucuuccuggaccagaacaugcuggccgugaucgacgagcugaugcaggcccugaacuucaacagcgagaccgugccccagaagagcagccuggaggagcccgacuucuacaagaccaagaucaagcugugcauccugcugcacgccuucagaaucagagccgugaccaucgacagagugaugagcuaccugaacgccagcuaa

SEQ ID NO: 18457 - RNA, 987 nt, Artificial Sequence
  IL12B__Homo_sapiens__NP_002178
augugccaccagcagcuggugaucagcugguucagccugguguuccuggccagcccccugguggccaucugggagcugaagaaggacguguacgugguggagcuggacugguaccccgacgcccccggcgagaugguggugcugaccugcgacacccccgaggaggacggcaucaccuggacccuggaccagagcagcgaggugcugggcagcggcaagacccugaccauccaggugaaggaguucggcgacgccggccaguacaccugccacaagggcggcgaggugcugagccacagccugcugcugcugcacaagaaggaggacggcaucuggagcaccgacauccugaaggaccagaaggagcccaagaacaagaccuuccugagaugcgaggccaagaacuacagcggcagauucaccugcugguggcugaccaccaucagcaccgaccugaccuucagcgugaagagcagcagaggcagcagcgacccccagggcgugaccugcggcgccgccacccugagcgccgagagagugagaggcgacaacaaggaguacgaguacagcguggagugccaggaggacagcgccugccccgccgccgaggagagccugcccaucgaggugaugguggacgccgugcacaagcugaaguacgagaacuacaccagcagcuucuucaucagagacaucaucaagcccgacccccccaagaaccugcagcugaagccccugaagaacagcagacagguggaggugagcugggaguaccccgacaccuggagcaccccccacagcuacuucagccugaccuucugcgugcaggugcagggcaagagcaagagagagaagaaggacagaguguucaccgacaagaccagcgccaccgugaucugcagaaagaacgccagcaucagcgugagagcccaggacagauacuacagcagcagcuggagcgagugggccagcgugcccugcagcuaa

SEQ ID NO: 18458 - RNA, 2109 nt, Artificial Sequence
  IL12RB1__Homo_sapiens__NP_001276953
auguucgugggccuguucagccugcugagcuucaacguguucagaagcggcgacggcguggccgagcccagaagauggcagagaggcagccccggcgccgugggccuguacguggaccccauggagccccuggugaccuggguggugccccugcuguuccuguuccugcugagcagacagggcgccgccugcagaaccagcgagugcugcuuccaggacccccccuaccccgacgccgacagcggcagcgccagcggccccagagaccugagaugcuacagaaucagcagcgacagauacgagugcagcuggcaguacgagggccccaccgccggcgugagccacuuccugagaugcugccugagcagcggcagaugcugcuacuucgccgccggcagcgccaccagacugcaguucagcgaccaggccggcgugagcgugcuguacaccgugacccuguggguggagagcugggccagaaaccagaccgagaagagccccgaggugacccugcagcuguacaacagcgugaaguacgagcccccccugggcgacaucaaggugagcaagcuggccggccagcugagaauggagugggagacccccgacaaccaggugggcgccgaggugcaguucagacacagaacccccagcagccccuggaagcugggcgacugcggcccccaggacgacgacaccgagagcugccugugcccccuggagaugaacguggcccaggaguuccagcugagaagaagacagcugggcagccagggcagcagcuggagcaaguggagcagccccgugugcgugccccccgagaaccccccccagccccaggugagauucagcguggagcagcugggccaggacggcagaagaagacugacccugaaggagcagcccacccagcuggagcugcccgagggcugccagggccuggcccccggcaccgaggugaccuacagacugcagcugcacaugcugagcugccccugcaaggccaaggccaccagaacccugcaccugggcaagaugcccuaccugagcggcgccgccuacaacguggccgugaucagcagcaaccaguucggccccggccugaaccagaccuggcacauccccgccgacacccacaccgagcccguggcccugaacaucagcgugggcaccaacggcaccaccauguacuggcccgccagagcccagagcaugaccuacugcaucgaguggcagcccgugggccaggacggcggccuggccaccugcagccugaccgccccccaggaccccgaccccgccggcauggccaccuacagcuggagcagagagagcggcgccaugggccaggagaagugcuacuacaucaccaucuucgccagcgcccaccccgagaagcugacccuguggagcaccgugcugagcaccuaccacuucggcggcaacgccagcgccgccggcaccccccaccacgugagcgugaagaaccacagccuggacagcgugagcguggacugggcccccagccugcugagcaccugccccggcgugcugaaggaguacguggugagaugcagagacgaggacagcaagcaggugagcgagcaccccgugcagcccaccgagacccaggugacccugagcggccugagagccggcguggccuacaccgugcaggugagagccgacaccgccuggcugagaggcguguggagccagccccagagauucagcaucgaggugcaggugagcgacuggcugaucuucuucgccagccugggcagcuuccugagcauccugcuggugggcgugcugggcuaccugggccugaacagagccgccagacaccugugccccccccugcccacccccugcgccagcagcgccaucgaguuccccggcggcaaggagaccuggcaguggaucaaccccguggacuuccaggaggaggccagccugcaggaggcccuggugguggagaugagcugggacaagggcgagagaaccgagccccuggagaagaccgagcugcccgagggcgcccccgagcuggcccuggacaccgagcugagccuggaggacggcgacagaugcaaggccaagauguaa

SEQ ID NO: 18459 - RNA, 441 nt, Artificial Sequence
  IL13__Homo_sapiens__NP_002179
augcacccccugcugaacccccugcugcuggcccugggccugauggcccugcugcugaccaccgugaucgcccugaccugccugggcggcuucgccagccccggccccgugccccccagcaccgcccugagagagcugaucgaggagcuggugaacaucacccagaaccagaaggccccccugugcaacggcagcaugguguggagcaucaaccugaccgccggcauguacugcgccgcccuggagagccugaucaacgugagcggcugcagcgccaucgagaagacccagagaaugcugagcggcuucugcccccacaaggugagcgccggccaguucagcagccugcacgugagagacaccaagaucgagguggcccaguucgugaaggaccugcugcugcaccugaagaagcuguucagagagggccaguucaacuaa

SEQ ID NO: 18460 - RNA, 1284 nt, Artificial Sequence
  IL13RA1__Homo_sapiens__NP_001551
auggaguggcccgccagacugugcggccugugggcccugcugcugugcgccggcggcggcggcggcggcggcggcgccgcccccaccgagacccagccccccgugaccaaccugagcgugagcguggagaaccugugcaccgugaucuggaccuggaacccccccgagggcgccagcagcaacugcagccugugguacuucagccacuucggcgacaagcaggacaagaagaucgcccccgagaccagaagaagcaucgaggugccccugaacgagagaaucugccugcaggugggcagccagugcagcaccaacgagagcgagaagcccagcauccugguggagaagugcaucagcccccccgagggcgaccccgagagcgccgugaccgagcugcagugcaucuggcacaaccugagcuacaugaagugcagcuggcugcccggcagaaacaccagccccgacaccaacuacacccuguacuacuggcacagaagccuggagaagauccaccagugcgagaacaucuucagagagggccaguacuucggcugcagcuucgaccugaccaaggugaaggacagcagcuucgagcagcacagcgugcagaucauggugaaggacaacgccggcaagaucaagcccagcuucaacaucgugccccugaccagcagagugaagcccgaccccccccacaucaagaaccugagcuuccacaacgacgaccuguacgugcagugggagaacccccagaacuucaucagcagaugccuguucuacgagguggaggugaacaacagccagaccgagacccacaacguguucuacgugcaggaggccaagugcgagaaccccgaguucgagagaaacguggagaacaccagcugcuucauggugcccggcgugcugcccgacacccugaacaccgugagaaucagagugaagaccaacaagcugugcuacgaggacgacaagcuguggagcaacuggagccaggagaugagcaucggcaagaagagaaacagcacccuguacaucaccaugcugcugaucgugcccgugaucguggccggcgccaucaucgugcugcugcuguaccugaagagacugaagaucaucaucuucccccccauccccgaccccggcaagaucuucaaggagauguucggcgaccagaacgacgacacccugcacuggaagaaguacgacaucuacgagaagcagaccaaggaggagaccgacagcguggugcugaucgagaaccugaagaaggccagccaguaa

SEQ ID NO: 18461 - RNA, 1143 nt, Artificial Sequence
  IL13RA2__Homo_sapiens__NP_000631
auggccuucgugugccuggccaucggcugccuguacaccuuccugaucagcaccaccuucggcugcaccagcagcagcgacaccgagaucaaggugaaccccccccaggacuucgagaucguggaccccggcuaccugggcuaccuguaccugcaguggcagcccccccugagccuggaccacuucaaggagugcaccguggaguacgagcugaaguacagaaacaucggcagcgagaccuggaagaccaucaucaccaagaaccugcacuacaaggacggcuucgaccugaacaagggcaucgaggccaagauccacacccugcugcccuggcagugcaccaacggcagcgaggugcagagcagcugggccgagaccaccuacuggaucagcccccagggcauccccgagaccaaggugcaggacauggacugcguguacuacaacuggcaguaccugcugugcagcuggaagcccggcaucggcgugcugcuggacaccaacuacaaccuguucuacugguacgagggccuggaccacgcccugcagugcguggacuacaucaaggccgacggccagaacaucggcugcagauuccccuaccuggaggccagcgacuacaaggacuucuacaucugcgugaacggcagcagcgagaacaagcccaucagaagcagcuacuucaccuuccagcugcagaacaucgugaagccccugccccccguguaccugaccuucaccagagagagcagcugcgagaucaagcugaaguggagcaucccccugggccccauccccgccagaugcuucgacuacgagaucgagaucagagaggacgacaccacccuggugaccgccaccguggagaacgagaccuacacccugaagaccaccaacgagaccagacagcugugcuucguggugagaagcaaggugaacaucuacugcagcgacgacggcaucuggagcgaguggagcgacaagcagugcugggagggcgaggaccugagcaagaagacccugcugagauucuggcugcccuucggcuucauccugauccuggugaucuucgugaccggccugcugcugagaaagcccaacaccuaccccaagaugauccccgaguucuucugcgacaccuaa

SEQ ID NO: 18462 - RNA, 489 nt, Artificial Sequence
  IL15__Homo_sapiens__NP_000576
augagaaucagcaagccccaccugagaagcaucagcauccagugcuaccugugccugcugcugaacagccacuuccugaccgaggccggcauccacguguucauccugggcugcuucagcgccggccugcccaagaccgaggccaacugggugaacgugaucagcgaccugaagaagaucgaggaccugauccagagcaugcacaucgacgccacccuguacaccgagagcgacgugcaccccagcugcaaggugaccgccaugaagugcuuccugcuggagcugcaggugaucagccuggagagcggcgacgccagcauccacgacaccguggagaaccugaucauccuggccaacaacagccugagcagcaacggcaacgugaccgagagcggcugcaaggagugcgaggagcuggaggagaagaacaucaaggaguuccugcagagcuucgugcacaucgugcagauguucaucaacaccagcuaa

SEQ ID NO: 18463 - RNA, 696 nt, Artificial Sequence
  IL15RA__Homo_sapiens__NP_001230468
augagcguggagcacgccgacaucugggugaagagcuacagccuguacagcagagagagauacaucugcaacagcggcuucaagagaaaggccggcaccagcagccugaccgagugcgugcugaacaaggccaccaacguggcccacuggaccacccccagccugaagugcaucagagaccccgcccuggugcaccagagacccgccccccccagcaccgugaccaccgccggcgugaccccccagcccgagagccugagccccagcggcaaggagcccgccgccagcagccccagcagcaacaacaccgccgccaccaccgccgccaucgugcccggcagccagcugaugcccagcaagagccccagcaccggcaccaccgagaucagcagccacgagagcagccacggcacccccagccagaccaccgccaagaacugggagcugaccgccagcgccagccaccagccccccggcguguacccccagggccacagcgacaccaccguggccaucagcaccagcaccgugcugcugugcggccugagcgccgugagccugcuggccugcuaccugaagagcagacagacccccccccuggccagcguggagauggaggccauggaggcccugcccgugaccuggggcaccagcagcagagacgaggaccuggagaacugcagccaccaccuguaa

SEQ ID NO: 18464 - RNA, 3996 nt, Artificial Sequence
  IL16__Homo_sapiens__NP_001165599
auggagagccacagcagagccggcaagagcagaaagagcgccaaguucagaagcaucagcagaagccugaugcugugcaacgccaagaccagcgacgacggcagcagccccgacgagaaguaccccgaccccuucgagaucagccuggcccagggcaaggagggcaucuuccacagcagcgugcagcuggccgacaccagcgaggccggccccagcagcgugcccgaccuggcccuggccagcgaggccgcccagcugcaggccgccggcaacgacagaggcaagaccugcagaagaaucuucuucaugaaggagagcagcaccgccagcagcagagagaagcccggcaagcuggaggcccagagcagcaacuuccuguuccccaaggccugccaccagagagccagaagcaacagcaccagcgugaaccccuacugcaccagagagaucgacuuccccaugaccaagaagagcgccgcccccaccgacagacagcccuacagccugugcagcaacagaaagagccugagccagcagcuggacugccccgccggcaaggccgccggcaccagcagacccaccagaagccugagcaccgcccagcuggugcagcccagcggcggccugcaggccagcgugaucagcaacaucgugcugaugaagggccaggccaagggccugggcuucagcaucgugggcggcaaggacagcaucuacggccccaucggcaucuacgugaagaccaucuucgccggcggcgccgccgccgccgacggcagacugcaggagggcgacgagauccuggagcugaacggcgagagcauggccggccugacccaccaggacgcccugcagaaguucaagcaggccaagaagggccugcugacccugaccgugagaaccagacugaccgccccccccagccugugcagccaccugagccccccccugugcagaagccugagcagcagcaccugcaucaccaaggacagcagcagcuucgcccuggagagccccagcgcccccaucagcaccgccaagcccaacuacagaaucaugguggaggugagccugcagaaggaggccggcgugggccugggcaucggccugugcagcgugcccuacuuccagugcaucagcggcaucuucgugcacacccugagccccggcagcguggcccaccuggacggcagacugagaugcggcgacgagaucguggagaucagcgacagccccgugcacugccugacccugaacgagguguacaccauccugagccacugcgaccccggccccgugcccaucaucgugagcagacaccccgacccccaggugagcgagcagcagcugaaggaggccguggcccaggccguggagaacaccaaguucggcaaggagagacaccaguggagccuggagggcgugaagagacuggagagcagcuggcacggcagacccacccuggagaaggagagagagaagaacagcgcccccccccacagaagagcccagaaggugaugaucagaagcagcagcgacagcagcuacaugagcggcagccccggcggcagccccggcagcggcagcgccgagaagcccagcagcgacguggacaucagcacccacagccccagccugccccuggccagagagcccguggugcugagcaucgccagcagcagacugccccaggagagccccccccugcccgagagcagagacagccaccccccccugagacugaagaagagcuucgagauccuggugagaaagcccaugagcagcaagcccaagcccccccccagaaaguacuucaagagcgacagcgacccccagaagagccuggaggagagagagaacagcagcugcagcagcggccacaccccccccaccugcggccaggaggccagagagcugcugccccugcugcugccccaggaggacaccgccggcagaagccccagcgccagcgccggcugccccggccccggcaucggcccccagaccaagagcagcaccgagggcgagcccggcuggagaagagccagccccgugacccagaccagccccaucaagcacccccugcugaagagacaggccagaauggacuacagcuucgacaccaccgccgaggaccccugggugagaaucagcgacugcaucaagaaccuguucagccccaucaugagcgagaaccacggccacaugccccugcagcccaacgccagccugaacgaggaggagggcacccagggccaccccgacggcaccccccccaagcuggacaccgccaacggcacccccaagguguacaagagcgccgacagcagcaccgugaagaagggcccccccguggcccccaagcccgccugguucagacagagccugaagggccugagaaacagagccagcgaccccagaggccugcccgaccccgcccugagcacccagcccgcccccgccagcagagagcaccugggcagccacaucagagccagcagcagcagcagcagcaucagacagagaaucagcagcuucgagaccuucggcagcagccagcugcccgacaagggcgcccagagacugagccugcagcccagcagcggcgaggccgccaagccccugggcaagcacgaggagggcagauucagcggccugcugggcagaggcgccgcccccacccuggugccccagcagcccgagcaggugcugagcagcggcagccccgccgccagcgaggccagagaccccggcgugagcgagagccccccccccggcagacagcccaaccagaagacccugccccccggccccgacccccugcugagacugcugagcacccaggccgaggagagccagggccccgugcugaagaugcccagccagagagccagaagcuucccccugaccagaagccagagcugcgagaccaagcugcuggacgagaagaccagcaagcuguacagcaucagcagccaggugagcagcgccgugaugaagagccugcugugccugcccagcagcaucagcugcgcccagacccccugcauccccaaggagggcgccagccccaccagcagcagcaacgaggacagcgccgccaacggcagcgccgagaccagcgcccuggacaccggcuucagccugaaccugagcgagcugagagaguacaccgagggccugaccgaggccaaggaggacgacgacggcgaccacagcagccugcagagcggccagagcgugaucagccugcugagcagcgaggagcugaagaagcugaucgaggaggugaaggugcuggacgaggccacccugaagcagcuggacggcauccacgugaccauccugcacaaggaggagggcgccggccugggcuucagccuggccggcggcgccgaccuggagaacaaggugaucaccgugcacagaguguuccccaacggccuggccagccaggagggcaccauccagaagggcaacgaggugcugagcaucaacggcaagagccugaagggcaccacccaccacgacgcccuggccauccugagacaggccagagagcccagacaggccgugaucgugaccagaaagcugacccccgaggccaugcccgaccugaacagcagcaccgacagcgccgccagcgccagcgccgccagcgacgugagcguggagagcaccgaggccaccgugugcaccgugacccuggagaagaugagcgccggccugggcuucagccuggagggcggcaagggcagccugcacggcgacaagccccugaccaucaacagaaucuucaagggcgccgccagcgagcagagcgagaccgugcagcccggcgacgagauccugcagcugggcggcaccgccaugcagggccugaccagauucgaggccuggaacaucaucaaggcccugcccgacggccccgugaccaucgugaucagaagaaagagccugcagagcaaggagaccaccgccgccggcgacagcuaa

SEQ ID NO: 18465 - RNA, 468 nt, Artificial Sequence
  IL17A__Homo_sapiens__NP_002181
augacccccggcaagaccagccuggugagccugcugcugcugcugagccuggaggccaucgugaaggccggcaucaccauccccagaaaccccggcugccccaacagcgaggacaagaacuuccccagaaccgugauggugaaccugaacauccacaacagaaacaccaacaccaaccccaagagaagcagcgacuacuacaacagaagcaccagccccuggaaccugcacagaaacgaggaccccgagagauaccccagcgugaucugggaggccaagugcagacaccugggcugcaucaacgccgacggcaacguggacuaccacaugaacagcgugcccauccagcaggagauccuggugcugagaagagagcccccccacugccccaacagcuucagacuggagaagauccuggugagcgugggcugcaccugcgugacccccaucgugcaccacguggccuaa

SEQ ID NO: 18466 - RNA, 543 nt, Artificial Sequence
  IL17B__Homo_sapiens__NP_055258
auggacuggccccacaaccugcuguuccugcugaccaucagcaucuuccugggccugggccagcccagaagccccaagagcaagagaaagggccagggcagacccggcccccuggcccccggcccccaccaggugccccuggaccuggugagcagaaugaagcccuacgccagaauggaggaguacgagagaaacaucgaggagaugguggcccagcugagaaacagcagcgagcuggcccagagaaagugcgaggugaaccugcagcuguggaugagcaacaagagaagccugagccccuggggcuacagcaucaaccacgaccccagcagaauccccguggaccugcccgaggccagaugccugugccugggcugcgugaaccccuucaccaugcaggaggacagaagcauggugagcgugcccguguucagccaggugcccgugagaagaagacugugcccccccccccccagaaccggccccugcagacagagagccgugauggagaccaucgccgugggcugcaccugcaucuucuaa

SEQ ID NO: 18467 - RNA, 594 nt, Artificial Sequence
  IL17C__Homo_sapiens__NP_037410
augacccugcugcccggccugcuguuccugaccuggcugcacaccugccuggcccaccacgaccccagccugagaggccacccccacagccacggcaccccccacugcuacagcgccgaggagcugccccugggccaggcccccccccaccugcuggccagaggcgccaaguggggccaggcccugcccguggcccuggugagcagccuggaggccgccagccacagaggcagacacgagagacccagcgccaccacccagugccccgugcugagacccgaggaggugcuggaggccgacacccaccagagaagcaucagccccuggagauacagaguggacaccgacgaggacagauacccccagaagcuggccuucgccgagugccugugcagaggcugcaucgacgccagaaccggcagagagaccgccgcccugaacagcgugagacugcugcagagccugcuggugcugagaagaagacccugcagcagagacggcagcggccugcccacccccggcgccuucgccuuccacaccgaguucauccacgugcccgugggcugcaccugcgugcugcccagaagcguguaa

SEQ ID NO: 18468 - RNA, 609 nt, Artificial Sequence
  IL17D__Homo_sapiens__NP_612141
augcugguggccggcuuccugcuggcccugccccccagcugggccgccggcgcccccagagccggcagaagacccgccagacccagaggcugcgccgacagacccgaggagcugcuggagcagcuguacggcagacuggccgccggcgugcugagcgccuuccaccacacccugcagcugggccccagagagcaggccagaaacgccagcugccccgccggcggcagacccgccgacagaagauucagaccccccaccaaccugagaagcgugagccccugggccuacagaaucagcuacgaccccgccagauaccccagauaccugcccgaggccuacugccugugcagaggcugccugaccggccuguucggcgaggaggacgugagauucagaagcgcccccguguacaugcccaccguggugcugagaagaacccccgccugcgccggcggcagaagcguguacaccgaggccuacgugaccauccccgugggcugcaccugcgugcccgagcccgagaaggacgccgacagcaucaacagcagcaucgacaagcagggcgccaagcugcugcugggccccaacgacgcccccgccggccccuaa

SEQ ID NO: 18469 - RNA, 492 nt, Artificial Sequence
  IL17F__Homo_sapiens__XP_011512578
augaccgugaagacccugcacggccccgccauggugaaguaccugcugcugagcauccugggccuggccuuccugagcgaggccgccgccagaaagauccccaaggugggccacaccuucuuccagaagcccgagagcugcccccccgugcccggcggcagcaugaagcuggacaucggcaucaucaacgagaaccagagagugagcaugagcagaaacaucgagagcagaagcaccagccccuggaacuacaccgugaccugggaccccaacagauaccccagcgagguggugcaggcccagugcagaaaccugggcugcaucaacgcccagggcaaggaggacaucagcaugaacagcgugcccauccagcaggagacccugguggugagaagaaagcaccagggcugcagcgugagcuuccagcuggagaaggugcuggugaccgugggcugcaccugcgugacccccgugauccaccacgugcaguaa

SEQ ID NO: 18470 - RNA, 2499 nt, Artificial Sequence
  IL17RA__Homo_sapiens__NP_001276834
augggcgccgccagaagcccccccagcgccgugcccggcccccugcugggccugcugcugcugcugcugggcgugcuggcccccggcggcgccagccugagacugcuggaccacagagcccuggugugcagccagcccggccugaacugcaccgugaagaacagcaccugccuggacgacagcuggauccaccccagaaaccugacccccagcagccccaaggaccugcagauccagcugcacuucgcccacacccagcagggcgaccuguuccccguggcccacaucgaguggacccugcagaccgacgccagcauccuguaccuggagggcgccgagcugagcgugcugcagcugaacaccaacgagagacugugcgugagauucgaguuccugagcaagcugagacaccaccacagaagauggagauucaccuucagccacuucgugguggaccccgaccaggaguacgaggugaccgugcaccaccugcccaagcccauccccgacggcgaccccaaccaccagagcaagaacuuccuggugcccgacugcgagcacgccagaaugaaggugaccacccccugcaugagcagcggcagccugugggaccccaacaucaccguggagacccuggaggcccaccagcugagagugagcuucacccuguggaacgagagcacccacuaccagauccugcugaccagcuucccccacauggagaaccacagcugcuucgagcacaugcaccacauccccgcccccagacccgaggaguuccaccagagaagcaacgugacccugacccugagaaaccugaagggcugcugcagacaccaggugcagauccagcccuucuucagcagcugccugaacgacugccugagacacagcgccaccgugagcugccccgagaugcccgacacccccgagcccauccccggccccggcagcgagaaguacagcgacgacaccaaguacaccgacggccugcccgccgccgaccugaucccccccccccugaagcccagaaagguguggaucaucuacagcgccgaccacccccuguacguggacguggugcugaaguucgcccaguuccugcugaccgccugcggcaccgagguggcccuggaccugcuggaggagcaggccaucagcgaggccggcgugaugaccugggugggcagacagaagcaggagaugguggagagcaacagcaagaucaucgugcugugcagcagaggcaccagagccaaguggcaggcccugcugggcagaggcgcccccgugagacugagaugcgaccacggcaagcccgugggcgaccuguucaccgccgccaugaacaugauccugcccgacuucaagagacccgccugcuucggcaccuacguggugugcuacuucagcgaggugagcugcgacggcgacgugcccgaccuguucggcgccgcccccagauacccccugauggacagauucgaggagguguacuucagaauccaggaccuggagauguuccagcccggcagaaugcacagagugggcgagcugagcggcgacaacuaccugagaagccccggcggcagacagcugagagccgcccuggacagauucagagacuggcaggugagaugccccgacugguucgagugcgagaaccuguacagcgccgacgaccaggacgcccccagccuggacgaggagguguucgaggagccccugcugccccccggcaccggcaucgugaagagagccccccuggugagagagcccggcagccaggccugccuggccaucgacccccuggugggcgaggagggcggcgccgccguggccaagcuggagccccaccugcagcccagaggccagcccgccccccagccccugcacacccuggugcuggccgccgaggagggcgcccugguggccgccguggagcccggcccccuggccgacggcgccgccgugagacuggcccuggccggcgagggcgaggccugcccccugcugggcagccccggcgccggcagaaacagcgugcuguuccugcccguggaccccgaggacagcccccugggcagcagcacccccauggccagccccgaccugcugcccgaggacgugagagagcaccuggagggccugaugcugagccuguucgagcagagccugagcugccaggcccagggcggcugcagcagacccgccauggugcugaccgacccccacacccccuacgaggaggagcagagacagagcgugcagagcgaccagggcuacaucagcagaagcagcccccagccccccgagggccugaccgagauggaggaggaggaggaggaggagcaggaccccggcaagcccgcccugccccugagccccgaggaccuggagagccugagaagccugcagagacagcugcuguucagacagcugcagaagaacagcggcugggacaccaugggcagcgagagcgagggccccagcgccuaa

SEQ ID NO: 18471 - RNA, 1509 nt, Artificial Sequence
  IL17RB__Homo_sapiens__NP_061195
augagccuggugcugcugagccuggccgcccugugcagaagcgccgugcccagagagcccaccgugcagugcggcagcgagaccggccccagccccgaguggaugcugcagcacgaccugauccccggcgaccugagagaccugagaguggagcccgugaccaccagcguggccaccggcgacuacagcauccugaugaacgugagcugggugcugagagccgacgccagcaucagacugcugaaggccaccaagaucugcgugaccggcaagagcaacuuccagagcuacagcugcgugagaugcaacuacaccgaggccuuccagacccagaccagacccagcggcggcaaguggaccuucagcuacaucggcuuccccguggagcugaacaccguguacuucaucggcgcccacaacauccccaacgccaacaugaacgaggacggccccagcaugagcgugaacuucaccagccccggcugccuggaccacaucaugaaguacaagaagaagugcgugaaggccggcagccugugggaccccaacaucaccgccugcaagaagaacgaggagaccguggaggugaacuucaccaccaccccccugggcaacagauacauggcccugauccagcacagcaccaucaucggcuucagccagguguucgagccccaccagaagaagcagaccagagccagcguggugauccccgugaccggcgacagcgagggcgccaccgugcagcugacccccuacuuccccaccugcggcagcgacugcaucagacacaagggcaccguggugcugugcccccagaccggcgugcccuucccccuggacaacaacaagagcaagcccggcggcuggcugccccugcugcugcugagccugcugguggccaccugggugcugguggccggcaucuaccugauguggagacacgagagaaucaagaagaccagcuucagcaccaccacccugcugccccccaucaaggugcuggugguguaccccagcgagaucugcuuccaccacaccaucugcuacuucaccgaguuccugcagaaccacugcagaagcgaggugauccuggagaaguggcagaagaagaagaucgccgagaugggccccgugcaguggcuggccacccagaagaaggccgccgacaaggugguguuccugcugagcaacgacgugaacagcgugugcgacggcaccugcggcaagagcgagggcagccccagcgagaacagccaggaccuguucccccuggccuucaaccuguucugcagcgaccugagaagccagauccaccugcacaaguacguggugguguacuucagagagaucgacaccaaggacgacuacaacgcccugagcgugugccccaaguaccaccugaugaaggacgccaccgccuucugcgccgagcugcugcacgugaagcagcaggugagcgccggcaagagaagccaggccugccacgacggcugcugcagccuguaa

SEQ ID NO: 18472 - RNA, 2124 nt, Artificial Sequence
  IL17RC__Homo_sapiens__NP_001190192
augcccgugcccugguuccugcugagccuggcccugggcagaagccccguggugcugagccuggagagacuggugggcccccaggacgccacccacugcagccccggccugagcugcagacugugggacagcgacauccugugccugcccggcgacaucgugcccgcccccggccccgugcuggcccccacccaccugcagaccgagcuggugcugagaugccagaaggagaccgacugcgaccugugccugagaguggccgugcaccuggccgugcacggccacugggaggagcccgaggacgaggagaaguucggcggcgccgccgacagcggcguggaggagcccagaaacgccagccugcaggcccagguggugcugagcuuccaggccuaccccaccgccagaugcgugcugcuggaggugcaggugcccgccgcccuggugcaguucggccagagcgugggcagcgugguguacgacugcuucgaggccgcccugggcagcgaggugagaaucuggagcuacacccagcccagauacgagaaggagcugaaccacacccagcagcugcccgacugcagaggccuggagguguggaacagcauccccagcugcugggcccugcccuggcugaacgugagcgccgacggcgacaacgugcaccuggugcugaacgugagcgaggagcagcacuucggccugagccuguacuggaaccaggugcagggcccccccaagcccagauggcacaagaaccugaccggcccccagaucaucacccugaaccacaccgaccuggugcccugccugugcauccagguguggccccuggagcccgacagcgugagaaccaacaucugccccuucagagaggaccccagagcccaccagaaccuguggcaggccgccagacugagacugcugacccugcagagcuggcugcuggacgcccccugcagccugcccgccgaggccgcccugugcuggagagcccccggcggcgaccccugccagccccuggugcccccccugagcugggagaacgugaccguggacaaggugcuggaguucccccugcugaagggccaccccaaccugugcgugcaggugaacagcagcgagaagcugcagcugcaggagugccugugggccgacagccugggcccccugaaggacgacgugcugcugcuggagaccagaggcccccaggacaacagaagccugugcgcccuggagcccagcggcugcaccagccugcccagcaaggccagcaccagagccgccagacugggcgaguaccugcugcaggaccugcagagcggccagugccugcagcugugggacgacgaccugggcgcccugugggccugccccauggacaaguacauccacaagagaugggcccugguguggcuggccugccugcuguucgccgccgcccugagccugauccugcugcugaagaaggaccacgccaaggccgccgccagaggcagagccgcccugcugcuguacagcgccgacgacagcggcuucgagagacuggugggcgcccuggccagcgcccugugccagcugccccugagaguggccguggaccuguggagcagaagagagcugagcgcccagggccccguggccugguuccacgcccagagaagacagacccugcaggagggcggcgugguggugcugcuguucagccccggcgccguggcccugugcagcgaguggcugcaggacggcgugagcggccccggcgcccacggcccccacgacgccuucagagccagccugagcugcgugcugcccgacuuccugcagggcagagcccccggcagcuacgugggcgccugcuucgacagacugcugcaccccgacgccgugcccgcccuguucagaaccgugcccguguucacccugcccagccagcugcccgacuuccugggcgcccugcagcagcccagagcccccagaagcggcagacugcaggagagagccgagcaggugagcagagcccugcagcccgcccuggacagcuacuuccacccccccggcacccccgcccccggcagaggcgugggccccggcgccggccccggcgccggcgacggcaccuaa

SEQ ID NO: 18473 - RNA, 2220 nt, Artificial Sequence
  IL17RD__Homo_sapiens__NP_060033
auggcccccuggcugcagcugugcagcguguucuucaccgugaacgccugccugaacggcagccagcuggccguggccgccggcggcagcggcagagccagaggcgccgacaccugcggcuggagaggcgugggccccgccagcagaaacagcggccuguacaacaucaccuucaaguacgacaacugcaccaccuaccugaaccccgugggcaagcacgugaucgccgacgcccagaacaucaccaucagccaguacgccugccacgaccagguggccgugaccauccuguggagccccggcgcccugggcaucgaguuccugaagggcuucagagugauccuggaggagcugaagagcgagggcagacagugccagcagcugauccugaaggaccccaagcagcugaacagcagcuucaagagaaccggcauggagagccagcccuuccugaacaugaaguucgagaccgacuacuucgugaagguggugcccuuccccagcaucaagaacgagagcaacuaccaccccuucuucuucagaaccagagccugcgaccugcugcugcagcccgacaaccuggccugcaagcccuucuggaagcccagaaaccugaacaucagccagcacggcagcgacaugcaggugagcuucgaccacgccccccacaacuucggcuucagauucuucuaccugcacuacaagcugaagcacgagggccccuucaagagaaagaccugcaagcaggagcagaccaccgagaccaccagcugccugcugcagaacgugagccccggcgacuacaucaucgagcugguggacgacaccaacaccaccagaaaggugaugcacuacgcccugaagcccgugcacagccccugggccggccccaucagagccguggccaucaccgugccccugguggugaucagcgccuucgccacccuguucaccgugaugugcagaaagaagcagcaggagaacaucuacagccaccuggacgaggagagcagcgagagcagcaccuacaccgccgcccugcccagagagagacugagacccagacccaagguguuccugugcuacagcagcaaggacggccagaaccacaugaacguggugcagugcuucgccuacuuccugcaggacuucugcggcugcgagguggcccuggaccugugggaggacuucagccugugcagagagggccagagagagugggugauccagaagauccacgagagccaguucaucaucguggugugcagcaagggcaugaaguacuucguggacaagaagaacuacaagcacaagggcggcggcagaggcagcggcaagggcgagcuguuccugguggccgugagcgccaucgccgagaagcugagacaggccaagcagagcagcagcgccgcccugagcaaguucaucgccguguacuucgacuacagcugcgagggcgacgugcccggcauccuggaccugagcaccaaguacagacugauggacaaccugccccagcugugcagccaccugcacagcagagaccacggccugcaggagcccggccagcacaccagacagggcagcagaagaaacuacuucagaagcaagagcggcagaagccuguacguggccaucugcaacaugcaccaguucaucgacgaggagcccgacugguucgagaagcaguucgugcccuuccacccccccccccugagauacagagagcccgugcuggagaaguucgacagcggccuggugcugaacgacgugaugugcaagcccggccccgagagcgacuucugccugaagguggaggccgccgugcugggcgccaccggccccgccgacagccagcacgagagccagcacggcggccuggaccaggacggcgaggccagacccgcccuggacggcagcgccgcccugcagccccugcugcacaccgugaaggccggcagccccagcgacaugcccagagacagcggcaucuacgacagcagcgugcccagcagcgagcugagccugccccugauggagggccugagcaccgaccagaccgagaccagcagccugaccgagagcgugagcagcagcagcggccugggcgaggaggagccccccgcccugcccagcaagcugcugagcagcggcagcugcaaggccgaccugggcugcagaagcuacaccgacgagcugcacgccguggccccccuguaa

SEQ ID NO: 18474 - RNA, 1602 nt, Artificial Sequence
  IL17RE__Homo_sapiens__NP_001180309
augggcagcagcagacuggccgcccugcugcugccccugcugcugaucgugaucgaccugagcgacagcgccggcaucggcuucagacaccugccccacuggaacaccagaugcccccuggccagccacaccgacgacagcuucaccggcagcagcgccuacauccccugcagaaccuggugggcccuguucagcaccaagcccuggugcgugagaguguggcacugcagcagaugccugugccagcaccugcugagcggcggcagcggccugcagagaggccuguuccaccugcuggugcagaagagcaagaagagcagcaccuucaaguucuacagaagacacaagaugcccgcccccgcccagagaaagcugcugcccagaagacaccugagcgagaagagccaccacaucagcauccccagccccgacaucagccacaagggccugagaagcaagagaacccagcccagcgaccccgagaccugggagagccugcccagacuggacagccagagacacggcggccccgaguucagcuucgaccugcugcccgaggccagagccaucagagugaccaucagcagcggccccgaggugagcgugagacugugccaccagugggcccuggagugcgaggagcugagcagccccuacgacgugcagaagaucgugagcggcggccacaccguggagcugcccuacgaguuccugcugcccugccugugcaucgaggccagcuaccugcaggaggacaccgugagaagaaagaagugccccuuccagagcuggcccgaggccuacggcagcgacuucuggaagagcgugcacuucaccgacuacagccagcacacccagauggugauggcccugacccugagaugcccccugaagcuggaggccgcccugugccagagacacgacuggcacacccugugcaaggaccugcccaacgccaccgccagagagagcgacggcugguacgugcuggagaagguggaccugcacccccagcugugcuucaaguucagcuucggcaacagcagccacguggagugcccccaccagaccggcagccugaccagcuggaacgugagcauggacacccaggcccagcagcugauccugcacuucagcagcagaaugcacgccaccuucagcgccgccuggagccugcccggccugggccaggacacccuggugccccccguguacaccgugagccaggccagaggcagcagccccgugagccuggaccugaucauccccuuccugagacccggcugcugcgugcugcugcacgccagccugagcagccccggcggcgaggacgccuggcugaucggcgugggcggcagcgugcccagcggcguggccgugagaugccccgugugccuggaggccccccuggugagcggcugccugcugcagacccccggcgcccuggaccccggcaccgccggccccccccaccccaccggcugcugcagcggcccccaccugcccgcccccaccgugagacccggccccagcgccgccagcgccccccccgccagaggcggccugggcggcgccgccgcccccggcggcagcgccggcuaa

SEQ ID NO: 18475 - RNA, 1011 nt, Artificial Sequence
  IL17REL__Homo_sapiens__NP_001001694
augagcagaagcgugcuggaggcccugaccagcagcaccgccaugcagugcgugcccagcgacggcugcgccaugcugcugagagugagagccagcaucacccugcacgagagacugagaggccuggaggccugcgccaugagccuggacacccaggagacccagugccagagcguguggguggccagagccagccacagacagcagggcggccagcagcugcaggugcacuucggcugcuucgccgugagcguggcccagcaccuguacgugacccugagaaccaucccccacuucugcggcgugcagcuggaccagagacaccugguggaggccggcaagcugagcuacuggguggacagaagaagaaaggccauccuggugcaggugcccagagccagcggcagccccgacuacuaccugagacugugccugaagagauucaccugcgaggacgccggcgcccccgugagagugaccgccaacagcgugagccaggccguguuccugcccuacagccaggagcugcccugccugugccuggagggcuggagcgccacccccgacgccgugagaauccagaucugccccuucgagaacgacaccgaggcccuggaggugcugugggacaccguguacuaccaccccgagagccagacccugagcugggagcccgccugccccgugagcggccacgugagccugugcuggagacccggccccggcgccggcugcagaaagcugcagcagagcagccagcuggugcacagaagagugcaguacccccugguggacacccagccccagcugugccugaaguucagcaccagcuggggcagcugggugagaugccccuucgagcagagaagauuccccaccccccccaccagcagaugcaccugcgugaccggcggcagccacagcagccugcccgccaacgcccacagcagacccgccagaagccugcagccccaggugaccuggcagcccccccugcugcugcccagcuaa

SEQ ID NO: 18476 - RNA, 585 nt, Artificial Sequence
  IL18BP__Homo_sapiens__NP_001034749
augaccaugagacacaacuggacccccgaccugagcccccugugggugcugcugcugugcgcccacguggugacccugcuggugagagccacccccgugagccagaccaccaccgccgccaccgccagcgugagaagcaccaaggaccccugccccagccagccccccguguuccccgccgccaagcagugccccgcccuggaggugaccuggcccgagguggaggugccccugaacggcacccugagccugagcugcguggccugcagcagauuccccaacuucagcauccuguacuggcugggcaacggcagcuucaucgagcaccugcccggcagacugugggagggcagcaccagcagagagagaggcagcaccggcacccagcugugcaaggcccuggugcuggagcagcugacccccgcccugcacagcaccaacuucagcugcgugcugguggaccccgagcagguggugcagagacacguggugcuggcccagcugugggccggccugagagccacccugccccccacccaggaggcccugcccagcagccacagcagcccccagcagcagggcuaa

SEQ ID NO: 18477 - RNA, 570 nt, Artificial Sequence
  IL18__Homo_sapiens__NP_001230140
auggccgccgagcccguggaggacaacugcaucaacuucguggccaugaaguucaucgacaacacccuguacuucaucgagaaccuggagagcgacuacuucggcaagcuggagagcaagcugagcgugaucagaaaccugaacgaccaggugcuguucaucgaccagggcaacagaccccuguucgaggacaugaccgacagcgacugcagagacaacgcccccagaaccaucuucaucaucagcauguacaaggacagccagcccagaggcauggccgugaccaucagcgugaagugcgagaagaucagcacccugagcugcgagaacaagaucaucagcuucaaggagaugaacccccccgacaacaucaaggacaccaagagcgacaucaucuucuuccagagaagcgugcccggccacgacaacaagaugcaguucgagagcagcagcuacgagggcuacuuccuggccugcgagaaggagagagaccuguucaagcugauccugaagaaggaggacgagcugggcgacagaagcaucauguucaccgugcagaacgaggacuaa

SEQ ID NO: 18478 - RNA, 1626 nt, Artificial Sequence
  IL18R1__Homo_sapiens__NP_003846
augaacugcagagagcugccccugacccugugggugcugaucagcgugagcaccgccgagagcugcaccagcagaccccacaucaccgugguggagggcgagcccuucuaccugaagcacugcagcugcagccuggcccacgagaucgagaccaccaccaagagcugguacaagagcagcggcagccaggagcacguggagcugaaccccagaagcagcagcagaaucgcccugcacgacugcgugcuggaguucuggcccguggagcugaacgacaccggcagcuacuucuuccagaugaagaacuacacccagaaguggaagcugaacgugaucagaagaaacaagcacagcugcuucaccgagagacaggugaccagcaagaucguggaggugaagaaguucuuccagaucaccugcgagaacagcuacuaccagacccuggugaacagcaccagccuguacaagaacugcaagaagcugcugcuggagaacaacaagaaccccaccaucaagaagaacgccgaguucgaggaccagggcuacuacagcugcgugcacuuccugcaccacaacggcaagcuguucaacaucaccaagaccuucaacaucaccaucguggaggacagaagcaacaucgugcccgugcugcugggccccaagcugaaccacguggccguggagcugggcaagaacgugagacugaacugcagcgcccugcugaacgaggaggacgugaucuacuggauguucggcgaggagaacggcagcgaccccaacauccacgaggagaaggagaugagaaucaugacccccgagggcaaguggcacgccagcaaggugcugagaaucgagaacaucggcgagagcaaccugaacgugcuguacaacugcaccguggccagcaccggcggcaccgacaccaagagcuucauccuggugagaaaggccgacauggccgacauccccggccacguguucaccagaggcaugaucaucgccgugcugauccugguggccguggugugccuggugaccgugugcgugaucuacagaguggaccuggugcuguucuacagacaccugaccagaagagacgagacccugaccgacggcaagaccuacgacgccuucgugagcuaccugaaggagugcagacccgagaacggcgaggagcacaccuucgccguggagauccugcccagagugcuggagaagcacuucggcuacaagcugugcaucuucgagagagacguggugcccggcggcgccgugguggacgagauccacagccugaucgagaagagcagaagacugaucaucgugcugagcaagagcuacaugagcaacgaggugagauacgagcuggagagcggccugcacgaggcccugguggagagaaagaucaagaucauccugaucgaguucacccccgugaccgacuucaccuuccugccccagagccugaagcugcugaagagccacagagugcugaaguggaaggccgacaagagccugagcuacaacagcagauucuggaagaaccugcuguaccugaugcccgccaagaccgugaagcccggcagagacgagcccgaggugcugcccgugcugagcgagagcuaa

SEQ ID NO: 18479 - RNA, 1800 nt, Artificial Sequence
  IL18RAP__Homo_sapiens__NP_003844
augcugugccugggcuggaucuuccuguggcugguggccggcgagagaaucaagggcuucaacaucagcggcugcagcaccaagaagcugcuguggaccuacagcaccagaagcgaggaggaguucgugcuguucugcgaccugcccgagccccagaagagccacuucugccacagaaacagacugagccccaagcaggugcccgagcaccugcccuucaugggcagcaacgaccugagcgacgugcagugguaccagcagcccagcaacggcgacccccuggaggacaucagaaagagcuacccccacaucauccaggacaagugcacccugcacuuccugacccccggcgugaacaacagcggcagcuacaucugcagacccaagaugaucaagagccccuacgacguggccugcugcgugaagaugauccuggaggugaagccccagaccaacgccagcugcgaguacagcgccagccacaagcaggaccugcugcugggcagcaccggcagcaucagcugccccagccugagcugccagagcgacgcccagagccccgccgugaccugguacaagaacggcaagcugcugagcguggagagaagcaacagaaucgugguggacgagguguacgacuaccaccagggcaccuacgugugcgacuacacccagagcgacaccgugagcagcuggaccgugagagccguggugcaggugagaaccaucgugggcgacaccaagcugaagcccgacauccuggaccccguggaggacacccuggagguggagcugggcaagccccugaccaucagcugcaaggccagauucggcuucgagagaguguucaaccccgugaucaagugguacaucaaggacagcgaccuggagugggaggugagcgugcccgaggccaagagcaucaagagcacccugaaggacgagaucaucgagagaaacaucauccuggagaaggugacccagagagaccugagaagaaaguucgugugcuucgugcagaacagcaucggcaacaccacccagagcgugcagcugaaggagaagagaggcguggugcugcuguacauccugcugggcaccaucggcacccugguggccgugcuggccgccagcgcccugcuguacagacacuggaucgagaucgugcugcuguacagaaccuaccagagcaaggaccagacccugggcgacaagaaggacuucgacgccuucgugagcuacgccaaguggagcagcuuccccagcgaggccaccagcagccugagcgaggagcaccuggcccugagccuguuccccgacgugcuggagaacaaguacggcuacagccugugccugcuggagagagacguggcccccggcggcguguacgccgaggacaucgugagcaucaucaagagaagcagaagaggcaucuucauccugagccccaacuacgugaacggccccagcaucuucgagcugcaggccgccgugaaccuggcccuggacgaccagacccugaagcugauccugaucaaguucugcuacuuccaggagcccgagagccugccccaccuggugaagaaggcccugagagugcugcccaccgugaccuggagaggccugaagagcgugccccccaacagcagauucugggccaagaugagauaccacaugcccgugaagaacagccagggcuucaccuggaaccagcugagaaucaccagcagaaucuuccaguggaagggccugagcagaaccgagaccaccggcagaagcagccagcccaaggagugguaa

SEQ ID NO: 18480 - RNA, 534 nt, Artificial Sequence
  IL19__Homo_sapiens__NP_037503
augaagcugcagugcgugagccuguggcugcugggcaccauccugauccugugcagcguggacaaccacggccugagaagaugccugaucagcaccgacaugcaccacaucgaggagagcuuccaggagaucaagagagccauccaggccaaggacaccuuccccaacgugaccauccugagcacccuggagacccugcagaucaucaagccccuggacgugugcugcgugaccaagaaccugcuggccuucuacguggacagaguguucaaggaccaccaggagcccaaccccaagauccugagaaagaucagcagcaucgccaacagcuuccuguacaugcagaagacccugagacagugccaggagcagagacagugccacugcagacaggaggccaccaacgccaccagagugauccacgacaacuacgaccagcuggaggugcacgccgccgccaucaagagccugggcgagcuggacguguuccuggccuggaucaacaagaaccacgaggugauguucagcgccuaa

SEQ ID NO: 18481 - RNA, 816 nt, Artificial Sequence
  IL1A__Homo_sapiens__NP_000566
auggccaaggugcccgacauguucgaggaccugaagaacugcuacagcgagaacgaggaggacagcagcagcaucgaccaccugagccugaaccagaagagcuucuaccacgugagcuacggcccccugcacgagggcugcauggaccagagcgugagccugagcaucagcgagaccagcaagaccagcaagcugaccuucaaggagagcaugguggugguggccaccaacggcaaggugcugaagaagagaagacugagccugagccagagcaucaccgacgacgaccuggaggccaucgccaacgacagcgaggaggagaucaucaagcccagaagcgcccccuucagcuuccugagcaacgugaaguacaacuucaugagaaucaucaaguacgaguucauccugaacgacgcccugaaccagagcaucaucagagccaacgaccaguaccugaccgccgccgcccugcacaaccuggacgaggccgugaaguucgacaugggcgccuacaagagcagcaaggacgacgccaagaucaccgugauccugagaaucagcaagacccagcuguacgugaccgcccaggacgaggaccagcccgugcugcugaaggagaugcccgagauccccaagaccaucaccggcagcgagaccaaccugcuguucuucugggagacccacggcaccaagaacuacuucaccagcguggcccaccccaaccuguucaucgccaccaagcaggacuacugggugugccuggccggcggcccccccagcaucaccgacuuccagauccuggagaaccaggccuaa

SEQ ID NO: 18482 - RNA, 810 nt, Artificial Sequence
  IL1B__Homo_sapiens__NP_000567
auggccgaggugcccgagcuggccagcgagaugauggccuacuacagcggcaacgaggacgaccuguucuucgaggccgacggccccaagcagaugaagugcagcuuccaggaccuggaccugugcccccuggacggcggcauccagcugagaaucagcgaccaccacuacagcaagggcuucagacaggccgccagcguggugguggccauggacaagcugagaaagaugcuggugcccugcccccagaccuuccaggagaacgaccugagcaccuucuuccccuucaucuucgaggaggagcccaucuucuucgacaccugggacaacgaggccuacgugcacgacgcccccgugagaagccugaacugcacccugagagacagccagcagaagagccuggugaugagcggccccuacgagcugaaggcccugcaccugcagggccaggacauggagcagcaggugguguucagcaugagcuucgugcagggcgaggagagcaacgacaagauccccguggcccugggccugaaggagaagaaccuguaccugagcugcgugcugaaggacgacaagcccacccugcagcuggagagcguggaccccaagaacuaccccaagaagaagauggagaagagauucguguucaacaagaucgagaucaacaacaagcuggaguucgagagcgcccaguuccccaacugguacaucagcaccagccaggccgagaacaugcccguguuccugggcggcaccaagggcggccaggacaucaccgacuucaccaugcaguucgugagcagcuaa

SEQ ID NO: 18483 - RNA, 459 nt, Artificial Sequence
  IL1F10__Homo_sapiens__NP_115945
augugcagccugcccauggccagauacuacaucaucaaguacgccgaccagaaggcccuguacaccagagacggccagcugcuggugggcgaccccguggccgacaacugcugcgccgagaagaucugcauccugcccaacagaggccuggccagaaccaaggugcccaucuuccugggcauccagggcggcagcagaugccuggccugcguggagaccgaggagggccccagccugcagcuggaggacgugaacaucgaggagcuguacaagggcggcgaggaggccaccagauucaccuucuuccagagcagcagcggcagcgccuucagacuggaggccgccgccuggcccggcugguuccugugcggccccgccgagccccagcagcccgugcagcugaccaaggagagcgagcccagcgccagaaccaaguucuacuucgagcagagcugguaa

SEQ ID NO: 18484 - RNA, 1710 nt, Artificial Sequence
  IL1R1__Homo_sapiens__XP_011509420
augaaggugcugcugagacugaucugcuucaucgcccugcugaucagcagccuggaggccgacaagugcaaggagagagaggagaagaucauccuggugagcagcgccaacgagaucgacgugagacccugcccccugaaccccaacgagcacaagggcaccaucaccugguacaaggacgacagcaagacccccgugagcaccgagcaggccagcagaauccaccagcacaaggagaagcugugguucgugcccgccaagguggaggacagcggccacuacuacugcguggugagaaacagcagcuacugccugagaaucaagaucagcgccaaguucguggagaacgagcccaaccugugcuacaacgcccaggccaucuucaagcagaagcugcccguggccggcgacggcggccuggugugccccuacauggaguucuucaagaacgagaacaacgagcugcccaagcugcagugguacaaggacugcaagccccugcugcuggacaacauccacuucagcggcgugaaggacagacugaucgugaugaacguggccgagaagcacagaggcaacuacaccugccacgccagcuacaccuaccugggcaagcaguaccccaucaccagagugaucgaguucaucacccuggaggagaacaagcccaccagacccgugaucgugagccccgccaacgagaccauggagguggaccugggcagccagauccagcugaucugcaacgugaccggccagcugagcgacaucgccuacuggaaguggaacggcagcgugaucgacgaggacgaccccgugcugggcgaggacuacuacagcguggagaaccccgccaacaagagaagaagcacccugaucaccgugcugaacaucagcgagaucgagagcagauucuacaagcaccccuucaccugcuucgccaagaacacccacggcaucgacgccgccuacauccagcugaucuaccccgugaccaacuuccagaagcacaugaucggcaucugcgugacccugaccgugaucaucgugugcagcguguucaucuacaagaucuucaagaucgacaucgugcugugguacagagacagcugcuacgacuuccugcccaucaaggccagcgacggcaagaccuacgacgccuacauccuguaccccaagaccgugggcgagggcagcaccagcgacugcgacaucuucguguucaaggugcugcccgaggugcuggagaagcagugcggcuacaagcuguucaucuacggcagagacgacuacgugggcgaggacaucguggaggugaucaacgagaacgugaagaagagcagaagacugaucaucauccuggugagagagaccagcggcuucagcuggcugggcggcagcagcgaggagcagaucgccauguacaacgcccuggugcaggacggcaucaagguggugcugcuggagcuggagaagauccaggacuacgagaagaugcccgagagcaucaaguucaucaagcagaagcacggcgccaucagauggagcggcgacuucacccagggcccccagagcgccaagaccagauucuggaagaacgugagauaccacaugcccgugcagagaagaagccccagcagcaagcaccagcugcugagccccgccaccaaggagaagcugcagagagaggcccacgugccccugggcuaa

SEQ ID NO: 18485 - RNA, 1197 nt, Artificial Sequence
  IL1R2__Homo_sapiens__NP_004624
augcugagacuguacgugcuggugaugggcgugagcgccuucacccugcagcccgccgcccacaccggcgccgccagaagcugcagauucagaggcagacacuacaagagagaguucagacuggagggcgagcccguggcccugagaugcccccaggugcccuacuggcugugggccagcgugagccccagaaucaaccugaccuggcacaagaacgacagcgccagaaccgugcccggcgaggaggagaccagaaugugggcccaggacggcgcccuguggcugcugcccgcccugcaggaggacagcggcaccuacgugugcaccaccagaaacgccagcuacugcgacaagaugagcaucgagcugagaguguucgagaacaccgacgccuuccugcccuucaucagcuacccccagauccugacccugagcaccagcggcgugcuggugugccccgaccugagcgaguucaccagagacaagaccgacgugaagauccagugguacaaggacagccugcugcuggacaaggacaacgagaaguuccugagcgugagaggcaccacccaccugcuggugcacgacguggcccuggaggacgccggcuacuacagaugcgugcugaccuucgcccacgagggccagcaguacaacaucaccagaagcaucgagcugagaaucaagaagaagaaggaggagaccauccccgugaucaucagcccccugaagaccaucagcgccagccugggcagcagacugaccauccccugcaagguguuccugggcaccggcaccccccugaccaccaugcugugguggaccgccaacgacacccacaucgagagcgccuaccccggcggcagagugaccgagggccccagacaggaguacagcgagaacaacgagaacuacaucgaggugccccugaucuucgaccccgugaccagagaggaccugcacauggacuucaagugcguggugcacaacacccugagcuuccagacccugagaaccaccgugaaggaggccagcagcaccuucagcuggggcaucgugcuggccccccugagccuggccuuccuggugcugggcggcaucuggaugcacagaagaugcaagcacagaaccggcaaggccgacggccugaccgugcuguggccccaccaccaggacuuccagagcuaccccaaguaa

SEQ ID NO: 18486 - RNA, 1713 nt, Artificial Sequence
  IL1RAP__Homo_sapiens__NP_001161401
augacccugcuguggugcguggugagccuguacuucuacggcauccugcagagcgacgccagcgagagaugcgacgacuggggccuggacaccaugagacagauccagguguucgaggacgagcccgccagaaucaagugcccccuguucgagcacuuccugaaguucaacuacagcaccgcccacagcgccggccugacccugaucugguacuggaccagacaggacagagaccuggaggagcccaucaacuucagacugcccgagaacagaaucagcaaggagaaggacgugcugugguucagacccacccugcugaacgacaccggcaacuacaccugcaugcugagaaacaccaccuacugcagcaagguggccuucccccuggagguggugcagaaggacagcugcuucaacagccccaugaagcugcccgugcacaagcuguacaucgaguacggcauccagagaaucaccugccccaacguggacggcuacuuccccagcagcgugaagcccaccaucaccugguacaugggcugcuacaagauccagaacuucaacaacgugauccccgagggcaugaaccugagcuuccugaucgcccugaucagcaacaacggcaacuacaccugcguggugaccuaccccgagaacggcagaaccuuccaccugaccagaacccugaccgugaagguggugggcagccccaagaacgccgugccccccgugauccacagccccaacgaccacgugguguacgagaaggagcccggcgaggagcugcugauccccugcaccguguacuucagcuuccugauggacagcagaaacgaggugugguggaccaucgacggcaagaagcccgacgacaucaccaucgacgugaccaucaacgagagcaucagccacagcagaaccgaggacgagaccagaacccagauccugagcaucaagaaggugaccagcgaggaccugaagagaagcuacgugugccacgccagaagcgccaagggcgagguggccaaggccgccaaggugaagcagaaggugcccgcccccagauacaccguggagcuggccugcggcuucggcgccaccgugcugcugguggugauccugaucgugguguaccacguguacuggcuggagauggugcuguucuacagagcccacuucggcaccgacgagaccauccuggacggcaaggaguacgacaucuacgugagcuacgccagaaacgccgaggaggaggaguucgugcugcugacccugagaggcgugcuggagaacgaguucggcuacaagcugugcaucuucgacagagacagccugcccggcggcaucgugaccgacgagacccugagcuucauccagaagagcagaagacugcugguggugcugagccccaacuacgugcugcagggcacccaggcccugcuggagcugaaggccggccuggagaacauggccagcagaggcaacaucaacgugauccuggugcaguacaaggccgugaaggagaccaaggugaaggagcugaagagagccaagaccgugcugaccgugaucaaguggaagggcgagaagagcaaguacccccagggcagauucuggaagcagcugcagguggccaugcccgugaagaagagccccagaagaagcagcagcgacgagcagggccugagcuacagcagccugaagaacguguaa

SEQ ID NO: 18487 - RNA, 2091 nt, Artificial Sequence
  IL1RAPL1__Homo_sapiens__XP_005274498
augaaggcccccaucccccaccugauccugcuguacgccaccuucacccagagccugaagguggugaccaagagaggcagcgccgacggcugcaccgacuggagcaucgacaucaagaaguaccaggugcuggugggcgagcccgugagaaucaagugcgcccuguucuacggcuacaucagaaccaacuacagccuggcccagagcgccggccugagccugaugugguacaagagcagcggccccggcgacuucgaggagcccaucgccuucgacggcagcagaaugagcaaggaggaggacagcaucugguucagacccacccugcugcaggacagcggccuguacgccugcgugaucagaaacagcaccuacugcaugaaggugagcaucagccugaccgugggcgagaacgacaccggccugugcuacaacagcaagaugaaguacuucgagaaggccgagcugagcaagagcaaggagaucagcugcagagacaucgaggacuuccugcugcccaccagagagcccgagauccugugguacaaggagugcagaaccaagaccuggagacccagcaucguguucaagagagacacccugcugaucagagaggugagagaggacgacaucggcaacuacaccugcgagcugaaguacggcggcuucguggugagaagaaccaccgagcugaccgugaccgccccccugaccgacaagccccccaagcugcuguaccccauggagagcaagcugaccauccaggagacccagcugggcgacagcgccaaccugaccugcagagccuucuucggcuacagcggcgacgugagcccccugaucuacuggaugaagggcgagaaguucaucgaggaccuggacgagaacagagugugggagagcgacaucagaauccugaaggagcaccugggcgagcaggaggugagcaucagccugaucguggacagcguggaggagggcgaccugggcaacuacagcugcuacguggagaacggcaacggcagaagacacgccagcgugcugcugcacaagagagagcugauguacaccguggagcuggccggcggccugggcgccauccugcugcugcuggugugccuggugaccaucuacaagugcuacaagaucgagaucaugcuguucuacagaaaccacuucggcgccgaggagcuggacggcgacaacaaggacuacgacgccuaccugagcuacaccaagguggaccccgaccaguggaaccaggagaccggcgaggaggagagauucgcccuggagauccugcccgacaugcuggagaagcacuacggcuacaagcuguucauccccgacagagaccugauccccaccggcaccuacaucgaggacguggccagaugcguggaccagagcaagagacugaucaucgugaugacccccaacuacguggugagaagaggcuggagcaucuucgagcuggagaccagacugagaaacaugcuggugaccggcgagaucaaggugauccugaucgagugcagcgagcugagaggcaucaugaacuaccaggagguggaggcccugaagcacaccaucaagcugcugaccgugaucaaguggcacggccccaagugcaacaagcugaacagcaaguucuggaagagacugcaguacgagaugcccuucaagagaaucgagcccaucacccacgagcaggcccuggacgugagcgagcagggccccuucggcgagcugcagaccgugagcgccaucagcauggccgccgccaccagcaccgcccuggccaccgcccaccccgaccugagaagcaccuuccacaacaccuaccacagccagaugagacagaagcacuacuacagaagcuacgaguacgacgugccccccaccggcacccugccccugaccagcaucggcaaccagcacaccuacugcaacauccccaugacccugaucaacggccagagaccccagaccaagagcagcagagagcagaaccccgacgaggcccacaccaacagcgccauccugccccugcugcccagagagaccagcaucagcagcgugaucugguaa

SEQ ID NO: 18488 - RNA, 2061 nt, Artificial Sequence
  IL1RAPL2__Homo_sapiens__NP_059112
augaagccccccuuccugcuggcccugguggugugcagcguggugagcaccaaccugaagauggugagcaagagaaacagcguggacggcugcaucgacuggagcguggaccugaagaccuacauggcccuggccggcgagcccgugagagugaagugcgcccuguucuacagcuacaucagaaccaacuacagcaccgcccagagcaccggccugagacugaugugguacaagaacaagggcgaccuggaggagcccaucaucuucagcgaggugagaaugagcaaggaggaggacagcaucugguuccacagcgccgaggcccaggacagcggcuucuacaccugcgugcugagaaacagcaccuacugcaugaaggugagcaugagccugaccguggccgagaacgagagcggccugugcuacaacagcagaaucagauaccuggagaagagcgaggugaccaagagaaaggagaucagcugccccgacauggacgacuucaagaagagcgaccaggagcccgacguggugugguacaaggagugcaagcccaagauguggagaagcaucaucauccagaagggcaacgcccugcugauccaggaggugcaggaggaggacggcggcaacuacaccugcgagcugaaguacgagggcaagcuggugagaagaaccaccgagcugaaggugaccgcccugcugaccgacaagccccccaagccccuguuccccauggagaaccagcccagcgugaucgacgugcagcugggcaagccccugaacauccccugcaaggccuucuucggcuucagcggcgagagcggccccaugaucuacuggaugaagggcgagaaguucaucgaggagcuggccggccacaucagagagggcgagaucagacugcugaaggagcaccugggcgagaaggagguggagcuggcccugaucuucgacagcgugguggaggccgaccuggccaacuacaccugccacguggagaacagaaacggcagaaagcacgccagcgugcugcugagaaagaaggaccugaucuacaagaucgagcuggccggcggccugggcgccaucuuccugcugcuggugcugcugguggugaucuacaagugcuacaacaucgagcugaugcuguucuacagacagcacuucggcgccgacgagaccaacgacgacaacaaggaguacgacgccuaccugagcuacaccaagguggaccaggacacccuggacugcgacaaccccgaggaggagcaguucgcccuggaggugcugcccgacgugcuggagaagcacuacggcuacaagcuguucauccccgagagagaccugauccccagcggcaccuacauggaggaccugaccagauacguggagcagagcagaagacugaucaucgugcugacccccgacuacauccugagaagaggcuggagcaucuucgagcuggagagcagacugcacaacaugcuggugagcggcgagaucaaggugauccugaucgagugcaccgagcugaagggcaaggugaacugccaggagguggagagccugaagagaagcaucaagcugcugagccugaucaaguggaagggcagcaagagcagcaagcugaacagcaaguucuggaagcaccugguguacgagaugcccaucaagaagaaggagaugcugcccagaugccacgugcuggacagcgccgagcagggccuguucggcgagcugcagcccauccccagcaucgccaugaccagcaccagcgccacccuggugagcagccaggccgaccugcccgaguuccaccccagcgacagcaugcagaucagacacugcugcagaggcuacaagcacgagauccccgccaccacccugcccgugcccagccugggcaaccaccacaccuacugcaaccugccccugacccugcugaacggccagcugccccugaacaacacccugaaggacacccaggaguuccacagaaacagcagccugcugccccugagcagcaaggagcugagcuucaccagcgacaucugguaa

SEQ ID NO: 18489 - RNA, 636 nt, Artificial Sequence
  IL1RL1__Homo_sapiens__NP_001269337
auguacagcaccgugagcggcagcgagaagaacagcaagaucuacugccccaccaucgaccuguacaacuggaccgccccccuggagugguucaagaacugccaggcccugcagggcagcagauacagagcccacaagagcuuccuggugaucgacaacgugaugaccgaggacgccggcgacuacaccugcaaguucauccacaacgagaacggcgccaacuacagcgugaccgccaccagaagcuucaccgugaaggacgagcagggcuucagccuguuccccgugaucggcgcccccgcccagaacgagaucaaggagguggagaucggcaagaacgccaaccugaccugcagcgccugcuucggcaagggcacccaguuccuggccgccgugcuguggcagcugaacggcaccaagaucaccgacuucggcgagcccagaauccagcaggaggagggccagaaccagagcuucagcaacggccuggccugccuggacauggugcugagaaucgccgacgugaaggaggaggaccugcugcugcaguacgacugccuggcccugaaccugcacggccugagaagacacaccgugagacugagcagaaagaaccccagcaaggagugcuucuaa

SEQ ID NO: 18490 - RNA, 1728 nt, Artificial Sequence
  IL1RL2__Homo_sapiens__NP_003845
auguggagccugcugcugugcggccugagcaucgcccugccccugagcgugaccgccgacggcugcaaggacaucuucaugaagaacgagauccugagcgccagccagcccuucgccuucaacugcaccuucccccccaucaccagcggcgaggugagcgugaccugguacaagaacagcagcaagauccccgugagcaagaucauccagagcagaauccaccaggacgagaccuggauccuguuccugcccauggaguggggcgacagcggcguguaccagugcgugaucaagggcagagacagcugccacagaauccacgugaaccugaccguguucgagaagcacuggugcgacaccagcaucggcggccugcccaaccugagcgacgaguacaagcagauccugcaccugggcaaggacgacagccugaccugccaccugcacuuccccaagagcugcgugcugggccccaucaagugguacaaggacugcaacgagaucaagggcgagagauucaccgugcuggagaccagacugcuggugagcaacgugagcgccgaggacagaggcaacuacgccugccaggccauccugacccacagcggcaagcaguacgaggugcugaacggcaucaccgugagcaucaccgagagagccggcuacggcggcagcgugcccaagaucaucuaccccaagaaccacagcaucgaggugcagcugggcaccacccugaucguggacugcaacgugaccgacaccaaggacaacaccaaccugagaugcuggagagugaacaacacccugguggacgacuacuacgacgagagcaagagaaucagagagggcguggagacccacgugagcuucagagagcacaaccuguacaccgugaacaucaccuuccuggaggugaagauggaggacuacggccugcccuucaugugccacgccggcgugagcaccgccuacaucauccugcagcugcccgcccccgacuucagagccuaccugaucggcggccugaucgcccugguggccguggccgugagcgugguguacaucuacaacaucuucaagaucgacaucgugcugugguacagaagcgccuuccacagcaccgagaccaucguggacggcaagcuguacgacgccuacgugcuguaccccaagccccacaaggagagccagagacacgccguggacgcccuggugcugaacauccugcccgaggugcuggagagacagugcggcuacaagcuguucaucuucggcagagacgaguuccccggccaggccguggccaacgugaucgacgagaacgugaagcugugcagaagacugaucgugaucguggugcccgagagccugggcuucggccugcugaagaaccugagcgaggagcagaucgccguguacagcgcccugauccaggacggcaugaaggugauccugaucgagcuggagaagaucgaggacuacaccgugaugcccgagagcauccaguacaucaagcagaagcacggcgccaucagauggcacggcgacuucaccgagcagagccagugcaugaagaccaaguucuggaagaccgugagauaccacaugccccccagaagaugcagacccuucccccccgugcagcugcugcagcacacccccugcuacagaaccgccggccccgagcugggcagcagaagaaagaagugcacccugaccaccggcuaa

SEQ ID NO: 18491 - RNA, 480 nt, Artificial Sequence
  IL1RN__Homo_sapiens__NP_000568
auggcccuggagaccaucugcagacccagcggcagaaagagcagcaagaugcaggccuucagaaucugggacgugaaccagaagaccuucuaccugagaaacaaccagcugguggccggcuaccugcagggccccaacgugaaccuggaggagaagaucgacguggugcccaucgagccccacgcccuguuccugggcauccacggcggcaagaugugccugagcugcgugaagagcggcgacgagaccagacugcagcuggaggccgugaacaucaccgaccugagcgagaacagaaagcaggacaagagauucgccuucaucagaagcgacagcggccccaccaccagcuucgagagcgccgccugccccggcugguuccugugcaccgccauggaggccgaccagcccgugagccugaccaacaugcccgacgagggcgugauggugaccaaguucuacuuccaggaggacgaguaa

SEQ ID NO: 18492 - RNA, 531 nt, Artificial Sequence
  IL20__Homo_sapiens__NP_061194
augaaggccagcagccuggccuucagccugcugagcgccgccuucuaccugcuguggacccccagcaccggccugaagacccugaaccugggcagcugcgugaucgccaccaaccugcaggagaucagaaacggcuucagcgagaucagaggcagcgugcaggccaaggacggcaacaucgacaucagaauccugagaagaaccgagagccugcaggacaccaagcccgccaacagaugcugccugcugagacaccugcugagacuguaccuggacagaguguucaagaacuaccagacccccgaccacuacacccugagaaagaucagcagccuggccaacagcuuccugaccaucaagaaggaccugagacugugccacgcccacaugaccugccacugcggcgaggaggccaugaagaaguacagccagauccugagccacuucgagaagcuggagccccaggccgccguggugaaggcccugggcgagcuggacauccugcugcaguggauggaggagaccgaguaa

SEQ ID NO: 18493 - RNA, 1515 nt, Artificial Sequence
  IL20RA__Homo_sapiens__NP_001265651
augaagaacgugcugcaguggaccccccccgagggccugcagggcgugaaggugaccuacaccgugcaguacuucaucuacggccagaagaaguggcugaacaagagcgagugcagaaacaucaacagaaccuacugcgaccugagcgccgagaccagcgacuacgagcaccaguacuacgccaaggugaaggccaucuggggcaccaagugcagcaagugggccgagagcggcagauucuaccccuuccuggagacccagaucggcccccccgagguggcccugaccaccgacgagaagagcaucagcguggugcugaccgcccccgagaaguggaagagaaaccccgaggaccugcccgugagcaugcagcagaucuacagcaaccugaaguacaacgugagcgugcugaacaccaagagcaacagaaccuggagccagugcgugaccaaccacacccuggugcugaccuggcuggagcccaacacccuguacugcgugcacguggagagcuucgugcccggcccccccagaagagcccagcccagcgagaagcagugcgccagaacccugaaggaccagagcagcgaguucaaggccaagaucaucuucugguacgugcugcccaucagcaucaccguguuccuguucagcgugaugggcuacagcaucuacagauacauccacgugggcaaggagaagcaccccgccaaccugauccugaucuacggcaacgaguucgacaagagauucuucgugcccgccgagaagaucgugaucaacuucaucacccugaacaucagcgacgacagcaagaucagccaccaggacaugagccugcugggcaagagcagcgacgugagcagccugaacgacccccagcccagcggcaaccugagacccccccaggaggaggaggaggugaagcaccugggcuacgccagccaccugauggagaucuucugcgacagcgaggagaacaccgagggcaccagccugacccagcaggagagccugagcagaaccaucccccccgacaagaccgugaucgaguacgaguacgacgugagaaccaccgacaucugcgccggccccgaggagcaggagcugagccugcaggaggaggugagcacccagggcacccugcuggagagccaggccgcccuggccgugcugggcccccagacccugcaguacagcuacaccccccagcugcaggaccuggacccccuggcccaggagcacaccgacagcgaggagggccccgaggaggagcccagcaccacccugguggacugggacccccagaccggcagacugugcauccccagccugagcagcuucgaccaggacagcgagggcugcgagcccagcgagggcgacggccugggcgaggagggccugcugagcagacuguacgaggagcccgcccccgacagaccccccggcgagaacgagaccuaccugaugcaguucauggaggaguggggccuguacgugcagauggagaacuaa

SEQ ID NO: 18494 - RNA, 936 nt, Artificial Sequence
  IL20RB__Homo_sapiens__NP_653318
augcagaccuucaccauggugcuggaggagaucuggaccagccuguucaugugguucuucuacgcccugauccccugccugcugaccgacgagguggccauccugcccgccccccagaaccugagcgugcugagcaccaacaugaagcaccugcugauguggagccccgugaucgcccccggcgagaccguguacuacagcguggaguaccagggcgaguacgagagccuguacaccagccacaucuggauccccagcagcuggugcagccugaccgagggccccgagugcgacgugaccgacgacaucaccgccaccgugcccuacaaccugagagugagagccacccugggcagccagaccagcgccuggagcauccugaagcaccccuucaacagaaacagcaccauccugaccagacccggcauggagaucaccaaggacggcuuccaccuggugaucgagcuggaggaccugggcccccaguucgaguuccugguggccuacuggagaagagagcccggcgccgaggagcacgugaagauggugagaagcggcggcauccccgugcaccuggagaccauggagcccggcgccgccuacugcgugaaggcccagaccuucgugaaggccaucggcagauacagcgccuucagccagaccgagugcguggaggugcagggcgaggccaucccccuggugcuggcccuguucgccuucgugggcuucaugcugauccuggugguggugccccuguucguguggaagaugggcagacugcugcaguacagcugcugccccgugguggugcugcccgacacccugaagaucaccaacagcccccagaagcugaucagcugcagaagagaggagguggacgccugcgccaccgccgugaugagccccgaggagcugcugagagccuggaucagcuaa

SEQ ID NO: 18495 - RNA, 489 nt, Artificial Sequence
  IL21__Homo_sapiens__NP_068575
augagaagcagccccggcaacauggagagaaucgugaucugccugauggugaucuuccugggcacccuggugcacaagagcagcagccagggccaggacagacacaugaucagaaugagacagcugaucgacaucguggaccagcugaagaacuacgugaacgaccuggugcccgaguuccugcccgcccccgaggacguggagaccaacugcgaguggagcgccuucagcugcuuccagaaggcccagcugaagagcgccaacaccggcaacaacgagagaaucaucaacgugagcaucaagaagcugaagagaaagccccccagcaccaacgccggcagaagacagaagcacagacugaccugccccagcugcgacagcuacgagaagaagccccccaaggaguuccuggagagauucaagagccugcugcagaagaugauccaccagcaccugagcagcagaacccacggcagcgaggacagcuaa

SEQ ID NO: 18496 - RNA, 1617 nt, Artificial Sequence
  IL21R__Homo_sapiens__NP_068570
augcccagaggcugggccgccccccugcugcugcugcugcugcagggcggcuggggcugccccgaccuggugugcuacaccgacuaccugcagaccgugaucugcauccuggagauguggaaccugcaccccagcacccugacccugaccuggcaggaccaguacgaggagcugaaggacgaggccaccagcugcagccugcacagaagcgcccacaacgccacccacgccaccuacaccugccacauggacguguuccacuucauggccgacgacaucuucagcgugaacaucaccgaccagagcggcaacuacagccaggagugcggcagcuuccugcuggccgagagcaucaagcccgccccccccuucaacgugaccgugaccuucagcggccaguacaacaucagcuggagaagcgacuacgaggaccccgccuucuacaugcugaagggcaagcugcaguacgagcugcaguacagaaacagaggcgaccccugggccgugagccccagaagaaagcugaucagcguggacagcagaagcgugagccugcugccccuggaguucagaaaggacagcagcuacgagcugcaggugagagccggccccaugcccggcagcagcuaccagggcaccuggagcgaguggagcgaccccgugaucuuccagacccagagcgaggagcugaaggagggcuggaacccccaccugcugcugcugcugcugcuggugaucguguucauccccgccuucuggagccugaagacccacccccuguggagacuguggaagaagaucugggccgugcccagccccgagagauucuucaugccccuguacaagggcugcagcggcgacuucaagaagugggugggcgcccccuucaccggcagcagccuggagcugggccccuggagccccgaggugcccagcacccuggagguguacagcugccacccccccagaagccccgccaagagacugcagcugaccgagcugcaggagcccgccgagcugguggagagcgacggcgugcccaagcccagcuucuggcccaccgcccagaacagcggcggcagcgccuacagcgaggagagagacagacccuacggccuggugagcaucgacaccgugaccgugcuggacgccgagggccccugcaccuggcccugcagcugcgaggacgacggcuaccccgcccuggaccuggacgccggccuggagcccagccccggccuggaggacccccugcuggacgccggcaccaccgugcugagcugcggcugcgugagcgccggcagccccggccugggcggcccccugggcagccugcuggacagacugaagcccccccuggccgacggcgaggacugggccggcggccugcccuggggcggcagaagccccggcggcgugagcgagagcgaggccggcagcccccuggccggccuggacauggacaccuucgacagcggcuucgugggcagcgacugcagcagccccguggagugcgacuucaccagccccggcgacgagggcccccccagaagcuaccugagacaguggguggugaucccccccccccugagcagccccggcccccaggccagcuaa

SEQ ID NO: 18497 - RNA, 540 nt, Artificial Sequence
  IL22__Homo_sapiens__NP_065386
auggccgcccugcagaagagcgugagcagcuuccugaugggcacccuggccaccagcugccugcugcugcuggcccugcuggugcagggcggcgccgccgcccccaucagcagccacugcagacuggacaagagcaacuuccagcagcccuacaucaccaacagaaccuucaugcuggccaaggaggccagccuggccgacaacaacaccgacgugagacugaucggcgagaagcuguuccacggcgugagcaugagcgagagaugcuaccugaugaagcaggugcugaacuucacccuggaggaggugcuguucccccagagcgacagauuccagcccuacaugcaggagguggugcccuuccuggccagacugagcaacagacugagcaccugccacaucgagggcgacgaccugcacauccagagaaacgugcagaagcugaaggacaccgugaagaagcugggcgagagcggcgagaucaaggccaucggcgagcuggaccugcuguucaugagccugagaaacgccugcaucuaa

SEQ ID NO: 18498 - RNA, 792 nt, Artificial Sequence
  IL22RA2__Homo_sapiens__NP_443194
augaugcccaagcacugcuuccugggcuuccugaucagcuucuuccugaccggcguggccggcacccagagcacccacgagagccugaagccccagagagugcaguuccagagcagaaacuuccacaacauccugcaguggcagcccggcagagcccugaccggcaacagcagcguguacuucgugcaguacaagaucauguucagcugcagcaugaagagcagccaccagaagcccagcggcugcuggcagcacaucagcugcaacuuccccggcugcagaacccuggccaaguacggccagagacaguggaagaacaaggaggacugcuggggcacccaggagcugagcugcgaccugaccagcgagaccagcgacauccaggagcccuacuacggcagagugagagccgccagcgccggcagcuacagcgaguggagcaugacccccagauucacccccuggugggagaccaagaucgacccccccgugaugaacaucacccaggugaacggcagccugcuggugauccugcacgcccccaaccugcccuacagauaccagaaggagaagaacgugagcaucgaggacuacuacgagcugcuguacagaguguucaucaucaacaacagccuggagaaggagcagaagguguacgagggcgcccacagagccguggagaucgaggcccugaccccccacagcagcuacugcgugguggccgagaucuaccagcccaugcuggacagaagaagccagagaagcgaggagagaugcguggagauccccuaa

SEQ ID NO: 18499 - RNA, 570 nt, Artificial Sequence
  IL23A__Homo_sapiens__XP_011536779
augcugggcagcagagccgugaugcugcugcugcugcugcccuggaccgcccagggcagagccgugcccggcggcagcagccccgccuggacccagugccagcagcugagccagaagcugugcacccuggccuggagcgcccacccccuggugggccacauggaccugagagaggagggcgacgaggagaccaccaacgacgugccccacauccagugcggcgacggcugcgacccccagggccugagagacaacagccaguucugccugcagagaauccaccagggccugaucuucuacgagaagcugcugggcagcgacaucuucaccggcgagcccagccugcugcccgacagccccgugggccagcugcacgccagccugcugggccugagccagcugcugcagcccgagggccaccacugggagacccagcagauccccagccugagccccagccagcccuggcagagacugcugcugagauucaagauccugagaagccugcaggccuucguggccguggccgccagaguguucgcccacggcgccgccacccugagccccuaa

SEQ ID NO: 18500 - RNA, 1980 nt, Artificial Sequence
  IL23R__Homo_sapiens__XP_011539091
augcugcugugccacggcauccuguuccccuggauccagguguucgccagaaagcugcaggagggcaacagccuguuccugcugcccgacaugaaccaggugaccauccagugggacgccgugaucgcccuguacauccuguucagcuggugccacggcggcaucaccaacaucaacugcagcggccacaucuggguggagcccgccaccaucuucaagaugggcaugaacaucagcaucuacugccaggccgccaucaagaacugccagcccagaaagcugcacuucuacaagaacggcaucaaggagagauuccagaucaccagaaucaacaagaccaccgccagacugugguacaagaacuuccuggagccccacgccagcauguacugcaccgccgagugccccaagcacuuccaggagacccugaucugcggcaaggacaucagcagcggcuacccccccgacauccccgacgaggugaccugcgugaucuacgaguacagcggcaacaugaccugcaccuggaacgccggcaagcugaccuacaucgacaccaaguacguggugcacgugaagagccuggagaccgaggaggagcagcaguaccugaccagcagcuacaucaacaucagcaccgacagccugcagggcggcaagaaguaccuggugugggugcaggccgccaacgcccugggcauggaggagagcaagcagcugcagauccaccuggacgacaucgugauccccagcgccgccgugaucagcagagccgagaccaucaacgccaccgugcccaagaccaucaucuacugggacagccagaccaccaucgagaaggugagcugcgagaugagauacaaggccaccaccaaccagaccuggaacgugaaggaguucgacaccaacuucaccuacgugcagcagagcgaguucuaccuggagcccaacaucaaguacguguuccaggugagaugccaggagaccggcaagagauacuggcagcccuggagcagccuguucuuccacaagacccccgagaccgugccccaggugaccagcaaggccuuccagcacgacaccuggaacagcggccugaccguggccagcaucagcaccggccaccugaccagcgacaacagaggcgacaucggccugcugcugggcaugaucguguucgccgugaugcugagcauccugagccugaucggcaucuucaacagaagcuucagaaccggcaucaagagaagaauccugcugcugauccccaaguggcuguacgaggacauccccaacaugaagaacagcaacguggugaagaugcugcaggagaacagcgagcugaugaacaacaacagcagcgagcaggugcuguacguggaccccaugaucaccgagaucaaggagaucuucauccccgagcacaagcccaccgacuacaagaaggagaacaccggcccccuggagaccagagacuacccccagaacagccuguucgacaacaccaccgugguguacauccccgaccugaacaccggcuacaagccccagaucagcaacuuccugcccgagggcagccaccugagcaacaacaacgagaucaccagccugacccugaagccccccguggacagccuggacagcggcaacaaccccagacugcagaagcaccccaacuucgccuucagcgugagcagcgugaacagccugagcaacaccaucuuccugggcgagcugagccugauccugaaccagggcgagugcagcagccccgacauccagaacagcguggaggaggagaccaccaugcugcuggagaacgacagccccagcgagaccauccccgagcagacccugcugcccgacgaguucgugagcugccugggcaucgugaacgaggagcugcccagcaucaacaccuacuucccccagaacauccuggagagccacuucaacagaaucagccugcuggagaaguaa

SEQ ID NO: 18501 - RNA, 624 nt, Artificial Sequence
  IL24__Homo_sapiens__NP_001172085
augaacuuccagcagagacugcagagccuguggacccuggccagcagacccuucugccccccccugcuggccaccgccagccagaugcagaugguggugcugcccugccugggcuucacccugcugcuguggagccaggugagcggcgcccagggccaggaguuccacuucggccccugccaggugaagggcguggugccccagaagcugugggaggccuucugggccgugaaggacaccaugcaggcccaggacaacaucaccagcgccagacugcugcagcaggaggugcugcagaacgugagcgacgccgagagcugcuaccuggugcacacccugcuggaguucuaccugaagaccguguucaagaacuaccacaacagaaccguggaggugagaacccugaagagcuucagcacccuggccaacaacuucgugcugaucgugagccagcugcagcccagccaggagaacgagauguucagcaucagagacagcgcccacagaagauuccugcuguucagaagagccuucaagcagcuggacguggaggccgcccugaccaaggcccugggcgagguggacauccugcugaccuggaugcagaaguucuacaagcuguaa

SEQ ID NO: 18502 - RNA, 534 nt, Artificial Sequence
  IL25__Homo_sapiens__NP_073626
augagagagagacccagacugggcgaggacagcagccugaucagccuguuccugcaggugguggccuuccuggccauggugaugggcacccacaccuacagccacuggcccagcugcugccccagcaagggccaggacaccagcgaggagcugcugagauggagcaccgugcccgugcccccccuggagcccgccagacccaacagacaccccgagagcugcagagccagcgaggacggcccccugaacagcagagccaucagccccuggagauacgagcuggacagagaccugaacagacugccccaggaccuguaccacgccagaugccugugcccccacugcgugagccugcagaccggcagccacauggaccccagaggcaacagcgagcugcuguaccacaaccagaccguguucuacagaagacccugccacggcgagaagggcacccacaagggcuacugccuggagagaagacuguacagagugagccuggccugcgugugcgugagacccagagugaugggcuaa

SEQ ID NO: 18503 - RNA, 516 nt, Artificial Sequence
  IL26__Homo_sapiens__XP_011536870
augcuggugaacuucauccugagaugcggccugcugcuggugacccugagccuggccaucgccaagcacaagcagagcagcuucaccaagagcugcuaccccagaggcacccugagccaggccguggacgcccuguacaucaaggccgccuggcugaaggccaccauccccgaggacagaaucaagaacaucagacugcugaagaagaagaccaagaagcaguucaugaagaacugccaguuccaggagcagcugcugagcuucuucauggaggacguguucggccagcugcagcugcagggcugcaagaagaucagauucguggaggacuuccacagccugagacagaagcugagccacugcaucagcugcgccagcagcgccagagagaugaagagcaucaccagaaugaagagaaucuucuacagaaucggcaacaagggcaucuacaaggccaucagcgagcuggacauccugcugagcuggaucaagaagcugcuggagagcagccaguaa

SEQ ID NO: 18504 - RNA, 732 nt, Artificial Sequence
  IL27__Homo_sapiens__NP_663634
augggccagaccgccggcgaccugggcuggagacugagccugcugcugcugccccugcugcuggugcaggccggcguguggggcuuccccagaccccccggcagaccccagcugagccugcaggagcugagaagagaguucaccgugagccugcaccuggccagaaagcugcugagcgaggugagaggccaggcccacagauucgccgagagccaccugcccggcgugaaccuguaccugcugccccugggcgagcagcugcccgacgugagccugaccuuccaggccuggagaagacugagcgaccccgagagacugugcuucaucagcaccacccugcagcccuuccacgcccugcugggcggccugggcacccagggcagauggaccaacauggagagaaugcagcugugggccaugagacuggaccugagagaccugcagagacaccugagauuccaggugcuggccgccggcuucaaccugcccgaggaggaggaggaggaggaggaggaggaggaggaggagagaaagggccugcugcccggcgcccugggcagcgcccugcagggccccgcccaggugagcuggccccagcugcugagcaccuacagacugcugcacagccuggagcuggugcugagcagagccgugagagagcugcugcugcugagcaaggccggccacagcguguggccccugggcuuccccacccugagcccccagcccuaa

SEQ ID NO: 18505 - RNA, 1911 nt, Artificial Sequence
  IL27RA__Homo_sapiens__NP_004834
augagaggcggcagaggcgcccccuucuggcuguggccccugcccaagcuggcccugcugccccugcugugggugcuguuccagagaaccagaccccagggcagcgccggcccccugcagugcuacggcgugggcccccugggcgaccugaacugcagcugggagccccugggcgaccugggcgcccccagcgagcugcaccugcagagccagaaguacagaagcaacaagacccagaccguggccguggccgccggcagaagcuggguggccauccccagagagcagcugaccaugagcgacaagcugcugguguggggcaccaaggccggccagccccuguggccccccguguucgugaaccuggagacccagaugaagcccaacgcccccagacugggccccgacguggacuucagcgaggacgacccccuggaggccaccgugcacugggccccccccaccuggcccagccacaaggugcugaucugccaguuccacuacagaagaugccaggaggccgccuggacccugcuggagcccgagcugaagaccaucccccugacccccguggagauccaggaccuggagcuggccaccggcuacaagguguacggcagaugcagaauggagaaggaggaggaccuguggggcgaguggagccccauccugagcuuccagaccccccccagcgcccccaaggacgugugggugagcggcaaccugugcggcacccccggcggcgaggagccccugcugcuguggaaggcccccggccccugcgugcaggugagcuacaaggugugguucugggugggcggcagagagcugagccccgagggcaucaccugcugcugcagccugauccccagcggcgccgagugggccagagugagcgccgugaacgccaccagcugggagccccugaccaaccugagccuggugugccuggacagcgccagcgcccccagaagcguggccgugagcagcaucgccggcagcaccgagcugcuggugaccuggcagcccggccccggcgagccccuggagcacgugguggacugggccagagacggcgacccccuggagaagcugaacugggugagacugccccccggcaaccugagcgcccugcugcccggcaacuucaccgugggcgugcccuacagaaucaccgugaccgccgugagcgccagcggccuggccagcgccagcagcguguggggcuucagagaggagcuggccccccuggugggccccacccuguggagacugcaggacgccccccccggcacccccgccaucgccuggggcgaggugcccagacaccagcugagaggccaccugacccacuacacccugugcgcccagagcggcaccagccccagcgugugcaugaacgugagcggcaacacccagagcgugacccugcccgaccugcccuggggccccugcgagcugugggugaccgccagcaccaucgccggccagggcccccccggccccauccugagacugcaccugcccgacaacacccugagauggaaggugcugcccggcauccuguuccuguggggccuguuccugcugggcugcggccugagccuggccaccagcggcagaugcuaccaccugagacacaaggugcugcccagaugggugugggagaaggugcccgaccccgccaacagcagcagcggccagccccacauggagcaggugcccgaggcccagccccugggcgaccugcccauccuggagguggaggagauggagcccccccccgugauggagagcagccagcccgcccaggccaccgccccccuggacagcggcuacgagaagcacuuccugcccacccccgaggagcugggccugcugggcccccccagaccccaggugcuggccuaa

SEQ ID NO: 18506 - RNA, 462 nt, Artificial Sequence
  IL2__Homo_sapiens__NP_000577
auguacagaaugcagcugcugagcugcaucgcccugagccuggcccuggugaccaacagcgcccccaccagcagcagcaccaagaagacccagcugcagcuggagcaccugcugcuggaccugcagaugauccugaacggcaucaacaacuacaagaaccccaagcugaccagaaugcugaccuucaaguucuacaugcccaagaaggccaccgagcugaagcaccugcagugccuggaggaggagcugaagccccuggaggaggugcugaaccuggcccagagcaagaacuuccaccugagacccagagaccugaucagcaacaucaacgugaucgugcuggagcugaagggcagcgagaccaccuucaugugcgaguacgccgacgagaccgccaccaucguggaguuccugaacagauggaucaccuucugccagagcaucaucagcacccugaccuaa

SEQ ID NO: 18507 - RNA, 819 nt, Artificial Sequence
  IL2RA__Homo_sapiens__NP_000408
auggacagcuaccugcugauguggggccugcugaccuucaucauggugcccggcugccaggccgagcugugcgacgacgacccccccgagaucccccacgccaccuucaaggccauggccuacaaggagggcaccaugcugaacugcgagugcaagagaggcuucagaagaaucaagagcggcagccuguacaugcugugcaccggcaacagcagccacagcagcugggacaaccagugccagugcaccagcagcgccaccagaaacaccaccaagcaggugaccccccagcccgaggagcagaaggagagaaagaccaccgagaugcagagccccaugcagcccguggaccaggccagccugcccggccacugcagagagcccccccccugggagaacgaggccaccgagagaaucuaccacuucguggugggccagaugguguacuaccagugcgugcagggcuacagagcccugcacagaggccccgccgagagcgugugcaagaugacccacggcaagaccagauggacccagccccagcugaucugcaccggcgagauggagaccagccaguuccccggcgaggagaagccccaggccagccccgagggcagacccgagagcgagaccagcugccuggugaccaccaccgacuuccagauccagaccgagauggccgccaccauggagaccagcaucuucaccaccgaguaccagguggccguggccggcugcguguuccugcugaucagcgugcugcugcugagcggccugaccuggcagagaagacagagaaagagcagaagaaccaucuaa

SEQ ID NO: 18508 - RNA, 1656 nt, Artificial Sequence
  IL2RB__Homo_sapiens__NP_000869
auggccgcccccgcccugagcuggagacugccccugcugauccugcugcugccccuggccaccagcugggccagcgccgccgugaacggcaccagccaguucaccugcuucuacaacagcagagccaacaucagcugcguguggagccaggacggcgcccugcaggacaccagcugccaggugcacgccuggcccgacagaagaagauggaaccagaccugcgagcugcugcccgugagccaggccagcugggccugcaaccugauccugggcgcccccgacagccagaagcugaccaccguggacaucgugacccugagagugcugugcagagagggcgugagauggagagugauggccauccaggacuucaagcccuucgagaaccugagacugauggcccccaucagccugcagguggugcacguggagacccacagaugcaacaucagcugggagaucagccaggccagccacuacuucgagagacaccuggaguucgaggccagaacccugagccccggccacaccugggaggaggccccccugcugacccugaagcagaagcaggaguggaucugccuggagacccugacccccgacacccaguacgaguuccaggugagagugaagccccugcagggcgaguucaccaccuggagccccuggagccagccccuggccuucagaaccaagcccgccgcccugggcaaggacaccauccccuggcugggccaccugcuggugggccugagcggcgccuucggcuucaucauccugguguaccugcugaucaacugcagaaacaccggccccuggcugaagaaggugcugaagugcaacacccccgaccccagcaaguucuucagccagcugagcagcgagcacggcggcgacgugcagaaguggcugagcagccccuuccccagcagcagcuucagccccggcggccuggcccccgagaucagcccccuggaggugcuggagagagacaaggugacccagcugcugcugcagcaggacaaggugcccgagcccgccagccugagcagcaaccacagccugaccagcugcuucaccaaccagggcuacuucuucuuccaccugcccgacgcccuggagaucgaggccugccagguguacuucaccuacgaccccuacagcgaggaggaccccgacgagggcguggccggcgcccccaccggcagcagcccccagccccugcagccccugagcggcgaggacgacgccuacugcaccuuccccagcagagacgaccugcugcuguucagccccagccugcugggcggccccagcccccccagcaccgcccccggcggcagcggcgccggcgaggagagaaugccccccagccugcaggagagagugcccagagacugggacccccagccccugggcccccccacccccggcgugcccgaccugguggacuuccagcccccccccgagcuggugcugagagaggccggcgaggaggugcccgacgccggccccagagagggcgugagcuuccccuggagcagaccccccggccagggcgaguucagagcccugaacgccagacugccccugaacaccgacgccuaccugagccugcaggagcugcagggccaggaccccacccaccugguguaa

SEQ ID NO: 18509 - RNA, 1110 nt, Artificial Sequence
  IL2RG__Homo_sapiens__NP_000197
augcugaagcccagccugcccuucaccagccugcuguuccugcagcugccccugcugggcgugggccugaacaccaccauccugacccccaacggcaacgaggacaccaccgccgacuucuuccugaccaccaugcccaccgacagccugagcgugagcacccugccccugcccgaggugcagugcuucguguucaacguggaguacaugaacugcaccuggaacagcagcagcgagccccagcccaccaaccugacccugcacuacugguacaagaacagcgacaacgacaaggugcagaagugcagccacuaccuguucagcgaggagaucaccagcggcugccagcugcagaagaaggagauccaccuguaccagaccuucguggugcagcugcaggaccccagagagcccagaagacaggccacccagaugcugaagcugcagaaccuggugauccccugggcccccgagaaccugacccugcacaagcugagcgagagccagcuggagcugaacuggaacaacagauuccugaaccacugccuggagcaccuggugcaguacagaaccgacugggaccacagcuggaccgagcagagcguggacuacagacacaaguucagccugcccagcguggacggccagaagagauacaccuucagagugagaagcagauucaacccccugugcggcagcgcccagcacuggagcgaguggagccaccccauccacuggggcagcaacaccagcaaggagaaccccuuccuguucgcccuggaggccguggugaucagcgugggcagcaugggccugaucaucagccugcugugcguguacuucuggcuggagagaaccaugcccagaauccccacccugaagaaccuggaggaccuggugaccgaguaccacggcaacuucagcgccuggagcggcgugagcaagggccuggccgagagccugcagcccgacuacagcgagagacugugccuggugagcgagaucccccccaagggcggcgcccugggcgagggccccggcgccagccccugcaaccagcacagccccuacugggccccccccugcuacacccugaagcccgagaccuaa

SEQ ID NO: 18510 - RNA, 495 nt, Artificial Sequence
  IL31__Homo_sapiens__XP_011536628
auggccagccacagcggccccagcaccagcgugcuguuccuguucugcugccugggcggcuggcuggccagccacacccugcccgugagacugcugagacccagcgacgacgugcagaagaucguggaggagcugcagagccugagcaagaugcugcugaaggacguggaggaggagaagggcgugcuggugagccagaacuacacccugcccugccugagccccgacgcccagccccccaacaacauccacagccccgccaucagagccuaccugaagaccaucagacagcuggacaacaagagcgugaucgacgagaucaucgagcaccuggacaagcugaucuuccaggacgcccccgagaccaacaucagcgugcccaccgacacccacgagugcaagagauucauccugaccaucagccagcaguucagcgagugcauggaccuggcccugaagagccugaccagcggcgcccagcaggccaccaccuaa

SEQ ID NO: 18511 - RNA, 2238 nt, Artificial Sequence
  IL31RA__Homo_sapiens__NP_001229565
augaagcugagcccccagcccagcugcgugaaccugggcaugauguggaccugggcccuguggaugcugcccagccugugcaaguucagccuggccgcccugcccgccaagcccgagaacaucagcugcguguacuacuacagaaagaaccugaccugcaccuggagccccggcaaggagaccagcuacacccaguacaccgugaagagaaccuacgccuucggcgagaagcacgacaacugcaccaccaacagcagcaccagcgagaacagagccagcugcagcuucuuccugcccagaaucaccauccccgacaacuacaccaucgagguggaggccgagaacggcgacggcgugaucaagagccacaugaccuacuggagacuggagaacaucgccaagaccgagccccccaagaucuucagagugaagcccgugcugggcaucaagagaaugauccagaucgaguggaucaagcccgagcuggcccccgugagcagcgaccugaaguacacccugagauucagaaccgugaacagcaccagcuggauggaggugaacuucgccaagaacagaaaggacaagaaccagaccuacaaccugaccggccugcagcccuucaccgaguacgugaucgcccugagaugcgccgugaaggagagcaaguucuggagcgacuggagccaggagaagaugggcaugaccgaggaggaggcccccugcggccuggagcuguggagagugcugaagcccgccgaggccgacggcagaagacccgugagacugcuguggaagaaggccagaggcgcccccgugcuggagaagacccugggcuacaacaucugguacuaccccgagagcaacaccaaccugaccgagaccaugaacaccaccaaccagcagcuggagcugcaccugggcggcgagagcuucugggugagcaugaucagcuacaacagccugggcaagagccccguggccacccugagaauccccgccauccaggagaagagcuuccagugcaucgaggugaugcaggccugcguggccgaggaccagcugguggugaaguggcagagcagcgcccuggacgugaacaccuggaugaucgagugguuccccgacguggacagcgagcccaccacccugagcugggagagcgugagccaggccaccaacuggaccauccagcaggacaagcugaagcccuucuggugcuacaacaucagcguguaccccaugcugcacgacaaggugggcgagcccuacagcauccaggccuacgccaaggagggcgugcccagcgagggccccgagaccaagguggagaacaucggcgugaagaccgugaccaucaccuggaaggagauccccaagagcgagagaaagggcaucaucugcaacuacaccaucuucuaccaggccgagggcggcaagggcuucagcaagaccgugaacagcagcauccugcaguacggccuggagagccugaagagaaagaccagcuacaucgugcaggugauggccagcaccagcgccggcggcaccaacggcaccagcaucaacuucaagacccugagcuucagcguguucgagaucauccugaucaccagccugaucggcggcggccugcugauccugaucauccugaccguggccuacggccugaagaagcccaacaagcugacccaccugugcuggcccaccgugcccaaccccgccgagagcagcaucgccaccuggcacggcgacgacuucaaggacaagcugaaccugaaggagagcgacgacagcgugaacaccgaggacagaauccugaagcccugcagcacccccagcgacaagcuggugaucgacaagcugguggugaacuucggcaacgugcugcaggagaucuucaccgacgaggccagaaccggccaggagaacaaccugggcggcgagaagaacggcuacgugaccugccccuucagacccgacugcccccugggcaagagcuucgaggagcugcccgugagccccgagaucccccccagaaagagccaguaccugagaagcagaaugcccgagggcaccagacccgaggccaaggagcagcugcuguucagcggccagagccuggugcccgaccaccugugcgaggagggcgcccccaaccccuaccugaagaacagcgugaccgccagagaguuccuggugagcgagaagcugcccgagcacaccaagggcgagguguaa

SEQ ID NO: 18512 - RNA, 396 nt, Artificial Sequence
  IL32__Homo_sapiens__NP_001012651
augugcuuccccaaggugcugagcgacgacaugaagaagcugaaggccagaaugcaccaggccaucgagagauucuacgacaagaugcagaacgccgagagcggcagaggccaggugaugagcagccuggccgagcuggaggacgacuucaaggagggcuaccuggagaccguggccgccuacuacgaggagcagcaccccgagcugaccccccugcuggagaaggagagagacggccugagaugcagaggcaacagaagccccgugcccgacguggaggaccccgccaccgaggagcccggcgagagcuucugcgacaagagcuacggcgcccccagaggcgacaaggaggagcugaccccccagaagugcagcgagccccagagcagcaaguaa

SEQ ID NO: 18513 - RNA, 687 nt, Artificial Sequence
  IL33__Homo_sapiens__NP_001186569
augaagcccaagaugaaguacagcaccaacaagaucagcaccgccaaguggaagaacaccgccagcaaggcccugugcuucaagcugggcaagagccagcagaaggccaaggaggugugccccauguacuucaugaagcugagaagcggccugaugaucaagaaggaggccugcuacuucagaagagagaccaccaagagacccagccugaagaccggcagaaagcacaagagacaccuggugcuggccgccugccagcagcagagcaccguggagugcuucgccuucggcaucagcggcgugcagaaguacaccagagcccugcacgacagcagcaucaccgacaaggugcugcugagcuacuacgagagccagcaccccagcaacgagagcggcgacggcguggacggcaagaugcugauggugacccugagccccaccaaggacuucuggcugcacgccaacaacaaggagcacagcguggagcugcacaagugcgagaagccccugcccgaccaggccuucuucgugcugcacaacaugcacagcaacugcgugagcuucgagugcaagaccgaccccggcguguucaucggcgugaaggacaaccaccuggcccugaucaagguggacagcagcgagaaccugugcaccgagaacauccuguucaagcugagcgagaccuaa

SEQ ID NO: 18514 - RNA, 729 nt, Artificial Sequence
  IL34__Homo_sapiens__XP_011521205
augcccagaggcuucaccuggcugagauaccugggcaucuuccugggcguggcccugggcaacgagccccuggagauguggccccugacccagaacgaggagugcaccgugaccggcuuccugagagacaagcugcaguacagaagcagacugcaguacaugaagcacuacuuccccaucaacuacaagaucagcgugcccuacgagggcguguucagaaucgccaacgugaccagacugcagagagcccaggugagcgagagagagcugagauaccugugggugcuggugagccugagcgccaccgagagcgugcaggacgugcugcuggagggccaccccagcuggaaguaccugcaggagguggagacccugcugcugaacgugcagcagggccugaccgacguggaggugagccccaagguggagagcgugcugagccugcugaacgcccccggccccaaccugaagcuggugagacccaaggcccugcuggacaacugcuucagagugauggagcugcuguacugcagcugcugcaagcagagcagcgugcugaacuggcaggacugcgaggugcccagcccccagagcugcagccccgagcccagccugcaguacgccgccacccagcuguacccccccccccccuggagccccagcagccccccccacagcaccggcagcgugagacccgugagagcccagggcgagggccugcugcccuaa

SEQ ID NO: 18515 - RNA, 477 nt, Artificial Sequence
  IL36A__Homo_sapiens__NP_055255
auggagaaggcccugaagaucgacaccccccagcagggcagcauccaggacaucaaccacagagugugggugcugcaggaccagacccugaucgccgugcccagaaaggacagaaugagccccgugaccaucgcccugaucagcugcagacacguggagacccuggagaaggacagaggcaaccccaucuaccugggccugaacggccugaaccugugccugaugugcgccaaggugggcgaccagcccacccugcagcugaaggagaaggacaucauggaccuguacaaccagcccgagcccgugaagagcuuccuguucuaccacagccagagcggcagaaacagcaccuucgagagcguggccuuccccggcugguucaucgccgugagcagcgagggcggcugcccccugauccugacccaggagcugggcaaggccaacaccaccgacuucggccugaccaugcuguucuaa

SEQ ID NO: 18516 - RNA, 495 nt, Artificial Sequence
  IL36B__Homo_sapiens__NP_055253
augaacccccagagagaggccgcccccaagagcuacgccaucagagacagcagacagauggugugggugcugagcggcaacagccugaucgccgccccccugagcagaagcaucaagcccgugacccugcaccugaucgccugcagagacaccgaguucagcgacaaggagaagggcaacaugguguaccugggcaucaagggcaaggaccugugccuguucugcgccgagauccagggcaagcccacccugcagcugaagcugcagggcagccaggacaacaucggcaaggacaccugcuggaagcuggugggcauccacaccugcaucaaccuggacgugagagagagcugcuucaugggcacccuggaccaguggggcaucggcgugggcagaaagaaguggaagagcagcuuccagcaccaccaccugagaaagaaggacaaggacuucagcagcaugagaaccaacaucggcaugcccggcagaauguaa

SEQ ID NO: 18517 - RNA, 510 nt, Artificial Sequence
  IL36G__Homo_sapiens__NP_062564
augagaggcacccccggcgacgccgacggcggcggcagagccguguaccagagcaugugcaagcccaucaccggcaccaucaacgaccugaaccagcagguguggacccugcagggccagaaccugguggccgugcccagaagcgacagcgugacccccgugaccguggccgugaucaccugcaaguaccccgaggcccuggagcagggcagaggcgaccccaucuaccugggcauccagaaccccgagaugugccuguacugcgagaaggugggcgagcagcccacccugcagcugaaggagcagaagaucauggaccuguacggccagcccgagcccgugaagcccuuccuguucuacagagccaagaccggcagaaccagcacccuggagagcguggccuuccccgacugguucaucgccagcagcaagagagaccagcccaucauccugaccagcgagcugggcaagagcuacaacaccgccuucgagcugaacaucaacgacuaa

SEQ ID NO: 18518 - RNA, 468 nt, Artificial Sequence
  IL36RN__Homo_sapiens__NP_775262
auggugcugagcggcgcccugugcuucagaaugaaggacagcgcccugaaggugcuguaccugcacaacaaccagcugcuggccggcggccugcacgccggcaaggugaucaagggcgaggagaucagcguggugcccaacagauggcuggacgccagccugagccccgugauccugggcgugcagggcggcagccagugccugagcugcggcgugggccaggagcccacccugacccuggagcccgugaacaucauggagcuguaccugggcgccaaggagagcaagagcuucaccuucuacagaagagacaugggccugaccagcagcuucgagagcgccgccuaccccggcugguuccugugcaccgugcccgaggccgaccagcccgugagacugacccagcugcccgagaacggcggcuggaacgcccccaucaccgacuucuacuuccagcagugcgacuaa

SEQ ID NO: 18519 - RNA, 657 nt, Artificial Sequence
  IL37__Homo_sapiens__NP_055254
augagcuucgugggcgagaacagcggcgugaagaugggcagcgaggacugggagaaggacgagccccagugcugccuggaggaccccgccggcagcccccuggagcccggccccagccugcccaccaugaacuucgugcacaccagccccaaggugaagaaccugaaccccaagaaguucagcauccacgaccaggaccacaaggugcuggugcuggacagcggcaaccugaucgccgugcccgacaagaacuacaucagacccgagaucuucuucgcccuggccagcagccugagcagcgccagcgccgagaagggcagccccauccugcugggcgugagcaagggcgaguucugccuguacugcgacaaggacaagggccagagccaccccagccugcagcugaagaaggagaagcugaugaagcuggccgcccagaaggagagcgccagaagacccuucaucuucuacagagcccaggugggcagcuggaacaugcuggagagcgccgcccaccccggcugguucaucugcaccagcugcaacugcaacgagcccgugggcgugaccgacaaguucgagaacagaaagcacaucgaguucagcuuccagcccgugugcaaggccgagaugagccccagcgaggugagcgacuaa

SEQ ID NO: 18520 - RNA, 459 nt, Artificial Sequence
  IL3__Homo_sapiens__NP_000579
augagcagacugcccgugcugcugcugcugcagcugcuggugagacccggccugcaggcccccaugacccagaccaccccccugaagaccagcugggugaacugcagcaacaugaucgacgagaucaucacccaccugaagcagcccccccugccccugcuggacuucaacaaccugaacggcgaggaccaggacauccugauggagaacaaccugagaagacccaaccuggaggccuucaacagagccgugaagagccugcagaacgccagcgccaucgagagcauccugaagaaccugcugcccugccugccccuggccaccgccgcccccaccagacaccccauccacaucaaggacggcgacuggaacgaguucagaagaaagcugaccuucuaccugaagacccuggagaacgcccaggcccagcagaccacccugagccuggccaucuucuaa

SEQ ID NO: 18521 - RNA, 903 nt, Artificial Sequence
  IL3RA__Homo_sapiens__NP_001254642
auggugcugcuguggcugacccugcugcugaucgcccugcccugccugcugcagaccaaggagggcggcaagcccugggccggcgccgagaaccugaccugcuggauccacgacguggacuuccugagcugcagcugggccgugggccccggcgcccccgccgacgugcaguacgaccuguaccugaacguggccaacagaagacagcaguacgagugccugcacuacaagaccgacgcccagggcaccagaaucggcugcagauucgacgacaucagcagacugagcagcggcagccagagcagccacauccuggugagaggcagaagcgccgccuucggcauccccugcaccgacaaguucgugguguucagccagaucgagauccugaccccccccaacaugaccgccaagugcaacaagacccacagcuucaugcacuggaagaugagaagccacuucaacagaaaguucagauacgagcugcagauccagaagagaaugcagcccgugaucaccgagcaggugagagacagaaccagcuuccagcugcugaaccccggcaccuacaccgugcagaucagagccagagagagaguguacgaguuccugagcgccuggagcaccccccagagauucgagugcgaccaggaggagggcgccaacaccagagccuggagaaccagccugcugaucgcccugggcacccugcuggcccuggugugcguguucgugaucugcagaagauaccuggugaugcagagacuguuccccagaaucccccacaugaaggaccccaucggcgacagcuuccagaacgacaagcugguggugugggaggccggcaaggccggccuggaggagugccuggugaccgaggugcagguggugcagaagaccuaa

SEQ ID NO: 18522 - RNA, 462 nt, Artificial Sequence
  IL4__Homo_sapiens__NP_000580
augggccugaccagccagcugcugcccccccuguucuuccugcuggccugcgccggcaacuucgugcacggccacaagugcgacaucacccugcaggagaucaucaagacccugaacagccugaccgagcagaagacccugugcaccgagcugaccgugaccgacaucuucgccgccagcaagaacaccaccgagaaggagaccuucugcagagccgccaccgugcugagacaguucuacagccaccacgagaaggacaccagaugccugggcgccaccgcccagcaguuccacagacacaagcagcugaucagauuccugaagagacuggacagaaaccuguggggccuggccggccugaacagcugccccgugaaggaggccaaccagagcacccuggagaacuuccuggagagacugaagaccaucaugagagagaaguacagcaagugcagcagcuaa

SEQ ID NO: 18523 - RNA, 1770 nt, Artificial Sequence
  IL4I1__Homo_sapiens__NP_001244947
augcccaacgacgacuucugccccggccugaccaucaaggccaugggcgccgagagagccccccagagacagcccugcacccugcaccugcuggugcuggugcccauccugcugagccugguggccagccaggacuggaaggccgagagaagccaggaccccuucgagaagugcaugcaggaccccgacuacgagcagcugcugaagguggugaccuggggccugaacagaacccugaagccccagagagugaucguggugggcgccggcguggccggccugguggccgccaaggugcugagcgacgccggccacaaggugaccauccuggaggccgacaacagaaucggcggcagaaucuucaccuacagagaccagaacaccggcuggaucggcgagcugggcgccaugagaaugcccagcagccacagaauccugcacaagcugugccagggccugggccugaaccugaccaaguucacccaguacgacaagaacaccuggaccgaggugcacgaggugaagcugagaaacuacgugguggagaaggugcccgagaagcugggcuacgcccugagaccccaggagaagggccacagccccgaggacaucuaccagauggcccugaaccaggcccugaaggaccugaaggcccugggcugcagaaaggccaugaagaaguucgagagacacacccugcuggaguaccugcugggcgagggcaaccugagcagacccgccgugcagcugcugggcgacgugaugagcgaggacggcuucuucuaccugagcuucgccgaggcccugagagcccacagcugccugagcgacagacugcaguacagcagaaucgugggcggcugggaccugcugcccagagcccugcugagcagccugagcggccuggugcugcugaacgcccccgugguggccaugacccagggcccccacgacgugcacgugcagaucgagaccagcccccccgccagaaaccugaaggugcugaaggccgacguggugcugcugaccgccagcggccccgccgugaagagaaucaccuucagccccccccugcccagacacaugcaggaggcccugagaagacugcacuacgugcccgccaccaagguguuccugagcuucagaagacccuucuggagagaggagcacaucgagggcggccacagcaacaccgacagacccagcagaaugaucuucuaccccccccccagagagggcgcccugcugcuggccagcuacaccuggagcgacgccgccgccgccuucgccggccugagcagagaggaggcccugagacuggcccuggacgacguggccgcccugcacggccccguggugagacagcugugggacggcaccggcguggugaagagaugggccgaggaccagcacagccagggcggcuucguggugcagccccccgcccuguggcagaccgagaaggacgacuggaccgugcccuacggcagaaucuacuucgccggcgagcacaccgccuacccccacggcuggguggagaccgccgugaagagcgcccugagagccgccaucaagaucaacagcagaaagggccccgccagcgacaccgccagccccgagggccacgccagcgacauggagggccagggccacgugcacggcguggccagcagccccagccacgaccuggccaaggaggagggcagccacccccccgugcagggccagcugagccugcagaacaccacccacaccagaaccagccacuaa

SEQ ID NO: 18524 - RNA, 2433 nt, Artificial Sequence
  IL4R__Homo_sapiens__NP_001244336
augcagaaggacgccagaagagagggcaacaugaaggugcugcaggagcccaccugcgugagcgacuacaugagcaucagcaccugcgaguggaagaugaacggccccaccaacugcagcaccgagcugagacugcuguaccagcugguguuccugcugagcgaggcccacaccugcauccccgagaacaacggcggcgccggcugcgugugccaccugcugauggacgacguggugagcgccgacaacuacacccuggaccugugggccggccagcagcugcuguggaagggcagcuucaagcccagcgagcacgugaagcccagagcccccggcaaccugaccgugcacaccaacgugagcgacacccugcugcugaccuggagcaaccccuacccccccgacaacuaccuguacaaccaccugaccuacgccgugaacaucuggagcgagaacgaccccgccgacuucagaaucuacaacgugaccuaccuggagcccagccugagaaucgccgccagcacccugaagagcggcaucagcuacagagccagagugagagccugggcccagugcuacaacaccaccuggagcgaguggagccccagcaccaaguggcacaacagcuacagagagcccuucgagcagcaccugcugcugggcgugagcgugagcugcaucgugauccuggccgugugccugcugugcuacgugagcaucaccaagaucaagaaggaguggugggaccagauccccaaccccgccagaagcagacugguggccaucaucauccaggacgcccagggcagccagugggagaagagaagcagaggccaggagcccgccaagugcccccacuggaagaacugccugaccaagcugcugcccugcuuccuggagcacaacaugaagagagacgaggacccccacaaggccgccaaggagaugcccuuccagggcagcggcaagagcgccuggugccccguggagaucagcaagaccgugcuguggcccgagagcaucagcguggugagaugcguggagcuguucgaggcccccguggagugcgaggaggaggaggagguggaggaggagaagggcagcuucugcgccagccccgagagcagcagagacgacuuccaggagggcagagagggcaucguggccagacugaccgagagccuguuccuggaccugcugggcgaggagaacggcggcuucugccagcaggacaugggcgagagcugccugcugccccccagcggcagcaccagcgcccacaugcccugggacgaguuccccagcgccggccccaaggaggccccccccuggggcaaggagcagccccugcaccuggagcccagcccccccgccagccccacccagagccccgacaaccugaccugcaccgagaccccccuggugaucgccggcaaccccgccuacagaagcuucagcaacagccugagccagagccccugccccagagagcugggccccgacccccugcuggccagacaccuggaggagguggagcccgagaugcccugcgugccccagcugagcgagcccaccaccgugccccagcccgagcccgagaccugggagcagauccugagaagaaacgugcugcagcacggcgccgccgccgcccccgugagcgcccccaccagcggcuaccaggaguucgugcacgccguggagcagggcggcacccaggccagcgccguggugggccugggcccccccggcgaggccggcuacaaggccuucagcagccugcuggccagcagcgccgugagccccgagaagugcggcuucggcgccagcagcggcgaggagggcuacaagcccuuccaggaccugauccccggcugccccggcgaccccgcccccgugcccgugccccuguucaccuucggccuggacagagagccccccagaagcccccagagcagccaccugcccagcagcagccccgagcaccugggccuggagcccggcgagaagguggaggacaugcccaagcccccccugccccaggagcaggccaccgacccccugguggacagccugggcagcggcaucguguacagcgcccugaccugccaccugugcggccaccugaagcagugccacggccaggaggacggcggccagacccccgugauggccagccccugcugcggcugcugcugcggcgacagaagcagcccccccaccaccccccugagagcccccgaccccagccccggcggcgugccccuggaggccagccugugccccgccagccuggcccccagcggcaucagcgagaagagcaagagcagcagcagcuuccaccccgcccccggcaacgcccagagcagcagccagacccccaagaucgugaacuucgugagcgugggccccaccuacaugagagugagcuaa

SEQ ID NO: 18525 - RNA, 528 nt, Artificial Sequence
  IL5__Homo_sapiens__XP_006714664
augggcgugguggugggcuggaucggcgaccccggcagcggcaccgacaacaagcugaccggcgacgccgugcuguacuacgcccugagccugcccaaggccaacgccgagagauucagagccaugagaaugcugcugcaccugagccugcuggcccugggcgccgccuacguguacgccauccccaccgagauccccaccagcgcccuggugaaggagacccuggcccugcugagcacccacagaacccugcugaucgccaacgagacccugagaauccccgugcccgugcacaagaaccaccagcugugcaccgaggagaucuuccagggcaucggcacccuggagagccagaccgugcagggcggcaccguggagagacuguucaagaaccugagccugaucaagaaguacaucgacggccagaagaagaagugcggcgaggagagaagaagagugaaccaguuccuggacuaccugcaggaguuccugggcgugaugaacaccgaguggaucaucgagagcuaa

SEQ ID NO: 18526 - RNA, 1263 nt, Artificial Sequence
  IL5RA__Homo_sapiens__NP_000555
augaucaucguggcccacgugcugcugauccugcugggcgccaccgagauccugcaggccgaccugcugcccgacgagaagaucagccugcugccccccgugaacuucaccaucaaggugaccggccuggcccaggugcugcugcaguggaagcccaaccccgaccaggagcagagaaacgugaaccuggaguaccaggugaagaucaacgcccccaaggaggacgacuacgagaccagaaucaccgagagcaagugcgugaccauccugcacaagggcuucagcgccagcgugagaaccauccugcagaacgaccacagccugcuggccagcagcugggccagcgccgagcugcacgccccccccggcagccccggcaccagcaucgugaaccugaccugcaccaccaacaccaccgaggacaacuacagcagacugagaagcuaccaggugagccugcacugcaccuggcuggugggcaccgacgcccccgaggacacccaguacuuccuguacuacagauacggcagcuggaccgaggagugccaggaguacagcaaggacacccugggcagaaacaucgccugcugguuccccagaaccuucauccugagcaagggcagagacuggcuggccgugcuggugaacggcagcagcaagcacagcgccaucagacccuucgaccagcuguucgcccugcacgccaucgaccagaucaaccccccccugaacgugaccgccgagaucgagggcaccagacugagcauccagugggagaagcccgugagcgccuuccccauccacugcuucgacuacgaggugaagauccacaacaccagaaacggcuaccugcagaucgagaagcugaugaccaacgccuucaucagcaucaucgacgaccugagcaaguacgacgugcaggugagagccgccgugagcagcaugugcagagaggccggccuguggagcgaguggagccagcccaucuacgugggcaacgacgagcacaagccccugagagagugguucgugaucgugaucauggccaccaucugcuucauccugcugauccugagccugaucugcaagaucugccaccuguggaucaagcuguucccccccauccccgcccccaagagcaacaucaaggaccuguucgugaccaccaacuacgagaaggccggcagcagcgagaccgagaucgaggugaucugcuacaucgagaagcccggcguggagacccuggaggacagcguguucuaa

SEQ ID NO: 18527 - RNA, 639 nt, Artificial Sequence
  IL6__Homo_sapiens__NP_000591
augaacagcuucagcaccagcgccuucggccccguggccuucagccugggccugcugcuggugcugcccgccgccuuccccgcccccgugccccccggcgaggacagcaaggacguggccgccccccacagacagccccugaccagcagcgagagaaucgacaagcagaucagauacauccuggacggcaucagcgcccugagaaaggagaccugcaacaagagcaacaugugcgagagcagcaaggaggcccuggccgagaacaaccugaaccugcccaagauggccgagaaggacggcugcuuccagagcggcuucaacgaggagaccugccuggugaagaucaucaccggccugcuggaguucgagguguaccuggaguaccugcagaacagauucgagagcagcgaggagcaggccagagccgugcagaugagcaccaaggugcugauccaguuccugcagaagaaggccaagaaccuggacgccaucaccacccccgaccccaccaccaacgccagccugcugaccaagcugcaggcccagaaccaguggcugcaggacaugaccacccaccugauccugagaagcuucaaggaguuccugcagagcagccugagagcccugagacagauguaa

SEQ ID NO: 18528 - RNA, 1407 nt, Artificial Sequence
  IL6R__Homo_sapiens__NP_000556
augcuggccgugggcugcgcccugcuggccgcccugcuggccgcccccggcgccgcccuggcccccagaagaugccccgcccaggagguggccagaggcgugcugaccagccugcccggcgacagcgugacccugaccugccccggcguggagcccgaggacaacgccaccgugcacugggugcugagaaagcccgccgccggcagccaccccagcagaugggccggcaugggcagaagacugcugcugagaagcgugcagcugcacgacagcggcaacuacagcugcuacagagccggcagacccgccggcaccgugcaccugcugguggacgugccccccgaggagccccagcugagcugcuucagaaagagcccccugagcaacguggugugcgaguggggccccagaagcacccccagccugaccaccaaggccgugcugcuggugagaaaguuccagaacagccccgccgaggacuuccaggagcccugccaguacagccaggagagccagaaguucagcugccagcuggccgugcccgagggcgacagcagcuucuacaucgugagcaugugcguggccagcagcgugggcagcaaguucagcaagacccagaccuuccagggcugcggcauccugcagcccgacccccccgccaacaucaccgugaccgccguggccagaaaccccagauggcugagcgugaccuggcaggacccccacagcuggaacagcagcuucuacagacugagauucgagcugagauacagagccgagagaagcaagaccuucaccaccuggauggugaaggaccugcagcaccacugcgugauccacgacgccuggagcggccugagacacguggugcagcugagagcccaggaggaguucggccagggcgaguggagcgaguggagccccgaggccaugggcacccccuggaccgagagcagaagcccccccgccgagaacgaggugagcacccccaugcaggcccugaccaccaacaaggacgacgacaacauccuguucagagacagcgccaacgccaccagccugcccgugcaggacagcagcagcgugccccugcccaccuuccugguggccggcggcagccuggccuucggcacccugcugugcaucgccaucgugcugagauucaagaagaccuggaagcugagagcccugaaggagggcaagaccagcaugcacccccccuacagccugggccagcuggugcccgagagacccagacccacccccgugcuggugccccugaucagcccccccgugagccccagcagccugggcagcgacaacaccagcagccacaacagacccgacgccagagaccccagaagccccuacgacaucagcaacaccgacuacuucuuccccagauaa

SEQ ID NO: 18529 - RNA, 2574 nt, Artificial Sequence
  IL6ST__Homo_sapiens__NP_001177910
augcugacccugcagaccuggcuggugcaggcccuguucaucuuccugaccaccgagagcaccggcgagcugcuggaccccugcggcuacaucagccccgagagccccguggugcagcugcacagcaacuucaccgccgugugcgugcugaaggagaagugcauggacuacuuccacgugaacgccaacuacaucguguggaagaccaaccacuucaccauccccaaggagcaguacaccaucaucaacagaaccgccagcagcgugaccuucaccgacaucgccagccugaacauccagcugaccugcaacauccugaccuucggccagcuggagcagaacguguacggcaucaccaucaucagcggccugccccccgagaagcccaagaaccugagcugcaucgugaacgagggcaagaagaugagaugcgagugggacggcggcagagagacccaccuggagaccaacuucacccugaagagcgagugggccacccacaaguucgccgacugcaaggccaagagagacacccccaccagcugcaccguggacuacagcaccguguacuucgugaacaucgagguguggguggaggccgagaacgcccugggcaaggugaccagcgaccacaucaacuucgaccccguguacaaggugaagcccaaccccccccacaaccugagcgugaucaacagcgaggagcugagcagcauccugaagcugaccuggaccaaccccagcaucaagagcgugaucauccugaaguacaacauccaguacagaaccaaggacgccagcaccuggagccagaucccccccgaggacaccgccagcaccagaagcagcuucaccgugcaggaccugaagcccuucaccgaguacguguucagaaucagaugcaugaaggaggacggcaagggcuacuggagcgacuggagcgaggaggccagcggcaucaccuacgaggacagacccagcaaggcccccagcuucugguacaagaucgaccccagccacacccagggcuacagaaccgugcagcugguguggaagacccugccccccuucgaggccaacggcaagauccuggacuacgaggugacccugaccagauggaagagccaccugcagaacuacaccgugaacgccaccaagcugaccgugaaccugaccaacgacagauaccuggccacccugaccgugagaaaccuggugggcaagagcgacgccgccgugcugaccauccccgccugcgacuuccagggcaaccuggccgagagcaagugcuaccugaucaccgugacccccguguacgccgacggccccggcagccccgagagcaucaaggccuaccugaagcaggccccccccagcaagggccccaccgugagaaccaagaaggugggcaagaacgaggccgugcuggagugggaccagcugcccguggacgugcagaacggcuucaucagaaacuacaccaucuucuacagaaccaucaucggcaacgagaccgccgugaacguggacagcagccacaccgaguacacccugagcagccugaccagcgacacccuguacauggugagaauggccgccuacaccgacgagggcggcaaggacggccccgaguucaccuucaccacccccaaguucgcccagggcgagaucgaggccaucguggugcccgugugccuggccuuccugcugaccacccugcugggcgugcuguucugcuucaacaagagagaccugaucaagaagcacaucuggcccaacgugcccgaccccagcaagagccacaucgcccaguggagcccccacaccccccccagacacaacuucaacagcaaggaccagauguacagcgacggcaacuucaccgacgugagcgugguggagaucgaggccaacgacaagaagcccuuccccgaggaccugaagagccuggaccuguucaagaaggagaagaucaacaccgagggccacagcagcggcaucggcggcagcagcugcaugagcagcagcagacccagcaucagcagcagcgacgagaacgagagcagccagaacaccagcagcaccgugcaguacagcaccguggugcacagcggcuacagacaccaggugcccagcgugcagguguucagcagaagcgagagcacccagccccugcuggacagcgaggagagacccgaggaccugcagcugguggaccacguggacggcggcgacggcauccugcccagacagcaguacuucaagcagaacugcagccagcacgagagcagccccgacaucagccacuucgagagaagcaagcaggugagcagcgugaacgaggaggacuucgugagacugaagcagcagaucagcgaccacaucagccagagcugcggcagcggccagaugaagauguuccaggaggugagcgccgccgacgccuucggccccggcaccgagggccagguggagagauucgagaccgugggcauggaggccgccaccgacgagggcaugcccaagagcuaccugccccagaccgugagacagggcggcuacaugccccaguaa

SEQ ID NO: 18530 - RNA, 402 nt, Artificial Sequence
  IL7__Homo_sapiens__NP_001186815
auguuccacgugagcuucagauacaucuucggccugcccccccugauccuggugcugcugcccguggccagcagcgacugcgacaucgagggcaaggacggcaagcaguacgagagcgugcugauggugagcaucgaccagcugcuggacagcaugaaggagaucggcagcaacugccugaacaacgaguucaacuucuucaagagacacaucugcgacgccaacaaggugaagggcagaaagcccgccgcccugggcgaggcccagcccaccaagagccuggaggagaacaagagccugaaggagcagaagaagcugaacgaccugugcuuccugaagagacugcugcaggagaucaagaccugcuggaacaagauccugaugggcaccaaggagcacuaa

SEQ ID NO: 18531 - RNA, 1380 nt, Artificial Sequence
  IL7R__Homo_sapiens__NP_002176
augaccauccugggcaccaccuucggcaugguguucagccugcugcagguggugagcggcgagagcggcuacgcccagaacggcgaccuggaggacgccgagcuggacgacuacagcuucagcugcuacagccagcuggaggugaacggcagccagcacagccugaccugcgccuucgaggaccccgacgugaacaucaccaaccuggaguucgagaucugcggcgcccugguggaggugaagugccugaacuucagaaagcugcaggagaucuacuucaucgagaccaagaaguuccugcugaucggcaagagcaacaucugcgugaaggugggcgagaagagccugaccugcaagaagaucgaccugaccaccaucgugaagcccgaggcccccuucgaccugagcgugguguacagagagggcgccaacgacuucguggugaccuucaacaccagccaccugcagaagaaguacgugaaggugcugaugcacgacguggccuacagacaggagaaggacgagaacaaguggacccacgugaaccugagcagcaccaagcugacccugcugcagagaaagcugcagcccgccgccauguacgagaucaaggugagaagcauccccgaccacuacuucaagggcuucuggagcgaguggagccccagcuacuacuucagaacccccgagaucaacaacagcagcggcgagauggaccccauccugcugaccaucagcauccugagcuucuucagcguggcccugcuggugauccuggccugcgugcuguggaagaagagaaucaagcccaucguguggcccagccugcccgaccacaagaagacccuggagcaccugugcaagaagcccagaaagaaccugaacgugagcuucaaccccgagagcuuccuggacugccagauccacagaguggacgacauccaggccagagacgagguggagggcuuccugcaggacaccuucccccagcagcuggaggagagcgagaagcagagacugggcggcgacgugcagagccccaacugccccagcgaggacguggugaucacccccgagagcuucggcagagacagcagccugaccugccuggccggcaacgugagcgccugcgacgcccccauccugagcagcagcagaagccuggacugcagagagagcggcaagaacggcccccacguguaccaggaccugcugcugagccugggcaccaccaacagcacccugcccccccccuucagccugcagagcggcauccugacccugaaccccguggcccagggccagcccauccugaccagccugggcagcaaccaggaggaggccuacgugaccaugagcagcuucuaccagaaccaguaa

SEQ ID NO: 18532 - RNA, 435 nt, Artificial Sequence
  IL9__Homo_sapiens__NP_000581
augcugcuggccauggugcugaccagcgcccugcugcugugcagcguggccggccagggcugccccacccuggccggcauccuggacaucaacuuccugaucaacaagaugcaggaggaccccgccagcaagugccacugcagcgccaacgugaccagcugccugugccugggcauccccagcgacaacugcaccagacccugcuucagcgagagacugagccagaugaccaacaccaccaugcagaccagauacccccugaucuucagcagagugaagaagagcguggaggugcugaagaacaacaagugccccuacuucagcugcgagcagcccugcaaccagaccaccgccggcaacgcccugaccuuccugaagagccugcuggagaucuuccagaaggagaagaugagaggcaugagaggcaagaucuaa

SEQ ID NO: 18533 - RNA, 1566 nt, Artificial Sequence
  IL9R__Homo_sapiens__NP_002177
augggccugggcagaugcaucugggagggcuggacccuggagagcgaggcccugagaagagacaugggcaccuggcugcuggccugcaucugcaucugcaccugcgugugccugggcgugagcgugaccggcgagggccagggccccagaagcagaaccuucaccugccugaccaacaacauccugagaaucgacugccacuggagcgcccccgagcugggccagggcagcagccccuggcugcuguucaccagcaaccaggcccccggcggcacccacaagugcauccugagaggcagcgagugcaccguggugcugccccccgaggccgugcuggugcccagcgacaacuucaccaucaccuuccaccacugcaugagcggcagagagcaggugagccugguggaccccgaguaccugcccagaagacacgugaagcuggacccccccagcgaccugcagagcaacaucagcagcggccacugcauccugaccuggagcaucagccccgcccuggagcccaugaccacccugcugagcuacgagcuggccuucaagaagcaggaggaggccugggagcaggcccagcacagagaccacaucgugggcgugaccuggcugauccuggaggccuucgagcuggaccccggcuucauccacgaggccagacugagagugcagauggccacccuggaggacgacgugguggaggaggagagauacaccggccaguggagcgaguggagccagcccgugugcuuccaggccccccagagacagggcccccugaucccccccuggggcuggcccggcaacacccugguggccgugagcaucuuccugcugcugaccggccccaccuaccugcuguucaagcugagccccagagugaagagaaucuucuaccagaacgugcccagccccgccauguucuuccagccccuguacagcgugcacaacggcaacuuccagaccuggaugggcgcccacggcgccggcgugcugcugagccaggacugcgccggcaccccccagggcgcccuggagcccugcgugcaggaggccaccgcccugcugaccugcggccccgccagacccuggaagagcguggcccuggaggaggagcaggagggccccggcaccagacugcccggcaaccugagcagcgaggacgugcugcccgccggcugcaccgaguggagagugcagacccuggccuaccugccccaggaggacugggcccccaccagccugaccagacccgccccccccgacagcgagggcagcagaagcagcagcagcagcagcagcagcaacaacaacaacuacugcgcccugggcugcuacggcggcuggcaccugagcgcccugcccggcaacacccagagcagcggccccauccccgcccuggccugcggccugagcugcgaccaccagggccuggagacccagcagggcguggccugggugcuggccggccacugccagagacccggccugcacgaggaccugcagggcaugcugcugcccagcgugcugagcaaggccagaagcuggaccuucuaa

SEQ ID NO: 18534 - RNA, 1641 nt, Artificial Sequence
  ILDR1__Homo_sapiens__NP_001186728
auggccuggcccaagcugcccgcccccuggcugcugcugugcaccuggcugcccgccggcugccugagccugcuggugaccgugcagcacaccgagagauacgugacccuguucgccagcaucauccugaagugcgacuacaccaccagcgcccagcugcaggacgugguggugaccuggagauucaagagcuucugcaaggaccccaucuucgacuacuacagcgccagcuaccaggccgcccugagccugggccaggaccccagcaacgacugcaacgacaaccagagagaggugagaaucguggcccagagaagaggccagaacgagcccgugcugggcguggacuacagacagagaaagaucaccauccagaacagagccgaccuggugaucaacgaggugauguggugggaccacggcguguacuacugcaccaucgaggcccccggcgacaccagcggcgaccccgacaaggaggugaagcugaucgugcugcacuggcugaccgugaucuucaucauccugggcgcccugcugcugcugcugcugaucggcgugugcuggugccagugcugcccccaguacugcugcugcuacaucagaugccccugcugccccgcccacugcugcugccccgaggaggcccuggccagacacagauacaugaagcaggcccaggcccugggcccccagaugaugggcaagccccuguacuggggcgccgacagaagcagccaggugagcagcuaccccaugcacccccugcugcagagagaccugagccugcccagcagccugccccagaugcccaugacccagaccaccaaccagccccccaucgccaacggcgugcuggaguaccuggagaaggagcugagaaaccugaaccuggcccagccccugccccccgaccugaagggcagauucggccaccccugcagcaugcugagcagccugggcagcgaggugguggagagaagaaucauccaccugcccccccugaucagagaccugagcagcagcagaagaaccagcgacagccugcaccagcaguggcugacccccauccccagcagacccugggaccugagagagggcagaagccaccaccacuaccccgacuuccaccaggagcugcaggacagaggccccaagagcugggcccuggagagaagagagcuggaccccagcuggagcggcagacacagaagcagcagacugaacggcagccccauccacuggagcgacagagacagccugagcgacgugcccagcagcagcgaggccagauggagacccagccacccccccuucagaagcagaugccaggagagacccagaagacccagccccagagagagcacccagagacacggcagaagaagaagacacagaagcuacagccccccccugcccagcggccugagcagcuggagcagcgaggaggacaaggagagacagccccagagcuggagagcccacagaagaggcagccacagcccccacuggcccgaggagaagccccccagcuacagaagccuggacaucacccccggcaagaacagcagaaagaagggcagcguggagagaagaagcgagaaggacagcagccacagcggcagaagcguggugaucuaa

SEQ ID NO: 18535 - RNA, 1920 nt, Artificial Sequence
  ILDR2__Homo_sapiens__NP_955383
auggacagagugcugcugagauggaucagccuguucuggcugaccgccaugguggagggccugcaggugaccgugcccgacaagaagaagguggccaugcuguuccagcccaccgugcugagaugccacuucagcaccagcagccaccagcccgccguggugcaguggaaguucaagagcuacugccaggacagaaugggcgagagccugggcaugagcagcaccagagcccagagccugagcaagagaaaccuggagugggaccccuaccuggacugccuggacagcagaagaaccgugagagugguggccagcaagcagggcagcaccgugacccugggcgacuucuacagaggcagagagaucaccaucgugcacgacgccgaccugcagaucggcaagcugauguggggcgacagcggccuguacuacugcaucaucaccacccccgacgaccuggagggcaagaacgaggacagcguggagcugcuggugcugggcagaaccggccugcuggccgaccugcugcccagcuucgccguggagaucaugcccgaguggguguucgugggccuggugcugcugggcguguuccuguucuucgugcuggugggcaucugcuggugccagugcugcccccacagcugcugcugcuacgugagaugccccugcugccccgacagcugcugcugcccccaggcccuguacgaggccggcaaggccgccaaggccggcuacccccccagcgugagcggcgugcccggccccuacagcauccccagcgugccccugggcggcgcccccagcagcggcaugcugauggacaagccccacccccccccccuggcccccagcgacagcaccggcggcagccacagcgugagaaagggcuacagaauccaggccgacaaggagagagacagcaugaaggugcuguacuacguggagaaggagcuggcccaguucgaccccgccagaagaaugagaggcagauacaacaacaccaucagcgagcugagcagccugcacgaggaggacagcaacuucagacagagcuuccaccagaugagaagcaagcaguuccccgugagcggcgaccuggagagcaaccccgacuacuggagcggcgugaugggcggcagcagcggcgccagcagaggccccagcgccauggaguacaacaaggaggacagagagagcuucagacacagccagcccagaagcaagagcgagaugcugagcagaaagaacuucgccaccggcgugcccgccgugagcauggacgagcuggccgccuucgccgacagcuacggccagagacccagaagagccgacggcaacagccacgaggccagaggcggcagcagauucgagagaagcgagagcagagcccacagcggcuucuaccaggacgacagccuggaggaguacuacggccagagaagcagaagcagagagccccugaccgacgccgacagaggcugggccuucagccccgccagaagaagacccgccgaggacgcccaccugcccagacuggugagcagaacccccggcaccgcccccaaguacgaccacagcuaccugggcagcgccagagagagacaggccagacccgagggcgccagcagaggcggcagccuggagacccccagcaagagaagcgcccagcugggccccagaagcgccagcuacuacgccuggagcccccccggcaccuacaaggccggcagcagccaggacgaccaggaggacgccagcgacgacgcccugccccccuacagcgagcuggagcugaccagaggccccagcuacagaggcagagaccugcccuaccacagcaacagcgagaagaagagaaagaaggagcccgccaagaagaccaacgacuuccccaccagaaugagccuggugguguaa

SEQ ID NO: 18536 - RNA, 1059 nt, Artificial Sequence
  ILF2__Homo_sapiens__NP_001254738
auggccuuccccagagugaagcccgcccccgacgagaccagcuucagcgaggcccugcugaagagaaaccaggaccuggcccccaacagcgccgagcaggccagcauccugagccuggugaccaagaucaacaacgugaucgacaaccugaucguggcccccggcaccuucgaggugcagaucgaggaggugagacaggugggcagcuacaagaagggcaccaugaccaccggccacaacguggccgaccugguggugauccugaagauccugcccacccuggaggccguggccgcccugggcaacaaggugguggagagccugagagcccaggaccccagcgaggugcugaccaugcugaccaacgagaccggcuucgagaucagcagcagcgacgccaccgugaagauccugaucaccaccgugccccccaaccugagaaagcuggaccccgagcugcaccuggacaucaaggugcugcagagcgcccuggccgccaucagacacgccagaugguucgaggagaacgccagccagagcaccgugaaggugcugaucagacugcugaaggaccugagaaucagauuccccggcuucgagccccugacccccuggauccuggaccugcugggccacuacgccgugaugaacaaccccaccagacagccccuggcccugaacguggccuacagaagaugccugcagauccuggccgccggccuguuccugcccggcagcgugggcaucaccgaccccugcgagagcggcaacuucagagugcacaccgugaugacccuggagcagcaggacauggugugcuacaccgcccagacccuggugagaauccugagccacggcggcuucagaaagauccugggccaggagggcgacgccagcuaccuggccagcgagaucagcaccugggacggcgugaucgugacccccagcgagaaggccuacgagaagccccccgagaagaaggagggcgaggaggaggaggagaacaccgaggagcccccccagggcgaggaggaggagagcauggagacccaggaguaa

SEQ ID NO: 18537 - RNA, 2121 nt, Artificial Sequence
  ILF3__Homo_sapiens__NP_001131145
augagacccaugagaaucuucgugaacgacgacagacacgugauggccaagcacagcagcguguaccccacccaggaggagcuggaggccgugcagaacauggugagccacaccgagagagcccugaaggccgugagcgacuggaucgacgagcaggagaagggcagcagcgagcaggccgagagcgacaacauggacgugccccccgaggacgacagcaaggagggcgccggcgagcagaagaccgagcacaugaccagaacccugagaggcgugaugagagugggccugguggccaagggccugcugcugaagggcgaccuggaccuggagcuggugcugcugugcaaggagaagcccaccaccgcccugcuggacaagguggccgacaaccuggccauccagcuggccgccgugaccgaggacaaguacgagauccugcagagcguggacgacgccgccaucgugaucaagaacaccaaggagcccccccugagccugaccauccaccugaccagccccguggugagagaggagauggagaaggugcuggccggcgagacccugagcgugaacgacccccccgacgugcuggacagacagaagugccuggccgcccuggccagccugagacacgccaagugguuccaggccagagccaacggccugaagagcugcgugaucgugaucagagugcugagagaccugugcaccagagugcccaccuggggcccccugagaggcuggccccuggagcugcugugcgagaagagcaucggcaccgccaacagacccaugggcgccggcgaggcccugagaagagugcuggagugccuggccagcggcaucgugaugcccgacggcagcggcaucuacgaccccugcgagaaggaggccaccgacgccaucggccaccuggacagacagcagagagaggacaucacccagagcgcccagcacgcccugagacuggccgccuucggccagcugcacaaggugcugggcauggacccccugcccagcaagaugcccaagaagcccaagaacgagaaccccguggacuacaccgugcagaucccccccagcaccaccuacgccaucacccccaugaagagacccauggaggaggacggcgaggagaagagccccagcaagaagaagaagaagauccagaagaaggaggagaaggccgagcccccccaggccaugaacgcccugaugagacugaaccagcugaagcccggccugcaguacaagcuggugagccagaccggccccgugcacgcccccaucuucaccaugagcguggagguggacggcaacagcuucgaggccagcggccccagcaagaagaccgccaagcugcacguggccgugaaggugcugcaggacaugggccugcccaccggcgccgagggcagagacagcagcaagggcgaggacagcgccgaggagaccgaggccaagcccgccgugguggcccccgcccccgugguggaggccgugagcacccccagcgccgccuuccccagcgacgccaccgccgagaacgugaagcagcagggccccauccugaccaagcacggcaagaaccccgugauggagcugaacgagaagagaagaggccugaaguacgagcugaucagcgagaccggcggcagccacgacaagagauucgugauggagguggagguggacggccagaaguuccagggcgccggcagcaacaagaagguggccaaggccuacgccgcccuggccgcccuggagaagcuguuccccgacaccccccuggcccuggacgccaacaagaagaagagagcccccgugcccgugagaggcggccccaaguucgccgccaagccccacaaccccggcuucggcaugggcggccccaugcacaacgaggugccccccccccccaaccugagaggcagaggcagaggcggcagcaucagaggcagaggcagaggcagaggcuucggcggcgccaaccacggcggcuacaugaacgccggcgccggcuacggcagcuacggcuacggcggcaacagcgccaccgccggcuacagcgacuucuucaccgacugcuacggcuaccacgacuucggcagcagcuaa

SEQ ID NO: 18538 - RNA, 1359 nt, Artificial Sequence
  ILK__Homo_sapiens__NP_001014795
auggacgacaucuucacccagugcagagagggcaacgccguggccgugagacuguggcuggacaacaccgagaacgaccugaaccagggcgacgaccacggcuucagcccccugcacugggccugcagagagggcagaagcgccgugguggagaugcugaucaugagaggcgccagaaucaacgugaugaacagaggcgacgacaccccccugcaccuggccgccagccacggccacagagacaucgugcagaagcugcugcaguacaaggccgacaucaacgccgugaacgagcacggcaacgugccccugcacuacgccugcuucuggggccaggaccagguggccgaggaccugguggccaacggcgcccuggugagcaucugcaacaaguacggcgagaugcccguggacaaggccaaggccccccugagagagcugcugagagagagagccgagaagaugggccagaaccugaacagaauccccuacaaggacaccuucuggaagggcaccaccagaaccagacccagaaacggcacccugaacaagcacagcggcaucgacuucaagcagcugaacuuccugaccaagcugaacgagaaccacagcggcgagcuguggaagggcagauggcagggcaacgacaucguggugaaggugcugaaggugagagacuggagcaccagaaagagcagagacuucaacgaggagugccccagacugagaaucuucagccaccccaacgugcugcccgugcugggcgccugccagagcccccccgccccccaccccacccugaucacccacuggaugcccuacggcagccuguacaacgugcugcacgagggcaccaacuucgugguggaccagagccaggccgugaaguucgcccuggacauggccagaggcauggccuuccugcacacccuggagccccugauccccagacacgcccugaacagcagaagcgugaugaucgacgaggacaugaccgccagaaucagcauggccgacgugaaguucagcuuccagugccccggcagaauguacgcccccgccuggguggcccccgaggcccugcagaagaagcccgaggacaccaacagaagaagcgccgacauguggagcuucgccgugcugcugugggagcuggugaccagagaggugcccuucgccgaccugagcaacauggagaucggcaugaagguggcccuggagggccugagacccaccaucccccccggcaucagcccccacgugugcaagcugaugaagaucugcaugaacgaggaccccgccaagagacccaaguucgacaugaucgugcccauccuggagaagaugcaggacaaguaa

SEQ ID NO: 18539 - RNA, 501 nt, Artificial Sequence
  IMMP1L__Homo_sapiens__NP_001291203
augcugagaggcgugcugggcaagaccuucagacuggugggcuacaccauccaguacggcugcaucgcccacugcgccuucgaguacgugggcggcguggugaugugcagcggccccagcauggagcccaccauccagaacagcgacaucguguucgccgagaaccugagcagacacuucuacggcauccagagaggcgacaucgugaucgccaagagccccagcgaccccaagagcaacaucugcaagagagugaucggccuggagggcgacaagauccugaccaccagccccagcgacuucuucaagagccacagcuacgugcccaugggccacguguggcuggagggcgacaaccugcagaacagcaccgacagcagaugcuacggccccauccccuacggccugaucagaggcagaaucuucuucaagaucuggccccugagcgacuucggcuuccugagagccagccccaacggccacagauucagcgacgacuaa

SEQ ID NO: 18540 - RNA, 528 nt, Artificial Sequence
  IMMP2L__Homo_sapiens__XP_005250687
auggcccagagccagggcugggugaagagauacaucaaggccuucugcaagggcuucuucguggccgugcccguggccgugaccuuccuggacagaguggccugcguggccagaguggagggcgccagcaugcagcccagccugaaccccggcggcagccagagcagcgacguggugcugcugaaccacuggaaggugagaaacuucgaggugcacagaggcgacaucgugagccuggugagccccaagaaccccgagcagaagaucaucaagagagugaucgcccuggagggcgacaucgugagaaccaucggccacaagaacagauacgugaaggugcccagaggccacaucuggguggagggcgaccaccacggccacagcuucgacagcaacagcuucggccccgugagccugggccugcugcacgcccacgccacccacauccuguggccccccgagagauggcagaagcuggagagcgugcugccccccgagagacugcccgugcagagagaggaggaguaa

SEQ ID NO: 18541 - RNA, 2274 nt, Artificial Sequence
  IMMT__Homo_sapiens__NP_001093639
augcugagagccugccagcugagcggcgugaccgccgccgcccagagcugccugugcggcaaguucgugcugagaccccugagacccugcagaagauacagcaccagcggcagcagcggccugaccaccggcaagaucgccggcgccggccugcuguucgugggcggcggcaucggcggcaccauccuguacgccaagugggacagccacuucagagagagcguggagaagaccauccccuacagcgacaagcuguucgagauggugcugggccccgccgccuacaacgugccccugcccaagaagagcauccagagcggcccccugaagaucagcagcgugagcgaggugaugaaggagagcaagcagcccgccagccagcugcagaagcagaagggcgacacccccgccagcgccaccgcccccaccgaggccgcccagaucaucagcgccgccggcgacacccugagcgugcccgcccccgccgugcagcccgaggagagccugaagaccgaccaccccgagaucggcgagggcaagcccacccccgcccugagcgaggccagcagcagcagcaucagagagagaccccccgaggagguggccgccagacuggcccagcaggagaagcaggagcaggugaagaucgagagccuggccaagagccuggaggacgcccugagacagaccgccagcgugacccugcaggccaucgccgcccagaacgccgccgugcaggccgugaacgcccacagcaacauccugaaggccgccauggacaacagcgagaucgccggcgagaagaagagcgcccaguggagaaccguggagggcgcccugaaggagagaagaaaggccguggacgaggccgccgacgcccugcugaaggccaaggaggagcuggagaagaugaagagcgugaucgagaacgccaagaagaaggagguggccggcgccaagccccacaucaccgccgccgagggcaagcugcacaacaugaucguggaccuggacaacguggugaagaaggugcaggccgcccagagcgaggccaagguggugagccaguaccacgagcugguggugcaggccagagacgacuucaagagagagcuggacagcaucacccccgaggugcugcccggcuggaagggcaugagcgugagcgaccuggccgacaagcugagcaccgacgaccugaacagccugaucgcccacgcccacagaagaaucgaccagcugaacagagagcuggccgagcagaaggccaccgagaagcagcacaucacccuggcccuggagaagcagaagcuggaggagaagagagccuucgacagcgccguggccaaggcccuggagcaccacagaagcgagauccaggccgagcaggacagaaagaucgaggaggugagagacgccauggagaacgagaugagaacccagcugagaagacaggccgccgcccacaccgaccaccugagagacgugcugagagugcaggagcaggagcugaagagcgaguucgagcagaaccugagcgagaagcugagcgagcaggagcugcaguucagaagacugagccaggagcagguggacaacuucacccuggacaucaacaccgccuacgccagacugagaggcaucgagcaggccgugcagagccacgccguggccgaggaggaggccagaaaggcccaccagcuguggcugagcguggaggcccugaaguacagcaugaagaccagcagcgccgagacccccaccaucccccugggcagcgccguggaggccaucaaggccaacugcagcgacaacgaguucacccaggcccugaccgccgccaucccccccgagagccugaccagaggcguguacagcgaggagacccugagagccagauucuacgccgugcagaagcuggccagaagaguggccaugaucgacgagaccagaaacagccuguaccaguacuuccugagcuaccugcagagccugcugcuguuccccccccagcagcugaagcccccccccgagcugugccccgaggacaucaacaccuucaagcugcugagcuacgccagcuacugcaucgagcacggcgaccuggagcuggccgccaaguucgugaaccagcugaagggcgagagcagaagaguggcccaggacuggcugaaggaggccagaaugacccuggagaccaagcagaucguggagauccugaccgccuacgccagcgccgugggcaucggcaccacccaggugcagcccgaguaa

SEQ ID NO: 18542 - RNA, 555 nt, Artificial Sequence
  IMP3__Homo_sapiens__NP_060755
auggugagaaagcugaaguuccacgagcagaagcugcugaagcagguggacuuccugaacugggaggugaccgaccacaaccugcacgagcugagagugcugagaagauacagacugcagagaagagaggacuacaccagauacaaccagcugagcagagccgugagagagcuggccagaagacugagagaccugcccgagagagaccaguucagagugagagccagcgccgcccugcuggacaagcuguacgcccugggccuggugcccaccagaggcagccuggagcugugcgacuucgugaccgccagcagcuucugcagaagaagacugcccaccgugcugcugaagcugagaauggcccagcaccugcaggccgccguggccuucguggagcagggccacgugagagugggccccgacguggugaccgaccccgccuuccuggugaccagaagcauggaggacuucgugaccuggguggacagcagcaagaucaagagacacgugcuggaguacaacgaggagagagacgacuucgaccuggaggccuaa

SEQ ID NO: 18543 - RNA, 1011 nt, Artificial Sequence
  IMPA1__Homo_sapiens__NP_001138350
augggccagagacccggccccgugcugcccgccguggccgugcugggccagguggccaagagaaagguggccuggcugcugagauggaaggccgugaccagaaccgagaccgccggcaacagcagcggcguguacggcuucggcaagaugaagaucuucgugaaguacuuccagaagauggccgaccccuggcaggagugcauggacuacgccgugacccuggccagacaggccggcgagguggugugcgaggccaucaagaacgagaugaacgugaugcugaagagcagccccguggaccuggugaccgccaccgaccagaagguggagaagaugcugaucagcagcaucaaggagaaguaccccagccacagcuucaucggcgaggagagcguggccgccggcgagaagagcauccugaccgacaaccccaccuggaucaucgaccccaucgacggcaccaccaacuucgugcacagauuccccuucguggccgugagcaucggcuucgccgugaacaagaagaucgaguucggcgugguguacagcugcguggagggcaagauguacaccgccagaaagggcaagggcgccuucugcaacggccagaagcugcaggugagccagcaggaggacaucaccaagagccugcuggugaccgagcugggcagcagcagaacccccgagaccgugagaauggugcugagcaacauggagaagcuguucugcauccccgugcacggcaucagaagcgugggcaccgccgccgugaacaugugccugguggccaccggcggcgccgacgccuacuacgagaugggcauccacugcugggacguggccggcgccggcaucaucgugaccgaggccggcggcgugcugauggacgugaccggcggccccuucgaccugaugagcagaagagugaucgccgccaacaacagaauccuggccgagagaaucgccaaggagauccaggugaucccccugcagagagacgacgaggacuaa

SEQ ID NO: 18544 - RNA, 867 nt, Artificial Sequence
  IMPA2__Homo_sapiens__NP_055029
augaagcccagcggcgaggaccaggccgcccuggccgccggccccugggaggagugcuuccaggccgccgugcagcuggcccugagagccggccagaucaucagaaaggcccugaccgaggagaagagagugagcaccaagaccagcgccgccgaccuggugaccgagaccgaccaccugguggaggaccugaucaucagcgagcugagagagagauuccccagccacagauucaucgccgaggaggccgccgccagcggcgccaagugcgugcugacccacagccccaccuggaucaucgaccccaucgacggcaccugcaacuucgugcacagauuccccaccguggccgugagcaucggcuucgccgugagacaggagcuggaguucggcgugaucuaccacugcaccgaggagagacuguacaccggcagaagaggcagaggcgccuucugcaacggccagagacugagagugagcggcgagaccgaccugagcaaggcccuggugcugaccgagaucggccccaagagagaccccgccacccugaagcuguuccugagcaacauggagagacugcugcacgccaaggcccacggcgugagagugaucggcagcagcacccuggcccugugccaccuggccagcggcgccgccgacgccuacuaccaguucggccugcacugcugggaccuggccgccgccaccgugaucaucagagaggccggcggcaucgugaucgacaccagcggcggcccccuggaccugauggccugcagagugguggccgccagcaccagagagauggccaugcugaucgcccaggcccugcagaccaucaacuacggcagagacgacgagaaguaa

SEQ ID NO: 18545 - RNA, 963 nt, Artificial Sequence
  IMPACT__Homo_sapiens__NP_060909
auggccgagggcgacgccggcagcgaccagagacagaacgaggagaucgaggccauggccgccaucuacggcgaggaguggugcgugaucgacgacugcgccaagaucuucugcaucagaaucagcgacgacaucgacgaccccaaguggacccugugccugcaggugaugcugcccaacgaguaccccggcaccgccccccccaucuaccagcugaacgcccccuggcugaagggccaggagagagccgaccugagcaacagccuggaggagaucuacauccagaacaucggcgagagcauccuguaccuguggguggagaagaucagagacgugcugauccagaagagccagaugaccgagcccggccccgacgugaagaagaagaccgaggaggaggacguggagugcgaggacgaccugauccuggccugccagcccgagagcagcgugaaggcccuggacuucgacaucagcgagaccagaaccgagguggagguggaggagcugccccccaucgaccacggcauccccaucaccgacagaagaagcaccuuccaggcccaccuggcccccguggugugccccaagcaggugaagauggugcugagcaagcuguacgagaacaagaagaucgccagcgccacccacaacaucuacgccuacagaaucuacugcgaggacaagcagaccuuccugcaggacugcgaggacgacggcgagaccgccgccggcggcagacugcugcaccugauggagauccugaacgugaagaacgugauggugguggugagcagaugguacggcggcauccugcugggccccgacagauucaagcacaucaacaacugcgccagaaacauccugguggagaagaacuacaccaacagccccgaggagagcagcaaggcccugggcaagaacaagaaggugagaaaggacaagaagagaaacgagcacuaa

SEQ ID NO: 18546 - RNA, 1080 nt, Artificial Sequence
  IMPAD1__Homo_sapiens__NP_060283
auggcccccaugggcaucagacugagcccccugggcguggccguguucugccugcugggccugggcgugcuguaccaccuguacagcggcuuccuggccggcagauucagccuguucggccugggcggcgagcccggcggcggcgccgccggccccgccgccgccgccgacggcggcaccguggaccugagagagaugcuggccgugagcgugcuggccgccgugagaggcggcgacgaggugagaagagugagagagagcaacgugcugcacgagaagagcaagggcaagaccagagagggcgccgaggacaagaugaccagcggcgacgugcugagcaacagaaagauguucuaccugcugaagaccgccuuccccagcgugcagaucaacaccgaggagcacguggacgccgccgaccaggaggugauccugugggaccacaagauccccgaggacauccugaaggaggugaccacccccaaggaggugcccgccgagagcgugaccguguggaucgacccccuggacgccacccaggaguacaccgaggaccugagaaaguacgugaccaccauggugugcguggccgugaacggcaagcccaugcugggcgugauccacaagcccuucagcgaguacaccgccugggccaugguggacggcggcagcaacgugaaggccagaagcagcuacaacgagaagacccccagaaucguggugagcagaagccacagcggcauggugaagcagguggcccugcagaccuucggcaaccagaccaccaucauccccgccggcggcgccggcuacaaggugcuggcccugcuggacgugcccgacaagagccaggagaaggccgaccuguacauccacgugaccuacaucaagaagugggacaucugcgccggcaacgccauccugaaggcccugggcggccacaugaccacccugagcggcgaggagaucagcuacaccggcagcgacggcaucgagggcggccugcuggccagcaucagaaugaaccaccaggcccuggugagaaagcugcccgaccuggagaagaccggccacaaguaa

SEQ ID NO: 18547 - RNA, 1800 nt, Artificial Sequence
  IMPDH1__Homo_sapiens__NP_000874
auggagggcccccugaccccccccccccugcagggcggcggcgccgccgccgugcccgagcccggcgccagacagcaccccggccacgagaccgccgcccagagauacagcgccagacugcugcaggccggcuacgagcccgagagccccagacuggaccuggccacccaccccaccacccccagaagcgagcugagcagcguggugcugcuggccggcgugggcgugcagauggacagacugagaagagccagcauggccgacuaccugaucagcggcggcaccggcuacgugcccgaggacggccugaccgcccagcagcuguucgccagcgccgacggccugaccuacaacgacuuccugauccugcccggcuucaucgacuucaucgccgacgagguggaccugaccagcgcccugaccagaaagaucacccugaagaccccccugaucagcagccccauggacaccgugaccgaggccgacauggccaucgccauggcccugaugggcggcaucggcuucauccaccacaacugcacccccgaguuccaggccaacgaggugagaaaggugaagaaguucgagcagggcuucaucaccgaccccguggugcugagccccagccacaccgugggcgacgugcuggaggccaagaugagacacggcuucagcggcauccccaucaccgagaccggcaccaugggcagcaagcuggugggcaucgugaccagcagagacaucgacuuccuggccgagaaggaccacaccacccugcugagcgaggugaugacccccagaaucgagcuggugguggcccccgccggcgugacccugaaggaggccaacgagauccugcagagaagcaagaagggcaagcugcccaucgugaacgacugcgacgagcugguggccaucaucgccagaaccgaccugaagaagaacagagacuacccccuggccagcaaggacagccagaagcagcugcugugcggcgccgccgugggcaccagagaggacgacaaguacagacuggaccugcugacccaggccggcguggacgugaucgugcuggacagcagccagggcaacagcguguaccagaucgccauggugcacuacaucaagcagaaguacccccaccugcaggugaucggcggcaacguggugaccgccgcccaggccaagaaccugaucgacgccggcguggacggccugagagugggcaugggcugcggcagcaucugcaucacccaggaggugauggccugcggcagaccccagggcaccgccguguacaagguggccgaguacgccagaagauucggcgugcccaucaucgccgacggcggcauccagaccgugggccacguggugaaggcccuggcccugggcgccagcaccgugaugaugggcagccugcuggccgccaccaccgaggcccccggcgaguacuucuucagcgacggcgugagacugaagaaguacagaggcaugggcagccuggacgccauggagaagagcagcagcagccagaagagauacuucagcgagggcgacaaggugaagaucgcccagggcgugagcggcagcauccaggacaagggcagcauccagaaguucgugcccuaccugaucgccggcauccagcacggcugccaggacaucggcgccagaagccugagcgugcugagaagcaugauguacagcggcgagcugaaguucgagaagagaaccaugagcgcccagaucgagggcggcgugcacggccugcacagcuacgagaagagacuguacuaa

SEQ ID NO: 18548 - RNA, 1545 nt, Artificial Sequence
  IMPDH2__Homo_sapiens__NP_000875
auggccgacuaccugaucagcggcggcaccagcuacgugcccgacgacggccugaccgcccagcagcuguucaacugcggcgacggccugaccuacaacgacuuccugauccugcccggcuacaucgacuucaccgccgaccagguggaccugaccagcgcccugaccaagaagaucacccugaagaccccccuggugagcagccccauggacaccgugaccgaggccggcauggccaucgccauggcccugaccggcggcaucggcuucauccaccacaacugcacccccgaguuccaggccaacgaggugagaaaggugaagaaguacgagcagggcuucaucaccgaccccguggugcugagccccaaggacagagugagagacguguucgaggccaaggccagacacggcuucugcggcauccccaucaccgacaccggcagaaugggcagcagacuggugggcaucaucagcagcagagacaucgacuuccugaaggaggaggagcacgacugcuuccuggaggagaucaugaccaagagagaggaccuggugguggcccccgccggcaucacccugaaggaggccaacgagauccugcagagaagcaagaagggcaagcugcccaucgugaacgaggacgacgagcugguggccaucaucgccagaaccgaccugaagaagaacagagacuacccccuggccagcaaggacgccaagaagcagcugcugugcggcgccgccaucggcacccacgaggacgacaaguacagacuggaccugcuggcccaggccggcguggacgugguggugcuggacagcagccagggcaacagcaucuuccagaucaacaugaucaaguacaucaaggacaaguaccccaaccugcaggugaucggcggcaacguggugaccgccgcccaggccaagaaccugaucgacgccggcguggacgcccugagagugggcaugggcagcggcagcaucugcaucacccaggaggugcuggccugcggcagaccccaggccaccgccguguacaaggugagcgaguacgccagaagauucggcgugcccgugaucgccgacggcggcauccagaacgugggccacaucgccaaggcccuggcccugggcgccagcaccgugaugaugggcagccugcuggccgccaccaccgaggcccccggcgaguacuucuucagcgacggcaucagacugaagaaguacagaggcaugggcagccuggacgccauggacaagcaccugagcagccagaacagauacuucagcgaggccgacaagaucaagguggcccagggcgugagcggcgccgugcaggacaagggcagcauccacaaguucgugcccuaccugaucgccggcauccagcacagcugccaggacaucggcgccaagagccugacccaggugagagccaugauguacagcggcgagcugaaguucgagaagagaaccagcagcgcccagguggagggcggcgugcacagccugcacagcuacgagaagagacuguucuaa

SEQ ID NO: 18549 - RNA, 2160 nt, Artificial Sequence
  IMPG1__Homo_sapiens__NP_001269297
auguaccuggagaccagaagagccaucuucguguucuggaucuuccugcaggugcagggcaccaaggugugccaggaggccgugugggaggccuacagaaucuuccuggacagaauccccgacaccggcgaguaccaggacugggugagcaucugccagcaggagaccuucugccuguucgacaucggcaagaacuucagcaacagccaggagcaccuggaccugcugcagcagagaaucaagcagagaagcuuccccgacagaaaggacgagaucagcgccgagaagacccugggcgagcccggcgagaccaucgugaucagcaccgacguggccaacgugagccugggccccuucccccugacccccgacgacacccugcugaacgagauccuggacaacacccugaacgacaccaagaugcccaccaccgagagagagaccgaguucgccgugcuggaggagcagagaguggagcugagcgugagccuggugaaccagaaguucaaggccgagcuggccgacagccagagccccuacuaccaggagcuggccggcaagagccagcugcagaugcagaagaucuucaagaagcugcccggcuucaagaagauccacgugcugggcuucagacccaagaaggagaaggacggcagcagcagcaccgagaugcagcugaccgccaucuucaagagacacagcgccgaggccaagagccccgccagcgaccugcugagcuucgacagcaacaagaucgagagcgaggagguguaccacggcaccauggaggaggacaagcagcccgagaucuaccugaccgccaccgaccugaagagacugaucagcaaggcccuggaggaggagcagagccuggacgugggcaccauccaguucaccgacgagaucgccggcagccugcccgccuucggccccgacacccagagcgagcugcccaccagcuucgccgugaucaccgaggacgccacccugagccccgagcugccccccguggagccccagcuggagaccguggacggcgccgagcacggccugcccgacaccagcuggagcccccccgccauggccagcaccagccugagcgaggccccccccuucuucauggccagcagcaucuucagccugaccgaccagggcaccaccgacaccauggccaccgaccagaccaugcuggugcccggccugaccauccccaccagcgacuacagcgccaucagccagcuggcccugggcaucagccacccccccgccagcagcgacgacagcagaagcagcgccggcggcgaggacauggugagacaccuggacgagauggaccugagcgacacccccgcccccagcgaggugcccgagcugagcgaguacgugagcgugcccgaccacuuccuggaggacaccacccccgugagcgcccugcaguacaucaccaccagcagcaugaccaucgcccccaagggcagagagcuggugguguucuucagccugagaguggccaacauggccuucagcaacgaccuguucaacaagagcagccuggaguacagagcccuggagcagcaguucacccagcugcuggugcccuaccugagaagcaaccugaccggcuucaagcagcuggagauccugaacuucagaaacggcagcgugaucgugaacagcaagaugaaguucgccaagagcgugcccuacaaccugaccaaggccgugcacggcgugcuggaggacuucagaagcgccgccgcccagcagcugcaccuggagaucgacagcuacagccugaacaucgagcccgccgaccaggccgaccccugcaaguuccuggccugcggcgaguucgcccagugcgugaagaacgagagaaccgaggaggccgagugcagaugcaagcccggcuacgacagccagggcagccuggacggccuggagcccggccugugcggccccggcaccaaggagugcgaggugcugcagggcaagggcgcccccugcagacugcccgaccacagcgagaaccaggccuacaagaccagcgugaagaaguuccagaaccagcagaacaacaaggugaucagcaagagaaacagcgagcugcugaccguggaguacgaggaguucaaccaccaggacugggagggcaacuaa

SEQ ID NO: 18550 - RNA, 3726 nt, Artificial Sequence
  IMPG2__Homo_sapiens__NP_057331
augaucauguucccccuguucggcaagaucagccugggcauccugaucuucgugcugaucgagggcgacuuccccagccugaccgcccagaccuaccugagcaucgaggagauccaggagcccaagagcgccgugagcuuccugcugcccgaggagagcaccgaccugagccuggccaccaagaagaagcagccccuggacagaagagagaccgagagacaguggcugaucagaagaagaagaagcauccuguuccccaacggcgugaagaucugccccgacgagagcguggccgaggccguggccaaccacgugaaguacuucaaggugagagugugccaggaggccgugugggaggccuucagaaccuucugggacagacugcccggcagagaggaguaccacuacuggaugaaccugugcgaggacggcgugaccagcaucuucgagaugggcaccaacuucagcgagagcguggagcacagaagccugaucaugaagaagcugaccuacgccaaggagaccgugagcagcagcgagcugagcagccccgugcccgugggcgacaccagcacccugggcgacaccacccugagcgugccccaccccgagguggacgccuacgagggcgccagcgagagcagccuggagagacccgaggagagcaucagcaacgagaucgagaacgugaucgaggaggccaccaagcccgccggcgagcagaucgccgaguucagcauccaccugcugggcaagcaguacagagaggagcugcaggacagcagcagcuuccaccaccagcaccuggaggaggaguucaucagcgagguggagaacgccuucaccggccugcccggcuacaaggagaucagagugcuggaguucagaagccccaaggagaacgacagcggcguggacguguacuacgccgugaccuucaacggcgaggccaucagcaacaccaccugggaccugaucagccugcacagcaacaagguggagaaccacggccugguggagcuggacgacaagcccaccgugguguacaccaucagcaacuucagagacuacaucgccgagacccugcagcagaacuuccugcugggcaacagcagccugaaccccgaccccgacagccugcagcugaucaacgugagaggcgugcugagacaccagaccgaggaccugguguggaacacccagagcagcagccugcaggccacccccagcagcauccuggacaacaccuuccaggccgccuggcccagcgccgacgagagcaucaccagcagcauccccccccuggacuucagcagcggcccccccagcgccaccggcagagagcuguggagcgagagcccccugggcgaccuggugagcacccacaagcuggccuuccccagcaagaugggccugagcagcagccccgaggugcuggaggugagcagccugacccugcacagcgugacccccgccgugcugcagaccggccugcccguggccagcgaggagagaaccagcggcagccaccugguggaggacggccuggccaacguggaggagagcgaggacuuccugagcaucgacagccugcccagcagcagcuucacccagcccgugcccaaggagaccauccccagcauggaggacagcgacgugagccugaccagcagccccuaccugaccagcagcauccccuucggccuggacagccugaccagcaaggugaaggaccagcugaaggugagccccuuccugcccgacgccagcauggagaaggagcugaucuucgacggcggccugggcagcggcagcggccagaagguggaccugaucaccuggcccuggagcgagaccagcagcgagaagagcgccgagccccugagcaagcccuggcuggaggacgacgacagccugcugcccgccgagaucgaggacaagaagcuggugcugguggacaagauggacagcaccgaccagaucagcaagcacagcaaguacgagcacgacgacagaagcacccacuuccccgaggaggagccccugagcggccccgccgugcccaucuucgccgacaccgccgccgagagcgccagccugacccugcccaagcacaucagcgaggugcccggcguggacgacuacagcgugaccaaggccccccugauccugaccagcguggccaucagcgccagcaccgacaagagcgaccaggccgacgccauccugagagaggacauggagcagaucaccgagagcagcaacuacgagugguucgacagcgaggugagcauggugaagcccgacaugcagacccuguggaccauccugcccgagagcgagagaguguggaccagaaccagcagccuggagaagcugagcagagacauccuggccagcaccccccagagcgccgacagacuguggcugagcgugacccagagcaccaagcugccccccaccaccaucagcacccugcuggaggacgaggugaucaugggcgugcaggacaucagccuggagcuggacagaaucggcaccgacuacuaccagcccgagcaggugcaggagcagaacggcaaggugggcagcuacguggagaugagcaccagcgugcacagcaccgagauggugagcguggccuggcccaccgagggcggcgacgaccugagcuacacccagaccagcggcgcccuggugguguucuucagccugagagugaccaacaugauguucagcgaggaccuguucaacaagaacagccuggaguacaaggcccuggagcagagauuccuggagcugcuggugcccuaccugcagagcaaccugaccggcuuccagaaccuggagauccugaacuucagaaacggcagcaucguggugaacagcagaaugaaguucgccaacagcgugccccccaacgugaacaacgccguguacaugauccuggaggacuucugcaccaccgccuacaacaccaugaaccuggccaucgacaaguacagccuggacguggagagcggcgacgaggccaaccccugcaaguuccaggccugcaacgaguucagcgagugccuggugaaccccuggagcggcgaggccaagugcagaugcuuccccggcuaccugagcguggaggagagacccugccagagccugugcgaccugcagcccgacuucugccugaacgacggcaagugcgacaucaugcccggccacggcgccaucugcagaugcagagugggcgagaacuggugguacagaggcaagcacugcgaggaguucgugagcgagcccgugaucaucggcaucaccaucgccagcguggugggccugcuggugaucuucagcgccaucaucuacuucuucaucagaacccugcaggcccaccacgacagaagcgagagagagagccccuucagcggcagcagcagacagcccgacagccugagcagcaucgagaacgccgugaaguacaaccccguguacgagagccacagagccggcugcgagaaguacgagggccccuacccccagcaccccuucuacagcagcgccagcggcgacgugaucggcggccugagcagagaggagaucagacagauguacgagagcagcgagcugagcagagaggagauccaggagagaaugagagugcuggagcuguacgccaacgaccccgaguucgccgccuucgugagagagcagcagguggaggagguguaa

SEQ ID NO: 18551 - RNA, 5739 nt, Artificial Sequence
  INADL__Homo_sapiens__XP_011538767
augcccgagaaccccgccaccgacaagcugcaggugcugcaggugcuggacagacugaagaugaagcugcaggagaagggcgacaccagccagaacgagaagcugagcauguucuacgagacccugaagagcccccuguucaaccagauccugacccugcagcagagcaucaagcagcugaagggccagcugaaccacauccccagcgacugcagcgccaacuucgacuucagcagaaagggccugcugguguucaccgacggcagcaucaccaacggcaacgugcacagacccagcaacaacagcaccgugagcggccuguuccccuggacccccaagcugggcaacgaggacuucaacagcgugauccagcagauggcccagggcagacagaucgaguacaucgacaucgagagacccagcaccggcggccugggcuucagcgugguggcccugagaagccagaaccugggcaagguggacaucuucgugaaggacgugcagcccggcagcguggccgacagagaccagagacugaaggagaacgaccagauccuggccaucaaccacaccccccuggaccagaacaucagccaccagcaggccaucgcccugcugcagcagaccaccggcagccugagacugaucguggccagagagcccgugcacaccaagagcagcaccagcagcagccugaacgacaccacccugcccgagaccgugugcuggggccacguggaggagguggagcugaucaacgacggcagcggccugggcuucggcaucgugggcggcaagaccagcggcgugguggugagaaccaucgugcccggcggccuggccgacagagacggcagacugcagaccggcgaccacauccugaagaucggcggcaccaacgugcagggcaugaccagcgagcagguggcccaggugcugagaaacugcggcaacagcgugagaaugcugguggccagagaccccgccggcgacaucagcgugaccccccccgcccccgccgcccugcccguggcccugcccaccguggccagcaagggccccggcagcgacagcagccuguucgagaccuacaacguggagcuggugagaaaggacggccagagccugggcaucagaaucgugggcuacgugggcaccagccacaccggcgaggccagcggcaucuacgugaagagcaucauccccggcagcgccgccuaccacaacggccacauccaggugaacgacaagaucguggccguggacggcgugaacauccagggcuucgccaaccacgacgugguggaggugcugagaaacgccggccagguggugcaccugacccuggugagaagaaagaccagcagcagcaccagcccccuggagccccccagcgacagaggcaccgugguggagccccugaagccccccgcccuguuccugaccggcgccguggagaccgagaccaacguggacggcgaggacgaggagaucaaggagagaaucgacacccugaagaacgacaacauccaggcccuggagaagcuggagaaggugcccgacagccccgagaacgagcugaagagcagaugggagaaccugcugggccccgacuacgaggugaugguggccacccuggacacccagaucgccgacgacgccgagcugcagaaguacagcaagcugcugcccauccacacccugagacugggcguggagguggacagcuucgacggccaccacuacaucagcagcaucgugagcggcggccccguggacacccugggccugcugcagcccgaggacgagcugcuggaggugaacggcaugcagcuguacggcaagagcagaagagaggccgugagcuuccugaaggaggugcccccccccuucacccuggugugcugcagaagacuguucgacgacgaggccagcguggacgagcccagaagaaccgagaccagccugcccgagaccgagguggaccacaacauggacgugaacaccgaggaggacgacgacggcgagcuggcccuguggagccccgaggugaagaucguggagcuggugaaggacugcaagggccugggcuucagcauccuggacuaccaggacccccuggaccccaccagaagcgugaucgugaucagaagccugguggccgacggcguggccgagagaagcggcggccugcugcccggcgacagacuggugagcgugaacgaguacugccuggacaacaccagccuggccgaggccguggagauccugaaggccgugccccccggccuggugcaccugggcaucugcaagccccugguggaggacaacgaggaggagagcugcuacauccugcacagcagcagcaacgaggacaagaccgaguucagcggcaccauccacgacaucaacagcagccugauccuggaggcccccaagggcuucagagacgagcccuacuucaaggaggagcugguggacgagcccuuccuggaccugggcaagagcuuccacagccagcagaaggagaucgagcagagcaaggaggccugggagaugcacgaguuccugacccccagacugcaggagauggacgaggagagagagauccugguggacgaggaguacgagcuguaccaggaccccagccccagcauggagcuguacccccugagccacauccaggaggccacccccgugcccagcgugaacgagcugcacuucggcacccaguggcugcacgacaacgagcccagcgagagccaggaggccagaaccggcagaaccguguacagccaggaggcccagcccuacggcuacugccccgagaacgugaugaaggagaacuucgugauggagagccugcccagcgugcccagcaccgagggcaacagccagcagggcagauucgacgaccuggagaaccugaacagccuggccaagaccagccuggaccugggcaugauccccaacgacgugcagggccccagccugcugaucgaccugcccgugguggcccagagaagagagcaggaggaccugccccuguaccagcaccaggccaccagagugaucagcaaggccagcgccuacaccggcaugcugagcagcagauacgccaccgacaccugcgagcugcccgagagagaggagggcgagggcgaggagacccccaacuucagccacuggggcccccccagaaucguggagaucuucagagagcccaacgugagccugggcaucagcaucgugggcggccagaccgugaucaagagacugaagaacggcgaggagcugaagggcaucuucaucaagcaggugcuggaggacagccccgccggcaagaccaacgcccugaagaccggcgacaagauccuggaggugagcggcguggaccugcagaacgccagccacagcgaggccguggaggccaucaagaacgccggcaaccccgugguguucaucgugcagagccugagcagcacccccagagugauccccaacgugcacaacaaggccaacaagaucaccggcaaccagaaccaggacacccaggagaagaaggagaagagacagggcaccgcccccccccccaugaagcugcccccccccuacaaggcccugaccgacgacagcgacgagaacgaggaggaggacgccuucaccgaccagaagaucagacagagauacgccgaccugcccggcgagcugcacaucaucgagcuggagaaggacaagaacggccugggccugagccuggccggcaacaaggacagaagcagaaugagcaucuucguggugggcaucaaccccgagggccccgccgccgccgacggcagaaugagaaucggcgacgagcugcuggagaucaacaaccagauccuguacggcagaagccaccagaacgccagcgccaucaucaagaccgcccccagcaaggugaagcugguguucaucagaaacgaggacgccgugaaccagauggccgugacccccuuccccgugcccagcagcagccccagcagcaucgaggaccagagcggcaccgagcccaucagcagcgaggaggacggcagcguggaggugggcaucaagcagcugcccgagagcgagagcuucaagcuggccgugagccagaugaagcagcagaaguaccccaccaaggugagcuucagcagccaggagaucccccuggcccccgccagcagcuaccacagcaccgacgccgacuucaccggcuacggcggcuuccaggccccccugagcguggaccccgccaccugccccaucgugcccggccaggagaugaucaucgagaucagcaagggcagaagcggccugggccugagcaucgugggcggcaaggacaccccccuguucuggagacugggcagccccagagccuggagccagcaccuggugagagccuucaugcugcaccaccccgugaccgagguggagggccagaacgccaucgugauccacgagguguacgaggagggcgccgccgccagagacggcagacugugggccggcgaccagauccuggaggugaacggcguggaccugagaaacagcagccacgaggaggccaucaccgcccugagacagaccccccagaaggugagacuggugguguacagagacgaggcccacuacagagacgaggagaaccuggagaucuuccccguggaccugcagaagaaggccggcagaggccugggccugagcaucgugggcaagagaaacggcagcggcguguucaucagcgacaucgugaagggcggcgccgccgaccuggacggcagacugauccagggcgaccagauccugagcgugaacggcgaggacaugagaaacgccagccaggagaccguggccaccauccugaagugcgcccagggccuggugcagcuggagaucggcagacugagagccggcagcuggaccagcgccagaaccaccagccagaacagccagggcagccagcagagcgcccacagcagcugccaccccagcuucgcccccgugaucaccggccugcagaaccuggugggcaccaagagagugagcgaccccagccagaagaacagcggcaccgacauggagcccagaaccguggagaucaacagagagcugagcgacgcccugggcaucagcaucgccggcggcagaggcagcccccugggcgacauccccguguucaucgccaugauccaggccagcggcguggccgccagaacccagaagcugaaggugggcgacagaaucgugagcaucaacggccagccccuggacggccugagccacgccgacguggugaaccugcugaagaacgccuacggcagaaucauccugcaggugguggccgacaccaacaucagcgccaucgccgcccagcuggagaacaugagcaccggcuaccaccugggcagccccaccgccgagcaccaccccgaggacaccgagacccccccccccaagaucaucacccuggagaagggcagcgagggccugggcuucagcaucgugggcggcuacggcagcccccacggcgaccugcccaucuacgugaagaccguguucgccaagggcgccgccgccgacgacggcagacugaagagaggcgaccagauccuggccgugaacggcgagacccuggagggcgugacccacgagcaggccguggccauccugaagcaccagagaggcaccgugacccugaccgugcugagcuaa

SEQ ID NO: 18552 - RNA, 1500 nt, Artificial Sequence
  INA__Homo_sapiens__NP_116116
augagcuucggcagcgagcacuaccugugcagcagcagcagcuacagaaagguguucggcgacggcagcagacugagcgccagacugagcggcgccggcggcgccggcggcuucagaagccagagccugagcagaagcaacguggccagcagcgccgccugcagcagcgccagcagccugggccugggccuggccuacagaagaccccccgccagcgacggccuggaccugagccaggccgccgccagaaccaacgaguacaagaucaucagaaccaacgagaaggagcagcugcagggccugaacgacagauucgccguguucaucgagaaggugcaccagcuggagacccagaacagagcccuggaggccgagcuggccgcccugagacagagacacgccgagcccagcagagugggcgagcuguuccagagagagcugagagaccugagagcccagcuggaggaggccagcagcgccagaagccaggcccugcuggagagagacggccuggccgaggaggugcagagacugagagccagaugcgaggaggagagcagaggcagagagggcgccgagagagcccugaaggcccagcagagagacguggacggcgccacccuggccagacuggaccuggagaagaagguggagagccugcuggacgagcuggccuucgugagacaggugcacgacgaggagguggccgagcugcuggccacccugcaggccagcagccaggccgccgccgagguggacgugaccguggccaagcccgaccugaccagcgcccugagagagaucagagcccaguacgagagccuggccgccaagaaccugcagagcgccgaggagugguacaagagcaaguucgccaaccugaacgagcaggccgccagaagcaccgaggccaucagagccagcagagaggagauccacgaguacagaagacagcugcaggccagaaccaucgagaucgagggccugagaggcgccaacgagagccuggagagacagauccuggagcuggaggagagacacagcgccgagguggccggcuaccaggacagcaucggccagcuggagaacgaccugagaaacaccaagagcgagauggccagacaccugagagaguaccaggaccugcugaacgugaagauggcccuggacaucgagaucgccgccuacagaaagcugcuggagggcgaggagaccagauucagcaccagcggccugagcaucagcggccugaacccccugcccaaccccagcuaccugcugccccccagaauccugagcgccaccaccagcaaggugagcagcaccggccugagccugaagaaggaggaggaggaggaggaggccagcaagguggccagcaagaagaccagccagaucggcgagagcuucgaggagauccuggaggagaccgugaucagcaccaagaagaccgagaagagcaacaucgaggagaccaccaucagcagccagaagaucuaa

SEQ ID NO: 18553 - RNA, 2757 nt, Artificial Sequence
  INCENP__Homo_sapiens__NP_001035784
augggcaccaccgcccccggccccauccaccugcuggagcugugcgaccagaagcugauggaguuccugugcaacauggacaacaaggaccugguguggcuggaggagauccaggaggaggccgagagaauguucaccagagaguucagcaaggagcccgagcugaugcccaagacccccagccagaagaacagaagaaagaagagaagaaucagcuacgugcaggacgagaacagagaccccaucagaagaagacugagcagaagaaagagcagaagcagccagcugagcagcagaagacugagaagcaaggacagcguggagaagcuggccaccguggugggcgagaacggcagcgugcugagaagagugaccagagccgccgccgccgccgccgccgccaccauggcccuggccgcccccagcagccccacccccgagagccccaccaugcugaccaagaagcccgaggacaaccacacccagugccagcuggugcccgugguggagaucggcaucagcgagagacagaacgccgagcagcacgugacccagcugaugagcaccgagccccugcccagaacccugagccccacccccgccagcgccaccgcccccaccagccagggcauccccaccagcgacgaggagagcacccccaagaagagcaaggccagaauccuggagagcaucaccgugagcagccugauggccaccccccaggaccccaagggccagggcgugggcaccggcagaagcgccagcaagcugagaaucgcccaggugagccccggccccagagacagccccgccuuccccgacagccccuggagagagagagugcuggcccccauccugcccgacaacuucagcacccccaccggcagcagaaccgacagccagagcgugagacacagccccaucgcccccagcagccccagcccccaggugcuggcccagaaguacagccugguggccaagcaggagagcguggugagaagagccagcagaagacuggccaagaagaccgccgaggagcccgccgccagcggcagaaucaucugccacagcuaccuggagagacugcugaacguggaggugccccagaaggugggcagcgagcagaaggagccccccgaggaggccgagcccguggccgccgccgagcccgaggugcccgagaacaacggcaacaacagcuggccccacaacgacaccgagaucgccaacagcacccccaaccccaagcccgccgccagcagccccgagacccccagcgccggccagcaggaggccaagaccgaccaggccgacggccccagagagcccccccagagcgccagaagaaagagaagcuacaagcaggccgugagcgagcuggacgaggagcagcaccuggaggacgaggagcugcagccccccagaagcaagacccccagcagccccugccccgccagcaagguggugagaccccugagaaccuuccugcacaccgugcagagaaaccagaugcugaugacccccaccagcgcccccagaagcgugaugaagagcuucaucaagagaaacaccccccugagaauggaccccaagugcagcuucguggagaaggagagacagagacuggagaaccugagaagaaaggaggaggccgagcagcugagaagacagaagguggaggaggacaagagaagaagacuggaggaggugaagcugaagagagaggagagacugagaaaggugcugcaggccagagagagaguggagcagaugaaggaggagaagaagaagcagaucgagcagaaguucgcccagaucgacgagaagaccgagaaggccaaggaggagagacuggccgaggagaaggccaagaagaaggccgccgccaagaagauggaggagguggaggccagaagaaagcaggaggaggaggccagaagacugagauggcugcagcaggaggaggaggagagaagacaccaggagcugcugcagaagaagaaggaggaggagcaggagagacugagaaaggccgccgaggccaagagacuggccgagcagagagagcaggagagaagagagcaggagagaagagagcaggagagaagagagcaggagagaagagagcaggagagaagagagcaggagagacagcuggccgagcaggagagaagaagagagcaggagagacugcaggccgagagagagcugcaggagagagagaaggcccugagacugcagaaggagcagcugcagagagagcuggaggagaagaagaagaaggaggagcagcagagacuggccgagagacagcugcaggaggagcaggagaagaaggccaaggaggccgccggcgccagcaaggcccugaacgugaccguggacgugcagagccccgccugcaccagcuaccagaugaccccccagggccacagagccccccccaagaucaaccccgacaacuacggcauggaccugaacagcgacgacagcaccgacgacgaggcccaccccagaaagcccauccccaccugggccagaggcaccccccugagccaggccaucauccaccaguacuaccacccccccaaccugcuggagcuguucggcaccauccugccccuggaccuggaggacaucuucaagaagagcaagcccagauaccacaagagaaccagcagcgccguguggaacagccccccccugcagggcgccagagugcccagcagccuggccuacagccugaagaagcacuaa

SEQ ID NO: 18554 - RNA, 3723 nt, Artificial Sequence
  INF2__Homo_sapiens__NP_001026884
augagcgugaaggagggcgcccagagaaagugggccgcccugaaggagaagcugggcccccaggacagcgaccccaccgaggccaaccuggagagcgccgaccccgagcugugcaucagacugcugcagaugcccagcguggugaacuacagcggccugagaaagagacuggagggcagcgacggcggcuggauggugcaguuccuggagcagagcggccuggaccugcugcuggaggcccuggccagacugagcggcagaggcguggccagaaucagcgacgcccugcugcagcugaccugcgugagcugcgugagagccgugaugaacagcagacagggcaucgaguacauccugagcaaccagggcuacgugagacagcugagccaggcccuggacaccagcaacgugauggugaagaagcagguguucgagcugcuggccgcccugugcaucuacagccccgagggccacgugcugacccuggacgcccuggaccacuacaagaccgugugcagccagcaguacagauucagcaucgugaugaacgagcugagcggcagcgacaacgugcccuacguggugacccugcugagcgugaucaacgccgugauccugggccccgaggaccugagagccagaacccagcugagaaacgaguucaucggccugcagcugcuggacgugcuggccagacugagagaccuggaggacgccgaccugcugauccagcuggaggccuucgaggaggccaaggccgaggacgaggaggagcugcugagagugagcggcggcguggacaugagcagccaccaggagguguucgccagccuguuccacaaggugagcugcagccccgugagcgcccagcugcugagcgugcugcagggccugcugcaccuggagcccacccugagaagcagccagcugcugugggaggcccuggagagccuggugaacagagccgugcugcuggccagcgacgcccaggagugcacccuggaggaggugguggagagacugcugagcgugaagggcagacccagacccagcccccuggugaaggcccacaagagcgugcaggccaaccuggaccagagccagagaggcagcagcccccagaacaccaccacccccaagcccagcguggagggccagcagcccgccgccgccgccgccugcgagcccguggaccacgcccagagcgagagcauccugaaggugagccagcccagagcccuggagcagcaggccagcacccccccccccccccccccccccccccugcugcccggcagcagcgccgagccccccccccccccccccccccccccccugcccagcgugggcgccaaggcccugcccaccgccccccccccccccccccugcccggccugggcgccauggccccccccgcccccccccugccccccccccugcccggcagcugcgaguuccugcccccccccccccccccccugcccggccugggcugccccccccccccccccccccugcugcccggcaugggcuggggcccccccccccccccccccccccugcugcccugcaccugcagcccccccguggccggcggcauggaggaggugaucguggcccagguggaccacggccugggcagcgccugggugcccagccacagaagagugaacccccccacccugagaaugaagaagcugaacuggcagaagcugcccagcaacguggccagagagcacaacagcaugugggccagccugagcagccccgacgccgaggccguggagcccgacuucagcagcaucgagagacuguucagcuuccccgccgccaagcccaaggagcccaccaugguggcccccagagccagaaaggagcccaaggagaucaccuuccuggacgccaagaagagccugaaccugaacaucuuccugaagcaguucaagugcagcaacgaggagguggccgccaugaucagagccggcgacaccaccaaguucgacguggaggugcugaagcagcugcugaagcugcugcccgagaagcacgagaucgagaaccugagagccuucaccgaggagagagccaagcuggccagcgccgaccacuucuaccugcugcugcuggccauccccugcuaccagcugagaaucgagugcaugcugcugugcgagggcgccgccgccgugcuggacauggugagacccaaggcccagcuggugcuggccgccugcgagagccugcugaccagcagacagcugcccaucuucugccagcugauccugagaaucggcaacuuccugaacuacggcagccacaccggcgacgccgacggcuucaagaucagcacccugcugaagcugaccgagaccaagagccagcagaacagagugacccugcugcaccacgugcuggaggaggccgagaagagccaccccgaccugcugcagcugcccagagaccuggagcagcccagccaggccgccggcaucaaccuggagaucaucagaagcgaggccagcagcaaccugaagaagcugcuggagaccgagagaaaggugagcgccagcguggccgaggugcaggagcaguacaccgagagacugcaggccagcaucagcgccuucagagcccuggacgagcuguucgaggccaucgagcagaagcagagagagcuggccgacuaccugugcgaggacgcccagcagcugagccuggaggacaccuucagcaccaugaaggccuucagagaccuguuccugagagcccugaaggagaacaaggacagaaaggagcaggccgccaaggccgagagaagaaagcagcagcuggccgaggaggaggccagaagacccagaggcgaggacggcaagcccgugagaaagggccccggcaagcaggaggaggugugcgugaucgacgcccugcuggccgacaucagaaagggcuuccagcugagaaagaccgccagaggcagaggcgacaccgacggcggcagcaaggccgccagcauggacccccccagagccaccgagcccguggccaccagcaaccccgccggcgaccccgugggcagcaccagaugccccgccagcgagcccggccuggacgccaccaccgccagcgagagcagaggcugggaccugguggacgccgugacccccggcccccagcccacccuggagcagcuggaggagggcggccccagaccccuggagagaagaagcagcugguacguggacgccagcgacgugcugaccaccgaggacccccagugcccccagccccuggagggcgccuggcccgugacccugggcgacgcccaggcccugaagccccugaaguucagcagcaaccagccccccgccgccggcagcagcagacaggacgccaaggaccccaccagccugcugggcgugcugcaggccgaggccgacagcaccagcgagggccuggaggacgccgugcacagcagaggcgccagaccccccgccgccggccccggcggcgacgaggacgaggacgaggaggacaccgcccccgagagcgcccuggacaccagccuggacaagagcuucagcgaggacgccgugaccgacagcagcggcagcggcacccugcccagagccagaggcagagccagcaagggcaccggcaagagaagaaagaagagacccagcagaagccaggagggccugagacccagacccaaggccaaguaa

SEQ ID NO: 18555 - RNA, 789 nt, Artificial Sequence
  ING1__Homo_sapiens__NP_001254657
augagcuucguggagugccccuaccacagccccgccgagagacugguggccgaggccgacgagggcggccccagcgccaucaccgagauccugaaggagcuggacgagugcuacgagagauucagcagagagaccgacggcgcccagaagagaagaaugcugcacugcgugcagagagcccugaucagaagccaggagcugggcgacgagaagauccagaucgugagccagaugguggagcugguggagaacagaaccagacagguggacagccacguggagcuguucgaggcccagcaggagcugggcgacaccgccggcaacagcggcaaggccggcgccgacagacccaagggcgaggccgccgcccaggccgacaagcccaacagcaagagaagcagaagacagagaaacaacgagaacagagagaacgccagcagcaaccacgaccacgacgacggcgccagcggcacccccaaggagaagaaggccaagaccagcaagaagaagaagagaagcaaggccaaggccgagagagaggccagccccgccgaccugcccaucgaccccaacgagcccaccuacugccugugcaaccaggugagcuacggcgagaugaucggcugcgacaacgacgagugccccaucgagugguuccacuucagcugcgugggccugaaccacaagcccaagggcaagugguacugccccaagugcagaggcgagaacgagaagaccauggacaaggcccuggagaagagcaagaaggagagagccuacaacagauaa

SEQ ID NO: 18556 - RNA, 723 nt, Artificial Sequence
  ING2__Homo_sapiens__NP_001278888
auggaccaggacggcgaccagcagcugggccccagcagaauccuggccccccagacccugaaggagaucgacgacguguacgagaaguacaagaaggaggacgaccugaaccagaagaagagacugcagcagcugcugcagagagcccugaucaacagccaggagcugggcgacgagaagauccagaucgugacccagaugcuggagcugguggagaacagagccagacagauggagcugcacagccagugcuuccaggaccccgccgagagcgagagagccagcgacaaggccaagauggacagcagccagcccgagagaagcagcagaagacccagaagacagagaaccagcgagagcagagaccugugccacauggccaacggcaucgaggacugcgacgaccagccccccaaggagaagaagagcaagagcgccaagaagaagaagagaagcaaggccaagcaggagagagaggccagccccguggaguucgccaucgaccccaacgagcccaccuacugccugugcaaccaggugagcuacggcgagaugaucggcugcgacaacgagcagugccccaucgagugguuccacuucagcugcgugagccugaccuacaagcccaagggcaagugguacugccccaagugcagaggcgacaacgagaagaccauggacaagagcaccgagaagaccaagaaggacagaagaagcagauaa

SEQ ID NO: 18557 - RNA, 1257 nt, Artificial Sequence
  ING3__Homo_sapiens__NP_061944
augcuguaccuggaggacuaccuggagaugaucgagcagcugcccauggaccugagagacagauucaccgagaugagagagauggaccugcaggugcagaacgccauggaccagcuggagcagagagugagcgaguucuucaugaacgccaagaagaacaagcccgaguggagagaggagcagauggccagcaucaagaaggacuacuacaaggcccuggaggacgccgacgagaaggugcagcuggccaaccagaucuacgaccugguggacagacaccugagaaagcuggaccaggagcuggccaaguucaagauggagcuggaggccgacaacgccggcaucaccgagauccuggagagaagaagccuggagcuggacacccccagccagcccgugaacaaccaccacgcccacagccacacccccguggagaagagaaaguacaaccccaccagccaccacaccaccaccgaccacauccccgagaagaaguucaagagcgaggcccugcugagcacccugaccagcgacgccagcaaggagaacacccugggcugcagaaacaacaacagcaccgccagcagcaacaacgccuacaacgugaacagcagccagccccugggcagcuacaacaucggcagccugagcagcggcaccggcgccggcgccaucaccauggccgccgcccaggccgugcaggccaccgcccagaugaaggagggcagaagaaccagcagccugaaggccagcuacgaggccuucaagaacaacgacuuccagcugggcaaggaguucagcauggccagagagaccgugggcuacagcagcagcagcgcccugaugaccacccugacccagaacgccagcagcagcgccgccgacagcagaagcggcagaaagagcaagaacaacaacaagagcagcagccagcagagcagcagcagcagcagcagcagcagccugagcagcugcagcagcagcagcaccguggugcaggagaucagccagcagaccaccguggugcccgagagcgacagcaacagccagguggacuggaccuacgaccccaacgagcccagauacugcaucugcaaccaggugagcuacggcgagauggugggcugcgacaaccaggacugccccaucgagugguuccacuacggcugcgugggccugaccgaggcccccaagggcaagugguacugcccccagugcaccgccgccaugaagagaagaggcagcagacacaaguaa

SEQ ID NO: 18558 - RNA, 750 nt, Artificial Sequence
  ING4__Homo_sapiens__NP_001121054
auggccgccggcauguaccuggagcacuaccuggacagcaucgagaaccugcccuucgagcugcagagaaacuuccagcugaugagagaccuggaccagagaaccgaggaccugaaggccgagaucgacaagcuggccaccgaguacaugagcagcgccagaagccugagcagcgaggagaagcuggcccugcugaagcagauccaggaggccuacggcaagugcaaggaguucggcgacgacaaggugcagcuggccaugcagaccuacgagaugguggacaagcacaucagaagacuggacaccgaccuggccagauucgaggccgaccugaaggagaagcagaucgagagcagcgacuacgacagcagcagcagcaagggcaagaagaagggcagaacccagaaggagaagaaggccgccagagccagaagcaagggcaagaacagcgacgaggaggcccccaagaccgcccagaagaagcugaagcuggugagaaccagccccgaguacggcaugcccagcgugaccuucggcagcgugcaccccagcgacgugcuggacaugcccguggaccccaacgagcccaccuacugccugugccaccaggugagcuacggcgagaugaucggcugcgacaaccccgacugcagcaucgagugguuccacuucgccugcgugggccugaccaccaagcccagaggcaagugguucugccccagaugcagccaggagagaaagaagaaguaa

SEQ ID NO: 18559 - RNA, 723 nt, Artificial Sequence
  ING5__Homo_sapiens__NP_115705
auggccaccgccauguaccuggagcacuaccuggacagcaucgagaaccugcccugcgagcugcagagaaacuuccagcugaugagagagcuggaccagagaaccgaggacaagaaggccgagaucgacauccuggccgccgaguacaucagcaccgugaagacccugagccccgaccagagaguggagagacugcagaagauccagaacgccuacagcaagugcaaggaguacagcgacgacaaggugcagcuggccaugcagaccuacgagaugguggacaagcacaucagaagacuggacgccgaccuggccagauucgaggccgaccugaaggacaagauggagggcagcgacuucgagagcagcggcggcagaggccugaagaagggcagaggccagaaggagaagagaggcagcagaggcagaggcagaagaaccagcgaggaggacacccccaagaagaagaagcacaagggcggcagcgaguucaccgacaccauccugagcgugcaccccagcgacgugcuggacaugcccguggaccccaacgagcccaccuacugccugugccaccaggugagcuacggcgagaugaucggcugcgacaaccccgacugccccaucgagugguuccacuucgccugcguggaccugaccaccaagcccaagggcaagugguucugccccagaugcgugcaggagaagagaaagaagaaguaa

SEQ ID NO: 18560 - RNA, 1101 nt, Artificial Sequence
  INHA__Homo_sapiens__NP_002182
auggugcugcaccugcugcuguuccugcugcugaccccccagggcggccacagcugccagggccuggagcuggccagagagcuggugcuggccaaggugagagcccuguuccuggacgcccugggcccccccgccgugaccagagagggcggcgaccccggcgugagaagacugcccagaagacacgcccugggcggcuucacccacagaggcagcgagcccgaggaggaggaggacgugagccaggccauccuguuccccgccaccgacgccagcugcgaggacaagagcgccgccagaggccuggcccaggaggccgaggagggccuguucagauacauguucagacccagccagcacaccagaagcagacaggugaccagcgcccagcugugguuccacaccggccuggacagacagggcaccgccgccagcaacagcagcgagccccugcugggccugcuggcccugagccccggcggccccguggccgugcccaugagccugggccacgcccccccccacugggccgugcugcaccuggccaccagcgcccugagccugcugacccaccccgugcuggugcugcugcugagaugcccccugugcaccugcagcgccagacccgaggccacccccuuccugguggcccacaccagaaccagaccccccagcggcggcgagagagccagaagaagcaccccccugaugagcuggcccuggagccccagcgcccugagacugcugcagagaccccccgaggagcccgccgcccacgccaacugccacagaguggcccugaacaucagcuuccaggagcugggcugggagagauggaucguguacccccccagcuucaucuuccacuacugccacggcggcugcggccugcacaucccccccaaccugagccugcccgugcccggcgccccccccacccccgcccagcccuacagccugcugcccggcgcccagcccugcugcgccgcccugcccggcaccaugagaccccugcacgugagaaccaccagcgacggcggcuacagcuucaaguacgagaccgugcccaaccugcugacccagcacugcgccugcaucuaa

SEQ ID NO: 18561 - RNA, 1281 nt, Artificial Sequence
  INHBA__Homo_sapiens__NP_002183
augccccugcuguggcugagaggcuuccugcuggccagcugcuggaucaucgugagaagcagccccacccccggcagcgagggccacagcgccgcccccgacugccccagcugcgcccuggccgcccugcccaaggacgugcccaacagccagcccgagaugguggaggccgugaagaagcacauccugaacaugcugcaccugaagaagagacccgacgugacccagcccgugcccaaggccgcccugcugaacgccaucagaaagcugcacgugggcaaggugggcgagaacggcuacguggagaucgaggacgacaucggcagaagagccgagaugaacgagcugauggagcagaccagcgagaucaucaccuucgccgagagcggcaccgccagaaagacccugcacuucgagaucagcaaggagggcagcgaccugagcgugguggagagagccgagguguggcuguuccugaaggugcccaaggccaacagaaccagaaccaaggugaccaucagacuguuccagcagcagaagcacccccagggcagccuggacaccggcgaggaggccgaggaggugggccugaagggcgagagaagcgagcugcugcugagcgagaaggugguggacgccagaaagagcaccuggcacguguuccccgugagcagcagcauccagagacugcuggaccagggcaagagcagccuggacgugagaaucgccugcgagcagugccaggagagcggcgccagccuggugcugcugggcaagaagaagaagaaggaggaggagggcgagggcaagaagaagggcggcggcgagggcggcgccggcgccgacgaggagaaggagcagagccacagacccuuccugaugcugcaggccagacagagcgaggaccacccccacagaagaagaagaagaggccuggagugcgacggcaaggugaacaucugcugcaagaagcaguucuucgugagcuucaaggacaucggcuggaacgacuggaucaucgcccccagcggcuaccacgccaacuacugcgagggcgagugccccagccacaucgccggcaccagcggcagcagccugagcuuccacagcaccgugaucaaccacuacagaaugagaggccacagccccuucgccaaccugaagagcugcugcgugcccaccaagcugagacccaugagcaugcuguacuacgacgacggccagaacaucaucaagaaggacauccagaacaugaucguggaggagugcggcugcagcuaa

SEQ ID NO: 18562 - RNA, 1224 nt, Artificial Sequence
  INHBB__Homo_sapiens__NP_002184
auggacggccugcccggcagagcccugggcgccgccugccugcugcugcuggccgccggcuggcugggccccgaggccuggggcagccccacccccccccccacccccgccgcccccccccccccccccccccccggcagccccggcggcagccaggacaccugcaccagcugcggcggcuucagaagacccgaggagcugggcagaguggacggcgacuuccuggaggccgugaagagacacauccugagcagacugcagaugagaggcagacccaacaucacccacgccgugcccaaggccgccauggugaccgcccugagaaagcugcacgccggcaaggugagagaggacggcagaguggagaucccccaccuggacggccacgccagccccggcgccgacggccaggagagagugagcgagaucaucagcuucgccgagaccgacggccuggccagcagcagagugagacuguacuucuucaucagcaacgagggcaaccagaaccuguucguggugcaggccagccuguggcuguaccugaagcugcugcccuacgugcuggagaagggcagcagaagaaaggugagagugaagguguacuuccaggagcagggccacggcgacagauggaacaugguggagaagagaguggaccugaagagaagcggcuggcacaccuucccccugaccgaggccauccaggcccuguucgagagaggcgagagaagacugaaccuggacgugcagugcgacagcugccaggagcuggccguggugcccguguucguggaccccggcgaggagagccacagacccuucgugguggugcaggccagacugggcgacagcagacacagaaucagaaagagaggccuggagugcgacggcagaaccaaccugugcugcagacagcaguucuucaucgacuucagacugaucggcuggaacgacuggaucaucgcccccaccggcuacuacggcaacuacugcgagggcagcugccccgccuaccuggccggcgugcccggcagcgccagcagcuuccacaccgccguggugaaccaguacagaaugagaggccugaaccccggcaccgugaacagcugcugcauccccaccaagcugagcaccaugagcaugcuguacuucgacgacgaguacaacaucgugaagagagacgugcccaacaugaucguggaggagugcggcugcgccuaa

SEQ ID NO: 18563 - RNA, 1059 nt, Artificial Sequence
  INHBC__Homo_sapiens__NP_005529
augaccagcagccugcugcuggccuuccugcugcuggcccccaccaccguggccacccccagagccggcggccagugccccgccugcggcggccccacccuggagcuggagagccagagagagcugcugcuggaccuggccaagagaagcauccuggacaagcugcaccugacccagagacccacccugaacagacccgugagcagagccgcccugagaaccgcccugcagcaccugcacggcgugccccagggcgcccugcuggaggacaacagagagcaggagugcgagaucaucagcuucgccgagaccggccugagcaccaucaaccagaccagacuggacuuccacuucagcagcgacagaaccgccggcgacagagaggugcagcaggccagccugauguucuucgugcagcugcccagcaacaccaccuggacccugaaggugagagugcuggugcugggcccccacaacaccaaccugacccuggccacccaguaccugcuggagguggacgccagcggcuggcaccagcugccccugggccccgaggcccaggccgccugcagccagggccaccugacccuggagcuggugcuggagggccagguggcccagagcagcgugauccugggcggcgccgcccacagacccuucguggccgccagagugagagugggcggcaagcaccagauccacagaagaggcaucgacugccagggcggcagcagaaugugcugcagacaggaguucuucguggacuucagagagaucggcuggcacgacuggaucauccagcccgagggcuacgccaugaacuucugcaucggccagugcccccugcacaucgccggcaugcccggcaucgccgccagcuuccacaccgccgugcugaaccugcugaaggccaacaccgccgccggcaccaccggcggcggcagcugcugcgugcccaccgccagaagaccccugagccugcuguacuacgacagagacagcaacaucgugaagaccgacauccccgacauggugguggaggccugcggcugcagcuaa

SEQ ID NO: 18564 - RNA, 1053 nt, Artificial Sequence
  INHBE__Homo_sapiens__NP_113667
augagacugcccgacgugcagcuguggcuggugcugcugugggcccuggugagagcccagggcaccggcagcgugugccccagcugcggcggcagcaagcuggccccccaggccgagagagcccuggugcuggagcuggccaagcagcagauccuggacggccugcaccugaccagcagacccagaaucacccacccccccccccaggccgcccugaccagagcccugagaagacugcagcccggcagcguggcccccggcaacggcgaggaggugaucagcuucgccaccgugaccgacagcaccagcgccuacagcagccugcugaccuuccaccugagcacccccagaagccaccaccuguaccacgccagacuguggcugcacgugcugcccacccugcccggcacccugugccugagaaucuucagauggggccccagaagaagaagacagggcagcagaacccugcuggccgagcaccacaucaccaaccugggcuggcacacccugacccugcccagcagcggccugagaggcgagaagagcggcgugcugaagcugcagcuggacugcagaccccuggagggcaacagcaccgugaccggccagcccagaagacugcuggacaccgccggccaccagcagcccuuccuggagcugaagaucagagccaacgagcccggcgccggcagagccagaagaagaacccccaccugcgagcccgccaccccccugugcugcagaagagaccacuacguggacuuccaggagcugggcuggagagacuggauccugcagcccgagggcuaccagcugaacuacugcagcggccagugccccccccaccuggccggcagccccggcaucgccgccagcuuccacagcgccguguucagccugcugaaggccaacaaccccuggcccgccagcaccagcugcugcgugcccaccgccagaagaccccugagccugcuguaccuggaccacaacggcaacguggugaagaccgacgugcccgacauggugguggaggccugcggcugcagcuaa

SEQ ID NO: 18565 - RNA, 1071 nt, Artificial Sequence
  INO80B__Homo_sapiens__NP_112578
augagcaagcuguggagaagaggcagcaccagcggcgccauggaggcccccgagcccggcgaggcccuggagcugagccuggccggcgcccacggccacggcgugcacaagaagaagcacaagaagcacaagaagaagcacaagaagaagcaccaccaggaggaggacgccggccccacccagcccagccccgccaagccccagcugaagcugaagaucaagcugggcggccaggugcugggcaccaagagcgugcccaccuucaccgugauccccgagggccccagaagccccagcccccugauggugguggacaacgaggaggagcccauggagggcgugccccuggagcaguacagagccuggcuggacgaggacagcaaccugagccccagcccccugagagaccugagcggcggccugggcggccaggaggaggaggaggagcagagauggcuggacgcccuggagaagggcgagcuggacgacaacggcgaccugaagaaggagaucaacgagagacugcugaccgccagacagagagcccugcugcagaaggccagaagccagcccagccccaugcugccccugcccguggccgagggcugccccccccccgcccugaccgaggagaugcugcugaagagagaggagagagccagaaagagaagacugcaggccgccagaagagccgaggagcacaagaaccagaccaucgagagacugaccaagaccgccgccaccagcggcagaggcggcagaggcggcgccagaggcgagagaagaggcggcagagccgccgcccccgcccccauggugagauacugcagcggcgcccagggcagcacccugagcuucccccccggcgugcccgcccccaccgccgugagccagagacccagccccagcggccccccccccagaugcagcgugcccggcugcccccaccccagaagauacgccugcagcagaaccggccaggcccugugcagccugcagugcuacagaaucaaccugcagaugagacugggcggccccgagggccccggcagcccccugcuggccaccuaa

SEQ ID NO: 18566 - RNA, 3084 nt, Artificial Sequence
  INO80D__Homo_sapiens__NP_060229
auguacgagggcaagcacauccacuucagcgagguggacaacaagccccugugcagcuacagccccaagcugugcaagcagagaagacugaacggcuacgccuucugcaucagacacgugcuggaggacaagaccgcccccuucaagcagugcgaguacguggccaaguacaacagccagagaugcaccaaccccauccccaagagcgaggacagaagauacugcaacagccaccugcaggugcugggcuucauccccaagaaggagagaaagaagaagaacgaccccaucgacgaggugaaggugagacaccagauggacaccauggccuucagccugaccgugcccacccuggcccugaagaugcccaacggccuggacggcaugagccugagcccccccggcgccagagugccccugcacuaccuggagaccgagcuggaggaccccuucgccuucaacgaggaggacgacgaccugaagaagggcgccaccgugagaaagaagcugcagagcaagcuggcccagaacagacagagacagagagagaccgagauccugaaggugagacaggagcacuucagccccccccccgcccccagccagcagcagcccccccagcagcacagccaccugagcccccugagcaccagccugaagccccccgcccccccccagggcagcgugugcaagagcccccagccccagaacaccagccugcccaugcagggcguggcccccaccacccacaccaucgcccaggccagacagcugagccacaagagaccccugccccugcugcccagcagcagagcccccaccguggacccccccagaaccgacagaauccugaugaaggccaccgccuucagcccccacuucagcugcaucagcagacugcagagacuggugaagcugugcacccagaagcaccagcuggacaccgaccuguucccccaccugggccuggacuggagcgaggagagcggcgaggagcccgaggacagcgagcaggccagccccuaccagguggccuggagcaucagagagacccugagauaccagagacacgccagcgacgacgacgacgccgagagcagaagcagcagagugacccagcugugcaccuacuuccagcagaaguacaagcaccugugcagacuggagagagccgagagcagacagaagaagugcagacacaccuucagaaaggcccugcugcaggccgccagcaaggagcccgagugcaccggccagcugauccaggagcugagaagagccgccugcagcagaaccagcaucagcagaaccaagcugagagagguggagcccgccgccugcagcggcaccgugaagggcgagcagugcgccaacaaggcccugcccuucaccagacacugcuuccagcacauccugcugaaccacagccagcagcuguucagcagcugcaccgccaaguucgccgacggccagcagugcagcgugcccguguucgacaucacccaccagaccccccugugcgaggagcacgccaagaagauggacaacuuccugagaggcgacaacagcagaaaggugcagcaccagcagcagagaaagcccagaaagaagaccaagccccccgcccugaccaagaagcacaagaagaagagaagaagaggccccagaagaccccagaagcccaucccccccgccgugccccagggcaaccugagcaugcccgccagcgugagccugcccguggaggccagccacaucagaagccccagcacccccgagcugagcgccgacgagcugcccgacgacaucgccaacgagaucaccgacaucccccacgaccuggagcugaaccaggaggacuucagcgacgugcugcccagacugcccgacgaccugcaggacuucgacuucuucgagggcaagaacggcgaccugcugcccaccaccgaggaggccgaggagcuggagagagcccugcaggccgugaccagccuggagugccugagcaccaucggcgugcuggcccagagcgacggcgugcccgugcaggagcugagcgacagaggcaucggcguguucagcaccggcaccggcgccagcggcauccagagccugagcagagaggugaacaccgaccugggcgagcugcugaacggcagaaucgugcacgacaacuucagcagccuggagcuggacgagaaccugcugagaagcgccacccugagcaacccccccaccccccuggccggccagauccagggccaguucagcgcccccgccaacgugggccugaccagcgccacccugaucagccagagcgcccugggcgagagagccuuccccggccaguuccacggccugcacgacggcagccacgccagccagagaccccaccccgcccagcugcugagcaaggccgacgaccugaucaccagcagacagcaguacagcagcgaccacagccacagcagcccccacggcagccacuacgacagcgagcacgugcccagccccuacagcgaccacaucaccagcccccacaccaccagcuacagcggcgacaacauggccgccaccuucagcgccgagaugcccaucauggcccagcaccugcugcccacccagcuggaggugccccugggcggcguggugaaccccagaacccacuggggcaaccugcccgugaaccugggcgaccccagccccuucagcaaccugcugggcgccgacggccaccugcugagcaccagccugagcaccccccccaccaccagcaacagcgagaccacccagcccgccuucgccaccgugacccccagcagcagcagcgugcugcccggccugccccagaccagcuucagcggcaugggccccagcgccgagcugauggccagcaccagccccaagcagcagcugccccaguucagcgccgccuucggccaccagcugagcagccacagcggcauccccaaggaccugcagcccagccacagcagcaucgccccccccaccggcuucaccgugaccggcgccaccgccaccagcaccaacaacgccagcagccccuuccccagccccaacuaa

SEQ ID NO: 18567 - RNA, 4671 nt, Artificial Sequence
  INO80__Homo_sapiens__NP_060023
auggccagcgagcugggcgccagagacgacggcggcugcaccgagcuggccaagccccuguaccugcaguaccuggagagagcccugagacuggaccacuuccugagacagaccagcgccaucuucaacagaaacaucagcagcgacgacagcgaggacggccuggacgacagcaacccccugcugccccagagcggcgacccccugauccaggugaaggaggagccccccaacagccugcugggcgagaccagcggcgccggcagcagcggcaugcugaacaccuacagccugaacggcgugcugcagagcgagagcaagugcgacaagggcaaccuguacaacuucagcaagcugaagaagagcagaaaguggcugaagagcauccugcugagcgacgagagcagcgaggccgacagccagagcgaggacgacgacgaggaggagcugaaccugagcagagaggagcugcacaacaugcugagacugcacaaguacaagaagcugcaccagaacaaguacagcaaggacaaggagcugcagcaguaccaguacuacagcgccggccugcugagcaccuacgaccccuucuacgagcagcagagacaccugcugggccccaagaagaagaaguucaaggaggagaagaagcugaaggccaagcugaagaaggugaagaagaagagaagaagagacgaggagcugagcagcgaggagagccccagaagacaccaccaccagaccaagguguucgccaaguucagccacgacgcccccccccccggcaccaagaagaagcaccugagcaucgagcagcugaacgccagaagaagaaagguguggcugagcaucgugaagaaggagcugcccaaggccaacaagcagaaggccagcgccagaaaccuguuccugaccaacagcagaaagcuggcccaccagugcaugaaggaggugagaagagccgcccugcaggcccagaagaacugcaaggagacccugcccagagccagaagacugaccaaggagaugcugcuguacuggaagaaguacgagaagguggagaaggagcacagaaagagagccgagaaggaggcccuggagcagagaaagcuggacgaggagaugagagaggccaagagacagcagagaaagcugaacuuccugaucacccagaccgagcuguacgcccacuucaugagcagaaagagagacaugggccacgacggcauccaggaggagauccugagaaagcuggaggacagcagcacccagagacagaucgacaucggcggcggcgugguggugaacaucacccaggaggacuacgacagcaaccacuucaaggcccaggcccugaagaacgccgagaacgccuaccacauccaccaggccagaaccagaagcuucgacgaggacgccaaggagagcagagccgccgcccugagagccgccaacaagagcggcaccggcuucggcgagagcuacagccuggccaaccccagcaucagagccggcgaggacaucccccagcccaccaucuucaacggcaagcugaagggcuaccagcugaagggcaugaacuggcuggccaaccuguacgagcagggcaucaacggcauccuggccgacgagaugggccugggcaagaccgugcagagcaucgcccugcuggcccaccuggccgagagagagaacaucuggggccccuuccugaucaucagccccgccagcacccugaacaacuggcaccaggaguucaccagauucgugcccaaguucaaggugcugcccuacuggggcaacccccacgacagaaaggugaucagaagauucuggagccagaagacccuguacacccaggacgcccccuuccacguggugaucaccagcuaccagcugguggugcaggacgugaaguacuuccagagagugaaguggcaguacauggugcuggacgaggcccaggcccugaagagcagcagcagcgugagauggaagauccugcugcaguuccagugcagaaacagacugcugcugaccggcacccccauccagaacaccauggccgagcugugggcccugcugcacuucaucaugcccacccuguucgacagccacgaggaguucaacgagugguucagcaaggacaucgagagccacgccgagaacaagagcgccaucgacgagaaccagcugagcagacugcacaugauccugaagcccuucaugcugagaagaaucaagaaggacguggagaacgagcugagcgacaagaucgagauccugauguacugccagcugaccagcagacagaagcugcuguaccaggcccugaagaacaagaucagcaucgaggaccugcugcagagcagcaugggcagcacccagcaggcccagaacaccaccagcagccugaugaaccuggugaugcaguucagaaaggugugcaaccaccccgagcuguucgagagacaggagaccuggagccccuuccacaucagccugaagcccuaccacaucagcaaguucaucuacagacacggccagaucagaguguucaaccacagcagagacagauggcugagagugcugagccccuucgcccccgacuacauccagagaagccuguuccacagaaagggcaucaacgaggagagcugcuucagcuuccugagauucaucgacaucagccccgccgagauggccaaccugaugcugcagggccugcuggccagauggcuggcccuguuccugagccugaaggccagcuacagacugcaccagcugagaagcuggggcgcccccgagggcgagagccaccagagauaccugagaaacaaggacuuccugcugggcgugaacuucccccugagcuuccccaaccugugcagcugcccccugcugaagagccugguguucagcagccacugcaaggccgugagcggcuacagcgaccagguggugcaccagagaagaagcgccaccagcagccugagaagaugccugcugaccgagcugcccagcuuccugugcguggccagccccagagugaccgccgugccccuggacagcuacugcaacgacagaagcgccgaguacgagagaagagugcugaaggagggcggcagccuggccgccaagcagugccugcugaacggcgcccccgagcuggccgccgacuggcugaacagaagaagccaguucuuccccgagcccgccggcggccuguggagcaucagaccccagaacggcuggagcuucaucagaauccccggcaaggagagccugaucaccgacagcggcaagcuguacgcccuggacgugcugcugaccagacugaagagccagggccacagagugcugaucuacagccagaugaccagaaugaucgaccugcuggaggaguacaugguguacagaaagcacaccuacaugagacuggacggcagcagcaagaucagcgagagaagagacaugguggccgacuuccagaacagaaacgacaucuucguguuccugcugagcaccagagccggcggccugggcaucaaccugaccgccgccgacaccgugaucuucuacgacagcgacuggaaccccaccguggaccagcaggccauggacagagcccacagacugggccagaccaagcaggugaccguguacagacugaucugcaagggcaccaucgaggagagaauccugcagagagccaaggagaagagcgagauccagagaauggugaucagcggcggcaacuucaagcccgacacccugaagcccaaggagguggugagccugcugcuggacgacgaggagcuggagaagaagcugagacugagacaggaggagaagagacagcaggaggagaccaacagagugaaggagagaaagagaaagagagagaaguacgccgagaagaagaagaaggaggacgagcuggacggcaagagaagaaaggagggcgugaaccuggugauccccuucgugcccagcgccgacaacagcaaccugagcgccgacggcgacgacagcuucaucagcguggacagcgccaugcccagccccuucagcgagaucagcaucagcagcgagcugcacaccggcagcaucccccuggacgagagcagcagcgacaugcuggugaucguggacgaccccgccagcagcgccccccagagcagagccaccaacagccccgccagcaucaccggcagcgugagcgacaccgugaacggcaucagcauccaggagaugcccgccgccggcagaggccacagcgccagaagcagaggcagacccaagggcagcggcagcaccgccaagggcgccggcaagggcagaagcagaaagagcaccgccggcagcgccgccgccauggccggcgccaaggccggcgccgccgccgccagcgccgccgccuacgccgccuacggcuacaacgugagcaagggcaucagcgccagcagcccccugcagaccagccuggugagacccgccggccuggccgacuucggccccagcagcgccagcagcccccugagcagcccccugagcaagggcaacaacgugcccggcaaccccaagaaccugcacaugaccagcagccuggcccccgacagccuggugagaaagcagggcaagggcaccaaccccagcggcggcagauaa

SEQ ID NO: 18568 - RNA, 1200 nt, Artificial Sequence
  INPP1__Homo_sapiens__NP_001122400
augagcgacauccugagagagcugcugugcgugagcgagaaggccgccaacaucgccagagccugcagacagcaggaggcccuguuccagcugcugaucgaggagaagaaggagggcgagaagaacaagaaguucgccguggacuucaagacccuggccgacgugcuggugcaggaggugaucaagcagaacauggagaacaaguuccccggccuggagaagaacaucuucggcgaggagagcaacgaguucaccaacgacuggggcgagaagaucacccugagacugugcagcaccgaggaggagaccgccgagcugcugagcaaggugcugaacggcaacaagguggccagcgaggcccuggccagaguggugcaccaggacguggccuucaccgaccccacccuggacagcaccgagaucaacgugccccaggacauccugggcaucuggguggaccccaucgacagcaccuaccaguacaucaagggcagcgccgacaucaagagcaaccagggcaucuuccccugcggccugcagugcgugaccauccugaucggcguguacgacauccagaccggcgugccccugaugggcgugaucaaccagcccuucgugagcagagaccccaacacccugagauggaagggccagugcuacuggggccugagcuacaugggcaccaacaugcacagccugcagcugaccaucagcagaagaaacggcagcgagacccacaccggcaacaccggcagcgaggccgccuucagccccagcuucagcgccgugaucagcaccagcgagaaggagaccaucaaggccgcccugagcagagugugcggcgacagaaucuucggcgccgccggcgccggcuacaagagccugugcguggugcagggccugguggacaucuacaucuucagcgaggacaccaccuucaagugggacagcugcgccgcccacgccauccugagagccaugggcggcggcaucguggaccugaaggagugccuggagagaaaccccgagaccggccuggaccugccccagcugguguaccacguggagaacgagggcgccgccggcguggacagaugggccaacaagggcggccugaucgccuacagaagcagaaagagacuggagaccuuccugagccugcuggugcagaaccuggcccccgccgagacccacaccuaa

SEQ ID NO: 18569 - RNA, 2934 nt, Artificial Sequence
  INPP4A__Homo_sapiens__NP_001127696
augaccgccagagagcacagccccagacacggcgccagagccagagccaugcagagagccagcaccaucgacguggccgccgacaugcugggccugagccuggccggcaacauccaggaccccgacgagcccauccuggaguucagccuggccugcagcgagcugcacacccccagccuggacagaaagcccaacagcuucguggccgugagcgugaccacccccccccaggccuucuggaccaagcacgcccagaccgagaucaucgagggcaccaacaaccccaucuuccugagcagcaucgccuucuuccaggacagccugaucaaccagaugacccaggugaagcugagcguguacgacgugaaggacagaagccagggcaccauguaccugcugggcagcggcaccuucaucgugaaggaccugcugcaggacagacaccacagacugcaccugacccugagaagcgccgagagcgacagagugggcaacaucaccgugaucggcuggcagauggaggagaagagcgaccagagaccccccgugaccagaagcguggacaccgugaacggcagaauggugcugcccguggacgagagccugaccgaggcccugggcaucagaagcaaguacgccagccugagaaaggacacccugcugaagagcguguucggcggcgccaucugcagaauguacagauuccccaccaccgacggcaaccaccugagaauccuggagcagauggccgagagcgugcugagccugcacgugcccagacaguucgugaagcugcugcuggaggaggacgccgccagagugugcgagcuggaggagcugggcgagcugagccccugcugggagagccugagaagacagaucgugacccaguaccagaccaucauccugaccuaccaggagaaccugaccgaccugcaccaguacagaggccccagcuucaaggccagcagccugaaggccgacaagaagcuggaguucgugcccaccaaccugcacauccagagaaugagagugcaggacgacggcggcagcgaccagaacuacgacaucgugaccaucggcgcccccgccgcccacugccagggcuucaagagcggcggccugagaaagaagcugcacaaguucgaggagaccaagaagcacuucgaggagugcugcaccagcagcggcugccagagcaucaucuacaucccccaggacguggugagagccaaggagaucaucgcccagaucaacacccugaagacccaggugagcuacuacgccgagagacugagcagagccgccaaggacagaagcgccaccggccuggagagaacccuggccauccuggccgacaagaccagacagcuggugaccgugugcgacugcaagcugcuggccaacagcauccacggccugaacgccgccagacccgacuacaucgccagcaaggccagccccaccagcaccgaggaggagcaggugaugcugagaaacgaccaggacacccugauggccagauggaccggcagaaacagcagaagcagccugcagguggacuggcacgaggaggagugggagaagguguggcugaacguggacaagagccuggagugcaucauccagagaguggacaagcugcugcagaaggagagacugcacggcgagggcugcgaggacguguuccccugcgccggcagcugcaccagcaagaagggcaaccccgacagccacgccuacuggaucagacccgaggaccccuucugcgacgugcccagcagccccugccccagcaccaugcccagcaccgccugccacccccaccugaccacccacugcagccccccccccgaggagagcagccccggcgaguggagcgaggcccuguacccccugcugaccacccugaccgacugcguggccaugaugagcgacaaggccaagaaggccaugguguuccugcugaugcaggacagcgcccccaccaucgccaccuaccugagccugcaguacagaagagacgugguguucugccagacccugaccgcccugaucugcggcuucaucaucaagcugagaaacugccugcacgacgacggcuuccugagacagcuguacaccaucggccugcuggcccaguucgagagccugcugagcaccuacggcgaggagcuggccaugcuggaggacaugagccugggcaucauggaccugagaaacgugaccuucaaggugacccaggccaccagcagcgccagcgccgacaugcugcccgugaucaccggcaacagagacggcuucaacgugagagugccccugcccggcccccuguucgacgcccugcccagagagauccagagcggcaugcugcugagagugcagcccgugcuguucaacgugggcaucaacgagcagcagacccuggccgagagauucggcgacaccagccugcaggaggugaucaacguggagagccuggugagacugaacagcuacuucgagcaguucaaggaggugcugcccgaggacugccugcccagaagcagaagccagaccugccugcccgagcugcugagauuccugggccagaacgugcacgccagaaagaacaagaacguggacauccuguggcaggccgccgagaucugcagaagacugaacggcgugagauucaccagcugcaagagcgccaaggacagaaccgccaugagcgugacccuggagcagugccugauccugcagcacgagcacggcauggccccccagguguucacccaggcccuggagugcaugagaagcgagggcugcagaagagagaacaccaugaagaacgugggcagcagaaaguacgccuucaacagccugcagcugaaggccuuccccaagcacuacagaccccccgagggcaccuacggcaagguggagaccuaa

SEQ ID NO: 18570 - RNA, 2775 nt, Artificial Sequence
  INPP4B__Homo_sapiens__NP_001095139
auggagaucaaggaggagggcgccagcgaggagggccagcacuuccugcccaccgcccaggccaacgaccccggcgacugccaguucaccagcauccagaagacccccaacgagccccagcuggaguucauccuggccugcaaggaccugguggcccccgugagagacagaaagcugaacacccuggugcagaucagcgugauccaccccguggagcagagccugaccagauacagcagcaccgagaucguggagggcaccagagacccccuguuccugaccggcgugaccuuccccagcgaguaccccaucuacgaggagaccaagaucaagcugaccguguacgacgugaaggacaagagccacgacaccgugagaaccagcgugcugcccgagcacaaggaccccccccccgaggugggcagaagcuuccugggcuacgccagcuucaaggugggcgagcugcugaagagcaaggagcagcugcuggugcugagccugagaaccagcgacggcggcaagguggugggcaccaucgaggugagcguggugaagaugggcgagaucgaggacggcgaggccgaccacaucaccaccgacgugcagggccagaagugcgcccuggugugcgagugcaccgcccccgagagcgugagcggcaaggacaaccugcccuuccugaacagcgugcugaagaaccccgugugcaagcuguacagauuccccaccagcgacaacaaguggaugagaaucagagagcagaugagcgagagcauccugagcuuccacauccccaaggagcugaucagccugcacaucaaggaggaccugugcagaaaccaggagaucaaggagcugggcgagcugagcccccacugggacaaccugagaaagaacgugcugacccacugcgaccagauggugaacauguaccaggacauccugaccgagcugagcaaggagaccggcagcagcuucaagagcagcagcagcaagggcgagaagacccuggaguucgugcccaucaaccugcaccugcagagaaugcaggugcacagcccccaccugaaggacgcccuguacgacgugaucaccgugggcgcccccgccgcccacuuccagggcuucaagaacggcggccugagaaagcugcugcacagauucgagaccgagagaagaaacaccggcuaccaguucaucuacuacagccccgagaacaccgccaaggccaaggaggugcugagcaacaucaaccagcugcagccccugaucgccacccacgccgaccugcugcugaacagcgccagccagcacagccccgacagccugaagaacagccugaagaugcugagcgagaagaccgagcuguucgugcacgccuucaaggaccagcuggugagaagcgcccugcuggcccuguacaccgccagacccggcggcauccugaagaagccccccagccccaagagcagcaccgaggagagcagcccccaggaccagccccccgugaugagaggccaggacagcaucccccaccacagcgacuacgacgaggaggagugggacagagugugggccaacgugggcaagagccugaacugcaucaucgccaugguggacaagcugaucgagagagacggcggcagcgagggcagcggcggcaacaacgacggcgagaaggagcccagccugaccgacgccauccccagccaccccagagaggacugguacgagcagcuguacccccugauccugacccugaaggacugcaugggcgagguggugaacagagccaagcagagccugaccuucgugcugcugcaggagcuggccuacagccugccccagugccugaugcugacccugagaagagacaucguguucagccaggcccuggccggccuggugugcggcuucaucaucaagcugcagaccagccuguacgaccccggcuuccugcagcagcugcacaccgugggccugaucgugcaguacgagggccugcugagcaccuacagcgacgagaucggcaugcuggaggacauggccgugggcaucagcgaccugaagaagguggccuucaagaucaucgaggccaagagcaacgacgugcugcccgugaucaccggcagaagagagcacuacgugguggaggugaagcugcccgccagaauguucgagagccugccccugcagaucaaggagggccagcugcugcacguguaccccgugcuguucaacgugggcaucaacgagcagcagacccuggccgagagauucggcgacgugagccugcaggagagcaucaaccaggagaacuucgagcugcugcaggaguacuacaagaucuucauggagaagaugccccccgacuacaucagccacuuccaggagcagaacgaccugaaggcccugcuggagaaccugcugcagaacauccagagcaagaagagaaagaacguggagaucauguggcuggccgccaccaucugcagaaagcugaacggcaucagauucaccugcugcaagagcgccaaggacagaaccagcaugagcgugacccuggagcagugcagcauccugagagacgagcaccagcugcacaaggacuucuucaucagagcccuggacugcaugagaagagagggcugcagaaucgagaacgugcugaagaacaucaagugcagaaaguacgccuucaacaugcugcagcugauggccuuccccaaguacuacagaccccccgagggcaccuacggcaaggccgacaccuaa

SEQ ID NO: 18571 - RNA, 1239 nt, Artificial Sequence
  INPP5A__Homo_sapiens__NP_005530
auggccggcaaggccgccgcccccggcaccgccgugcugcuggugaccgccaacgugggcagccuguucgacgaccccgagaaccugcagaagaacuggcugagagaguucuaccagguggugcacacccacaagccccacuucauggcccugcacugccaggaguucggcggcaagaacuacgaggccagcaugagccacguggacaaguucgugaaggagcugcugagcagcgacgccaugaaggaguacaacagagccagaguguaccuggacgagaacuacaagagccaggagcacuucaccgcccugggcagcuucuacuuccugcacgagagccugaagaacaucuaccaguucgacuucaaggccaagaaguacagaaagguggccggcaaggagaucuacagcgacacccuggagagcacccccaugcuggagaaggagaaguucccccaggacuacuuccccgagugcaaguggagcagaaagggcuucaucagaaccagauggugcaucgccgacugcgccuucgaccuggugaacauccaccuguuccacgacgccagcaaccugguggccugggagaccagccccagcguguacagcggcaucagacacaaggcccugggcuacgugcuggacagaaucaucgaccagagauucgagaaggugagcuacuucguguucggcgacuucaacuucagacuggacagcaagagcgugguggagacccugugcaccaaggccaccaugcagaccgugagagccgccgacaccaacgagguggugaagcugaucuucagagagagcgacaacgacagaaaggugaugcugcagcuggagaagaagcuguucgacuacuucaaccaggagguguucagagacaacaacggcaccgcccugcuggaguucgacaaggagcugagcguguucaaggacagacuguacgagcuggacaucagcuucccccccagcuaccccuacagcgaggacgccagacagggcgagcaguacaugaacaccagaugccccgccuggugcgacagaauccugaugagccccagcgccaaggagcuggugcugagaagcgagagcgaggagaagguggugaccuacgaccacaucggccccaacgugugcaugggcgaccacaagcccguguuccuggccuucagaaucaugcccggcgccggcaagccccacgcccacgugcacaagugcugcguggugcaguaa

SEQ ID NO: 18572 - RNA, 2250 nt, Artificial Sequence
  INPP5B__Homo_sapiens__NP_001284363
augagcgccgccgccggcagcagagagagaaacaccgccggcggcagcaacuucgacggccugagacccaacggcaagggcgugcccauggaccagagcagcagaggccaggacaagcccgagagccugcagcccagacagaacaagagcaagagcgagaucaccgacauggugagaagcagcaccaucaccgugagcgacaaggcccacauccugagcaugcagaaguucggccugagagacaccaucgugaagagccaccugcugcagaaggaggaggacuacaccuacauccagaacuucagauucuucgccggcaccuacaacgugaacggccagagccccaaggagugccugagacuguggcugagcaacggcauccaggcccccgacguguacugcgugggcuuccaggagcuggaccugagcaaggaggccuucuucuuccacgacacccccaaggaggaggagugguucaaggccgugagcgagggccugcaccccgacgccaaguacgccaaggugaagcugaucagacuggugggcaucaugcugcugcuguacgugaagcaggagcacgccgccuacaucagcgagguggaggccgagaccgugggcaccggcaucaugggcagaaugggcaacaagggcggcguggccaucagauuccaguuccacaacaccagcaucugcguggugaacagccaccuggccgcccacaucgaggaguacgagagaagaaaccaggacuacaaggacaucugcagcagaaugcaguucugccagcccgaccccagccugcccccccugaccaucagcaaccacgacgugauccuguggcugggcgaccugaacuacagaaucgaggagcuggacguggagaaggugaagaagcugaucgaggagaaggacuuccagaugcuguacgccuacgaccagcugaagauccagguggccgccaagaccguguucgagggcuucaccgagggcgagcugaccuuccagcccaccuacaaguacgacaccggcagcgacgacugggacaccagcgagaagugcagagcccccgccuggugcgacagaauccuguggaagggcaagaacaucacccagcugagcuaccagagccacauggcccugaagaccagcgaccacaagcccgugagcagcguguucgacaucggcgugagaguggugaacgacgagcuguacagaaagacccuggaggagaucgugagaagccuggacaagauggagaacgccaacauccccagcgugagccugagcaagagagaguucugcuuccagaacgugaaguacaugcagcugaagguggagagcuucaccauccacaacggccaggugcccugccacuucgaguucaucaacaagcccgacgaggagagcuacugcaagcaguggcugaacgccaaccccagcagaggcuuccugcugcccgacagcgacguggagaucgaccuggagcuguucgugaacaagaugaccgccaccaagcugaacagcggcgaggacaagaucgaggacauccuggugcugcaccuggacagaggcaaggacuacuuccugagcgugagcggcaacuaccugcccagcugcuucggcagccccauccacacccugugcuacaugagagagcccauccuggaccugccccuggagaccaucagcgagcugacccugaugcccguguggaccggcgacgacggcagccagcuggacagccccauggagauccccaaggagcuguggaugaugguggacuaccuguacagaaacgccgugcagcaggaggaccuguuccagcagcccggccugagaagcgaguucgagcacaucagagacugccuggacaccggcaugaucgacaaccugagcgccagcaaccacagcguggccgaggcccugcugcuguuccuggagagccugcccgagcccgugaucugcuacagcaccuaccacaacugccuggagugcagcggcaacuacaccgccagcaagcaggugaucagcacccugcccaucuuccacaagaacguguuccacuaccugauggccuuccugagagagcugcugaagaacagcgccaagaaccaccuggacgagaacauccuggccagcaucuucggcagccugcugcugagaaaccccgccggccaccagaagcuggacaugaccgagaagaagaaggcccaggaguucauccaccaguuccugugcaacccccuguaa

SEQ ID NO: 18573 - RNA, 3570 nt, Artificial Sequence
  INPP5D__Homo_sapiens__NP_001017915
auggugcccugcuggaaccacggcaacaucaccagaagcaaggccgaggagcugcugagcagaaccggcaaggacggcagcuuccuggugagagccagcgagagcaucagcagagccuacgcccugugcgugcuguacagaaacugcguguacaccuacagaauccugcccaacgaggacgacaaguucaccgugcaggccagcgagggcgugagcaugagauucuucaccaagcuggaccagcugaucgaguucuacaagaaggagaacaugggccuggugacccaccugcaguaccccgugccccuggaggaggaggacaccggcgacgaccccgaggaggacaccguggagagcguggugagcccccccgagcugccccccagaaacaucccccugaccgccagcagcugcgaggccaaggaggugcccuucagcaacgagaaccccagagccaccgagaccagcagacccagccugagcgagacccuguuccagagacugcagagcauggacaccagcggccugcccgaggagcaccugaaggccauccaggacuaccugagcacccagcuggcccaggacagcgaguucgugaagaccggcagcagcagccugccccaccugaagaagcugaccacccugcugugcaaggagcuguacggcgaggugaucagaacccugcccagccuggagagccugcagagacuguucgaccagcagcugagccccggccugagacccagaccccaggugcccggcgaggccaaccccaucaacauggugagcaagcugagccagcugaccagccugcugagcagcaucgaggacaaggugaaggcccugcugcacgagggccccgagagcccccacagacccagccugaucccccccgugaccuucgaggugaaggccgagagccugggcaucccccagaagaugcagcugaagguggacguggagagcggcaagcugaucaucaagaagagcaaggacggcagcgaggacaaguucuacagccacaagaagauccugcagcugaucaagagccagaaguuccugaacaagcuggugauccugguggagaccgagaaggagaagauccugagaaaggaguacguguucgccgacagcaagaagagagagggcuucugccagcugcugcagcagaugaagaacaagcacagcgagcagcccgagcccgacaugaucaccaucuucaucggcaccuggaacaugggcaacgcccccccccccaagaagaucaccagcugguuccugagcaagggccagggcaagaccagagacgacagcgccgacuacaucccccacgacaucuacgugaucggcacccaggaggacccccugagcgagaaggaguggcuggagauccugaagcacagccugcaggagaucaccagcgugaccuucaagaccguggccauccacacccuguggaacaucagaaucguggugcuggccaagcccgagcacgagaacagaaucagccacaucugcaccgacaacgugaagaccggcaucgccaacacccugggcaacaagggcgccgugggcgugagcuucauguucaacggcaccagccugggcuucgugaacagccaccugaccagcggcagcgagaagaagcugagaagaaaccagaacuacaugaacauccugagauuccuggcccugggcgacaagaagcugagccccuucaacaucacccacagauucacccaccuguucugguucggcgaccugaacuacagaguggaccugcccaccugggaggccgagaccaucauccagaagaucaagcagcagcaguacgccgaccugcugagccacgaccagcugcugaccgagagaagagagcagaagguguuccugcacuucgaggaggaggagaucaccuucgcccccaccuacagauucgagagacugaccagagacaaguacgccuacaccaagcagaaggccaccggcaugaaguacaaccugcccagcuggugcgacagagugcuguggaagagcuacccccuggugcacguggugugccagagcuacggcagcaccagcgacaucaugaccagcgaccacagccccguguucgccaccuucgaggccggcgugaccagccaguucgugagcaagaacggccccggcaccguggacagccagggccagaucgaguuccugagaugcuacgccacccugaagaccaagagccagaccaaguucuaccuggaguuccacagcagcugccuggagagcuucgugaagagccaggagggcgagaacgaggagggcagcgagggcgagcugguggugaaguucggcgagacccugcccaagcugaagcccaucaucagcgaccccgaguaccugcuggaccagcacauccugaucagcaucaagagcagcgacagcgacgagagcuacggcgagggcugcaucgcccugagacuggaggccaccgagacccagcugcccaucuacaccccccugacccaccacggcgagcugaccggccacuuccagggcgagaucaagcugcagaccagccagggcaagaccagagagaagcuguacgacuucgugaagaccgagagagacgagagcagcggccccaagacccugaagagccugaccagccacgaccccaugaagcagugggaggugaccagcagagccccccccugcagcggcagcagcaucaccgagaucaucaaccccaacuacaugggcgugggccccuucggcccccccaugccccugcacgugaagcagacccugagccccgaccagcagcccaccgccuggagcuacgaccagccccccaaggacagcccccugggccccugcagaggcgagagcccccccaccccccccggccagccccccaucagccccaagaaguuccugcccagcaccgccaacagaggccugccccccagaacccaggagagcagacccagcgaccugggcaagaacgccggcgacacccugccccaggaggaccugccccugaccaagcccgagauguucgagaacccccuguacggcagccugagcagcuuccccaagcccgcccccagaaaggaccaggagagccccaagaugcccagaaaggagcccccccccugccccgagcccggcauccugagccccagcaucgugcugaccaaggcccaggaggccgacagaggcgagggccccggcaagcaggugcccgcccccagacugagaagcuucaccugcagcagcagcgccgagggcagagccgccggcggcgacaagagccagggcaagcccaagacccccgugagcagccaggcccccgugcccgccaagagacccaucaagcccagcagaagcgagaucaaccagcagaccccccccacccccacccccagacccccccugcccgugaagagccccgccgugcugcaccugcagcacagcaagggcagagacuacagagacaacaccgagcugccccaccacggcaagcacagacccgaggagggcccccccggcccccugggcagaaccgccaugcaguaa

SEQ ID NO: 18574 - RNA, 1935 nt, Artificial Sequence
  INPP5E__Homo_sapiens__NP_063945
augcccagcaaggccgagaaccugagacccagcgagcccgccccccagccccccgagggcagaacccugcagggccagcugcccggcgccccccccgcccagagagccggcagcccccccgacgcccccggcagcgagagccccgcccuggccugcagcacccccgccacccccagcggcgaggacccccccgccagagccgcccccaucgcccccagaccccccgccagacccagacuggagagagcccugagccuggacgacaagggcuggagaagaagaagauucagaggcagccaggaggaccuggaggccagaaacggcaccagccccagcagaggcagcgugcagagcgagggccccggcgcccccgcccacagcugcagcccccccugccugagcaccagccugcaggagauccccaagagcagaggcgugcugagcagcgagagaggcagccccagcagcggcggcaacccccugagcggcguggccagcagcagccccaaccugccccacagagacgccgccguggccggcagcagccccagacugcccagccugcugccccccagacccccccccgcccugagccuggacaucgccagcgacagccugagaaccgccaacaagguggacagcgaccuggccgacuacaagcugagagcccagccccugcuggugagagcccacagcagccugggccccggcagacccagaagcccccuggccugcgacgacugcagccugagaagcgccaagagcagcuucagccugcuggcccccaucagaagcaaggacgugagaagcagaagcuaccuggagggcagccugcuggccagcggcgcccugcugggcgccgacgagcuggccagauacuuccccgacagaaacguggcccuguucguggccaccuggaacaugcagggccagaaggagcugccccccagccuggacgaguuccugcugcccgccgaggccgacuacgcccaggaccuguacgugaucggcgugcaggagggcugcagcgacagaagagagugggagaccagacugcaggagacccugggcccccacuacgugcugcugagcagcgccgcccacggcgugcuguacaugagccuguucaucagaagagaccugaucugguucugcagcgagguggagugcagcaccgugaccaccagaaucgugagccagaucaagaccaagggcgcccugggcaucagcuucaccuucuucggcaccagcuuccuguucaucaccagccacuucaccagcggcgacggcaagguggccgagagacugcuggacuacaccagaaccgugcaggcccuggugcugcccagaaacgugcccgacaccaaccccuacagaagcagcgccgccgacgugaccaccagauucgacgagguguucugguucggcgacuucaacuucagacugagcggcggcagaaccgugguggacgcccugcugugccagggccuggugguggacgugcccgcccugcugcagcacgaccagcugaucagagagaugagaaagggcagcaucuucaagggcuuccaggagcccgacauccacuuccugcccagcuacaaguucgacaucggcaaggacaccuacgacagcaccagcaagcagagaacccccagcuacaccgacagagugcuguacagaagcagacacaagggcgacaucugccccgugagcuacagcagcugccccggcaucaagaccagcgaccacagacccguguacggccuguucagagugaaggugagacccggcagagacaacaucccccuggccgccggcaaguucgacagagagcuguaccugcugggcaucaagagaagaaucagcaaggagauccagagacagcaggcccugcagagccagaacagcagcaccaucugcagcgugagcuaa

SEQ ID NO: 18575 - RNA, 1569 nt, Artificial Sequence
  INPP5F__Homo_sapiens__NP_001230123
augugccacgacgugaucuucauggccuggcugaagcagcaguucagcgagugcacccugaucgacgccacccacagagacguggacgugcugcugcugcugagcaacagcgccuacuacguggccuacuacgacgacgagguggacaaggugaaccaguaccagagacugagccuggagaaccuggagaagaucgagaucggccccgagcccacccuguucggcaagcccaaguucagcugcaugagacugcacuacagauacaaggaggccagcggcuacuuccacacccugagagccgugaugagaaaccccgaggaggacggcaaggacacccugcagugcaucgccgagaugcugcagaucaccaagcaggccaugggcagcgaccugcccaucaucgagaagaagcuggagagaaagagcagcaagccccacgaggacaucaucggcaucagaagccagaaccagggcagccuggcccagggcaagaacuuccugaugagcaaguucagcagccugaaccagaaggugaagcagaccaagagcaacgugaacaucggcaaccugagaaagcugggcaacuucaccaagcccgagaugaaggugaacuuccugaagcccaaccugaaggugaaccuguggaagagcgacagcagccuggagaccauggagaacaccggcgugauggacaaggugcaggccgagagcgacggcgacaugagcagcgacaacgacagcuaccacagcgacgaguuccugaccaacagcaagagcgacgaggacagacagcuggccaacagccuggagagcgugggccccaucgacuacgugcugcccagcugcggcaucaucgccagcgcccccagacugggcagcagaagccagagccugagcagcaccgacagcagcgugcacgcccccagcgagaucaccguggcccacggcagcggccugggcaagggccaggagagcccccugaagaagagccccagcgccggcgacgugcacauccugaccggcuucgccaagcccauggacaucuacugccacagauucgugcaggacgcccagaacaaggugacccaccugagcgagaccagaagcgugagccagcaggccagccaggagagaaaccagaugaccaaccaggugagcaacgagacccagagcgagagcaccgagcagacccccagcagacccagccagcuggacgugagccugagcgccaccggcccccaguuccugagcguggagcccgcccacagcguggccagccagaagacccccaccagcgccagcagcaugcuggagcuggagaccggccugcacgugacccccagccccagcgagagcagcagcagcagagccgugagccccuucgccaagaucagaagcagcauggugcagguggccagcaucacccaggccggccugacccacggcaucaacuucgccgugagcaaggugcagaagagcccccccgagcccgagaucaucaaccaggugcagcagaacgagcugaagaagauguucauccagugccagaccagaaucauccagaucuaa

SEQ ID NO: 18576 - RNA, 1347 nt, Artificial Sequence
  INPP5K__Homo_sapiens__NP_057616
augagcagcagaaagcugagcggccccaagggcagaagacugagcauccacguggugaccuggaacguggccagcgccgcccccccccuggaccugagcgaccugcugcagcugaacaacagaaaccugaaccuggacaucuacgugaucggccugcaggagcugaacagcggcaucaucagccugcugagcgacgccgccuucaacgacagcuggagcagcuuccugauggacgugcugagcccccugagcuucaucaaggugagccacgugagaaugcagggcauccugcugcugguguucgccaaguaccagcaccugcccuacauccagauccugagcaccaagagcacccccaccggccuguucggcuacuggggcaacaagggcggcgugaacaucugccugaagcuguacggcuacuacgugagcaucaucaacugccaccugcccccccacaucagcaacaacuaccagagacuggagcacuucgacagaauccuggagaugcagaacugcgagggcagagacauccccaacauccuggaccacgaccugaucaucugguucggcgacaugaacuucagaaucgaggacuucggccugcacuucgugagagagagcaucaagaacagaugcuacggcggccugugggagaaggaccagcugagcaucgccaagaagcacgacccccugcugagagaguuccaggagggcagacugcuguucccccccaccuacaaguucgacagaaacagcaacgacuacgacaccagcgagaagaagagaaagcccgccuggaccgacagaauccuguggagacugaagagacagcccugcgccggccccgacacccccaucccccccgccagccacuucagccugagccugagaggcuacagcagccacaugaccuacggcaucagcgaccacaagcccgugagcggcaccuucgaccuggagcugaagccccuggugagcgccccccugaucgugcugaugcccgaggaccuguggaccguggagaacgacaugauggugagcuacagcagcaccagcgacuuccccagcagccccugggacuggaucggccuguacaaggugggccugagagacgugaacgacuacgugagcuacgccugggugggcgacagcaaggugagcugcagcgacaaccugaaccagguguacaucgacaucagcaacauccccaccaccgaggacgaguuccugcugugcuacuacagcaacagccugagaagcguggugggcaucagcagacccuuccagaucccccccggcagccugagagaggacccccugggcgaggcccagccccagaucuaa

SEQ ID NO: 18577 - RNA, 3777 nt, Artificial Sequence
  INPPL1__Homo_sapiens__NP_001558
auggccagcgccugcggcgcccccggccccggcggcgcccugggcagccaggcccccagcugguaccacagagaccugagcagagccgccgccgaggagcugcuggccagagccggcagagacggcagcuuccuggugagagacagcgagagcguggccggcgccuucgcccugugcgugcuguaccagaagcacgugcacaccuacagaauccugcccgacggcgaggacuuccuggccgugcagaccagccagggcgugcccgugagaagauuccagacccugggcgagcugaucggccuguacgcccagcccaaccagggccuggugugcgcccugcugcugcccguggagggcgagagagagcccgacccccccgacgacagagacgccagcgacggcgaggacgagaagcccccccugccccccagaagcggcagcaccagcaucagcgcccccaccggccccagcagcccccugcccgcccccgagacccccaccgcccccgccgccgagagcgcccccaacggccugagcaccgugagccacgacuaccugaagggcagcuacggccuggaccuggaggccgugagaggcggcgccagccaccugccccaccugaccagaacccuggccaccagcugcagaagacugcacagcgagguggacaaggugcugagcggccuggagauccugagcaagguguucgaccagcagagcagccccauggugaccagacugcugcagcagcagaaccugccccagaccggcgagcaggagcuggagagccuggugcugaagcugagcgugcugaaggacuuccugagcggcauccagaagaaggcccugaaggcccugcaggacaugagcagcaccgccccccccgccccccagcccagcaccagaaaggccaagaccauccccgugcaggccuucgaggugaagcuggacgugacccugggcgaccugaccaagaucggcaagagccagaaguucacccugagcguggacguggagggcggcagacuggugcugcugagaagacagagagacagccaggaggacuggaccaccuucacccacgacagaaucagacagcugaucaagagccagagagugcagaacaagcugggcgugguguucgagaaggagaaggacagaacccagagaaaggacuucaucuucgugagcgccagaaagagagaggccuucugccagcugcugcagcugaugaagaacaagcacagcaagcaggacgagcccgacaugaucagcguguucaucggcaccuggaacaugggcagcgugcccccccccaagaacgugaccagcugguucaccagcaagggccugggcaagacccuggacgaggugaccgugaccaucccccacgacaucuacguguucggcacccaggagaacagcgugggcgacagagaguggcuggaccugcugagaggcggccugaaggagcugaccgaccuggacuacagacccaucgccaugcagagccuguggaacaucaagguggccgugcuggugaagcccgagcacgagaacagaaucagccacgugagcaccagcagcgugaagaccggcaucgccaacacccugggcaacaagggcgccgugggcgugagcuucauguucaacggcaccagcuucggcuucgugaacugccaccugaccagcggcaacgagaagaccgccagaagaaaccagaacuaccuggacauccugagacugcugagccugggcgacagacagcugaacgccuucgacaucagccugagauucacccaccuguucugguucggcgaccugaacuacagacuggacauggacauccaggagauccugaacuacaucagcagaaaggaguucgagccccugcugagaguggaccagcugaaccuggagagagagaagcacaagguguuccugagauucagcgaggaggagaucagcuucccccccaccuacagauacgagagaggcagcagagacaccuacgccuggcacaagcagaagcccaccggcgugagaaccaacgugcccagcuggugcgacagaauccuguggaagagcuaccccgagacccacaucaucugcaacagcuacggcugcaccgacgacaucgugaccagcgaccacagccccguguucggcaccuucgaggugggcgugaccagccaguucaucagcaagaagggccugagcaagaccagcgaccaggccuacaucgaguucgagagcaucgaggccaucgugaagaccgccagcagaaccaaguucuucaucgaguucuacagcaccugccuggaggaguacaagaagagcuucgagaacgacgcccagagcagcgacaacaucaacuuccugaaggugcaguggagcagcagacagcugcccacccugaagcccauccuggccgacaucgaguaccugcaggaccagcaccugcugcugaccgugaagagcauggacggcuacgagagcuacggcgagugcgugguggcccugaagagcaugaucggcagcaccgcccagcaguuccugaccuuccugagccacagaggcgaggagaccggcaacaucagaggcagcaugaaggugagagugcccaccgagagacugggcaccagagagagacuguacgaguggaucagcaucgacaaggacgaggccggcgccaagagcaaggcccccagcgugagcagaggcagccaggagcccagaagcggcagcagaaagcccgccuucaccgaggccagcugcccccugagcagacuguucgaggagcccgagaagcccccccccaccggcagaccccccgccccccccagagccgcccccagagaggagccccugacccccagacugaagcccgagggcgcccccgagcccgagggcguggccgcccccccccccaagaacagcuucaacaaccccgccuacuacgugcuggagggcgugccccaccagcugcugccccccgagccccccagccccgccagagcccccgugcccagcgccaccaagaacaagguggccaucaccgugcccgccccccagcugggccaccacagacaccccagagugggcgagggcagcagcagcgacgaggagagcggcggcacccugcccccccccgacuuccccccccccccccugcccgacagcgccaucuuccugccccccagccuggacccccugcccggccccguggugagaggcagaggcggcgccgaggccagaggcccccccccccccaaggcccaccccagacccccccugccccccggccccagccccgccagcaccuuccugggcgagguggccagcggcgacgacagaagcugcagcgugcugcagauggccaagacccugagcgagguggacuacgcccccgccggccccgccagaagcgcccugcugcccggcccccuggagcugcagccccccagaggccugcccagcgacuacggcagaccccugagcuuccccccccccagaaucagagagagcauccaggaggaccuggccgaggaggcccccugccugcagggcggcagagccagcggccugggcgaggccggcaugagcgccuggcugagagccaucggccuggagagauacgaggagggccuggugcacaacggcugggacgaccuggaguuccugagcgacaucaccgaggaggaccuggaggaggccggcgugcaggaccccgcccacaagagacugcugcuggacacccugcagcugagcaaguaa

SEQ ID NO: 18578 - RNA, 1740 nt, Artificial Sequence
  INSC__Homo_sapiens__NP_001027024
augagaagaccccccggcaacggcgaggccgccagcgagggccccggcggcuggggccuguggggcgugcaggagagcagaagacugugcugcgccggccacgacagaugcaagcaggcccugcugcagaucggcaucaacaugauggcccugcccggcggcagacaccuggacagcgugacccugcccggccagagacugcaccugaugcagguggacagcgugcagagauggauggaggaccugaagcugaugaccgagugcgagugcaugugcgugcugcaggccaagcccaucagccuggaggaggacgcccagggcgaccugauccuggccggcggccccggccccggcgacccccugcagcugcugcugaagagaggcugggugaucagcaccgagcugagaagaaucggccagaagcuggcccaggacagaugggccagagugcacagcaugagcgugagacugaccugccacgccagaagcauggugagcgaguacagcgccgugagcagaaacagccugaaggagaugggcgagaucgagaagcugcugauggagaagugcagcgagcugagcgccgugaccgagagaugccugcagguggagaacgagcacgugcugaagagcaugaaggccugcgugagcgagacccugagcaugcugggccagcacuucggccagcugcuggagcuggcccugaccagagaggugcaggcccuggugagaaagaucgacgccagcgacaacaucuacaccaccgagagcaccaccggcaaccuguucagccugacccaggagggcgccccccugugcagaaucaucgccaaggagggcggcgugguggcccuguucaaggugugcagacaggacagcuucagaugccuguacccccaggcccugagaacccuggccagcaucugcugcguggaggagggcgugcaccagcuggagaagguggacggcgugcugugccuggccgacauccugaccgacaacagccacagcgaggccaccagagccgaggccgccgccgugguggcccaggugaccagcccccaccugcccgugacccagcaccugagcagcuuccuggagagcauggaggagaucgugaccgcccuggugaagcugugccaggaggccagcagcggcgagguguuccugcuggccagcgccgcccuggccaacaucaccuucuucgacaccauggccugcgagaugcugcugcagcugaacgccaucagagugcugcuggaggccugcagcgacaagcagagaguggacacccccuacaccagagaccagaucgugaccauccuggccaacaugagcgugcuggagcagugcgccagcgacaucauccaggagaacggcgugcagcugaucaugggcaugcugagcgagaagcccagaagcggcacccccgccgagguggccgccugcgagagagugcagcagaaggccgccgugacccuggccagacugagcagagaccccgacguggccagagaggccgugagacugagcugcaugagcagacugaucgagcugugcagaagccccagcgagagaaacagcagcgacgccgugcugguggccugccuggccgcccugagaagacuggccggcgugugccccgagggccugcaggacagcgacuuccagcagcuggugcagcccagacugguggacagcuuccugcugugcagcaacauggaggagagcuucguguaa

SEQ ID NO: 18579 - RNA, 333 nt, Artificial Sequence
  INS__Homo_sapiens__NP_001278826
auggcccuguggaugagacugcugccccugcuggcccugcuggcccuguggggccccgaccccgccgccgccuucgugaaccagcaccugugcggcagccaccugguggaggcccuguaccuggugugcggcgagagaggcuucuucuacacccccaagaccagaagagaggccgaggaccugcaggugggccagguggagcugggcggcggccccggcgccggcagccugcagccccuggcccuggagggcagccugcagaagagaggcaucguggagcagugcugcaccagcaucugcagccuguaccagcuggagaacuacugcaacuaa

SEQ ID NO: 18580 - RNA, 834 nt, Artificial Sequence
  INSIG1__Homo_sapiens__NP_005533
augcccagacugcacgaccacuucuggagcugcagcugcgcccacagcgccagaagaagaggcccccccagagccagcgccgccggccuggccgccaaggugggcgagaugaucaacgugagcgugagcggccccagccugcuggccgcccacggcgcccccgacgccgaccccgcccccagaggcagaagcgccgccaugagcggccccgagcccggcagccccuaccccaacaccuggcaccacagacugcugcagagaagccuggugcuguucagcgugggcguggugcuggcccuggugcugaaccugcugcagauccagagaaacgugacccuguuccccgaggaggugaucgccaccaucuucagcagcgccuggugggugccccccugcugcggcaccgccgccgccguggugggccugcuguaccccugcaucgacagccaccugggcgagccccacaaguucaagagagagugggccagcgugaugagaugcaucgccguguucgugggcaucaaccacgccagcgccaagcuggacuucgccaacaacgugcagcugagccugacccuggccgcccugagccugggccugugguggaccuucgacagaagcagaagcggccugggccugggcaucaccaucgccuuccuggccacccugaucacccaguuccugguguacaacggcguguaccaguacaccagccccgacuuccuguacaucagaagcuggcugcccugcaucuucuucagcggcggcgugaccgugggcaacaucggcagacagcuggccaugggcgugcccgagaagccccacagcgacuaa

SEQ ID NO: 18581 - RNA, 678 nt, Artificial Sequence
  INSIG2__Homo_sapiens__XP_011509594
auggccgagggcgagaccgagagccccggccccaagaagugcggccccuacaucagcagcgugaccagccagagcgugaaccugaugaucagaggcguggugcuguucuucaucggcguguuccuggcccuggugcugaaccugcugcagauccagagaaacgugacccuguucccccccgacgugaucgccagcaucuucagcagcgccuggugggugccccccugcugcggcaccgccagcgccgugaucggccugcuguaccccugcaucgacagacaccugggcgagccccacaaguucaagagagaguggagcagcgugaugagaugcguggccguguucgugggcaucaaccacgccagcgccaagguggacuucgacaacaacauccagcugagccugacccuggccgcccugagcaucggccugugguggaccuucgacagaagcagaagcggcuucggccugggcgugggcaucgccuuccuggccaccguggugacccagcugcugguguacaacggcguguaccaguacaccagccccgacuuccuguacgugagaagcuggcugcccugcaucuucuucgccggcggcaucaccaugggcaacaucggcagacagcuggccauguacgagugcaaggugaucgccgagaagagccaccaggaguaa

SEQ ID NO: 18582 - RNA, 603 nt, Artificial Sequence
  INS-IGF2__Homo_sapiens__NP_001035835
auggcccuguggaugagacugcugccccugcuggcccugcuggcccuguggggccccgaccccgccgccgccuucgugaaccagcaccugugcggcagccaccugguggaggcccuguaccuggugugcggcgagagaggcuucuucuacacccccaagaccagaagagaggccgaggaccugcaggccagcgcccugagccugagcagcagcaccagcaccuggcccgagggccuggacgccaccgccagagccccccccgcccugguggugaccgccaacaucggccaggccggcggcagcagcagcagacaguucagacagagagcccugggcaccagcgacagccccgugcuguucauccacugccccggcgccgccggcaccgcccagggccuggaguacagaggcagaagagugaccaccgagcuggugugggaggagguggacagcagcccccagccccagggcagcgagagccugcccgcccagccccccgcccagcccgccccccagcccgagccccagcaggccagagagcccagccccgaggugagcugcugcggccuguggcccagaagaccccagagaagccagaacuaa

SEQ ID NO: 18583 - RNA, 474 nt, Artificial Sequence
  INSL3__Homo_sapiens__NP_001252516
auggaccccagacugcccgccugggcccuggugcugcugggccccgcccugguguucgcccugggccccgcccccacccccgagaugagagagaagcugugcggccaccacuucgugagagcccuggugagagugugcggcggccccagauggagcaccgaggccagaagacccgccaccggcggcgaccagagagagagccacagcgugagccaggccggccugaagcugcugagcagcagcaacccccccacccugaccuuccagagcgugggcaucagcgacgugagcugcuacagcggcuggagagacgacaucugcagcaugggcugguggcccaccgugaucagcagaugggaccuggccugcagccccugccccagaccccugaccaucaccgccaccaccgugcagcugccccccacccugcacgccaccgccgccagcguggccgugcccaacaagaccugcuaa

SEQ ID NO: 18584 - RNA, 420 nt, Artificial Sequence
  INSL4__Homo_sapiens__NP_002186
auggccagccuguucagaagcuaccugcccgccaucuggcugcugcugagccagcugcugagagagagccuggccgccgagcugagaggcugcggccccagauucggcaagcaccugcugagcuacugccccaugcccgagaagaccuucaccaccacccccggcggcuggcugcuggagagcggcagacccaaggagauggugagcaccagcaacaacaaggacggccaggcccugggcaccaccagcgaguucauccccaaccugagccccgagcugaagaagccccugagcgagggccagcccagccugaagaagaucauccugagcagaaagaagagaagcggcagacacagauucgaccccuucugcugcgaggugaucugcgacgacggcaccagcgugaagcugugcaccuaa

SEQ ID NO: 18585 - RNA, 642 nt, Artificial Sequence
  INSL6__Homo_sapiens__NP_009110
augcccagacugcugagacugagccugcuguggcugggccugcugcuggugagauucagcagagagcugagcgacaucagcagcgccagaaagcugugcggcagauaccuggugaaggagaucgagaagcugugcggccacgccaacuggagccaguucagauucgaggaggagacccccuucagcagacugaucgcccaggccagcgagaagguggaggccuacagccccuaccaguucgagagcccccagaccgccagccccgccagaggcagaggcaccaaccccgugagcaccagcugggaggaggccgugaacagcugggagaugcagagccugcccgaguacaaggacaagaagggcuacagcccccugggcaagaccagagaguucagcagcagccacaacaucaacguguacauccacgagaacgccaaguuccagaagaagagaagaaacaagaucaagacccugagcaaccuguucuggggccaccacccccagagaaagagaagaggcuacagcgagaagugcugccugaccggcugcaccaaggaggagcugagcaucgccugccugcccuacaucgacuucaagagacugaaggagaagagaagcagccuggugaccaagaucuacuaa

SEQ ID NO: 18586 - RNA, 1533 nt, Artificial Sequence
  INSM1__Homo_sapiens__NP_002187
augcccagaggcuuccuggugaagagaagcaagaagagcacccccgugagcuacagagugagaggcggcgaggacggcgacagagcccugcugcugagccccagcugcggcggcgccagagccgagccccccgcccccagccccgugcccggcccccugcccccccccccccccgccgagagagcccacgccgcccuggccgccgcccuggccugcgcccccggcccccagccccccccccagggccccagagccgcccacuucggcaaccccgaggccgcccaccccgccccccuguacagccccaccagacccgugagcagagagcacgagaagcacaaguacuucgagagaagcuucaaccugggcagccccgugagcgccgagagcuuccccacccccgccgcccugcugggcggcggcggcggcggcggcgccagcggcgccggcggcggcggcaccugcggcggcgacccccugcuguucgcccccgccgagcugaagaugggcaccgccuucagcgccggcgccgaggccgccagaggccccggccccggccccccccugccccccgccgccgcccugagaccccccggcaagagaccccccccccccaccgccgccgagccccccgccaaggccgugaaggcccccggcgccaagaagcccaaggccaucagaaagcugcacuucgaggacgaggugaccaccagccccgugcugggccugaagaucaaggagggccccguggaggcccccagaggcagagccggcggcgccgccagaccccugggcgaguucaucugccagcugugcaaggaggaguacgccgaccccuucgcccuggcccagcacaagugcagcagaaucgugagaguggaguacagaugccccgagugcgccaagguguucagcugccccgccaaccuggccagccacagaagauggcacaagcccagacccgcccccgccgccgccagagcccccgagcccgaggccgccgccagagccgaggccagagaggcccccggcggcggcagcgacagagacacccccagccccggcggcgugagcgagagcggcagcgaggacggccuguacgagugccaccacugcgccaagaaguucagaagacaggccuaccugagaaagcaccugcuggcccaccaccaggcccugcaggccaagggcgccccccuggccccccccgccgaggaccugcuggcccuguaccccggccccgacgagaaggccccccaggaggccgccggcgacggcgagggcgccggcgugcugggccugagcgccagcgccgagugccaccugugccccgugugcggcgagagcuucgccagcaagggcgcccaggagagacaccugagacugcugcacgccgcccagguguuccccugcaaguacugccccgccaccuucuacagcagccccggccugaccagacacaucaacaagugccaccccagcgagaacagacaggugauccugcugcaggugcccgugagacccgccugcuaa

SEQ ID NO: 18587 - RNA, 1701 nt, Artificial Sequence
  INSM2__Homo_sapiens__NP_115983
augcccagaggcuuccuggugaagagaaccaagagaaccggcggccuguacagagugagacuggccgagagaguguucccccugcugggcccccagggcgccccccccuuccuggaggaggcccccagcgccagccugcccggcgccgagagagccaccccccccaccagagaggagcccggcaagggccugaccgccgaggccgccagagagcagagcggcagccccugcagagccgccggcgugagccccggcaccggcggcagagagggcgccgaguggagagccggcggcagagagggccccggccccagccccagccccagccccagccccgccaagcccgccggcgccgagcugagaagagccuuccuggagagaugccugagcagccccgugagcgccgagagcuuccccggcggcgccgccgccguggccgccuucagcugcagcguggcccccgccgccgcccccacccccggcgagcaguuccugcugccccugagagcccccuuccccgagcccgcccugcagcccgaccccgccccccugagcgccgcccugcagagccugaagagagccgccggcggcgagagaagaggcaaggcccccaccgacugcgccagcggccccgccgccgccggcaucaagaagcccaaggccaugagaaagcugagcuucgccgacgaggugaccaccagccccgugcugggccugaagaucaaggaggaggagcccggcgcccccagcagaggccugggcggcagcagaaccccccugggcgaguucaucugccagcugugcaaggagcaguacgccgaccccuucgcccuggcccagcacagaugcagcagaaucgugagaguggaguacagaugccccgagugcgacaagguguucagcugccccgccaaccuggccagccacagaagauggcacaagcccagacccgccgccgccaacgccgccaccgugagcagcgccgacggcaagccccccagcagcagcagcagcagcagcagagacagcggcgccaucgccagcuuccuggccgagggcaaggagaacagcagaaucgagagaaccgccgaccagcacccccaggccagagacagcagcggcgccgaccagcaccccgacagcgcccccagacagggccugcaggugcugacccaccccgagcccccccugccccagggccccuacaccgagggcgugcugggcagaagagugcccgugcccggcagcaccagcggcggcagaggcagcgagaucuucgugugccccuacugccacaagaaguucagaagacaggccuaccugagaaagcaccugagcacccacgaggccggcagcgccagagcccuggcccccggcuucggcagcgagagaggcgccccccuggccuucgccugcccccugugcggcgcccacuuccccaccgccgacaucagagagaagcacagacuguggcacgccgugagagaggagcugcugcugcccgcccuggccggcgccccccccgagaccagcggccccagcggccccagcgacggcagcgcccagcagaucuucagcugcaagcacugccccagcaccuucuucagcagccccggccugaccagacacaucaacaagugccaccccagcgagagcagacaggugcugcugcugcagaugccccugagacccggcugcuaa

SEQ ID NO: 18588 - RNA, 4149 nt, Artificial Sequence
  INSR__Homo_sapiens__NP_000199
auggccaccggcggcagaagaggcgccgccgccgccccccugcugguggccguggccgcccugcugcugggcgccgccggccaccuguaccccggcgaggugugccccggcauggacaucagaaacaaccugaccagacugcacgagcuggagaacugcagcgugaucgagggccaccugcagauccugcugauguucaagaccagacccgaggacuucagagaccugagcuuccccaagcugaucaugaucaccgacuaccugcugcuguucagaguguacggccuggagagccugaaggaccuguuccccaaccugaccgugaucagaggcagcagacuguucuucaacuacgcccuggugaucuucgagauggugcaccugaaggagcugggccuguacaaccugaugaacaucaccagaggcagcgugagaaucgagaagaacaacgagcugugcuaccuggccaccaucgacuggagcagaauccuggacagcguggaggacaacuacaucgugcugaacaaggacgacaacgaggagugcggcgacaucugccccggcaccgccaagggcaagaccaacugccccgccaccgugaucaacggccaguucguggagagaugcuggacccacagccacugccagaaggugugccccaccaucugcaagagccacggcugcaccgccgagggccugugcugccacagcgagugccugggcaacugcagccagcccgacgaccccaccaagugcguggccugcagaaacuucuaccuggacggcagaugcguggagaccugccccccccccuacuaccacuuccaggacuggagaugcgugaacuucagcuucugccaggaccugcaccacaagugcaagaacagcagaagacagggcugccaccaguacgugauccacaacaacaagugcauccccgagugccccagcggcuacaccaugaacagcagcaaccugcugugcacccccugccugggccccugccccaaggugugccaccugcuggagggcgagaagaccaucgacagcgugaccagcgcccaggagcugagaggcugcaccgugaucaacggcagccugaucaucaacaucagaggcggcaacaaccuggccgccgagcuggaggccaaccugggccugaucgaggagaucagcggcuaccugaagaucagaagaagcuacgcccuggugagccugagcuucuucagaaagcugagacugaucagaggcgagacccuggagaucggcaacuacagcuucuacgcccuggacaaccagaaccugagacagcugugggacuggagcaagcacaaccugaccaucacccagggcaagcuguucuuccacuacaaccccaagcugugccugagcgagauccacaagauggaggaggugagcggcaccaagggcagacaggagagaaacgacaucgcccugaagaccaacggcgaccaggccagcugcgagaacgagcugcugaaguucagcuacaucagaaccagcuucgacaagauccugcugagaugggagcccuacuggccccccgacuucagagaccugcugggcuucaugcuguucuacaaggaggcccccuaccagaacgugaccgaguucgacggccaggacgccugcggcagcaacagcuggaccgugguggacaucgaccccccccugagaagcaacgaccccaagagccagaaccaccccggcuggcugaugagaggccugaagcccuggacccaguacgccaucuucgugaagacccuggugaccuucagcgacgagagaagaaccuacggcgccaagagcgacaucaucuacgugcagaccgacgccaccaaccccagcgugccccuggaccccaucagcgugagcaacagcagcagccagaucauccugaaguggaagccccccagcgaccccaacggcaacaucacccacuaccugguguucugggagagacaggccgaggacagcgagcuguucgagcuggacuacugccugaagggccugaagcugcccagcagaaccuggagcccccccuucgagagcgaggacagccagaagcacaaccagagcgaguacgaggacagcgccggcgagugcugcagcugccccaagaccgacagccagauccugaaggagcuggaggagagcagcuucagaaagaccuucgaggacuaccugcacaacgugguguucgugcccagaaagaccagcagcggcaccggcgccgaggaccccagacccagcagaaagagaagaagccugggcgacgugggcaacgugaccguggccgugcccaccguggccgccuuccccaacaccagcagcaccagcgugcccaccagccccgaggagcacagacccuucgagaagguggugaacaaggagagccuggugaucagcggccugagacacuucaccggcuacagaaucgagcugcaggccugcaaccaggacacccccgaggagagaugcagcguggccgccuacgugagcgccagaaccaugcccgaggccaaggccgacgacaucgugggccccgugacccacgagaucuucgagaacaacguggugcaccugauguggcaggagcccaaggagcccaacggccugaucgugcuguacgaggugagcuacagaagauacggcgacgaggagcugcaccugugcgugagcagaaagcacuucgcccuggagagaggcugcagacugagaggccugagccccggcaacuacagcgugagaaucagagccaccagccuggccggcaacggcagcuggaccgagcccaccuacuucuacgugaccgacuaccuggacgugcccagcaacaucgccaagaucaucaucggcccccugaucuucguguuccuguucagcguggugaucggcagcaucuaccuguuccugagaaagagacagcccgacggcccccugggcccccuguacgccagcagcaaccccgaguaccugagcgccagcgacguguuccccugcagcguguacgugcccgacgagugggaggugagcagagagaagaucacccugcugagagagcugggccagggcagcuucggcaugguguacgagggcaacgccagagacaucaucaagggcgaggccgagaccagaguggccgugaagaccgugaacgagagcgccagccugagagagagaaucgaguuccugaacgaggccagcgugaugaagggcuucaccugccaccacguggugagacugcugggcguggugagcaagggccagcccacccugguggugauggagcugauggcccacggcgaccugaagagcuaccugagaagccugagacccgaggccgagaacaaccccggcagacccccccccacccugcaggagaugauccagauggccgccgagaucgccgacggcauggccuaccugaacgccaagaaguucgugcacagagaccuggccgccagaaacugcaugguggcccacgacuucaccgugaagaucggcgacuucggcaugaccagagacaucuacgagaccgacuacuacagaaagggcggcaagggccugcugcccgugagauggauggcccccgagagccugaaggacggcguguucaccaccagcagcgacauguggagcuucggcguggugcugugggagaucaccagccuggccgagcagcccuaccagggccugagcaacgagcaggugcugaaguucgugauggacggcggcuaccuggaccagcccgacaacugccccgagagagugaccgaccugaugagaaugugcuggcaguucaaccccaagaugagacccaccuuccuggagaucgugaaccugcugaaggacgaccugcaccccagcuuccccgaggugagcuucuuccacagcgaggagaacaaggcccccgagagcgaggagcuggagauggaguucgaggacauggagaacgugccccuggacagaagcagccacugccagagagaggaggccggcggcagagacggcggcagcagccugggcuucaagagaagcuacgaggagcacauccccuacacccacaugaacggcggcaagaagaacggcagaauccugacccugcccagaagcaaccccagcuaa

SEQ ID NO: 18589 - RNA, 3894 nt, Artificial Sequence
  INSRR__Homo_sapiens__NP_055030
auggccgugcccagccuguggcccuggggcgccugccugcccgugaucuuccugagccugggcuucggccuggacaccguggaggugugccccagccuggacaucagaagcgagguggccgagcugagacagcuggagaacugcagcgugguggagggccaccugcagauccugcugauguucaccgccaccggcgaggacuucagaggccugagcuuccccagacugacccaggugaccgacuaccugcugcuguucagaguguacggccuggagagccugagagaccuguuccccaaccuggccgugaucagaggcaccagacuguuccugggcuacgcccuggugaucuucgagaugccccaccugagagacguggcccugcccgcccugggcgccgugcugagaggcgccgugagaguggagaagaaccaggagcugugccaccugagcaccaucgacuggggccugcugcagcccgcccccggcgccaaccacaucgugggcaacaagcugggcgaggagugcgccgacgugugccccggcgugcugggcgccgccggcgagcccugcgccaagaccaccuucagcggccacaccgacuacagaugcuggaccagcagccacugccagagagugugccccugcccccacggcauggccugcaccgccagaggcgagugcugccacaccgagugccugggcggcugcagccagcccgaggaccccagagccugcguggccugcagacaccuguacuuccagggcgccugccugugggccugcccccccggcaccuaccaguacgagagcuggagaugcgugaccgccgagagaugcgccagccugcacagcgugcccggcagagccagcaccuucggcauccaccagggcagcugccuggcccagugccccagcggcuucaccagaaacagcagcagcaucuucugccacaagugcgagggccugugccccaaggagugcaaggugggcaccaagaccaucgacagcauccaggccgcccaggaccuggugggcugcacccacguggagggcagccugauccugaaccugagacagggcuacaaccuggagccccagcugcagcacagccugggccugguggagaccaucaccggcuuccugaagaucaagcacagcuucgcccuggugagccugggcuucuucaagaaccugaagcugaucagaggcgacgccaugguggacggcaacuacacccuguacgugcuggacaaccagaaccugcagcagcugggcagcuggguggccgccggccugaccauccccgugggcaagaucuacuucgccuucaaccccagacugugccuggagcacaucuacagacuggaggaggugaccggcaccagaggcagacagaacaaggccgagaucaaccccagaaccaacggcgacagagccgccugccagaccagaacccugagauucgugagcaacgugaccgaggccgacagaauccugcugagaugggagagauacgagccccuggaggccagagaccugcugagcuucaucguguacuacaaggagagccccuuccagaacgccaccgagcacgugggccccgacgccugcggcacccagagcuggaaccugcuggacguggagcugccccugagcagaacccaggagcccggcgugacccuggccagccugaagcccuggacccaguacgccguguucgugagagccaucacccugaccaccgaggaggacagcccccaccagggcgcccagagccccaucguguaccugagaacccugcccgccgcccccaccgugccccaggacgugaucagcaccagcaacagcagcagccaccugcuggugagauggaagccccccacccagagaaacggcaaccugaccuacuaccuggugcuguggcagagacuggccgaggacggcgaccuguaccugaacgacuacugccacagaggccugagacugcccaccagcaacaacgaccccagauucgacggcgaggacggcgaccccgaggccgagauggagagcgacugcugccccugccagcaccccccccccggccaggugcugcccccccuggaggcccaggaggccagcuuccagaagaaguucgagaacuuccugcacaacgccaucaccauccccaucagccccuggaaggugaccagcaucaacaagagcccccagagagacagcggcagacacagaagagccgccggcccccugagacugggcggcaacagcagcgacuucgagauccaggaggacaaggugcccagagagagagccgugcugagcggccugagacacuucaccgaguacagaaucgacauccacgccugcaaccacgccgcccacaccgugggcugcagcgccgccaccuucguguucgccagaaccaugccccacagagaggccgacggcauccccggcaagguggccugggaggccagcagcaagaacagcgugcugcugagauggcuggagccccccgaccccaacggccugauccugaaguacgagaucaaguacagaagacugggcgaggaggccaccgugcugugcgugagcagacugagauacgccaaguucggcggcgugcaccuggcccugcugccccccggcaacuacagcgccagagugagagccaccagccuggccggcaacggcagcuggaccgacagcguggccuucuacauccugggccccgaggaggaggacgccggcggccugcacgugcugcugaccgccacccccgugggccugacccugcugaucgugcuggccgcccugggcuucuucuacggcaagaagagaaacagaacccuguacgccagcgugaaccccgaguacuucagcgccagcgacauguacgugcccgacgagugggaggugcccagagagcagaucagcaucaucagagagcugggccagggcagcuucggcaugguguacgagggccuggccagaggccuggaggccggcgaggagagcacccccguggcccugaagaccgugaacgagcuggccagccccagagagugcaucgaguuccugaaggaggccagcgugaugaaggccuucaagugccaccacguggugagacugcugggcguggugagccagggccagcccacccuggugaucauggagcugaugaccagaggcgaccugaagagccaccugagaagccugagacccgaggccgagaacaaccccggccugccccagcccgcccugggcgagaugauccagauggccggcgagaucgccgacggcauggccuaccuggccgccaacaaguucgugcacagagaccuggccgccagaaacugcauggugagccaggacuucaccgugaagaucggcgacuucggcaugaccagagacguguacgagaccgacuacuacagaaagggcggcaagggccugcugcccgugagauggauggcccccgagagccugaaggacggcaucuucaccacccacagcgacguguggagcuucggcguggugcugugggagaucgugacccuggccgagcagcccuaccagggccugagcaacgagcaggugcugaaguucgugauggacggcggcgugcuggaggagcuggagggcugcccccugcagcugcaggagcugaugagcagaugcuggcagcccaaccccagacugagacccagcuucacccacauccuggacagcauccaggaggagcugagacccagcuucagacugcugagcuucuacuacagccccgagugcagaggcgccagaggcagccugcccaccaccgacgccgagcccgacagcagccccacccccagagacugcagcccccagaacggcggccccggccacuaa

SEQ ID NO: 18590 - RNA, 1389 nt, Artificial Sequence
  INTS12__Homo_sapiens__NP_001135943
auggccgccaccgugaaccuggagcuggaccccaucuuccugaaggcccugggcuuccugcacagcaagagcaaggacagcgccgagaagcugaaggcccugcuggacgagagccuggccagaggcaucgacagcagcuacagacccagccagaaggacguggagccccccaagaucagcagcaccaagaacaucagcaucaagcaggagcccaagaucagcagcagccugcccagcggcaacaacaacggcaaggugcugaccaccgagaaggugaagaaggaggccgagaagagacccgccgacaagaugaagagcgacaucaccgagggcguggacauccccaagaagcccagacuggagaagcccgagacccagagcagccccaucaccgugcagagcagcaaggaccugcccauggccgaccugagcagcuucgaggagaccagcgccgacgacuucgccauggagaugggccuggccugcguggugugcagacagaugaugguggccagcggcaaccagcugguggagugccaggagugccacaaccuguaccacagagacugccacaagccccaggugaccgacaaggaggccaacgaccccagacuggugugguacugcgccagaugcaccagacagaugaagagaauggcccagaagacccagaagcccccccagaagcccgcccccgccguggugagcgugacccccgccgugaaggacccccuggugaagaagcccgagaccaagcugaagcaggagaccaccuuccuggccuucaagagaaccgaggugaagaccagcaccgugaucagcggcaacagcagcagcgccagcgugagcagcagcgugaccagcggccugaccggcugggccgccuucgccgccaagaccagcagcgccggccccagcaccgccaagcugagcagcaccacccagaacaacaccggcaagcccgccaccagcagcgccaaccagaagcccgugggccugaccggccuggccaccagcagcaagggcggcaucggcagcaagaucggcagcaacaacagcaccacccccaccgugccccugaagcccccccccccccugacccugggcaagaccggccugagcagaagcgugagcugcgacaacgugagcaaggugggccugcccagccccagcagccuggugcccggcagcagcagccagcugagcggcaacggcaacagcggcaccagcggccccagcggcagcaccaccagcaagaccaccagcgagagcagcagcagccccagcgccagccugaagggccccaccagccaggagagccagcugaacgccaugaagagacugcagauggugaagaagaaggccgcccagaagaagcugaagaaguaa

SEQ ID NO: 18591 - RNA, 6573 nt, Artificial Sequence
  INTS1__Homo_sapiens__NP_001073922
augaacagagccaagcccaccaccgugagaagacccagcgccgccgccaagcccagcggccaccccccccccggcgacuucaucgcccugggcagcaagggccaggccaacgagagcaagaccgccagcacccugcugaagcccgcccccagcggccugcccagcgagagaaagagagacgccgccgccgcccugagcagcgccagcgcccugaccggccugaccaagagacccaagcugagcagcacccccccccugagcgcccugggcagacuggccgaggccgccguggccgagaagagagccaucagccccagcaucaaggagcccagcguggugcccaucgaggugcugcccaccgugcugcuggacgagaucgaggccgccgagcuggagggcaacgacgacagaaucgagggcgugcugugcggcgccgugaagcagcugaaggugaccagagccaagcccgacagcacccuguaccugagccugauguaccuggccaagaucaagcccaacaucuucgccaccgagggcgugaucgaggcccugugcagccugcugagaagagacgccagcaucaacuucaaggccaagggcaacagccuggugagcgugcuggccugcaaccugcugauggccgccuacgaggaggacgagaacuggcccgagaucuucgugaagguguacaucgaggacagccugggcgagagaaucuggguggacagcccccacugcaagaccuucguggacaacauccagaccgccuucaacaccagaaugccccccagaagcgugcugcugcagggcgaggccggcagaguggccggcgaccugggcgccggcagcagcccccaccccagccugaccgaggaggaggacagccagaccgagcugcugaucgccgaggagaagcugagccccgagcaggagggccagcugaugcccagauacgaggagcuggccgagagcguggaggaguacgugcuggacaugcugagagaccagcugaacagaagacagcccaucgacaacgugagcagaaaccugcugagacugcugaccagcaccugcggcuacaaggaggugagacugcuggccgugcagaagcuggagauguggcugcagaaccccaagcugaccagacccgcccaggaccugcugaugagcgugugcaugaacugcaacacccacggcagcgaggacauggacgugaucagccaccugaucaagaucagacugaagcccaaggugcugcugaaccacuucaugcugugcaucagagagcugcugagcgcccacaaggacaaccugggcaccaccaucaagcuggugaucuucaacgagcugagcagcgccagaaaccccaacaacaugcaggugcuguacaccgcccugcagcacagcagcgagcuggcccccaaguuccuggccaugguguuccaggaccugcugaccaacaaggacgacuaccugagagccagcagagcccugcugagagagaucaucaagcagaccaagcacgagaucaacuuccaggccuucugccugggccugaugcaggagagaaaggagccccaguaccuggagauggaguucaaggagagauucguggugcacaucaccgacgugcuggccgugagcaugaugcugggcaucaccgcccaggugaaggaggccggcaucgccugggacaagggcgagaagagaaaccuggaggugcugagaagcuuccagaaccagaucgccgccauccagagagacgccgugugguggcugcacaccguggugcccagcaucagcaagcuggcccccaaggacuacgugcacugccugcacaaggugcuguucaccgagcagcccgagaccuacuacaagugggacaacuggccccccgagagcgacagaaacuucuuccugagacugugcagcgaggugcccauccuggaggacacccugaugagaauccuggugaucggccugagcagagagcugccccugggccccgccgacgccauggagcuggccgaccaccuggugaagagagccgccgccgugcaggccgacgacguggaggugcugaaggugggcagaacccagcugaucgacgccgugcugaaccugugcaccuaccaccaccccgagaacauccagcugccccccggcuaccagccccccaaccuggccaucagcacccuguacuggaaggccuggccccugcugcuggugguggccgccuucaaccccgagaacaucggccuggccgccugggaggaguaccccacccugaagaugcugauggagauggugaugaccaacaacuacagcuacccccccugcacccugaccgacgaggagaccagaaccgagaugcugaacagagagcugcagaccgcccagagagagaagcaggagauccuggccuucgagggccaccuggccgccgccagcaccaagcagaccaucaccgagagcagcagccugcugcugagccagcugaccagccuggacccccagggcccccccagaagaccccccccccacauccuggaccaggugaagagccugaaccagagccugagacugggccaccugcugugcagaagcagaaaccccgacuuccugcugcacaucauccagagacaggccagcagccagagcaugcccuggcuggccgaccuggugcagagcagcgagggcagccuggacgugcugcccgugcagugccugugcgaguuccugcugcacgacgccguggacgacgccgccagcggcgaggaggacgacgagggcgagagcaaggagcagaaggccaagaagagacagagacagcagaagcagagacagcugcugggcagacugcaggaccugcugcugggccccaaggccgacgagcagaccaccugcgaggugcuggacuacuuccugagaagacugggcagcagccagguggccagcagagugcuggccaugaagggccugagccuggugcugagcgagggcagccugagagacggcgaggagaaggagccccccauggaggaggacgugggcgacaccgacgugcugcagggcuaccaguggcugcugagagaccugcccagacugccccuguucgacagcgugagaagcaccaccgcccuggcccugcagcaggccauccacauggagaccgacccccagaccaucagcgccuaccugaucuaccugagccagcacacccccguggaggagcaggcccagcacagcgaccuggcccuggacguggccagacuggugguggagagaagcaccaucaugagccaccuguucagcaagcugagccccagcgccgccagcgacgccgugcugagcgcccugcugagcaucuucagcagauacgugagaagaaugagacagagcaaggagggcgaggagguguacagcuggagcgagagccaggaccagguguuccugagauggagcagcggcgagaccgccaccaugcacauccugguggugcacgccauggugauccugcugacccugggcccccccagagccgacgacagcgaguuccaggcccugcuggacaucugguuccccgaggagaagccccugcccaccgccuuccugguggacaccagcgaggaggcccugcugcugcccgacuggcugaagcugagaaugaucagaagcgaggugcugagacugguggacgccgcccugcaggaccuggagccccagcagcugcugcuguucgugcagagcuucggcauccccgugagcagcaugagcaagcugcugcaguuccuggaccaggccguggcccacgacccccagacccuggagcagaacaucauggacaagaacuacauggcccaccugguggaggugcagcacgagagaggcgccagcggcggccagaccuuccacagccugcugaccgccagccugccccccagaagagacagcaccgaggcccccaagcccaagagcagccccgagcagcccaucggccagggcagaaucagagugggcacccagcugagagugcugggccccgaggacgaccuggccggcauguuccugcagaucuucccccugagccccgaccccagauggcagagcagcagccccagacccguggcccuggcccugcagcaggcccugggccaggagcuggccagaguggugcagggcagccccgaggugcccggcaucaccgugagagugcugcaggcccuggccacccugcugagcagcccccacggcggcgcccuggugaugagcaugcacagaagccacuuccuggccugcccccugcugagacagcugugccaguaccagagaugcgugccccaggacaccggcuucagcagccuguuccugaaggugcugcugcagaugcugcaguggcuggacagccccggcguggagggcggcccccugagagcccagcugagaaugcuggccagccaggccagcgccggcagaagacugagcgacgugagaggcggccugcugagacuggccgaggcccuggccuucagacaggaccuggagguggugagcagcaccgugagagccgugaucgccacccugagaagcggcgagcagugcagcguggagcccgaccugaucagcaaggugcugcagggccugaucgaggugagaagcccccaccuggaggagcugcugaccgccuucuucagcgccaccgccgacgccgccagccccuuccccgccugcaagcccguggugguggugagcagccugcugcugcaggaggaggagccccuggccggcggcaagcccggcgccgacggcggcagccuggaggccgugagacugggccccagcagcggccugcugguggacuggcuggagaugcuggaccccgagguggugagcagcugccccgaccugcagcugagacugcuguucagcagaagaaagggcaagggccaggcccaggugcccagcuucagacccuaccugcugacccuguucacccaccagagcagcuggcccacccugcaccagugcaucagagugcugcugggcaagagcagagagcagagauucgaccccagcgccagccuggacuuccugugggccugcauccacgugcccagaaucuggcagggcagagaccagagaaccccccagaagagaagagaggagcuggugcugagagugcagggccccgagcugaucagccugguggagcugauccuggccgaggccgagaccagaagccaggacggcgacaccgccgccugcagccugauccaggccagacugccccugcugcugagcugcugcugcggcgacgacgagagcgugagaaaggugaccgagcaccugagcggcugcauccagcaguggggcgacagcgugcugggcagaagaugcagagaccugcugcugcagcuguaccugcagagacccgagcugagagugcccgugcccgaggugcugcugcacagcgagggcgccgccagcagcagcgugugcaagcuggacggccugauccacagauucaucacccugcuggccgacaccagcgacagcagagcccuggagaacagaggcgccgacgccagcauggccugcagaaagcuggccguggcccacccccugcugcugcugagacaccugcccaugaucgccgcccugcugcacggcagaacccaccugaacuuccaggaguucagacagcagaaccaccugagcugcuuccugcacgugcugggccugcuggagcugcugcagccccacguguucagaagcgagcaccagggcgcccugugggacugccugcugagcuucaucagacugcugcugaacuacagaaagagcagcagacaccuggccgccuucaucaacaaguucgugcaguucauccacaaguacaucaccuacaacgcccccgccgccaucagcuuccugcagaagcacgccgacccccugcacgaccugagcuucgacaacagcgaccuggugaugcugaagagccugcuggccggccugagccugcccagcagagacgacagaaccgacagaggccuggacgaggagggcgaggaggagagcagcgccggcagccugccccuggugagcgugagccuguucaccccccugaccgccgccgagauggcccccuacaugaagagacugagcagaggccagaccguggaggaccugcuggaggugcugagcgacaucgacgagaugagcagaagaagacccgagauccugagcuucuucagcaccaaccugcagagacugaugagcagcgccgaggagugcugcagaaaccuggccuucagccuggcccugagaagcaugcagaacagccccagcaucgccgccgccuuccugcccaccuucauguacugccugggcagccaggacuucgagguggugcagaccgcccugagaaaccugcccgaguacgcccugcugugccaggagcacgccgccgugcugcugcacagagccuuccuggugggcauguacggccagauggaccccagcgcccagaucagcgaggcccugagaauccugcacauggaggccgugauguaa

SEQ ID NO: 18592 - RNA, 3615 nt, Artificial Sequence
  INTS2__Homo_sapiens__NP_065799
augaaggaccagcagaccgugaucaugaccgagugcaccagccugcaguucgugagccccuucgccuucgaggccaugcagaagguggacguggugugccuggccagccugagcgaccccgagcugagacugcugcugcccugccuggugagaauggcccugugcgcccccgccgaccagagccagagcugggcccaggacaagaagcugauccugagacugcugagcggcguggaggccgugaacagcaucguggcccugcugagcguggacuuccacgcccuggagcaggacgccagcaaggagcagcagcugagacacaagcugggcggcggcagcggcgagagcauccuggugagccagcugcagcacggccugacccuggaguucgagcacagcgacagccccagaagacugagacuggugcugagcgagcugcuggccaucaugaacaaggugagcgagagcaacggcgaguucuucuucaagagcagcgagcuguucgagagccccguguaccuggaggaggccgccgacgugcugugcauccugcaggccgagcugcccagccugcugcccaucguggacguggccgaggcccugcugcacgugagaaacggcgccugguuccugugccugcugguggccaacgugcccgacagcuucaacgaggugugcagaggccugaucaagaacggcgagagacaggacgaggagagccugggcggcagaagaagaaccgacgcccugagauuccugugcaagaugaaccccagccaggcccugaaggugagaggcauggugguggaggagugccaccugcccggccugggcguggcccugacccuggaccacaccaagaacgaggccugcgaggacggcgugagcgaccuggugugcuucgugagcggccugcugcugggcaccaacgccaaggugagaaccugguucggcaccuucaucagaaacggccagcagagaaagagagagaccagcagcagcgugcuguggcagaugagaagacagcugcugcuggagcugaugggcauccugcccaccgugagaagcaccagaaucguggaggaggccgacguggacauggagcccaacgugagcguguacagcggccugaaggaggagcacguggugaaggccagcgcccugcugagacuguacugcgcccugaugggcaucgccggccugaagcccaccgaggaggaggccgagcagcugcugcagcugaugaccagcagaccccccgccacccccgccggcgugagauucgugagccugagcuucugcaugcugcuggccuucagcacccuggugagcacccccgagcaggagcagcugauggugguguggcugagcuggaugaucaaggaggaggccuacuucgagagcaccagcggcgugagcgccagcuucggcgagaugcugcugcugguggccauguacuuccacagcaaccagcugagcgccaucaucgaccuggugugcagcacccugggcaugaagaucgugaucaagcccagcagccugagcagaaugaagaccaucuucacccaggagaucuucaccgagcagguggugaccgcccacgccgugagagugcccgugaccagcaaccugagcgccaacaucaccggcuuccugcccauccacugcaucuaccagcugcugagaagcagaagcuucaccaagcacaaggugagcaucaaggacuggaucuacagacagcugugcgagaccagcaccccccugcacccccagcugcugccccugaucgacguguacaucaacagcauccugacccccgccagcaagagcaaccccgaggccaccaaccagcccgugaccgagcaggagauccugaacaucuuccagggcgugaucggcggcgacaacaucagacugaaccagagauucagcaucaccgcccagcugcuggugcuguacuacauccugagcuacgaggaggcccugcuggccaacaccaagacccuggccgccaugcagagaaagcccaagagcuacagcagcagccugauggaccagauccccaucaaguuccugaucagacaggcccagggccugcagcaggagcugggcggccugcacagcgcccugcugagacugcuggccaccaacuacccccaccugugcaucguggacgacuggaucugcgaggaggagaucaccggcaccgacgcccugcugagaagaaugcugcugaccaacaacgccaagaaccacagccccaagcagcugcaggaggccuucagcgccgugcccgugaaccacacccaggugaugcagaucaucgagcaccugacccugcugagcgccagcgagcugauccccuacgccgaggugcugaccagcaacaugagccagcugcugaacagcggcgugcccagaagaauccugcagaccgugaacaagcuguggauggugcugaacaccgugaugcccagaagacugugggugaugaccgugaacgcccugcagcccagcaucaaguucgugagacagcagaaguacacccagaacgaccugaugaucgacccccugaucgugcugagaugcgaccagagagugcacagaugccccccccugauggacaucacccugcacaugcugaacggcuaccugcuggccagcaaggccuaccugagcgcccaccugaaggagaccgagcaggacagacccagccagaacaacaccaucggccuggugggccagaccgacgcccccgaggugaccagagaggagcugaagaacgcccugcuggccgcccaggacagcgccgccgugcagauccugcuggagaucugccugcccaccgaggaggagaaggccaacggcgugaaccccgacagccugcugagaaacgugcagagcgugaucaccaccagcgcccccaacaagggcauggaggagggcgaggacaaccugcugugcaaccugagagaggugcagugccugaucugcugccugcugcaccagauguacaucgccgaccccaacaucgccaagcuggugcacuuccagggcuaccccugcgagcugcugccccugaccguggccggcauccccagcaugcacaucugccuggacuucauccccgagcugaucgcccagcccgagcuggagaagcagaucuucgccauccagcugcugagccaccugugcauccaguacgcccugcccaagagccugagcguggccagacuggccgugaacgugaugggcacccugcugaccgugcugacccaggccaagagauacgccuucuucaugcccacccugcccagccuggugagcuucugcagagccuuccccccccuguacgaggacaucaugagccugcugauccagaucggccaggugugcgccagcgacguggccacccagaccagagacaucgaccccaucaucaccagacugcagcagaucaaggagaagcccagcggcuggagccagaucugcaaggacagcagcuacaagaacggcagcagagacaccggcagcauggaccccgacgugcagcugugccacugcaucgagagaaccgugaucgagaucaucaacaugagcgugagcggcaucuaa

SEQ ID NO: 18593 - RNA, 3129 nt, Artificial Sequence
  INTS3__Homo_sapiens__NP_075391
auggagcugcagaagggcaagggcgccgccgccgccgccgccgccagcggcgccgccggcggcggcggcggcggcgccggcgccggcgcccccggcggcggcagacugcugcugagcaccagccuggacgccaaggacgagcuggaggagagacuggagagaugcaugagcaucgugaccagcaugaccgccggcgugagcgagagagaggccaacgacgcccugaacgccuacgugugcaagggccugccccagcacgaggagaucugccugggccuguucacccugauccugaccgagcccgcccaggcccagaagugcuacagagaccuggcccuggugagcagagacggcaugaacaucgugcugaacaagaucaaccagauccugauggagaaguaccugaagcugcaggacaccugcagaacccagcugguguggcuggugagagagcuggugaagagcggcgugcugggcgccgacggcgugugcaugaccuucaugaagcagaucgccggcggcgacgugaccgccaagaacaucuggcuggccgagagcgugcuggacauccugaccgagcagagagagugggugcugaagagcagcauccugaucgccauggccguguacaccuaccugagacugaucguggaccaccacggcaccgcccagcugcaggcccugagacagaaggagguggacuucugcaucagccugcugagagagagauucauggagugccugaugaucggcagagaccuggugagacugcugcagaacguggccagaauccccgaguucgagcugcuguggaaggacaucauccacaacccccaggcccugagcccccaguucaccggcauccugcagcugcugcagagcagaaccagcagaaaguuccuggccugcagacugacccccgacauggagaccaagcugcuguucaugaccagcagagugagauucggccagcagaagagauaccaggacugguuccagagacaguaccugagcacccccgacagccagagccugagaugcgaccugaucagauacaucugcggcguggugcaccccagcaacgaggugcugagcagcgacauccugcccagaugggccaucaucggcuggcugcugaccaccugcaccagcaacguggccgccagcaacgccaagcuggcccuguucuacgacuggcuguucuucagccccgacaaggacagcaucaugaacaucgagcccgccauccuggugaugcaccacagcaugaagccccaccccgccaucaccgccacccugcuggacuucaugugcagaaucauccccaacuucuaccccccccuggagggccacgugagacagggcguguucagcagccugaaccacaucguggagaagagagugcuggcccaccuggccccccuguucgacaaccccaagcuggacaaggagcugagagccaugcugagagagaaguuccccgaguucugcagcagccccagcccccccguggaggugaagaucgaggagcccgugagcauggagauggacaaccacaugagcgacaaggacgagagcugcuacgacaacgccgaggccgccuucagcgacgacgaggaggaccugaacagcaagggcaagaagagagaguucagauuccaccccaucaaggagaccgugguggaggagcccguggacaucacccccuaccuggaccagcuggacgagagccugagagacaaggugcugcagcugcagaagggcagcgacaccgaggcccagugcgaggugaugcaggagaucguggaccaggugcuggaggaggacuucgacagcgagcagcugagcgugcuggccagcugccugcaggagcuguucaaggcccacuucagaggcgaggugcugcccgaggagaucaccgaggagagccuggaggagagcgugggcaagccccuguaccugaucuucagaaaccugugccagaugcaggaggacaacagcagcuucagccugcugcuggaccugcugagcgagcuguaccagaagcagcccaagaucggcuaccaccugcuguacuaccugagagccagcaaggccgccgccggcaagaugaaccuguacgagagcuucgcccaggccacccagcugggcgaccugcacaccugccugaugauggacaugaaggccugccaggaggacgacgugagacugcugugccaccugacccccagcaucuacaccgaguuccccgacgagacccugagaagcggcgagcugcugaacaugaucguggccgugaucgacagcgcccagcugcaggagcuggugugccacgugaugaugggcaaccuggugauguucagaaaggacagcgugcugaacauccugauccagagccuggacugggagaccuucgagcaguacugcgccuggcagcuguuccuggcccacaacaucccccuggagaccaucauccccauccugcagcaccugaaguacaaggagcaccccgaggcccugagcugccugcugcugcagcugagaagagagaagcccagcgaggagauggugaagauggugcugagcagacccugccaccccgacgaccaguucaccaccagcauccugagacacuggugcaugaagcacgacgagcugcuggccgagcacaucaagagccugcugaucaagaacaacagccugcccagaaagagacagagccugagaagcagcagcagcaagcuggcccagcugacccuggagcagauccuggagcaccuggacaaccugagacugaaccugaccaacaccaagcagaacuucuucagccagacccccauccugcaggcccugcagcacgugcaggccagcugcgacgaggcccacaagaugaaguucagcgaccuguucagccuggccgaggaguacgaggacagcagcaccaagccccccaagagcagaagaaaggccgcccugagcagccccagaagcagaaagaacgccacccagccccccaacgccgaggaggagagcggcagcagcagcgccagcgaggaggaggacaccaagcccaagcccaccaagagaaagagaaagggcagcagcgccgugggcagcgacagcgacuaa

SEQ ID NO: 18594 - RNA, 2892 nt, Artificial Sequence
  INTS4__Homo_sapiens__NP_291025
auggccgcccaccugaagaagagaguguacgaggaguucaccaagguggugcagccccaggaggagaucgccaccaagaagcugagacugaccaagcccagcaagagcgccgcccugcacaucgaccugugcaaggccaccagccccgccgacgcccugcaguaccugcugcaguucgccagaaagcccguggaggccgagagcguggagggcguggugagaauccugcuggagcacuacuacaaggagaacgaccccagcgugagacugaagaucgccagccugcugggccugcugagcaagaccgccggcuucagccccgacugcaucauggacgacgccaucaacauccugcagaacgagaagagccaccaggugcuggcccagcugcuggacacccugcuggccaucggcaccaagcugcccgagaaccaggccauccagaugagacugguggacguggccugcaagcaccugaccgacaccagccacggcgugagaaacaagugccugcagcugcugggcaaccugggcagccuggagaagagcgugaccaaggacgccgagggccuggccgccagagacgugcagaagaucaucggcgacuacuucagcgaccaggaccccagagugagaaccgccgccaucaaggccaugcugcagcugcacgagagaggccugaagcugcaccagaccaucuacaaccaggccugcaagcugcugagcgacgacuacgagcaggugagaagcgccgccgugcagcugaucuggguggugagccagcuguaccccgagagcaucgugcccauccccagcagcaacgaggagaucagacugguggacgacgccuucggcaagaucugccacauggugagcgacggcagcuggguggugagagugcaggccgccaagcugcugggcagcauggagcaggugagcagccacuuccuggagcagacccuggacaagaagcugaugagcgaccugagaagaaagagaaccgcccacgagagagccaaggagcuguacagcagcggcgaguucagcagcggcagaaaguggggcgacgacgcccccaaggaggagguggacaccggcgccgugaaccugaucgagagcggcgccugcggcgccuucgugcacggccuggaggacgagauguacgaggugagaaucgccgccguggaggcccugugcaugcuggcccagagcagccccagcuucgccgagaagugccuggacuuccugguggacauguucaacgacgagaucgaggaggugagacugcagagcauccacaccaugagaaagaucagcaacaacaucacccugagagaggaccagcuggacaccgugcuggccgugcuggaggacagcagcagagacaucagagaggcccugcacgagcugcugugcugcaccaacgugagcaccaaggagggcauccaccuggcccugguggagcugcugaagaaccugaccaaguaccccaccgacagagacagcaucuggaagugccugaaguuccugggcagcagacaccccacccuggugcugccccuggugcccgagcugcugagcacccaccccuucuucgacaccgccgagcccgacauggacgaccccgccuacaucgccgugcuggugcugaucuucaacgccgccaagaccugccccaccaugcccgcccuguucagcgaccacaccuucagacacuacgccuaccugagagacagccugagccaccuggugcccgcccugagacugcccggcagaaagcuggugagcagcgccgugagccccagcaucaucccccaggaggaccccagccagcaguuccugcagcagagccuggagagaguguacagccugcagcaccuggacccccagggcgcccaggagcugcuggaguucaccaucagagaccugcagagacugggcgagcugcagagcgagcuggccggcguggccgacuucagcgccaccuaccugagaugccagcugcugcugaucaaggcccugcaggagaagcuguggaacguggccgccccccuguaccugaagcagagcgaccuggccagcgccgccgccaagcagaucauggaggagaccuacaagauggaguucauguacagcggcguggagaacaagcagguggugaucauccaccacaugagacugcaggccaaggcccugcagcugaucgugaccgccagaaccaccagaggccuggacccccuguucggcaugugcgagaaguuccugcaggagguggacuucuuccagagauacuucaucgccgaccugccccaccugcaggacagcuucguggacaagcugcuggaccugaugcccagacugaugaccagcaagcccgccgagguggugaagauccugcagaccaugcugagacagagcgccuuccugcaccugccccugcccgagcagauccacaaggccagcgccaccaucaucgagcccgccggcgagagcgacaacccccugagauucaccagcggccuggugguggcccuggacguggacgccacccuggagcacgugcaggacccccagaacaccgugaaggugcaggugcuguaccccgacggccaggcccagaugauccaccccaagcccgccgacuucagaaaccccggccccggcagacacagacugaucacccagguguaccugagccacaccgccuggaccgaggccugccagguggaggugagacugcugcuggccuacaacagcagcgccagaauccccaagugccccuggauggagggcggcgagaugagcccccagguggagaccagcaucgagggcaccauccccuucagcaagcccgugaagguguacaucaugcccaagcccgccagaagauaa

SEQ ID NO: 18595 - RNA, 3060 nt, Artificial Sequence
  INTS5__Homo_sapiens__NP_085131
augagcgcccugugcgacccccccggcgcccccggcccccccggccccgcccccgccacccacggccccgccccccugagcgcccaggagcugagccaggagaucaaggccuuccugaccggcguggaccccauccugggccaccagcugagcgccagagagcacgccagaugcggccugcugcugcugagaagccugccccccgccagagccgccgugcuggaccaccugagaggcguguucgacgagagcgugagagcccaccuggccgcccuggacgagacccccguggccggccccccccaccugagaccccccccccccagccacgugcccgccggcggccccggccuggaggacguggugcaggaggugcagcaggugcugagcgaguucaucagagccaaccccaaggccugggcccccgugaucagcgccuggagcaucgaccugaugggccagcugagcagcaccuacagcggccagcaccagagagugccccacgccaccggcgcccugaacgagcugcugcagcuguggaugggcugcagagccaccagaacccugauggacaucuacgugcagugccugagcgcccugaucggcagcugccccgacgccugcguggacgcccugcuggacaccagcgugcagcacagcccccacuucgacugggugguggcccacaucggcagcagcuuccccggcaccaucaucagcagagugcugagcugcggccugaaggacuucugcgugcacggcggcgccggcggcggcgccggcagcagcggcggcagcagcagccagacccccagcaccgaccccuuccccggcagccccgccauccccgccgagaagagagugcccaagaucgccagcguggugggcauccugggccaccuggccagcagacacggcgacagcaucagaagagagcugcugagaauguuccacgacagccuggccggcggcagcggcggcagaagcggcgaccccagccugcaggccaccgugcccuuccugcugcagcuggccgugaugagccccgcccugcugggcaccgugagcggcgagcugguggacugccugaagccccccgccgugcugagccagcugcagcagcaccugcagggcuuccccagagaggagcuggacaacaugcugaaccuggccgugcaccuggugagccaggccagcggcgccggcgccuacagacugcugcaguuccugguggacaccgccaugcccgccagcgugaucaccacccagggccuggccgugcccgacaccgugagagaggccugcgacagacugauccagcugcugcugcugcaccugcagaagcuggugcaccacagaggcggcagccccggcgagggcgugcugggccccccccccccccccagacuggugcccuuccuggacgcccugaagaaccacgugggcgagcugugcggcgagacccugagacuggagagaaagagauuccuguggcagcaccagcugcugggccugcugagcguguacaccagacccagcugcggccccgaggcccugggccaccugcugagcagagccagaagccccgaggagcugagccuggccacccagcuguacgccggccugguggugagccugagcggccugcugccccuggccuucagaagcugccuggccagagugcacgccggcacccugcagccccccuucaccgccagauuccugagaaaccuggcccugcuggugggcugggagcagcagggcggcgagggccccgccgcccugggcgcccacuucggcgagagcgccagcgcccaccugagcgaccuggccccccugcugcugcaccccgaggaggagguggccgaggccgccgccagccugcuggccaucugccccuuccccagcgaggcccugagccccagccagcugcugggccuggugagagccggcgugcacagauucuucgccagccugagacugcacggcccccccggcguggccagcgccugccagcugcugaccagacugagccagaccagccccgccggccugaaggccgugcugcagcugcugguggagggcgcccugcacagaggcaacaccgagcuguucggcggccagguggacggcgacaacgagacccugagcguggugagcgccagccuggccagcgccagccugcuggacaccaacagaagacacaccgccgccgugcccggccccggcggcaucuggagcguguuccacgccggcgugaucggcagaggccugaagccccccaaguucgugcagagcagaaaccagcaggaggugaucuacaacacccagagccugcugagccugcuggugcacugcugcagcgcccccggcggcaccgagugcggcgagugcuggggcgcccccauccugagccccgaggccgccaaggccguggccgugacccugguggagagcgugugccccgacgccgccggcgccgagcuggccuggccccccgaggagcacgccagagccaccguggagagagaccugagaaucggcagaagauucagagagcagccccugcuguucgagcugcugaagcugguggccgccgccccccccgcccugugcuacugcagcgugcugcugagaggccugcuggccgcccugcugggccacugggaggccagcagacaccccgacaccacccacagccccuggcaccuggaggccagcugcacccugguggccgugauggccgagggcagccugcugccccccgcccugggcaacaugcacgagguguucagccagcuggcccccuucgaggugagacugcugcugcugagcguguggggcuuccugagagagcacggcccccugccccagaaguucaucuuccagagcgagagaggcagauucaucagagacuucagcagagagggcggcggcgagggcggcccccaccuggccgugcugcacagcgugcugcacagaaacaucgacagacugggccuguucagcggcagauuccaggcccccagccccagcacccugcugagacagggcaccuaa

SEQ ID NO: 18596 - RNA, 2625 nt, Artificial Sequence
  INTS6__Homo_sapiens__NP_001035026
augaaccagagaagccaccugggcaccaccuaccuggacaccgccaagggcgccguggagaccuucaugaagcugagagccagagaccccgccagcagaggcgacagauacaugcuggugaccuucgaggagccccccuacgccaucaaggccggcuggaaggagaaccacgccaccuucaugaacgagcugaagaaccugcaggccgagggccugaccacccugggccagagccugagaaccgccuucgaccugcugaaccugaacagacuggugaccggcaucgacaacuacggccagggcagaaaccccuucuuccuggagcccgccaucaucaucaccaucaccgacggcagcaagcugaccaccaccagcggcgugcaggacgagcugcaccugccccugaacagcccccugcccggcagcgagcugaccaaggagcccuucagaugggaccagagacuguucgcccuggugcugagacugcccggcaccaugagcguggagagcgagcagcugaccggcgugccccuggacgacagcgccaucacccccaugugcgaggugaccggcggcagaagcuacagcgugugcagccccagaaugcugaaccagugccuggagagccuggugcagaaggugcagagcggcguggugaucaacuucgagaaggccggccccgaccccagccccguggaggacggccagcccgacaucagcagacccuucggcagccagcccuggcacagcugccacaagcugaucuacgugagacccaaccccaagaccggcgugcccaucggccacuggcccgugcccgagagcuucuggcccgaccagaacagccccacccugccccccagaaccagccaccccguggugaaguucagcugcaccgacugcgagcccauggugaucgacaagcugcccuucgacaaguacgagcuggagcccagcccccugacccaguucauccuggagagaaagagcccccagaccugcuggcagguguacgugagcaacagcgccaaguacagcgagcugggccaccccuucggcuaccugaaggccagcaccgcccugaacugcgugaaccuguucgugaugcccuacaacuaccccgugcugcugccccugcuggacgaccuguucaaggugcacaaggccaagcccacccugaaguggagacagagcuucgagagcuaccugaagaccaugccccccuacuaccugggcccccugaagaaggccgugagaaugaugggcgcccccaaccugaucgccgacagcauggaguacggccugagcuacagcgugaucagcuaccugaagaagcugagccagcaggccaagaucgagagcgacagagugaucggcagcgugggcaagaagguggugcaggagaccggcaucaaggugagaagcagaagccacggccugagcauggccuacagaaaggacuuccagcagcugcugcagggcaucagcgaggacgugccccacagacugcuggaccugaacaugaaggaguacaccggcuuccagguggcccugcugaacaaggaccugaagccccagaccuucagaaacgccuacgacauccccagaagaaaccugcuggaccaccugaccagaaugagaagcaaccugcugaagagcaccagaagauuccugaagggccaggacgaggaccaggugcacagcgugcccaucgcccagaugggcaacuaccaggaguaccugaagcaggugcccagcccccugagagagcuggaccccgaccagcccagaagacugcacaccuucggcaaccccuucaagcuggacaagaagggcaugaugaucgacgaggccgacgaguucguggccggcccccagaacaagcacaagagacccggcgagcccaacaugcagggcauccccaagagaagaagaugcaugagcccccugcugagaggcagacagcagaaccccguggugaacaaccacaucggcggcaagggcccccccgcccccaccacccaggcccagcccgaccugaucaagccccugccccugcacaagaucagcgagaccaccaacgacagcaucauccacgacgugguggagaaccacguggccgaccagcugagcagcgacaucacccccaacgccauggacaccgaguucagcgccagcagccccgccagccugcuggagagacccaccaaccacauggaggcccugggccacgaccaccugggcaccaacgaccugaccgugggcggcuuccuggagaaccacgaggagcccagagacaaggagcagugcgccgaggagaacauccccgccagcagccugaacaagggcaagaagcugaugcacugcagaagccacgaggaggugaacaccgagcugaaggcccagaucaugaaggagaucagaaagcccggcagaaaguacgagagaaucuucacccugcugaagcacgugcagggcagccugcagaccagacugaucuuccugcagaacgugaucaaggaggccagcagauucaagaagagaaugcugaucgagcagcuggagaacuuccuggacgagauccacagaagagccaaccagaucaaccacaucaacagcaacuaa

SEQ ID NO: 18597 - RNA, 2742 nt, Artificial Sequence
  INTS7__Homo_sapiens__NP_001186738
auggccagcaacagcaccaagagcuuccuggccgacgccggcuacggcgagcaggagcuggacgccaacagcgcccugauggagcuggacaagggccugagaagcggcaagcugggcgagcagugcgaggccguggugagauuccccagacuguuccagaaguaccccuuccccauccugaucaacagcgccuuccugaagcuggccgacguguucagagugggcaugcugggcagccuggccagcaucauccccgagagaaagaacgcccaccacagcaucagacagagccuggacagccacgacaacguggagguggaggccgccguguucgccgccgccaacuucagcgcccagagcaaggacuucgccgugggcaucugcaacaagaucagcgagaugauccagggccuggccacccccguggaccugaagcugaagcugauccccauccugcagcacaugcaccacgacgccauccuggccagcagcgccagacagcugcugcagcagcuggugaccagcuaccccagcaccaagauggugaucgugagccugcacaccuucacccugcuggccgccagcagccugguggacacccccaagcagauccagcugcugcugcaguaccugaagaacgaccccagaaaggccgugaagagacuggccauccaggaccugaagcugcuggccaacaagaccccccacaccuggagcagagagaacauccaggcccugugcgagugcgcccugcagacccccuacgacagccugaagcugggcaugcugagcgugcugagcacccugagcggcaccaucgccaucaagcacuacuucagcaucgugcccggcaacgugagcagcagccccagaagcagcgaccuggugaagcuggcccaggagugcugcuaccacaacaacagaggcaucgccgcccacggcgugagagugcugaccaacaucaccgugagcugccaggagaaggaccugcuggcccuggagcaggacgccguguucggccuggagagccugcuggugcugugcagccaggacgacagccccggcgcccaggccacccugaagaucgcccugaacugcauggugaagcuggccaagggcagaccccaccugagccagagcgugguggagacccugcugacccagcugcacagcgcccaggacgccgccagaauccugaugugccacugccuggccgccaucgccaugcagcugcccgugcugggcgacggcaugcugggcgaccugauggagcuguacaaggugaucggcagaagcgccaccgacaagcagcaggagcugcuggugagccuggccaccgugaucuucguggccagccagaaggcccugagcguggagagcaaggccgugaucaagcagcagcuggagagcgugagcaacggcuggaccguguacagaaucgccagacaggccagcagaaugggcaaccacgacauggccaaggagcuguaccagagccugcugacccagguggccagcgagcacuucuacuucuggcugaacagccugaaggaguucagccacgccgagcagugccugaccggccugcaggaggagaacuacagcagcgcccugagcugcaucgccgagagccugaaguucuaccacaagggcaucgccagccugaccgccgccagcaccccccugaacccccugagcuuccagugcgaguucgugaagcugagaaucgaccugcugcaggccuucagccagcugaucugcaccugcaacagccugaagaccagccccccccccgccaucgccaccaccaucgccaugacccugggcaacgaccugcagagaugcggcagaaucagcaaccagaugaagcagagcauggaggaguucagaagccuggccagcagauacggcgaccuguaccaggccagcuucgacgccgacagcgccacccugagaaacguggagcugcagcagcagagcugccugcugaucagccacgccaucgaggcccugauccuggaccccgagagcgccagcuuccaggaguacggcagcaccggcaccgcccacgccgacagcgaguacgagagaagaaugaugagcguguacaaccacgugcuggaggagguggagagccugaacagaaaguacacccccgugagcuacaugcacaccgccugccugugcaacgccaucaucgcccugcugaaggugccccugagcuuccagagauacuucuuccagaagcugcagagcaccagcaucaagcuggcccugagccccagccccagaaaccccgccgagcccaucgccgugcagaacaaccagcagcuggcccugaagguggagggcguggugcagcacggcagcaagcccggccuguucagaaagauccagagcgugugccugaacgugagcagcacccugcagagcaagagcggccaggacuacaagauccccaucgacaacaugaccaacgagauggagcagagaguggagccccacaacgacuacuucagcacccaguuccugcugaacuucgccauccugggcacccacaacaucaccguggagagcagcgugaaggacgccaacggcaucguguggaagaccggccccagaaccaccaucuucgugaagagccuggaggaccccuacagccagcagaucagacugcagcagcagcaggcccagcagccccugcagcagcagcagcagagaaacgccuacaccagauucuaa

SEQ ID NO: 18598 - RNA, 2988 nt, Artificial Sequence
  INTS8__Homo_sapiens__NP_060334
augagcgccgaggccgccgacagagaggccgccaccagcagcagacccugcacccccccccagaccugcugguucgaguuccugcuggaggagagccugcuggagaagcaccugagaaagcccugccccgaccccgcccccgugcagcugaucgugcaguuccuggagcaggccagcaagcccagcgugaacgagcagaaccaggugcagcccccccccgacaacaagagaaacagaauccugaagcugcuggcccugaagguggccgcccaccugaagugggaccuggacauccuggagaagagccugagcgugcccgugcugaacaugcugcugaacgagcugcugugcaucagcaaggugccccccggcaccaagcacguggacauggaccuggccacccugccccccaccaccgccauggccgugcugcuguacaacagaugggccaucagaaccaucgugcagagcagcuuccccgugaagcaggccaagcccggccccccccagcugagcgugaugaaccagaugcagcaggagaaggagcugaccgagaacauccugaaggugcugaaggagcaggccgccgacagcauccuggugcuggaggccgcccugaagcugaacaaggaccuguacgugcacaccaugagaacccuggaccugcuggccauggagcccggcauggugaacggcgagaccgagagcagcaccgccggccugaaggugaagaccgaggagaugcagugccaggugugcuacgaccugggcgccgccuacuuccagcagggcagcaccaacagcgccguguacgagaacgccagagagaaguucuucagaaccaaggagcugaucgccgagaucggcagccugagccugcacugcaccaucgacgagaagagacuggccggcuacugccaggccugcgacgugcuggugcccagcagcgacagcaccagccagcagcugacccccuacagccaggugcacaucugccugagaagcggcaacuaccaggaggugauccagaucuucaucgaggacaaccugacccugagccugcccgugcaguucagacagagcgugcugagagagcuguucaagaaggcccagcagggcaacgaggcccuggacgagaucugcuucaaggugugcgccugcaacaccgugagagacauccuggagggcagaaccaucagcgugcaguucaaccagcuguuccugagacccaacaaggagaagaucgacuuccugcuggaggugugcagcagaagcgugaaccuggagaaggccagcgagagccugaagggcaacauggccgccuuccugaagaacgugugccugggccuggaggaccugcaguacguguucaugaucagcagccacgagcuguucaucacccugcugaaggacgaggagagaaagcugcugguggaccagaugagaaagagaagccccagagugaaccugugcaucaagcccgugaccagcuucuacgacauccccgccagcgccagcgugaacaucggccagcuggagcaccagcugauccugagcguggaccccuggagaaucagacagauccugaucgagcugcacggcaugaccagcgagagacaguucuggaccgugagcaacaagugggaggugcccagcguguacagcggcgugauccugggcaucaaggacaaccugaccagagaccugguguacauccugauggccaagggccugcacugcagcaccgugaaggacuucagccacgccaagcagcuguucgccgccugccuggagcuggugaccgaguucagccccaagcugagacaggugaugcugaacgagaugcugcugcuggacauccacacccacgaggccggcaccggccaggccggcgagagaccccccagcgaccugaucagcagagugagaggcuaccuggagaugagacugcccgacaucccccugagacaggugaucgccgaggagugcguggccuucaugcugaacuggagagagaacgaguaccugacccugcaggugcccgccuuccugcugcagagcaaccccuacgugaagcugggccagcugcuggccgccaccugcaaggagcugcccggccccaaggagagcagaagaaccgccaaggaccugugggaggugguggugcagaucugcagcgugagcagccagcacaagagaggcaacgacggcagagugagccugaucaagcagagagagagcacccugggcaucauguacagaagcgagcugcugagcuucaucaagaagcugagagagccccuggugcugaccaucauccugagccuguucgugaagcugcacaacgugagagaggacaucgugaacgacaucaccgccgagcacaucagcaucuggcccagcagcauccccaaccugcagagcguggacuucgaggccguggccaucaccgugaaggagcuggugagauacacccugagcaucaaccccaacaaccacagcuggcugaucauccaggccgacaucuacuucgccaccaaccaguacagcgccgcccugcacuacuaccugcaggccggcgccgugugcagcgacuucuucaacaaggccgugccccccgacguguacaccgaccaggugaucaagagaaugaucaagugcugcagccugcugaacugccacacccagguggccauccugugccaguuccugagagagaucgacuacaagaccgccuucaagagccugcaggagcagaacagccacgacgccauggacagcuacuacgacuacaucugggacgugaccauccuggaguaccugaccuaccugcaccacaagagaggcgagaccgacaagagacagaucgccaucaaggccaucggccagaccgagcugaacgccagcaaccccgaggaggugcugcagcuggccgcccagagaagaaagaagaaguuccugcaggccauggccaagcuguacuucuaa

SEQ ID NO: 18599 - RNA, 2829 nt, Artificial Sequence
  INTU__Homo_sapiens__NP_056508
auggccagcguggccagcugcgacagcagacccagcagcgacgagcugcccggcgaccccagcagccaggaggaggacgaggacuacgacuucgaggacagagugagcgacagcggcagcuacagcagcgccagcagcgacuacgacgaccuggagcccgaguggcuggacagcgugcagaagaacggcgagcuguucuaccuggagcugagcgaggacgaggaggagagccugcugcccgagacccccaccgugaaccacgugagauucagcgagaacgagaucaucaucgaggacgacuacaaggagagaaagaaguacgagcccaagcugaagcaguucaccaagauccugagaagaaagagacugcugcccaagagaugcaacaagaagaacagcaacgacaacggccccgugagcauccugaagcaccagagcaaccagaagaccggcgugaucgugcagcagagauacaaggacgugaacguguacgugaaccccaagaagcugaccgugaucaaggccaaggagcagcugaagcugcuggaggugcuggugggcaucauccaccagaccaaguggagcuggagaagaaccggcaagcagggcgacggcgagagacugguggugcacggccugcugcccggcggcagcgccaugaagagcggccaggugcugaucggcgacgugcugguggccgugaacgacguggacgugaccaccgagaacaucgagagagugcugagcugcauccccggccccaugcaggugaagcugaccuucgagaacgccuacgacgugaagagagagaccagccaccccagacagaagaagacccagagcaacaccagcgaccuggugaagcugcuguggggcgaggagguggagggcauccagcagagcggccugaacaccccccacaucaucauguaccugacccugcagcuggacagcgagaccagcaaggaggagcaggagauccuguaccacuaccccaugagcgaggccagccagaagcugaagagcgugagaggcaucuuccugacccugugcgacaugcuggagaacgugaccggcacccaggugaccagcagcagccugcugcugaacggcaagcagauccacguggccuacuggaaggagagcgacaagcugcugcugaucggccugcccgccgaggaggugccccugcccagacugagaaacaugaucgagaacgugauccagacccugaaguucauguacggcagccuggacagcgccuucugccagaucgagaacgugcccagacuggaccacuucuucaaccuguucuuccagagagcccugcagcccgccaagcugcacagcagcgccagccccagcgcccagcaguacgacgccagcagcgccgugcugcuggacaaccugcccggcgugagauggcugacccugccccuggagaucaagauggagcuggacauggcccugagcgaccuggaggccgccgacuucgccgagcugagcgaggacuacuacgacaugagaagacuguacaccauccugggcagcagccuguucuacaagggcuaccugaucugcagccaccugcccaaggacgaccugaucgacaucgccguguacugcagacacuacugccugcugccccuggccgccaagcagagaaucggccagcugaucaucuggagagagguguucccccagcaccaccugagaccccuggccgacagcagcaccgagguguuccccgagcccgagggcagauacuuccugcugguggugggccugaagcacuacaugcugugcgugcugcuggaggccggcggcugcgccagcaaggccaucggcagccccggccccgacugcguguacguggaccaggugaagaccacccugcaccagcuggacggcguggacagcagaaucgacgagagacuggccagcagccccgugcccugccugagcugcgccgacugguuccugaccggcagcagagagaagaccgacagccugaccaccagccccauccugagcagacugcagggcaccagcaagguggccaccagccccaccugcagaagaacccuguucggcgacuacagccugaagaccagaaagcccagccccagcugcagcagcggcggcagcgacaacggcugcgagggcggcgaggacgacggcuucagcccccacaccacccccgacgccgugagaaagcagagagagagccagggcagcgacggccuggaggagagcggcacccugcugaaggugaccaagaagaagagcacccugcccaaccccuuccaccugggcaaccugaagaaggaccugcccgagaaggagcuggagaucuacaacaccgugaagcugaccagcggccccgagaacacccuguuccacuacguggcccuggagaccgugcagggcaucuucaucacccccacccuggaggagguggcccagcugagcggcagcauccacccccagcugaucaagaacuuccaccagugcugccugagcaucagagccguguuccagcagacccugguggaggagaagaagaagggccugaacagcggcgaccacagcgacagcgccaagagcgugagcagccugaaccccgugaaggagcacggcgugcuguucgagugcagccccggcaacuggaccgaccagaagaaggccccccccgugauggccuacuggguggugggcagacuguuccugcaccccaagccccaggagcuguacgugugcuuccacgacagcgugaccgagaucgccaucgagaucgccuucaagcuguucuucggccugacccuguaa

SEQ ID NO: 18600 - RNA, 3198 nt, Artificial Sequence
  INVS__Homo_sapiens__NP_055240
augaacaagagcgagaaccugcuguucgccggcagcagccuggccagccaggugcacgccgccgccgugaacggcgacaagggcgcccugcagagacugaucgugggcaacagcgcccugaaggacaaggaggaccaguucggcagaaccccccugauguacugcgugcuggccgacagacuggacugcgccgacgcccugcugaaggccggcgccgacgugaacaagaccgaccacagccagagaaccgcccugcaccuggccgcccagaagggcaacuacagauucaugaagcugcugcugaccagaagagccaacuggaugcagaaggaccuggaggagaugaccccccugcaccugaccaccagacacagaagccccaagugccuggcccugcugcugaaguucauggcccccggcgagguggacacccaggacaagaacaagcagaccgcccugcacuggagcgccuacuacaacaaccccgagcacgugaagcugcugaucaagcacgacagcaacaucggcauccccgacguggagggcaagaucccccugcacugggccgccaaccacaaggaccccagcgccgugcacaccgugagaugcauccuggacgccgcccccaccgagagccugcugaacuggcaggacuacgagggcagaaccccccugcacuucgccguggccgacggcaacgugaccgugguggacgugcugaccagcuacgagagcugcaacaucaccagcuacgacaaccuguucagaaccccccugcacugggccgcccugcugggccacgcccagaucgugcaccugcugcuggagagaaacaagagcggcaccauccccagcgacagccagggcgccaccccccugcacuacgccgcccagagcaacuucgccgagaccgugaagguguuccugaagcaccccagcgugaaggacgacagcgaccuggagggcagaaccagcuucaugugggccgccggcaagggcagcgacgacgugcugagaaccaugcugagccugaagagcgacaucgacaucaacauggccgacaaguacggcggcaccgcccugcacgccgccgcccugagcggccacgugagcaccgugaagcugcugcuggagaacaacgcccagguggacgccaccgacgugaugaagcacaccccccuguucagagccugcgagaugggccacaaggacgugauccagacccugaucaagggcggcgccagaguggaccugguggaccaggacggccacagccugcugcacugggccgcccugggcggcaacgccgacgugugccagauccugaucgagaacaagaucaaccccaacgugcaggacuacgccggcagaaccccccugcagugcgccgccuacggcggcuacaucaacugcauggccgugcugauggagaacaacgccgaccccaacauccaggacaaggagggcagaaccgcccugcacuggagcugcaacaacggcuaccuggacgccaucaagcugcugcuggacuucgccgccuuccccaaccagauggagaacaacgaggagagauacaccccccuggacuacgcccugcugggcgagagacacgaggugauccaguucaugcuggagcacggcgcccugagcaucgccgccauccaggacaucgccgccuucaagauccaggccguguacaagggcuacaaggugagaaaggccuucagagacagaaagaaccugcugaugaagcacgagcagcugagaaaggacgccgccgccaagaagagagaggaggagaacaagagaaaggaggccgagcagcagaagggcagaagaagccccgacagcugcagaccccaggcccugcccugccugcccagcacccaggacgugcccagcagacagagcagagcccccagcaagcagccccccgccggcaacguggcccagggccccgagcccagagacagcagaggcagccccggcggcagccugggcggcgcccugcagaaggagcagcacgugagcagcgaccugcagggcaccaacagcagaagacccaacgagaccgccagagagcacagcaagggccagagcgccugcgugcacuucagacccaacgagggcagcgacggcagcagacaccccggcgugcccagcguggagaagagcagaggcgagaccgccggcgacgagagaugcgccaagggcaagggcuucgugaagcagcccagcugcaucagaguggccggccccgacgagaagggcgaggacagcagaagagccgccgccagccugcccccccacgacagccacuggaagcccagcagaagacacgacaccgagcccaaggccaagugcgccccccagaagagaagaacccaggagcugagaggcggcagaugcagccccgccggcagcagcagacccggcagcgccagaggcgaggccgugcacgccggccagaaccccccccaccacagaacccccagaaacaaggugacccaggccaagcugaccggcggccuguacagccaccugccccagagcaccgaggagcugagaagcggcgccagaagacuggagaccagcacccugagcgaggacuuccaggugagcaaggagaccgaccccgcccccggcccccugagcggccagagcgugaacaucgaccugcugcccguggagcugagacugcagaucauccagagagagagaagaagaaaggagcuguucagaaagaagaacaaggccgccgccgugauccagagagccuggagaagcuaccagcugagaaagcaccugagccaccugagacacaugaagcagcugggcgccggcgacguggacagauggagacaggagagcaccgcccugcugcugcagguguggagaaaggagcuggagcugaaguucccccagaccaccgccgugagcaaggcccccaagagccccagcaagggcaccagcggcaccaagagcaccaagcacagcgugcugaagcagaucuacggcugcagccacgagggcaagauccaccaccccaccagaagcgugaaggccagcagcgugcugagacugaacagcgugagcaaccugcagugcauccaccugcuggagaacagcggcagaagcaagaacuucagcuacaaccugcagagcgccacccagcccaagaacaagaccaagcccuaa

SEQ ID NO: 18601 - RNA, 831 nt, Artificial Sequence
  IP6K1__Homo_sapiens__NP_001006115
augcuggacggcaacagcggccugagcagcgagaagaucagccacaaccccuggagccugagaugccacaagcagcagcugagcagaaugagaagcgagagcaaggacagaaagcuguacaaguuccugcugcuggagaacguggugcaccacuucaaguaccccugcgugcuggaccugaagaugggcaccagacagcacggcgacgacgccagcgccgagaaggccgccagacagaugagaaagugcgagcagagcaccagcgccacccugggcgugagagugugcggcaugcagguguaccagcuggacaccggccacuaccugugcagaaacaaguacuacggcagaggccugagcaucgagggcuucagaaacgcccuguaccaguaccugcacaacggccuggaccugagaagagaccuguucgagcccauccugagcaagcugagaggccugaaggccgugcuggagagacaggccagcuacagauucuacagcagcagccugcuggugaucuacgacggcaaggagugcagagccgagagcugccuggacagaagaagcgagaugagacugaagcaccuggacauggugcugcccgagguggccagcagcugcggccccagcaccagccccagcaacaccagccccgaggccggccccagcagccagcccaagguggacgugagaaugaucgacuucgcccacagcaccuucaagggcuucagagacgaccccaccgugcacgacggccccgacagaggcuacguguucggccuggagaaccugaucagcaucauggagcagaugagagacgagaaccaguaa

SEQ ID NO: 18602 - RNA, 294 nt, Artificial Sequence
  IP6K2__Homo_sapiens__NP_001005911
augagccccgccuucagagccauggacguggagcccagagccaagggcgugcugcuggagcccuucgugcaccaggugggcggccacagcugcgugcugagauucaacgagaccacccugugcaagccccuggugcccagagagcaccaguucuacgagacccugcccgccgagaugagaaaguucaccccccaguacaagggccagagccagagaccccuggugagcuggcccagccugccccacuucuuccccuggagcuucccccuguggccccagggcagcguggccuaa

SEQ ID NO: 18603 - RNA, 1233 nt, Artificial Sequence
  IP6K3__Homo_sapiens__NP_001136355
augguggugcagaacagcgccgacgccggcgacaugagagccggcgugcagcuggagcccuuccugcaccaggugggcggccacaugagcgugaugaaguacgacgagcacaccgugugcaagccccuggugagcagagagcagagauucuacgagagccugccccuggccaugaagagauucaccccccaguacaagggcaccgugaccgugcaccuguggaaggacagcaccggccaccugagccugguggccaaccccgugaaggagagccaggagcccuucaaggugagcaccgagagcgccgccguggccaucuggcagacccugcagcagaccaccggcagcaacggcagcgacugcacccuggcccaguggccccacgcccagcuggccagaagccccaaggagagccccgccaaggcccugcugagaagcgagccccaccugaacacccccgccuucagccugguggaggacaccaacggcaaccagguggagagaaagagcuucaaccccuggggccugcagugccaccaggcccaccugaccagacugugcagcgaguaccccgagaacaagagacacagauuccugcugcuggagaacguggugagccaguacacccaccccugcgugcuggaccugaagaugggcaccagacagcacggcgacgacgccagcgaggagaagaaggccagacacaugagaaagugcgcccagagcaccagcgccugccugggcgugagaaucugcggcaugcagguguaccagaccgacaagaaguacuuccugugcaaggacaaguacuacggcagaaagcugagcguggagggcuucagacaggcccuguaccaguuccugcacaacggcagccaccugagaagagagcugcuggagcccauccugcaccagcugagagcccugcugagcgugaucagaagccagagcagcuacagauucuacagcagcagccugcuggugaucuacgacggccaggagccccccgagagagcccccggcagcccccacccccacgaggccccccaggccgcccacggcagcagccccggcggccugaccaagguggacaucagaaugaucgacuucgcccacaccaccuacaagggcuacuggaacgagcacaccaccuacgacggccccgaccccggcuacaucuucggccuggagaaccugaucagaauccugcaggacauccaggagggcgaguaa

SEQ ID NO: 18604 - RNA, 1317 nt, Artificial Sequence
  IPCEF1__Homo_sapiens__XP_005266979
augaccagcuacauggccaucgacggcagcgcccugcaggugccccugagacagaagcccagaagaaagacccagggcuuccugaccaugagcagaagaagaaucagcugcaaggaccugggccacgccgacugccagggcuggcuguacaagaagaaggagaagggcagcuuccugagcaacaaguggaagaaguucugggugauccugaagggcagcagccuguacugguacagcaaccagauggccgagaaggccgacggcuucgugaaccugcccgacuucaccguggagagagccagcgagugcaagaagaagcacgccuucaagaucagccacccccagaucaagaccuucuacuucgccgccgagaacgugcaggagaugaacguguggcugaacaagcugggcagcgccgugauccaccaggagagcaccaccaaggacgaggagugcuacagcgagagcgagcaggaggaccccgagaucgccgccgagacccccccccccccccacgccagccagacccagagccugaccgcccagcaggccagcagcagcagccccagccugagcggcaccagcuacagcuucagcagccuggagaacaccgugaagacccccagcagcuuccccagcagccugagcaaggagagacagagccugcccgacaccgugaacagccugagcgccgccgaggacgagggccagcccaucaccuucgccgugcaggugcacagccccgugcccagcgaggccggcauccacaaggcccuggagaacagcuucgugaccagcgagagcggcuuccugaacagccugagcagcgacgacaccagcagccugagcagcaaccacgaccaccugaccgugcccgacaagcccgccggcagcaagaucauggacaaggaggagaccaaggugagcgaggacgacgagauggagaagcuguacaagagccuggagcaggccagccugagcccccugggcgacagaagacccagcaccaagaaggagcugagaaagagcuucgugaagagaugcaagaaccccagcaucaacgagaagcugcacaagaucagaacccugaacagcacccugaagugcaaggagcacgaccuggccaugaucaaccagcugcuggacgaccccaagcugaccgccagaaaguacagagaguggaaggugaugaacacccugcugauccaggacaucuaccagcagcagagagccagccccgcccccgacgacaccgacgacaccccccaggagcugaagaagagccccagcagccccagcguggagaacagcaucuaa

SEQ ID NO: 18605 - RNA, 1251 nt, Artificial Sequence
  IPMK__Homo_sapiens__NP_689416
auggccaccgagccccccagcccccugagaguggaggcccccggcccccccgagaugagaaccagccccgccaucgagagcacccccgagggcaccccccagcccgccggcggcagacugagauuccugaacggcugcgugccccugagccaccagguggccggccacauguacggcaaggacaaggugggcauccugcagcaccccgacggcaccgugcugaagcagcugcagcccccccccagaggccccagagagcuggaguucuacaacaugguguacgccgccgacugcuucgacggcgugcugcuggagcugagaaaguaccugcccaaguacuacggcaucuggagcccccccaccgcccccaacgaccuguaccugaagcuggaggacgugacccacaaguucaacaagcccugcaucauggacgugaagaucggccagaagagcuacgaccccuucgccagcagcgagaagauccagcagcaggugagcaaguacccccugauggaggagaucggcuuccuggugcugggcaugagaguguaccacgugcacagcgacagcuacgagaccgagaaccagcacuacggcagaagccugaccaaggagaccaucaaggacggcgugagcagauucuuccacaacggcuacugccugagaaaggacgccguggccgccagcauccagaagaucgagaagauccugcagugguucgagaaccagaagcagcugaacuucuacgccagcagccugcuguucguguacgagggcagcagccagcccaccaccaccaagcugaacgacagaacccuggccgagaaguuccugagcaagggccagcugagcgacaccgaggugcuggaguacaacaacaacuuccacgugcugagcagcaccgccaacggcaagaucgagagcagcgugggcaagagccugagcaagauguacgccagacacagaaagaucuacaccaagaagcaccacagccagaccagccugaagguggagaaccuggagcaggacaacggcuggaagagcaugagccaggagcaccugaacggcaacgugcugagccagcuggagaagguguucuaccaccugcccaccggcugccaggagaucgccgagguggaggugagaaugaucgacuucgcccacguguuccccagcaacaccaucgacgagggcuacguguacggccugaagcaccugaucagcgugcugagaagcauccuggacaacuaa

SEQ ID NO: 18606 - RNA, 3048 nt, Artificial Sequence
  IPO11__Homo_sapiens__NP_001128251
auggugcagcccaucauccaccugggcuacgugguguacagccugcuguaccugggcuacaagcccgugcagcacgugaccgcccugaacaccgugagcagcugccacaagauggugagcauggaccugaacagcgccagcaccguggugcugcaggugcugacccaggccaccagccaggacaccgccgugcugaagcccgccgaggagcagcugaagcagugggagacccagcccggcuucuacagcgugcugcugaacaucuucaccaaccacacccuggacaucaacgugagauggcuggccgugcuguacuucaagcacggcaucgacagauacuggagaagaguggccccccacgcccugagcgaggaggagaagaccacccugagagccggccugaucaccaacuucaacgagcccaucaaccagaucgccacccagaucgccgugcugaucgccaagguggccagacuggacugccccagacaguggcccgagcugauccccacccugaucgagagcgugaaggugcaggacgaccugagacagcacagagcccugcugaccuucuaccacgugaccaagacccuggccagcaagagacuggccgccgacagaaagcuguucuacgaccuggccagcggcaucuacaacuucgccugcagccuguggaaccaccacaccgacaccuuccugcaggaggugagcagcggcaacgaggccgccauccugagcagccuggagagaacccugcugagccugaaggugcugagaaagcugaccgugaacggcuucguggagccccacaagaacauggaggugaugggcuuccugcacggcaucuucgagagacugaagcaguuccuggagugcagcagaagcaucggcaccgacaacgugugcagagacagacuggagaagaccaucauccuguucaccaaggugcugcuggacuuccuggaccagcaccccuucagcuucaccccccugauccagagaagccuggaguucagcgugagcuacguguucaccgaggugggcgagggcgugaccuucgagagauucaucgugcagugcaugaaccugaucaagaugaucgugaagaacuacgccuacaagcccagcaagaacuucgaggacagcagccccgagacccuggaggcccacaagaucaagauggccuucuucaccuaccccacccugaccgagaucugcagaagacuggugagccacuacuuccugcugaccgaggaggagcugaccaugugggaggaggaccccgagggcuucaccguggaggagaccggcggcgacagcuggaaguacagccugagacccugcaccgaggugcuguucaucgacaucuuccacgaguacaaccagacccugacccccgugcugcuggagaugaugcagacccugcagggccccaccaacguggaggacaugaacgcccugcugaucaaggacgccguguacaacgccgugggccuggccgccuacgagcuguucgacagcguggacuucgaccagugguucaagaaccagcugcugcccgagcugcaggugauccacaacagauacaagccccugagaagaagagugaucuggcugaucggccaguggaucagcgugaaguucaagagcgaccugagacccaugcuguacgaggccaucugcaaccugcugcaggaccaggaccugguggugagaaucgagaccgccaccacccugaagcugaccguggacgacuucgaguucagaaccgaccaguuccugcccuaccuggagaccauguucacccugcuguuccagcugcugcagcaggugaccgagugcgacaccaagaugcacgugcugcacgugcugagcugcgugaucgagagagugaacaugcagaucagacccuacgugggcugccuggugcaguaccugccccugcuguggaagcagagcgaggagcacaacaugcugagaugcgccauccugaccacccugauccaccuggugcagggccugggcgccgacagcaagaaccuguaccccuuccugcugcccgugauccagcugagcaccgacgugagccagcccccccacguguaccugcuggaggacggccuggagcuguggcuggugacccuggagaacagccccugcaucacccccgagcugcugagaaucuuccagaacaugagcccccugcuggagcugagcagcgagaaccugagaaccugcuucaagaucaucaacggcuacaucuuccugagcagcaccgaguuccugcagaccuacgccgugggccugugccagagcuucugcgagcugcugaaggagaucaccaccgagggccaggugcaggugcugaaggugguggagaacgcccugaaggugaaccccauccugggcccccagauguuccagcccauccugcccuacguguucaagggcaucaucgagggcgagagauaccccguggugaugagcaccuaccugggcgugaugggcagagugcugcugcagaacaccagcuucuucagcagccugcugaacgagauggcccacaaguucaaccaggagauggaccagcugcugggcaacaugaucgagauguggguggacagaauggacaacaucacccagcccgagagaagaaagcugagcgcccuggcccugcugagccugcugcccagcgacaacagcgugauccaggacaaguucugcggcaucaucaacaucagcguggagggccugcacgacgugaugaccgaggaccccgagaccggcaccuacaaggacugcaugcugaugagccaccuggaggagcccaaggugaccgaggacgaggagccccccaccgagcaggacaagagaaagaagaugcuggcccugaaggaccccgugcacaccgugagccugcagcaguucaucuacgagaagcugaaggcccagcaggagaugcugggcgagcagggcuuccagagccugauggagaccguggacaccgagaucgugacccagcugcaggaguuccugcagggcuucuaa

SEQ ID NO: 18607 - RNA, 1989 nt, Artificial Sequence
  IPO13__Homo_sapiens__XP_011540763
auggagaccagccacggcaucugcagaaucgccguggcccugggcgagaaccacagcagagcccugcuggaccagguggagcacuggcagagcuuccuggcccuggugaacaugaucauguucugcaccggcauccccggccacuaccccgugaacgagaccaccagcagccugacccugaccuucugguacacccugcaggacgacauccugagcuucgaggccgagaagcaggccguguaccagcagguguacagacccguguacuuccagcugguggacgugcugcugcacaaggcccaguuccccagcgacgaggaguacggcuucuggagcagcgacgagaaggagcaguucagaaucuacagaguggacaucagcgacacccugauguacguguacgagaugcugggcgccgagcugcugagcaaccuguacgacaagcugggcagacugcugaccagcagcgaggagcccuacagcuggcagcacaccgaggcccugcuguacggcuuccagagcaucgccgagaccaucgacgugaacuacagcgacguggugcccggccugaucggccugauccccagaaucagcaucagcaacgugcagcuggccgacaccgugauguucaccaucggcgcccugagcgaguggcuggccgaccaccccgugaugaucaacagcgugcugccccuggugcugcacgcccugggcaaccccgagcugagcgugagcagcgugagcacccugaagaagaucugcagagagugcaaguacgaccugccccccuacgccgccaacaucguggccgugagccaggacgugcugaugaagcagauccacaagaccagccagugcauguggcugaugcaggcccugggcuuccugcugagcgcccugcagguggaggagauccugaagaaccugcacagccugaucagccccuacauccagcagcuggagaagcuggccgaggagauccccaaccccagcaacaagcuggccaucgugcacauccugggccugcugagcaaccuguucaccacccuggacaucagccaccacgaggacgaccacgagggccccgagcugagaaagcugcccgugccccagggccccaaccccguggugguggugcugcagcagguguuccagcugauccagaaggugcugagcaaguggcugaacgacgcccaggugguggaggccgugugcgccaucuucgagaagagcgugaagacccugcuggacgacuucgcccccauggugccccagcugugcgagaugcugggcagaauguacagcaccaucccccaggccagcgcccuggaccugaccagacagcuggugcacaucuucgcccacgagcccgcccacuucccccccaucgaggcccuguuccugcuggugaccagcgugacccugacccuguuccagcagggccccagagaccaccccgacaucguggacagcuucaugcagcugcuggcccaggcccugaagagaaagcccgaccuguuccugugcgagagacuggacgugaaggccguguuccagugcgccgugcuggcccugaaguuccccgaggcccccaccgugaaggccagcugcggcuucuucaccgagcugcugcccagaugcggcgagguggagagcgugggcaagguggugcaggaggacggcagaaugcugcugaucgccgugcuggaggccaucggcggccaggccagcagaagccugauggacugcuucgccgacauccuguucgcccugaacaagcacugcuucagccugcugagcauguggaucaaggaggcccugcagccccccggcuuccccagcgccagacugagccccgagcagaaggacaccuucagccagcagauccugagagagagagugaacaagagaagagugaaggagauggugaaggaguucacccugcugugcagaggccugcacggcaccgacuacaccgccgacuacuaa

SEQ ID NO: 18608 - RNA, 3117 nt, Artificial Sequence
  IPO7__Homo_sapiens__NP_006382
auggaccccaacaccaucaucgaggcccugagaggcaccauggaccccgcccugagagaggccgccgagagacagcugaacgaggcccacaagagccugaacuucgugagcacccugcugcagaucaccaugagcgagcagcuggaccugcccgugagacaggccggcgugaucuaccugaagaacaugaucacccaguacuggcccgacagagagaccgcccccggcgacaucagccccuacaccauccccgaggaggacagacacugcaucagagagaacaucguggaggccaucauccacagccccgagcugaucagagugcagcugaccaccugcauccaccacaucaucaagcacgacuaccccagcagauggaccgccaucguggacaagaucggcuucuaccugcagagcgacaacagcgccugcuggcugggcauccugcugugccuguaccagcuggugaagaacuacgaguacaagaagcccgaggagagaagcccccugguggccgccaugcagcacuuccugcccgugcugaaggacagauucauccagcugcugagcgaccagagcgaccagagcgugcugauccagaagcagaucuucaagaucuucuacgcccuggugcaguacacccugccccuggagcugaucaaccagcagaaccugaccgaguggaucgagauccugaagaccguggugaacagagacgugcccaacgagacccugcagguggaggaggacgacagacccgagcugcccugguggaagugcaagaagugggcccugcacauccuggccagacuguucgagagauacggcagccccggcaacgugagcaaggaguacaacgaguucgccgagguguuccugaaggccuucgccgugggcgugcagcaggugcugcugaaggugcuguaccaguacaaggagaagcaguacauggcccccagagugcugcagcagacccugaacuacaucaaccagggcgugagccacgcccugaccuggaagaaccugaagccccacauccagggcaucauccaggacgugaucuucccccugaugugcuacaccgacgccgacgaggagcuguggcaggaggaccccuacgaguacaucagaaugaaguucgacguguucgaggacuucaucagccccaccaccgccgcccagacccugcuguucaccgccugcagcaagagaaaggaggugcugcagaagaccaugggcuucugcuaccagauccugaccgagcccaacgccgaccccagaaagaaggacggcgcccugcacaugaucggcagccuggccgagauccugcugaagaagaagaucuacaaggaccagauggaguacaugcugcagaaccacguguucccccuguucagcagcgagcugggcuacaugagagccagagccugcugggugcugcacuacuucugcgaggugaaguucaagagcgaccagaaccugcagaccgcccuggagcugaccagaagaugccugaucgacgacagagagaugcccgugaagguggaggccgccaucgcccugcaggugcugaucagcaaccaggagaaggccaaggaguacaucacccccuucaucagacccgugaugcaggcccugcugcacaucaucagagagaccgagaacgacgaccugaccaacgugauccagaagaugaucugcgaguacagcgaggaggugacccccaucgccguggagaugacccagcaccuggccaugaccuucaaccaggugauccagaccggccccgacgaggagggcagcgacgacaaggccgugaccgccaugggcauccugaacaccaucgacacccugcugagcgugguggaggaccacaaggagaucacccagcagcuggagggcaucugccugcaggugaucggcaccgugcugcagcagcacgugcuggaguucuacgaggagaucuucagccuggcccacagccugaccugccagcaggugagcccccagauguggcagcugcugccccugguguucgagguguuccagcaggacggcuucgacuacuucaccgacaugaugccccugcugcacaacuacgugaccguggacaccgacacccugcugagcgacaccaaguaccuggagaugaucuacagcaugugcaagaaggugcugaccggcguggccggcgaggacgccgagugccacgccgccaagcugcuggaggugaucauccugcagugcaagggcagaggcaucgaccagugcaucccccuguucguggaggccgcccuggagagacugaccagagaggugaagaccagcgagcugagaaccaugugccugcagguggccaucgccgcccuguacuacaacccccaccugcugcugaacacccuggagaaccugagauuccccaacaacguggagcccgugaccaaccacuucaucacccaguggcugaacgacguggacugcuuccugggccugcacgacagaaagaugugcgugcugggccugugcgcccugaucgacauggagcagaucccccaggugcugaaccaggugagcggccagauccugcccgccuucauccugcuguucaacggccugaagagagccuacgccugccacgccgagcacgagaacgacagcgacgacgacgacgaggccgaggacgacgacgagaccgaggagcugggcagcgacgaggacgacaucgacgaggacggccaggaguaccuggagauccuggccaagcaggccggcgaggacggcgacgacgaggacugggaggaggacgacgccgaggagaccgcccuggagggcuacagcaccaucaucgacgacgaggacaaccccguggacgaguaccagaucuucaaggccaucuuccagaccauccagaacagaaaccccgugugguaccaggcccugacccacggccugaacgaggagcagagaaagcagcugcaggacaucgccacccuggccgaccagagaagagccgcccacgagagcaagaugaucgagaagcacggcggcuacaaguucagcgcccccguggugcccagcagcuucaacuucggcggccccgcccccggcaugaacuaa

SEQ ID NO: 18609 - RNA, 2499 nt, Artificial Sequence
  IPO8__Homo_sapiens__NP_001177924
auggagagccugacccugaagggcuacgcccugccccugcagcuggugaacaaccagaccaugaccaccuggauggagaucuucagaaccaucaucgacagaaccgugccccccgagacccugcacaucgacgaggacgacagacccgagcuggugugguggaagugcaagaagugggcccugcacaucguggccagacuguucgagagauacggcagccccggcaacgugaccaaggaguacuucgaguucagcgaguucuuccugaagaccuacgccgugggcauccagcaggugcugcugaagauccuggaccaguacagacagaaggaguacguggcccccagagugcugcagcaggccuucaacuaccugaaccagggcguggugcacagcaucaccuggaagcagaugaagccccacauccagaacaucagcgaggacgugaucuucagcgugaugugcuacaaggacgaggacgaggagcuguggcaggaggaccccuacgaguacaucagaaugaaguucgacaucuucgaggacuacgccagccccaccaccgccgcccagacccugcuguacaccgccgccaagaagagaaaggaggugcugcccaagaugauggccuucugcuaccagauccugaccgaccccaacuucgaccccagaaagaaggacggcgcccugcacgugaucggcagccuggccgagauccugcugaagaagagccuguucaaggaccagauggagcuguuccugcagaaccacguguucccccugcugcugagcaaccugggcuaccugagagccagaagcugcugggugcugcacgccuucagcagccugaaguuccacaacgagcugaaccugagaaacgccguggagcuggccaagaagagccugaucgaggacaaggagaugcccgugaagguggaggccgcccuggcccugcagagccugaucagcaaccagauccaggccaaggaguacaugaagccccacgugagacccaucaugcaggagcugcugcacaucgugagagagaccgagaacgacgacgugaccaacgugauccagaagaugaucugcgaguacagccaggagguggccagcaucgccguggacaugacccagcaccuggccgagaucuucggcaaggugcugcagagcgacgaguacgaggagguggaggacaagaccgugauggccaugggcauccugcacaccaucgacaccauccugaccgugguggaggaccacaaggagaucacccagcagcuggagaacaucugccugagaaucaucgaccuggugcugcagaagcacgugaucgaguucuacgaggagauccugagccuggccuacagccugaccugccacagcaucagcccccagauguggcagcugcugggcauccuguacgagguguuccagcaggacugcuucgaguacuucaccgacaugaugccccugcugcacaacuacgugaccaucgacaccgacacccugcugagcaacgccaagcaccuggagauccuguucaccaugugcagaaaggugcugugcggcgacgccggcgaggacgccgagugccacgccgccaagcugcuggaggugaucauccugcagugcaagggcagaggcaucgaccagugcaucccccuguucgugcagcuggugcuggagagacugaccagaggcgugaagaccagcgagcugagaaccaugugccugcagguggccaucgccgcccuguacuacaaccccgaccugcugcugcacacccuggagagaauccagcugccccacaaccccggccccaucaccgugcaguucaucaaccaguggaugaacgacaccgacugcuuccugggccaccacgacagaaagaugugcaucaucggccugagcauccugcuggagcugcagaacagaccccccgccguggacgccguggugggccagaucgugcccagcauccuguuccuguuccugggccugaagcaggugugcgccaccagacagcuggugaacagagaggacagaagcaaggccgagaaggccgacauggaggagaacgaggagaucagcagcgacgaggaggagaccaacgugaccgcccaggccaugcagagcaacaacggcagaggcgaggacgaggaggaggaggacgacgacugggacgaggaggugcuggaggagaccgcccuggagggcuucagcaccccccuggaccuggacaacagcguggacgaguaccaguucuucacccaggcccugaucaccgugcagagcagagacgccgccugguaccagcugcugauggccccccugagcgaggaccagagaaccgcccugcaggagguguacacccuggccgagcacagaagaaccguggccgaggccaagaagaagaucgagcagcagggcggcuucaccuucgagaacaagggcgugcugagcgccuucaacuucggcaccgugcccagcaacaacuaa

SEQ ID NO: 18610 - RNA, 3126 nt, Artificial Sequence
  IPO9__Homo_sapiens__NP_060555
auggccgccgccgccgccgccggcgccgccagcggccugcccggccccguggcccagggccugaaggaggcccugguggacacccugaccggcauccugagccccgugcaggaggugagagccgccgccgaggagcagaucaaggugcuggaggugaccgaggaguucggcgugcaccuggccgagcugaccguggacccccagggcgcccuggccaucagacagcuggccagcgugauccugaagcaguacguggagacccacuggugcgcccagagcgagaaguucagaccccccgagaccaccgagagagccaagaucgugaucagagagcugcugcccaacggccugagagagagcaucagcaaggugagaagcagcguggccuacgccgugagcgccaucgcccacugggacuggcccgaggccuggccccagcuguucaaccugcugauggagaugcuggugagcggcgaccugaacgccgugcacggcgccaugagagugcugaccgaguucaccagagaggugaccgacacccagaugccccugguggcccccgugauccugcccgagauguacaagaucuucaccauggccgagguguacggcaucagaaccagaagcagagccguggagaucuucaccaccugcgcccacaugaucugcaacauggaggagcuggagaagggcgccgccaaggugcugaucuuccccguggugcagcaguucaccgaggccuucgugcaggcccugcagauccccgacggccccaccagcgacagcggcuucaagauggaggugcugaaggccgugaccgcccuggugaagaacuuccccaagcacauggugagcagcaugcagcagauccugcccaucguguggaacacccugaccgagagcgccgccuucuacgugagaaccgaggugaacuacaccgaggagguggaggaccccguggacagcgacggcgaggugcugggcuucgagaaccugguguucagcaucuucgaguucgugcacgcccugcuggagaacagcaaguucaagagcaccgugaagaaggcccugcccgagcugaucuacuacaucauccuguacaugcagaucaccgaggagcagaucaagguguggaccgccaacccccagcaguucguggaggacgaggacgacgacaccuucagcuacaccgugagaaucgccgcccaggaccugcugcuggccguggccaccgacuuccagaacgagagcgccgccgcccuggccgccgccgccaccagacaccugcaggaggccgagcagaccaagaacagcggcaccgagcacugguggaagauccacgaggccugcaugcuggcccugggcagcgugaaggccaucaucaccgacagcgugaagaacggcagaauccacuucgacaugcacggcuuccugaccaacgugauccuggccgaccugaaccugagcgugagccccuuccugcugggcagagcccugugggccgccagcagauucaccguggccaugagccccgagcugauccagcaguuccugcaggccaccgugagcggccugcacgagacccagccccccagcgugagaaucagcgccgugagagccaucuggggcuacugcgaccagcugaaggugagcgagagcacccacgugcugcagcccuuccugcccagcauccuggacggccugauccaccuggccgcccaguucagcagcgaggugcugaaccuggugauggagacccugugcaucgugugcaccguggaccccgaguucaccgccagcauggagagcaagaucugccccuucaccaucgccaucuuccugaaguacagcaacgaccccgugguggccagccuggcccaggacaucuucaaggagcugagccagaucgaggccugccagggccccaugcagaugagacugauccccacccuggugagcaucaugcaggcccccgccgacaagauccccgccggccugugcgccaccgccaucgacauccugaccaccguggugagaaacaccaagcccccccugagccagcugcugaucugccaggccuuccccgccguggcccagugcacccugcacaccgacgacaacgccaccaugcagaacggcggcgagugccugagagccuacgugagcgugacccuggagcagguggcccaguggcacgacgagcagggccacaacggccugugguacgugaugcagguggugagccagcugcuggaccccagaaccagcgaguucaccgccgccuucgugggcagacuggugagcacccugaucagcaaggccggcagagagcugggcgagaaccuggaccagauccugagagccauccugagcaagaugcagcaggccgagacccugagcgugaugcagagccugaucaugguguucgcccaccuggugcacacccagcuggagccccugcuggaguuccugugcagccugcccggccccaccggcaagcccgcccuggaguucgugauggccgaguggaccagcagacagcaccuguucuacggccaguacgagggcaaggugagcagcguggcccugugcaagcugcugcagcacggcaucaacgccgacgacaagagacugcaggacaucagagugaagggcgaggagaucuacagcauggacgagggcaucagaaccagaagcaagagcgccaagaaccccgagagauggaccaacaucccccugcuggugaagauccugaagcugaucaucaacgagcugagcaacgugauggaggccaacgccgccagacaggccacccccgccgaguggagccaggacgacagcaacgacaugugggaggaccaggaggaggaggaggaggaggaggaggacggccuggccggccagcugcugagcgacauccuggccaccagcaaguacgaggaggacuacuacgaggacgacgaggaggacgaccccgacgcccugaaggacccccuguaccagaucgaccugcaggccuaccugaccgacuuccugugccaguucgcccagcagcccugcuacaucauguucagcggccaccugaacgacaacgagagaagagugcugcagaccaucggcaucuaa

SEQ ID NO: 18611 - RNA, 1797 nt, Artificial Sequence
  IQCB1__Homo_sapiens__NP_001018864
augaagcccaccggcaccgaccccagaauccugagcaucgccgccgagguggccaagagccccgagcagaacgugcccgugauccugcugaagcugaaggagaucaucaacaucaccccccugggcagcagcgagcugaagaagaucaagcaggacaucuacugcuacgaccugauccaguacugccugcuggugcugagccaggacuacagcagaauccagggcggcuggaccaccaucagccagcugacccagauccugagccacugcugcgugggccuggagcccggcgaggacgccgaggaguucuacaacgagcugcugcccagcgccgccgagaacuuccuggugcugggcagacagcugcagaccugcuucaucaacgccgccaaggccgaggagaaggacgagcugcugcacuucuuccagaucgugaccgacagccuguucuggcugcugggcggccacguggagcugauccagaacgugcugcagagcgaccacuuccugcaccugcugcaggccgacaacgugcagaucggcagcgccgugaugaugaugcugcagaacauccugcagaucaacagcggcgaccugcugagaaucggcagaaaggcccuguacagcauccuggacgaggugaucuucaagcuguucagcacccccagccccgugaucagaagcaccgccaccaagcugcugcugcugauggccgagagccaccaggagauccugauccugcugagacagagcaccugcuacaagggccugagaagacugcugagcaagcaggagaccggcaccgaguucagccaggagcugagacagcuggugggccugcugagccccaugguguaccaggagguggaggagcagaagcugcaccaggccgccugccugauccaggccuacuggaagggcuuccagaccagaaagagacugaagaagcugcccagcgccgugaucgcccugcagagaagcuucagaagcaagagaagcaagaugcugcuggagaucaacagacagaaggaggaggaggaccugaagcugcagcugcagcugcagagacagagagccaugagacugagcagagagcugcagcugagcaugcuggagaucgugcaccccggccagguggagaagcacuacagagagauggaggagaagagcgcccugaucauccagaagcacuggagaggcuacagagagagaaagaacuuccaccagcagagacagagccugaucgaguacaaggccgccgugacccugcagagagccgcccugaaguuccuggccaagugcagaaagaagaagaagcuguucgcccccuggagaggccugcaggagcugaccgacgccagaagaguggagcugaagaagagaguggacgacuacgugagaagacaccugggcagccccaugagcgacguggugagcagagagcugcacgcccaggcccaggagagacugcagcacuacuucaugggcagagcccuggaggagagagcccagcagcacagagaggcccugaucgcccagaucagcaccaacguggagcagcugaugaaggcccccagccugaaggaggccgagggcaaggagcccgagcuguuccugagcagaagcagacccguggccgccaaggccaagcaggcccaccugaccacccugaagcacauccaggcccccugguggaagaagcugggcgaggagagcggcgacgagaucgacgugcccaaggacgagcugagcaucgagcuggagaaccuguucaucggcggcaccaagccccccuaa

SEQ ID NO: 18612 - RNA, 1332 nt, Artificial Sequence
  IQCG__Homo_sapiens__NP_001127907
auggaggaggacagccuggaggacagcaaccugccccccaagguguggcacagcgagaugaccgugagcgugaccggcgagccccccagcaccguggaggaggagggcauccccaaggagaccgacaucgagaucauccccgagauccccgagacccuggagccccugagccugcccgacgugcugagaaucagcgccgugcuggaggacaccaccgaccagcugagcauccugaacuacaucaugcccgugcaguacgagggcagacagagcaucugcgugaagagcagagagaugaaccuggagggcaccaaccuggacaagcugcccauggccagcaccaucaccaagauccccagcccccugaucaccgaggagggccccaaccugcccgagaucagacacagaggcagauucgccguggaguucaacaagaugcaggaccugguguucaagaagcccaccagacagaccaucaugaccaccgagacccugaagaagauccagaucgacagacaguucuucagcgacgugaucgccgacaccaucaaggagcugcaggacagcgccaccuacaacagccugcugcaggcccugagcaaggagagagagaacaagaugcacuucuacgacaucaucgccagagaggagaagggcagaaagcagaucaucagccugcagaagcagcugaucaacgugaagaaggaguggcaguucgaggugcagagccagaacgaguacaucgccaaccugaaggaccagcugcaggagaugaaggccaagagcaaccuggagaacagauacaugaagaccaacaccgagcugcagaucgcccagacccagaagaagugcaacagaaccgaggagcugcugguggaggagaucgagaagcugagaaugaagaccgaggaggaggccagaacccacaccgagaucgagauguuccugagaaaggagcagcagaagcuggaggagagacuggaguucuggauggagaaguacgacaaggacaccgagaugaagcagaacgagcugaacgcccugaaggccaccaaggccagcgaccuggcccaccugcaggaccuggccaagaugaucagagaguacgagcaggugaucaucgaggacagaaucgagaaggagagaagcaagaagaaggugaagcaggaccugcuggagcugaagagcgugaucaagcugcaggccugguggagaggcaccaugaucagaagagagaucggcggcuucaagaugcccaaggacaagguggacagcaaggacagcaagggcaagggcaagggcaaggacaagagaagaggcaagaagaaguaa

SEQ ID NO: 18613 - RNA, 3084 nt, Artificial Sequence
  IQCH__Homo_sapiens__NP_001026885
auggcccagaacaccgagaaccacgaccccgugggcagcauccugauccagauccacgaggaccuguaccagcugaaggagaagcugaccaaguucagccccgaggagaagggcgagacccuggacauccagagccuggagaccgccaucaagagaaccgaggugggccugagaauccacaucgagaaguaccugaacguggugaaccagaacgugcugaccaccagcgugaacgacgagagccuguacaccccccaggccagcaaguggcugcugcccaccgugaucgaccagaagagcuucaucuucccccaggagagcgagggcaccuucuggcagccccagagacagcacagcagcagccugcccguguuccccagagccaagaucaaggugagcaagcugaucaagggcagcaacaucagcagccugaccgugcugcccagcagccacugcaccgaccccuacuucacccccauccccgugcugcaggccgacgcccacaagggcauccugagcaugaucgagagaggccugaucccccccaccgccagaaucaccuuccagaacccccccaucacccccagagccgccccccugcacagcuucgacgaggccagaaagauccccaccguggccaccuucaccauccccagagagcccccccccagccccgccgaggugaaguucuuccccaagaagcagagaagcaagggcaagagcagaagaagcagaggccaccacgacagaaaggccaugaaggugaagaccccccugagagcccugaagagccugugggacuacgacuuccugaucuacgacggcgugaucgacaacaccgcccccgacuuccuggccuucaaggagcacuucagccuggccuggggcggcaucuucagccugcuggagcacguggagaaguuccugagaaacuacgccauccccgaggugaagaucaagggcaacaaccugguggcccugcugcccgaguucgagcugaccaacaagcugaccagauacgaccugcugagcgugcuggaggaccccgcccacgugcagaugcugaucaaccugcccggccagagauacaagggccaggacggcaacagcgaggccgccaugaagauccaggccaccuggaagugcuacaaggccagaaaguucuuccuguucuacagacagcagaagugggccagcggcgugaucgccaucgccuggcugcuguacugccacaagaccagacugaagaagauccugaaggagagcagacagagacaccuggagaacuucagaaucagagccaagcaccuggccgccaacuggaacagaaucagaaccagcagaagaaccaucauccacauccccagccugggcuacagccagcccgugagagagcacaucgccgacuucaacacccagcagaacaugcagcugggcagacugugcgacauccuggacgccaacgugaacgugaucuacaucugcagccaccacaugaacgacgagcuggugcuguacuacaagaagauccugagccugcacgccgccgugaagagcggcaaccuggaggacagaagcgaccugcaggacagauucaagaucaucacccccgaggccgugaacaucuuccccaagcaccacaugugccuggccacccaccugauguacagccccaaggccaucaagagaaucaagaaccugaucagaggcaccgaggccuacaucgugagcggccugcugcacagagacgaccuggccguggccgacaugcuggacauccccauccugggcagcgagcccgagcuggcccaccuguacagcaccaagagcggcggcaagagaguguucgacagcgccaacguggccgugccccccggcaucuacgacaucuacagccagcagcagaugaucgagcagcugagccagcugaucaccgaccaccugcagauccagagauggcuguucaagauggacagcgaguucagaggcaacggcaccgccuucugcgacauccccagcuaccugaagugcuacaagugggugcugaaggagagcagcagauacggccuggaggacuggagaaagaagugggcccaggagcccgcccuggugaagaucagcgaggagcuggccggcauccuggcccagcacgcccagcccgugaacgagaagagauuccccaccuggagaaaguuccugcagaccuuccugagccagggcggcgugaucgaggccuucccccccgccgacaacgugaccaaccugaccguggacaugcugaucgagcccaacggcaagaucagcgugcugagcaccggcgaccagcugcacgccgagagccccuucaucagcagcggcaccaccgugccccagaccagcguggacccccaggugcugaccuaccugugccugcagaucggcaaggccugcagaaugagagacguggugggcuacuucagcaucgaccuggugaccuucaucgaccccagcacccuggagcagcaggugugggccaccggccugaaccuggccuacagcgaccagcuggcccugacccagcugacccuguaccugaccaacggccaccuggacugcagccugagcacccuggaggugcccagauucgugcccaaggagagaaagaagaccaagugcaugagcgcccugagcaugcccaugcuggccaccagcagauacgccgugaugaccacccagcugagacacagcaaccugagccugguguuccacuacguguuccugcagaucugcagagcccacggcaucggcuacgaccuggaggagagacagggcaccguguucauccuguacgagcaccugaagagacacaagcugggcaugcugaccaucggcgaggaccugcagggcgugcugaugaccuucgccagacaccuguucaucauccaccaggagaucagcgcccccaacaugcagggcgagaccaacuucaagaccaccaucgccgacaucgagaccauccugagagugaccaaggagaacaagaugagauucgaggaggagcagcagagcaaggacgacaagaaccugagcaagcccaagaaguaa

SEQ ID NO: 18614 - RNA, 480 nt, Artificial Sequence
  IQCJ__Homo_sapiens__NP_001036170
augagacuggaggagcugaagagacugcagaacccccuggagcaggugaacgacggcaaguacagcuucgagaaccaccagcuggccauggacgccgagaacaacaucgagaaguacccccugaaccugcagccccuggagagcaaggugaagaucauccagagagccuggagagaguaccugcagagacaggagccccugggcaagagaagccccagcccccccagcgugagcagcgagaagcugagcagcagcgugagcaugaacaccuucagcgacagcagcacccccuucgccagagcccccgugggcaagauccaccccuacaucagcuggagacugcagagccccggcgacaagcugcccggcggcagaaaggugauccugcuguaccuggaccagcuggccagacccaccggcuucauccacacccugaaggagccccagaucgagagacugggcuuccugacccugcaguaa

SEQ ID NO: 18615 - RNA, 1692 nt, Artificial Sequence
  IQCJ-SCHIP1__Homo_sapiens__NP_001184042
augagacuggaggagcugaagagacugcagaacccccuggagcaggugaacgacggcaaguacagcuucgagaaccaccagcuggccauggacgccgagaacaacaucgagaaguacccccugaaccugcagccccuggagagcaaggugaagaucauccagagagccuggagagaguaccugcagagacaggagccccugggcaagagaagccccagcccccccagcgugagcagcgagaagcugagcagcagcgugagcaugaacaccuucagcgacagcagcacccccgacuacagagaggacggcauggaccugggcagcgacgccggcagcagcagcagcagcagcagagccagcagccagagcaacagcaccaaggugacccccugcagcgagugcaagagcagcagcagccccggcggcagccuggaccuggugagcgcccuggaggacuacgaggagcccuuccccguguaccagaagaaggugaucgacgagugggcccccgaggaggacggcgaggaggaggaggaggaggacgagagagaccagagaggcuacagagacgacagaagccccgccagagagcccggcgacgugagcgccagaaccagaagcggcggcggcggcggcagaagcgccaccaccgccaugcccccccccgugcccaacggcaaccugcaccagcacgacccccaggaccugagacacaacggcaacguggugguggccggcagacccagcugcagcagaggccccagaagagccauccagaagccccagcccgccggcggcagaagaagcggcagaggccccgccgccggcggccugugccugcagccccccgacggcggcaccugcgugcccgaggagccccccgugccccccauggacugggaggcccuggagaagcaccuggccggccugcaguucagagagcaggaggugagaaaccagggccaggccagaaccaacagcaccagcgcccagaagaacgagagagagagcaucagacagaagcuggcccugggcagcuucuucgacgacggccccggcaucuacaccagcugcagcaagagcggcaagcccagccugagcagcagacugcagagcggcaugaaccugcagaucugcuucgugaacgacagcggcagcgacaaggacagcgacgccgacgacagcaagaccgagaccagccuggacaccccccugagccccaugagcaagcagagcagcagcuacagcgacagagacaccaccgaggaggagagcgagagccuggacgacauggacuuccugaccagacagaagaagcugcaggccgaggccaagauggcccuggccauggccaagcccauggccaagaugcagguggagguggagaagcagaacagaaagaagagccccguggccgaccugcugccccacaugccccacaucagcgagugccugaugaagagaagccugaagcccaccgaccugagagacaugaccaucggccagcugcaggugaucgugaacgaccugcacagccagaucgagagccugaacgaggagcuggugcagcugcugcugaucagagacgagcugcacaccgagcaggacgccaugcugguggacaucgaggaccugaccagacacgccgagagccagcagaagcacauggccgagaagaugcccgccaaguaa

SEQ ID NO: 18616 - RNA, 864 nt, Artificial Sequence
  IQCK__Homo_sapiens__NP_694940
auggccgcccccagacagauccccagccacaucgugagacugaagcccagcugcagcaccgacagcagcuucaccagaacccccgugcccaccgugagccuggccagcagagagcugcccgugagcagcuggcaggugaccgagcccagcagcaagaaccugugggagcagaucugcaaggaguacgaggccgagcagccccccuuccccgagggcuacaaggugaagcaggagcccgugaucaccguggcccccguggaggagaugcuguuccacggcuucagcgccgagcacuacuuccccgugagccacuucaccaugaucagcagaacccccugcccccaggacaagagcgagaccaucaaccccaagaccugcagccccaaggaguaccuggagaccuucaucuuccccgugcugcugcccggcauggccagccugcugcaccaggccaagaaggagaagugcuucgagagaaagagaaccaaguucaucgccugcgacuuccugaccgaguggcuguacaaccagaaccccaagagagccggcgagcccuucaccgaguucuucagcauccccuucguggaggagagacugaagcagcaccccagaccccccaucccccugagccugcugcugaccgaggaggaggccgcccuguacauccagagcuucuggagagccugcguggugagaugcgaccccgagauccaggagcugagacaguggcagaagaagcugagagaggccaagcacauccaccagcaggugaagaucuucugggccaagcaggagcagaaggugaagugcaagauggaggacgacgccgugcccgccgccaagaugaagauccccagcagcuaa

SEQ ID NO: 18617 - RNA, 4974 nt, Artificial Sequence
  IQGAP1__Homo_sapiens__NP_003861
augagcgccgccgacgagguggacggccugggcguggccagaccccacuacggcagcgugcuggacaacgagagacugaccgccgaggagauggacgagagaagaagacagaacguggccuacgaguaccugugccaccuggaggaggccaagagauggauggaggccugccugggcgaggaccugccccccaccaccgagcuggaggagggccugagaaacggcguguaccuggccaagcugggcaacuucuucagccccaagguggugagccugaagaagaucuacgacagagagcagaccagauacaaggccaccggccugcacuucagacacaccgacaacgugauccaguggcugaacgccauggacgagaucggccugcccaagaucuucuaccccgagaccaccgacaucuacgacagaaagaacaugcccagaugcaucuacugcauccacgcccugagccuguaccuguucaagcugggccuggccccccagauccaggaccuguacggcaagguggacuucaccgaggaggagaucaacaacaugaagaccgagcuggagaaguacggcauccagaugcccgccuucagcaagaucggcggcauccuggccaacgagcugagcguggacgaggccgcccugcacgccgccgugaucgccaucaacgaggccaucgacagaagaauccccgccgacaccuucgccgcccugaagaaccccaacgccaugcuggugaaccuggaggagccccuggccagcaccuaccaggacauccuguaccaggccaagcaggacaagaugaccaacgccaagaacagaaccgagaacagcgagagagagagagacguguacgaggagcugcugacccaggccgagauccagggcaacaucaacaaggugaacaccuucagcgcccuggccaacaucgaccuggcccuggagcagggcgacgcccuggcccuguucagagcccugcagagccccgcccugggccugagaggccugcagcagcagaacagcgacugguaccugaagcagcugcugagcgacaagcagcagaagagacagagcggccagaccgacccccugcagaaggaggagcugcagagcggcguggacgccgccaacagcgccgcccagcaguaccagagaagacuggccgccguggcccugaucaacgccgccauccagaagggcguggccgagaagaccgugcuggagcugaugaaccccgaggcccagcugccccagguguaccccuucgccgccgaccuguaccagaaggagcuggccacccugcagagacagagccccgagcacaaccugacccaccccgagcugagcguggccguggagaugcugagcagcguggcccugaucaacagagcccuggagagcggcgacgugaacaccguguggaagcagcugagcagcagcgugaccggccugaccaacaucgaggaggagaacugccagagauaccuggacgagcugaugaagcugaaggcccaggcccacgccgagaacaacgaguucaucaccuggaacgacauccaggccugcguggaccacgugaaccugguggugcaggaggagcacgagagaauccuggccaucggccugaucaacgaggcccuggacgagggcgacgcccagaagacccugcaggcccugcagauccccgccgccaagcuggagggcgugcuggccgagguggcccagcacuaccaggacacccugaucagagccaagagagagaaggcccaggagauccaggacgagagcgccgugcuguggcuggacgagauccagggcggcaucuggcagagcaacaaggacacccaggaggcccagaaguucgcccugggcaucuucgccaucaacgaggccguggagagcggcgacgugggcaagacccugagcgcccugagaagccccgacgugggccuguacggcgugauccccgagugcggcgagaccuaccacagcgaccuggccgaggccaagaagaagaagcuggccgugggcgacaacaacagcaagugggugaagcacugggugaagggcggcuacuacuacuaccacaaccuggagacccaggagggcggcugggacgagccccccaacuucgugcagaacagcaugcagcugagcagagaggagauccagagcagcaucagcggcgugaccgccgccuacaacagagagcagcuguggcuggccaacgagggccugaucaccagacugcaggccagaugcagaggcuaccuggugagacaggaguucagaagcagaaugaacuuccugaagaagcagauccccgccaucaccugcauccagagccaguggagaggcuacaagcagaagaaggccuaccaggacagacuggccuaccugagaagccacaaggacgagguggugaagauccagagccuggccagaaugcaccaggccagaaagagauacagagacagacugcaguacuucagagaccacaucaacgacaucaucaagauccaggccuucaucagagccaacaaggccagagacgacuacaagacccugaucaacgccgaggacccccccauggugguggugagaaaguucgugcaccugcuggaccagagcgaccaggacuuccaggaggagcuggaccugaugaagaugagagaggaggugaucacccugaucagaagcaaccagcagcuggagaacgaccugaaccugauggacaucaagaucggccugcuggugaagaacaagaucacccugcaggacguggugagccacagcaagaagcugaccaagaagaacaaggagcagcugagcgacaugaugaugaucaacaagcagaagggcggccugaaggcccugagcaaggagaagagagagaagcuggaggccuaccagcaccuguucuaccugcugcagaccaaccccaccuaccuggccaagcugaucuuccagaugccccagaacaagagcaccaaguucauggacagcgugaucuucacccuguacaacuacgccagcaaccagagagaggaguaccugcugcugagacuguucaagaccgcccugcaggaggagaucaagagcaagguggaccagauccaggagaucgugaccggcaaccccaccgugaucaagaugguggugagcuucaacagaggcgccagaggccagaacgcccugagacagauccuggcccccguggugaaggagaucauggacgacaagagccugaacaucaagaccgaccccguggacaucuacaagagcugggugaaccagauggagagccagaccggcgaggccagcaagcugcccuacgacgugacccccgagcaggcccuggcccacgaggaggugaagaccagacuggacagcagcaucagaaacaugagagccgugaccgacaaguuccugagcgccaucgugagcagcguggacaagauccccuacggcaugagauucaucgccaaggugcugaaggacagccugcacgagaaguuccccgacgccggcgaggacgagcugcugaagaucaucggcaaccugcuguacuacagauacaugaaccccgccaucguggcccccgacgccuucgacaucaucgaccugagcgccggcggccagcugaccaccgaccagagaagaaaccugggcagcaucgccaagaugcugcagcacgccgccagcaacaagauguuccugggcgacaacgcccaccugagcaucaucaacgaguaccugagccagagcuaccagaaguucagaagauucuuccagaccgccugcgacgugcccgagcugcaggacaaguucaacguggacgaguacagcgaccuggugacccugaccaagcccgugaucuacaucagcaucggcgagaucaucaacacccacacccugcugcuggaccaccaggacgccaucgcccccgagcacaacgaccccauccacgagcugcuggacgaccugggcgaggugcccaccaucgagagccugaucggcgagagcagcggcaaccugaacgaccccaacaaggaggcccuggccaagaccgaggugagccugacccugaccaacaaguucgacgugcccggcgacgagaacgccgagauggacgccagaaccauccugcugaacaccaagagacugaucguggacgugaucagauuccagcccggcgagacccugaccgagauccuggagacccccgccaccagcgagcaggaggccgagcaccagagagccaugcagagaagagccaucagagacgccaagacccccgacaagaugaagaagagcaagagcgugaaggaggacagcaaccugacccugcaggagaagaaggagaagauccagaccggccugaagaagcugaccgagcugggcaccguggaccccaagaacaaguaccaggagcugaucaacgacaucgccagagacaucagaaaccagagaagauacagacagagaagaaaggccgagcuggugaagcugcagcagaccuacgccgcccugaacagcaaggccaccuucuacggcgagcagguggacuacuacaagagcuacaucaagaccugccuggacaaccuggccagcaagggcaaggugagcaagaagcccagagagaugaagggcaagaagagcaagaagaucagccugaaguacaccgccgccagacugcacgagaagggcgugcugcuggagaucgaggaccugcaggugaaccaguucaagaacgugaucuucgagaucagccccaccgaggaggugggcgacuucgaggugaaggccaaguucaugggcgugcagauggagaccuucaugcugcacuaccaggaccugcugcagcugcaguacgagggcguggccgugaugaagcuguucgacagagccaaggugaacgugaaccugcugaucuuccugcugaacaagaaguucuacggcaaguaa

SEQ ID NO: 18618 - RNA, 3216 nt, Artificial Sequence
  IQGAP2__Homo_sapiens__NP_001272390
augcacagccugcccggcgugguggccgugggcuacaucaacgaggccaucgacgagggcaacccccugagaacccuggagacccugcugcugcccaccgccaacaucagcgacguggaccccgcccacgcccagcacuaccaggacgugcuguaccacgccaagagccagaagcugggcgacagcgagagcgugagcaaggugcuguggcuggacgagauccagcaggccguggacgacgccaacguggacgaggacagagccaagcagugggugacccuggugguggacgugaaccagugccuggagggcaagaagagcagcgacauccugagcgugcugaagagcagcaccagcaacgccaacgacaucauccccgagugcgccgacaaguacuacgacgcccuggugaaggccaaggagcugaagagcgagagagugagcagcgacggcagcuggcugaagcugaaccugcacaagaaguacgacuacuacuacaacaccgacagcaaggagagcagcugggugacccccgagagcugccuguacaaggagagcuggcugaccggcaaggagaucgaggccuucuggaagggcuacaagcagagaaaggaguacaugcacagaagacagaccuucaucgacaacaccgacagcaucgugaagauccagagcugguucagaauggccaccgccagaaagagcuaccugagcagacugcaguacuucagagaccacaacaacgagaucgugaagauccagagccugcugagagccaacaaggccagagacgacuacaagacccuggugggcagcgagaaccccccccugaccgugaucagaaaguucguguaccugcuggaccagagcgaccuggacuuccaggaggagcuggagguggccagacugagagaggagguggugaccaagaucagagccaaccagcagcuggagaaggaccugaaccugauggacaucaagaucggccugcuggugaagaacagaaucacccuggaggacgugaucagccacagcaagaagcugaacaagaagaagggcggcgagauggagauccugaacaacaccgacaaccagggcaucaagagccugagcaaggagagaagaaagacccuggagaccuaccagcagcuguucuaccugcugcagaccaacccccuguaccuggccaagcugaucuuccagaugccccagaacaagagcaccaaguucauggacaccgugaucuucacccuguacaacuacgccagcaaccagagagaggaguaccugcugcugaagcuguucaagaccgcccuggaggaggagaucaagagcaagguggaccaggugcaggacaucgugaccggcaaccccaccgugaucaagaugguggugagcuucaacagaggcgccagaggccagaacacccugagacagcugcuggcccccguggugaaggagaucaucgacgacaagagccugaucaucaacaccaaccccguggagguguacaaggccugggugaaccagcuggagacccagaccggcgaggccagcaagcugcccuacgacgugaccaccgagcaggcccugaccuaccccgaggugaagaacaagcuggaggccagcaucgagaaccugagaagagugaccgacaaggugcugaacagcaucaucagcagccuggaccugcugcccuacggccugagauacaucgccaaggugcugaagaacagcauccacgagaaguuccccgacgccaccgaggacgagcugcugaagaucgugggcaaccugcuguacuacagauacaugaaccccgccaucguggcccccgacggcuucgacaucaucgacaugaccgccggcggccagaucaacagcgaccagagaagaaaccugggcagcguggccaaggugcugcagcacgccgccagcaacaagcuguucgagggcgagaacgagcaccugagcagcaugaacaacuaccugagcgagaccuaccaggaguucagaaaguacuucaaggaggccugcaacgugcccgagcccgaggagaaguucaacauggacaaguacaccgaccuggugaccgugagcaagcccgugaucuacaucagcaucgaggagaucaucagcacccacagccugcugcuggagcaccaggacgccaucgcccccgagaagaacgaccugcugagcgagcugcugggcagccugggcgaggugcccaccguggagagcuuccugggcgagggcgccguggaccccaacgaccccaacaaggccaacacccugagccagcugagcaagaccgagaucagccuggugcugaccagcaaguacgacaucgaggacggcgaggccaucgacagcagaagccugaugaucaagaccaagaagcugaucaucgacgugaucagaaaccagcccggcaacacccugaccgagauccuggagacccccgccaccgcccagcaggagguggaccacgccaccgacauggugagcagagccaugaucgacagcagaacccccgaggagaugaagcacagccagagcaugaucgaggacgcccagcugccccuggagcagaagaagagaaagauccagagaaaccugagaacccuggagcagaccggccacgugagcagcgagaacaaguaccaggacauccugaacgagaucgccaaggacaucagaaaccagagaaucuacagaaagcugagaaaggccgagcuggccaagcugcagcagacccugaacgcccugaacaagaaggccgccuucuacgaggagcagaucaacuacuacgacaccuacaucaagaccugccuggacaaccugaagagaaagaacaccagaagaagcaucaagcuggacggcaagggcgagcccaagggcgccaagagagccaagcccgugaaguacaccgccgccaagcugcacgagaagggcgugcugcuggacaucgacgaccugcagaccaaccaguucaagaacgugaccuucgacaucaucgccaccgaggacgugggcaucuucgacgugagaagcaaguuccugggcguggagauggagaaggugcagcugaacauccaggaccugcugcagaugcaguacgagggcguggccgugaugaagauguucgacaaggugaaggugaacgugaaccugcugaucuaccugcugaacaagaaguucuacggcaaguaa

SEQ ID NO: 18619 - RNA, 4896 nt, Artificial Sequence
  IQGAP3__Homo_sapiens__NP_839943
auggagagaagagccgccggccccggcugggccgccuacgagagacugaccgccgaggagauggacgagcagagaagacagaacguggccuaccaguaccugugcagacuggaggaggccaagagauggauggaggccugccugaaggaggagcugcccagccccguggagcuggaggagagccugagaaacggcgugcugcuggccaagcugggccacugcuucgcccccagcguggugccccugaagaagaucuacgacguggagcagcugagauaccaggccaccggccugcacuucagacacaccgacaacaucaacuucuggcugagcgccaucgcccacaucggccugcccagcaccuucuuccccgagaccaccgacaucuacgacaagaagaacaugcccagagugguguacugcauccacgcccugagccuguuccuguucagacugggccuggccccccagauccacgaccuguacggcaaggugaaguucaccgccgaggagcugagcaacauggccagcgagcuggccaaguacggccugcagcugcccgccuucagcaagaucggcggcauccuggccaacgagcugagcguggacgaggccgccgugcacgccgccgugcuggccaucaacgaggccguggagagaggcgugguggaggacacccuggccgcccugcagaaccccagcgcccugcuggagaaccugagagagccccuggccgccguguaccaggagaugcuggcccaggccaagauggagaaggccgccaacgccagaaaccacgacgacagagagagccaggacaucuacgaccacuaccugacccaggccgagauccagggcaacaucaaccacgugaacgugcacggcgcccuggaggugguggacgacgcccuggagagacagagccccgaggcccugcugaaggcccugcaggaccccgcccuggcccugagaggcgugagaagagacuucgccgacugguaccuggagcagcugaacagcgacagagagcagaaggcccaggagcugggccugguggagcugcuggagaaggaggaggugcaggccggcguggccgccgccaacaccaagggcgaccaggagcaggccaugcugcacgccgugcagagaaucaacaaggccaucagaagaggcguggccgccgacaccgugaaggagcugaugugccccgaggcccagcugccccccguguaccccguggccagcagcauguaccagcuggagcuggccgugcugcagcagcagcagggcgagcugggccaggaggagcuguucguggccguggagaugcugagcgccguggugcugaucaacagagcccuggaggccagagacgccagcggcuucuggagcagccuggugaaccccgccaccggccuggccgagguggagggcgagaacgcccagagauacuucgacgcccugcugaagcugagacaggagagaggcaugggcgaggacuuccugagcuggaacgaccugcaggccaccgugagccaggugaacgcccagacccaggaggagaccgacagagugcuggccgugagccugaucaacgaggcccuggacaagggcagccccgagaagacccugagcgcccugcugcugcccgccgccggccuggacgacgugagccugcccguggcccccagauaccaccugcugcugguggccgccaagagacagaaggcccaggugaccggcgaccccggcgccgugcuguggcuggaggagaucagacagggcguggugagagccaaccaggacaccaacaccgcccagagaauggcccugggcguggccgccaucaaccaggccaucaaggagggcaaggccgcccagaccgagagagugcugagaaaccccgccguggcccugagaggcguggugcccgacugcgccaacggcuaccagagagcccuggagagcgccauggccaagaagcagagacccgccgacaccgccuucugggugcagcacgacaugaaggacggcaccgccuacuacuuccaccugcagaccuuccagggcaucugggagcagccccccggcugcccccugaacaccagccaccugaccagagaggagauccagagcgccgugaccaaggugaccgccgccuacgacagacagcagcuguggaaggccaacgugggcuucgugauccagcugcaggccagacugagaggcuuccuggugagacagaaguucgccgagcacagccacuuccugagaaccuggcugcccgccgugaucaagauccaggcccacuggagaggcuacagacagagaaagaucuaccuggaguggcugcaguacuucaaggccaaccuggacgccaucaucaagauccaggccugggccagaaugugggccgccagaagacaguaccugagaagacugcacuacuuccagaagaacgugaacagcaucgugaagauccaggccuucuucagagccagaaaggcccaggacgacuacagaauccuggugcacgccccccaccccccccugagcguggugagaagauucgcccaccugcugaaccagagccagcaggacuuccuggccgaggccgagcugcugaagcugcaggaggagguggugagaaagaucagaagcaaccagcagcuggagcaggaccugaacaucauggacaucaagaucggccugcuggugaagaacagaaucacccugcaggagguggugagccacugcaagaagcugaccaagagaaacaaggagcagcugagcgacaugauggugcuggacaagcagaagggccugaagagccugagcaaggagaagagacagaagcuggaggccuaccagcaccuguucuaccugcugcagacccagcccaucuaccuggccaagcugaucuuccagaugccccagaacaagaccaccaaguucauggaggccgugaucuucagccuguacaacuacgccagcagcagaagagaggccuaccugcugcugcagcuguucaagaccgcccugcaggaggagaucaagagcaagguggagcagccccaggacguggugaccggcaaccccaccguggugagacugguggugagauucuacagaaacggcagaggccagagcgcccugcaggagauccugggcaaggugauccaggacgugcuggaggacaaggugcugagcgugcacaccgaccccgugcaccuguacaagaacuggaucaaccagaccgaggcccagaccggccagagaagccaccugcccuacgacgugacccccgagcaggcccugagccaccccgaggugcagagaagacuggacaucgcccugagaaaccugcuggccaugaccgacaaguuccugcuggccaucaccagcagcguggaccagauccccuacggcaugagauacguggccaaggugcugaaggccacccuggccgagaaguuccccgacgccaccgacagcgagguguacaagguggugggcaaccugcuguacuacagauuccugaaccccgccgugguggcccccgacgccuucgacaucguggccauggccgccggcggcgcccuggccgccccccagagacacgcccugggcgccguggcccagcugcugcagcacgccgccgccggcaaggccuucagcggccagagccagcaccugagagugcugaacgacuaccuggaggagacccaccugaaguucagaaaguucauccacagagccugccaggugcccgagcccgaggagagauucgccguggacgaguacagcgacaugguggccguggccaagcccaugguguacaucaccgugggcgagcuggugaacacccacagacugcugcuggagcaccaggacugcaucgcccccgaccaccaggacccccugcacgagcugcuggaggaccugggcgagcugcccaccauccccgaccugaucggcgagagcaucgccgccgacggccacaccgaccugagcaagcuggaggugagccugacccugaccaacaaguucgagggccuggaggccgacgccgacgacagcaacaccagaagccugcugcugagcaccaagcagcugcuggccgacaucauccaguuccaccccggcgacacccugaaggagauccugagccugagcgccagcagagagcaggaggccgcccacaagcagcugaugagcagaagacaggccugcaccgcccagacccccgagccccugagaagacacagaagccugaccgcccacagccugcugccccuggccgagaagcagagaagagugcugagaaaccugagaagacuggaggcccugggccuggugagcgccagaaacggcuaccagggccugguggacgagcuggccaaggacaucagaaaccagcacagacacagacacagaagaaaggccgagcuggugaagcugcaggccacccugcagggccugagcaccaagaccaccuucuacgaggagcagggcgacuacuacagccaguacaucagagccugccuggaccaccuggcccccgacagcaagagcagcggcaagggcaagaagcagcccagccugcacuacaccgccgcccagcugcuggagaagggcgugcugguggagaucgaggaccugcccgccagccacuucagaaacgugaucuucgacaucacccccggcgacgaggccggcaaguucgaggugaacgccaaguuccugggcguggacauggagagauuccagcugcacuaccaggaccugcugcagcugcaguacgagggcguggccgugaugaagcuguucaacaaggccaaggugaacgugaaccugcugaucuuccugcugaacaagaaguuccugagaaaguaa

SEQ ID NO: 18620 - RNA, 3345 nt, Artificial Sequence
  IQSEC1__Homo_sapiens__NP_001127854
auggccugcagaagaagauacuucguggagggcgaggcccccagcagcgagaccggcaccagccuggacagccccagcgccuacccccagggcccccuggugcccggcagcagccugagccccgaccacuacgagcacaccagcgugggcgccuacggccuguacagcggcccccccggccagcagcagagaaccagaagacccaagcugcagcacagcaccagcauccugagaaagcaggccgaggaggaggccaucaagagaagcagaagccugagcgagagcuacgagcugagcagcgaccugcaggacaagcagguggagaugcuggagagaaaguacggcggcagacuggugaccagacacgccgccagaaccauccagaccgccuucagacaguaccagaugaacaagaacuucgagagacugagaagcagcaugagcgagaacagaaugagcagaagaaucgugcugagcaacaugagaaugcaguucagcuucgagggccccgagaaggugcacagcagcuacuucgagggcaagcaggugagcgugaccaacgacggcagccagcugggcgcccuggugagccccgagugcggcgaccugagcgagcccaccacccugaagagccccgcccccagcagcgacuucgccgacgccaucaccgagcuggaggacgccuucagcagacaggugaagagccuggccgagagcaucgacgacgcccugaacugcagaagccugcacaccgaggaggcccccgcccuggacgccgccagagccagagacaccgagccccagaccgcccugcacggcauggaccacagaaagcuggacgagaugaccgccagcuacagcgacgugacccuguacaucgacgaggaggagcugagccccccccugccccugagccaggccggcgacagacccagcagcaccgagagcgaccugagacugagagccggcggcgccgcccccgacuacugggcccuggcccacaaggaggacaaggccgacaccgacaccagcugcagaagcacccccagccuggagagacaggagcagagacugagaguggagcaccugccccugcugaccaucgagccccccagcgacagcagcguggaccugagcgacagaagcgagagaggcagccugaagagacagagcgccuacgagagaagccugggcggccagcagggcagccccaagcacggcccccacagcggcgcccccaagagccugcccagagaggagcccgagcugagacccagaccccccagaccccuggacagccaccuggccaucaacggcagcgccaacagacagagcaagagcgagagcgacuacagcgacggcgacaacgacagcaucaacagcaccagcaacagcaacgacaccaucaacugcagcagcgagagcagcagcagagacagccugagagagcagacccugagcaagcagaccuaccacaaggaggccagaaacagcugggacagccccgccuucagcaacgacgugaucagaaagagacacuacagaaucggccugaaccuguucaacaagaagcccgagaagggcgugcaguaccugaucgagagaggcuucgugcccgacacccccgugggcguggcccacuuccugcugcagagaaagggccugagcagacagaugaucggcgaguuccugggcaacagacagaagcaguucaacagagacgugcuggacugcgugguggacgagauggacuucagcaccauggagcuggacgaggcccugagaaaguuccaggcccacaucagagugcagggcgaggcccagaagguggagagacugaucgaggccuucagccagagauacugcaucugcaaccccggcguggugagacaguucagaaaccccgacaccaucuucauccuggccuucgccaucauccugcugaacaccgacauguacagccccaacgugaagcccgagagaaagaugaagcuggaggacuucaucaagaaccugagaggcguggacgacggcgaggacauccccagagagaugcugaugggcaucuacgagagaaucagaaagagagagcugaagaccaacgaggaccacgugagccaggugcagaagguggagaagcugaucgugggcaagaagcccaucggcagccugcaccccggccugggcugcgugcugagccugccccacagaagacuggugugcuacugcagacuguucgaggugcccgaccccaacaagccccagaagcugggccugcaccagagagagaucuuccuguucaacgaccugcugguggugaccaagaucuuccagaagaagaagaacagcgugaccuacagcuucagacagagcuucagccuguacggcaugcaggugcugcuguucgagaaccaguacuaccccaacggcaucagacugaccagcagcgugcccggcgccgacaucaaggugcugaucaacuucaacgcccccaacccccaggacagaaagaaguucaccgacgaccugagagagagcaucgccgaggugcaggagauggagaagcacagaaucgagagcgagcuggagaagcagaagggcguggugagacccagcaugagccagugcagcagccugaagaaggagagcggcaacggcacccugagcagagccugccuggacgacagcuacgccagcggcgagggccugaagagaagcgcccugagcagcagccugagagaccugagcgaggccggcaagagaggcagaagaagcagcgccggcagccuggagagcaacguggagggcagcaucaucagcagcccccacaugagaagaagagccaccagcaccagagagugccccagcagaccccaccagaccaugcccaacagcagcagccugcugggcagccuguucggcagcaagagaggcaagccccccccccaggcccaccugcccagcgcccccgcccugccccccccccacccccccguggugcugccccaccugcagcacagcguggccggccaccaccugggcccccccgagggccugccccaggccgccaugcacggccaccacacccaguacugccacaugcagaaccccccccccuaccaccaccaccaccaccaccaccccccccagcacauccagcacgcccaccaguaccaccacggcccccacggcggccaccccgccuacggcgcccacgcccacggccaccccccccugcccagcgcccacgugggccacaccgugcaccaccacggccagccccccgccccccccccccccaccagcagcaaggccaagcccagcggcaucagcaccaucguguaa

SEQ ID NO: 18621 - RNA, 4467 nt, Artificial Sequence
  IQSEC2__Homo_sapiens__NP_001104595
auggaggccggcagcggcccccccggcggccccggcagcgagagccccaacagagccguggaguaccugcuggagcugaacaacaucaucgagagccagcagcagcugcuggagacccagagaagaagaaucgaggagcuggagggccagcuggaccagcugacccaggagaacagagaccugagagaggagagccagcugcacagaggcgagcugcacagagacccccacggcgccagagacagccccggcagagagagccaguaccagaaccugagagagacccaguuccaccacagagagcugagagagagccaguuccaccaggccgccagagacgugggcuaccccaacagagagggcgccuaccagaacagagaggccguguacagagacaaggagagagacgccagcuacccccugcaggacaccaccggcuacaccgccagagagagagacguggcccagugccaccugcaccacgagaaccccgcccugggcagagagagaggcggcagagaggccggccccgcccaccccggcagagagaaggaggccggcuacagcgccgccgugggcgugggccccagaccccccagagagagaggccagcugagcagaggcgccagcagaagcagcagccccggcgccggcggcggccacagcaccagcaccagcaccagccccgccaccacccugcagagaaagagcgacggcgagaacagcagaaccgugagcguggagggcgacgcccccggcagcgaccugagcaccgccguggacagccccggcagccagccccccuacagacugagccagcugccccccagcagcagccacaugggcggcccccccgccggcgugggccugcccugggcccagagagccagacugcagcccgccagcguggcccugagaaagcaggaggaggaggagaucaagagaagcaaggcccugagcgacagcuacgagcugagcaccgaccugcaggacaagaagguggagaugcuggagagaaaguacggcggcagcuuccugagcagaagagccgccagaaccauccagaccgccuucagacaguacagaaugaacaagaacuucgagagacugagaagcagcgccagcgagagcagaaugagcagaagaaucauccugagcaacaugagaaugcaguucagcuucgaggaguacgagaaggcccagaaccccgccuacuucgagggcaagcccgccagccuggacgagggcgccauggccggcgccagaagccacagacuggagagaggccugcccuacggcggcagcugcggcggcggcaucgacggcggcggcagcagcgugaccaccagcggcgaguucagcaacgacaucaccgagcuggaggacagcuucagcaagcaggugaagagccuggccgagagcaucgacgaggcccugaacugccaccccagcggccccaugagcgaggagcccggcagcgcccagcuggagaagagagagagcaaggagcagcaggaggacagcagcgccaccagcuucagcgaccugccccuguaccuggacgacaccgugccccagcagagccccgagagacugcccagcaccgagccccccccccagggcagacccgaguucugggcccccgccccccugccccccgugcccccccccgugcccagcggcaccagagaggacggcagcagagaggagggcaccagaagaggccccggcugccuggagugcagagacuucagacugagagccgcccaccugccccugcugaccaucgagccccccagcgacagcagcguggaccugagcgacagaagcgacagaggcagcgugcacagacagcugguguacgaggccgacggcugcagcccccacggcacccugaagcacaagggcccccccggcagagcccccaucccccacagacacuaccccgcccccgagggccccgcccccgccccccccggcccccugccccccgcccccaacagcggcaccggccccagcggcguggccggcggcagaagacugggcaagugcgaggccgccggcgagaacagcgacggcggcgacaacgagagccuggagagcagcagcaacagcaacgagaccaucaacugcagcagcggcagcagcagcagagacagccugagagagccccccgccaccggccugugcaagcagaccuaccagagagagaccagacacagcugggacagccccgccuucaacaacgacguggugcagagaagacacuacagaaucggccugaaccuguucaacaagaagcccgagaagggcauccaguaccugaucgagagaggcuuccugagcgacacccccgugggcguggcccacuucauccuggagagaaagggccugagcagacagaugaucggcgaguuccugggcaacagacagaagcaguucaacagagacgugcuggacugcgugguggacgagauggacuucagcagcauggaccuggacgacgcccugagaaaguuccagagccacaucagagugcagggcgaggcccagaagguggagagacugaucgaggccuucagccagagauacugcgugugcaaccccgcccuggugagacaguucagaaaccccgacaccaucuucauccuggccuucgccaucauccugcugaacaccgacauguacagccccagcgugaaggccgagagaaagaugaagcuggacgacuucaucaagaaccugagaggcguggacaacggcgaggacauccccagagaccugcuggugggcaucuaccagagaauccagggcagagagcugagaaccaacgacgaccacgugagccaggugcaggccguggagagaaugaucgugggcaagaagcccgugcugagccugccccacagaagacuggugugcugcugccagcuguacgaggugcccgaccccaacagaccccagagacugggccugcaccagagagagguguuccuguucaacgaccugcugguggugaccaagaucuuccagaagaagaagauccuggugaccuacagcuucagacagagcuucccccugguggagaugcacaugcagcuguuccagaacagcuacuaccaguucggcaucaagcugcugagcgccgugcccggcggcgagagaaaggugcugaucaucuucaacgcccccagccugcaggacagacugagauucaccagcgaccugagagagagcaucgccgaggugcaggagauggagaaguacagaguggagagcgagcuggagaagcagaagggcaugaugagacccaacgccagccagcccggcggcgccaaggacagcgugaacggcaccauggccagaagcagccuggaggacaccuacggcgccggcgacggccugaagagaggcgcccugagcagcagccugagagaccugagcgacgccggcaagagaggcagaagaaacagcgugggcagccuggacagcaccaucgagggcagcgugaucagcagccccagaccccaccagagaaugcccccccccccccccccccccccccccgaggaguacaagagccagagacccgugagcaacagcagcagcuuccugggcagccuguucggcagcaagagaggcaagggccccuuccagaugccccccccccccaccggccaggccagcgccagcagcagcagcgccagcagcacccaccaccaccaccaccaccaccaccacggccacagccacggcggccugggcgugcugcccgacggccagagcaagcugcaggcccugcacgcccaguacugccagggccccggccccgcccccccccccuaccugcccccccagcagcccagccugcccccccccccccagcagccccccccccugccccagcugggcagcaucccccccccccccgccagcgccccccccgugggcccccacagacacuuccacgcccacggccccgugcccggcccccagcacuacacccugggcagacccggcagagcccccagaagaggcgccggcggccacccccaguucgccccccacggcagacacccccugcaccagcccaccagcccccugccccuguacagccccgccccccagcacccccccgcccacaagcagggccccaagcacuucaucuucagccaccacccccagaugaugcccgccgccggcgccgccggcggccccggcagcagaccccccggcggcagcuacagccacccccaccacccccagagcccccugagcccccacagccccauccccccccaccccagcuaccccccccugcccccccccagcccccacaccccccacagcccccugccccccaccagcccccacggcccccugcacgccagcggcccccccggcaccgccaacccccccagcgccaaccccaaggccaagcccagcagaaucagcaccgugguguaa

SEQ ID NO: 18622 - RNA, 3549 nt, Artificial Sequence
  IQSEC3__Homo_sapiens__NP_001164209
auggagagccugcuggagaaccccgugagagccgugcuguaccugaaggagcugaccgccaucgugcagaaccagcagagccugauccacacccagagagagagaaucgacgagcuggagagaagacuggacgagcugagcgccgagaacagaagccugugggagcaccagcagcugcugcaggcccagcccccccccggccuggugccccccagcagcgccccccugcccgccgcccccgccaccgcccccgccgccgccgccagagcccaggagccccugcaggaccagggccagagaagcgccgccgccccccaccccgcccccgacagaccccccagacagcaccacggccagcugcuggagcagccccagagaggccccggcagcagagcccacaccccccagagcccccacaagcaccugggcacccagggcgccgugaccgacaaggagaaggagagaccccccagcugcugcgccgccgccggcgcccugcugcagcacaagagccccagcgcccugggcaagggcgugcugagcagaagacccgagaacgagaccgugcugcaccaguucugcugccccgccgccgacgccugcagcgaccuggccagccagagcgacggcagcugcacccaggccggcggcggcauggaggacagcgugguggccgccgccgccguggccgccggcagacccagcgcccacgcccccaaggcccaggcccaggagcugcaggaggaggaggagagacccggcgccggcgccgccagccccagagccggcccccagcacaaggccagccccggcagacagcagcccgcccuggccaccgcccugugcccccacgcccccgccgccagcgacuacgagcugagccuggaccugaagaacaagcagaucgagaugcuggagcacaaguacggcggccaccuggugagcagaagagccgccugcaccauccagaccgccuucagacaguaccagcugagcaagaacuucgagaagaucagaaacagccugcuggagagcagacugcccagaagaaucagccugagaaaggugagaagccccaccgccgagagccuggccgccgagaaggcccugauggagggcuacggccuggugggccugccccuggugagaagccccagccugccccccaccuucgccggcacccugaccgagcuggaggacagcuucaccgagcaggugcagagccuggccaagagcaucgacgacgcccugagcaccuggagccugaagaccaugugcagccugagagagagcggcgccuaccagcugcaccaggcccugcaggccgccgccggcccccccggccuggaggccgagggcagagcccccgagagcgccggccccggccccggcgacgacgccgccgagacccccggccugccccccgcccacagcggcacccugaugauggccuucagagacgugaccgugcagaucgccaaccagaacaucagcgugagcagcagcaccgcccugagcguggccaacugccugggcgcccagaccgugcaggcccccgccgagcccgccgccggcaaggccgagcagggcgagaccagcggcagagaggcccccgaggcccccgccgugggcagagaggacgccagcgccgaggacagcugcgccgaggccgccgccagcggcgccgccgacggcgccaccgcccccaagaccgaggaggaggaggaggaggaggagaccgccgaggugggcagaggcgccgaggccgaggccggcgaccuggagcagcugagcagcagcagcaccagcaccaagagcgccaagagcggcagcgaggccagcgccagcgccagcaaggacgcccugcaggccaugauccugagccugcccagauaccacugcgagaaccccgccagcugcaagagccccacccugagcaccgacacccugagaaagagacuguacagaaucggccugaaccuguucaacaucaaccccgacaagggcauccaguuccugaucagcagaggcuucauccccgacacccccaucggcguggcccacuuccugcugcagagaaagggccugagcagacagaugaucggcgaguuccugggcaacagcaagaagcaguucaacagagacgugcuggacugcgugguggacgagauggacuucagcagcauggagcuggacgaggcccugagaaaguuccaggcccacaucagagugcagggcgaggcccagaagguggagagacugaucgaggccuucagccagagauacugcaugugcaaccccgagguggugcagcaguuccacaaccccgacaccaucuucauccuggccuucgccaucauccugcugaacaccgacauguacagccccaacaucaagcccgacagaaagaugaugcuggaggacuucaucagaaaccugagaggcguggacgacggcgccgacauccccagagagcugguggugggcaucuacgagagaauccagcagaaggagcugaagagcaacgaggaccacgugaccuacgugaccaagguggagaagagcaucgugggcaugaagaccgugcugagcgugccccacagaagacuggugugcugcagcagacuguucgaggugaccgacgugaacaagcugcagaagcaggccgcccaccagagagagguguuccuguucaacgaccugcuggugauccugaagcugugccccaagaagaagagcagcagcaccuacaccuucugcaagagcgugggccugcugggcaugcaguuccagcuguucgagaacgaguacuacagccacggcaucacccuggugaccccccugagcggcagcgagaagaagcaggugcugcacuucugcgcccugggcagcgacgagaugcagaaguucguggaggaccugaaggagagcaucgccgaggugaccgagcuggagcagaucagaaucgagugggagcuggagaagcagcagggcaccaagacccugagcuucaagcccugcggcgcccagggcgacccccagagcaagcagggcagccccaccgccaagagagaggccgcccugagagagagacccgccgagagcaccguggaggugagcauccacaacagacugcagaccagccagcacaacagcggccugggcgccgagagaggcgcccccgugcccccccccgaccugcagcccagcccccccagacagcagacccccccccugcccccccccccccccaccccccccggcacccuggugcagugccagcagaucgugaaggugaucgugcuggacaagcccugccuggccagaauggagccccugcugagccaggcccugagcugcuacaccagcagcagcagcgacagcugcggcagcaccccccugggcggccccggcagccccgugaaggugacccaccagcccccccugccccccccccccccccccuacaaccacccccaccaguucugcccccccggcagccugcugcacggccacagauacagcagcggcagcagaagccugguguaa

SEQ ID NO: 18623 - RNA, 783 nt, Artificial Sequence
  IRAK1BP1__Homo_sapiens__NP_001010844
augagccugcagaagaccccccccaccagaguguucguggagcuggugcccugggccgacagaagcagagagaacaaccuggccagcggcagagagacccugcccggccugagacacccccugagcagcacccaggcccagaccgccaccagagaggugcaggugagcggcaccagcgaggugagcgccggccccgacagagcccaggugguggugagagugagcagcaccaaggaggccgccgccgaggccaagaagagcgugugcagaagacuggacuacaucacccagagccugcagcagcagggcgugcaggccgagaacaucaccgugaccaaggacuucagaagaguggagaacgccuaccacauggaggccgaggugugcaucaccuucaccgaguucggcaagaugcagaacaucugcaacuuccugguggagaagcuggacagcagcguggugaucagccccccccaguucuaccacacccccggcagcguggagaaccugagaagacaggccugccugguggccguggagaacgccuggagaaaggcccaggaggugugcaaccuggugggccagacccugggcaagccccugcugaucaaggaggaggagaccaaggagugggagggccagaucgacgaccaccagagcagcagacugagcagcagccugaccgugcagcagaagaucaagagcgccaccauccacgccgccagcaagguguucaucaccuucgaggugaagggcaaggagaagagaaagaagcaccuguaa

SEQ ID NO: 18624 - RNA, 2049 nt, Artificial Sequence
  IRAK1__Homo_sapiens__NP_001020413
auggccggcggccccggccccggcgagcccgccgcccccggcgcccagcacuuccuguacgaggugccccccugggugaugugcagauucuacaaggugauggacgcccuggagcccgccgacuggugccaguucgccgcccugaucgugagagaccagaccgagcugagacugugcgagagaagcggccagagaaccgccagcgugcuguggcccuggaucaacagaaacgccagaguggccgaccuggugcacauccugacccaccugcagcugcugagagccagagacaucaucaccgccuggcacccccccgccccccugcccagccccggcaccaccgcccccagacccagcagcauccccgcccccgccgaggccgaggccuggagccccagaaagcugcccagcagcgccagcaccuuccugagccccgccuuccccggcagccagacccacagcggccccgagcugggccuggugcccagccccgccagccuguggccccccccccccagccccgcccccagcagcaccaagcccggccccgagagcagcgugagccugcugcagggcgccagacccuuccccuucugcuggccccugugcgagaucagcagaggcacccacaacuucagcgaggagcugaagaucggcgagggcggcuucggcugcguguacagagccgugaugagaaacaccguguacgccgugaagagacugaaggagaacgccgaccuggaguggaccgccgugaagcagagcuuccugaccgagguggagcagcugagcagauucagacaccccaacaucguggacuucgccggcuacugcgcccagaacggcuucuacugccugguguacggcuuccugcccaacggcagccuggaggacagacugcacugccagacccaggccugccccccccugagcuggccccagagacuggacauccugcugggcaccgccagagccauccaguuccugcaccaggacagccccagccugauccacggcgacaucaagagcagcaacgugcugcuggacgagagacugacccccaagcugggcgacuucggccuggccagauucagcagauucgccggcagcagccccagccagagcagcaugguggccagaacccagaccgugagaggcacccuggccuaccugcccgaggaguacaucaagaccggcagacuggccguggacaccgacaccuucagcuucggcgugguggugcuggagacccuggccggccagagagccgugaagacccacggcgccagaaccaaguaccugaaggaccugguggaggaggaggccgaggaggccggcguggcccugagaagcacccagagcacccugcaggccggccuggccgccgacgccugggccgcccccaucgccaugcagaucuacaagaagcaccuggaccccagacccggccccugcccccccgagcugggccugggccugggccagcuggccugcugcugccugcacagaagagccaagagaagaccccccaugacccaggagaacagcuacgugagcagcaccggcagagcccacagcggcgccgcccccuggcagccccuggccgcccccagcggcgccagcgcccaggccgccgagcagcugcagagaggccccaaccagcccguggagagcgacgagagccugggcggccugagcgccgcccugagaagcuggcaccugacccccagcugcccccuggaccccgccccccugagagaggccggcugcccccagggcgacaccgccggcgagagcagcuggggcagcggccccggcagcagacccaccgccguggagggccuggcccugggcagcagcgccagcagcagcagcgagcccccccagaucaucaucaaccccgccagacagaagauggugcagaagcuggcccuguacgaggacggcgcccuggacagccugcagcugcugagcagcagcagccugcccggccugggccuggagcaggacagacagggccccgaggagagcgacgaguuccagagcuaa

SEQ ID NO: 18625 - RNA, 1878 nt, Artificial Sequence
  IRAK2__Homo_sapiens__NP_001561
auggccugcuacaucuaccagcugcccagcugggugcuggacgaccugugcagaaacauggacgcccugagcgagugggacuggauggaguucgccagcuacgugaucaccgaccugacccagcugagaaagaucaagagcauggagagagugcagggcgugagcaucaccagagagcugcuguggugguggggcaugagacaggccaccgugcagcagcugguggaccugcugugcagacuggagcuguacagagccgcccagaucauccugaacuggaagcccgcccccgagaucagaugccccauccccgccuuccccgacagcgugaagcccgagaagccccuggccgccagcgugagaaaggccgaggacgagcaggaggagggccagcccgugagaauggccaccuuccccggccccggcagcagccccgccagagcccaccagcccgccuuccugcagccccccgaggaggacgccccccacagccugagaagcgaccugcccaccagcagcgacagcaaggacuucagcaccagcauccccaagcaggagaagcugcugagccuggccggcgacagccuguucuggagcgaggccgacguggugcaggccaccgacgacuucaaccagaacagaaagaucagccagggcaccuucgccgacguguacagaggccacagacacggcaagcccuucguguucaagaagcugagagagaccgccugcagcagccccggcagcaucgagagauucuuccaggccgagcugcagaucugccugagaugcugccaccccaacgugcugcccgugcugggcuucugcgccgccagacaguuccacagcuucaucuaccccuacauggccaacggcagccugcaggacagacugcagggccagggcggcagcgacccccugcccuggccccagagagugagcaucugcagcggccugcugugcgccguggaguaccugcacggccuggagaucauccacagcaacgugaagagcagcaacgugcugcuggaccagaaccugacccccaagcuggcccaccccauggcccaccugugccccgugaacaagagaagcaaguacaccaugaugaagacccaccugcugagaaccagcgccgccuaccugcccgaggacuucaucagagugggccagcugaccaagagaguggacaucuucagcugcggcaucgugcuggccgaggugcugaccggcauccccgccauggacaacaacagaagccccguguaccugaaggaccugcugcugagcgacauccccagcagcaccgccagccugugcagcagaaagaccggcguggagaacgugauggccaaggagaucugccagaaguaccuggagaagggcgccggcagacugcccgaggacugcgccgaggcccuggccaccgccgccugccugugccugagaagaagaaacaccagccugcaggaggugugcggcagcguggccgccguggaggagagacugagaggcagagagacccugcugcccuggagcggccugagcgagggcaccggcagcagcagcaacacccccgaggagaccgacgacguggacaacagcagccuggacgccagcagcagcaugagcguggcccccugggccggcgccgccaccccccugcugcccaccgagaacggcgagggcagacugagagugaucgugggcagagaggccgacagcagcagcgaggccugcgugggccuggagcccccccaggacgugaccgagaccagcuggcagaucgagaucaacgaggccaagagaaagcugauggagaacauccugcuguacaaggaggagaagguggacagcaucgagcuguucggccccuaa

SEQ ID NO: 18626 - RNA, 1608 nt, Artificial Sequence
  IRAK3__Homo_sapiens__NP_001135995
auggccggcaacugcggcgccagaggcgcccugagcgcccacacccugcuguucgaccugccccccgcccugcugggcgagcugugcgccgugcuggacagcugcgacggcgcccugggcuggagaggccugggcgccgugcugagccccagcgagaagagcuaccaggagggcggcuuccccaacauccuguucaaggagaccgccaacgugaccguggacaacgugcugauccccgagcacaacgagaagggcauccugcugaagagcagcaucagcuuccagaacaucaucgagggcaccagaaacuuccacaaggacuuccugaucggcgagggcgagaucuucgagguguacagaguggagauccagaaccugaccuacgccgugaagcuguucaagcaggagaagaagaugcagugcaagaagcacuggaagagauuccugagcgagcuggaggugcugcugcuguuccaccaccccaacauccuggagcuggccgccuacuucaccgagaccgagaaguucugccugaucuaccccuacaugagaaacggcacccuguucgacagacugcagugcgugggcgacaccgccccccugcccuggcacaucagaaucggcauccugaucggcaucagcaaggccauccacuaccugcacaacgugcagcccugcagcgugaucugcggcagcaucagcagcgccaacauccugcuggacgaccaguuccagcccaagcugaccgacuucgccauggcccacuucagaagccaccuggagcaccagagcugcaccaucaacaugaccagcagcagcagcaagcaccugugguacaugcccgaggaguacaucagacagggcaagcugagcaucaagaccgacguguacagcuucggcaucgugaucauggaggugcugaccggcugcagaguggugcuggacgaccccaagcacauccagcugagagaccugcugagagagcugauggagaagagaggccuggacagcugccugagcuuccuggacaagaaggugccccccugccccagaaacuucagcgccaagcuguucugccuggccggcagaugcgccgccaccagagccaagcugagacccagcauggacgaggugcugaacacccuggagagcacccaggccagccuguacuucgccgaggacccccccaccagccugaagagcuucagaugccccagcccccuguuccuggagaacgugcccagcauccccguggaggacgacgagagccagaacaacaaccugcugcccagcgacgagggccugagaaucgacagaaugacccagaagacccccuucgagugcagccagagcgaggugauguuccugagccuggacaagaagcccgagagcaagagaaacgaggaggccugcaacaugcccagcagcagcugcgaggagagcugguuccccaaguacaucgugcccagccaggaccugagacccuacaaggugaacaucgaccccagcagcgaggcccccggccacagcugcagaagcagacccguggagagcagcugcagcagcaaguucagcugggacgaguacgagcaguacaagaaggaguaa

SEQ ID NO: 18627 - RNA, 1011 nt, Artificial Sequence
  IRAK4__Homo_sapiens__NP_001138728
augcccuucugcgacaaggacagaacccugaugacccccgugcagaaccuggagcagagcuacaugccccccgacagcagcagccccgagaacaagagccuggaggugagcgacaccagauuccacagcuucagcuucuacgagcugaagaacgugaccaacaacuucgacgagagacccaucagcgugggcggcaacaagaugggcgagggcggcuucggcgugguguacaagggcuacgugaacaacaccaccguggccgugaagaagcuggccgccaugguggacaucaccaccgaggagcugaagcagcaguucgaccaggagaucaaggugauggccaagugccagcacgagaaccugguggagcugcugggcuucagcagcgacggcgacgaccugugccugguguacguguacaugcccaacggcagccugcuggacagacugagcugccuggacggcacccccccccugagcuggcacaugagaugcaagaucgcccagggcgccgccaacggcaucaacuuccugcacgagaaccaccacauccacagagacaucaagagcgccaacauccugcuggacgaggccuucaccgccaagaucagcgacuucggccuggccagagccagcgagaaguucgcccagaccgugaugaccagcagaaucgugggcaccaccgccuacauggcccccgaggcccugagaggcgagaucacccccaagagcgacaucuacagcuucggcguggugcugcuggagaucaucaccggccugcccgccguggacgagcacagagagccccagcugcugcuggacaucaaggaggagaucgaggacgaggagaagaccaucgaggacuacaucgacaagaagaugaacgacgccgacagcaccagcguggaggccauguacagcguggccagccagugccugcacgagaagaagaacaagagacccgacaucaagaaggugcagcagcugcugcaggagaugaccgccagcuaa

SEQ ID NO: 18628 - RNA, 2892 nt, Artificial Sequence
  IREB2__Homo_sapiens__NP_004127
auggacgcccccaaggccggcuacgccuucgaguaccugaucgagacccugaacgacagcagccacaagaaguucuucgacgugagcaagcugggcaccaaguacgacgugcugcccuacagcaucagagugcugcuggaggccgccgugagaaacugcgacggcuuccugaugaagaaggaggacgugaugaacauccuggacuggaagaccaagcagagcaacguggaggugcccuucuuccccgccagagugcugcugcaggacuucaccggcauccccgccaugguggacuucgccgccaugagagaggccgugaagacccugggcggcgaccccgagaaggugcaccccgccugccccaccgaccugaccguggaccacagccugcagaucgacuucagcaagugcgccauccagaacgcccccaaccccggcggcggcgaccugcagaaggccggcaagcugagcccccugaaggugcagcccaagaagcugcccugcagaggccagaccaccugcagaggcagcugcgacagcggcgagcugggcagaaacagcggcaccuucagcagccagaucgagaacacccccauccugugccccuuccaccugcagcccgugcccgagcccgagaccgugcugaagaaccaggagguggaguucggcagaaacagagagagacugcaguucuucaaguggagcagcagaguguucaagaacguggccgugaucccccccggcaccggcauggcccaccagaucaaccuggaguaccugagcagagugguguucgaggagaaggaccugcuguuccccgacagcguggugggcaccgacagccacaucaccauggugaacggccugggcauccugggcuggggcgugggcggcaucgagaccgaggccgugaugcugggccugcccgugagccugacccugcccgagguggugggcugcgagcugaccggcagcagcaaccccuucgugaccagcaucgacguggugcugggcaucaccaagcaccugagacaggugggcguggccggcaaguucguggaguucuucggcagcggcgugagccagcugagcaucguggacagaaccaccaucgccaacaugugccccgaguacggcgccauccugagcuucuuccccguggacaacgugacccugaagcaccuggagcacaccggcuucagcaaggccaagcuggagagcauggagaccuaccugaaggccgugaagcuguucagaaacgaccagaacagcagcggcgagcccgaguacagccaggugauccagaucaaccugaacagcaucgugcccagcgugagcggccccaagagaccccaggacagaguggccgugaccgacaugaagagcgacuuccaggccugccugaacgagaaggugggcuucaagggcuuccagaucgccgccgagaagcagaaggacaucgugagcauccacuacgagggcagcgaguacaagcugagccacggcagcguggugaucgccgccgugaucagcugcaccaacaacugcaaccccagcgugaugcuggccgccggccugcuggccaagaaggccguggaggccggccugagagugaagcccuacaucagaaccagccugagccccggcagcggcauggugacccacuaccugagcagcagcggcgugcugcccuaccugagcaagcugggcuucgagaucgugggcuacggcugcagcaccugcgugggcaacaccgccccccugagcgacgccgugcugaacgccgugaagcagggcgaccuggugaccugcggcauccugagcggcaacaagaacuucgagggcagacugugcgacugcgugagagccaacuaccuggccagccccccccuggugguggccuacgccaucgccggcaccgugaacaucgacuuccagaccgagccccugggcaccgaccccaccggcaagaacaucuaccugcacgacaucuggcccagcagagaggaggugcacagaguggaggaggagcacgugauccugagcauguucaaggcccugaaggacaagaucgagaugggcaacaagagauggaacagccuggaggcccccgacagcgugcuguuccccugggaccugaagagcaccuacaucagaugccccagcuucuucgacaagcugaccaaggagcccaucgcccugcaggccaucgagaacgcccacgugcugcuguaccugggcgacagcgugaccaccgaccacaucagccccgccggcagcaucgccagaaacagcgccgccgccaaguaccugaccaacagaggccugacccccagagaguucaacagcuacggcgccagaagaggcaacgacgccgugaugaccagaggcaccuucgccaacaucaagcuguucaacaaguucaucggcaagcccgcccccaagaccauccacuuccccagcggccagacccuggacguguucgaggccgccgagcuguaccagaaggagggcaucccccugaucauccuggccggcaagaaguacggcagcggcaacagcagagacugggccgccaagggccccuaccugcugggcgugaaggccgugcuggccgagagcuacgagaagauccacaaggaccaccugaucggcaucggcaucgccccccugcaguuccugcccggcgagaacgccgacagccugggccugagcggcagagagaccuucagccugaccuuccccgaggagcugagccccggcaucacccugaacauccagaccagcaccggcaagguguucagcgugaucgccagcuucgaggacgacguggagaucacccuguacaagcacggcggccugcugaacuucguggccagaaaguucagcuaa

SEQ ID NO: 18629 - RNA, 978 nt, Artificial Sequence
  IRF1__Homo_sapiens__NP_002189
augcccaucaccagaaugagaaugagacccuggcuggagaugcagaucaacagcaaccagauccccggccugaucuggaucaacaaggaggagaugaucuuccagauccccuggaagcacgccgccaagcacggcugggacaucaacaaggacgccugccuguucagaagcugggccauccacaccggcagauacaaggccggcgagaaggagcccgaccccaagaccuggaaggccaacuucagaugcgccaugaacagccugcccgacaucgaggaggugaaggaccagagcagaaacaagggcagcagcgccgugagaguguacagaaugcugcccccccugaccaagaaccagagaaaggagagaaagagcaagagcagcagagacgccaagagcaaggccaagagaaagagcugcggcgacagcagccccgacaccuucagcgacggccugagcagcagcacccugcccgacgaccacagcagcuacaccgugcccggcuacaugcaggaccuggagguggagcaggcccugacccccgcccugagccccugcgccgugagcagcacccugcccgacuggcacauccccguggagguggugcccgacagcaccagcgaccuguacaacuuccaggugagccccaugcccagcaccagcgaggccaccaccgacgaggacgaggagggcaagcugcccgaggacaucaugaagcugcuggagcagagcgaguggcagcccaccaacguggacggcaagggcuaccugcugaacgagcccggcgugcagcccaccagcguguacggcgacuucagcugcaaggaggagcccgagaucgacagccccggcggcgacaucggccugagccugcagagaguguucaccgaccugaagaacauggacgccaccuggcuggacagccugcugacccccgugagacugcccagcauccaggccauccccugcgcccccuaa

SEQ ID NO: 18630 - RNA, 1716 nt, Artificial Sequence
  IRF2BP2__Homo_sapiens__NP_001070865
auggccgccgccguggccguggccgccgccagcagaagacagagcugcuaccugugcgaccugcccagaaugcccugggccaugaucugggacuucaccgagcccgugugcagaggcugcgugaacuacgagggcgccgacagaguggaguucgugaucgagaccgccagacagcugaagagagcccacggcugcuuccccgagggcagaagcccccccggcgccgccgccagcgccgccgccaagccccccccccugagcgccaaggacauccugcugcagcagcagcagcagcugggccacggcggccccgaggccgcccccagagccccccaggcccuggagagauacccccuggccgccgccgccgagagaccccccagacugggcagcgacuucggcagcagcagacccgccgccagccuggcccagccccccaccccccagcccccccccgugaacggcauccuggugcccaacggcuucagcaagcuggaggagccccccgagcugaacagacagagccccaaccccagaagaggccacgccgugccccccacccuggugccccugaugaacggcagcgccaccccccugcccaccgcccugggccugggcggcagagccgccgccagccuggccgccgugagcggcaccgccgccgccagccugggcagcgcccagcccaccgaccugggcgcccacaagagacccgccagcgugagcagcagcgccgccguggagcacgagcagagagaggccgccgccaaggagaagcagccccccccccccgcccacagaggccccgccgacagccugagcaccgccgccggcgccgccgagcugagcgccgagggcgccggcaagagcagaggcagcggcgagcaggacugggugaacagacccaagaccgugagagacacccugcuggcccugcaccagcacggccacagcggccccuucgagagcaaguucaagaaggagcccgcccugaccgccguggccagaaccgccagaaagagaaagcccagccccgagcccgagggcgaggugggcccccccaagaucaacggcgaggcccagcccuggcugagcaccagcaccgagggccugaagauccccaugacccccaccagcagcuucgugagcccccccccccccaccgccagcccccacagcaacagaaccaccccccccgaggccgcccagaacggccagagccccauggccgcccugauccugguggccgacaacgccggcggcagccacgccagcaaggacgccaaccaggugcacagcaccaccagaagaaacagcaacagcccccccagccccagcagcaugaaccagagaagacugggccccagagaggugggcggccagggcgccggcaacaccggcggccuggagcccgugcaccccgccagccugcccgacagcagccuggccaccagcgccccccugugcugcacccugugccacgagagacuggaggacacccacuucgugcagugccccagcgugcccagccacaaguucugcuuccccugcagcagacagagcaucaagcagcagggcgccagcggcgagguguacugccccagcggcgagaagugcccccuggugggcagcaacgugcccugggccuucaugcagggcgagaucgccaccauccuggccggcgacgugaaggugaagaaggagagagacagcuaa

SEQ ID NO: 18631 - RNA, 2391 nt, Artificial Sequence
  IRF2BPL__Homo_sapiens__NP_078772
augagcgccgcccaggugagcagcagcagaagacagagcugcuaccugugcgaccugcccagaaugcccugggccaugaucugggacuucagcgagcccgugugcagaggcugcgugaacuacgagggcgccgacagaaucgaguucgugaucgagaccgccagacagcugaagagagcccacggcugcuuccaggacggcagaagccccggcccccccccccccgugggcgugaagaccguggcccugagcgccaaggaggccgccgccgccgccgccgccgccgccgccgccgccgccgccgcccagcagcagcagcagcagcagcagcagcagcagcagcagcagcagcagcagcagcagcagcagcagcagcagcagcugaaccacguggacggcagcagcaagcccgccgugcuggccgcccccagcggccuggagagauacggccugagcgccgccgccgccgccgccgccgccgccgccgccgccguggagcagagaagcagauucgaguacccccccccccccgugagccugggcagcagcagccacaccgccagacugcccaacggccugggcggccccaacggcuuccccaagcccacccccgaggagggcccccccgagcugaacagacagagccccaacagcagcagcgccgccgccagcguggccagcagaagaggcacccacggcggccuggugaccggccugcccaaccccggcggcggcggcggcccccagcugaccgugccccccaaccugcugccccagacccugcugaacggccccgccagcgccgccgugcugccccccccccccccccacgcccugggcagcagaggcccccccacccccgccccccccggcgcccccggcggccccgccugccugggcggcacccccggcgugagcgccaccagcagcagcgccagcagcagcaccagcagcagcguggccgaggugggcgugggcgccggcggcaagagacccggcagcgugagcagcaccgaccaggagagagagcugaaggagaagcagagaaacgccgaggcccuggccgagcugagcgagagccugagaaacagagccgaggagugggccagcaagcccaagauggugagagacacccugcugacccuggccggcugcacccccuacgaggugagauucaagaaggaccacagccugcugggcagaguguucgccuucgacgccgugagcaagcccggcauggacuacgagcugaagcuguucaucgaguaccccaccggcagcggcaacguguacagcagcgccagcggcguggccaagcagauguaccaggacugcaugaaggacuucggcagaggccugagcagcggcuucaaguaccuggaguacgagaagaagcacggcagcggcgacuggagacugcugggcgaccugcugcccgaggccgugagauucuucaaggagggcgugcccggcgccgacaugcugccccagcccuaccuggacgccagcugccccaugcugcccaccgcccuggugagccugagcagagcccccagcgccccccccggcaccggcgcccugccccccgccgcccccagcggcagaggcgccgccgccagccugagaaagagaaaggccagccccgagccccccgacagcgccgagggcgcccugaagcugggcgaggagcagcagagacagcaguggauggccaaccagagcgaggcccugaagcugaccaugagcgccggcggcuucgccgcccccggccacgccgccggcggcccccccccccccccccccccccugggcccccacagcaacagaaccaccccccccgagagcgccccccagaacggccccagccccauggccgcccugaugagcguggccgacacccugggcaccgcccacagccccaaggacggcagcagcgugcacagcaccaccgccagcgccagaagaaacagcagcagccccgugagccccgccagcgugcccggccagagaagacuggccagcagaaacggcgaccugaaccugcagguggccccccccccccccagcgcccaccccggcauggaccaggugcacccccagaacauccccgacagccccauggccaacagcggcccccugugcugcaccaucugccacgagagacuggaggacacccacuucgugcagugccccagcgugcccagccacaaguucugcuuccccugcagcagagagagcaucaaggcccagggcgccaccggcgagguguacugccccagcggcgagaagugcccccuggugggcagcaacgugcccugggccuucaugcagggcgagaucgccaccauccuggccggcgacgugaaggugaagaaggagagagaccccuaa

SEQ ID NO: 18632 - RNA, 1050 nt, Artificial Sequence
  IRF2__Homo_sapiens__NP_002190
augcccguggagagaaugagaaugagacccuggcuggaggagcagaucaacagcaacaccauccccggccugaaguggcugaacaaggagaagaagaucuuccagauccccuggaugcacgccgccagacacggcugggacguggagaaggacgccccccuguucagaaacugggccauccacaccggcaagcaccagcccggcguggacaagcccgaccccaagaccuggaaggccaacuucagaugcgccaugaacagccugcccgacaucgaggaggugaaggacaagagcaucaagaagggcaacaacgccuucagaguguacagaaugcugccccugagcgagagacccagcaagaagggcaagaagcccaagaccgagaaggaggacaaggugaagcacaucaagcaggagcccguggagagcagccugggccugagcaacggcgugagcgaccugagccccgaguacgccgugcugaccagcaccaucaagaacgagguggacagcaccgugaacaucaucguggugggccagagccaccuggacagcaacaucgagaaccaggagaucgugaccaacccccccgacaucugccaggugguggaggugaccaccgagagcgacgagcagcccgugagcaugagcgagcuguacccccugcagaucagccccgugagcagcuacgccgagagcgagaccaccgacagcgugcccagcgacgaggagagcgccgagggcagaccccacuggagaaagagaaacaucgagggcaagcaguaccugagcaacaugggcaccagaggcagcuaccugcugcccggcauggccagcuucgugaccagcaacaagcccgaccugcaggugaccaucaaggaggagagcaaccccgugcccuacaacagcagcuggccccccuuccaggaccugccccugagcagcagcaugacccccgccagcagcagcagcagacccgacagagagaccagagccagcgugaucaagaagaccagcgacaucacccaggccagagugaagagcugcuaa

SEQ ID NO: 18633 - RNA, 1179 nt, Artificial Sequence
  IRF3__Homo_sapiens__NP_001184052
auggugggcagaaagcagggcuggagcugcagagugaccggcaucaagcccggcaagcccgccugggccgaggccaccggcgccuacgugcccggcagagacaagcccgaccugcccaccuggaagagaaacuucagaagcgcccugaacagaaaggagggccugagacuggccgaggacagaagcaaggacccccacgacccccacaagaucuacgaguucgugaacagcggcgugggcgacuucagccagcccgacaccagccccgacaccaacggcggcggcagcaccagcgacacccaggaggacauccuggacgagcugcugggcaacauggugcuggccccccugcccgaccccggcccccccagccuggccguggcccccgagcccugcccccagccccugagaagccccagccuggacaaccccacccccuuccccaaccugggccccagcgagaacccccugaagagacugcuggugcccggcgaggagugggaguucgaggugaccgccuucuacagaggcagacagguguuccagcagaccaucagcugccccgagggccugagacuggugggcagcgaggugggcgacagaacccugcccggcuggcccgugacccugcccgaccccggcaugagccugaccgacagaggcgugaugagcuacgugagacacgugcugagcugccugggcggcggccuggcccuguggagagccggccaguggcugugggcccagagacugggccacugccacaccuacugggccgugagcgaggagcugcugcccaacagcggccacggccccgacggcgaggugcccaaggacaaggagggcggcguguucgaccugggccccuucaucguggaccugaucaccuucaccgagggcagcggcagaagccccagauacgcccugugguucugcgugggcgagagcuggccccaggaccagcccuggaccaagagacuggugauggugaagguggugcccaccugccugagagcccugguggagauggccagagugggcggcgccagcagccuggagaacaccguggaccugcacaucagcaacagccacccccugagccugaccagcgaccaguacaaggccuaccugcaggaccugguggagggcauggacuuccagggccccggcgagagcuaa

SEQ ID NO: 18634 - RNA, 1353 nt, Artificial Sequence
  IRF4__Homo_sapiens__NP_001182215
augaaccuggagggcggcggcagaggcggcgaguucggcaugagcgccgugagcugcggcaacggcaagcugagacaguggcugaucgaccagaucgacagcggcaaguaccccggccuggugugggagaacgaggagaagagcaucuucagaauccccuggaagcacgccggcaagcaggacuacaacagagaggaggacgccgcccuguucaaggccugggcccuguucaagggcaaguucagagagggcaucgacaagcccgacccccccaccuggaagaccagacugagaugcgcccugaacaagagcaacgacuucgaggagcugguggagagaagccagcuggacaucagcgaccccuacaagguguacagaaucgugcccgagggcgccaagaagggcgccaagcagcugacccuggaggacccccagaugagcaugagccaccccuacaccaugaccacccccuaccccagccugcccgcccaggugcacaacuacaugaugcccccccuggacagaagcuggagagacuacgugcccgaccagccccaccccgagauccccuaccagugccccaugaccuucggccccagaggccaccacuggcagggccccgccugcgagaacggcugccaggugaccggcaccuucuacgccugcgccccccccgagagccaggcccccggcgugcccaccgagcccagcaucagaagcgccgaggcccuggccuucagcgacugcagacugcacaucugccuguacuacagagagauccuggugaaggagcugaccaccagcagccccgagggcugcagaaucagccacggccacaccuacgacgccagcaaccuggaccaggugcuguuccccuaccccgaggacaacggccagagaaagaacaucgagaagcugcugagccaccuggagagaggcguggugcuguggauggcccccgacggccuguacgccaagagacugugccagagcagaaucuacugggacggcccccuggcccugugcaacgacagacccaacaagcuggagagagaccagaccugcaagcuguucgacacccagcaguuccugagcgagcugcaggccuucgcccaccacggcagaagccugcccagauuccaggugacccugugcuucggcgaggaguuccccgacccccagagacagagaaagcugaucaccgcccacguggagccccugcuggccagacagcuguacuacuucgcccagcagaacagcggccacuuccugagaggcuacgaccugcccgagcacaucagcaaccccgaggacuaccacagaagcaucagacacagcagcauccaggaguaa

SEQ ID NO: 18635 - RNA, 1497 nt, Artificial Sequence
  IRF5__Homo_sapiens__NP_001092097
augaaccagagcauccccguggcccccaccccccccagaagagugagacugaagcccuggcugguggcccaggugaacagcugccaguaccccggccugcagugggugaacggcgagaagaagcuguucugcauccccuggagacacgccaccagacacggccccagccaggacggcgacaacaccaucuucaaggccugggccaaggagaccggcaaguacaccgagggcguggacgaggccgaccccgccaaguggaaggccaaccugagaugcgcccugaacaagagcagagacuucagacugaucuacgacggccccagagacaugcccccccagcccuacaagaucuacgaggugugcagcaacggccccgcccccaccgacagccagccccccgaggacuacagcuucggcgccggcgaggaggaggaggaggaggaggagcugcagagaaugcugcccagccugagccugaccgaggacgugaaguggccccccacccugcagccccccacccugagaccccccacccugcagccccccacccugcagccccccguggugcugggcccccccgcccccgaccccagcccccuggcccccccccccggcaaccccgccggcuucagagagcugcugagcgaggugcuggagcccggcccccugcccgccagccugccccccgccggcgagcagcugcugcccgaccugcugaucagcccccacaugcugccccugaccgaccuggagaucaaguuccaguacagaggcagaccccccagagcccugaccaucagcaacccccacggcugcagacuguucuacagccagcuggaggccacccaggagcagguggagcuguucggccccaucagccuggagcaggugagauuccccagccccgaggacauccccagcgacaagcagagauucuacaccaaccagcugcuggacgugcuggacagaggccugauccugcagcugcagggccaggaccuguacgccaucagacugugccagugcaagguguucuggagcggccccugcgccagcgcccacgacagcugccccaaccccauccagagagaggugaagaccaagcuguucagccuggagcacuuccugaacgagcugauccuguuccagaagggccagaccaacacccccccccccuucgagaucuucuucugcuucggcgaggaguggcccgacagaaagcccagagagaagaagcugaucaccgugcagguggugcccguggccgccagacugcugcuggagauguucagcggcgagcugagcuggagcgccgacagcaucagacugcagaucagcaaccccgaccugaaggacagaaugguggagcaguucaaggagcugcaccacaucuggcagagccagcagagacugcagcccguggcccaggccccccccggcgccggccugggcgugggccagggccccuggcccaugcaccccgccggcaugcaguaa

SEQ ID NO: 18636 - RNA, 1119 nt, Artificial Sequence
  IRF6__Homo_sapiens__NP_001193625
auguacgacggcaccaaggaggugcccaugaaccccgugaagaucuaccaggugugcgacaucccccagccccagggcagcaucaucaaccccggcagcaccggcagcgcccccugggacgagaaggacaacgacguggacgaggaggacgaggaggacgagcuggaccagagccagcaccacgugcccauccaggacaccuuccccuuccugaacaucaacggcagccccauggcccccgccagcgugggcaacugcagcgugggcaacugcagccccgaggccguguggcccaagaccgagccccuggagauggaggugccccaggcccccauccagcccuucuacagcagccccgagcuguggaucagcagccugcccaugaccgaccuggacaucaaguuccaguacagaggcaaggaguacggccagaccaugaccgugagcaacccccagggcugcagacuguucuacggcgaccugggccccaugcccgaccaggaggagcuguucggccccgugagccuggagcaggugaaguuccccggccccgagcacaucaccaacgagaagcagaagcuguucaccagcaagcugcuggacgugauggacagaggccugauccuggaggugagcggccacgccaucuacgccaucagacugugccagugcaagguguacuggagcggccccugcgcccccagccugguggcccccaaccugaucgagagacagaagaaggugaagcuguucugccuggagaccuuccugagcgaccugaucgcccaccagaagggccagaucgagaagcagccccccuucgagaucuaccugugcuucggcgaggaguggcccgacggcaagccccuggagagaaagcugauccuggugcaggugauccccgugguggccagaaugaucuacgagauguucagcggcgacuucaccagaagcuucgacagcggcagcgugagacugcagaucagcacccccgacaucaaggacaacaucguggcccagcugaagcagcuguacagaauccugcagacccaggagagcuggcagcccaugcagcccacccccagcaugcagcugccccccgcccugcccccccaguaa

SEQ ID NO: 18637 - RNA, 1512 nt, Artificial Sequence
  IRF7__Homo_sapiens__NP_001563
auggcccuggcccccgagagagccgcccccagagugcuguucggcgaguggcugcugggcgagaucagcagcggcugcuacgagggccugcaguggcuggacgaggccagaaccugcuucagagugcccuggaagcacuucgccagaaaggaccugagcgaggccgacgccagaaucuucaaggccugggccguggccagaggcagauggccccccagcagcagaggcggcggccccccccccgaggccgagaccgccgagagagccggcuggaagaccaacuucagaugcgcccugagaagcaccagaagauucgugaugcugagagacaacagcggcgaccccgccgacccccacaagguguacgcccugagcagagagcugugcuggagagagggccccggcaccgaccagaccgaggccgaggcccccgccgccgugccccccccccagggcggcccccccggccccuuccuggcccacacccacgccggccugcaggcccccggcccccugcccgcccccgccggcgacaagggcgaccugcugcugcaggccgugcagcagagcugccuggccgaccaccugcugaccgccagcuggggcgccgaccccgugcccaccaaggcccccggcgagggccaggagggccugccccugaccggcgccugcgccggcggccccggccugcccgccggcgagcuguacggcugggccguggagaccacccccagccccggcccccagcccgccgcccugaccaccggcgaggccgccgcccccgagagcccccaccaggccgagcccuaccugagccccagccccagcgccugcaccgccgugcaggagcccagccccggcgcccuggacgugaccaucauguacaagggcagaaccgugcugcagaagguggugggccaccccagcugcaccuuccuguacggcccccccgaccccgccgugagagccaccgacccccagcagguggccuuccccagccccgccgagcugcccgaccagaagcagcugagauacaccgaggagcugcugagacacguggcccccggccugcaccuggagcugagaggcccccagcugugggccagaagaaugggcaagugcaagguguacugggaggugggcggcccccccggcagcgccagccccagcacccccgccugccugcugcccagaaacugcgacacccccaucuucgacuucagaguguucuuccaggagcugguggaguucagagccagacagagaagaggcagccccagauacaccaucuaccugggcuucggccaggaccugagcgccggcagacccaaggagaagagccuggugcuggugaagcuggagcccuggcugugcagagugcaccuggagggcacccagagagagggcgugagcagccuggacagcagcagccugagccugugccugagcagcgccaacagccuguacgacgacaucgagugcuuccugauggagcuggagcagcccgccuaa

SEQ ID NO: 18638 - RNA, 1281 nt, Artificial Sequence
  IRF8__Homo_sapiens__NP_002154
augugcgacagaaacggcggcagaagacugagacaguggcugaucgagcagaucgacagcagcauguaccccggccugaucugggagaacgaggagaagagcauguucagaauccccuggaagcacgccggcaagcaggacuacaaccaggagguggacgccagcaucuucaaggccugggccguguucaagggcaaguucaaggagggcgacaaggccgagcccgccaccuggaagaccagacugagaugcgcccugaacaagagccccgacuucgaggaggugaccgacagaagccagcuggacaucagcgagcccuacaagguguacagaaucgugcccgaggaggagcagaagugcaagcugggcguggccaccgccggcugcgugaacgaggugaccgagauggagugcggcagaagcgagaucgacgagcugaucaaggagcccagcguggacgacuacaugggcaugaucaagagaagccccagcccccccgaggccugcagaagccagcugcugcccgacuggugggcccagcagcccagcaccggcgugccccuggugaccggcuacaccaccuacgacgcccaccacagcgccuucagccagauggugaucagcuucuacuacggcggcaagcuggugggccaggccaccaccaccugccccgagggcugcagacugagccugagccagcccggccugcccggcaccaagcuguacggccccgagggccuggagcuggugagauucccccccgccgacgccauccccagcgagagacagagacaggugaccagaaagcuguucggccaccuggagagaggcgugcugcugcacagcagcagacagggcguguucgugaagagacugugccagggcagaguguucugcagcggcaacgccguggugugcaagggcagacccaacaagcuggagagagacgagguggugcagguguucgacaccagccaguucuucagagagcugcagcaguucuacaacagccagggcagacugcccgacggcagaguggugcugugcuucggcgaggaguuccccgacauggccccccugagaagcaagcugauccuggugcagaucgagcagcuguacgugagacagcuggccgaggaggccggcaagagcugcggcgccggcagcgugaugcaggcccccgaggagcccccccccgaccagguguucagaauguuccccgacaucugcgccagccaccagagaagcuucuucagagagaaccagcagaucaccguguaa

SEQ ID NO: 18639 - RNA, 1182 nt, Artificial Sequence
  IRF9__Homo_sapiens__NP_006075
auggccagcggcagagccagaugcaccagaaagcugagaaacugggugguggagcagguggagagcggccaguuccccggcgugugcugggacgacaccgccaagaccauguucagaauccccuggaagcacgccggcaagcaggacuucagagaggaccaggacgccgccuucuucaaggccugggccaucuucaagggcaaguacaaggagggcgacaccggcggccccgccguguggaagaccagacugagaugcgcccugaacaagagcagcgaguucaaggaggugcccgagagaggcagaauggacguggccgagcccuacaagguguaccagcugcugccccccggcaucgugagcggccagcccggcacccagaaggugcccagcaagagacagcacagcagcgugagcagcgagagaaaggaggaggaggacgccaugcagaacugcacccugagccccagcgugcugcaggacagccugaacaacgaggaggagggcgccagcggcggcgccgugcacagcgacaucggcagcagcagcagcagcagcagccccgagccccaggaggugaccgacaccaccgaggcccccuuccagggcgaccagagaagccuggaguuccugcugccccccgagcccgacuacagccugcugcugaccuucaucuacaacggcagaguggugggcgaggcccaggugcagagccuggacugcagacugguggccgagcccagcggcagcgagagcagcauggagcaggugcuguuccccaagcccggcccccuggagcccacccagagacugcugagccagcuggagagaggcauccugguggccagcaaccccagaggccuguucgugcagagacugugccccauccccaucagcuggaacgccccccaggccccccccggccccggcccccaccugcugcccagcaacgagugcguggagcuguucagaaccgccuacuucugcagagaccuggugagauacuuccagggccugggccccccccccaaguuccaggugacccugaacuucugggaggagagccacggcagcagccacaccccccagaaccugaucaccgugaagauggagcaggccuucgccagauaccugcuggagcagacccccgagcagcaggccgccauccugagccugguguaa

SEQ ID NO: 18640 - RNA, 1446 nt, Artificial Sequence
  IRG1__Homo_sapiens__NP_001245335
augaugcugaagagcaucaccgagagcuucgccaccgccauccacggccugaaggugggccaccugaccgacagagugauccagagaagcaagagaaugauccuggacacccugggcgccggcuuccugggcaccaccaccgagguguuccacaucgccagccaguacagcaagaucuacagcagcaacaucagcagcaccguguggggccagcccgacaucagacugccccccaccuacgccgccuucgugaacggcguggccauccacagcauggacuucgacgacaccuggcaccccgccacccaccccagcggcgccgugcugcccgugcugaccgcccuggccgaggcccugcccagaagccccaaguucagcggccuggaccugcugcuggccuucaacgugggcaucgaggugcagggcagacugcugcacuucgccaaggaggccaacgacaugcccaagagauuccacccccccagcguggugggcacccugggcagcgccgccgccgccagcaaguuccugggccugagcagcaccaagugcagagaggcccuggccaucgccgugagccacgccggcgcccccauggccaacgccgccacccagaccaagccccugcacaucggcaacgccgccaagcacggcaucgaggccgccuuccuggccaugcugggccugcagggcaacaagcaggugcuggaccuggaggccggcuucggcgccuucuacgccaacuacagccccaaggugcugcccagcaucgccagcuacagcuggcugcuggaccagcaggacguggccuucaagagauuccccgcccaccugagcacccacuggguggccgacgccgccgccagcgugagaaagcaccugguggccgagagagcccugcugcccaccgacuacaucaagagaaucgugcugagaauccccaacgugcaguacgugaacagacccuuccccgugagcgagcacgaggccagacacagcuuccaguacguggccugcgccaugcugcuggacggcggcaucaccgugcccagcuuccacgagugccagaucaacagaccccaggugagagagcugcugagcaagguggagcuggaguacccccccgacaaccugcccagcuucaacauccuguacugcgagaucagcgugacccugaaggacggcgccaccuucaccgacagaagcgacaccuucuacggccacuggagaaagccccugagccaggaggaccuggaggagaaguucagagccaacgccagcaagaugcugagcugggacaccguggagagccugaucaagaucgugaagaaccuggaggaccuggaggacugcagcgugcugaccacccugcugaagggccccagcccccccgagguggccagcaacagccccgccugcaacaacagcaucaccaaccugagcuaa

SEQ ID NO: 18641 - RNA, 546 nt, Artificial Sequence
  IRGM__Homo_sapiens__NP_001139277
auggaggccaugaacguggagaaggccagcgccgacggcaaccugcccgaggugaucagcaacaucaaggagacccugaagaucgugagcagaacccccgugaacaucaccauggccggcgacagcggcaacggcaugagcaccuucaucagcgcccugagaaacaccggccacgagggcaaggccagcccccccaccgagcuggugaaggccacccagagaugcgccagcuacuucagcagccacuucagcaacguggugcugugggaccugcccggcaccggcagcgccaccaccacccuggagaacuaccugauggagaugcaguucaacagauacgacuucaucaugguggccagcgcccaguucagcaugaaccacgugaugcuggccaagaccgccgaggacaugggcaagaaguucuacaucguguggaccaagcuggacauggaccugagcaccggcgcccugcccgaggugcagcugcugcagaucagagagaacgugcuggagaaccugcagaaggagagagugugcgaguacuaa

SEQ ID NO: 18642 - RNA, 3729 nt, Artificial Sequence
  IRS1__Homo_sapiens__NP_005535
auggccagcccccccgagagcgacggcuucagcgacgugagaaaggugggcuaccugagaaagcccaagagcaugcacaagagauucuucgugcugagagccgccagcgaggccggcggccccgccagacuggaguacuacgagaacgagaagaaguggagacacaagagcagcgcccccaagagaagcaucccccuggagagcugcuucaacaucaacaagagagccgacagcaagaacaagcaccugguggcccuguacaccagagacgagcacuucgccaucgccgccgacagcgaggccgagcaggacagcugguaccaggcccugcugcagcugcacaacagagccaagggccaccacgacggcgccgccgcccugggcgccggcggcggcggcggcagcugcagcggcagcagcggccugggcgaggccggcgaggaccugagcuacggcgacgugccccccggccccgccuucaaggagguguggcaggugauccugaagcccaagggccugggccagaccaagaaccugaucggcaucuacagacugugccugaccagcaagaccaucagcuucgugaagcugaacagcgaggccgccgccguggugcugcagcugaugaacaucagaagaugcggccacagcgagaacuucuucuucaucgaggugggcagaagcgccgugaccggccccggcgaguucuggaugcagguggacgacagcgugguggcccagaacaugcacgagaccauccuggaggccaugagagccaugagcgacgaguucagacccagaagcaagagccagagcagcagcaacugcagcaaccccaucagcgugccccugagaagacaccaccugaacaaccccccccccagccaggugggccugaccagaagaagcagaaccgagagcaucaccgccaccagccccgccagcauggugggcggcaagcccggcagcuucagagugagagccagcagcgacggcgagggcaccaugagcagacccgccagcguggacggcagccccgugagccccagcaccaacagaacccacgcccacagacacagaggcagcgccagacugcaccccccccugaaccacagcagaagcauccccaugcccgccagcagaugcagccccagcgccaccagccccgugagccugagcagcagcagcaccagcggccacggcagcaccagcgacugccuguuccccagaagaagcagcgccagcgugagcggcagccccagcgacggcggcuucaucagcagcgacgaguacggcagcagccccugcgacuucagaagcagcuucagaagcgugacccccgacagccugggccacaccccccccgccagaggcgaggaggagcugagcaacuacaucugcaugggcggcaagggccccagcacccugaccgcccccaacggccacuacauccugagcagaggcggcaacggccacagaugcacccccggcaccggccugggcaccagccccgcccuggccggcgacgaggccgccagcgccgccgaccuggacaacagauucagaaagagaacccacagcgccggcaccagccccaccaucacccaccagaagacccccagccagagcagcguggccagcaucgaggaguacaccgagaugaugcccgccuacccccccggcggcggcagcggcggcagacugcccggccacagacacagcgccuucgugcccaccagaagcuaccccgaggagggccuggagaugcacccccuggagagaagaggcggccaccacagacccgacagcagcacccugcacaccgacgacggcuacaugcccaugagccccggcguggcccccgugcccagcggcagaaagggcagcggcgacuacaugcccaugagccccaagagcgugagcgccccccagcagaucaucaaccccaucagaagacacccccagagaguggaccccaacggcuacaugaugaugagccccagcggcggcugcagccccgacaucggcggcggccccagcagcagcagcagcagcagcaacgccgugcccagcggcaccagcuacggcaagcuguggaccaacggcgugggcggccaccacagccacgugcugccccaccccaagccccccguggagagcagcggcggcaagcugcugcccugcaccggcgacuacaugaacaugagccccgugggcgacagcaacaccagcagccccagcgacugcuacuacggccccgaggacccccagcacaagcccgugcugagcuacuacagccugcccagaagcuucaagcacacccagagacccggcgagcccgaggagggcgccagacaccagcaccugagacugagcaccagcagcggcagacugcuguacgccgccaccgccgacgacagcagcagcagcaccagcagcgacagccugggcggcggcuacugcggcgccagacuggagcccagccugccccacccccaccaccaggugcugcagccccaccugcccagaaagguggacaccgccgcccagaccaacagcagacuggccagacccaccagacugagccugggcgaccccaaggccagcacccugcccagagccagagagcagcagcagcagcagcagccccugcugcacccccccgagcccaagagccccggcgaguacgugaacaucgaguucggcagcgaccagagcggcuaccugagcggccccguggccuuccacagcagccccagcgugagaugccccagccagcugcagcccgcccccagagaggaggagaccggcaccgaggaguacaugaagauggaccugggccccggcagaagagccgccuggcaggagagcaccggcguggagaugggcagacugggccccgccccccccggcgccgccagcaucugcagacccaccagagccgugcccagcagcagaggcgacuacaugaccaugcagaugagcugccccagacagagcuacguggacaccagccccgccgcccccgugagcuacgccgacaugagaaccggcaucgccgccgaggaggugagccugcccagagccaccauggccgccgccagcagcagcagcgccgccagcgccagccccaccggcccccagggcgccgccgagcuggccgcccacagcagccugcugggcggcccccagggccccggcggcaugagcgccuucaccagagugaaccugagccccaacagaaaccagagcgccaaggugaucagagccgacccccagggcugcagaagaagacacagcagcgagaccuucagcagcacccccagcgccaccagagugggcaacaccgugcccuucggcgccggcgccgccgugggcggcggcggcggcagcagcagcagcagcgaggacgugaagagacacagcagcgccagcuucgagaacguguggcugagacccggcgagcugggcggcgcccccaaggagcccgccaagcugugcggcgccgccggcggccuggagaacggccugaacuacaucgaccuggaccuggugaaggacuucaagcagugcccccaggagugcacccccgagccccagccccccccccccccccccccccaccagccccugggcagcggcgagagcagcagcaccagaagaagcagcgaggaccugagcgccuacgccagcaucagcuuccagaagcagcccgaggacagacaguaa

SEQ ID NO: 18643 - RNA, 4017 nt, Artificial Sequence
  IRS2__Homo_sapiens__NP_003740
auggccagcccccccagacacggcccccccggccccgccagcggcgacggccccaaccugaacaacaacaacaacaacaacaaccacagcgugagaaagugcggcuaccugagaaagcagaagcacggccacaagagauucuucgugcugagaggccccggcgccggcggcgacgaggccaccgccggcggcggcagcgccccccagccccccagacuggaguacuacgagagcgagaagaaguggagaagcaaggccggcgcccccaagagagugaucgcccuggacugcugccugaacaucaacaagagagccgacgccaagcacaaguaccugaucgcccuguacaccaaggacgaguacuucgccguggccgccgagaacgagcaggagcaggagggcugguacagagcccugaccgaccuggugagcgagggcagagccgccgccggcgacgccccccccgccgccgcccccgccgccagcugcagcgccagccugcccggcgcccugggcggcagcgccggcgccgccggcgccgaggacagcuacggccugguggcccccgccaccgccgccuacagagagguguggcaggugaaccugaagcccaagggccugggccagagcaagaaccugaccggcguguacagacugugccugagcgccagaaccaucggcuucgugaagcugaacugcgagcagcccagcgugacccugcagcugaugaacaucagaagaugcggccacagcgacagcuucuucuucaucgaggugggcagaagcgccgugaccggccccggcgagcuguggaugcaggccgacgacagcgugguggcccagaacauccacgagaccauccuggaggccaugaaggcccugaaggagcuguucgaguucagacccagaagcaagagccagagcagcggcagcagcgccacccaccccaucagcgugcccggcgccagaagacaccaccaccuggugaaccugccccccagccagaccggccuggugagaagaagcagaaccgacagccuggccgccaccccccccgccgccaagugcagcagcugcagagugagaaccgccagcgagggcgacggcggcgccgccgccggcgccgccgccgccggcgccagacccgugagcguggccggcagcccccugagccccggccccgugagagccccccugagcagaagccacacccugagcggcggcugcggcggcagaggcagcaagguggcccugcugcccgccggcggcgcccugcagcacagcagaagcaugagcaugcccguggcccacagcccccccgccgccaccagccccggcagccugagcagcagcagcggccacggcagcggcagcuacccccccccccccggcccccaccccccccugccccacccccugcaccacggccccggccagagacccagcagcggcagcgccagcgccagcggcagccccagcgaccccggcuucaugagccuggacgaguacggcagcagccccggcgaccugagagccuucugcagccacagaagcaacacccccgagagcaucgccgagaccccccccgccagagacggcggcggcggcggcgaguucuacggcuacaugaccauggacagaccccugagccacugcggcagaagcuacagaagagugagcggcgacgccgcccaggaccuggacagaggccugagaaagagaaccuacagccugaccacccccgccagacagagacccgugccccagcccagcagcgccagccuggacgaguacacccugaugagagccaccuucagcggcagcgccggcagacugugccccagcugccccgccagcagccccaagguggccuaccaccccuaccccgaggacuacggcgacaucgagaucggcagccacagaagcagcagcagcaaccugggcgccgacgacggcuacaugcccaugacccccggcgccgcccuggccggcagcggcagcggcagcugcagaagcgacgacuacaugcccaugagccccgccagcgugagcgcccccaagcagauccugcagcccagagccgccgccgccgccgccgccgccgugcccagcgccggccccgccggccccgcccccaccagcgccgccggcagaaccuuccccgccagcggcggcggcuacaaggccagcagccccgccgagagcagccccgaggacagcggcuacaugagaauguggugcggcagcaagcugagcauggagcacgccgacggcaagcugcugcccaacggcgacuaccugaacgugagccccagcgacgccgugaccaccggcaccccccccgacuucuucagcgccgcccugcaccccggcggcgagccccugagaggcgugcccggcugcugcuacagcagccugcccagaagcuacaaggcccccuacaccugcggcggcgacagcgaccaguacgugcugaugagcagccccgugggcagaauccuggaggaggagagacuggagccccaggccacccccggccccagccaggccgccagcgccuucggcgccggccccacccagcccccccaccccguggugcccagccccgugagacccagcggcggcagacccgagggcuuccugggccagagaggcagagccgugagacccaccagacugagccuggagggccugcccagccugcccagcaugcacgaguacccccugccccccgagcccaagagccccggcgaguacaucaacaucgacuucggcgagcccggcgccagacugagcccccccgcccccccccugcuggccagcgccgccagcagcagcagccugcugagcgccagcagccccgccagcagccugggcagcggcacccccggcaccagcagcgacagcagacagagaagcccccugagcgacuacaugaaccuggacuucagcagccccaagagccccaagcccggcgcccccagcggccaccccgugggcagccuggacggccugcugagccccgaggccagcagccccuaccccccccugccccccagacccagcgccagccccagcagcagccugcagccccccccccccccccccgcccccggcgagcuguacagacugccccccgccagcgccguggccaccgcccagggccccggcgccgccagcagccugagcagcgacaccggcgacaacggcgacuacaccgagauggccuucggcguggccgccacccccccccagcccaucgccgccccccccaagcccgaggccgccagaguggccagccccaccagcggcgugaagagacugagccugauggagcaggugagcggcguggaggccuuccugcaggccagccagccccccgacccccacagaggcgccaaggugaucagagccgacccccagggcggcagaagaagacacagcagcgagaccuucagcagcaccaccaccgugacccccgugagccccagcuucgcccacaaccccaagagacacaacagcgccagcguggagaacgugagccugagaaagagcagcgagggcggcgugggcgugggccccggcggcggcgacgagccccccaccagccccagacagcugcagcccgcccccccccuggccccccagggcagacccuggacccccggccagcccggcggccuggugggcugccccggcagcggcggcagccccaugagaagagagaccagcgccggcuuccagaacggccugaacuacaucgccaucgacgugagagaggagcccggccugcccccccagccccagccccccccccccccccugccccagcccggcgacaagagcagcuggggcagaaccagaagccugggcggccugaucagcgccgugggcgugggcagcaccggcggcggcugcggcggccccggccccggcgcccugccccccgccaacaccuacgccagcaucgacuuccugagccaccaccugaaggaggccaccaucgugaaggaguaa

SEQ ID NO: 18644 - RNA, 3774 nt, Artificial Sequence
  IRS4__Homo_sapiens__NP_003595
auggccagcugcagcuucaccagagaccaggccaccagaagacugagaggcgccgccgccgccgccgccgccgcccuggccgccguggugaccaccccccugcugagcagcggcacccccaccgcccugaucggcaccggcagcagcugccccggcgccauguggcugagcaccgccaccggcagcagaagcgacagcgagagcgaggaggaggaccugcccgugggcgaggaggugugcaagagaggcuaccugagaaagcagaagcacggccacagaagauacuucgugcugaagcuggagaccgccgacgcccccgccagacuggaguacuacgagaacgccagaaaguucagacacagcgugagagccgccgccgccgccgccgccgccgccgccagcggcgccgccauccccccccugaucccccccagaagagugaucacccuguaccagugcuucagcgugagccagagagccgacgccagauacagacaccugaucgcccuguucacccaggacgaguacuucgccaugguggccgagaacgagagcgagcaggagagcugguaccugcugcugagcagacugauccuggagagcaagagaagaagaugcggcacccugggcgcccagcccgacggcgagcccgccgcccuggccgccgccgccgccgccgagccccccuucuacaaggacguguggcaggugaucgugaagcccagaggccugggccacagaaaggagcugagcggcguguucagacugugccugaccgacgaggaggugguguucgugagacugaacaccgagguggccagcgugguggugcagcugcugagcaucagaagaugcggccacagcgagcaguacuucuuccuggaggugggcagaagcaccgugaucggccccggcgagcuguggaugcagguggacgacugcgugguggcccagaacaugcacgagcuguuccuggagaagaugagagcccugugcgccgacgaguacagagccagaugcagaagcuacagcaucagcaucggcgcccaccugcugacccugcugagcgccagaagacaccugggccuggugccccuggagcccggcggcuggcugagaagaagcagauucgagcaguucugccaccugagagccaucggcgacggcgaggacgagaugcuguucaccagaagauucgugacccccagcgagcccguggcccacagcagaagaggcagacugcaccugcccagaggcagaagaagcagaagagccgugagcgugcccgccagcuucuucagaagacuggcccccagccccgccagacccagacaccccgccgaggcccccaacaacggcgccagacugagcagcgaggugagcggcagcggcagcggcaacuucggcgaggagggcaacccccagggcaaggaggaccaggagggcagcggcggcgacuacaugcccaugaacaacuggggcagcggcaacggcagaggcagcggcggcggccagggcagcaacggccagggcagcagcagccacagcagcggcggcaaccagugcagcggcgagggccagggcagcagaggcggccagggcagcaacggccagggcagcggcggcaaccagugcagcagagacggccagggcaccgccggcggccacggcagcggcggcggccagagacccggcggcggccacggcagcggcggcggccagggccccggcgacggccacggcagcggcggcggcaagaacagcggcggcggcaagggcagcggcagcggcaagggcagcgacggcgacggcgagagaggcaagagccugaagaagagaagcuacuucggcaagcugacccagagcaagcagcagcagaugccccccccccccccccccccccccccccccccccccgccggcggcaccggcggcaagggcaagagcggcggcagauucagacuguacuucugcguggacagaggcgccaccaaggagugcaaggaggccaaggaggugaaggacgccgagauccccgagggcgccgccagaggcccccacagagccagagccuucgacgaggacgaggacgaccccuacgugcccaugagacccggcguggccaccccccuggugagcagcagcgacuacaugcccauggccccccagaacgugagcgccagcaagaagagacacagcagaagccccuucgaggacagcagaggcuacaugaugauguuccccagagugagccccccccccgcccccagcccccccaaggcccccgacaccaacaaggaggacgacagcaaggacaacgacagcgagagcgacuacauguucauggcccccggcgccggcgccauccccaagaaccccagaaacccccagggcggcagcagcagcaagagcuggagcagcuacuucagccugcccaaccccuucagaagcagcccccugggccagaacgacaacagcgaguacgugcccaugcugcccggcaaguuccugggcagaggccuggacaaggaggugagcuacaacugggaccccaaggacgccgccagcaagcccagcggcgagggcagcuucagcaagcccggcgacggcggcagccccagcaagcccagcgaccacgagccccccaagaacaaggccaagagacccaacagacugagcuucaucaccaagggcuacaagaucaagcccaagccccagaagcccacccacgagcagagagaggccgacagcagcagcgacuacgugaacauggacuucaccaagagagagagcaacacccccgcccccagcacccagggccugcccgacagcuggggcaucaucgccgagcccagacagagcgccuucagcaacuacgugaacguggaguucggcgugcccuuccccaaccccgccaacgaccugagcgaccugcugagagccauccccagagccaacccccugagccuggacagcgccagauggccccugcccccccugccccugagcgccaccggcagcaacgccaucgaggaggagggcgacuacaucgaggugaucuucaacagcgccaugacccccgccauggcccuggccgacagcgccaucagauacgacgccgagaccggcagaaucuacgugguggaccccuucagcgagugcugcauggacaucagccugagccccagcagaugcagcgagcccccccccguggccagacugcugcaggaggaggagcaggagagaagaagaccccagagcagaagccagagcuucuucgccgccgccagagccgccgugagcgccuuccccaccgacagccuggagagagaccugagccccagcagcgcccccgccguggccagcgccgccgagcccacccuggcccugagccaggugguggccgccgccagcgcccuggccgccgcccccggcaucggcgccgccgccgccgccgccggcuucgacagcgccagcgccagaugguuccagcccguggccaacgccgccgacgccgaggccgugagaggcgcccaggacguggccggcggcagcaaccccggcgcccacaaccccagcgccaaccuggccagaggcgacaaccaggccggcggcgccgccgccgccgccgccgcccccgagcccccccccagaagcagaagagugcccagaccccccgagagagaggacagcgacaacgacgacgacacccacgugagaauggacuucgccagaagagacaaccaguucgacagccccaagagaggcagauaa

SEQ ID NO: 18645 - RNA, 1443 nt, Artificial Sequence
  IRX1__Homo_sapiens__NP_077313
augagcuucccccagcugggcuacccccaguaccugagcgccgccggccccggcgccuacggcggcgagagacccggcgugcuggccgccgccgccgccgccgccgccgccgccagcagcggcagacccggcgccgccgagcugggcggcggcgccggcgccgccgccgugaccagcgugcugggcauguacgccgccgccggccccuacgccggcgcccccaacuacagcgccuuccugcccuacgccgccgaccugagccuguucagccagaugggcagccaguacgagcugaaggacaaccccggcgugcaccccgccaccuucgccgcccacaccgcccccgccuacuaccccuacggccaguuccaguacggcgaccccggcagacccaagaacgccaccagagagagcaccagcacccugaaggccuggcugaacgagcacagaaagaaccccuaccccaccaagggcgagaagaucaugcuggccaucaucaccaagaugacccugacccaggugagcaccugguucgccaacgccagaagaagacugaagaaggagaacaaggugaccuggggcgccagaagcaaggaccaggaggacggcgcccuguucggcagcgacaccgagggcgaccccgagaaggccgaggacgacgaggagaucgaccuggagagcaucgacaucgacaagaucgacgagcacgacggcgaccagagcaacgaggacgacgaggacaaggccgaggccccccacgcccccgccgcccccagcgcccuggccagagaccagggcagcccccuggccgccgccgacgugcugaagccccaggacagcccccugggccuggccaaggaggcccccgagcccggcagcaccagacugcugagccccggcgccgccgccggcggccugcagggcgccccccacggcaagcccaagaucuggagccuggccgagaccgccaccagccccgacggcgcccccaaggccagcccccccccccccgccggccaccccggcgcccacggccccagcgccggcgccccccugcagcaccccgccuuccugcccagccacggccuguacaccugccacaucggcaaguucagcaacuggaccaacagcgccuuccuggcccagggcagccugcugaacaugagaagcuuccugggcgugggcgccccccacgccgccccccacggcccccaccugcccgcccccccccccccccagccccccguggccaucgcccccggcgcccugaacggcgacaaggccagcgugagaagcagccccacccugcccgagagagaccuggugcccagacccgacagccccgcccagcagcugaagagccccuuccagcccgugagagacaacagccuggccccccaggagggcacccccagaauccuggccgcccugcccagcgccuaa

SEQ ID NO: 18646 - RNA, 1416 nt, Artificial Sequence
  IRX2__Homo_sapiens__NP_150366
augagcuacccccagggcuaccuguaccaggcccccggcagccuggcccuguacagcugccccgccuacggcgccagcgcccuggccgcccccagaagcgaggagcuggccagaagcgccagcggcagcgccuucagccccuaccccggcagcgccgccuucaccgcccaggccgccaccggcuucggcagcccccugcaguacagcgccgacgccgccgccgccgccgccggcuuccccagcuacaugggcgcccccuacgacgcccacaccaccggcaugaccggcgccaucagcuaccaccccuacggcagcgccgccuaccccuaccagcugaacgaccccgccuacagaaagaacgccaccagagacgccaccgccacccugaaggccuggcugaacgagcacagaaagaaccccuaccccaccaagggcgagaagaucaugcuggccaucaucaccaagaugacccugacccaggugagcaccugguucgccaacgccagaagaagacugaagaaggagaacaagaugaccugggcccccagaaacaagagcgaggacgaggacgaggacgagggcgacgccaccagaagcaaggacgagagccccgacaaggcccaggagggcaccgagaccagcgccgaggacgagggcaucagccugcacguggacagccugaccgaccacagcugcagcgccgagagcgacggcgagaagcugcccugcagagccggcgacccccugugcgagagcggcagcgagugcaaggacaaguacgacgaccuggaggacgacgaggacgacgacgaggagggcgagagaggccuggccccccccaagcccgugaccagcagcccccugaccggccuggaggccccccugcugagccccccccccgaggccgcccccagaggcggcagaaagaccccccagggcagcagaaccagccccggcgcccccccccccgccagcaagcccaagcuguggagccuggccgagaucgccaccagcgaccugaagcagcccagccugggccccggcugcggcccccccggccugcccgccgccgccgcccccgccagcaccggcgccccccccggcggcagccccuaccccgccagcccccugcugggcagaccccuguacuacaccagccccuucuacggcaacuacaccaacuacggcaaccugaacgccgcccugcagggccagggccugcugagauacaacagcgccgccgccgcccccggcgaggcccugcacaccgcccccaaggccgccagcgacgccggcaaggccggcgcccacccccuggagagccacuacagaagccccggcggcggcuacgagcccaagaaggacgccagcgagggcugcaccguggugggcggcggcgugcagcccuaccuguaa

SEQ ID NO: 18647 - RNA, 1506 nt, Artificial Sequence
  IRX3__Homo_sapiens__NP_077312
augagcuucccccagcugggcuaccaguacaucagaccccuguaccccagcgagagacccggcgccgccggcggcagcggcggcagcgccggcgccagaggcggccugggcgccggcgccagcgagcugaacgccagcggcagccugagcaacgugcugagcagcguguacggcgcccccuacgccgccgccgccgccgccgccgccgcccagggcuacggcgccuuccugcccuacgccgccgagcugcccaucuucccccagcugggcgcccaguacgagcugaaggacagccccggcgugcagcaccccgccgccgccgccgccuucccccacccccaccccgccuucuaccccuacggccaguaccaguucggcgaccccagcagacccaagaacgccaccagagagagcaccagcacccugaaggccuggcugaacgagcacagaaagaaccccuaccccaccaagggcgagaagaucaugcuggccaucaucaccaagaugacccugacccaggugagcaccugguucgccaacgccagaagaagacugaagaaggagaacaagaugaccugggcccccagaagcagaaccgacgaggagggcaacgccuacggcagcgagagagaggaggaggacgaggaggaggacgaggaggacggcaagagagagcuggagcuggaggaggaggagcugggcggcgaggaggaggacaccggcggcgagggccuggccgacgacgacgaggacgaggagaucgaccuggagaaccuggacggcgccgccaccgagcccgagcugagccuggccggcgccgccagaagagacggcgaccugggccugggccccaucagcgacagcaagaacagcgacagcgaggacagcagcgagggccuggaggacagaccccugcccgugcugagccuggcccccgcccccccccccguggccguggccagccccagccugcccagcccccccgugagccuggaccccugcgcccccgcccccgcccccgccagcgcccugcagaagcccaagaucuggagccuggccgagaccgccaccagccccgacaaccccagaagaagcccccccggcgccggcggcagcccccccggcgccgccguggcccccagcgcccugcagcugagccccgccgccgccgccgccgccgcccacagacuggugagcgccccccugggcaaguuccccgccuggaccaacagacccuuccccggccccccccccggccccagacugcacccccugagccugcugggcagcgcccccccccaccugcugggccugcccggcgccgccggccaccccgccgccgccgccgccuucgccagacccgccgagcccgagggcggcaccgacagaugcagcgcccuggagguggagaagaagcugcugaagaccgccuuccagcccgugcccagaagaccccagaaccaccuggacgccgcccuggugcugagcgcccugagcagcagcuaa

SEQ ID NO: 18648 - RNA, 1560 nt, Artificial Sequence
  IRX4__Homo_sapiens__NP_057442
augagcuacccccaguucggcuaccccuacagcagcgccccccaguuccugauggccaccaacagccugagcaccugcugcgagagcggcggcagaacccuggccgacagcggccccgccgccagcgcccaggcccccguguacugccccguguacgagagcagacugcuggccaccgccagacacgagcugaacagcgccgccgcccugggcguguacggcggccccuacggcggcagccagggcuacggcaacuacgugaccuacggcagcgaggccagcgccuucuacagccugaacagcuucgacagcaaggacggcagcggcagcgcccacggcggccuggcccccgccgccgccgccuacuaccccuacgagcccgcccugggccaguaccccuacgacagauacggcaccauggacagcggcaccagaagaaagaacgccaccagagagaccaccagcacccugaaggccuggcugcaggagcacagaaagaaccccuaccccaccaagggcgagaagaucaugcuggccaucaucaccaagaugacccugacccaggugagcaccugguucgccaacgccagaagaagacugaagaaggagaacaagaugaccuggccccccagaaacaagugcgccgacgagaagagacccuacgccgagggcgaggaggaggagggcggcgaggaggaggccagagaggagccccugaagagcagcaagaacgccgagcccgugggcaaggaggagaaggagcuggagcugagcgaccuggacgacuucgacccccuggaggccgagccccccgccugcgagcugaagccccccuuccacagccuggacggcggccuggagagagugcccgccgcccccgacggccccgugaaggaggccagcggcgcccugagaaugagccuggccgccggcggcggcgccgcccuggacgaggaccuggagagagccagaagcugccugagaagcgccgccgccggccccgagccccugcccggcgccgagggcggcccccaggugugcgaggccaagcugggcuucgugcccgccggcgccagcgccggccuggaggccaagcccagaaucuggagccuggcccacaccgccaccgccgccgccgccgccgccaccagccugagccagaccgaguuccccagcugcaugcugaagagacagggccccgccgcccccgccgccgugagcagcgcccccgccaccagccccagcguggcccugccccacagcggcgcccuggacagacaccaggacagccccgugaccagccugagaaacuggguggacggcguguuccacgaccccauccugagacacagcacccugaaccaggccugggccaccgccaagggcgcccugcuggaccccggcccccugggcagaagccugggcgccggcgccaacgugcugaccgccccccuggccagagccuucccccccgccgugccccaggacgcccccgccgccggcgccgccagagagcugcuggcccugcccaaggccggcggcaagcccuucugcgccuaa

SEQ ID NO: 18649 - RNA, 1449 nt, Artificial Sequence
  IRX5__Homo_sapiens__NP_001239126
augagcuacccccagggcuaccuguaccagcccagcgccagccuggcccuguacagcugccccgccuacagcaccagcgugaucagcggccccagaaccgacgagcugggcagaagcagcagcggcagcgccuucagccccuacgccggcagcaccgccuucaccgcccccagccccggcuacaacagccaccugcaguacggcgccgaccccgccgccgccgccgccgccgccuucagcagcuacgugggcagccccuacgaccacacccccggcauggccggcagccugggcuaccaccccuacgccgccccccugggcagcuaccccuacggcgaccccgccuacagaaagaacgccaccagagacgccaccgccacccugaaggccuggcugaacgagcacagaaagaaccccuaccccaccaagggcgagaagaucaugcuggccaucaucaccaagaugacccugacccaggugagcaccugguucgccaacgccagaagaagacugaagaaggagaacaagaugaccuggacccccagaaacagaagcgaggacgaggaggaggaggagaacaucgaccuggagaagaacgacgaggacgagccccagaagcccgaggacaagggcgaccccgagggccccgaggccggcgccgagcagaaggccgccagcggcugcgagagacugcagggcccccccacccccgccggcaaggagaccgagggcagccugagcgacagcgacuucaaggagccccccagcgagggcagacuggacgcccugcagggcccccccagaaccggcggccccagccccgccggccccgccgccgccagacuggccgaggaccccgccccccacuaccccgccggcgcccccgcccccggcccccaccccgccgccggcgaggugccccccggccccggcggccccagcgugauccacagccccccccccccccccccccccgccgugcuggccaagcccaagcuguggagccuggccgagaucgccaccagcagcgacaaggugaaggacggcggcggcggcaacgagggcagccccugcccccccugccccggccccaucgccggccaggcccugggcggcagcagagccagccccgcccccgcccccagcagaagccccagcgcccagugccccuuccccggcggcaccgugcugagcagaccccuguacuacaccgcccccuucuaccccggcuacaccaacuacggcagcuucggccaccugcacggccaccccggccccggccccggccccaccaccggccccggcagccacuucaacggccugaaccagaccgugcugaacagagccgacgcccuggccaaggaccccaagaugcugagaagccagagccagcuggaccugugcaaggacagccccuacgagcugaagaagggcaugagcgacaucuaa

SEQ ID NO: 18650 - RNA, 429 nt, Artificial Sequence
  ISCU__Homo_sapiens__NP_055116
auggugcugaucgacaugagcguggaccugagcacccaggugguggaccacuacgagaaccccagaaacgugggcagccuggacaagaccagcaagaacgugggcaccggccuggugggcgcccccgccugcggcgacgugaugaagcugcagauccagguggacgagaagggcaagaucguggacgccagauucaagaccuucggcugcggcagcgccaucgccagcagcagccuggccaccgagugggugaagggcaagaccguggaggaggcccugaccaucaagaacaccgacaucgccaaggagcugugccugccccccgugaagcugcacugcagcaugcuggccgaggacgccaucaaggccgcccuggccgacuacaagcugaagcaggagcccaagaagggcgaggccgagaagaaguaa

SEQ ID NO: 18651 - RNA, 546 nt, Artificial Sequence
  ISG20__Homo_sapiens__NP_001290163
auggccggcagcagagaggugguggccauggacugcgagauggugggccugggcccccacagagagagcggccuggccagaugcagccuggugaacgugcacggcgccgugcuguacgacaaguucaucagacccgagggcgagaucaccgacuacagaaccagagugagcggcgugaccccccagcacauggugggcgccacccccuucgccguggccagacuggagauccugcagcugcugaagggcaagcugguggugggccacgaccugaagcacgacuuccaggcccugaaggaggacaugagcggcuacaccaucuacgacaccagcaccgacagacugcuguggagagaggccaagcuggaccacugcagaagagugagccugagagugcugagcgagagacugcugcacaagagcauccagaacagccugcugggccacagcagcguggaggacgccagagccaccauggagcuguaccagaucagccagagaaucagagccagaagaggccugcccagacuggccgugagcgacuaa

SEQ ID NO: 18652 - RNA, 1050 nt, Artificial Sequence
  ISL1__Homo_sapiens__NP_002193
augggcgacaugggcgacccccccaagaagaagagacugaucagccugugcgugggcugcggcaaccagauccacgaccaguacauccugagagugagccccgaccuggaguggcacgccgccugccugaagugcgccgagugcaaccaguaccuggacgagagcugcaccugcuucgugagagacggcaagaccuacugcaagagagacuacaucagacuguacggcaucaagugcgccaagugcagcaucggcuucagcaagaacgacuucgugaugagagccagaagcaagguguaccacaucgagugcuucagaugcguggccugcagcagacagcugauccccggcgacgaguucgcccugagagaggacggccuguucugcagagccgaccacgacgugguggagagagccagccugggcgccggcgacccccugagcccccugcaccccgccagaccccugcagauggccgccgagcccaucagcgccagacagcccgcccugagaccccacgugcacaagcagcccgagaagaccaccagagugagaaccgugcugaacgagaagcagcugcacacccugagaaccugcuacgccgccaaccccagacccgacgcccugaugaaggagcagcugguggagaugaccggccugagccccagagugaucagagugugguuccagaacaagagaugcaaggacaagaagagaagcaucaugaugaagcagcugcagcagcagcagcccaacgacaagaccaacauccagggcaugaccggcacccccaugguggccgccagccccgagagacacgacggcggccugcaggccaaccccguggaggugcagagcuaccagccccccuggaaggugcugagcgacuucgcccugcagagcgacaucgaccagcccgccuuccagcagcuggugaacuucagcgagggcggccccggcagcaacagcaccggcagcgagguggccagcaugagcagccagcugcccgacacccccaacagcaugguggccagccccaucgaggccuaa

SEQ ID NO: 18653 - RNA, 1395 nt, Artificial Sequence
  ISM1__Homo_sapiens__NP_543016
auggugagacuggccgccgagcugcugcugcugcugggccugcugcugcugacccugcacaucaccgugcugagaggcagcggcgccgccgacggccccgacgccgccgccggcaacgccagccaggcccagcugcagaacaaccugaacgugggcagcgacaccaccagcgagaccagcuucagccugagcaaggaggcccccagagagcaccuggaccaccaggccgcccaccagcccuuccccagacccagauucagacaggagaccggccaccccagccugcagagagacuuccccagaagcuuccugcuggaccugcccaacuuccccgaccugagcaaggccgacaucaacggccagaaccccaacauccaggugaccaucgaggugguggacggccccgacagcgaggccgacaaggaccagcaccccgagaacaagcccagcuggagcgugcccagccccgacuggagagccugguggcagagaagccugagccuggccagagccaacagcggcgaccaggacuacaaguacgacagcaccagcgacgacagcaacuuccugaacccccccagaggcugggaccacaccgcccccggccacagaaccuucgagaccaaggaccagcccgaguacgacagcaccgacggcgagggcgacuggagccuguggagcgugugcagcgugaccugcggcaacggcaaccagaagagaaccagaagcugcggcuacgccugcaccgccaccgagagcagaaccugcgacagacccaacugccccggcaucgaggacaccuucagaaccgccgccaccgaggugagccugcuggccggcagcgaggaguucaacgccaccaagcuguucgagguggacaccgacagcugcgagagauggaugagcugcaagagcgaguuccugaagaaguacaugcacaaggugaugaacgaccugcccagcugccccugcagcuaccccaccgagguggccuacagcaccgccgacaucuucgacagaaucaagagaaaggacuucagauggaaggacgccagcggccccaaggagaagcuggagaucuacaagcccaccgccagauacugcaucagaagcaugcugagccuggagagcaccacccuggccgcccagcacugcugcuacggcgacaacaugcagcugaucaccagaggcaagggcgccggcacccccaaccugaucagcaccgaguucagcgccgagcugcacuacaagguggacgugcugcccuggaucaucugcaagggcgacuggagcagauacaacgaggccagaccccccaacaacggccagaagugcaccgagagccccagcgacgaggacuacaucaagcaguuccaggaggccagagaguacuaa

SEQ ID NO: 18654 - RNA, 879 nt, Artificial Sequence
  ISM2__Homo_sapiens__NP_872315
augagagcccugagagacagagccggccugcugcugugcgugcugcugcuggccgcccugcuggaggccgcccugggccugcccgugaagaagcccagacugagaggccccagacccggcagccugaccagacuggccgaggugagcgccagccccgaccccagaccccugaaggaggaggaggaggccccccugcugcccagaacccaccugcaggccgagccccaccagcacggcugcuggaccgugaccgagcccgccgccaugacccccggcaacgccaccccccccagaacccccgaggugaccccccugagacuggagcugcagaagcugcccggccuggccaacaccacccugagcacccccaaccccgacacccaggccagcgccagccccgaccccagaccccugagagaggaggaggaggccagacugcugcccagaacccaccugcaggccgagcugcaccagcacggcugcuggaccgugaccgagcccgccgcccugacccccggcaacgccaccccccccagaacccaggaggugaccccccugcugcuggagcugcagaagcugcccgagcuggugcacgccacccugagcacccccaaccccgacaaccagaccaugagccugagaagaagcggcgugcccggccugcccgccgugggcaccgccgcccuggccagcagcagaggccugggccccguggccauggccgcccugccccccagacccgugcccgugaccugcccccccgugcuggcccugagaaccagaacccccugggccagccccgugagaagcggcagcagcuggcccgccaugcugagaaccugcaugaucaagauguggaccgccgugagaagcggcuaa

SEQ ID NO: 18655 - RNA, 1356 nt, Artificial Sequence
  ISPD__Homo_sapiens__NP_001094896
auggaggccggcccccccggcagcgccagacccgccgagcccggccccugccugagcggccagagaggcgccgaccacaccgccagcgccagccugcagagcguggccggcaccgagcccggcagacacccccaggccguggccgccgugcugcccgccggcggcugcggcgagagaaugggcgugcccacccccaagcaguucugccccauccuggagagaccccugaucagcuacacccugcaggcccuggagagagugugcuggaucaaggacaucgugguggccgugaccggcgagaacauggaggugaugaagagcaucauccagaaguaccagcacaagagaaucagccugguggaggccggcgugaccagacacagaagcaucuucaacggccugaaggcccuggccgaggaccagaucaacagcaagcugagcaagcccgagguggugaucauccacgacgccgugagacccuucguggaggagggcgugcugcugaagguggugaccgccgccaaggagcacggcgccgccggcgccaucagaccccuggugagcaccguggugagccccagcgccgacggcugccuggacuacagccuggagagagccagacacagagccagcgagaugccccaggccuuccuguucgacgugaucuacgaggccuaccagcagugcagcgacuacgaccuggaguucggcaccgagugccugcagcuggcccugaaguacugcugcaccaaggccaagcugguggagggcagccccgaccuguggaaggugaccuacaagagagaccuguacgccgccgagagcaucaucaaggagagaaucagccaggagaucugcguggugauggacaccgaggaggacaacaagcacgugggccaccugcuggaggaggugcugaagagcgagcugaaccacgugaaggugaccagcgaggcccugggccacgccggcagacaccugcagcagaucauccuggaccagugcuacaacuucgugugcgugaacgugaccaccagcgacuuccaggagacccagaagcugcugagcaugcuggaggagagcagccugugcauccuguaccccguggugguggugagcgugcacuuccuggacuucaagcuggugccccccagccagaagauggagaaccugaugcagaucagagaguucgccaaggaggugaaggagagaaacauccugcuguacggccugcugaucagcuacccccaggacgaccagaagcugcaggagagccugagacagggcgccaucaucaucgccagccugaucaaggagagaaacagcggccugaucggccagcugcugaucgccuaa

SEQ ID NO: 18656 - RNA, 1101 nt, Artificial Sequence
  IST1__Homo_sapiens__NP_001257904
augcugggcagcggcuucaaggccgagagacugagagugaaccugagacuggugaucaacagacugaagcugcuggagaagaagaagaccgagcuggcccagaaggccagaaaggagaucgccgacuaccuggccgccggcaaggacgagagagccagaaucagaguggagcacaucaucagagaggacuaccugguggaggccauggagauccuggagcuguacugcgaccugcugcuggccagauucggccugauccagagcaugaaggagcuggacagcggccuggccgagagcgugagcacccugaucugggccgcccccagacugcagagcgagguggccgagcugaagaucguggccgaccagcugugcgccaaguacagcaaggaguacggcaagcugugcagaaccaaccagaucggcaccgugaacgacagacugaugcacaagcugagcguggaggccccccccaagauccugguggagagauaccugaucgagaucgccaagaacuacaacgugcccuacgagcccgacagcguggugauggccgaggccccccccggcguggagaccgaccugaucgacgugggcuucaccgacgacgugaagaagggcggccccggcagaggcggcagcggcggcuucaccgcccccgugggcggccccgacggcaccgugcccaugcccaugcccaugcccaugcccaugcccagcgccaacacccccuucagcuacccccugcccaagggccccagcgacuucaacggccugcccaugggcaccuaccaggccuuccccaacauccaccccccccagauccccgccaccccccccagcuacgagagcguggacgacaucaacgccgacaagaacaucagcagcgcccagaucgugggccccggccccaagcccgaggccagcgccaagcugcccagcagacccgccgacaacuacgacaacuucgugcugcccgagcugcccagcgugcccgacacccugcccaccgccagcgccggcgccagcaccagcgccagcgaggacaucgacuucgacgaccugagcagaagauucgaggagcugaagaagaagaccuaa

SEQ ID NO: 18657 - RNA, 738 nt, Artificial Sequence
  ISX__Homo_sapiens__NP_001290437
augugcgccgaggugggccccgcccugugcagaggcauggagagaaacagccugggcugcugcgaggcccccaagaagcugagccugagcuucagcaucgaggccauccugaagagacccgccagaagaagcgacauggacagacccgagggccccggcgaggagggccccggcgaggccgccgccagcggcagcggccuggagaagccccccaaggaccagccccaggagggcagaaagagcaagagaagagugagaaccaccuucaccaccgagcagcugcacgagcuggagaagaucuuccacuucacccacuaccccgacgugcacaucagaagccagcuggccgccagaaucaaccugcccgaggccagagugcagaucugguuccagaaccagagagccaaguggagaaagcaggagaagaucggcaaccugggcgccccccagcagcugagcgaggccagcguggcccugcccaccaaccuggacguggccggccccaccuggaccagcaccgcccugagaagacuggccccccccaccagcugcugccccagcgcccaggaccagcuggccagcgccugguuccccgccuggaucacccugcugcccgcccaccccugggagacccagcccgugcccggccugcccauccaccagaccugcauccccgugcugugcauccugccccccccccaccccaaguggggcagcaucugcgccaccagcaccuaa

SEQ ID NO: 18658 - RNA, 1515 nt, Artificial Sequence
  ISYNA1__Homo_sapiens__NP_001164409
auggaggccgccgcccaguucuucguggagagccccgacgugguguacggccccgaggccaucgaggcccaguacgaguacagaaccaccagagugagcagagagggcggcgugcugaaggaggccaacuacuacggcagccugacccaggccggcaccgugagccugggccuggacgccgagggccaggagguguucgugcccuucagcgccgugcugcccaugguggcccccaacgaccugguguucgacggcugggacaucagcagccugaaccuggccgaggccaugagaagagccaaggugcuggacuggggccugcaggagcagcuguggccccacauggaggcccugagacccagacccagcguguacauccccgaguucaucgccgccaaccagagcgccagagccgacaaccugauccccggcagcagagcccagcagcuggagcagaucagaagagacaucagagacuucagaagcagcgccggccuggacaaggugaucgugcuguggaccgccaacaccgagagauucugcgaggugauccccggccugaacgacaccgccgagaaccugcugagaaccaucgagcugggccuggaggugagccccagcacccuguucgccguggccagcauccuggagggcugcgccuuccugaacggcagcccccagaacacccuggugcccggcgcccuggagcuggccuggcagcacagaguguucgugggcggcgacgacuucaagagcggccagaccaaggugaagagcgugcugguggacuuccugaucggcagcggccugaagaccaugagcaucgugagcuacaaccaccugggcaacaacgacggcgagaaccugagcgccccccugcaguucagaagcaaggaggugagcaagagcaacgugguggacgacauggugcagagcaaccccgugcuguacacccccggcgaggagcccgaccacugcguggugaucaaguacgugcccuacgugggcgacagcaagagagcccuggacgaguacaccagcgagcugaugcugggcggcaccaacacccuggugcugcacaacaccugcgaggacagccugcuggccgcccccaucaugcuggaccuggcccugcugaccgagcugugccagagagugagcuucugcaccgacauggaccccgagccccagaccuuccaccccgugcugagccugcugagcuuccuguucaaggccccccuggugccccccggcagccccguggugaacgcccuguucagacagagaagcugcaucgagaacauccugagagccugcgugggccugcccccccagaaccacaugcugcuggagcacaagauggagagacccggccccagccugaagagagugggccccguggccgccaccuaccccaugcugaacaagaagggccccgugcccgccgccaccaacggcugcaccggcgacgccaacggccaccugcaggaggagccccccaugcccaccaccuaa

SEQ ID NO: 18659 - RNA, 2712 nt, Artificial Sequence
  ITCH__Homo_sapiens__NP_001244066
augagcgacagcggcagccagcugggcagcaugggcagccugaccaugaagagccagcugcagaucaccgugaucagcgccaagcugaaggagaacaagaagaacugguucggccccagccccuacguggaggugaccguggacggccagagcaagaagaccgagaagugcaacaacaccaacagccccaaguggaagcagccccugaccgugaucgugacccccgugagcaagcugcacuucagaguguggagccaccagacccugaagagcgacgugcugcugggcaccgccgcccuggacaucuacgagacccugaagagcaacaacaugaagcuggaggaggugguggugacccugcagcugggcggcgacaaggagcccaccgagaccaucggcgaccugagcaucugccuggacggccugcagcuggagagcgagguggugaccaacggcgagaccaccugcagcgagaacggcgugagccugugccugcccagacuggagugcaacagcgccaucagcgcccacugcaaccugugccugcccggccugagcgacagccccaucagcgccagcagaguggccggcuucaccggcgccagccagaacgacgacggcagcagaagcaaggacgagaccagagugagcaccaacggcagcgacgaccccgaggacgccggcgccggcgagaacagaagagugagcggcaacaacagccccagccugagcaacggcggcuucaagcccagcagaccccccagacccagcagaccccccccccccacccccagaagacccgccagcgugaacggcagccccagcgccaccagcgagagcgacggcagcagcaccggcagccugccccccaccaacaccaacaccaacaccagcgagggcgccaccagcggccugaucaucccccugaccaucagcggcggcagcggccccagaccccugaaccccgugacccaggccccccugccccccggcugggagcagagaguggaccagcacggcagaguguacuacguggaccacguggagaagagaaccaccugggacagacccgagccccugccccccggcugggagagaagaguggacaacaugggcagaaucuacuacguggaccacuucaccagaaccaccaccuggcagagacccacccuggagagcgugagaaacuacgagcaguggcagcugcagagaagccagcugcagggcgccaugcagcaguucaaccagagauucaucuacggcaaccaggaccuguucgccaccagccagagcaaggaguucgacccccugggcccccugccccccggcugggagaagagaaccgacagcaacggcagaguguacuucgugaaccacaacaccagaaucacccagugggaggaccccagaagccagggccagcugaacgagaagccccugcccgagggcugggagaugagauucaccguggacggcauccccuacuucguggaccacaacagaagaaccaccaccuacaucgaccccagaaccggcaagagcgcccuggacaacggcccccagaucgccuacgugagagacuucaaggccaaggugcaguacuucagauucuggugccagcagcuggccaugccccagcacaucaagaucaccgugaccagaaagacccuguucgaggacagcuuccagcagaucaugagcuucagcccccaggaccugagaagaagacugugggugaucuuccccggcgaggagggccuggacuacggcggcguggccagagagugguucuuccugcugagccacgaggugcugaaccccauguacugccuguucgaguacgccggcaaggacaacuacugccugcagaucaaccccgccagcuacaucaaccccgaccaccugaaguacuucagauucaucggcagauucaucgccauggcccuguuccacggcaaguucaucgacaccggcuucagccugcccuucuacaagagaauccugaacaagcccgugggccugaaggaccuggagagcaucgaccccgaguucuacaacagccugaucugggugaaggagaacaacaucgaggagugcgaccuggagauguacuucagcguggacaaggagauccugggcgagaucaagagccacgaccugaagcccaacggcggcaacauccuggugaccgaggagaacaaggaggaguacaucagaaugguggccgaguggagacugagcagaggcguggaggagcagacccaggccuucuucgagggcuucaacgagauccugccccagcaguaccugcaguacuucgacgccaaggagcuggaggugcugcugugcggcaugcaggagaucgaccugaacgacuggcagagacacgccaucuacagacacuacgccagaaccagcaagcagaucaugugguucuggcaguucgugaaggagaucgacaacgagaagagaaugagacugcugcaguucgugaccggcaccugcagacugcccgugggcggcuucgccgaccugaugggcagcaacggcccccagaaguucugcaucgagaaggugggcaaggagaacuggcugcccagaagccacaccugcuucaacagacuggaccugccccccuacaagagcuacgagcagcugaaggagaagcugcuguucgccaucgaggagaccgagggcuucggccaggaguaa

SEQ ID NO: 18660 - RNA, 1395 nt, Artificial Sequence
  ITFG1__Homo_sapiens__NP_001291931
auggacgugcugcugaccuaccugcccaagaacuacgccaagagcgagcugggcgccgugaucuucuggggccagaaccagacccuggaccccaacaacaugaccauccugaacagaaccuuccaggacgagccccugaucauggacuucaacggcgaccugauccccgacaucuucggcaucaccaacgagagcaaccagccccagauccugcugggcggcaaccugagcuggcaccccgcccugaccaccaccagcaagaugagaaucccccacagccacgccuucaucgaccugaccgaggacuucaccgccgaccuguuccugaccacccugaacgccaccaccagcaccuuccaguucgagaucugggagaaccuggacggcaacuucagcgugagcaccauccuggagaagccccagaacaugaugguggugggccagagcgccuucgccgacuucgacggcgacggccacauggaccaccugcugcccggcugcgaggacaagaacugccagaagagcaccaucuaccuggugagaagcggcaugaagcagugggugcccgugcugcaggacuucagcaacaagggcacccuguggggcuucgugcccuucguggacgagcagcagcccaccgagauccccauccccaucacccugcacaucggcgacuacaacauggacggcuaccccgacgcccuggugauccugaagaacaccagcggcagcaaccagcaggccuuccugcuggagaacgugcccugcaacaacgccagcugcgaggaggccagaagaauguucaagguguacugggagcugaccgaccugaaccagaucaaggacgccaugguggccaccuucuucgacaucuacgaggacggcauccuggacaucguggugcugagcaagggcuacaccaagaacgacuucgccauccacacccugaagaacaacuucgaggccgacgccuacuucgugaaggugaucgugcugagcggccugugcagcaacgacugccccagaaagaucacccccuucggcgugaaccagcccggccccuacaucauguacaccaccguggacgccaacggcuaccugaagaacggcagcgccggccagcugagccagagcgcccaccuggcccugcagcugcccuacaacgugcugggccugggcagaagcgccaacuuccuggaccaccuguacgugggcauccccagacccagcggcgagaagagcaucagaaagcaggaguggaccgccaucauccccaacagccagcugaucgugauccccuacccccacaacgugcccagaagcagccacagaugccugugcuuccaccugggcaacaacuggcacuucacccuggccggcaaggagagcagauaa

SEQ ID NO: 18661 - RNA, 1659 nt, Artificial Sequence
  ITFG3__Homo_sapiens__NP_114428
augcuggaccacaaggaccuggaggccgagauccacccccugaagaacgaggagagaaagagccaggagaaccugggcaaccccagcaagaacgaggacaacgugaagagcgcccccccccagagcagacugagcagaugcagagccgccgccuucuuccugagccuguuccugugccuguucgugguguucguggugagcuucgugauccccugccccgacagacccgccagccagagaauguggagaaucgacuacagcgccgccgugaucuacgacuuccuggccguggacgacaucaacggcgacagaauccaggacgugcuguuccuguacaagaacaccaacagcagcaacaacuucagcagaagcugcguggacgagggcuucagcagccccugcaccuucgccgccgccgugagcggcgccaacggcagcacccugugggagagacccguggcccaggacguggcccugguggagugcgccgugccccagcccagaggcagcgaggcccccagcgccugcauccuggugggcagacccagcagcuucaucgccgugaaccuguucaccggcgagacccuguggaaccacagcagcagcuucagcggcaacgccagcauccugagcccccugcugcaggugcccgacguggacggcgacggcgcccccgaccugcuggugcugacccaggagagagaggaggugagcggccaccuguacagcggcagcaccggccaccagaucggccugagaggcagccugggcguggacggcgagagcggcuuccugcugcacgugaccagaaccggcgcccacuacauccuguuccccugcgccagcagccugugcggcugcagcgugaagggccuguacgagaaggugaccggcagcggcggccccuucaagagcgacccccacugggagagcaugcugaacgccaccaccagaagaaugcugagccacagcagcggcgccgugagauaccugaugcacgugcccggcaacgccggcgccgacgugcugcuggugggcagcgaggccuucgugcugcuggacggccaggagcugacccccagauggacccccaaggccgcccacgugcugagaaagcccaucuucggcagauacaagcccgacacccuggccguggccguggagaacggcaccggcaccgacagacagauccuguuccuggaccugggcaccggcgccgugcugugcagccuggcccugcccagccugcccggcggcccccugagcgccagccugcccaccgccgaccacagaagcgccuucuucuucuggggccugcacgagcugggcagcaccagcgagaccgagaccggcgaggccagacacagccuguacauguuccaccccacccugcccagagugcugcuggagcuggccaacgugagcacccacaucguggccuucgacgccgugcuguucgagcccagcagacacgccgccuacauccugcugaccggccccgccgacagcgaggcccccggccuggugagcgugaucaagcacaaggugagagaccuggugcccagcagcagaguggugagacugggcgagggcggccccgacagcgaccaggccaucagagacagauucagcagacugagauaccagagcgaggccuaa

SEQ ID NO: 18662 - RNA, 3111 nt, Artificial Sequence
  ITGA10__Homo_sapiens__NP_001289969
augaacaucacccacgccuacagccagggccaccagaagcugaaccuggacaccgugagcuacaacaugcugggcguggacagcgacggcugccccaccuacauggacguggugaucgugcuggacggcagcaacagcaucuaccccuggagcgaggugcagaccuuccugagaagacuggugggcaagcuguucaucgaccccgagcagauccaggugggccuggugcaguacggcgagagccccgugcacgaguggagccugggcgacuucagaaccaaggaggagguggugagagccgccaagaaccugagcagaagagagggcagagagaccaagaccgcccaggccaucaugguggccugcaccgagggcuucagccagagccacggcggcagacccgaggccgccagacugcuggugguggugaccgacggcgagagccacgacggcgaggagcugcccgccgcccugaaggccugcgaggccggcagagugaccagauacggcaucgccgugcugggccacuaccugagaagacagagagaccccagcagcuuccugagagagaucagaaccaucgccagcgaccccgacgagagauucuucuucaacgugaccgacgaggccgcccugaccgacaucguggacgcccugggcgacagaaucuucggccuggagggcagccacgccgagaacgagagcagcuucggccuggagaugagccagaucggcuucagcacccacagacugaaggacggcauccuguucggcauggugggcgccuacgacuggggcggcagcgugcuguggcuggagggcggccacagacuguucccccccagaauggcccuggaggacgaguucccccccgcccugcagaaccacgccgccuaccugggcuacagcgugagcagcaugcugcugagaggcggcagaagacuguuccugagcggcgcccccagauucagacacagaggcaaggugaucgccuuccagcugaagaaggacggcgccgugagaguggcccagagccugcagggcgagcagaucggcagcuacuucggcagcgagcugugcccccuggacaccgacagagacggcaccaccgacgugcugcugguggccgcccccauguuccugggcccccagaacaaggagaccggcagaguguacguguaccuggugggccagcagagccugcugacccugcagggcacccugcagcccgagcccccccaggacgccagauucggcuucgccaugggcgcccugcccgaccugaaccaggacggcuucgccgacguggccgugggcgccccccuggaggacggccaccagggcgcccuguaccuguaccacggcacccagagcggcgugagaccccaccccgcccagagaaucgccgccgccagcaugccccacgcccugagcuacuucggcagaagcguggacggcagacuggaccuggacggcgacgaccugguggacguggccgugggcgcccagggcgccgccauccugcugagcagcagacccaucgugcaccugacccccagccuggaggugaccccccaggccaucagcguggugcagagagacugcagaagaagaggccaggaggccgugugccugaccgccgcccugugcuuccaggugaccagcagaacccccggcagaugggaccaccaguucuacaugagauucaccgccagccuggacgaguggaccgccggcgccagagccgccuucgacggcagcggccagagacugagccccagaagacugagacugagcgugggcaacgugaccugcgagcagcugcacuuccacgugcuggacaccagcgacuaccugagacccguggcccugaccgugaccuucgcccuggacaacaccaccaagcccggccccgugcugaacgagggcagccccaccagcauccagaagcuggugcccuucagcaaggacugcggccccgacaacgagugcgugaccgaccuggugcugcaggugaacauggacaucagaggcagcagaaaggcccccuucguggugagaggcggcagaagaaaggugcuggugagcaccacccuggagaacagaaaggagaacgccuacaacaccagccugagccugaucuucagcagaaaccugcaccuggccagccugaccccccagagagagagccccaucaagguggagugcgccgcccccagcgcccacgccagacugugcagcgugggccaccccguguuccagaccggcgccaaggugaccuuccugcuggaguucgaguucagcugcagcagccugcugagccagguguucgugaagcugaccgccagcagcgacagccuggagagaaacggcacccugcaggacaacaccgcccagaccagcgccuacauccaguacgagccccaccugcuguucagcagcgagagcacccugcacagauacgaggugcaccccuacggcacccugcccgugggccccggccccgaguucaagaccacccugagagugcagaaccugggcugcuacguggugagcggccugaucaucagcgcccugcugcccgccguggcccacggcggcaacuacuuccugagccugagccaggugaucaccaacaacgccagcugcaucgugcagaaccugaccgagccccccggcccccccgugcaccccgaggagcugcagcacaccaacagacugaacggcagcaacacccagugccagguggugagaugccaccugggccagcuggccaagggcaccgaggugagcgugggccugcugagacuggugcacaacgaguucuucagaagagccaaguucaagagccugaccguggugagcaccuucgagcugggcaccgaggagggcagcgugcugcagcugaccgaggccagcagauggagcgagagccugcuggagguggugcagaccagacccauccugaucagccuguggauccugaucggcagcgugcugggcggccugcugcugcuggcccugcugguguucugccuguggaagcugggcuucuucgcccacaagaagauccccgaggaggagaagagagaggagaagcuggagcaguaa

SEQ ID NO: 18663 - RNA, 3567 nt, Artificial Sequence
  ITGA11__Homo_sapiens__NP_001004439
auggaccugcccagaggccuggugguggccugggcccugagccuguggcccggcuucaccgacaccuucaacauggacaccagaaagcccagagugauccccggcagcagaaccgccuucuucggcuacaccgugcagcagcacgacaucagcggcaacaaguggcugguggugggcgccccccuggagaccaacggcuaccagaagaccggcgacguguacaagugccccgugauccacggcaacugcaccaagcugaaccugggcagagugacccugagcaacgugagcgagagaaaggacaacaugagacugggccugagccuggccaccaaccccaaggacaacagcuuccuggccugcagcccccuguggagccacgagugcggcagcagcuacuacaccaccggcaugugcagcagagugaacagcaacuucagauucagcaagaccguggcccccgcccugcagagaugccagaccuacauggacaucgugaucgugcuggacggcagcaacagcaucuaccccuggguggaggugcagcacuuccugaucaacauccugaagaaguucuacaucggccccggccagauccaggugggcguggugcaguacggcgaggacguggugcacgaguuccaccugaacgacuacagaagcgugaaggacgugguggaggccgccagccacaucgagcagagaggcggcaccgagaccagaaccgccuucggcaucgaguucgccagaagcgaggccuuccagaagggcggcagaaagggcgccaagaaggugaugaucgugaucaccgacggcgagagccacgacagccccgaccuggagaaggugauccagcagagcgagagagacaacgugaccagauacgccguggccgugcugggcuacuacaacagaagaggcaucaaccccgagaccuuccugaacgagaucaaguacaucgccagcgaccccgacgacaagcacuucuucaacgugaccgacgaggccgcccugaaggacaucguggacgcccugggcgacagaaucuucagccuggagggcaccaacaagaacgagaccagcuucggccuggagaugagccagaccggcuucagcagccacgugguggaggacggcgugcugcugggcgccgugggcgccuacgacuggaacggcgccgugcugaaggagaccagcgccggcaaggugaucccccugagagagagcuaccugaaggaguuccccgaggagcugaagaaccacggcgccuaccugggcuacaccgugaccagcguggugagcagcagacagggcagaguguacguggccggcgcccccagauucaaccacaccggcaaggugauccuguucaccaugcacaacaacagaagccugaccauccaccaggccaugagaggccagcagaucggcagcuacuucggcagcgagaucaccagcguggacaucgacggcgacggcgugaccgacgugcugcuggugggcgcccccauguacuucaacgagggcagagagagaggcaagguguacguguacgagcugagacagaaccuguucguguacaacggcacccugaaggacagccacagcuaccagaacgccagauucggcagcagcaucgccagcgugagagaccugaaccaggacagcuacaacgacgugguggugggcgccccccuggaggacaaccacgccggcgccaucuacaucuuccacggcuucagaggcagcauccugaagacccccaagcagagaaucaccgccagcgagcuggccaccggccugcaguacuucggcugcagcauccacggccagcuggaccugaacgaggacggccugaucgaccuggccgugggcgcccugggcaacgccgugauccuguggagcagacccguggugcagaucaacgccagccugcacuucgagcccagcaagaucaacaucuuccacagagacugcaagagaagcggcagagacgccaccugccuggccgccuuccugugcuucacccccaucuuccuggccccccacuuccagaccaccaccgugggcaucagauacaacgccaccauggacgagagaagauacacccccagagcccaccuggacgagggcggcgacagauucaccaacagagccgugcugcugagcagcggccaggagcugugcgagagaaucaacuuccacgugcuggacaccgccgacuacgugaagcccgugaccuucagcguggaguacagccuggaggaccccgaccacggccccaugcuggacgacggcuggcccaccacccugagagugagcgugcccuucuggaacggcugcaacgaggacgagcacugcgugcccgaccuggugcuggacgccagaagcgaccugcccaccgccauggaguacugccagagagugcugagaaagcccgcccaggacugcagcgccuacacccugagcuucgacaccaccguguucaucaucgagagcaccagacagagaguggccguggaggccacccuggagaacagaggcgagaacgccuacagcaccgugcugaacaucagccagagcgccaaccugcaguucgccagccugauccagaaggaggacagcgacggcagcaucgagugcgugaacgaggagagaagacugcagaagcaggugugcaacgugagcuaccccuucuucagagccaaggccaagguggccuucagacuggacuucgaguucagcaagagcaucuuccugcaccaccuggagaucgagcuggccgccggcagcgacagcaacgagagagacagcaccaaggaggacaacguggccccccugagauuccaccugaaguacgaggccgacgugcuguucaccagaagcagcagccugagccacuacgaggugaagcccaacagcagccuggagagauacgacggcaucggcccccccuucagcugcaucuucagaauccagaaccugggccuguuccccauccacggcaugaugaugaagaucaccauccccaucgccaccagaagcggcaacagacugcugaagcugagagacuuccugaccgacgaggccaacaccagcugcaacaucuggggcaacagcaccgaguacagacccacccccguggaggaggaccugagaagagccccccagcugaaccacagcaacagcgacguggugagcaucaacugcaacaucagacuggugcccaaccaggagaucaacuuccaccugcugggcaaccuguggcugagaagccugaaggcccugaaguacaagagcaugaagaucauggugaacgccgcccugcagagacaguuccacagccccuucaucuucagagaggaggaccccagcagacagaucguguucgagaucagcaagcaggaggacuggcaggugcccaucuggaucaucgugggcagcacccugggcggccugcugcugcuggcccugcuggugcuggcccuguggaagcugggcuucuucagaagcgccagaagaagaagagagcccggccuggaccccacccccaaggugcuggaguaa

SEQ ID NO: 18664 - RNA, 3540 nt, Artificial Sequence
  ITGA1__Homo_sapiens__NP_852478
auggcccccagacccagagccagacccggcguggccguggccugcugcuggcugcugaccguggugcugagaugcugcgugagcuucaacguggacgugaagaacagcaugaccuucagcggccccguggaggacauguucggcuacaccgugcagcaguacgagaacgaggagggcaagugggugcugaucggcagcccccuggugggccagcccaagaacagaaccggcgacguguacaagugccccgugggcagaggcgagagccugcccugcgugaagcuggaccugcccgugaacaccagcauccccaacgugaccgaggugaaggagaacaugaccuucggcagcacccuggugaccaaccccaacggcggcuuccuggccugcggcccccuguacgccuacagaugcggccaccugcacuacaccaccggcaucugcagcgacgugagccccaccuuccagguggugaacagcaucgcccccgugcaggagugcagcacccagcuggacaucgugaucgugcuggacggcagcaacagcaucuaccccugggacagcgugaccgccuuccugaacgaccugcuggagagaauggacaucggccccaagcagacccaggugggcaucgugcaguacggcgagaacgugacccacgaguucaaccugaacaaguacagcagcaccgaggaggugcugguggccgccaagaagaucgugcagagaggcggcagacagaccaugaccgcccugggcaucgacaccgccagaaaggaggccuucaccgaggccagaggcgccagaagaggcgugaagaaggugauggugaucgugaccgacggcgagagccacgacaaccacagacugaagaaggugauccaggacugcgaggacgagaacauccagagauucagcaucgccauccugggcagcuacaacagaggcaaccugagcaccgagaaguucguggaggagaucaagagcaucgccagcgagcccaccgagaagcacuucuucaacgugagcgacgagcuggcccuggugaccaucgugaagacccugggcgagagaaucuucgcccuggaggccaccgccgaccagagcgccgccagcuucgagauggagaugagccagaccggcuucagcgcccacuacagccaggacugggugaugcugggcgccgugggcgccuacgacuggaacggcaccguggugaugcagaaggccagccagaucaucauccccagaaacaccaccuucaacguggagagcaccaagaagaacgagccccuggccagcuaccugggcuacaccgugaacagcgccaccgccagcagcggcgacgugcuguacaucgccggccagcccagauacaaccacaccggccaggugaucaucuacagaauggaggacggcaacaucaagauccugcagacccugagcggcgagcagaucggcagcuacuucggcagcauccugaccaccaccgacaucgacaaggacagcaacaccgacauccugcuggugggcgcccccauguacaugggcaccgagaaggaggagcagggcaagguguacguguacgcccugaaccagaccagauucgaguaccagaugagccuggagcccaucaagcagaccugcugcagcagcagacagcacaacagcugcaccaccgagaacaagaacgagcccugcggcgccagauucggcaccgccaucgccgccgugaaggaccugaaccuggacggcuucaacgacaucgugaucggcgccccccuggaggacgaccacggcggcgccguguacaucuaccacggcagcggcaagaccaucagaaaggaguacgcccagagaauccccagcggcggcgacggcaagacccugaaguucuucggccagagcauccacggcgagauggaccugaacggcgacggccugaccgacgugaccaucggcggccugggcggcgccgcccuguucuggagcagagacguggccguggugaaggugaccaugaacuucgagcccaacaaggugaacauccagaagaagaacugccacauggagggcaaggagaccgugugcaucaacgccaccgugugcuucgacgugaagcugaagagcaaggaggacaccaucuacgaggccgaccugcaguacagagugacccuggacagccugagacagaucagcagaagcuucuucagcggcacccaggagagaaaggugcagagaaacaucaccgugagaaagagcgagugcaccaagcacagcuucuacaugcuggacaagcacgacuuccaggacagcgugagaaucacccuggacuucaaccugaccgaccccgagaacggccccgugcuggacgacagccugcccaacagcgugcacgaguacauccccuucgccaaggacugcggcaacaaggagaagugcaucagcgaccugagccugcacguggccaccaccgagaaggaccugcugaucgugagaagccagaacgacaaguucaacgugagccugaccgugaagaacaccaaggacagcgccuacaacaccagaaccaucgugcacuacagccccaaccugguguucagcggcaucgaggccauccagaaggacagcugcgagagcaaccacaacaucaccugcaaggugggcuaccccuuccugagaagaggcgagauggugaccuucaagauccuguuccaguucaacaccagcuaccugauggagaacgugaccaucuaccugagcgccaccagcgacagcgaggagccccccgagacccugagcgacaacguggugaacaucagcauccccgugaaguacgaggugggccugcaguucuacagcagcgccagcgaguaccacaucagcaucgccgccaacgagaccgugcccgaggugaucaacagcaccgaggacaucggcaacgagaucaacaucuucuaccugaucagaaagagcggcagcuuccccaugcccgagcugaagcugagcaucagcuuccccaacaugaccagcaacggcuaccccgugcuguaccccaccggccugagcagcagcgagaacgccaacugcagaccccacaucuucgaggaccccuucagcaucaacagcggcaagaagaugaccaccagcaccgaccaccugaagagaggcaccauccuggacugcaacaccugcaaguucgccaccaucaccugcaaccugaccagcagcgacaucagccaggugaacgugagccugauccuguggaagcccaccuucaucaagagcuacuucagcagccugaaccugaccaucagaggcgagcugagaagcgagaacgccagccuggugcugagcagcagcaaccagaagagagagcuggccauccagaucagcaaggacggccugcccggcagagugccccugugggugauccugcugagcgccuucgccggccugcugcugcugaugcugcugauccuggcccuguggaagaucggcuucuucaagagaccccugaagaagaagauggagaaguaa

SEQ ID NO: 18665 - RNA, 3120 nt, Artificial Sequence
  ITGA2B__Homo_sapiens__NP_000410
auggccagagcccugugcccccugcaggcccuguggcugcuggagugggugcugcugcugcugggccccugcgccgccccccccgccugggcccugaaccuggaccccgugcagcugaccuucuacgccggccccaacggcagccaguucggcuucagccuggacuuccacaaggacagccacggcagaguggccaucguggugggcgcccccagaacccugggccccagccaggaggagaccggcggcguguuccugugccccuggagagccgagggcggccagugccccagccugcuguucgaccugagagacgagaccagaaacgugggcagccagacccugcagaccuucaaggccagacagggccugggcgccagcguggugagcuggagcgacgugaucguggccugcgcccccuggcagcacuggaacgugcuggagaagaccgaggaggccgagaagacccccgugggcagcugcuuccuggcccagcccgagagcggcagaagagccgaguacagccccugcagaggcaacacccugagcagaaucuacguggagaacgacuucagcugggacaagagauacugcgaggccggcuucagcagcguggugacccaggccggcgagcuggugcugggcgcccccggcggcuacuacuuccugggccugcuggcccaggcccccguggccgacaucuucagcagcuacagacccggcauccugcuguggcacgugagcagccagagccugagcuucgacagcagcaaccccgaguacuucgacggcuacuggggcuacagcguggccgugggcgaguucgacggcgaccugaacaccaccgaguacguggugggcgcccccaccuggagcuggacccugggcgccguggagauccuggacagcuacuaccagagacugcacagacugagaggcgagcagauggccagcuacuucggccacagcguggccgugaccgacgugaacggcgacggcagacacgaccugcuggugggcgccccccuguacauggagagcagagccgacagaaagcuggccgaggugggcagaguguaccuguuccugcagcccagaggcccccacgcccugggcgcccccagccugcugcugaccggcacccagcuguacggcagauucggcagcgccaucgccccccugggcgaccuggacagagacggcuacaacgacaucgccguggccgcccccuacggcggccccagcggcagaggccaggugcugguguuccugggccagagcgagggccugagaagcagacccagccaggugcuggacagccccuuccccaccggcagcgccuucggcuucagccugagaggcgccguggacaucgacgacaacggcuaccccgaccugaucgugggcgccuacggcgccaaccagguggccguguacagagcccagcccguggugaaggccagcgugcagcugcuggugcaggacagccugaaccccgccgugaagagcugcgugcugccccagaccaagacccccgugagcugcuucaacauccagaugugcgugggcgccaccggccacaacaucccccagaagcugagccugaacgccgagcugcagcuggacagacagaagcccagacagggcagaagagugcugcugcugggcagccagcaggccggcaccacccugaaccuggaccugggcggcaagcacagccccaucugccacaccaccauggccuuccugagagacgaggccgacuucagagacaagcugagccccaucgugcugagccugaacgugagccugccccccaccgaggccggcauggcccccgccguggugcugcacggcgacacccacgugcaggagcagaccagaaucgugcuggacugcggcgaggacgacgugugcgugccccagcugcagcugaccgccagcgugaccggcagcccccugcuggugggcgccgacaacgugcuggagcugcagauggacgccgccaacgagggcgagggcgccuacgaggccgagcuggccgugcaccugccccagggcgcccacuacaugagagcccugagcaacguggagggcuucgagagacugaucugcaaccagaagaaggagaacgagaccagaguggugcugugcgagcugggcaaccccaugaagaagaacgcccagaucggcaucgccaugcuggugagcgugggcaaccuggaggaggccggcgagagcgugagcuuccagcugcagaucagaagcaagaacagccagaaccccaacagcaagaucgugcugcuggacgugcccgugagagccgaggcccagguggagcugagaggcaacagcuuccccgccagccuggugguggccgccgaggagggcgagagagagcagaacagccuggacagcuggggccccaagguggagcacaccuacgagcugcacaacaacggccccggcaccgugaacggccugcaccugagcauccaccugcccggccagagccagcccagcgaccugcuguacauccuggacauccagccccagggcggccugcagugcuucccccagccccccgugaacccccugaagguggacuggggccugcccauccccagccccagccccauccaccccgcccaccacaagagagacagaagacagaucuuccugcccgagcccgagcagcccagcagacugcaggaccccgugcuggugagcugcgacagcgcccccugcaccguggugcagugcgaccugcaggagauggccagaggccagagagccauggugaccgugcuggccuuccuguggcugcccagccuguaccagagaccccuggaccaguucgugcugcagagccacgccugguucaacgugagcagccugcccuacgccgugcccccccugagccugcccagaggcgaggcccagguguggacccagcugcugagagcccuggaggagagagccauccccaucuggugggugcuggugggcgugcugggcggccugcugcugcugaccauccuggugcuggccauguggaaggugggcuucuucaagagaaacagacccccccuggaggaggacgacgaggagggcgaguaa

SEQ ID NO: 18666 - RNA, 3546 nt, Artificial Sequence
  ITGA2__Homo_sapiens__NP_002194
augggccccgagagaaccggcgccgccccccugccccugcugcuggugcuggcccugagccagggcauccugaacugcugccuggccuacaacgugggccugcccgaggccaagaucuucagcggccccagcagcgagcaguucggcuacgccgugcagcaguucaucaaccccaagggcaacuggcugcuggugggcagccccuggagcggcuuccccgagaacagaaugggcgacguguacaagugccccguggaccugagcaccgccaccugcgagaagcugaaccugcagaccagcaccagcauccccaacgugaccgagaugaagaccaacaugagccugggccugauccugaccagaaacaugggcaccggcggcuuccugaccugcggcccccugugggcccagcagugcggcaaccaguacuacaccaccggcgugugcagcgacaucagccccgacuuccagcugagcgccagcuucagccccgccacccagcccugccccagccugaucgacguggugguggugugcgacgagagcaacagcaucuaccccugggacgccgugaagaacuuccuggagaaguucgugcagggccuggacaucggccccaccaagacccaggugggccugauccaguacgccaacaaccccagagugguguucaaccugaacaccuacaagaccaaggaggagaugaucguggccaccagccagaccagccaguacggcggcgaccugaccaacaccuucggcgccauccaguacgccagaaaguacgccuacagcgccgccagcggcggcagaagaagcgccaccaaggugauggugguggugaccgacggcgagagccacgacggcagcaugcugaaggccgugaucgaccagugcaaccacgacaacauccugagauucggcaucgccgugcugggcuaccugaacagaaacgcccuggacaccaagaaccugaucaaggagaucaaggccaucgccagcauccccaccgagagauacuucuucaacgugagcgacgaggccgcccugcuggagaaggccggcacccugggcgagcagaucuucagcaucgagggcaccgugcagggcggcgacaacuuccagauggagaugagccaggugggcuucagcgccgacuacagcagccagaacgacauccugaugcugggcgccgugggcgccuucggcuggagcggcaccaucgugcagaagaccagccacggccaccugaucuuccccaagcaggccuucgaccagauccugcaggacagaaaccacagcagcuaccugggcuacagcguggccgccaucagcaccggcgagagcacccacuucguggccggcgcccccagagccaacuacaccggccagaucgugcuguacagcgugaacgagaacggcaacaucaccgugauccaggcccacagaggcgaccagaucggcagcuacuucggcagcgugcugugcagcguggacguggacaaggacaccaucaccgacgugcugcuggugggcgcccccauguacaugagcgaccugaagaaggaggagggcagaguguaccuguucaccaucaaggagggcauccugggccagcaccaguuccuggagggccccgagggcaucgagaacaccagauucggcagcgccaucgccgcccugagcgacaucaacauggacggcuucaacgacgugaucgugggcagcccccuggagaaccagaacagcggcgccguguacaucuacaacggccaccagggcaccaucagaaccaaguacagccagaagauccugggcagcgacggcgccuucagaagccaccugcaguacuucggcagaagccuggacggcuacggcgaccugaacggcgacagcaucaccgacgugagcaucggcgccuucggccagguggugcagcuguggagccagagcaucgccgacguggccaucgaggccagcuucacccccgagaagaucacccuggugaacaagaacgcccagaucauccugaagcugugcuucagcgccaaguucagacccaccaagcagaacaaccagguggccaucguguacaacaucacccuggacgccgacggcuucagcagcagagugaccagcagaggccuguucaaggagaacaacgagagaugccugcagaagaacaugguggugaaccaggcccagagcugccccgagcacaucaucuacauccaggagcccagcgacguggugaacagccuggaccugagaguggacaucagccuggagaaccccggcaccagccccgcccuggaggccuacagcgagaccgccaagguguucagcauccccuuccacaaggacugcggcgaggacggccugugcaucagcgaccuggugcuggacgugagacagauccccgccgcccaggagcagcccuucaucgugagcaaccagaacaagagacugaccuucagcgugacccugaagaacaagagagagagcgccuacaacaccggcaucgugguggacuucagcgagaaccuguucuucgccagcuucagccugcccguggacggcaccgaggugaccugccagguggccgccagccagaagagcguggccugcgacgugggcuaccccgcccugaagagagagcagcaggugaccuucaccaucaacuucgacuucaaccugcagaaccugcagaaccaggccagccugagcuuccaggcccugagcgagagccaggaggagaacaaggccgacaaccuggugaaccugaagaucccccugcuguacgacgccgagauccaccugaccagaagcaccaacaucaacuucuacgagaucagcagcgacggcaacgugcccagcaucgugcacagcuucgaggacgugggccccaaguucaucuucagccugaaggugaccaccggcagcgugcccgugagcauggccaccgugaucauccacaucccccaguacaccaaggagaagaacccccugauguaccugaccggcgugcagaccgacaaggccggcgacaucagcugcaacgccgacaucaacccccugaagaucggccagaccagcagcagcgugagcuucaagagcgagaacuucagacacaccaaggagcugaacugcagaaccgccagcugcagcaacgugaccugcuggcugaaggacgugcacaugaagggcgaguacuucgugaacgugaccaccagaaucuggaacggcaccuucgccagcagcaccuuccagaccgugcagcugaccgccgccgccgagaucaacaccuacaaccccgagaucuacgugaucgaggacaacaccgugaccaucccccugaugaucaugaagcccgacgagaaggccgaggugcccaccggcgugaucaucggcagcaucaucgccggcauccugcugcugcuggcccugguggccauccuguggaagcugggcuucuucaagagaaaguacgagaagaugaccaagaaccccgacgagaucgacgagaccaccgagcugagcagcuaa

SEQ ID NO: 18667 - RNA, 3156 nt, Artificial Sequence
  ITGA3__Homo_sapiens__NP_002195
augggccccggccccagcagagcccccagagcccccagacugaugcugugcgcccuggcccugaugguggccgccggcggcugcguggugagcgccuucaaccuggacaccagauuccugguggugaaggaggccggcaaccccggcagccuguucggcuacagcguggcccugcacagacagaccgagagacagcagagauaccugcugcuggccggcgcccccagagagcuggccgugcccgacggcuacaccaacagaaccggcgccguguaccugugcccccugaccgcccacaaggacgacugcgagagaaugaacaucaccgugaagaacgaccccggccaccacaucaucgaggacauguggcugggcgugaccguggccagccagggccccgccggcagagugcuggugugcgcccacagauacacccaggugcuguggagcggcagcgaggaccagagaagaauggugggcaagugcuacgugagaggcaacgaccuggagcuggacagcagcgacgacuggcagaccuaccacaacgagaugugcaacagcaacaccgacuaccuggagaccggcaugugccagcugggcaccagcggcggcuucacccagaacaccguguacuucggcgcccccggcgccuacaacuggaagggcaacagcuacaugauccagagaaaggagugggaccugagcgaguacagcuacaaggaccccgaggaccagggcaaccuguacaucggcuacaccaugcaggugggcagcuucauccugcaccccaagaacaucaccaucgugaccggcgcccccagacacagacacaugggcgccguguuccugcugagccaggaggccggcggcgaccugagaagaagacaggugcuggagggcagccaggugggcgccuacuucggcagcgccaucgcccuggccgaccugaacaacgacggcuggcaggaccugcuggugggcgcccccuacuacuucgagagaaaggaggaggugggcggcgccaucuacguguucaugaaccaggccggcaccagcuuccccgcccaccccagccugcugcugcacggccccagcggcagcgccuucggccugagcguggccagcaucggcgacaucaaccaggacggcuuccaggacaucgccgugggcgcccccuucgagggccugggcaagguguacaucuaccacagcagcagcaagggccugcugagacagccccagcaggugauccacggcgagaagcugggccugcccggccuggccaccuucggcuacagccugagcggccagauggacguggacgagaacuucuaccccgaccugcuggugggcagccugagcgaccacaucgugcugcugagagccagacccgugaucaacaucgugcacaagacccuggugcccagacccgccgugcuggaccccgcccugugcaccgccaccagcugcgugcagguggagcugugcuucgccuacaaccagagcgccggcaaccccaacuacagaagaaacaucacccuggccuacacccuggaggccgacagagacagaagaccccccagacugagauucgccggcagcgagagcgccguguuccacggcuucuucagcaugcccgagaugagaugccagaagcuggagcugcugcugauggacaaccugagagacaagcugagacccaucaucaucagcaugaacuacagccugccccugagaaugcccgacagacccagacugggccugagaagccuggacgccuaccccauccugaaccaggcccaggcccuggagaaccacaccgaggugcaguuccagaaggagugcggccccgacaacaagugcgagagcaaccugcagaugagagccgccuucgugagcgagcagcagcagaagcugagcagacugcaguacagcagagacgugagaaagcugcugcugagcaucaacgugaccaacaccagaaccagcgagagaagcggcgaggacgcccacgaggcccugcugacccugguggugccccccgcccugcugcugagcagcgugagaccccccggcgccugccaggccaacgagaccaucuucugcgagcugggcaaccccuucaagagaaaccagagaauggagcugcugaucgccuucgaggugaucggcgugacccugcacaccagagaccugcaggugcagcugcagcugagcaccagcagccaccaggacaaccuguggcccaugauccugacccugcugguggacuacacccugcagaccagccugagcauggugaaccacagacugcagagcuucuucggcggcaccgugaugggcgagagcggcaugaagaccguggaggacgugggcagcccccugaaguacgaguuccaggugggccccaugggcgagggccuggugggccugggcacccuggugcugggccuggaguggcccuacgaggugagcaacggcaaguggcugcuguaccccaccgagaucaccgugcacggcaacggcagcuggcccugcagaccccccggcgaccugaucaacccccugaaccugacccugagcgaccccggcgacagacccagcagcccccagagaagaagaagacagcuggaccccggcggcggccagggccccccccccgugacccuggccgccgccaagaaggccaagagcgagaccgugcugaccugcgccaccggcagagcccacugcguguggcuggagugccccauccccgacgcccccguggugaccaacgugaccgugaaggccagaguguggaacagcaccuucaucgaggacuacagagacuucgacagagugagagugaacggcugggccacccuguuccugagaaccagcauccccaccaucaacauggagaacaagaccaccugguucagcguggacaucgacagcgagcugguggaggagcugcccgccgagaucgagcuguggcuggugcugguggccgugggcgccggccugcugcugcugggccugaucauccugcugcuguggaagugcggcuucuucaagagagccagaaccagagcccuguacgaggccaagagacagaaggccgagaugaagagccagcccagcgagaccgagagacugaccgacgacuacuaa

SEQ ID NO: 18668 - RNA, 3099 nt, Artificial Sequence
  ITGA4__Homo_sapiens__NP_000876
auggccugggaggccagaagagagcccggccccagaagagccgccgugagagagaccgugaugcugcugcugugccugggcgugcccaccggcagacccuacaacguggacaccgagagcgcccugcuguaccagggcccccacaacacccuguucggcuacagcguggugcugcacagccacggcgccaacagauggcugcuggugggcgcccccaccgccaacuggcuggccaacgccagcgugaucaaccccggcgccaucuacagaugcagaaucggcaagaaccccggccagaccugcgagcagcugcagcugggcagccccaacggcgagcccugcggcaagaccugccuggaggagagagacaaccaguggcugggcgugacccugagcagacagcccggcgagaacggcagcaucgugaccugcggccacagauggaagaacaucuucuacaucaagaacgagaacaagcugcccaccggcggcugcuacggcgugccccccgaccugagaaccgagcugagcaagagaaucgcccccugcuaccaggacuacgugaagaaguucggcgagaacuucgccagcugccaggccggcaucagcagcuucuacaccaaggaccugaucgugaugggcgcccccggcagcagcuacuggaccggcagccuguucguguacaacaucaccaccaacaaguacaaggccuuccuggacaagcagaaccaggugaaguucggcagcuaccugggcuacagcgugggcgccggccacuucagaagccagcacaccaccgagguggugggcggcgccccccagcacgagcagaucggcaaggccuacaucuucagcaucgacgagaaggagcugaacauccugcacgagaugaagggcaagaagcugggcagcuacuucggcgccagcgugugcgccguggaccugaacgccgacggcuucagcgaccugcuggugggcgcccccaugcagagcaccaucagagaggagggcagaguguucguguacaucaacagcggcagcggcgccgugaugaacgccauggagaccaaccuggugggcagcgacaaguacgccgccagauucggcgagagcaucgugaaccugggcgacaucgacaacgacggcuucgaggacguggccaucggcgccccccaggaggacgaccugcagggcgccaucuacaucuacaacggcagagccgacggcaucagcagcaccuucagccagagaaucgagggccugcagaucagcaagagccugagcauguucggccagagcaucagcggccagaucgacgccgacaacaacggcuacguggacguggccgugggcgccuucagaagcgacagcgccgugcugcugagaaccagacccguggugaucguggacgccagccugagccaccccgagagcgugaacagaaccaaguucgacugcguggagaacggcuggcccagcgugugcaucgaccugacccugugcuucagcuacaagggcaaggaggugcccggcuacaucgugcuguucuacaacaugagccuggacgugaacagaaaggccgagagcccccccagauucuacuucagcagcaacggcaccagcgacgugaucaccggcagcauccaggugagcagcagagaggccaacugcagaacccaccaggccuucaugagaaaggacgugagagacauccugacccccauccagaucgaggccgccuaccaccugggcccccacgugaucagcaagagaagcaccgaggaguuccccccccugcagcccauccugcagcagaagaaggagaaggacaucaugaagaagaccaucaacuucgccagauucugcgcccacgagaacugcagcgccgaccugcaggugagcgccaagaucggcuuccugaagccccacgagaacaagaccuaccuggccgugggcagcaugaagacccugaugcugaacgugagccuguucaacgccggcgacgacgccuacgagaccacccugcacgugaagcugcccgugggccuguacuucaucaagauccuggagcuggaggagaagcagaucaacugcgaggugaccgacaacagcggcguggugcagcuggacugcagcaucggcuacaucuacguggaccaccugagcagaaucgacaucagcuuccugcuggacgugagcagccugagcagagccgaggaggaccugagcaucaccgugcacgccaccugcgagaacgaggaggagauggacaaccugaagcacagcagagugaccguggccaucccccugaaguacgaggugaagcugaccgugcacggcuucgugaaccccaccagcuucguguacggcagcaacgacgagaacgagcccgagaccugcaugguggagaagaugaaccugaccuuccacgugaucaacaccggcaacagcauggcccccaacgugagcguggagaucauggugcccaacagcuucagcccccagaccgacaagcuguucaacauccuggacgugcagaccaccaccggcgagugccacuucgagaacuaccagagagugugcgcccuggagcagcagaagagcgccaugcagacccugaagggcaucgugagauuccugagcaagaccgacaagagacugcuguacugcaucaaggccgacccccacugccugaacuuccugugcaacuucggcaagauggagagcggcaaggaggccagcgugcacauccagcuggagggcagacccagcauccuggagauggacgagaccagcgcccugaaguucgagaucagagccaccggcuuccccgagcccaaccccagagugaucgagcugaacaaggacgagaacguggcccacgugcugcuggagggccugcaccaccagagacccaagagauacuucaccaucgugaucaucagcagcagccugcugcugggccugaucgugcugcugcugaucagcuacgugauguggaaggccggcuucuucaagagacaguacaagagcauccugcaggaggagaacagaagagacagcuggagcuacaucaacagcaagagcaacgacgacuaa

SEQ ID NO: 18669 - RNA, 3150 nt, Artificial Sequence
  ITGA5__Homo_sapiens__NP_002196
augggcagcagaacccccgagagcccccugcacgccgugcagcugagauggggccccagaagaagacccccccugcugccccugcugcugcugcugcugccccccccccccagagugggcggcuucaaccuggacgccgaggcccccgccgugcugagcggcccccccggcagcuucuucggcuucagcguggaguucuacagacccggcaccgacggcgugagcgugcuggugggcgcccccaaggccaacaccagccagcccggcgugcugcagggcggcgccguguaccugugccccuggggcgccagccccacccagugcacccccaucgaguucgacagcaagggcagcagacugcuggagagcagccugagcagcagcgagggcgaggagcccguggaguacaagagccugcagugguucggcgccaccgugagagcccacggcagcagcauccuggccugcgccccccuguacagcuggagaaccgagaaggagccccugagcgaccccgugggcaccugcuaccugagcaccgacaacuucaccagaauccuggaguacgcccccugcagaagcgacuucagcugggccgccggccagggcuacugccagggcggcuucagcgccgaguucaccaagaccggcagaguggugcugggcggccccggcagcuacuucuggcagggccagauccugagcgccacccaggagcagaucgccgagagcuacuaccccgaguaccugaucaaccuggugcagggccagcugcagaccagacaggccagcagcaucuacgacgacagcuaccugggcuacagcguggccgugggcgaguucagcggcgacgacaccgaggacuucguggccggcgugcccaagggcaaccugaccuacggcuacgugaccauccugaacggcagcgacaucagaagccuguacaacuucagcggcgagcagauggccagcuacuucggcuacgccguggccgccaccgacgugaacggcgacggccuggacgaccugcuggugggcgccccccugcugauggacagaacccccgacggcagaccccaggaggugggcagaguguacguguaccugcagcaccccgccggcaucgagcccacccccacccugacccugaccggccacgacgaguucggcagauucggcagcagccugaccccccugggcgaccuggaccaggacggcuacaacgacguggccaucggcgcccccuucggcggcgagacccagcagggcgugguguucguguuccccggcggccccggcggccugggcagcaagcccagccaggugcugcagccccugugggccgccagccacacccccgacuucuucggcagcgcccugagaggcggcagagaccuggacggcaacggcuaccccgaccugaucgugggcagcuucggcguggacaaggccgugguguacagaggcagacccaucgugagcgccagcgccagccugaccaucuuccccgccauguucaaccccgaggagagaagcugcagccuggagggcaaccccguggccugcaucaaccugagcuucugccugaacgccagcggcaagcacguggccgacagcaucggcuucaccguggagcugcagcuggacuggcagaagcagaagggcggcgugagaagagcccuguuccuggccagcagacaggccacccugacccagacccugcugauccagaacggcgccagagaggacugcagagagaugaagaucuaccugagaaacgagagcgaguucagagacaagcugagccccauccacaucgcccugaacuucagccuggacccccaggcccccguggacagccacggccugagacccgcccugcacuaccagagcaagagcagaaucgaggacaaggcccagauccugcuggacugcggcgaggacaacaucugcgugcccgaccugcagcuggagguguucggcgagcagaaccacguguaccugggcgacaagaacgcccugaaccugaccuuccacgcccagaacgugggcgagggcggcgccuacgaggccgagcugagagugaccgccccccccgaggccgaguacagcggccuggugagacaccccggcaacuucagcagccugagcugcgacuacuucgccgugaaccagagcagacugcuggugugcgaccugggcaaccccaugaaggccggcgccagccuguggggcggccugagauucaccgugccccaccugagagacaccaagaagaccauccaguucgacuuccagauccugagcaagaaccugaacaacagccagagcgacguggugagcuucagacugagcguggaggcccaggcccaggugacccugaacggcgugagcaagcccgaggccgugcuguuccccgugagcgacuggcaccccagagaccagccccagaaggaggaggaccugggccccgccgugcaccacguguacgagcugaucaaccagggccccagcagcaucagccagggcgugcuggagcugagcugcccccaggcccuggagggccagcagcugcuguacgugaccagagugaccggccugaacugcaccaccaaccaccccaucaaccccaagggccuggagcuggaccccgagggcagccugcaccaccagcagaagagagaggcccccagcagaagcagcgccagcagcggcccccagauccugaagugccccgaggccgagugcuucagacugagaugcgagcugggcccccugcaccagcaggagagccagagccugcagcugcacuucagagugugggccaagaccuuccugcagagagagcaccagcccuucagccugcagugcgaggccguguacaaggcccugaagaugcccuacagaauccugcccagacagcugccccagaaggagagacagguggccaccgccgugcaguggaccaaggccgagggcagcuacggcgugccccuguggaucaucauccuggccauccuguucggccugcugcugcugggccugcugaucuacauccuguacaagcugggcuucuucaagagaagccugcccuacggcaccgccauggagaaggcccagcugaagccccccgccaccagcgacgccuaa

SEQ ID NO: 18670 - RNA, 3222 nt, Artificial Sequence
  ITGA6__Homo_sapiens__NP_000201
auggccgccgccggccagcugugccugcuguaccugagcgccggccugcugagcagacugggcgccgccuucaaccuggacaccagagaggacaacgugaucagaaaguacggcgaccccggcagccuguucggcuucagccuggccaugcacuggcagcugcagcccgaggacaagagacugcugcuggugggcgcccccagagccgaggcccugccccugcagagagccaacagaaccggcggccuguacagcugcgacaucaccgccagaggccccugcaccagaaucgaguucgacaacgacgccgaccccaccagcgagagcaaggaggaccaguggaugggcgugaccgugcagagccagggccccggcggcaagguggugaccugcgcccacagauacgagaagagacagcacgugaacaccaagcaggagagcagagacaucuucggcagaugcuacgugcugagccagaaccugagaaucgaggacgacauggacggcggcgacuggagcuucugcgacggcagacugagaggccacgagaaguucggcagcugccagcagggcguggccgccaccuucaccaaggacuuccacuacaucguguucggcgcccccggcaccuacaacuggaagggcaucgugagaguggagcagaagaacaacaccuucuucgacaugaacaucuucgaggacggccccuacgaggugggcggcgagaccgagcacgacgagagccuggugcccgugcccgccaacagcuaccugggcuucagccuggacagcggcaagggcaucgugagcaaggacgagaucaccuucgugagcggcgcccccagagccaaccacagcggcgccguggugcugcugaagagagacaugaagagcgcccaccugcugcccgagcacaucuucgacggcgagggccuggccagcagcuucggcuacgacguggccgugguggaccugaacaaggacggcuggcaggacaucgugaucggcgccccccaguacuucgacagagacggcgaggugggcggcgccguguacguguacaugaaccagcagggcagauggaacaacgugaagcccaucagacugaacggcaccaaggacagcauguucggcaucgccgugaagaacaucggcgacaucaaccaggacggcuaccccgacaucgccgugggcgcccccuacgacgaccugggcaagguguucaucuaccacggcagcgccaacggcaucaacaccaagcccacccaggugcugaagggcaucagccccuacuucggcuacagcaucgccggcaacauggaccuggacagaaacagcuaccccgacguggccgugggcagccugagcgacagcgugaccaucuucagaagcagacccgugaucaacauccagaagaccaucaccgugacccccaacagaaucgaccugagacagaagaccgccugcggcgcccccagcggcaucugccugcaggugaagagcugcuucgaguacaccgccaaccccgccggcuacaaccccagcaucagcaucgugggcacccuggaggccgagaaggagagaagaaagagcggccugagcagcagagugcaguucagaaaccagggcagcgagcccaaguacacccaggagcugacccugaagagacagaagcagaaggugugcauggaggagacccuguggcugcaggacaacaucagagacaagcugagacccauccccaucaccgccagcguggagauccaggagcccagcagcagaagaagagugaacagccugcccgaggugcugcccauccugaacagcgacgagcccaagaccgcccacaucgacgugcacuuccugaaggagggcugcggcgacgacaacgugugcaacagcaaccugaagcuggaguacaaguucugcaccagagagggcaaccaggacaaguucagcuaccugcccauccagaagggcgugcccgagcuggugcugaaggaccagaaggacaucgcccuggagaucaccgugaccaacagccccagcaaccccagaaaccccaccaaggacggcgacgacgcccacgaggccaagcugaucgccaccuuccccgacacccugaccuacagcgccuacagagagcugagagccuuccccgagaagcagcugagcugcguggccaaccagaacggcagccaggccgacugcgagcugggcaaccccuucaagagaaacagcaacgugaccuucuaccuggugcugagcaccaccgaggugaccuucgacacccccgaccuggacaucaaccugaagcuggagaccaccagcaaccaggacaaccuggcccccaucaccgccaaggccaagguggugaucgagcugcugcugagcgugagcggcguggccaagcccagccagguguacuucggcggcaccguggugggcgagcaggccaugaagagcgaggacgaggugggcagccugaucgaguacgaguucagagugaucaaccugggcaagccccugaccaaccugggcaccgccacccugaacauccaguggcccaaggagaucagcaacggcaaguggcugcuguaccuggugaagguggagagcaagggccuggagaaggugaccugcgagccccagaaggagaucaacagccugaaccugaccgagagccacaacagcagaaagaagagagagaucaccgagaagcagaucgacgacaacagaaaguucagccuguucgccgagagaaaguaccagacccugaacugcagcgugaacgugaacugcgugaacaucagaugcccccugagaggccuggacagcaaggccagccugauccugagaagcagacuguggaacagcaccuuccuggaggaguacagcaagcugaacuaccuggacauccugaugagagccuucaucgacgugaccgccgccgccgagaacaucagacugcccaacgccggcacccaggugagagugaccguguuccccagcaagaccguggcccaguacagcggcgugcccugguggaucauccugguggccauccuggccggcauccugaugcuggcccugcugguguucauccuguggaagugcggcuucuucaagagaaacaagaaggaccacuacgacgccaccuaccacaaggccgagauccacgcccagcccagcgacaaggagagacugaccagcgacgccuaa

SEQ ID NO: 18671 - RNA, 3426 nt, Artificial Sequence
  ITGA7__Homo_sapiens__NP_001138468
auggccggcgccagaagcagagaccccuggggcgccagcggcaucugcuaccuguucggcagccugcugguggagcugcuguucagcagagccguggccuucaaccuggacgugaugggcgcccugagaaaggagggcgagcccggcagccuguucggcuucagcguggcccugcacagacagcugcagcccagaccccagagcuggcugcuggugggcgccccccaggcccuggcccugcccggccagcaggccaacagaaccggcggccuguucgccugcccccugagccuggaggagaccgacugcuacagaguggacaucgaccagggcgccgacaugcagaaggagagcaaggagaaccaguggcugggcgugagcgugagaagccagggccccggcggcaagaucgugaccugcgcccacagauacgaggccagacagagaguggaccagauccuggagaccagagacaugaucggcagaugcuucgugcugagccaggaccuggccaucagagacgagcuggacggcggcgaguggaaguucugcgagggcagaccccagggccacgagcaguucggcuucugccagcagggcaccgccgccgccuucagccccgacagccacuaccugcuguucggcgcccccggcaccuacaacuggaagggcaccgccagaguggagcugugcgcccagggcagcgccgaccuggcccaccuggacgacggccccuacgaggccggcggcgagaaggagcaggaccccagacugauccccgugcccgccaacagcuacuucggcuucagcaucgacagcggcaagggccuggugagagccgaggagcugagcuucguggccggcgcccccagagccaaccacaagggcgccguggugauccugagaaaggacagcgccagcagacuggugcccgaggugaugcugagcggcgagagacugaccagcggcuucggcuacagccuggccguggccgaccugaacagcgacggcuggcccgaccugaucgugggcgcccccuacuucuucgagagacaggaggagcugggcggcgccguguacguguaccugaaccagggcggccacugggccggcaucagcccccugagacugugcggcagccccgacagcauguucggcaucagccuggccgugcugggcgaccugaaccaggacggcuuccccgacaucgccgugggcgcccccuucgacggcgacggcaagguguucaucuaccacggcagcagccugggcgugguggccaagcccagccaggugcuggagggcgaggccgugggcaucaagagcuucggcuacagccugagcggcagccuggacauggacggcaaccaguaccccgaccugcuggugggcagccuggccgacaccgccgugcuguucagagccagacccauccugcacgugagccacgaggugagcaucgcccccagaagcaucgaccuggagcagcccaacugcgccggcggccacagcgugugcguggaccugagagugugcuucagcuacaucgccgugcccagcagcuacagccccaccguggcccuggacuacgugcuggacgccgacaccgacagaagacugagaggccaggugcccagagugaccuuccugagcagaaaccuggaggagcccaagcaccaggccagcggcaccguguggcugaagcaccagcacgacagagugugcggcgacgccauguuccagcugcaggagaacgugaaggacaagcugagagccaucguggugacccugagcuacagccugcagacccccagacugagaagacaggcccccggccagggccugccccccguggcccccauccugaacgcccaccagcccagcacccagagagccgagauccacuuccugaagcagggcugcggcgaggacaagaucugccagagcaaccugcagcuggugagagccagauucugcaccagagugagcgacaccgaguuccagccccugcccauggacguggacggcaccaccgcccuguucgcccugagcggccagcccgugaucggccuggagcugauggugaccaaccugcccagcgaccccgcccagccccaggccgacggcgacgacgcccacgaggcccagcugcuggugaugcugcccgacagccugcacuacagcggcgugagagcccuggaccccgccgagaagccccugugccugagcaacgagaacgccagccacguggagugcgagcugggcaaccccaugaagagaggcgcccaggugaccuucuaccugauccugagcaccagcggcaucagcaucgagaccaccgagcuggagguggagcugcugcuggccaccaucagcgagcaggagcugcaccccgugagcgccagagccagaguguucaucgagcugccccugagcaucgccggcauggccaucccccagcagcuguucuucagcggcguggugagaggcgagagagccaugcagagcgagagagacgugggcagcaaggugaaguacgaggugaccgugagcaaccagggccagagccugagaacccugggcagcgccuuccugaacaucauguggccccacgagaucgccaacggcaaguggcugcuguaccccaugcagguggagcuggagggcggccagggccccggccagaagggccugugcagccccagacccaacauccugcaccuggacguggacagcagagacagaagaagaagagagcuggagccccccgagcagcaggagcccggcgagagacaggagcccagcaugagcugguggcccgugagcagcgccgagaagaagaagaacaucacccuggacugcgccagaggcaccgccaacugcgugguguucagcugcccccuguacagcuucgacagagccgccgugcugcacguguggggcagacuguggaacagcaccuuccuggaggaguacagcgccgugaagagccuggaggugaucgugagagccaacaucaccgugaagagcagcaucaagaaccugaugcugagagacgccagcaccgugauccccgugaugguguaccuggaccccauggccgugguggccgagggcgugcccuggugggugauccugcuggccgugcuggccggccugcuggugcuggcccugcuggugcugcugcuguggaagaugggcuucuucaagagagccaagcaccccgaggccaccgugccccaguaccacgccgugaagauccccagagaggacagacagcaguucaaggaggagaagaccggcaccauccugagaaacaacuggggcagccccagaagagagggccccgacgcccaccccauccuggccgccgacggccaccccgagcugggccccgacggccaccccggccccggcaccgccuaa

SEQ ID NO: 18672 - RNA, 3147 nt, Artificial Sequence
  ITGA8__Homo_sapiens__NP_001278423
augagccccggcgccagcagaggccccagaggcagccaggccccccugaucgccccccugugcugcgccgccgccgcccugggcaugcugcuguggagccccgccugccaggccuucaaccuggacguggagaagcugaccguguacagcggccccaagggcagcuacuucggcuacgccguggacuuccacauccccgacgccagaaccgccagcgugcuggugggcgcccccaaggccaacaccagccagcccgacaucguggagggcggcgccguguacuacugccccuggcccgccgagggcagcgcccagugcagacagauccccuucgacaccaccaacaacagaaagaucagagugaacggcaccaaggagcccaucgaguucaagagcaaccagugguucggcgccaccgugaaggcccacaagggcaaggugguggccugcgccccccuguaccacuggagaacccugaagcccacccccgagaaggaccccgugggcaccugcuacguggccauccagaacuucagcgccuacgccgaguucagccccugcagaaacagcaacgccgaccccgagggccagggcuacugccaggccggcuucagccuggacuucuacaagaacggcgaccugaucgugggcggccccggcagcuucuacuggcagggccaggugaucaccgccagcguggccgacaucaucgccaacuacagcuucaaggacauccugagaaagcuggccggcgagaagcagaccgagguggcccccgccagcuacgacgacagcuaccuggagcugguggccggcauccccagaggcgcccagaacuucggcuacgugagcaucaucaacagcaccgacaugaccuucauccagaacuucaccggcgagcagauggccagcuacuucggcuacaccgugguggugagcgacgugaacagcgacggccuggacgacgugcuggugggcgccccccuguucauggagagagaguucgagagcaaccccagagaggugggccagaucuaccuguaccugcaggugagcagccugcuguucagagacccccagauccugaccggcaccgagaccuucggcagauucggcagcgccauggcccaccugggcgaccugaaccaggacggcuacaacgacaucgccaucggcgugcccuucgccggcaaggaccagagaggcaaggugcugaucuacaacggcaacaaggacggccugaacaccaagcccagccaggugcugcagggcgugugggccagccacgccgugcccagcggcuucggcuucacccugagaggcgacagcgacaucgacaagaacgacuaccccgaccugaucgugggcgccuucggcaccggcaagguggccguguacagagccagacccguggugaccguggacgcccagcugcugcugcaccccaugaucaucaaccuggagaacaagaccugccaggugcccgacagcaugaccagcgccgccugcuucagccugagagugugcgccagcgugaccggccagagcaucgccaacaccaucgugcugauggccgaggugcagcuggacagccugaagcagaagggcgccaucaagagaacccuguuccuggacaaccaccaggcccacagaguguucccccuggugaucaagagacagaagagccaccagugccaggacuucaucguguaccugagagacgagaccgaguucagagacaagcugagccccaucaacaucagccugaacuacagccuggacgagagcaccuucaaggagggccuggaggugaagcccauccugaacuacuacagagagaacaucgugagcgagcaggcccacauccugguggacugcggcgaggacaaccugugcgugcccgaccugaagcugagcgccagacccgacaagcaccaggugaucaucggcgacgagaaccaccugaugcugaucaucaacgccagaaacgagggcgagggcgccuacgaggccgagcuguucgugaugauccccgaggaggccgacuacgugggcaucgagagaaacaacaagggcuucagaccccugagcugcgaguacaagauggagaacgugaccagaaugguggugugcgaccugggcaaccccauggugagcggcaccaacuacagccugggccugagauucgccgugcccagacuggagaagaccaacaugagcaucaacuucgaccugcagaucagaagcagcaacaaggacaaccccgacagcaacuucgugagccugcagaucaacaucaccgccguggcccagguggagaucagaggcgugagccaccccccccagaucgugcugcccauccacaacugggagcccgaggaggagccccacaaggaggaggaggugggcccccugguggagcacaucuacgagcugcacaacaucggccccagcaccaucagcgacaccauccuggaggugggcuggcccuucagcgccagagacgaguuccugcuguacaucuuccacauccagacccugggcccccugcagugccagcccaaccccaacaucaacccccaggacaucaagcccgccgccagccccgaggacacccccgagcugagcgccuuccugagaaacagcaccaucccccaccuggugagaaagagagacgugcacgugguggaguuccacagacagagccccgccaagauccugaacugcaccaacaucgagugccugcagaucagcugcgccgugggcagacuggagggcggcgagagcgccgugcugaaggugagaagcagacugugggcccacaccuuccugcagagaaagaacgaccccuacgcccuggccagccuggugagcuucgaggugaagaagaugcccuacaccgaccagcccgccaagcugcccgagggcagcaucgugaucaagaccagcgugaucugggccacccccaacgugagcuucagcaucccccugugggugaucauccuggccauccugcugggccugcuggugcuggccauccugacccuggcccuguggaagugcggcuucuucgacagagccagacccccccaggaggacaugaccgacagagagcagcugaccaacgacaagacccccgaggccuaa

SEQ ID NO: 18673 - RNA, 3108 nt, Artificial Sequence
  ITGA9__Homo_sapiens__NP_002198
augggcggccccgccgcccccagaggcgccggcagacugagagcccugcugcuggcccuggugguggccggcauccccgccggcgccuacaaccuggacccccagagacccgugcacuuccagggccccgccgacagcuucuucggcuacgccgugcuggagcacuuccacgacaacaccagaugggugcuggugggcgcccccaaggccgacagcaaguacagccccagcgugaagagccccggcgccguguucaagugcagagugcacaccaaccccgacagaagaugcaccgagcuggacauggccagaggcaagaacagaggcaccagcugcggcaagaccugcagagaggacagagacgacgaguggaugggcgugagccuggccagacagcccaaggccgacggcagagugcuggccugcgcccacagauggaagaacaucuacuacgaggccgaccacauccugccccacggcuucugcuacaucauccccagcaaccugcaggccaagggcagaacccugauccccugcuacgaggaguacaagaagaaguacggcgaggagcacggcagcugccaggccggcaucgccggcuucuucaccgaggagcugguggugaugggcgcccccggcagcuucuacugggccggcaccaucaaggugcugaaccugaccgacaacaccuaccugaagcugaacgacgaggugaucaugaacagaagauacaccuaccugggcuacgccgugaccgccggccacuucagccaccccagcaccaucgacguggugggcggcgccccccaggacaagggcaucggcaagguguacaucuucagagccgacagaagaagcggcacccugaucaagaucuuccaggccagcggcaagaagaugggcagcuacuucggcagcagccugugcgccguggaccugaacggcgacggccugagcgaccugcuggugggcgcccccauguucagcgagaucagagacgagggccaggugaccguguacaucaacagaggcaacggcgcccuggaggagcagcuggcccugaccggcgacggcgccuacaacgcccacuucggcgagagcaucgccagccuggacgaccuggacaacgacggcuuccccgacguggccaucggcgcccccaaggaggacgacuucgccggcgccguguacaucuaccacggcgacgccggcggcaucgugccccaguacagcaugaagcugagcggccagaagaucaaccccgugcugagaauguucggccagagcaucagcggcggcaucgacauggacggcaacggcuaccccgacgugaccgugggcgccuucaugagcgacagcguggugcugcugagagccagacccgugaucaccguggacgugagcaucuuccugcccggcagcaucaacaucaccgccccccagugccacgacggccagcagcccgugaacugccugaacgugaccaccugcuucagcuuccacggcaagcacgugcccggcgagaucggccugaacuacgugcugauggccgacguggccaagaaggagaagggccagaugcccagaguguacuucgugcugcugggcgagaccaugggccaggugaccgagaagcugcagcugaccuacauggaggagaccugcagacacuacguggcccacgugaagagaagagugcaggacgugaucagccccaucguguucgaggccgccuacagccugagcgagcacgugaccggcgaggaggagagagagcugcccccccugacccccgugcugagauggaagaagggccagaagaucgcccagaagaaccagaccguguucgagagaaacugcagaagcgaggacugcgccgccgaccugcagcugcagggcaagcugcugcugagcagcauggacgagaagacccuguaccuggcccugggcgccgugaagaacaucagccugaacaucagcaucagcaaccugggcgacgacgccuacgacgccaacgugagcuucaacgugagcagagagcuguucuucaucaacauguggcagaaggaggagaugggcaucagcugcgagcugcuggagagcgacuuccugaagugcagcgugggcuuccccuucaugagaagcaagagcaaguacgaguucagcgugaucuucgacaccagccaccugagcggcgaggaggaggugcugagcuucaucgugaccgcccagagcggcaacaccgagagaagcgagagccugcacgacaacacccuggugcugauggugccccugaugcacgagguggacaccagcaucaccggcaucaugagccccaccagcuucguguacggcgagagcguggacgccgccaacuucauccagcuggacgaccuggagugccacuuccagcccaucaacaucacccugcagguguacaacaccggccccagcacccugcccggcagcagcgugagcaucagcuuccccaacagacugagcagcggcggcgccgagauguuccacgugcaggagaugguggugggccaggagaagggcaacugcagcuuccagaagaaccccacccccugcaucaucccccaggagcaggagaacaucuuccacaccaucuucgccuucuucaccaagagcggcagaaaggugcuggacugcgagaagcccggcaucagcugccugaccgcccacugcaacuucagcgcccuggccaaggaggagagcagaaccaucgacaucuacaugcugcugaacaccgagauccugaagaaggacagcagcagcgugauccaguucaugagcagagccaaggugaagguggaccccgcccugagagugguggagaucgcccacggcaaccccgaggaggugaccgugguguucgaggcccugcacaaccuggagcccagaggcuacguggugggcuggaucaucgccaucagccugcuggugggcauccugaucuuccugcugcuggccgugcugcuguggaagaugggcuucuucagaagaagauacaaggagaucaucgaggccgagaagaacagaaaggagaacgaggacagcugggacugggugcagaagaaccaguaa

SEQ ID NO: 18674 - RNA, 3486 nt, Artificial Sequence
  ITGAD__Homo_sapiens__NP_005344
augaccuucggcaccgugcugcugcugagcgugcuggccagcuaccacggcuucaaccuggacguggaggagcccaccaucuuccaggaggacgccggcggcuucggccagagcguggugcaguucggcggcagcagacugguggugggcgccccccuggaggugguggccgccaaccagaccggcagacuguacgacugcgccgccgccaccggcaugugccagcccaucccccugcacaucagacccgaggccgugaacaugagccugggccugacccuggccgccagcaccaacggcagcagacugcuggccugcggccccacccugcacagagugugcggcgagaacagcuacagcaagggcagcugccugcugcugggcagcagaugggagaucauccagaccgugcccgacgccacccccgagugcccccaccaggagauggacaucguguuccugaucgacggcagcggcagcaucgaccagaacgacuucaaccagaugaagggcuucgugcaggccgugaugggccaguucgagggcaccgacacccuguucgcccugaugcaguacagcaaccugcugaagauccacuucaccuucacccaguucagaaccagccccagccagcagagccugguggaccccaucgugcagcugaagggccugaccuucaccgccaccggcauccugaccguggugacccagcuguuccaccacaagaacggcgccagaaagagcgccaagaagauccugaucgugaucaccgacggccagaaguacaaggacccccuggaguacagcgacgugaucccccaggccgagaaggccggcaucaucagauacgccaucggcgugggccacgccuuccagggccccaccgccagacaggagcugaacaccaucagcagcgcccccccccaggaccacguguucaagguggacaacuucgccgcccugggcagcauccagaagcagcugcaggagaagaucuacgccguggagggcacccagagcagagccagcagcagcuuccagcacgagaugagccaggagggcuucagcaccgcccugaccauggacggccuguuccugggcgccgugggcagcuucagcuggagcggcggcgccuuccuguacccccccaacaugagccccaccuucaucaacaugagccaggagaacguggacaugagagacagcuaccugggcuacagcaccgagcuggcccuguggaagggcgugcagaaccuggugcugggcgcccccagauaccagcacaccggcaaggccgugaucuucacccaggugagcagacaguggagaaagaaggccgaggugaccggcacccagaucggcagcuacuucggcgccagccugugcagcguggacguggacagcgacggcagcaccgaccugauccugaucggcgccccccacuacuacgagcagaccagaggcggccaggugagcgugugcccccugcccagaggcagagugcaguggcagugcgacgccgugcugagaggcgagcagggccaccccuggggcagauucggcgccgcccugaccgugcugggcgacgugaacgaggacaagcugaucgacguggccaucggcgcccccggcgagcaggagaacagaggcgccguguaccuguuccacggcgccagcgagagcggcaucagccccagccacagccagagaaucgccagcagccagcugagccccagacugcaguacuucggccaggcccugagcggcggccaggaccugacccaggacggccugauggaccuggccgugggcgccagaggccaggugcugcugcugagaagccugcccgugcugaaggugggcguggccaugagauucagccccguggagguggccaaggccguguacagaugcugggaggagaagcccagcgcccuggaggccggcgacgccaccgugugccugaccauccagaagagcagccuggaccagcugggcgacauccagagcagcgugagauucgaccuggcccuggaccccggcagacugaccagcagagccaucuucaacgagaccaagaaccccacccugaccagaagaaagacccugggccugggcauccacugcgagacccugaagcugcugcugcccgacugcguggaggacguggugagccccaucauccugcaccugaacuucagccuggugagagagcccauccccagcccccagaaccugagacccgugcuggccgugggcagccaggaccuguucaccgccagccugcccuucgagaagaacugcggccaggacggccugugcgagggcgaccugggcgugacccugagcuucagcggccugcagacccugaccgugggcagcagccuggagcugaacgugaucgugaccguguggaacgccggcgaggacagcuacggcaccguggugagccuguacuaccccgccggccugagccacagaagagugagcggcgcccagaagcagccccaccagagcgcccugagacuggccugcgagaccgugcccaccgaggacgagggccugagaagcagcagaugcagcgugaaccaccccaucuuccacgagggcagcaacggcaccuucaucgugaccuucgacgugagcuacaaggccacccugggcgacagaaugcugaugagagccagcgccagcagcgagaacaacaaggccagcagcagcaaggccaccuuccagcuggagcugcccgugaaguacgccguguacaccaugaucagcagacaggaggagagcaccaaguacuucaacuucgccaccagcgacgagaagaagaugaaggaggccgagcacagauacagagugaacaaccugagccagagagaccuggccaucagcaucaacuucugggugcccgugcugcugaacggcguggccgugugggacguggugauggaggcccccagccagagccugcccugcgugagcgagagaaagcccccccagcacagcgacuuccugacccagaucagcagaagccccaugcuggacugcagcaucgccgacugccugcaguucagaugcgacgugcccagcuucagcgugcaggaggagcuggacuucacccugaagggcaaccugagcuucggcugggugagagagacccugcagaagaaggugcugguggugagcguggccgagaucaccuucgacaccagcguguacagccagcugcccggccaggaggccuucaugagagcccagauggagauggugcuggaggaggacgagguguacaacgccauccccaucaucaugggcagcagcgugggcgcccugcugcugcuggcccugaucaccgccacccuguacaagcugggcuucuucaagagacacuacaaggagaugcuggaggacaagcccgaggacaccgccaccuucagcggcgacgacuucagcugcguggcccccaacgugccccugagcuaa

SEQ ID NO: 18675 - RNA, 3540 nt, Artificial Sequence
  ITGAE__Homo_sapiens__NP_002199
auguggcuguuccacacccugcugugcaucgccagccuggcccugcuggccgccuucaacguggacguggccagacccuggcugacccccaagggcggcgcccccuucgugcugagcagccugcugcaccaggaccccagcaccaaccagaccuggcugcuggugaccagccccagaaccaagagaacccccggcccccugcacagaugcagccuggugcaggacgagauccugugccaccccguggagcacgugcccauccccaagggcagacacagaggcgugaccguggugagaagccaccacggcgugcugaucugcauccaggugcuggugagaagaccccacagccugagcagcgagcugaccggcaccugcagccugcugggccccgaccugagaccccaggcccaggccaacuucuucgaccuggagaaccugcuggaccccgacgccagaguggacaccggcgacugcuacagcaacaaggagggcggcggcgaggacgacgugaacaccgccagacagagaagagcccuggagaaggaggaggaggaggacaaggaggaggaggaggacgaggaggaggaggaggccggcaccgagaucgccaucauccuggacggcagcggcagcaucgacccccccgacuuccagagagccaaggacuucaucagcaacaugaugagaaacuucuacgagaagugcuucgagugcaacuucgcccuggugcaguacggcggcgugauccagaccgaguucgaccugagagacagccaggacgugauggccagccuggccagagugcagaacaucacccaggugggcagcgugaccaagaccgccagcgccaugcagcacgugcuggacagcaucuucaccagcagccacggcagcagaagaaaggccagcaaggugaugguggugcugaccgacggcggcaucuucgaggacccccugaaccugaccaccgugaucaacagccccaagaugcagggcguggagagauucgccaucggcgugggcgaggaguucaagagcgccagaaccgccagagagcugaaccugaucgccagcgaccccgacgagacccacgccuucaaggugaccaacuacauggcccuggacggccugcugagcaagcugagauacaacaucaucagcauggagggcaccgugggcgacgcccugcacuaccagcuggcccagaucggcuucagcgcccagauccuggacgagagacaggugcugcugggcgccgugggcgccuucgacuggagcggcggcgcccugcuguacgacaccagaagcagaagaggcagauuccugaaccagaccgccgccgccgccgccgacgccgaggccgcccaguacagcuaccugggcuacgccguggccgugcugcacaagaccugcagccugagcuacaucgccggcgcccccagauacaagcaccacggcgccguguucgagcugcagaaggagggcagagaggccagcuuccugcccgugcuggagggcgagcagaugggcagcuacuucggcagcgagcugugccccguggacaucgacauggacggcagcaccgacuuccugcugguggccgcccccuucuaccacgugcacggcgaggagggcagaguguacguguacagacugagcgagcaggacggcagcuucagccuggccagaauccugagcggccaccccggcuucaccaacgccagauucggcuucgccauggccgccaugggcgaccugagccaggacaagcugaccgacguggccaucggcgccccccuggagggcuucggcgccgacgacggcgccagcuucggcagcguguacaucuacaacggccacugggacggccugagcgccagccccagccagagaaucagagccagcaccguggcccccggccugcaguacuucggcaugagcauggccggcggcuucgacaucagcggcgacggccuggccgacaucaccgugggcacccugggccaggccgugguguucagaagcagacccguggugagacugaaggugagcauggccuucacccccagcgcccugcccaucggcuucaacggcguggugaacgugagacugugcuucgagaucagcagcgugaccaccgccagcgagagcggccugagagaggcccugcugaacuucacccuggacguggacgugggcaagcagagaagaagacugcagugcagcgacgugagaagcugccugggcugccugagagaguggagcagcggcagccagcugugcgaggaccugcugcugaugcccaccgagggcgagcugugcgaggaggacugcuucagcaacgccagcgugaaggugagcuaccagcugcagacccccgagggccagaccgaccacccccagcccauccuggacagauacaccgagcccuucgccaucuuccagcugcccuacgagaaggccugcaagaacaagcuguucugcguggccgagcugcagcuggccaccaccgugagccagcaggagcugguggugggccugaccaaggagcugacccugaacaucaaccugaccaacagcggcgaggacagcuacaugaccagcauggcccugaacuaccccagaaaccugcagcugaagagaaugcagaagccccccagccccaacauccagugcgacgacccccagcccguggccagcgugcugaucaugaacugcagaaucggccaccccgugcugaagagaagcagcgcccacgugagcgugguguggcagcuggaggagaacgccuuccccaacagaaccgccgacaucaccgugaccgugaccaacagcaacgagagaagaagccuggccaacgagacccacacccugcaguucagacacggcuucguggccgugcugagcaagcccagcaucauguacgugaacaccggccagggccugagccaccacaaggaguuccuguuccacgugcacggcgagaaccuguucggcgccgaguaccagcugcagaucugcgugcccaccaagcugagaggccugcaggugguggccgugaagaagcugaccagaacccaggccagcaccgugugcaccuggagccaggagagagccugcgccuacagcagcgugcagcacguggaggaguggcacagcgugagcugcgugaucgccagcgacaaggagaacgugaccguggccgccgagaucagcugggaccacagcgaggagcugcugaaggacgugaccgagcugcagauccugggcgagaucagcuucaacaagagccuguacgagggccugaacgccgagaaccacagaaccaagaucaccgugguguuccugaaggacgagaaguaccacagccugcccaucaucaucaagggcagcgugggcggccugcuggugcugaucgugauccuggugauccuguucaagugcggcuucuucaagagaaaguaccagcagcugaaccuggagagcaucagaaaggcccagcugaagagcgagaaccugcuggaggaggagaacuaa

SEQ ID NO: 18676 - RNA, 3261 nt, Artificial Sequence
  ITGAL__Homo_sapiens__NP_001107852
augaaggacagcugcaucaccgugauggccauggcccugcugagcggcuucuucuucuucgcccccgccagcagcuacaaccuggacgugagaggcgccagaagcuucagcccccccagagccggcagacacuucggcuacagagugcugcaggugggcaacggcgugaucgugggcgcccccggcgagggcaacagcaccggcagccuguaccagugccagagcggcaccggccacugccugcccgugacccugagaggcagcaacuacaccagcaaguaccugggcaugacccuggccaccgaccccaccgacggcagcauccuguucgccgccgugcaguucagcaccagcuacaagaccgaguucgacuucagcgacuacgugaagagaaaggaccccgacgcccugcugaagcacgugaagcacaugcugcugcugaccaacaccuucggcgccaucaacuacguggccaccgagguguucagagaggagcugggcgccagacccgacgccaccaaggugcugaucaucaucaccgacggcgaggccaccgacagcggcaacaucgacgccgccaaggacaucaucagauacaucaucggcaucggcaagcacuuccagaccaaggagagccaggagacccugcacaaguucgccagcaagcccgccagcgaguucgugaagauccuggacaccuucgagaagcugaaggaccuguucaccgagcugcagaagaagaucuacgugaucgagggcaccagcaagcaggaccugaccagcuucaacauggagcugagcagcagcggcaucagcgccgaccugagcagaggccacgccguggugggcgccgugggcgccaaggacugggccggcggcuuccuggaccugaaggccgaccugcaggacgacaccuucaucggcaacgagccccugacccccgaggugagagccggcuaccugggcuacaccgugaccuggcugcccagcagacagaagaccagccugcuggccagcggcgcccccagauaccagcacaugggcagagugcugcuguuccaggagccccagggcggcggccacuggagccaggugcagaccauccacggcacccagaucggcagcuacuucggcggcgagcugugcggcguggacguggaccaggacggcgagaccgagcugcugcugaucggcgccccccuguucuacggcgagcagagaggcggcagaguguucaucuaccagagaagacagcugggcuucgaggaggugagcgagcugcagggcgaccccggcuacccccugggcagauucggcgaggccaucaccgcccugaccgacaucaacggcgacggccugguggacguggccgugggcgccccccuggaggagcagggcgccguguacaucuucaacggcagacacggcggccugagcccccagcccagccagagaaucgagggcacccaggugcugagcggcauccagugguucggcagaagcauccacggcgugaaggaccuggagggcgacggccuggccgacguggccgugggcgccgagagccagaugaucgugcugagcagcagacccgugguggacauggugacccugaugagcuucagccccgccgagauccccgugcacgagguggagugcagcuacagcaccagcaacaagaugaaggagggcgugaacaucaccaucugcuuccagaucaagagccugaucccccaguuccagggcagacugguggccaaccugaccuacacccugcagcuggacggccacagaaccagaagaagaggccuguuccccggcggcagacacgagcugagaagaaacaucgccgugaccaccagcaugagcugcaccgacuucagcuuccacuuccccgugugcgugcaggaccugaucagccccaucaacgugagccugaacuucagccugugggaggaggagggcacccccagagaccagagagccggcaaggacaucccccccauccugagacccagccugcacagcgagaccugggagauccccuucgagaagaacugcggcgaggacaagaagugcgaggccaaccugagagugagcuucagccccgccagaagcagagcccugagacugaccgccuucgccagccugagcguggagcugagccugagcaaccuggaggaggacgccuacugggugcagcuggaccugcacuucccccccggccugagcuucagaaagguggagaugcugaagccccacagccagauccccgugagcugcgaggagcugcccgaggagagcagacugcugagcagagcccugagcugcaacgugagcagccccaucuucaaggccggccacagcguggcccugcagaugauguucaacacccuggugaacagcagcuggggcgacagcguggagcugcacgccaacgugaccugcaacaacgaggacagcgaccugcuggaggacaacagcgccaccaccaucauccccauccuguaccccaucaacauccugauccaggaccaggaggacagcacccuguacgugagcuucacccccaagggccccaagauccaccaggugaagcacauguaccaggugagaauccagcccagcauccacgaccacaacauccccacccuggaggccguggugggcgugccccagccccccagcgagggccccaucacccaccaguggagcgugcagauggagccccccgugcccugccacuacgaggaccuggagagacugcccgacgccgccgagcccugccugcccggcgcccuguucagaugccccgugguguucagacaggagauccuggugcaggugaucggcacccuggagcuggugggcgagaucgaggccagcagcauguucagccugugcagcagccugagcaucagcuucaacagcagcaagcacuuccaccuguacggcagcaacgccagccuggcccagguggugaugaagguggacgugguguacgagaagcagaugcuguaccuguacgugcugagcggcaucggcggccugcugcugcugcugcugaucuucaucgugcuguacaaggugggcuucuucaagagaaaccugaaggagaagauggaggccggcagaggcgugcccaacggcauccccgccgaggacagcgagcagcuggccagcggccaggaggccggcgaccccggcugccugaagccccugcacgagaaggacagcgagagcggcggcggcaaggacuaa

SEQ ID NO: 18677 - RNA, 3459 nt, Artificial Sequence
  ITGAM__Homo_sapiens__NP_000623
auggcccugagagugcugcugcugaccgcccugacccugugccacggcuucaaccuggacaccgagaacgccaugaccuuccaggagaacgccagaggcuucggccagagcguggugcagcugcagggcagcagagugguggugggcgccccccaggagaucguggccgccaaccagagaggcagccuguaccagugcgacuacagcaccggcagcugcgagcccaucagacugcaggugcccguggaggccgugaacaugagccugggccugagccuggccgccaccaccagccccccccagcugcuggccugcggccccaccgugcaccagaccugcagcgagaacaccuacgugaagggccugugcuuccuguucggcagcaaccugagacagcagccccagaaguuccccgaggcccugagaggcugcccccaggaggacagcgacaucgccuuccugaucgacggcagcggcagcaucaucccccacgacuucagaagaaugaaggaguucgugagcaccgugauggagcagcugaagaagagcaagacccuguucagccugaugcaguacagcgaggaguucagaauccacuucaccuucaaggaguuccagaacaaccccaaccccagaagccuggugaagcccaucacccagcugcugggcagaacccacaccgccaccggcaucagaaagguggugagagagcuguucaacaucaccaacggcgccagaaagaacgccuucaagauccugguggugaucaccgacggcgagaaguucggcgacccccugggcuacgaggacgugauccccgaggccgacagagagggcgugaucagauacgugaucggcgugggcgacgccuucagaagcgagaagagcagacaggagcugaacaccaucgccagcaagccccccagagaccacguguuccaggugaacaacuucgaggcccugaagaccauccagaaccagcugagagagaagaucuucgccaucgagggcacccagaccggcagcagcagcagcuucgagcacgagaugagccaggagggcuucagcgccgccaucaccagcaacggcccccugcugagcaccgugggcagcuacgacugggccggcggcguguuccuguacaccagcaaggagaagagcaccuucaucaacaugaccagaguggacagcgacaugaacgacgccuaccugggcuacgccgccgccaucauccugagaaacagagugcagagccuggugcugggcgcccccagauaccagcacaucggccugguggccauguucagacagaacaccggcaugugggagagcaacgccaacgugaagggcacccagaucggcgccuacuucggcgccagccugugcagcguggacguggacagcaacggcagcaccgaccuggugcugaucggcgccccccacuacuacgagcagaccagaggcggccaggugagcgugugcccccugcccagaggcagagccagauggcagugcgacgccgugcuguacggcgagcagggccagcccuggggcagauucggcgccgcccugaccgugcugggcgacgugaacggcgacaagcugaccgacguggccaucggcgcccccggcgaggaggacaacagaggcgccguguaccuguuccacggcaccagcggcagcggcaucagccccagccacagccagagaaucgccggcagcaagcugagccccagacugcaguacuucggccagagccugagcggcggccaggaccugaccauggacggccugguggaccugaccgugggcgcccagggccacgugcugcugcugagaagccagcccgugcugagagugaaggccaucauggaguucaaccccagagagguggccagaaacguguucgagugcaacgaccagguggugaagggcaaggaggccggcgaggugagagugugccugcacgugcagaagagcaccagagacagacugagagagggccagauccagagcguggugaccuacgaccuggcccuggacagcggcagaccccacagcagagccguguucaacgagaccaagaacagcaccagaagacagacccaggugcugggccugacccagaccugcgagacccugaagcugcagcugcccaacugcaucgaggaccccgugagccccaucgugcugagacugaacuucagccuggugggcaccccccugagcgccuucggcaaccugagacccgugcuggccgaggacgcccagagacuguucaccgcccuguuccccuucgagaagaacugcggcaacgacaacaucugccaggacgaccugagcaucaccuucagcuucaugagccuggacugccugguggugggcggccccagagaguucaacgugaccgugaccgugagaaacgacggcgaggacagcuacagaacccaggugaccuucuucuucccccuggaccugagcuacagaaaggugagcacccugcagaaccagagaagccagagaagcuggagacuggccugcgagagcgccagcagcaccgaggugagcggcgcccugaagagcaccagcugcagcaucaaccaccccaucuuccccgagaacagcgaggugaccuucaacaucaccuucgacguggacagcaaggccagccugggcaacaagcugcugcugaaggccaacgugaccagcgagaacaacaugcccagaaccaacaagaccgaguuccagcuggagcugcccgugaaguacgccguguacaugguggugaccagccacggcgugagcaccaaguaccugaacuucaccgccagcgagaacaccagcagagugaugcagcaccaguaccaggugagcaaccugggccagagaagccugcccaucagccugguguuccuggugcccgugagacugaaccagaccgugaucugggacagaccccaggugaccuucagcgagaaccugagcagcaccugccacaccaaggagagacugcccagccacagcgacuuccuggccgagcugagaaaggcccccguggugaacugcagcaucgccgugugccagagaauccagugcgacauccccuucuucggcauccaggaggaguucaacgccacccugaagggcaaccugagcuucgacugguacaucaagaccagccacaaccaccugcugaucgugagcaccgccgagauccuguucaacgacagcguguucacccugcugcccggccagggcgccuucgugagaagccagaccgagaccaagguggagcccuucgaggugcccaacccccugccccugaucgugggcagcagcgugggcggccugcugcugcuggcccugaucaccgccgcccuguacaagcugggcuucuucaagagacaguacaaggacaugaugagcgagggcggcccccccggcgccgagccccaguaa

SEQ ID NO: 18678 - RNA, 3009 nt, Artificial Sequence
  ITGAV__Homo_sapiens__NP_001138471
augcugcugggcacccugcugcugauccuguacauccugaugcugugcagaauguuccugcuggugggcgcccccaaggccaacaccacccagcccggcaucguggagggcggccaggugcugaagugcgacuggagcagcaccagaagaugccagcccaucgaguucgacgccaccggcaacagagacuacgccaaggacgacccccuggaguucaagagccaccagugguucggcgccagcgugagaagcaagcaggacaagauccuggccugcgccccccuguaccacuggagaaccgagaugaagcaggagagagagcccgugggcaccugcuuccugcaggacggcaccaagaccguggaguacgcccccugcagaagccaggacaucgacgccgacggccagggcuucugccagggcggcuucagcaucgacuucaccaaggccgacagagugcugcugggcggccccggcagcuucuacuggcagggccagcugaucagcgaccagguggccgagaucgugagcaaguacgaccccaacguguacagcaucaaguacaacaaccagcuggccaccagaaccgcccaggccaucuucgacgacagcuaccugggcuacagcguggccgugggcgacuucaacggcgacggcaucgacgacuucgugagcggcgugcccagagccgccagaacccugggcaugguguacaucuacgacggcaagaacaugagcagccuguacaacuucaccggcgagcagauggccgccuacuucggcuucagcguggccgccaccgacaucaacggcgacgacuacgccgacguguucaucggcgccccccuguucauggacagaggcagcgacggcaagcugcaggaggugggccaggugagcgugagccugcagagagccagcggcgacuuccagaccaccaagcugaacggcuucgagguguucgccagauucggcagcgccaucgccccccugggcgaccuggaccaggacggcuucaacgacaucgccaucgccgcccccuacggcggcgaggacaagaagggcaucguguacaucuucaacggcagaagcaccggccugaacgccgugcccagccagauccuggagggccagugggccgccagaagcaugccccccagcuucggcuacagcaugaagggcgccaccgacaucgacaagaacggcuaccccgaccugaucgugggcgccuucggcguggacagagccauccuguacagagccagacccgugaucaccgugaacgccggccuggagguguaccccagcauccugaaccaggacaacaagaccugcagccugcccggcaccgcccugaaggugagcugcuucaacgugagauucugccugaaggccgacggcaagggcgugcugcccagaaagcugaacuuccagguggagcugcugcuggacaagcugaagcagaagggcgccaucagaagagcccuguuccuguacagcagaagccccagccacagcaagaacaugaccaucagcagaggcggccugaugcagugcgaggagcugaucgccuaccugagagacgagagcgaguucagagacaagcugacccccaucaccaucuucauggaguacagacuggacuacagaaccgccgccgacaccaccggccugcagcccauccugaaccaguucacccccgccaacaucagcagacaggcccacauccugcuggacugcggcgaggacaacgugugcaagcccaagcuggaggugagcguggacagcgaccagaagaagaucuacaucggcgacgacaacccccugacccugaucgugaaggcccagaaccagggcgagggcgccuacgaggccgagcugaucgugagcaucccccugcaggccgacuucaucggcguggugagaaacaacgaggcccuggccagacugagcugcgccuucaagaccgagaaccagaccagacagguggugugcgaccugggcaaccccaugaaggccggcacccagcugcuggccggccugagauucagcgugcaccagcagagcgagauggacaccagcgugaaguucgaccugcagauccagagcagcaaccuguucgacaaggugagccccguggugagccacaagguggaccuggccgugcuggccgccguggagaucagaggcgugagcagccccgaccacaucuuccugcccauccccaacugggagcacaaggagaaccccgagaccgaggaggacgugggccccguggugcagcacaucuacgagcugagaaacaacggccccagcagcuucagcaaggccaugcugcaccugcaguggcccuacaaguacaacaacaacacccugcuguacauccugcacuacgacaucgacggccccaugaacugcaccagcgacauggagaucaacccccugagaaucaagaucagcagccugcagaccaccgagaagaacgacaccguggccggccagggcgagagagaccaccugaucaccaagagagaccuggcccugagcgagggcgacauccacacccugggcugcggcguggcccagugccugaagaucgugugccaggugggcagacuggacagaggcaagagcgccauccuguacgugaagagccugcuguggaccgagaccuucaugaacaaggagaaccagaaccacagcuacagccugaagagcagcgccagcuucaacgugaucgaguuccccuacaagaaccugcccaucgaggacaucaccaacagcacccuggugaccaccaacgugaccuggggcauccagcccgcccccaugcccgugcccgugugggugaucauccuggccgugcuggccggccugcugcugcuggccgugcugguguucgugauguacagaaugggcuucuucaagagagugagacccccccaggaggagcaggagagagagcagcugcagccccacgagaacggcgagggcaacagcgagaccuaa

SEQ ID NO: 18679 - RNA, 3492 nt, Artificial Sequence
  ITGAX__Homo_sapiens__NP_000878
augaccagaaccagagccgcccugcugcuguucaccgcccuggccaccagccugggcuucaaccuggacaccgaggagcugaccgccuucagaguggacagcgccggcuucggcgacagcguggugcaguacgccaacagcugggugguggugggcgccccccagaagaucaccgccgccaaccagaccggcggccuguaccagugcggcuacagcaccggcgccugcgagcccaucggccugcaggugccccccgaggccgugaacaugagccugggccugagccuggccagcaccaccagccccagccagcugcuggccugcggccccaccgugcaccacgagugcggcagaaacauguaccugaccggccugugcuuccugcugggccccacccagcugacccagagacugcccgugagcagacaggagugccccagacaggagcaggacaucguguuccugaucgacggcagcggcagcaucagcagcagaaacuucgccaccaugaugaacuucgugagagccgugaucagccaguuccagagacccagcacccaguucagccugaugcaguucagcaacaaguuccagacccacuucaccuucgaggaguucagaagaagcagcaacccccugagccugcuggccagcgugcaccagcugcagggcuucaccuacaccgccaccgccauccagaacguggugcacagacuguuccacgccagcuacggcgccagaagagacgccgccaagauccugaucgugaucaccgacggcaagaaggagggcgacagccuggacuacaaggacgugauccccauggccgacgccgccggcaucaucagauacgccaucggcgugggccuggccuuccagaacagaaacagcuggaaggagcugaacgacaucgccagcaagcccagccaggagcacaucuucaagguggaggacuucgacgcccugaaggacauccagaaccagcugaaggagaagaucuucgccaucgagggcaccgagaccaccagcagcagcagcuucgagcuggagauggcccaggagggcuucagcgccguguucacccccgacggccccgugcugggcgccgugggcagcuucaccuggagcggcggcgccuuccuguacccccccaacaugagccccaccuucaucaacaugagccaggagaacguggacaugagagacagcuaccugggcuacagcaccgagcuggcccuguggaagggcgugcagagccuggugcugggcgcccccagauaccagcacaccggcaaggccgugaucuucacccaggugagcagacaguggagaaugaaggccgaggugaccggcacccagaucggcagcuacuucggcgccagccugugcagcguggacguggacagcgacggcagcaccgaccuggugcugaucggcgccccccacuacuacgagcagaccagaggcggccaggugagcgugugcccccugcccagaggcuggagaagaugguggugcgacgccgugcuguacggcgagcagggccaccccuggggcagauucggcgccgcccugaccgugcugggcgacgugaacggcgacaagcugaccgacguggugaucggcgcccccggcgaggaggagaacagaggcgccguguaccuguuccacggcgugcugggccccagcaucagccccagccacagccagagaaucgccggcagccagcugagcagcagacugcaguacuucggccaggcccugagcggcggccaggaccugacccaggacggccugguggaccuggccgugggcgccagaggccaggugcugcugcugagaaccagacccgugcugugggugggcgugagcaugcaguucauccccgccgagauccccagaagcgccuucgagugcagagagcagguggugagcgagcagacccuggugcagagcaacaucugccuguacaucgacaagagaagcaagaaccugcugggcagcagagaccugcagagcagcgugacccuggaccuggcccuggaccccggcagacugagccccagagccaccuuccaggagaccaagaacagaagccugagcagagugagagugcugggccugaaggcccacugcgagaacuucaaccugcugcugcccagcugcguggaggacagcgugacccccaucacccugagacugaacuucacccuggugggcaagccccugcuggccuucagaaaccugagacccaugcuggccgccgacgcccagagauacuucaccgccagccugcccuucgagaagaacugcggcgccgaccacaucugccaggacaaccugggcaucagcuucagcuuccccggccugaagagccugcuggugggcagcaaccuggagcugaacgccgaggugaugguguggaacgacggcgaggacagcuacggcaccaccaucaccuucagccaccccgccggccugagcuacagauacguggccgagggccagaagcagggccagcugagaagccugcaccugaccugcgacagcgcccccgugggcagccagggcaccuggagcaccagcugcagaaucaaccaccugaucuucagaggcggcgcccagaucaccuuccuggccaccuucgacgugagccccaaggccgugcugggcgacagacugcugcugaccgccaacgugagcagcgagaacaacacccccagaaccagcaagaccaccuuccagcuggagcugcccgugaaguacgccguguacaccguggugagcagccacgagcaguucaccaaguaccugaacuucagcgagagcgaggagaaggagagccacguggccaugcacagauaccaggugaacaaccugggccagagagaccugcccgugagcaucaacuucugggugcccguggagcugaaccaggaggccguguggauggacguggaggugagccacccccagaaccccagccugagaugcagcagcgagaagaucgccccccccgccagcgacuuccuggcccacauccagaagaaccccgugcuggacugcagcaucgccggcugccugagauucagaugcgacgugcccagcuucagcgugcaggaggagcuggacuucacccugaagggcaaccugagcuucggcugggugagacagauccugcagaagaaggugagcguggugagcguggccgagaucaccuucgacaccagcguguacagccagcugcccggccaggaggccuucaugagagcccagaccaccaccgugcuggagaaguacaaggugcacaaccccaccccccugaucgugggcagcagcaucggcggccugcugcugcuggcccugaucaccgccgugcuguacaaggugggcuucuucaagagacaguacaaggagaugauggaggaggccaacggccagaucgcccccgagaacggcacccagacccccagcccccccagcgagaaguaa

SEQ ID NO: 18680 - RNA, 603 nt, Artificial Sequence
  ITGB1BP1__Homo_sapiens__NP_004754
auguucagaaagggcaagaagagacacagcagcagcagcagccagagcagcgagaucagcaccaagagcaagagcguggacagcagccugggcggccugagcagaagcagcaccguggccagccuggacaccgacagcaccaagagcagcggccagagcaacaacaacagcgacaccugcgccgaguucagaaucaaguacgugggcgccaucgagaagcugaagcugagcgagggcaagggccuggagggcccccuggaccugaucaacuacaucgacguggcccagcaggacggcaagcugcccuucgugccccccgaggaggaguucaucaugggcgugagcaaguacggcaucaaggugagcaccagcgaccaguacgacgugcugcacagacacgcccuguaccugaucaucagaauggugugcuacgacgacggccugggcgccggcaagagccugcuggcccugaagaccaccgacgccagcaacgaggaguacagccuguggguguaccagugcaacagccuggagcaggcccaggccaucugcaaggugcugagcaccgccuucgacagcgugcugaccagcgagaagcccuaa

SEQ ID NO: 18681 - RNA, 2406 nt, Artificial Sequence
  ITGB1__Homo_sapiens__NP_391988
augaaccugcagcccaucuucuggaucggccugaucagcagcgugugcugcguguucgcccagaccgacgagaacagaugccugaaggccaacgccaagagcugcggcgagugcauccaggccggccccaacugcggcuggugcaccaacagcaccuuccugcaggagggcaugcccaccagcgccagaugcgacgaccuggaggcccugaagaagaagggcugcccccccgacgacaucgagaaccccagaggcagcaaggacaucaagaagaacaagaacgugaccaacagaagcaagggcaccgccgagaagcugaagcccgaggacaucacccagauccagccccagcagcuggugcugagacugagaagcggcgagccccagaccuucacccugaaguucaagagagccgaggacuaccccaucgaccuguacuaccugauggaccugagcuacagcaugaaggacgaccuggagaacgugaagagccugggcaccgaccugaugaacgagaugagaagaaucaccagcgacuucagaaucggcuucggcagcuucguggagaagaccgugaugcccuacaucagcaccacccccgccaagcugagaaaccccugcaccagcgagcagaacugcaccagccccuucagcuacaagaacgugcugagccugaccaacaagggcgagguguucaacgagcuggugggcaagcagagaaucagcggcaaccuggacagccccgagggcggcuucgacgccaucaugcagguggccgugugcggcagccugaucggcuggagaaacgugaccagacugcugguguucagcaccgacgccggcuuccacuucgccggcgacggcaagcugggcggcaucgugcugcccaacgacggccagugccaccuggagaacaacauguacaccaugagccacuacuacgacuaccccagcaucgcccaccuggugcagaagcugagcgagaacaacauccagaccaucuucgccgugaccgaggaguuccagcccguguacaaggagcugaagaaccugauccccaagagcgccgugggcacccugagcgccaacagcagcaacgugauccagcugaucaucgacgccuacaacagccugagcagcgaggugauccuggagaacggcaagcugagcgagggcgugaccaucagcuacaagagcuacugcaagaacggcgugaacggcaccggcgagaacggcagaaagugcagcaacaucagcaucggcgacgaggugcaguucgagaucagcaucaccagcaacaagugccccaagaaggacagcgacagcuucaagaucagaccccugggcuucaccgaggagguggaggugauccugcaguacaucugcgagugcgagugccagagcgagggcauccccgagagccccaagugccacgagggcaacggcaccuucgagugcggcgccugcagaugcaacgagggcagagugggcagacacugcgagugcagcaccgacgaggugaacagcgaggacauggacgccuacugcagaaaggagaacagcagcgagaucugcagcaacaacggcgagugcgugugcggccagugcgugugcagaaagagagacaacaccaacgagaucuacagcggcaaguucugcgagugcgacaacuucaacugcgacagaagcaacggccugaucugcggcggcaacggcgugugcaagugcagagugugcgagugcaaccccaacuacaccggcagcgccugcgacugcagccuggacaccagcaccugcgaggccagcaacggccagaucugcaacggcagaggcaucugcgagugcggcgugugcaagugcaccgaccccaaguuccagggccagaccugcgagaugugccagaccugccugggcgugugcgccgagcacaaggagugcgugcagugcagagccuucaacaagggcgagaagaaggacaccugcacccaggagugcagcuacuucaacaucaccaagguggagagcagagacaagcugccccagcccgugcagcccgaccccgugagccacugcaaggagaaggacguggacgacugcugguucuacuucaccuacagcgugaacggcaacaacgaggugauggugcacgugguggagaaccccgagugccccaccggccccgacaucauccccaucguggccggcgugguggccggcaucgugcugaucggccuggcccugcugcugaucuggaagcugcugaugaucauccacgacagaagagaguucgccaaguucgagaaggagaagaugaacgccaagugggacacccaggagaaccccaucuacaagagccccaucaacaacuucaagaaccccaacuacggcagaaaggccggccuguaa

SEQ ID NO: 18682 - RNA, 2310 nt, Artificial Sequence
  ITGB2__Homo_sapiens__NP_000202
augcugggccugagacccccccugcuggcccuggugggccugcugagccugggcugcgugcugagccaggagugcaccaaguucaaggugagcagcugcagagagugcaucgagagcggccccggcugcaccuggugccagaagcugaacuucaccggccccggcgaccccgacagcaucagaugcgacaccagaccccagcugcugaugagaggcugcgccgccgacgacaucauggaccccaccagccuggccgagacccaggaggaccacaacggcggccagaagcagcugagcccccagaaggugacccuguaccugagacccggccaggccgccgccuucaacgugaccuucagaagagccaagggcuaccccaucgaccuguacuaccugauggaccugagcuacagcaugcuggacgaccugagaaacgugaagaagcugggcggcgaccugcugagagcccugaacgagaucaccgagagcggcagaaucggcuucggcagcuucguggacaagaccgugcugcccuucgugaacacccaccccgacaagcugagaaaccccugccccaacaaggagaaggagugccagccccccuucgccuucagacacgugcugaagcugaccaacaacagcaaccaguuccagaccgaggugggcaagcagcugaucagcggcaaccuggacgcccccgagggcggccuggacgccaugaugcagguggccgccugccccgaggagaucggcuggagaaacgugaccagacugcugguguucgccaccgacgacggcuuccacuucgccggcgacggcaagcugggcgccauccugacccccaacgacggcagaugccaccuggaggacaaccuguacaagagaagcaacgaguucgacuaccccagcgugggccagcuggcccacaagcuggccgagaacaacauccagcccaucuucgccgugaccagcagaauggugaagaccuacgagaagcugaccgagaucauccccaagagcgccgugggcgagcugagcgaggacagcagcaacguggugcaccugaucaagaacgccuacaacaagcugagcagcagaguguuccuggaccacaacgcccugcccgacacccugaaggugaccuacgacagcuucugcagcaacggcgugacccacagaaaccagcccagaggcgacugcgacggcgugcagaucaacgugcccaucaccuuccaggugaaggugaccgccaccgagugcauccaggagcagagcuucgugaucagagcccugggcuucaccgacaucgugaccgugcaggugcugccccagugcgagugcagaugcagagaccagagcagagacagaagccugugccacggcaagggcuuccuggagugcggcaucugcagaugcgacaccggcuacaucggcaagaacugcgagugccagacccagggcagaagcagccaggagcuggagggcagcugcagaaaggacaacaacagcaucaucugcagcggccugggcgacugcgugugcggccagugccugugccacaccagcgacgugcccggcaagcugaucuacggccaguacugcgagugcgacaccaucaacugcgagagauacaacggccaggugugcggcggccccggcagaggccugugcuucugcggcaagugcagaugccaccccggcuucgagggcagcgccugccagugcgagagaaccaccgagggcugccugaaccccagaagaguggagugcagcggcagaggcagaugcagaugcaacgugugcgagugccacagcggcuaccagcugccccugugccaggagugccccggcugccccagccccugcggcaaguacaucagcugcgccgagugccugaaguucgagaagggccccuucggcaagaacugcagcgccgccugccccggccugcagcugagcaacaaccccgugaagggcagaaccugcaaggagagagacagcgagggcugcuggguggccuacacccuggagcagcaggacggcauggacagauaccugaucuacguggacgagagcagagagugcguggccggccccaacaucgccgccaucgugggcggcaccguggccggcaucgugcugaucggcauccugcugcuggugaucuggaaggcccugauccaccugagcgaccugagagaguacagaagauucgagaaggagaagcugaagagccaguggaacaacgacaacccccuguucaagagcgccaccaccaccgugaugaaccccaaguucgccgagagcuaa

SEQ ID NO: 18683 - RNA, 2367 nt, Artificial Sequence
  ITGB3__Homo_sapiens__NP_000203
augagagccagacccagacccagaccccugugggccaccgugcuggcccugggcgcccuggccggcgugggcgugggcggccccaacaucugcaccaccagaggcgugagcagcugccagcagugccuggccgugagccccaugugcgccuggugcagcgacgaggcccugccccugggcagccccagaugcgaccugaaggagaaccugcugaaggacaacugcgcccccgagagcaucgaguuccccgugagcgaggccagagugcuggaggacagaccccugagcgacaagggcagcggcgacagcagccaggugacccaggugagcccccagagaaucgcccugagacugagacccgacgacagcaagaacuucagcauccaggugagacagguggaggacuaccccguggacaucuacuaccugauggaccugagcuacagcaugaaggacgaccuguggagcauccagaaccugggcaccaagcuggccacccagaugagaaagcugaccagcaaccugagaaucggcuucggcgccuucguggacaagcccgugagccccuacauguacaucagcccccccgaggcccuggagaaccccugcuacgacaugaagaccaccugccugcccauguucggcuacaagcacgugcugacccugaccgaccaggugaccagauucaacgaggaggugaagaagcagagcgugagcagaaacagagacgcccccgagggcggcuucgacgccaucaugcaggccaccgugugcgacgagaagaucggcuggagaaacgacgccagccaccugcugguguucaccaccgacgccaagacccacaucgcccuggacggcagacuggccggcaucgugcagcccaacgacggccagugccacgugggcagcgacaaccacuacagcgccagcaccaccauggacuaccccagccugggccugaugaccgagaagcugagccagaagaacaucaaccugaucuucgccgugaccgagaacguggugaaccuguaccagaacuacagcgagcugauccccggcaccaccgugggcgugcugagcauggacagcagcaacgugcugcagcugaucguggacgccuacggcaagaucagaagcaagguggagcuggaggugagagaccugcccgaggagcugagccugagcuucaacgccaccugccugaacaacgaggugauccccggccugaagagcugcaugggccugaagaucggcgacaccgugagcuucagcaucgaggccaaggugagaggcugcccccaggagaaggagaagagcuucaccaucaagcccgugggcuucaaggacagccugaucgugcaggugaccuucgacugcgacugcgccugccaggcccaggccgagcccaacagccacagaugcaacaacggcaacggcaccuucgagugcggcgugugcagaugcggccccggcuggcugggcagccagugcgagugcagcgaggaggacuacagacccagccagcaggacgagugcagccccagagagggccagcccgugugcagccagagaggcgagugccugugcggccagugcgugugccacagcagcgacuucggcaagaucaccggcaaguacugcgagugcgacgacuucagcugcgugagauacaagggcgagaugugcagcggccacggccagugcagcugcggcgacugccugugcgacagcgacuggaccggcuacuacugcaacugcaccaccagaaccgacaccugcaugagcagcaacggccugcugugcagcggcagaggcaagugcgagugcggcagcugcgugugcauccagcccggcagcuacggcgacaccugcgagaagugccccaccugccccgacgccugcaccuucaagaaggagugcguggagugcaagaaguucgacagaggcgcccugcacgacgagaacaccugcaacagauacugcagagacgagaucgagagcgugaaggagcugaaggacaccggcaaggacgccgugaacugcaccuacaagaacgaggacgacugcguggugagauuccaguacuacgaggacagcagcggcaagagcauccuguacgugguggaggagcccgagugccccaagggccccgacauccugguggugcugcugagcgugaugggcgccauccugcugaucggccuggccgcccugcugaucuggaagcugcugaucaccauccacgacagaaaggaguucgccaaguucgaggaggagagagccagagccaagugggacaccgccaacaacccccuguacaaggaggccaccagcaccuucaccaacaucaccuacagaggcaccuaa

SEQ ID NO: 18684 - RNA, 5469 nt, Artificial Sequence
  ITGB4__Homo_sapiens__NP_000204
auggccggccccagacccagccccugggccagacugcugcuggccgcccugaucagcgugagccugagcggcacccuggccaacagaugcaagaaggcccccgugaagagcugcaccgagugcgugagaguggacaaggacugcgccuacugcaccgacgagauguucagagacagaagaugcaacacccaggccgagcugcuggccgccggcugccagagagagagcaucguggugauggagagcagcuuccagaucaccgaggagacccagaucgacaccacccugagaagaagccagaugagcccccagggccugagagugagacugagacccggcgaggagagacacuucgagcuggagguguucgagccccuggagagccccguggaccuguacauccugauggacuucagcaacagcaugagcgacgaccuggacaaccugaagaagaugggccagaaccuggccagagugcugagccagcugaccagcgacuacaccaucggcuucggcaaguucguggacaaggugagcgugccccagaccgacaugagacccgagaagcugaaggagcccuggcccaacagcgacccccccuucagcuucaagaacgugaucagccugaccgaggacguggacgaguucagaaacaagcugcagggcgagagaaucagcggcaaccuggacgcccccgagggcggcuucgacgccauccugcagaccgccgugugcaccagagacaucggcuggagacccgacagcacccaccugcugguguucagcaccgagagcgccuuccacuacgaggccgacggcgccaacgugcuggccggcaucaugagcagaaacgacgagagaugccaccuggacaccaccggcaccuacacccaguacagaacccaggacuaccccagcgugcccacccuggugagacugcuggccaagcacaacaucauccccaucuucgccgugaccaacuacagcuacagcuacuacgagaagcugcacaccuacuuccccgugagcagccugggcgugcugcaggaggacagcagcaacaucguggagcugcuggaggaggccuucaacagaaucagaagcaaccuggacaucagagcccuggacagccccagaggccugagaaccgaggugaccagcaagauguuccagaagaccagaaccggcagcuuccacaucagaagaggcgaggugggcaucuaccaggugcagcugagagcccuggagcacguggacggcacccacgugugccagcugcccgaggaccagaagggcaacauccaccugaagcccagcuucagcgacggccugaagauggacgccggcaucaucugcgacgugugcaccugcgagcugcagaaggaggugagaagcgccagaugcagcuucaacggcgacuucgugugcggccagugcgugugcagcgagggcuggagcggccagaccugcaacugcagcaccggcagccugagcgacauccagcccugccugagagagggcgaggacaagcccugcagcggcagaggcgagugccagugcggccacugcgugugcuacggcgagggcagauacgagggccaguucugcgaguacgacaacuuccagugccccagaaccagcggcuuccugugcaacgacagaggcagaugcagcaugggccagugcgugugcgagcccggcuggaccggccccagcugcgacugcccccugagcaacgccaccugcaucgacagcaacggcggcaucugcaacggcagaggccacugcgagugcggcagaugccacugccaccagcagagccuguacaccgacaccaucugcgagaucaacuacagcgccauccaccccggccugugcgaggaccugagaagcugcgugcagugccaggccuggggcaccggcgagaagaagggcagaaccugcgaggagugcaacuucaaggugaagaugguggacgagcugaagagagccgaggaggugguggugagaugcagcuucagagacgaggacgacgacugcaccuacagcuacaccauggagggcgacggcgcccccggccccaacagcaccgugcuggugcacaagaagaaggacugcccccccggcagcuucugguggcugaucccccugcugcugcugcugcugccccugcuggcccugcugcugcugcugugcuggaaguacugcgccugcugcaaggccugccuggcccugcugcccugcugcaacagaggccacauggugggcuucaaggaggaccacuacaugcugagagagaaccugauggccagcgaccaccuggacacccccaugcugagaagcggcaaccugaagggcagagacguggugagauggaaggugaccaacaacaugcagagacccggcuucgccacccacgccgccagcaucaaccccaccgagcuggugcccuacggccugagccugagacuggccagacugugcaccgagaaccugcugaagcccgacaccagagagugcgcccagcugagacaggagguggaggagaaccugaacgagguguacagacagaucagcggcgugcacaagcugcagcagaccaaguucagacagcagcccaacgccggcaagaagcaggaccacaccaucguggacaccgugcugauggcccccagaagcgccaagcccgcccugcugaagcugaccgagaagcagguggagcagagagccuuccacgaccugaagguggcccccggcuacuacacccugaccgccgaccaggacgccagaggcaugguggaguuccaggagggcguggagcugguggacgugagagugccccuguucaucagacccgaggacgacgacgagaagcagcugcugguggaggccaucgacgugcccgccggcaccgccacccugggcagaagacuggugaacaucaccaucaucaaggagcaggccagagacguggugagcuucgagcagcccgaguucagcgugagcagaggcgaccagguggccagaauccccgugaucagaagagugcuggacggcggcaagagccaggugagcuacagaacccaggacggcaccgcccagggcaacagagacuacauccccguggagggcgagcugcuguuccagcccggcgaggccuggaaggagcugcaggugaagcugcuggagcugcaggagguggacagccugcugagaggcagacaggugagaagauuccacgugcagcugagcaaccccaaguucggcgcccaccugggccagccccacagcaccaccaucaucaucagagaccccgacgagcuggacagaagcuucaccagccagaugcugagcagccagccccccccccacggcgaccugggcgccccccagaaccccaacgccaaggccgccggcagcagaaagauccacuucaacuggcugccccccagcggcaagcccaugggcuacagagugaaguacuggauccagggcgacagcgagagcgaggcccaccugcuggacagcaaggugcccagcguggagcugaccaaccuguaccccuacugcgacuacgagaugaaggugugcgccuacggcgcccagggcgagggccccuacagcagccuggugagcugcagaacccaccaggaggugcccagcgagcccggcagacuggccuucaacguggugagcagcaccgugacccagcugagcugggccgagcccgccgagaccaacggcgagaucaccgccuacgaggugugcuacggccuggugaacgacgacaacagacccaucggccccaugaagaaggugcugguggacaaccccaagaacagaaugcugcugaucgagaaccugagagagagccagcccuacagauacaccgugaaggccagaaacggcgccggcuggggccccgagagagaggccaucaucaaccuggccacccagcccaagagacccaugagcauccccaucauccccgacauccccaucguggacgcccagagcggcgaggacuacgacagcuuccugauguacagcgacgacgugcugagaagccccagcggcagccagagacccagcgugagcgacgacaccggcugcggcuggaaguucgagccccugcugggcgaggagcuggaccugagaagagugaccuggagacugccccccgagcugauccccagacugagcgccagcagcggcagaagcagcgacgccgaggccccccacggcccccccgacgacggcggcgccggcggcaagggcggcagccugcccagaagcgccacccccggcccccccggcgagcaccuggugaacggcagaauggacuucgccuuccccggcagcaccaacagccugcacagaaugaccaccaccagcgccgccgccuacggcacccaccugagcccccacgugccccacagagugcugagcaccagcagcacccugaccagagacuacaacagccugaccagaagcgagcacagccacagcaccacccugcccagagacuacagcacccugaccagcgugagcagccacgacagcagacugaccgccggcgugcccgacacccccaccagacugguguucagcgcccugggccccaccagccugagagugagcuggcaggagcccagaugcgagagaccccugcagggcuacagcguggaguaccagcugcugaacggcggcgagcugcacagacugaacauccccaaccccgcccagaccagcguggugguggaggaccugcugcccaaccacagcuacguguucagagugagagcccagagccaggagggcuggggcagagagagagagggcgugaucaccaucgagagccaggugcacccccagagcccccugugcccccugcccggcagcgccuucacccugagcacccccagcgcccccggcccccugguguucaccgcccugagccccgacagccugcagcugagcugggagagacccagaagacccaacggcgacaucgugggcuaccuggugaccugcgagauggcccagggcggcggccccgccaccgccuucagaguggacggcgacagccccgagagcagacugaccgugcccggccugagcgagaacgugcccuacaaguucaaggugcaggccagaaccaccgagggcuucggccccgagagagagggcaucaucaccaucgagagccaggacggcggccccuucccccagcugggcagcagagccggccuguuccagcacccccugcagagcgaguacagcagcaucaccaccacccacaccagcgccaccgagcccuuccugguggacggccugacccugggcgcccagcaccuggaggccggcggcagccugaccagacacgugacccaggaguucgugagcagaacccugaccaccagcggcacccugagcacccacauggaccagcaguucuuccagaccuaa

SEQ ID NO: 18685 - RNA, 2400 nt, Artificial Sequence
  ITGB5__Homo_sapiens__NP_002204
augcccagagcccccgccccccuguacgccugccugcugggccugugcgcccugcugcccagacuggccggccugaacaucugcaccagcggcagcgccaccagcugcgaggagugccugcugauccaccccaagugcgccuggugcagcaaggaggacuucggcagccccagaagcaucaccagcagaugcgaccugagagccaaccuggugaagaacggcugcggcggcgagaucgagagccccgccagcagcuuccacgugcugagaagccugccccugagcagcaagggcagcggcagcgccggcugggacgugauccagaugaccccccaggagaucgccgugaaccugagacccggcgacaagaccaccuuccagcugcaggugagacagguggaggacuaccccguggaccuguacuaccugauggaccugagccugagcaugaaggacgaccuggacaacaucagaagccugggcaccaagcuggccgaggagaugagaaagcugaccagcaacuucagacugggcuucggcagcuucguggacaaggacaucagccccuucagcuacaccgcccccagauaccagaccaaccccugcaucggcuacaagcuguuccccaacugcgugcccagcuucggcuucagacaccugcugccccugaccgacagaguggacagcuucaacgaggaggugagaaagcagagagugagcagaaacagagacgcccccgagggcggcuucgacgccgugcugcaggccgccgugugcaaggagaagaucggcuggagaaaggacgcccugcaccugcugguguucaccaccgacgacgugccccacaucgcccuggacggcaagcugggcggccuggugcagccccacgacggccagugccaccugaacgaggccaacgaguacaccgccagcaaccagauggacuaccccagccuggcccugcugggcgagaagcuggccgagaacaacaucaaccugaucuucgccgugaccaagaaccacuacaugcuguacaagaacuucaccgcccugauccccggcaccaccguggagauccuggacggcgacagcaagaacaucauccagcugaucaucaacgccuacaacagcaucagaagcaagguggagcugagcgugugggaccagcccgaggaccugaaccuguucuucaccgccaccugccaggacggcgugagcuaccccggccagagaaagugcgagggccugaagaucggcgacaccgccagcuucgaggugagccuggaggccagaagcugccccagcagacacaccgagcacguguucgcccugagacccgugggcuucagagacagccuggaggugggcgugaccuacaacugcaccugcggcugcagcgugggccuggagcccaacagcgccagaugcaacggcagcggcaccuacgugugcggccugugcgagugcagccccggcuaccugggcaccagaugcgagugccaggacggcgagaaccagagcguguaccagaaccugugcagagaggccgagggcaagccccugugcagcggcagaggcgacugcagcugcaaccagugcagcugcuucgagagcgaguucggcaagaucuacggccccuucugcgagugcgacaacuucagcugcgccagaaacaagggcgugcugugcagcggccacggcgagugccacugcggcgagugcaagugccacgccggcuacaucggcgacaacugcaacugcagcaccgacaucagcaccugcagaggcagagacggccagaucugcagcgagagaggccacugccugugcggccagugccagugcaccgagcccggcgccuucggcgagaugugcgagaagugccccaccugccccgacgccugcagcaccaagagagacugcguggagugccugcugcugcacagcggcaagcccgacaaccagaccugccacagccugugcagagacgaggugaucaccuggguggacaccaucgugaaggacgaccaggaggccgugcugugcuucuacaagaccgccaaggacugcgugaugauguucaccuacguggagcugcccagcggcaagagcaaccugaccgugcugagagagcccgagugcggcaacacccccaacgccaugaccauccugcuggccguggugggcagcauccugcuggugggccuggcccugcuggccaucuggaagcugcuggugaccauccacgacagaagagaguucgccaaguuccagagcgagagaagcagagccagauacgagauggccagcaacccccuguacagaaagcccaucagcacccacaccguggacuucaccuucaacaaguucaacaagagcuacaacggcaccguggacuaa

SEQ ID NO: 18686 - RNA, 2367 nt, Artificial Sequence
  ITGB6__Homo_sapiens__NP_000879
augggcaucgagcugcugugccuguucuuccuguuccugggcagaaacgaccacgugcagggcggcugcgcccugggcggcgccgagaccugcgaggacugccugcugaucggcccccagugcgccuggugcgcccaggagaacuucacccaccccagcggcgugggcgagagaugcgacacccccgccaaccugcuggccaagggcugccagcugaacuucaucgagaaccccgugagccagguggagauccugaagaacaagccccugagcgugggcagacagaagaacagcagcgacaucgugcagaucgccccccagagccugauccugaagcugagacccggcggcgcccagacccugcaggugcacgugagacagaccgaggacuaccccguggaccuguacuaccugauggaccugagcgccagcauggacgacgaccugaacaccaucaaggagcugggcagcagacugagcaaggagaugagcaagcugaccagcaacuucagacugggcuucggcagcuucguggagaagcccgugagccccuucgugaagaccacccccgaggagaucgccaaccccugcagcagcauccccuacuucugccugcccaccuucggcuucaagcacauccugccccugaccaacgacgccgagagauucaacgagaucgugaagaaccagaagaucagcgccaacaucgacacccccgagggcggcuucgacgccaucaugcaggccgccgugugcaaggagaagaucggcuggagaaacgacagccugcaccugcugguguucgugagcgacgccgacagccacuucggcauggacagcaagcuggccggcaucgugauccccaacgacggccugugccaccuggacagcaagaacgaguacagcaugagcaccgugcuggaguaccccaccaucggccagcugaucgacaagcuggugcagaacaacgugcugcugaucuucgccgugacccaggagcaggugcaccuguacgagaacuacgccaagcugauccccggcgccaccgugggccugcugcagaaggacagcggcaacauccugcagcugaucaucagcgccuacgaggagcugagaagcgagguggagcuggaggugcugggcgacaccgagggccugaaccugagcuucaccgccaucugcaacaacggcacccuguuccagcaccagaagaagugcagccacaugaaggugggcgacaccgccagcuucagcgugaccgugaacaucccccacugcgagagaagaagcagacacaucaucaucaagcccgugggccugggcgacgcccuggagcugcuggugagccccgagugcaacugcgacugccagaaggagguggaggugaacagcagcaagugccaccacggcaacggcagcuuccagugcggcgugugcgccugccaccccggccacaugggccccagaugcgagugcggcgaggacaugcugagcaccgacagcugcaaggaggcccccgaccaccccagcugcagcggcagaggcgacugcuacugcggccagugcaucugccaccugagccccuacggcaacaucuacggccccuacugccagugcgacaacuucagcugcgugagacacaagggccugcugugcggcggcaacggcgacugcgacugcggcgagugcgugugcagaagcggcuggaccggcgaguacugcaacugcaccaccagcaccgacagcugcgugagcgaggacggcgugcugugcagcggcagaggcgacugcgugugcggcaagugcgugugcaccaaccccggcgccagcggccccaccugcgagagaugccccaccugcggcgaccccugcaacagcaagagaagcugcaucgagugccaccugagcgccgccggccaggccagagaggagugcguggacaagugcaagcuggccggcgccaccaucagcgaggaggaggacuucagcaaggacggcagcgugagcugcagccugcagggcgagaacgagugccugaucaccuuccugaucaccaccgacaacgagggcaagaccaucauccacagcaucaacgagaaggacugccccaagccccccaacauccccaugaucaugcugggcgugagccuggccauccugcugaucggcguggugcugcugugcaucuggaagcugcuggugagcuuccacgacagaaaggagguggccaaguucgaggccgagagaagcaaggccaaguggcagaccggcaccaacccccuguacagaggcagcaccagcaccuucaagaacgugaccuacaagcacagagagaagcagaagguggaccugagcaccgacugcuaa

SEQ ID NO: 18687 - RNA, 2397 nt, Artificial Sequence
  ITGB7__Homo_sapiens__NP_000880
augguggcccugcccauggugcuggugcugcugcuggugcugagcagaggcgagagcgagcuggacgccaagauccccagcaccggcgacgccaccgaguggagaaacccccaccugagcaugcugggcagcugccagcccgcccccagcugccagaagugcauccugagccaccccagcugcgccuggugcaagcagcugaacuucaccgccagcggcgaggccgaggccagaagaugcgccagaagagaggagcugcuggccagaggcugcccccuggaggagcuggaggagcccagaggccagcaggaggugcugcaggaccagccccugagccagggcgccagaggcgagggcgccacccagcuggccccccagagagugagagugacccugagacccggcgagccccagcagcugcaggugagauuccugagagccgagggcuaccccguggaccuguacuaccugauggaccugagcuacagcaugaaggacgaccuggagagagugagacagcugggccacgcccugcuggugagacugcaggaggugacccacagcgugagaaucggcuucggcagcuucguggacaagaccgugcugcccuucgugagcaccgugcccagcaagcugagacaccccugccccaccagacuggagagaugccagagccccuucagcuuccaccacgugcugagccugaccggcgacgcccaggccuucgagagagaggugggcagacagagcgugagcggcaaccuggacagccccgagggcggcuucgacgccauccugcaggccgcccugugccaggagcagaucggcuggagaaacgugagcagacugcugguguucaccagcgacgacaccuuccacaccgccggcgacggcaagcugggcggcaucuucaugcccagcgacggccacugccaccuggacagcaacggccuguacagcagaagcaccgaguucgacuaccccagcgugggccagguggcccaggcccugagcgccgccaacauccagcccaucuucgccgugaccagcgccgcccugcccguguaccaggagcugagcaagcugauccccaagagcgccgugggcgagcugagcgaggacagcagcaacguggugcagcugaucauggacgccuacaacagccugagcagcaccgugacccuggagcacagcagccugccccccggcgugcacaucagcuacgagagccagugcgagggccccgagaagagagagggcaaggccgaggacagaggccagugcaaccacgugagaaucaaccagaccgugaccuucugggugagccugcaggccacccacugccugcccgagccccaccugcugagacugagagcccugggcuucagcgaggagcugaucguggagcugcacacccugugcgacugcaacugcagcgacacccagccccaggccccccacugcagcgacggccagggccaccugcagugcggcgugugcagcugcgcccccggcagacugggcagacugugcgagugcagcguggccgagcugagcagccccgaccuggagagcggcugcagagcccccaacggcaccggcccccugugcagcggcaagggccacugccagugcggcagaugcagcugcagcggccagagcagcggccaccugugcgagugcgacgacgccagcugcgagagacacgagggcauccugugcggcggcuucggcagaugccagugcggcgugugccacugccacgccaacagaaccggcagagccugcgagugcagcggcgacauggacagcugcaucagccccgagggcggccugugcagcggccacggcagaugcaagugcaacagaugccagugccuggacggcuacuacggcgcccugugcgaccagugccccggcugcaagacccccugcgagagacacagagacugcgccgagugcggcgccuucagaaccggcccccuggccaccaacugcagcaccgccugcgcccacaccaacgugacccuggcccuggcccccauccuggacgacggcuggugcaaggagagaacccuggacaaccagcuguucuucuuccugguggaggacgacgccagaggcaccguggugcugagagugagaccccaggagaagggcgccgaccacacccaggccaucgugcugggcugcgugggcggcaucguggccgugggccugggccuggugcuggccuacagacugagcguggagaucuacgacagaagagaguacagcagauucgagaaggagcagcagcagcugaacuggaagcaggacagcaacccccuguacaagagcgccaucaccaccaccaucaaccccagauuccaggaggccgacagccccacccuguaa

SEQ ID NO: 18688 - RNA, 2310 nt, Artificial Sequence
  ITGB8__Homo_sapiens__NP_002205
augugcggcagcgcccuggccuucuucaccgccgccuucgugugccugcagaacgacagaagaggccccgccagcuuccugugggccgccuggguguucagccuggugcugggccugggccagggcgaggacaacagaugcgccagcagcaacgccgccagcugcgccagaugccuggcccugggccccgagugcggcuggugcgugcaggaggacuucaucagcggcggcagcagaagcgagagaugcgacaucgugagcaaccugaucagcaagggcugcagcguggacagcaucgaguaccccagcgugcacgugaucauccccaccgagaacgagaucaacacccaggugacccccggcgaggugagcauccagcugagacccggcgccgaggccaacuucaugcugaaggugcacccccugaagaaguaccccguggaccuguacuaccugguggacgugagcgccagcaugcacaacaacaucgagaagcugaacagcgugggcaacgaccugagcagaaagauggccuucuucagcagagacuucagacugggcuucggcagcuacguggacaagaccgugagccccuacaucagcauccaccccgagagaauccacaaccagugcagcgacuacaaccuggacugcaugcccccccacggcuacauccacgugcugagccugaccgagaacaucaccgaguucgagaaggccgugcacagacagaagaucagcggcaacaucgacacccccgagggcggcuucgacgccaugcugcaggccgccgugugcgagagccacaucggcuggagaaaggaggccaagagacugcugcuggugaugaccgaccagaccagccaccuggcccuggacagcaagcuggccggcaucguggugcccaacgacggcaacugccaccugaagaacaacguguacgugaagagcaccaccauggagcaccccagccugggccagcugagcgagaagcugaucgacaacaacaucaacgugaucuucgccgugcagggcaagcaguuccacugguacaaggaccugcugccccugcugcccggcaccaucgccggcgagaucgagagcaaggccgccaaccugaacaaccuggugguggaggccuaccagaagcugaucagcgaggugaaggugcagguggagaaccaggugcagggcaucuacuucaacaucaccgccaucugccccgacggcagcagaaagcccggcauggagggcugcagaaacgugaccagcaacgacgaggugcuguucaacgugaccgugaccaugaagaagugcgacgugaccggcggcaagaacuacgccaucaucaagcccaucggcuucaacgagaccgccaagauccacauccacagaaacugcagcugccagugcgaggacaacagaggccccaagggcaagugcguggacgagaccuuccuggacagcaagugcuuccagugcgacgagaacaagugccacuucgacgaggaccaguucagcagcgagagcugcaagagccacaaggaccagcccgugugcagcggcagaggcgugugcgugugcggcaagugcagcugccacaagaucaagcugggcaagguguacggcaaguacugcgagaaggacgacuucagcugccccuaccaccacggcaaccugugcgccggccacggcgagugcgaggccggcagaugccagugcuucagcggcugggagggcgacagaugccagugccccagcgccgccgcccagcacugcgugaacagcaagggccaggugugcagcggcagaggcaccugcgugugcggcagaugcgagugcaccgaccccagaagcaucggcagauucugcgagcacugccccaccugcuacaccgccugcaaggagaacuggaacugcaugcagugccugcacccccacaaccugagccaggccauccuggaccagugcaagaccagcugcgcccugauggagcagcagcacuacguggaccagaccagcgagugcuucagcagccccagcuaccugagaaucuucuucaucaucuucaucgugaccuuccugaucggccugcugaaggugcugaucaucagacaggugauccugcaguggaacagcaacaagaucaagagcagcagcgacuacagagugagcgccagcaagaaggacaagcugauccugcagagcgugugcaccagagccgugaccuacagaagagagaagcccgaggagaucaagauggacaucagcaagcugaacgcccacgagaccuucagaugcaacuucuaa

SEQ ID NO: 18689 - RNA, 1062 nt, Artificial Sequence
  ITGBL1__Homo_sapiens__NP_001258683
augugcaagaacagccaggacaucaucugcagcaacgccggcaccugccacugcggcagaugcaagugcgacaacagcgacggcagcggccugguguacggcaaguucugcgagugcgacgacagagagugcaucgacgacgagaccgaggagaucugcggcggccacggcaagugcuacugcggcaacugcuacugcaaggccggcuggcacggcgacaagugcgaguuccagugcgacaucacccccugggagagcaagagaagaugcaccagccccgacggcaagaucugcagcaacagaggcaccugcgugugcggcgagugcaccugccacgacguggaccccaccggcgacuggggcgacauccacggcgacaccugcgagugcgacgagagagacugcagagccguguacgacagauacagcgacgacuucugcagcggccacggccagugcaacugcggcagaugcgacugcaaggccggcugguacggcaagaagugcgagcacccccagagcugcacccugagcgccgaggagagcaucagaaagugccagggcagcagcgaccugcccugcagcggcagaggcaagugcgagugcggcaagugcaccugcuacccccccggcgacagaagaguguacggcaagaccugcgagugcgacgacagaagaugcgaggaccuggacggcguggugugcggcggccacggcaccugcagcugcggcagaugcgugugcgagagaggcugguucggcaagcugugccagcaccccagaaagugcaacaugaccgaggagcagagcaagaaccugugcgagagcgccgacggcauccugugcagcggcaagggcagcugccacugcggcaagugcaucugcagcgccgaggagugguacaucagcggcgaguucugcgacugcgacgacagagacugcgacaagcacgacggccugaucugcaccggcaacggcaucugcagcugcggcaacugcgagugcugggacggcuggaacggcaacgccugcgagaucuggcugggcagcgaguaccccuaa

SEQ ID NO: 18690 - RNA, 2736 nt, Artificial Sequence
  ITIH1__Homo_sapiens__NP_002206
auggacggcgccaugggccccagaggccugcugcugugcauguaccuggugagccugcugauccugcaggccaugcccgcccugggcagcgccaccggcagaagcaagagcagcgagaagagacaggccguggacaccgccguggacggcguguucaucagaagccugaaggugaacugcaaggugaccagcagauucgcccacuacguggugaccagccagguggugaacaccgccaacgaggccagagagguggccuucgaccuggagauccccaagaccgccuucaucagcgacuucgccgugaccgccgacggcaacgccuucaucggcgacaucaaggacaaggugaccgccuggaagcaguacagaaaggccgccaucagcggcgagaacgccggccuggugagagccagcggcagaaccauggagcaguucaccauccaccugaccgugaacccccagagcaaggugaccuuccagcugaccuacgaggaggugcugaagagaaaccacaugcaguacgagaucgugaucaaggugaagcccaagcagcuggugcaccacuucgagaucgacguggacaucuucgagccccagggcaucagcaagcuggacgcccaggccagcuuccugcccaaggagcuggccgcccagaccaucaagaagagcuucagcggcaagaagggccacgugcuguucagacccaccgugagccagcagcagagcugccccaccugcagcaccagccugcugaacggccacuucaaggugaccuacgacgugagcagagacaagaucugcgaccugcugguggccaacaaccacuucgcccacuucuucgccccccagaaccugaccaacaugaacaagaacgugguguucgugaucgacaucagcggcagcaugagaggccagaaggugaagcagaccaaggaggcccugcugaagauccugggcgacaugcagcccggcgacuacuucgaccuggugcuguucggcaccagagugcagagcuggaagggcagccuggugcaggccagcgaggccaaccugcaggccgcccaggacuucgugagaggcuucagccuggacgaggccaccaaccugaacggcggccugcugagaggcaucgagauccugaaccaggugcaggagagccugcccgagcugagcaaccacgccagcauccugaucaugcugaccgacggcgaccccaccgagggcgugaccgacagaagccagauccugaagaacgugagaaacgccaucagaggcagauucccccuguacaaccugggcuucggccacaacguggacuucaacuuccuggaggugaugagcauggagaacaacggcagagcccagagaaucuacgaggaccacgacgccacccagcagcugcagggcuucuacagccagguggccaagccccugcugguggacguggaccugcaguacccccaggacgccgugcuggcccugacccagaaccaccacaagcaguacuacgagggcagcgagaucgugguggccggcagaaucgccgacaacaagcagagcagcuucaaggccgacgugcaggcccacggcgagggccaggaguucagcaucaccugccugguggacgaggaggagaugaagaagcugcugagagagagaggccacaugcuggagaaccacguggagagacugugggccuaccugaccauccaggagcugcuggccaagagaaugaagguggacagagaggagagagccaaccugagcagccaggcccugcagaugagccuggacuacggcuucgugaccccccugaccagcaugagcaucagaggcauggccgaccaggacggccugaagcccaccaucgacaagcccagcgaggacagccccccccuggagaugcugggccccagaagaaccuucgugcugagcgcccugcagcccagccccacccacagcagcagcaacacccagagacugcccgacagagugaccggcguggacaccgacccccacuucaucauccacgugccccagaaggaggacacccugugcuucaacaucaacgaggagcccggcgugauccugagccuggugcaggaccccaacaccggcuucagcgugaacggccagcugaucggcaacaaggccagaagccccggccagcacgacggcaccuacuucggcagacugggcaucgccaaccccgccaccgacuuccagcuggaggugaccccccagaacaucacccugaaccccggcuucggcggccccguguucagcuggagagaccaggccgugcugagacaggacggcgugguggugaccaucaacaagaagagaaaccugguggugagcguggacgacggcggcaccuucgagguggugcugcacagaguguggaagggcagcagcgugcaccaggacuuccugggcuucuacgugcuggacagccacagaaugagcgccagaacccacggccugcugggccaguucuuccaccccaucggcuucgaggugagcgacauccaccccggcagcgaccccaccaagcccgacgccaccaugguggugagaaacagaagacugaccgugaccagaggccugcagaaggacuacagcaaggaccccuggcacggcgccgaggugagcugcugguucauccacaacaacggcgccggccugaucgacggcgccuacaccgacuacaucgugcccgacaucuucuaa

SEQ ID NO: 18691 - RNA, 2841 nt, Artificial Sequence
  ITIH2__Homo_sapiens__NP_002207
augaagagacugaccugcuucuucaucugcuucuuccugagcgaggugagcggcuucgagauccccaucaacggccugagcgaguucguggacuacgaggaccugguggagcuggcccccggcaaguuccagcugguggccgagaacagaagauaccagagaagccugcccggcgagagcgaggagaugauggaggagguggaccaggugacccuguacagcuacaaggugcagagcaccaucaccagcagaauggccaccaccaugauccagagcaagguggugaacaacagcccccagccccagaacgugguguucgacgugcagauccccaagggcgccuucaucagcaacuucagcaugaccguggacggcaagaccuucagaagcagcaucaaggagaagaccgugggcagagcccuguacgcccaggccagagccaagggcaagaccgccggccuggugagaagcagcgcccuggacauggagaacuucagaaccgaggugaacgugcugcccggcgccaaggugcaguucgagcugcacuaccaggaggugaaguggagaaagcugggcagcuacgagcacagaaucuaccugcagcccggcagacuggccaagcaccuggagguggacgugugggugaucgagccccagggccugagauuccugcacgugcccgacaccuucgagggccacuucgacggcgugcccgugaucagcaagggccagcagaaggcccacgugagcuucaagcccaccguggcccagcagagaaucugccccaacugcagagagaccgccguggacggcgagcugguggugcuguacgacgugaagagagaggagaaggccggcgagcuggagguguucaacggcuacuucgugcacuucuucgcccccgacaaccuggaccccauccccaagaacauccuguucgugaucgacgugagcggcagcauguggggcgugaagaugaagcagaccguggaggccaugaagaccauccuggacgaccugagagccgaggaccacuucagcgugaucgacuucaaccagaacaucagaaccuggagaaacgaccugaucagcgccaccaagacccagguggccgacgccaagagauacaucgagaagauccagcccagcggcggcaccaacaucaacgaggcccugcugagagccaucuucauccugaacgaggccaacaaccugggccugcuggaccccaacagcgugagccugaucauccuggugagcgacggcgaccccaccgugggcgagcugaagcugagcaagauccagaagaacgugaaggagaacauccaggacaacaucagccuguucagccugggcaugggcuucgacguggacuacgacuuccugaagagacugagcaacgagaaccacggcaucgcccagagaaucuacggcaaccaggacaccagcagccagcugaagaaguucuacaaccaggugagcaccccccugcugagaaacgugcaguucaacuacccccacaccagcgugaccgacgugacccagaacaacuuccacaacuacuucggcggcagcgagaucgugguggccggcaaguucgaccccgccaagcuggaccagaucgagagcgugaucaccgccaccagcgccaacacccagcuggugcuggagacccuggcccagauggacgaccugcaggacuuccugagcaaggacaagcacgccgaccccgacuucaccagaaagcugugggccuaccugaccaucaaccagcugcuggccgagagaagccuggcccccaccgccgccgccaagagaagaaucaccagaagcauccugcagaugagccuggaccaccacaucgugaccccccugaccagccuggugaucgagaacgaggccggcgacgagagaaugcuggccgacgcccccccccaggaccccagcugcugcagcggcgcccuguacuacggcagcaagguggugcccgacagcacccccagcugggccaaccccagccccacccccgugaucagcaugcuggcccagggcagccaggugcuggagagcaccccccccccccacgugaugagaguggagaacgacccccacuucaucaucuaccugcccaagagccagaagaacaucugcuucaacaucgacagcgagcccggcaagauccugaaccuggugagcgaccccgagagcggcaucguggugaacggccagcuggugggcgccaagaagcccaacaacggcaagcugagcaccuacuucggcaagcugggcuucuacuuccagagcgaggacaucaagaucgagaucagcaccgagaccaucacccugagccacggcagcagcaccuucagccugagcuggagcgacaccgcccaggugaccaaccagagagugcagaucagcgugaagaaggagaagguggugaccaucacccuggacaaggagaugagcuucagcgugcugcugcacagaguguggaagaagcaccccgugaacguggacuuccugggcaucuacaucccccccaccaacaaguucagccccaaggcccacggccugaucggccaguucaugcaggagcccaagauccacaucuucaacgagagacccggcaaggaccccgagaagcccgaggccagcauggaggugaagggccagaagcugaucaucaccagaggccugcagaaggacuacagaaccgaccugguguucggcaccgacgugaccugcugguucgugcacaacagcggcaagggcuucaucgacggccacuacaaggacuacuucgugccccagcuguacagcuuccugaagagacccuaa

SEQ ID NO: 18692 - RNA, 2673 nt, Artificial Sequence
  ITIH3__Homo_sapiens__NP_002208
auggccuucgccugguggcccugccugauccuggcccugcugagcagccuggccgccagcggcuuccccagaagccccuucagacugcugggcaagagaagccugcccgagggcguggccaacggcaucgagguguacagcaccaagaucaacagcaaggugaccagcagauucgcccacaacguggugaccaugagagccgugaacagagccgacaccgccaaggaggugagcuucgacguggagcugcccaagaccgccuucaucaccaacuucacccugaccaucgacggcgugaccuaccccggcaacgugaaggagaaggagguggccaagaagcaguacgagaaggccgugagccagggcaagaccgccggccuggugaaggccagcggcagaaagcuggagaaguucaccgugagcgugaacguggccgccggcagcaaggugaccuucgagcugaccuacgaggagcugcugaagagacacaagggcaaguacgagauguaccugaaggugcagcccaagcagcuggugaagcacuucgagaucgagguggacaucuucgagccccagggcaucagcaugcuggacgccgaggccagcuucaucaccaacgaccugcugggcagcgcccugaccaagagcuucagcggcaagaagggccacgugagcuucaagcccagccuggaccagcagagaagcugccccaccugcaccgacagccugcugaacggcgacuucaccaucaccuacgacgugaacagagagagccccggcaacgugcagaucgugaacggcuacuucgugcacuucuucgccccccagggccugcccguggugcccaagaacguggccuucgugaucgacaucagcggcagcauggccggcagaaagcuggagcagaccaaggaggcccugcugagaauccuggaggacaugcaggaggaggacuaccugaacuucauccuguucagcggcgacgugagcaccuggaaggagcaccuggugcaggccacccccgagaaccugcaggaggccagaaccuucgugaagagcauggaggacaagggcaugaccaacaucaacgacggccugcugagaggcaucagcaugcugaacaaggccagagaggagcacagaauccccgagagaagcaccagcaucgugaucaugcugaccgacggcgacgccaacgugggcgagagcagacccgagaagauccaggagaacgugagaaacgccaucggcggcaaguucccccuguacaaccugggcuucggcaacaaccugaacuacaacuuccuggagaacauggcccuggagaaccacggcuucgccagaagaaucuacgaggacagcgacgccgaccugcagcugcagggcuucuacgaggagguggccaacccccugcugaccggcguggagauggaguaccccgagaacgccauccuggaccugacccagaacaccuaccagcacuucuacgacggcagcgagaucgugguggccggcagacugguggacgaggacaugaacagcuucaaggccgacgugaagggccacggcgccaccaacgaccugaccuucaccgaggagguggacaugaaggagauggagaaggcccugcaggagagagacuacaucuucggcaacuacaucgagagacugugggccuaccugaccaucgagcagcugcuggagaagagaaagaacgcccacggcgaggagaaggagaaccugaccgccagagcccuggaccugagccugaaguaccacuucgugaccccccugaccagcaugguggugaccaagcccgaggacaacgaggacgagagagccaucgccgacaagcccggcgaggacgccgaggccacccccgugagccccgccaugagcuaccugaccagcuaccagcccccccagaaccccuacuacuacguggacggcgacccccacuucaucauccagauccccgagaaggacgacgcccugugcuucaacaucgacgaggcccccggcaccgugcugagacugauccaggacgccgugaccggccugaccgugaacggccagaucaccggcgacaagagaggcagccccgacagcaagaccagaaagaccuacuucggcaagcugggcaucgccaacgcccagauggacuuccagguggaggugaccaccgagaagaucacccuguggaacagagccgugcccagcaccuucagcuggcuggacaccgugaccgugacccaggacggccugagcaugaugaucaacagaaagaacaugguggugagcuucggcgacggcgugaccuucgugguggugcugcaccagguguggaagaagcaccccgugcacagagacuuccugggcuucuacgugguggacagccacagaaugagcgcccagacccacggccugcugggccaguucuuccagcccuucgacuucaaggugagcgacaucagacccggcagcgaccccaccaagcccgacgccacccugguggugaagaaccaccagcugaucgugaccagaggcagccagaaggacuacagaaaggacgccagcaucggcaccaagguggugugcugguucgugcacaacaacggcgagggccugaucgacggcgugcacaccgacuacaucgugcccaaccuguucuaa

SEQ ID NO: 18693 - RNA, 2703 nt, Artificial Sequence
  ITIH4__Homo_sapiens__NP_001159921
augaagccccccagacccgugagaaccugcagcaaggugcuggugcugcugagccugcuggccauccaccagaccaccaccgccgagaagaacggcaucgacaucuacagccugaccguggacagcagagugagcagcagauucgcccacaccguggugaccagcagaguggugaacagagccaacaccgugcaggaggccaccuuccagauggagcugcccaagaaggccuucaucaccaacuucagcaugaucaucgacggcaugaccuaccccggcaucaucaaggagaaggccgaggcccaggcccaguacagcgccgccguggccaagggcaagagcgccggccuggugaaggccaccggcagaaacauggagcaguuccaggugagcgugagcguggcccccaacgccaagaucaccuucgagcugguguacgaggagcugcugaagagaagacugggcguguacgagcugcugcugaaggugagaccccagcagcuggugaagcaccugcagauggacauccacaucuucgagccccagggcaucagcuuccuggagaccgagagcaccuucaugaccaaccagcugguggacgcccugaccaccuggcagaacaagaccaaggcccacaucagauucaagcccacccugagccagcagcagaagagccccgagcagcaggagaccgugcuggacggcaaccugaucaucagauacgacguggacagagccaucagcggcggcagcauccagaucgagaacggcuacuucgugcacuacuucgcccccgagggccugaccaccaugcccaagaacgugguguucgugaucgacaagagcggcagcaugagcggcagaaagauccagcagaccagagaggcccugaucaagauccuggacgaccugagccccagagaccaguucaaccugaucguguucagcaccgaggccacccaguggagacccagccuggugcccgccagcgccgagaacgugaacaaggccagaagcuucgccgccggcauccaggcccugggcggcaccaacaucaacgacgccaugcugauggccgugcagcugcuggacagcagcaaccaggaggagagacugcccgagggcagcgugagccugaucauccugcugaccgacggcgaccccaccgugggcgagaccaaccccagaagcauccagaacaacgugagagaggccgugagcggcagauacagccuguucugccugggcuucggcuucgacgugagcuacgccuuccuggagaagcuggcccuggacaacggcggccuggccagaagaauccacgaggacagcgacagcgcccugcagcugcaggacuucuaccaggagguggccaacccccugcugaccgccgugaccuucgaguaccccagcaacgccguggaggaggugacccagaacaacuucagacugcuguucaagggcagcgagauggugguggccggcaagcugcaggacagaggccccgacgugcugaccgccaccgugagcggcaagcugcccacccagaacaucaccuuccagaccgagagcagcguggccgagcaggaggccgaguuccagagccccaaguacaucuuccacaacuucauggagagacugugggccuaccugaccauccagcagcugcuggagcagaccgugagcgccagcgacgccgaccagcaggcccugagaaaccaggcccugaaccugagccuggccuacagcuucgugaccccccugaccagcaugguggugaccaagcccgacgaccaggagcagagccagguggccgagaagcccauggagggcgagagcagaaacagaaacgugcacagcgccggcgccgccggcagcagaaugaacuucagacccggcgugcugagcagcagacagcugggccugcccggcccccccgacgugcccgaccacgccgccuaccaccccuucagaagacuggccauccugcccgccagcgccccccccgccaccagcaaccccgaccccgccgugagcagagugaugaacaugaagaucgaggagaccaccaugaccacccagacccccgcccccauccaggcccccagcgccauccugccccugcccggccagagcguggagagacugugcguggaccccagacacagacagggccccgugaaccugcugagcgaccccgagcagggcguggaggugaccggccaguacgagagagagaaggccggcuucagcuggaucgaggugaccuucaagaacccccuggugugggugcacgccagccccgagcacgugguggugaccagaaacagaagaagcagcgccuacaaguggaaggagacccuguucagcgugaugcccggccugaagaugaccauggacaagaccggccugcugcugcugagcgaccccgacaaggugaccaucggccugcuguucugggacggcagaggcgagggccugagacugcugcugagagacaccgacagauucagcagccacgugggcggcacccugggccaguucuaccaggaggugcuguggggcagccccgccgccagcgacgacggcagaagaacccugagagugcagggcaacgaccacagcgccaccagagagagaagacuggacuaccaggagggcccccccggcguggagaucagcugcuggagcguggagcuguaa

SEQ ID NO: 18694 - RNA, 2109 nt, Artificial Sequence
  ITIH5__Homo_sapiens__NP_001001851
augcugcugcugcugggccugugccugggccugagccugugcgugggcagccaggaggaggcccagagcuggggccacagcagcgagcaggacggccugagagugcccagacaggugagacugcugcagagacugaagaccaagccccugaugaccgaguucagcgugaagagcaccaucaucagcagauacgccuucaccaccgugagcugcagaaugcugaacagagccagcgaggaccaggacaucgaguuccagaugcagauccccgccgccgccuucaucaccaacuucaccaugcugaucggcgacaagguguaccagggcgagaucaccgagagagagaagaagagcggcgacagagugaaggagaagagaaacaagaccaccgaggagaacggcgagaagggcaccgagaucuucagagccagcgccgugauccccagcaaggacaaggccgccuucuuccugagcuacgaggagcugcugcagagaagacugggcaaguacgagcacagcaucagcgugagaccccagcagcugagcggcagacugagcguggacgugaacauccuggagagcgccggcaucgccagccuggaggugcugccccugcacaacagcagacagagaggcagcggcagaggcgaggacgacagcggccccccccccagcaccgugaucaaccagaacgagaccuucgccaacaucaucuucaagcccaccguggugcagcaggccagaaucgcccagaacggcauccugggcgacuucaucaucagauacgacgugaacagagagcagagcaucggcgacauccaggugcugaacggcuacuucgugcacuacuucgcccccaaggaccugcccccccugcccaagaacgugguguucgugcuggacagcagcgccagcauggugggcaccaagcugagacagaccaaggacgcccuguucaccauccugcacgaccugagaccccaggacagauucagcaucaucggcuucagcaacagaaucaagguguggaaggaccaccugaucagcgugacccccgacagcaucagagacggcaagguguacauccaccacaugagccccaccggcggcaccgacaucaacggcgcccugcagagagccaucagacugcugaacaaguacguggcccacagcggcaucggcgacagaagcgugagccugaucguguuccugaccgacggcaagcccaccgugggcgagacccacacccugaagauccugaacaacaccagagaggccgccagaggccaggugugcaucuucaccaucggcaucggcaacgacguggacuucagacugcuggagaagcugagccuggagaacugcggccugaccagaagagugcacgaggaggaggacgccggcagccagcugaucggcuucuacgacgagaucagaaccccccugcugagcgacaucagaaucgacuacccccccagcagcguggugcaggccaccaagacccuguuccccaacuacuucaacggcagcgagaucaucaucgccggcaagcugguggacagaaagcuggaccaccugcacguggaggugaccgccagcaacagcaagaaguucaucauccugaagaccgacgugcccgugagaccccagaaggccggcaaggacgugaccggcagccccagacccggcggcgacggcgagggcgacaccaaccacaucgagagacuguggagcuaccugaccaccaaggagcugcugagcagcuggcugcagagcgacgacgagcccgagaaggagagacugagacagagagcccaggcccuggccgugagcuacagauuccugacccccuucaccagcaugaagcugagaggccccgugcccagaauggacggccuggaggaggcccacggcaugagcgccgccaugggccccgagcccguggugcagagcgugagaggcgccggcacccagcccggcccccugcugaagaagcccuaccagcccagaaucaagaucagcaagaccagcgugagaggcuucagaagagaggagcagaucuucagcaacgugaugaaguuccccuucgccagcauccuggagcuguaa

SEQ ID NO: 18695 - RNA, 1863 nt, Artificial Sequence
  ITK__Homo_sapiens__NP_005537
augaacaacuucauccugcuggaggagcagcugaucaagaagagccagcagaagagaagaaccagccccagcaacuucaaggugagauucuucgugcugaccaaggccagccuggccuacuucgaggacagacacggcaagaagagaacccugaagggcagcaucgagcugagcagaaucaagugcguggagaucgugaagagcgacaucagcauccccugccacuacaaguaccccuuccagguggugcacgacaacuaccugcuguacguguucgcccccgacagagagagcagacagagaugggugcuggcccugaaggaggagaccagaaacaacaacagccuggugcccaaguaccaccccaacuucuggauggacggcaaguggagaugcugcagccagcuggagaagcuggccaccggcugcgcccaguacgaccccaccaagaacgccagcaagaagccccugccccccacccccgaggacaacagaagaccccugugggagcccgaggagaccguggugaucgcccuguacgacuaccagaccaacgacccccaggagcuggcccugagaagaaacgaggaguacugccugcuggacagcagcgagauccacugguggagagugcaggacagaaacggccacgagggcuacgugcccagcagcuaccugguggagaagagccccaacaaccuggagaccuacgagugguacaacaagagcaucagcagagacaaggccgagaagcugcugcuggacaccggcaaggagggcgccuucauggugagagacagcagaaccgccggcaccuacaccgugagcguguucaccaaggccguggugagcgagaacaaccccugcaucaagcacuaccacaucaaggagaccaacgacaaccccaagagauacuacguggccgagaaguacguguucgacagcaucccccugcugaucaacuaccaccagcacaacggcggcggccuggugaccagacugagauaccccgugugcuucggcagacagaaggcccccgugaccgccggccugagauacggcaagugggugaucgaccccagcgagcugaccuucgugcaggagaucggcagcggccaguucggccuggugcaccugggcuacuggcugaacaaggacaagguggccaucaagaccaucagagagggcgccaugagcgaggaggacuucaucgaggaggccgaggugaugaugaagcugagccaccccaagcuggugcagcuguacggcgugugccuggagcaggcccccaucugccugguguucgaguucauggagcacggcugccugagcgacuaccugagaacccagagaggccuguucgccgccgagacccugcugggcaugugccuggacgugugcgagggcauggccuaccuggaggaggccugcgugauccacagagaccuggccgccagaaacugccuggugggcgagaaccaggugaucaaggugagcgacuucggcaugaccagauucgugcuggacgaccaguacaccagcagcaccggcaccaaguuccccgugaagugggccagccccgagguguucagcuucagcagauacagcagcaagagcgacguguggagcuucggcgugcugaugugggagguguucagcgagggcaagauccccuacgagaacagaagcaacagcgaggugguggaggacaucagcaccggcuucagacuguacaagcccagacuggccagcacccacguguaccagaucaugaaccacugcuggaaggagagacccgaggacagacccgccuucagcagacugcugagacagcuggccgagaucgccgagagcggccuguaa

SEQ ID NO: 18696 - RNA, 942 nt, Artificial Sequence
  ITLN1__Homo_sapiens__NP_060095
augaaccagcugagcuuccugcuguuccugaucgccaccaccagaggcuggagcaccgacgaggccaacaccuacuucaaggaguggaccugcagcagcagccccagccugcccagaagcugcaaggagaucaaggacgagugccccagcgccuucgacggccuguacuuccugagaaccgagaacggcgugaucuaccagaccuucugcgacaugaccagcggcggcggcggcuggacccugguggccagcgugcacgagaacgacaugagaggcaagugcaccgugggcgacagauggagcagccagcagggcagcaaggccguguaccccgagggcgacggcaacugggccaacuacaacaccuucggcagcgccgaggccgccaccagcgacgacuacaagaaccccggcuacuacgacauccaggccaaggaccugggcaucuggcacgugcccaacaagagccccaugcagcacuggagaaacagcagccugcugagauacagaaccgacaccggcuuccugcagacccugggccacaaccuguucggcaucuaccagaaguaccccgugaaguacggcgagggcaagugcuggaccgacaacggccccgugauccccgugguguacgacuucggcgacgcccagaagaccgccagcuacuacagccccuacggccagagagaguucaccgccggcuucgugcaguucagaguguucaacaacgagagagccgccaacgcccugugcgccggcaugagagugaccggcugcaacaccgagcaccacugcaucggcggcggcggcuacuuccccgaggccagcccccagcagugcggcgacuucagcggcuucgacuggagcggcuacggcacccacgugggcuacagcagcagcagagagaucaccgaggccgccgugcugcuguucuacagauaa

SEQ ID NO: 18697 - RNA, 978 nt, Artificial Sequence
  ITLN2__Homo_sapiens__XP_011507512
augcugagcaugcugagaaccaugaccagacugugcuuccugcuguucuucagcguggccaccagcggcugcagcgccgccgccgccagcagccuggagaugcugagcagagaguucgagaccugcgccuucagcuucagcagccugcccagaagcugcaaggagaucaaggagagaugccacagcgccggcgacggccuguacuuccugagaaccaagaacggcgugguguaccagaccuucugcgacaugaccagcggcggcggcggcuggacccugguggccagcgugcacgagaacgacaugagaggcaagugcaccgugggcgacagauggagcagccagcagggcaacaaggccgacuaccccgagggcgacggcaacugggccaacuacaacaccuucggcagcgccgaggccgccaccagcgacgacuacaagaaccccggcuacuacgacauccaggccaaggaccugggcaucuggcacgugcccaacaagagccccaugcagcacuggagaaacagcgcccugcugagauacagaaccaacaccggcuuccugcagagacugggccacaaccuguucggcaucuaccagaaguaccccgugaaguacagaagcggcaagugcuggaacgacaacggccccgccauccccgugguguacgacuucggcgacgccaagaagaccgccagcuacuacagccccuacggccagagagaguucguggccggcuucgugcaguucagaguguucaacaacgagagagccgccaacgcccugugcgccggcaucaaggugaccggcugcaacaccgagcaccacugcaucggcggcggcggcuucuucccccagggcaagcccagacagugcggcgacuucagcgccuucgacugggacggcuacggcacccacgugaagagcagcugcagcagagagaucaccgaggccgccgugcugcuguucuacagauaa

SEQ ID NO: 18698 - RNA, 660 nt, Artificial Sequence
  ITM2A__Homo_sapiens__NP_001165052
auggugaagaucgccuucaacacccccaccgccgugcagaaggaggaggccagacaggacguggaggcccugcugagcagaaccgugagaacccagauccugaccggcaagagcaccaucuacagaggcgagaugugcuucuucgacagcgaggaccccgccaacagccugagaggcggcgagcccaacuuccugcccgugaccgaggaggccgacaucagagaggacgacaacaucgccaucaucgacgugcccgugcccagcuucagcgacagcgaccccgccgccaucauccacgacuucgagaagggcaugaccgccuaccuggaccugcugcugggcaacugcuaccugaugccccugaacaccagcaucgugaugccccccaagaaccugguggagcuguucggcaagcuggccagcggcagauaccugccccagaccuacguggugagagaggaccugguggccguggaggagaucagagacgugagcaaccugggcaucuucaucuaccagcugugcaacaacagaaagagcuucagacugagaagaagagaccugcugcugggcuucaacaagagagccaucgacaagugcuggaagaucagacacuuccccaacgaguucaucguggagaccaagaucugccaggaguaa

SEQ ID NO: 18699 - RNA, 801 nt, Artificial Sequence
  ITM2B__Homo_sapiens__NP_068839
auggugaaggugaccuucaacagcgcccuggcccagaaggaggccaagaaggacgagcccaagagcggcgaggaggcccugaucaucccccccgacgccguggccguggacugcaaggaccccgacgacguggugcccgugggccagagaagagccuggugcuggugcaugugcuucggccuggccuucaugcuggccggcgugauccugggcggcgccuaccuguacaaguacuucgcccugcagcccgacgacguguacuacugcggcaucaaguacaucaaggacgacgugauccugaacgagcccagcgccgacgcccccgccgcccuguaccagaccaucgaggagaacaucaagaucuucgaggaggaggagguggaguucaucagcgugcccgugcccgaguucgccgacagcgaccccgccaacaucgugcacgacuucaacaagaagcugaccgccuaccuggaccugaaccuggacaagugcuacgugaucccccugaacaccagcaucgugaugccccccagaaaccugcuggagcugcugaucaacaucaaggccggcaccuaccugccccagagcuaccugauccacgagcacauggugaucaccgacagaaucgagaacaucgaccaccugggcuucuucaucuacagacugugccacgacaaggagaccuacaagcugcagagaagagagaccaucaagggcauccagaagagagaggccagcaacugcuucgccaucagacacuucgagaacaaguucgccguggagacccugaucugcagcuaa

SEQ ID NO: 18700 - RNA, 663 nt, Artificial Sequence
  ITM2C__Homo_sapiens__NP_001012532
auggugaagaucagcuuccagcccgccguggccggcaucaagggcgacaaggccgacaaggccagcgccagcgcccccgcccccgccagcgccaccgagauccugcugacccccgccagacuggccagagacaacuucuucagaugcggcgugcuguacgaggacagccugagcagccaggugagaacccagauggagcuggaggaggacgugaagaucuaccuggacgagaacuacgagagaaucaacgugcccgugccccaguucggcggcggcgaccccgccgacaucauccacgacuuccagagaggccugaccgccuaccacgacaucagccuggacaagugcuacgugaucgagcugaacaccaccaucgugcugccccccagaaacuucugggagcugcugaugaacgugaagagaggcaccuaccugccccagaccuacaucauccaggaggagaugguggugaccgagcacgugagcgacaaggaggcccugggcagcuucaucuaccaccugugcaacggcaaggacaccuacagacugagaagaagagccaccagaagaagaaucaacaagagaggcgccaagaacugcaacgccaucagacacuucgagaacaccuucgugguggagacccugaucugcggcgugguguaa

SEQ ID NO: 18701 - RNA, 462 nt, Artificial Sequence
  ITPA__Homo_sapiens__NP_001254552
auggccgccagccuggugggcaagaagaucguguucgugaccggcaacgccaagaagcuggaggaggugcagggccccgugcugguggaggacaccugccugugcuucaacgcccugggcggccugcccggccccuacaucaagugguuccuggagaagcugaagcccgagggccugcaccagcugcuggccggcuucgaggacaagagcgccuacgcccugugcaccuucgcccugagcaccggcgaccccagccagcccgugagacuguucagaggcagaaccagcggcagaaucguggcccccagaggcugccaggacuucggcugggaccccugcuuccagcccgacggcuacgagcagaccuacgccgagaugcccaaggccgagaagaacgccgugagccacagauucagagcccugcuggagcugcaggaguacuucggcagccuggccgccuaa

SEQ ID NO: 18702 - RNA, 1245 nt, Artificial Sequence
  ITPK1__Homo_sapiens__NP_001136065
augcagaccuuccugaagggcaagagagugggcuacuggcugagcgagaagaagaucaagaagcugaacuuccaggccuucgccgagcugugcagaaagagaggcauggagguggugcagcugaaccugagcagacccaucgaggagcagggcccccuggacgugaucauccacaagcugaccgacgugauccuggaggccgaccagaacgacagccagagccuggagcuggugcacagauuccaggaguacaucgacgcccaccccgagaccaucgugcuggacccccugcccgccaucagaacccugcuggacagaagcaagagcuacgagcugaucagaaagaucgaggccuacauggaggacgacagaaucugcagcccccccuucauggagcugaccagccugugcggcgacgacaccaugagacugcuggagaagaacggccugaccuuccccuucaucugcaagaccagaguggcccacggcaccaacagccacgagauggccaucguguucaaccaggagggccugaacgccauccagccccccugcguggugcagaacuucaucaaccacaacgccgugcuguacaagguguucguggugggcgagagcuacaccguggugcagagacccagccugaagaacuucagcgccggcaccagcgacagagagagcaucuucuucaacagccacaacgugagcaagcccgagagcagcagcgugcugaccgagcuggacaagaucgagggcguguucgagagacccagcgacgaggugaucagagagcugagcagagcccugagacaggcccugggcgugagccuguucggcaucgacaucaucaucaacaaccagaccggccagcacgccgugaucgacaucaacgccuuccccggcuacgagggcgugagcgaguucuucaccgaccugcugaaccacaucgccaccgugcugcagggccagagcaccgccauggccgccaccggcgacguggcccugcugagacacagcaagcugcuggccgagcccgccggcggccuggugggcgagagaaccugcagcgccagccccggcugcugcggcagcaugaugggccaggacgcccccuggaaggccgaggccgacgccggcggcaccgccaagcugccccaccagagacugggcugcaacgccggcgugagccccagcuuccagcagcacugcguggccagccuggccaccaaggccagcagccaguaa

SEQ ID NO: 18703 - RNA, 1386 nt, Artificial Sequence
  ITPKA__Homo_sapiens__NP_002211
augacccugcccggcggccccaccggcauggccagacccggcggcgccagacccugcagccccggccuggagagagcccccagaagaagcgugggcgagcugagacugcuguucgaggccagaugcgccgccguggccgccgccgccgccgccggcgagcccagagccagaggcgccaagagaagaggcggccaggugcccaacggccugcccagagccccccccgcccccgugaucccccagcugaccgugaccgccgaggagcccgacgugccccccaccagccccggcccccccgagagagagagagacugccugcccgccgccggcagcagccaccugcagcagcccagaagacugagcaccagcagcgugagcagcaccggcagcagcagccugcuggaggacagcgaggacgaccugcugagcgacagcgagagcagaagcagaggcaacgugcagcuggaggccggcgaggacgugggccagaagaaccacuggcagaagaucagaaccauggugaaccugcccgugaucagccccuucaagaagagauacgccugggugcagcuggccggccacaccggcagcuucaaggccgccggcaccagcggccugauccugaagagaugcagcgagcccgagagauacugccuggccagacugauggccgacgcccugagaggcugcgugcccgccuuccacggcgugguggagagagacggcgagagcuaccugcagcugcaggaccugcuggacggcuucgacggccccugcgugcuggacugcaagaugggcgugagaaccuaccuggaggaggagcugaccaaggccagagagagacccaagcugagaaaggacauguacaagaagaugcuggccguggaccccgaggcccccaccgaggaggagcacgcccagagagccgugaccaagcccagauacaugcaguggagagagggcaucagcagcagcaccacccugggcuucagaaucgagggcaucaagaaggccgacggcagcugcagcaccgacuucaagaccaccagaagcagagagcaggugcugagaguguucgaggaguucgugcagggcgacgaggaggugcugagaagauaccugaacagacugcagcagaucagagacacccuggaggugagcgaguucuucagaagacacgaggugaucggcagcagccugcuguucgugcacgaccacugccacagagccggcguguggcugaucgacuucggcaagaccaccccccugcccgacggccagauccuggaccacagaagacccugggaggagggcaacagagaggacggcuaccugcugggccuggacaaccugaucggcauccuggccagccuggccgagagauaa

SEQ ID NO: 18704 - RNA, 2052 nt, Artificial Sequence
  ITPKC__Homo_sapiens__XP_006723467
augagaagaugccccugcagaggcagccugaacgaggccgaggccggcgcccugcccgccgccgccagaaugggccuggaggcccccagaggcggcagaagaagacagcccggccagcagagacccggccccggcgccggcgcccccgccggcagacccgagggcggcggccccugggccagaaccgagggcagcagccugcacagcgagcccgagagagccggccugggccccgcccccggcaccgagagcccccaggccgaguucuggaccgacggccagaccgagcccgccgccgccggccugggcguggagaccgagagacccaagcagaagaccgagcccgacagaagcagccugagaacccaccuggaguggagcuggagcgagcuggagaccaccugccuguggaccgagaccggcaccgacggccuguggaccgacccccacagaagcgaccugcaguuccagcccgaggaggccagccccuggacccagcccggcgugcacggccccuggaccgagcuggagacccacggcagccagacccagcccgagagagugaagagcugggccgacaaccuguggacccaccagaacagcagcagccugcagacccaccccgagggcgccugccccagcaaggagcccagcgccgacggcagcuggaaggagcuguacaccgacggcagcagaacccagcaggacaucgagggccccuggaccgagcccuacaccgacggcagccagaagaagcaggacaccgaggccgccagaaagcagcccggcaccggcggcuuccagauccagcaggacaccgacggcagcuggacccagcccagcaccgacggcagccagaccgcccccggcaccgacugccugcugggcgagcccgaggacggcccccuggaggagcccgagcccggcgagcugcugacccaccuguacagccaccugaagugcagcccccugugccccgugcccagacugaucaucacccccgagacccccgagcccgaggcccagcccgugggcccccccagcagaguggagggcggcagcggcggcuucagcagcgccagcagcuucgacgagagcgaggacgacgugguggccggcggcggcggcgccagcgaccccgaggacagaagcggcagcaagcccuggaagaagcugaagaccgugcugaaguacagccccuucguggugagcuucagaaagcacuaccccugggugcagcugagcggccacgccggcaacuuccaggccggcgaggacggcagaauccugaagagauucugccagugcgagcagagaagccuggagcagcugaugaaggacccccugagacccuucgugcccgccuacuacggcauggugcugcaggacggccagaccuucaaccagauggaggaccugcuggccgacuucgagggccccagcaucauggacugcaagaugggcagcagaaccuaccuggaggaggagcuggugaaggccagagagagacccagacccagaaaggacauguacgagaagaugguggccguggaccccggcgcccccacccccgaggagcacgcccagggcgccgugaccaagcccagauacaugcaguggagagagaccaugagcagcaccagcacccugggcuucagaaucgagggcaucaagaaggccgacggcaccugcaacaccaacuucaagaagacccaggcccuggagcaggugaccaaggugcuggaggacuucguggacggcgaccacgugauccugcagaaguacguggccugccuggaggagcugagagaggcccuggagaucagccccuucuucaagacccacgagguggugggcagcagccugcuguucgugcacgaccacaccggccuggccaagguguggaugaucgacuucggcaagaccguggcccugcccgaccaccagacccugagccacagacugcccugggccgagggcaacagagaggacggcuaccuguggggccuggacaacaugaucugccugcugcagggccuggcccagagcuaa

SEQ ID NO: 18705 - RNA, 8133 nt, Artificial Sequence
  ITPR1__Homo_sapiens__NP_001093422
augagcgacaagaugagcagcuuccugcacaucggcgacaucugcagccuguacgccgagggcagcaccaacggcuucaucagcacccugggccugguggacgacagaugcguggugcagcccgagaccggcgaccugaacaacccccccaagaaguucagagacugccuguucaagcugugccccaugaacagauacagcgcccagaagcaguucuggaaggccgccaagcccggcgccaacagcaccaccgacgccgugcugcugaacaagcugcaccacgccgccgaccuggagaagaagcagaacgagaccgagaacagaaagcugcugggcaccgugauccaguacggcaacgugauccagcugcugcaccugaagagcaacaaguaccugaccgugaacaagagacugcccgcccugcuggagaagaacgccaugagagugacccuggacgaggccggcaacgagggcagcugguucuacauccagcccuucuacaagcugagaagcaucggcgacagcguggugaucggcgacaagguggugcugaaccccgugaacgccggccagccccugcacgccagcagccaccagcugguggacaaccccggcugcaacgaggugaacagcgugaacugcaacaccagcuggaagaucgugcuguucaugaaguggagcgacaacaaggacgacauccugaagggcggcgacguggugagacuguuccacgccgagcaggagaaguuccugaccugcgacgagcacagaaagaagcagcacguguuccugagaaccaccggcagacagagcgccaccagcgccaccagcagcaaggcccugugggagguggagguggugcagcacgaccccugcagaggcggcgccggcuacuggaacagccuguucagauucaagcaccuggccaccggccacuaccuggccgccgagguggaccccgacuucgaggaggagugccuggaguuccagcccagcguggaccccgaccaggacgccagcagaagcagacugagaaacgcccaggagaagaugguguacagccuggugagcgugcccgagggcaacgacaucagcagcaucuucgagcuggaccccaccacccugagaggcggcgacagccuggugcccagaaacagcuacgugagacugagacaccugugcaccaacaccugggugcacagcaccaacauccccaucgacaaggaggaggagaagcccgugaugcugaagaucggcaccagccccgugaaggaggacaaggaggccuucgccaucgugcccgugagccccgccgaggugagagaccuggacuucgccaacgacgccagcaaggugcugggcagcaucgccggcaagcuggagaagggcaccaucacccagaacgagagaagaagcgugaccaagcugcuggaggaccugguguacuucgugaccggcggcaccaacagcggccaggacgugcuggaggugguguucagcaagcccaacagagagagacagaagcugaugagagagcagaacauccugaagcagaucuucaagcugcugcaggcccccuucaccgacugcggcgacggccccaugcugagacuggaggagcugggcgaccagagacacgcccccuucagacacaucugcagacugugcuacagagugcugagacacagccagcaggacuacagaaagaaccaggaguacaucgccaagcaguucggcuucaugcagaagcagaucggcuacgacgugcuggccgaggacaccaucaccgcccugcugcacaacaacagaaagcugcuggagaagcacaucaccgccgccgagaucgacaccuucgugagccuggugagaaagaacagagagcccagauuccuggacuaccugagcgaccugugcgugagcaugaacaagagcauccccgugacccaggagcugaucugcaaggccgugcugaaccccaccaacgccgacauccugaucgagaccaagcuggugcugagcagauucgaguucgagggcgugagcagcaccggcgagaacgcccuggaggccggcgaggacgaggaggagguguggcuguucuggagagacagcaacaaggagaucagaagcaagagcgugagagagcuggcccaggacgccaaggagggccagaaggaggacagagacgugcugagcuacuacagauaccagcugaaccuguucgccagaaugugccuggacagacaguaccuggccaucaacgagaucagcggccagcuggacguggaccugauccugagaugcaugagcgacgagaaccugcccuacgaccugagagccagcuucugcagacugaugcugcacaugcacguggacagagacccccaggagcaggugacccccgugaaguacgccagacuguggagcgagauccccagcgagaucgccaucgacgacuacgacagcagcggcgccagcaaggacgagaucaaggagagauucgcccagaccauggaguucguggaggaguaccugagagacguggugugccagagauuccccuucagcgacaaggagaagaacaagcugaccuucgagguggugaaccuggccagaaaccugaucuacuucggcuucuacaacuucagcgaccugcugagacugaccaagauccugcuggccauccuggacugcgugcacgugaccaccaucuuccccaucagcaagauggccaagggcgaggagaacaagggcagcaacgugaugagaagcauccacggcgugggcgagcugaugacccagguggugcugagaggcggcggcuuccugcccaugacccccauggccgccgcccccgagggcaacgugaagcaggccgagcccgagaaggaggacaucauggugauggacaccaagcugaagaucaucgagauccugcaguucauccugaacgugagacuggacuacagaaucagcugccugcugugcaucuucaagagagaguucgacgagagcaacagccagaccagcgagaccagcagcggcaacagcagccaggagggccccagcaacgugcccggcgcccuggacuucgagcacaucgaggagcaggccgagggcaucuucggcggcagcgaggagaacaccccccuggaccuggacgaccacggcggcagaaccuuccugagagugcugcugcaccugaccaugcacgacuaccccccccuggugagcggcgcccugcagcugcuguucagacacuucagccagagacaggaggugcugcaggccuucaagcaggugcagcugcuggugaccagccaggacguggacaacuacaagcagaucaagcaggaccuggaccagcugagaagcaucguggagaagagcgagcuguggguguacaagggccagggccccgacgagaccauggacggcgccagcggcgagaacgagcacaagaagaccgaggagggcaacaacaagccccagaagcacgagagcaccagcagcuacaacuacagaguggugaaggagauccugaucagacugagcaagcugugcgugcaggagagcgccagcgugagaaagagcagaaagcagcagcagagacugcugagaaacaugggcgcccacgccguggugcuggagcugcugcagauccccuacgagaaggccgaggacaccaagaugcaggagaucaugagacuggcccacgaguuccugcagaacuucugcgccggcaaccagcagaaccaggcccugcugcacaagcacaucaaccuguuccugaaccccggcauccuggaggccgugaccaugcagcacaucuucaugaacaacuuccagcugugcagcgagaucaacgagagaguggugcagcacuucgugcacugcaucgagacccacggcagaaacgugcaguacaucaaguuccugcagaccaucgugaaggccgagggcaaguucaucaagaagugccaggacauggugauggccgagcuggugaacagcggcgaggacgugcugguguucuacaacgacagagccagcuuccagacccugauccagaugaugagaagcgagagagacagaauggacgagaacagcccccugauguaccacauccaccugguggagcugcuggccgugugcaccgagggcaagaacguguacaccgagaucaagugcaacagccugcugccccuggacgacaucgugagaguggugacccacgaggacugcauccccgaggugaagaucgccuacaucaacuuccugaaccacugcuacguggacaccgagguggagaugaaggagaucuacaccagcaaccacauguggaagcuguucgagaacuuccugguggacaucugcagagccugcaacaacaccagcgacagaaagcacgccgacagcauccuggagaaguacgugaccgagaucgugaugagcaucgugaccaccuucuucagcagccccuucagcgaccagagcaccacccugcagaccagacagcccguguucgugcagcugcugcagggcguguucagaguguaccacugcaacuggcugaugcccagccagaaggccagcguggagagcugcaucagagugcugagcgacguggccaagagcagagccaucgccauccccguggaccuggacagccaggugaacaaccuguuccugaagagccacagcaucgugcagaagaccgccaugaacuggagacugagcgccagaaacgccgccagaagagacagcgugcuggccgccagcagagacuacagaaacaucaucgagagacugcaggacaucgugagcgcccuggaggacagacugagaccccuggugcaggccgagcugagcgugcugguggacgugcugcacagacccgagcugcuguuccccgagaacaccgacgccagaagaaagugcgagagcggcggcuucaucugcaagcugaucaagcacaccaagcagcugcuggaggagaacgaggagaagcugugcaucaaggugcugcagacccugagagagaugaugaccaaggacagaggcuacggcgagaagggcgaggcccugagacaggugcuggugaacagauacuacggcaacgugagacccagcggcagaagagagagccugaccagcuucggcaacggcccccugagcgccggcggccccggcaagcccggcggcggcggcggcggcagcggcagcagcagcaugagcagaggcgagaugagccuggccgaggugcagugccaccuggacaaggagggcgccagcaaccuggugaucgaccugaucaugaacgccagcagcgacagaguguuccacgagagcauccugcuggccaucgcccugcuggagggcggcaacaccaccauccagcacagcuucuucugcagacugaccgaggacaagaagagcgagaaguucuucaagguguucuacgacagaaugaagguggcccagcaggagaucaaggccaccgugaccgugaacaccagcgaccugggcaacaagaagaaggacgacgagguggacagagacgcccccagcagaaagaaggccaaggagcccaccacccagaucaccgaggaggugagagaccagcugcuggaggccagcgccgccaccagaaaggccuucaccaccuucagaagagaggccgaccccgacgaccacuaccagcccggcgagggcacccaggccaccgccgacaaggccaaggacgaccuggagaugagcgccgugaucaccaucaugcagcccauccugagauuccugcagcugcugugcgagaaccacaacagagaccugcagaacuuccugagaugccagaacaacaagaccaacuacaaccuggugugcgagacccugcaguuccuggacugcaucugcggcagcaccaccggcggccugggccugcugggccuguacaucaacgagaagaacguggcccugaucaaccagacccuggagagccugaccgaguacugccagggccccugccacgagaaccagaacugcaucgccacccacgagagcaacggcaucgacaucaucaccgcccugauccugaacgacaucaacccccugggcaagaagagaauggaccuggugcuggagcugaagaacaacgccagcaagcugcugcuggccaucauggagagcagacacgacagcgagaacgccgagagaauccuguacaacaugagacccaaggagcugguggaggugaucaagaaggccuacaugcagggcgagguggaguucgaggacggcgagaacggcgaggacggcgccgccagccccagaaacgugggccacaacaucuacauccuggcccaccagcuggccagacacaacaaggagcugcagagcaugcugaagcccggcggccagguggacggcgacgaggcccuggaguucuacgccaagcacaccgcccagaucgagaucgugagacuggacagaaccauggagcagaucguguuccccgugcccagcaucugcgaguuccugaccaaggagagcaagcugagaaucuacuacaccaccgagagagacgagcagggcagcaagaucaacgacuucuuccugagaagcgaggaccuguucaacgagaugaacuggcagaagaagcugagagcccagcccgugcuguacuggugcgccagaaacaugagcuucuggagcagcaucagcuucaaccuggccgugcugaugaaccugcugguggccuucuucuaccccuucaagggcgugagaggcggcacccuggagccccacuggagcggccugcuguggaccgccaugcugaucagccuggccaucgugaucgcccugcccaagccccacggcaucagagcccugaucgccagcaccauccugagacugaucuucagcgugggccugcagcccacccuguuccugcugggcgccuucaacgugugcaacaagaucaucuuccugaugagcuucgugggcaacugcggcaccuucaccagaggcuacagagccauggugcuggacguggaguuccuguaccaccugcuguaccuggugaucugcgccaugggccuguucgugcacgaguucuucuacagccugcugcuguucgaccugguguacagagaggagacccugcugaacgugaucaagagcgugaccagaaacggcagaagcaucauccugaccgccgugcuggcccugauccugguguaccuguucagcaucgugggcuaccuguucuucaaggacgacuucauccuggagguggacagacugcccaacgagaccgccgugcccgagaccggcgagagccuggccagcgaguuccuguucagcgacgugugcagaguggagagcggcgagaacugcagcagccccgcccccagagaggagcuggugcccgccgaggagaccgagcaggacaaggagcacaccugcgagacccugcugaugugcaucgugaccgugcugagccacggccugagaagcggcggcggcgugggcgacgugcugagaaagcccagcaaggaggagccccuguucgccgccagagugaucuacgaccugcuguucuucuucauggugaucaucaucgugcugaaccugaucuucggcgugaucaucgacaccuucgccgaccugagaagcgagaagcagaagaaggaggagauccugaagaccaccugcuucaucugcggccuggagagagacaaguucgacaacaagaccgugaccuucgaggagcacaucaaggaggagcacaacauguggcacuaccugugcuucaucgugcuggugaaggugaaggacagcaccgaguacaccggccccgagagcuacguggccgagaugaucaaggagagaaaccuggacugguuccccagaaugagagccaugagccuggugagcagcgacagcgagggcgagcagaacgagcugagaaaccugcaggagaagcuggagagcaccaugaagcuggugaccaaccugagcggccagcugagcgagcugaaggaccagaugaccgagcagagaaagcagaagcagagaaucggccugcugggccaccccccccacaugaacgugaacccccagcagcccgccuaa

SEQ ID NO: 18706 - RNA, 8106 nt, Artificial Sequence
  ITPR2__Homo_sapiens__NP_002214
augaccgagaagaugagcagcuuccuguacaucggcgacaucgugagccuguacgccgagggcagcgugaacggcuucaucagcacccugggccugguggacgacagaugcguggugcaccccgaggccggcgaccuggccaacccccccaagaaguucagagacugccuguucaaggugugccccaugaacagauacagcgcccagaagcaguacuggaaggccaagcaggccaagcagggcaaccacaccgaggccgcccugcugaagaagcugcagcacgccgccgagcuggagcagaagcagaacgagagcgagaacaagaagcugcugggcgagaucgugaaguacagcaacgugauccagcugcugcacaucaagagcaacaaguaccugaccgugaacaagagacugcccgcccugcuggagaagaacgccaugagagugagccuggacgccgccggcaacgagggcagcugguucuacauccaccccuucuggaagcugagaagcgagggcgacaacaucguggugggcgacaagguggugcugaugcccgugaacgccggccagccccugcacgccagcaacaucgagcugcuggacaaccccggcugcaaggaggugaacgccgugaacugcaacaccagcuggaagaucacccuguucaugaaguacagcagcuacagagaggacgugcugaagggcggcgacguggugagacuguuccacgccgagcaggagaaguuccugaccugcgacgaguacgagaagaagcagcacaucuuccugagaaccacccugagacagagcgccaccagcgccaccagcagcaaggcccugugggagaucgagguggugcaccacgaccccugcagaggcggcgccggccaguggaacagccuguucagauucaagcaccuggccaccggcaacuaccuggccgccgagcugaaccccgacuacagagacgcccagaacgagggcaagaacgugagagacggcgugccccccaccagcaagaagaagagacaggccggcgagaagaucauguacacccuggugagcgugccccacggcaacgacaucgccagccuguucgagcuggacgccaccacccugcagagagccgacugccuggugcccagaaacagcuacgugagacugagacaccugugcaccaacaccugggugaccagcaccagcauccccaucgacaccgacgaggagagacccgugaugcugaagaucggcaccugccagaccaaggaggacaaggaggccuucgccaucgugagcgugccccugagcgaggugagagaccuggacuucgccaacgacgccaacaaggugcuggccaccaccgugaagaagcuggagaacggcaccaucacccagaacgagagaagauucgugaccaagcugcuggaggaccugaucuucuucguggccgacgugcccaacaacggccaggaggugcuggacguggugaucaccaagcccaacagagagagacagaagcugaugagagagcagaacauccuggcccagguguucggcauccugaaggcccccuucaaggagaaggccggcgagggcagcaugcugagacuggaggaccugggcgaccagagauacgcccccuacaaguacaugcugagacugugcuacagagugcugagacacagccagcaggacuacagaaagaaccaggaguacaucgccaagaacuucugcgugaugcagagccagaucggcuacgacauccuggccgaggacaccaucaccgcccugcugcacaacaacagaaagcugcuggagaagcacaucaccgccaaggagaucgagaccuucgugagccugcugagaagaaacagagagcccagauuccuggacuaccugagcgaccugugcgugagcaacaccaccgccauccccgugacccaggagcugaucugcaaguucaugcugagccccggcaacgccgacauccugauccagaccaagguggugagcaugcaggccgacaaccccauggagagcagcauccugagcgacgacaucgacgacgaggagguguggcuguacuggaucgacagcaacaaggagccccacggcaaggccaucagacaccuggcccaggaggccaaggagggcaccaaggccgaccuggaggugcugaccuacuacagauaccagcugaaccuguucgccagaaugugccuggacagacaguaccuggccaucaaccagaucagcacccagcugagcguggaccugauccugagaugcgugagcgacgagagccugcccuucgaccugagagccagcuucugcagacugaugcugcacaugcacguggacagagacccccaggagagcguggugcccgugagauacgccagacuguggaccgagauccccaccaagaucaccauccacgaguacgacagcaucaccgacagcagcagaaacgacaugaagagaaaguucgcccugaccauggaguucguggaggaguaccugaaggagguggugaaccagcccuuccccuucggcgacaaggagaagaacaagcugaccuucgagguggugcaccuggccagaaaccugaucuacuucggcuucuacagcuucagcgagcugcugagacugaccagaacccugcuggccauccuggacaucgugcaggcccccaugagcagcuacuucgagagacugagcaaguuccaggacggcggcaacaacgugaugagaaccauccacggcgugggcgagaugaugacccagauggugcugagcagaggcagcaucuuccccaugagcgugcccgacgugccccccagcauccaccccagcaagcagggcagccccaccgagcacgaggacgugaccgugauggacaccaagcugaagaucaucgagauccugcaguucauccugagcgugagacuggacuacagaaucagcuacaugcugagcaucuacaagaaggaguucggcgaggacaacgacaacgccgagaccagcgccagcggcagccccgacacccugcugcccagcgccaucgugcccgacaucgacgagaucgccgcccaggccgagaccauguucgccggcagaaaggagaagaaccccgugcagcuggacgacgagggcggcagaaccuuccugagagugcugauccaccugaucaugcacgacuaccccccccugcugagcggcgcccugcagcugcuguucaagcacuucagccagagagccgaggugcugcaggccuucaagcaggugcagcugcuggugagcaaccaggacguggacaacuacaagcagaucaaggccgaccuggaccagcugagacugaccguggagaagagcgagcuguggguggagaagagcagcaacuacgagaacggcgagaucggcgagagccaggugaagggcggcgaggagcccaucgaggagagcaacauccugagccccgugcaggacggcaccaagaagccccagaucgacagcaacaagagcaacaacuacagaaucgugaaggagauccugaucagacugagcaagcugugcgugcagaacaagaagugcagaaaccagcaccagagacugcugaagaacaugggcgcccacagcguggugcuggaccugcugcagauccccuacgagaagaacgacgagaagaugaacgaggugaugaaccuggcccacaccuuccugcagaacuucugcagaggcaacccccagaaccaggugcugcugcacaagcaccugaaccuguuccugacccccggccugcuggaggccgagaccaugagacacaucuucaugaacaacuaccaccugugcaacgagaucagcgagagaguggugcagcacuucgugcacugcaucgagacccacggcagacacguggaguaccugagauuccugcagaccaucgugaaggccgacggcaaguacgugaagaagugccaggacauggugaugaccgagcugaucaacggcggcgaggacgugcugaucuucuacaacgacagagccagcuuccccauccugcugcacaugaugugcagcgagagagacagaggcgacgagagcggcccccuggccuaccacaucacccugguggagcugcuggccgccugcaccgagggcaagaacguguacaccgagaucaagugcaacagccugcugccccuggacgacaucgugagaguggugacccacgacgacugcauccccgaggugaagaucgccuacgugaacuucgugaaccacugcuacguggacaccgagguggagaugaaggagaucuacaccagcaaccacaucuggaagcuguucgagaacuuccugguggacauggccagagugugcaacaccaccaccgacagaaagcacgccgacaucuuccuggagaagugcgugaccgagagcaucaugaacaucgugagcggcuucuucaacagccccuucagcgacaacagcaccagccugcagacccaccagcccguguucauccagcugcugcagagcgccuucagaaucuacaacugcaccuggcccaaccccgcccagaaggccagcguggagagcugcaucagaacccuggccgagguggccaagaacagaggcaucgccauccccguggaccuggacagccaggugaacacccuguucaugaagagccacagcaacauggugcagagagccgccaugggcuggagacugagcgccagaagcggccccagauucaaggaggcccugggcggccccgccugggacuacagaaacaucaucgagaagcugcaggacgugguggccagccuggagcaccaguucagccccaugaugcaggccgaguucagcgugcugguggacgugcuguacagccccgagcugcuguuccccgagggcagcgacgccagaaucagaugcggcgccuucaugagcaagcugaucaaccacaccaagaagcugauggagaaggaggagaagcugugcaucaagauccugcagacccugagagagaugcuggagaagaaggacagcuucguggaggagggcaacacccugagaaagauccugcugaacagauacuucaagggcgacuacagcaucggcgugaacggccaccugagcggcgccuacagcaagaccgcccaggugggcggcagcuucagcggccaggacagcgacaagaugggcaucagcaugagcgacauccagugccugcuggacaaggagggcgccagcgagcuggugaucgacgugaucgugaacaccaagaacgacagaaucuucagcgagggcaucuuccugggcaucgcccugcuggagggcggcaacacccagacccaguacagcuucuaccagcagcugcacgagcagaagaagagcgagaaguucuucaaggugcuguacgacagaaugaaggccgcccagaaggagaucagaagcaccgugaccgugaacaccaucgaccugggcaacaagaagagagacgacgacaacgagcugaugaccagcggccccagaaugagagugagagacagcacccugcaccugaaggagggcaugaagggccagcugaccgaggccagcagcgccaccagcaaggccuacugcguguacagaagagagauggaccccgagaucgacaucaugugcaccggccccgaggccggcaacaccgaggagaagagcgccgaggaggugaccaugagccccgccaucgccaucaugcagcccauccugagauuccugcagcugcugugcgagaaccacaacagagagcugcagaacuuccugagaaaccagaacaacaagaccaacuacaaccuggugugcgagacccugcaguuccuggacugcaucugcggcagcaccaccggcggccugggccugcugggccuguacaucaacgagaagaacguggcccuggugaaccagaaccuggagagccugaccgaguacugccagggccccugccacgagaaccagaccugcaucgccacccacgagagcaacggcaucgacaucaucaucgcccugauccugaacgacaucaacccccugggcaaguacagaauggaccuggugcugcagcugaagaacaacgccagcaagcugcugcuggccaucauggagagcagacacgacagcgagaacgccgagagaauccuguucaacaugagacccagagagcugguggacgugaugaagaacgccuacaaccagggccuggagugcgaccacggcgacgacgagggcggcgacgacggcgugagccccaaggacgugggccacaacaucuacauccuggcccaccagcuggccagacacaacaagcugcugcagcagaugcugaagcccggcagcgaccccgacgagggcgacgaggcccugaaguacuacgccaaccacaccgcccagaucgagaucgugagacacgacagaaccauggagcagaucguguuccccgugcccaacaucugcgaguaccugaccagagagagcaagugcagaguguucaacaccaccgagagagacgagcagggcagcaaggugaacgacuucuuccagcagaccgaggaccuguacaacgagaugaaguggcagaagaagaucagaaacaaccccgcccuguucugguucagcagacacaucagccuguggggcagcaucagcuucaaccuggccguguucaucaaccuggccguggcccuguucuaccccuucggcgacgacggcgacgagggcacccugagcccccuguucagcgugcugcuguggaucgccguggccaucugcaccagcaugcuguucuucuucagcaagcccgugggcaucagacccuuccuggugagcaucaugcugagaagcaucuacaccaucggccugggccccacccugauccugcugggcgccgccaaccugugcaacaagaucguguuccuggugagcuucgugggcaacagaggcaccuucaccagaggcuacagagccgugauccuggacauggccuuccuguaccacguggccuacgugcuggugugcaugcugggccuguucgugcacgaguucuucuacagcuuccugcuguucgaccugguguacagagaggagacccugcugaacgugaucaagagcgugaccagaaacggcagaagcaucauccugaccgccgugcuggcccugauccugguguaccuguucagcaucaucggcuuccuguuccugaaggacgacuucaccauggagguggacagacugaagaacagaacccccgugaccggcagccaccaggugcccaccaugacccugaccaccaugauggaggccugcgccaaggagaacugcagccccaccauccccgccagcaacaccgccgacgaggaguacgaggacggcaucgagagaaccugcgacacccugcugaugugcaucgugaccgugcugaaccagggccugagaaacggcggcggcgugggcgacgugcugagaagacccagcaaggacgagccccuguucgccgccagagugguguacgaccugcuguucuacuucaucgugaucaucaucgugcugaaccugaucuucggcgugaucaucgacaccuucgccgaccugagaagcgagaagcagaagaaggaggagauccugaagaccaccugcuucaucugcggccuggagagagacaaguucgacaacaagaccgugagcuucgaggagcacaucaagagcgagcacaacauguggcacuaccuguacuucaucgugcuggugaaggugaaggaccccaccgaguacaccggccccgagagcuacguggcccagaugaucguggagaagaaccuggacugguuccccagaaugagagccaugagccuggugagcaacgagggcgacagcgagcagaacgagaucagaagccugcaggagaagcuggagagcaccaugagccuggugaagcagcugagcggccagcuggccgagcugaaggagcagaugaccgagcagagaaagaacaagcagagacugggcuuccugggcagcaacaccccccacgugaaccaccacaugcccccccacuaa

SEQ ID NO: 18707 - RNA, 8016 nt, Artificial Sequence
  ITPR3__Homo_sapiens__NP_002215
augagcgagaugagcagcuuccugcacaucggcgacaucgugagccuguacgccgagggcagcgugaacggcuucaucagcacccugggccugguggacgacagaugcgugguggagcccgccgccggcgaccuggacaacccccccaagaaguucagagacugccuguucaaggugugccccaugaacagauacagcgcccagaagcaguacuggaaggccaagcagaccaagcaggacaaggagaagaucgccgacguggugcugcugcagaagcugcagcacgccgcccagauggagcagaagcagaacgacaccgagaacaagaaggugcacggcgacguggugaaguacggcagcgugauccagcugcugcacaugaagagcaacaaguaccugaccgugaacaagagacugcccgcccugcuggagaagaacgccaugagagugacccuggacgccaccggcaacgagggcagcuggcuguucauccagcccuucuggaagcugagaagcaacggcgacaacgugguggugggcgacaaggugauccugaaccccgugaacgccggccagccccugcacgccagcaacuacgagcugagcgacaacgccggcugcaaggaggugaacagcgugaacugcaacaccagcuggaagaucaaccuguucaugcaguucagagaccaccuggaggaggugcugaagggcggcgacguggugagacuguuccacgccgagcaggagaaguuccugaccugcgacgaguacaagggcaagcugcagguguuccugagaaccacccugagacagagcgccaccagcgccaccagcagcaacgcccugugggagguggagguggugcaccacgaccccugcagaggcggcgccggccacuggaacggccuguacagauucaagcaccuggccaccggcaacuaccuggccgccgaggagaaccccagcuacaagggcgacgccagcgaccccaaggccgccggcaugggcgcccagggcagaaccggcagaagaaacgccggcgagaagaucaaguacugccugguggccgugccccacggcaacgacaucgccagccuguucgagcuggaccccaccacccugcagaagaccgacagcuucgugcccagaaacagcuacgugagacugagacaccugugcaccaacaccuggauccagagcaccaacgugcccaucgacaucgaggaggagagacccaucagacugaugcugggcaccugccccaccaaggaggacaaggaggccuucgccaucgugagcgugcccgugagcgagaucagagaccuggacuucgccaacgacgccagcagcaugcuggccagcgccguggagaagcugaacgagggcuucaucagccagaacgacagaagauucgugauccagcugcuggaggaccugguguucuucgugagcgacgugcccaacaacggccagaacgugcuggacaucauggugaccaagcccaacagagagagacagaagcugaugagagagcagaacauccugaagcagguguucggcauccugaaggcccccuucagagagaagggcggcgagggcccccuggugagacuggaggagcugagcgaccagaagaacgcccccuaccagcacauguucagacugugcuacagagugcugagacacagccaggaggacuacagaaagaaccaggagcacaucgccaagcaguucggcaugaugcagagccagaucggcuacgacauccuggccgaggacaccaucaccgcccugcugcacaacaacagaaagcugcuggagaagcacaucaccaagaccgagguggagaccuucgugagccuggugagaaagaacagagagcccagauuccuggacuaccugagcgaccugugcgugagcaaccacaucgccauccccgugacccaggagcugaucugcaagugcgugcuggaccccaagaacagcgacauccugaucagaaccgagcugagacccgugaaggagauggcccagagccacgaguaccugagcaucgaguacagcgaggaggagguguggcugaccuggaccgacaagaacaacgagcaccacgagaagagcgugagacagcuggcccaggaggccagagccggcaacgcccacgacgagaacgugcugagcuacuacagauaccagcugaagcuguucgccagaaugugccuggacagacaguaccuggccaucgacgagaucagccagcagcugggcguggaccugaucuuccugugcauggccgacgagaugcugcccuucgaccugagagccagcuucugccaccugaugcugcacgugcacguggacagagacccccaggagcuggugacccccgugaaguucgccagacuguggaccgagauccccaccgccaucaccaucaaggacuacgacagcaaccugaacgccagcagagacgacaagaagaacaaguucgccaacaccauggaguucguggaggacuaccugaacaacguggugagcgaggccgugcccuucgccaacgaggagaagaacaagcugaccuucgagguggugagccuggcccacaaccugaucuacuucggcuucuacagcuucagcgagcugcugagacugaccagaacccugcugggcaucaucgacugcgugcagggcccccccgccaugcugcaggccuacgaggaccccggcggcaagaacgugagaagaagcauccagggcgugggccacaugaugagcaccauggugcugagcagaaagcagagcguguucagcgcccccagccugagcgccggcgccagcgccgccgagccccuggacagaagcaaguucgaggagaacgaggacaucguggugauggagaccaagcugaagauccuggagauccugcaguucauccugaacgugagacuggacuacagaaucagcuaccugcugagcguguucaagaaggaguucguggagguguuccccaugcaggacagcggcgccgacggcaccgcccccgccuucgacagcaccaccgccaacaugaaccuggacagaaucggcgagcaggccgaggccauguucggcgugggcaagaccagcagcaugcuggagguggacgacgagggcggcagaauguuccugagagugcugauccaccugaccaugcacgacuacgccccccuggugagcggcgcccugcagcugcuguucaagcacuucagccagagacaggaggccaugcacaccuucaagcaggugcagcugcugaucagcgcccaggacguggagaacuacaaggugaucaagagcgagcuggacagacugagaaccaugguggagaagagcgagcuguggguggacaagaagggcagcggcaagggcgaggagguggaggccggcgccgccaaggacaagaaggagagacccaccgacgaggagggcuuccugcacccccccggcgagaagagcagcgagaacuaccagaucgugaagggcauccuggagagacugaacaagaugugcggcgugggcgagcagaugagaaagaagcagcagagacugcugaagaacauggacgcccacaaggugaugcuggaccugcugcagauccccuacgacaagggcgacgccaagaugauggagauccugagauacacccaccaguuccugcagaaguucugcgccggcaaccccggcaaccaggcccugcugcacaagcaccugcaccuguuccugacccccggccugcuggaggccgagaccaugcagcacaucuuccugaacaacuaccagcugugcagcgagaucagcgagcccgugcugcagcacuucgugcaccugcuggccacccacggcagacacgugcaguaccuggacuuccugcacaccgugaucaaggccgagggcaaguacgugaagaagugccaggacaugaucaugaccgagcugaccaacgccggcgacgacguggugguguucuacaacgacaaggccagccuggcccaccugcuggacaugaugaaggccgccagagacggcguggaggaccacagcccccugauguaccacaucagccugguggaccugcuggccgccugcgccgagggcaagaacguguacaccgagaucaagugcaccagccugcugccccuggaggacguggugagcguggugacccacgaggacugcaucaccgaggugaagauggccuacgugaacuucgugaaccacugcuacguggacaccgagguggagaugaaggagaucuacaccagcaaccacaucuggacccuguucgagaacuucacccuggacauggccagagugugcagcaagagagagaagagaguggccgaccccacccuggagaaguacgugcugagcguggugcuggacaccaucaacgccuucuucagcagccccuucagcgagaacagcaccagccugcagacccaccagaccaucguggugcagcugcugcagagcaccaccagacugcuggagugccccuggcugcagcagcagcacaagggcagcguggaggccugcaucagaacccuggccaugguggccaagggcagagccauccugcugcccauggaccuggacgcccacaucagcagcaugcugagcagcggcgccagcugcgccgccgccgcccagagaaacgccagcagcuacaaggccaccaccagagccuuccccagagugacccccaccgccaaccagugggacuacaagaacaucaucgagaagcugcaggacaucaucaccgcccuggaggagagacugaagccccuggugcaggccgagcugagcgugcugguggacgugcugcacuggcccgagcugcuguuccuggagggcagcgaggccuaccagagaugcgagagcggcggcuuccugagcaagcugauccagcacaccaaggaccugauggagagcgaggagaagcugugcaucaaggugcugagaacccugcagcagaugcugcugaagaagaccaaguacggcgacagaggcaaccagcugagaaagaugcugcugcagaacuaccugcagaacagaaagagcaccagcagaggcgaccugcccgaccccaucggcaccggccuggaccccgacuggagcgccaucgccgccacccagugcagacuggacaaggagggcgccaccaagcuggugugcgaccugaucaccagcaccaagaacgagaagaucuuccaggagagcaucggccuggccauccaccugcuggacggcggcaacaccgagauccagaagagcuuccacaaccugaugaugagcgacaagaagagcgagagauucuucaaggugcugcacgacagaaugaagagagcccagcaggagaccaagagcaccguggccgugaacaugaacgaccugggcagccagccccacgaggacagagagcccguggaccccaccaccaagggcagaguggccagcuucagcauccccggcagcagcagcagauacagccugggccccagccugagaagaggccacgaggugagcgagagagugcagagcagcgagaugggcaccagcgugcugaucaugcagcccauccugagauuccugcagcugcugugcgagaaccacaacagagaccugcagaacuuccugagaugccagaacaacaagaccaacuacaaccuggugugcgagacccugcaguuccuggacaucaugugcggcagcaccaccggcggccugggccugcugggccuguacaucaacgaggacaacgugggccuggugauccagacccuggagacccugaccgaguacugccagggccccugccacgagaaccagaccugcaucgugacccacgagagcaacggcaucgacaucaucaccgcccugauccugaacgacaucagcccccugugcaaguacagaauggaccuggugcugcagcugaaggacaacgccagcaagcugcugcuggcccugauggagagcagacacgacagcgagaacgccgagagaauccugaucagccugagaccccaggagcugguggacgugaucaagaaggccuaccugcaggaggaggagagagagaacagcgaggugagccccagagaggugggccacaacaucuacauccuggcccugcagcugagcagacacaacaagcagcugcagcaccugcugaagcccgugaagagaauccaggaggaggaggccgagggcaucagcagcaugcugagccugaacaacaagcagcugagccagaugcugaagagcagcgcccccgcccaggaggaggaggaggacccccuggccuacuacgagaaccacaccagccagaucgagaucgugagacaggacagaagcauggagcagaucguguuccccgugcccggcaucugccaguuccugaccgaggagaccaagcacagacuguucaccaccaccgagcaggacgagcagggcagcaaggugagcgacuucuucgaccagagcagcuuccugcacaacgagauggaguggcagagaaagcugagaagcaugccccugaucuacugguucagcagaagaaugacccuguggggcagcaucagcuucaaccuggccguguucaucaacaucaucaucgccuucuucuaccccuacauggagggcgccagcaccggcgugcuggacagcccccugaucagccugcuguucuggauccugaucugcuucagcaucgccgcccuguucaccaagagauacagcaucagaccccugaucguggcccugauccugagaagcaucuacuaccugggcaucggccccacccugaacauccugggcgcccugaaccugaccaacaagaucguguucguggugagcuucgugggcaacagaggcaccuucaucagaggcuacaaggccauggugauggacauggaguuccuguaccacgugggcuacauccugaccagcgugcugggccuguucgcccacgagcuguucuacagcauccugcuguucgaccugaucuacagagaggagacccuguucaacgugaucaagagcgugaccagaaacggcagaagcauccugcugaccgcccugcuggcccugauccugguguaccuguucagcaucgugggcuuccuguuccugaaggacgacuucauccuggagguggacagacugcccaacaaccacagcaccgccagcccccugggcaugccccacggcgccgccgccuucguggacaccugcagcggcgacaagauggacugcgugagcggccugagcgugcccgaggugcuggaggaggacagagagcuggacagcaccgagagagccugcgacacccugcugaugugcaucgugaccgugaugaaccacggccugagaaacggcggcggcgugggcgacauccugagaaagcccagcaaggacgagagccuguuccccgccagagugguguacgaccugcuguucuucuucaucgugaucaucaucgugcugaaccugaucuucggcgugaucaucgacaccuucgccgaccugagaagcgagaagcagaagaaggaggagauccugaagaccaccugcuucaucugcggccuggagagagacaaguucgacaacaagaccgugagcuucgaggagcacaucaagcuggagcacaacauguggaacuaccuguacuucaucgugcuggugagagugaagaacaagaccgacuacaccggccccgagagcuacguggcccagaugaucaagaacaagaaccuggacugguuccccagaaugagagccaugagccuggugagcaacgagggcgagggcgagcagaacgagaucagaauccugcaggacaagcugaacagcaccaugaagcuggugagccaccugaccgcccagcugaacgagcugaaggagcagaugaccgagcagagaaagagaagacagagacugggcuucguggacgugcagaacugcaucagcagauaa

SEQ ID NO: 18708 - RNA, 3663 nt, Artificial Sequence
  ITSN1__Homo_sapiens__NP_001001132
auggcccaguuccccacccccuucggcggcagccuggacaucugggccaucaccguggaggagagagccaagcacgaccagcaguuccacagccugaagcccaucagcggcuucaucaccggcgaccaggccagaaacuucuucuuccagagcggccugccccagcccgugcuggcccagaucugggcccuggccgacaugaacaacgacggcagaauggaccagguggaguucagcaucgccaugaagcugaucaagcugaagcugcagggcuaccagcugcccagcgcccugccccccgugaugaagcagcagcccguggccaucagcagcgcccccgccuucggcaugggcggcaucgccagcaugcccccccugaccgccguggcccccgugcccaugggcagcauccccguggugggcaugagccccacccuggugagcagcgugcccaccgccgccgugcccccccuggccaacggcgccccccccgugauccagccccugcccgccuucgcccaccccgccgccacccugcccaagagcagcagcuucagcagaagcggccccggcagccagcugaacaccaagcugcagaaggcccagagcuucgacguggccagcgugccccccguggccgagugggccgugccccagagcagcagacugaaguacagacagcuguucaacagccacgacaagaccaugagcggccaccugaccggcccccaggccagaaccauccugaugcagagcagccugccccaggcccagcuggccagcaucuggaaccugagcgacaucgaccaggacggcaagcugaccgccgaggaguucauccuggccaugcaccugaucgacguggccaugagcggccagccccugccccccgugcugccccccgaguacaucccccccagcuucagaagagugagaagcggcagcggcaucagcgugaucagcagcaccagcguggaccagagacugcccgaggagcccgugcuggaggacgagcagcagcagcuggagaagaagcugcccgugaccuucgaggacaagaagagagagaacuucgagagaggcaaccuggagcuggagaagagaagacaggcccugcuggagcagcagagaaaggagcaggagagacuggcccagcuggagagagccgagcaggagagaaaggagagagagagacaggagcaggagagaaagagacagcuggagcuggagaagcagcuggagaagcagagagagcuggagagacagagagaggaggagagaagaaaggagaucgagagaagagaggccgccaagagagagcuggagagacagagacagcuggagugggagagaaacagaagacaggagcugcugaaccagagaaacaaggagcaggaggacaucguggugcugaaggccaagaagaagacccuggaguucgagcuggaggcccugaacgacaagaagcaccagcuggagggcaagcugcaggacaucagaugcagacugaccacccagagacaggagaucgagagcaccaacaagagcagagagcugagaaucgccgagaucacccaccugcagcagcagcugcaggagagccagcagaugcugggcagacugauccccgagaagcagauccugaacgaccagcugaagcaggugcagcagaacagccugcacagagacagccuggugacccugaagagagcccuggaggccaaggagcuggccagacagcaccugagagaccagcuggacgagguggagaaggagaccagaagcaagcugcaggagaucgacaucuucaacaaccagcugaaggagcugagagagauccacaacaagcagcagcugcagaagcagaagagcauggaggccgagagacugaagcagaaggagcaggagagaaagaucaucgagcuggagaagcagaaggaggaggcccagagaagagcccaggagagagacaagcaguggcuggagcacgugcagcaggaggacgagcaccagagacccagaaagcugcacgaggaggagaagcugaagagagaggagagcgugaagaagaaggacggcgaggagaagggcaagcaggaggcccaggacaagcugggcagacuguuccaccagcaccaggagcccgccaagcccgccgugcaggcccccuggagcaccgccgagaagggcccccugaccaucagcgcccaggagaacgugaaggugguguacuacagagcccuguaccccuucgagagcagaagccacgacgagaucaccauccagcccggcgacaucgugauggugaagggcgaguggguggacgagagccagaccggcgagcccggcuggcugggcggcgagcugaagggcaagaccggcugguuccccgccaacuacgccgagaagauccccgagaacgaggugcccgcccccgugaagcccgugaccgacagcaccagcgcccccgcccccaagcuggcccugagagagacccccgccccccuggccgugaccagcagcgagcccagcaccacccccaacaacugggccgacuucagcagcaccuggcccaccagcaccaacgagaagcccgagaccgacaacugggacgccugggccgcccagcccagccugaccgugcccagcgccggccagcugagacagagaagcgccuucacccccgccaccgccaccggcagcagccccagccccgugcugggccagggcgagaagguggagggccugcaggcccaggcccuguaccccuggagagccaagaaggacaaccaccugaacuucaacaagaacgacgugaucaccgugcuggagcagcaggacauguggugguucggcgaggugcagggccagaagggcugguuccccaagagcuacgugaagcugaucagcggccccaucagaaagagcaccagcauggacagcggcagcagcgagagccccgccagccugaagagaguggccagccccgccgccaagcccguggugagcggcgaggaguucaucgccauguacaccuacgagagcagcgagcagggcgaccugaccuuccagcagggcgacgugauccuggugaccaagaaggacggcgacugguggaccggcaccgugggcgacaaggccggcguguuccccagcaacuacgugagacugaaggacagcgagggcagcggcaccgccggcaagaccggcagccugggcaagaagcccgagaucgcccaggugaucgccagcuacaccgccaccggccccgagcagcugacccuggcccccggccagcugauccugaucagaaagaagaaccccggcggcuggugggagggcgagcugcaggccagaggcaagaagagacagaucggcugguuccccgccaacuacgugaagcugcugagccccggcaccagcaagaucacccccaccgagccccccaagagcaccgcccuggccgccgugugccaggugaucggcauguacgacuacaccgcccagaacgacgacgagcuggccuucaacaagggccagaucaucaacgugcugaacaaggaggaccccgacugguggaagggcgaggugaacggccaggugggccuguuccccagcaacuacgugaagcugaccaccgacauggaccccagccagcaguaa

SEQ ID NO: 18709 - RNA, 5094 nt, Artificial Sequence
  ITSN2__Homo_sapiens__NP_006268
augauggcccaguuccccaccgccaugaacggcggccccaacaugugggccaucaccagcgaggagagaaccaagcacgacagacaguucgacaaccugaagcccagcggcggcuacaucaccggcgaccaggccagaaacuucuuccugcagagcggccugcccgcccccgugcuggccgagaucugggcccugagcgaccugaacaaggacggcaagauggaccagcaggaguucagcaucgccaugaagcugaucaagcugaagcugcagggccagcagcugcccguggugcugccccccaucaugaagcagccccccauguucagcccccugaucagcgccagauucggcaugggcagcaugcccaaccugagcaucccccagccccugccccccgccgcccccaucaccagccugagcagcgccaccagcggcaccaaccugcccccccugaugaugcccaccccccuggugcccagcgugagcaccagcagccugcccaacggcaccgccagccugauccagccccugcccauccccuacagcagcagcacccugccccacggcagcagcuacagccugaugaugggcggcuucggcggcgccagcauccagaaggcccagagccugaucgaccugggcagcagcagcagcaccagcagcaccgccagccugagcggcaacagccccaagaccggcaccagcgagugggccgugccccagcccaccagacugaaguacagacagaaguucaacacccuggacaagagcaugagcggcuaccugagcggcuuccaggccagaaacgcccugcugcagagcaaccugagccagacccagcuggccaccaucuggacccuggccgacguggacggcgacggccagcugaaggccgaggaguucauccuggccaugcaccugaccgacauggccaaggccggccagccccugccccugacccugccccccgagcuggugccccccagcuucagaggcggcaagcagaucgacagcaucaacggcacccugcccagcuaccagaagaugcaggaggaggagccccagaagaagcugcccgugaccuucgaggacaagagaaaggccaacuacgagagaggcaacauggagcuggagaagagaagacaggcccugauggagcagcagcagagagaggccgagagaaaggcccagaaggagaaggaggagugggagagaaagcagagagagcugcaggagcaggaguggaagaagcagcuggagcuggagaagagacuggagaagcagagagagcuggagagacagagagaggaggagagaagaaaggacaucgagagaagagaggccgccaagcaggagcuggagagacagagaagacuggagugggagagaaucagaagacaggagcugcugaaccagaagaacagagagcaggaggagaucgugagacugaacagcaagaagaagaaccugcaccuggagcuggaggcccugaacggcaagcaccagcagaucagcggcagacugcaggacgugagacugaagaagcagacccagaagaccgagcuggaggugcuggacaagcagugcgaccuggagaucauggagaucaagcagcugcagcaggagcugcaggaguaccagaacaagcugaucuaccuggugcccgagaagcagcugcugaacgagagaaucaagaacaugcaguucagcaacacccccgacagcggcgugagccugcugcacaagaagagccuggagaaggaggagcugugccagagacugaaggagcagcuggacgcccuggagaaggagaccgccagcaagcugagcgagauggacagcuucaacaaccagcugaagugcggcaacauggacgacagcgugcugcagugccugcugagccugcugagcugccugaacaaccuguuccugcugcugaaggagcugagagagaccuacaacacccagcagcuggcccuggagcagcuguacaagaucaagagagacaagcugaaggagaucgagagaaagagacuggagcugaugcagaagaagaagcuggaggacgaggccgccagaaaggccaagcagggcaaggagaaccuguggaaggagaaccugagaaaggaggaggaggagaagcagaagagacugcaggaggagaagacccaggagaagauccaggaggaggagagaaaggccgaggagaagcagagaaaggacaaggacacccugaaggccgaggagaagaagagagagaccgccagcgugcuggugaacuacagagcccuguaccccuucgaggccagaaaccacgacgagaugagcuucaacagcggcgacaucauccagguggacgagaagaccgugggcgagcccggcuggcuguacggcagcuuccagggcaacuucggcugguuccccugcaacuacguggagaagaugcccagcagcgagaacgagaaggccgugagccccaagaaggcccugcugccccccaccgugagccugagcgccaccagcaccagcagcgagccccugagcagcaaccagcccgccagcgugaccgacuaccagaacgugagcuucagcaaccugaccgugaacaccagcuggcagaagaagagcgccuucaccagaaccgugagccccggcagcgugagccccauccacggccagggccaggugguggagaaccugaaggcccaggcccugugcagcuggaccgccaagaaggacaaccaccugaacuucagcaagcacgacaucaucaccgugcuggagcagcaggagaacuggugguucggcgaggugcacggcggcagaggcugguuccccaagagcuacgugaagaucauccccggcagcgaggugaagagagaggagcccgaggcccuguacgccgccgugaacaagaagcccaccagcgccgccuacagcgugggcgaggaguacaucgcccuguaccccuacagcagcguggagcccggcgaccugaccuucaccgagggcgaggagauccuggugacccagaaggacggcgagugguggaccggcagcaucggcgacagaagcggcaucuuccccagcaacuacgugaagcccaaggaccaggagagcuucggcagcgccagcaagagcggcgccagcaacaagaagcccgagaucgcccaggugaccagcgccuacguggccagcggcagcgagcagcugagccuggcccccggccagcugauccugauccugaagaagaacaccagcggcugguggcagggcgagcugcaggccagaggcaagaagagacagaagggcugguuccccgccagccacgugaagcugcugggccccagcagcgagagagccacccccgccuuccaccccgugugccaggugaucgccauguacgacuacgccgccaacaacgaggacgagcugagcuucagcaagggccagcugaucaacgugaugaacaaggacgaccccgacugguggcagggcgagaucaacggcgugaccggccuguuccccagcaacuacgugaagaugaccaccgacagcgaccccagccagcaguggugcgccgaccugcagacccuggacaccaugcagcccaucgagagaaagagacagggcuacauccacgagcugauccagaccgaggagagauacauggccgaccugcagcuggugguggagguguuccagaagagaauggccgagagcggcuuccugaccgagggcgagauggcccugaucuucgugaacuggaaggagcugaucaugagcaacaccaagcugcugaaggcccugagagugagaaagaagaccggcggcgagaagaugcccgugcagaugaucggcgacauccuggccgccgagcugagccacaugcaggccuacaucagauucugcagcugccagcugaacggcgccgcccugcugcagcagaagaccgacgaggacaccgacuucaaggaguuccugaagaagcuggccagcgaccccagaugcaagggcaugccccugagcagcuuccugcugaagcccaugcagagaaucaccagauacccccugcugaucagaagcauccuggagaacacccccgagagccacgccgaccacagcagccugaagcuggcccuggagagagccgaggagcugugcagccaggugaacgagggcgugagagagaaggagaacagcgacagacuggaguggauccaggcccacgugcagugcgagggccuggccgagcagcugaucuucaacagccugaccaacugccugggccccagaaagcugcugcacagcggcaagcuguacaagaccaagagcaacaaggagcugcacggcuuccuguucaacgacuuccugcugcugaccuacauggugaagcaguucgccgugagcagcggcagcgagaagcuguucagcagcaagagcaacgcccaguucaagauguacaagacccccaucuuccugaacgaggugcuggugaagcugcccaccgaccccagcagcgacgagcccguguuccacaucagccacaucgacagaguguacacccugagaaccgacaacaucaacgagagaaccgccugggugcagaagaucaaggccgccagcgagcaguacaucgacaccgagaagaagaagagagagaaggccuaccaggccagaagccagaagaccagcggcaucggcagacugauggugcacgugaucgaggccaccgagcugaaggccugcaagcccaacggcaagagcaaccccuacugcgagaucagcaugggcagccagagcuacaccaccagaaccauccaggacacccugaaccccaaguggaacuucaacugccaguucuucaucaaggaccuguaccaggacgugcugugccugacccuguucgacagagaccaguucagccccgacgacuuccugggcagaaccgagauccccguggccaagaucagaaccgagcaggagagcaagggccccaugaccagaagacugcugcugcacgaggugcccaccggcgaggugugggugagauucgaccugcagcuguucgagcagaagacccugcuguaa

SEQ ID NO: 18710 - RNA, 1191 nt, Artificial Sequence
  IVD__Homo_sapiens__NP_001152980
auggccgagauggccaccgccaccagacugcugggcuggagaguggccagcuggagacugagacccccccuggccggcuucgugagccagagagcccacagccugcugcccguggacgacgccaucaacggccugagcgaggagcagagacaggaguucuggaagcagcugggcaaccugggcgugcugggcaucaccgcccccgugcaguacggcggcagcggccugggcuaccuggagcacgugcuggugauggaggagaucagcagagccagcggcgccgugggccugagcuacggcgcccacagcaaccugugcaucaaccagcuggugagaaacggcaacgaggcccagaaggagaaguaccugcccaagcugaucagcggcgaguacaucggcgcccuggccaugagcgagcccaacgccggcagcgacguggugagcaugaagcugaaggccgagaagaagggcaaccacuacauccugaacggcaacaaguucuggaucaccaacggccccgacgccgacgugcugaucguguacgccaagaccgaccuggccgccgugcccgccagcagaggcaucaccgccuucaucguggagaagggcaugcccggcuucagcaccagcaagaagcuggacaagcugggcaugagaggcagcaacaccugcgagcugaucuucgaggacugcaagauccccgccgccaacauccugggccacgagaacaagggcguguacgugcugaugagcggccuggaccuggagagacuggugcuggccggcggcccccugggccugaugcaggccgugcuggaccacaccauccccuaccugcacgugagagaggccuucggccagaagaucggccacuuccagcugaugcagggcaagauggccgacauguacaccagacugauggccugcagacaguacguguacaacguggccaaggccugcgacgagggccacugcaccgccaaggacugcgccggcgugauccuguacagcgccgagugcgccacccagguggcccuggacggcauccagugcuucggcggcaacggcuacaucaacgacuuccccaugggcagauuccugagagacgccaagcuguacgagaucggcgccggcaccagcgaggugagaagacuggugaucggcagagccuucaacgccgacuuccacuaa

SEQ ID NO: 18711 - RNA, 1758 nt, Artificial Sequence
  IVL__Homo_sapiens__XP_006711363
augagccagcagcacacccugcccgugacccugagccccgcccugagccaggagcugcugaagaccgugcccccccccgugaacacccaccaggagcagaugaagcagcccaccccccugcccccccccugccagaaggugcccguggagcugcccguggaggugcccagcaagcaggaggagaagcacaugaccgccgugaagggccugcccgagcaggagugcgagcagcagcagaaggagccccaggagcaggagcugcagcagcagcacugggagcagcacgaggaguaccagaaggccgagaaccccgagcagcagcugaagcaggagaagacccagagagaccagcagcugaacaagcagcuggaggaggagaagaagcugcuggaccagcagcuggaccaggagcuggugaagagagacgagcagcugggcaugaagaaggagcagcugcuggagcugcccgagcagcaggagggccaccugaagcaccuggagcagcaggagggccagcugaagcaccccgagcagcaggagggccagcuggagcugcccgagcagcaggagggccagcuggagcugcccgagcagcaggagggccagcuggagcugcccgagcagcaggagggccagcuggagcugcccgagcagcaggagggccagcuggagcugcccgagcagcaggagggccagcuggagcugccccagcagcaggagggccagcuggagcugagcgagcagcaggagggccagcuggagcugagcgagcagcaggagggccagcugaagcaccuggagcaccaggagggccagcuggaggugcccgaggagcagaugggccagcugaaguaccuggagcagcaggagggccagcugaagcaccuggaccagcaggagaagcagcccgagcugcccgagcagcagaugggccagcugaagcaccuggagcagcaggagggccagcccaagcaccuggagcagcaggagggccagcuggagcagcuggaggagcaggagggccagcugaagcaccuggagcagcaggagggccagcuggagcaccuggagcaccaggagggccagcugggccugcccgagcagcaggugcugcagcugaagcagcuggagaagcagcagggccagcccaagcaccuggaggaggaggagggccagcugaagcaccuggugcagcaggagggccagcugaagcaccuggugcagcaggagggccagcuggagcagcaggagagacagguggagcaccuggagcagcaggugggccagcugaagcaccuggaggagcaggagggccagcugaagcaccuggagcagcagcagggccagcuggaggugcccgagcagcaggugggccagcccaagaaccuggagcaggaggagaagcagcuggagcugcccgagcagcaggagggccaggugaagcaccuggagaagcaggaggcccagcuggagcugcccgagcagcaggugggccagcccaagcaccuggagcagcaggagaagcaccuggagcaccccgagcagcaggacggccagcugaagcaccuggagcagcaggagggccagcugaaggaccuggagcagcagaagggccagcuggagcagcccguguucgcccccgcccccggccaggugcaggacauccagcccgcccugcccaccaagggcgaggugcugcugcccguggagcaccagcagcagaagcaggaggugcaguggccccccaagcacaaguaa

SEQ ID NO: 18712 - RNA, 1929 nt, Artificial Sequence
  IVNS1ABP__Homo_sapiens__NP_006460
augauccccaacggcuaccugauguucgaggacgagaacuucaucgagagcagcguggccaagcugaacgcccugagaaagagcggccaguucugcgacgugagacugcaggugugcggccacgagaugcuggcccacagagccgugcuggccugcugcagccccuaccuguucgagaucuucaacagcgacagcgacccccacggcaucagccacgugaaguucgacgaccugaaccccgaggccguggaggugcugcugaacuacgccuacaccgcccagcugaaggccgacaaggagcuggugaaggacguguacagcgccgccaagaagcugaagauggacagagugaagcaggugugcggcgacuaccugcugagcagaauggacgugaccagcugcaucagcuacagaaacuucgccagcugcaugggcgacagcagacugcugaacaagguggacgccuacauccaggagcaccugcugcagaucagcgaggaggaggaguuccugaagcugcccagacugaagcuggaggugaugcuggaggacaacgugugccugcccagcaacggcaagcuguacaccaaggugaucaacugggugcagagaagcaucugggagaacggcgacagccuggaggagcugauggaggaggugcagacccuguacuacagcgccgaccacaagcugcuggacggcaaccugcuggacggccaggccgagguguucggcagcgacgacgaccacauccaguucgugcagaagaagccccccagagagaacggccacaagcagaucagcagcagcagcaccggcugccugagcagccccaacgccaccgugcagagccccaagcacgaguggaagaucguggccagcgagaagaccagcaacaacaccuaccugugccuggccgugcuggacggcaucuucugcgugaucuuccugcacggcagaaacagcccccagagcagccccaccagcacccccaagcugagcaagagccugagcuucgagaugcagcaggacgagcugaucgagaagcccaugagccccaugcaguacgccagaagcggccugggcaccgccgagaugaacggcaagcugaucgccgccggcggcuacaacagagaggagugccugagaaccguggagugcuacaacccccacaccgaccacuggagcuuccuggcccccaugagaacccccagagccagauuccagauggccgugcugaugggccagcuguacguggugggcggcagcaacggccacagcgacgaccugagcugcggcgagauguacgacagcaacaucgacgacuggauccccgugcccgagcugagaaccaacagaugcaacgccggcgugugcgcccugaacggcaagcuguacaucgugggcggcagcgaccccuacggccagaagggccugaagaacugcgacguguucgaccccgugaccaagcuguggaccagcugcgccccccugaacaucagaagacaccagagcgccgugugcgagcugggcggcuaccuguacaucaucggcggcgccgagagcuggaacugccugaacaccguggagagauacaaccccgagaacaacaccuggacccugaucgcccccaugaacguggccagaagaggcgccggcguggccgugcugaacggcaagcuguucgugugcggcggcuucgacggcagccacgccaucagcugcguggagauguacgaccccaccagaaacgaguggaagaugaugggcaacaugaccagccccagaagcaacgccggcaucgccaccgugggcaacaccaucuacgccgugggcggcuucgacggcaacgaguuccugaacaccguggagguguacaaccuggagagcaacgaguggagccccuacaccaagaucuuccaguucuaa

SEQ ID NO: 18713 - RNA, 882 nt, Artificial Sequence
  IYD__Homo_sapiens__NP_001158166
auguacuuccugacccccauccugguggccauccugugcauccuggugguguggaucuucaagaacgccgacagaagcauggagaagaagaagggcgagcccagaaccagagccgaggccagacccuggguggacgaggaccugaaggacagcagcgaccugcaccaggccgaggaggacgccgacgaguggcaggagagcgaggagaacguggagcacauccccuucagccacaaccacuaccccgagaaggagauggugaagagaagccaggaguucuacgagcugcugaacaagagaagaagcgugagauucaucagcaacgagcaggugcccauggaggugaucgacaacgugaucagaaccgccggcaccgcccccagcggcgcccacaccgagcccuggaccuucgugguggugaaggaccccgacgugaagcacaagaucagaaagaucaucgaggaggaggaggagaucaacuacaugaagagaaugggccacagaugggugaccgaccugaagaagcugagaaccaacuggaucaaggaguaccuggacaccgcccccauccugauccugaucuucaagcaggugcacggcuucgccgccaacggcaagaagaaggugcacuacuacaacgagaucagcgugagcaucgccugcggcauccugcuggccgcccugcaggugaacaacggcaucaccaugagacaccagaccgccagacacagacaccugaucgagggccccggcagaagcagcgaggccugcagcaagcugagcagccagggcugccccgagugcagaagcggcgacugccacuaccacagcagccagcuguggcccagcaccgagggcgcccccggcccccccagaaccuaa

SEQ ID NO: 18714 - RNA, 1131 nt, Artificial Sequence
  IZUMO1__Homo_sapiens__XP_005258850
augagcgugcugcugcugagcguguggggcgagagcacccugcccaacggccugagagagcugugcgcccccgccgccaugggcccccacuucacccugcugugcgccgcccuggccggcugccugcugcccgccgagggcugcgugaucugcgaccccagcguggugcuggcccugaagagccuggagaaggacuaccugcccggccaccuggacgccaagcaccacaaggccaugauggagagaguggagaacgccgugaaggacuuccaggagcugagccugaacgaggacgccuacaugggcgugguggacgaggccacccugcagaagggcagcuggagccugcugaaggaccugaagagaaucaccgacagcgacgugaagggcgaccuguucgugaaggagcuguucuggaugcugcaccugcagaaggagaccuucgccaccuacguggccagauuccagaaggaggccuacugccccaacaagugcggcgugaugcugcagacccugaucuggugcaagaacugcaagaaggaggugcacgccugcagaaagagcuacgacugcggcgagagaaacguggaggugccccagauggaggacaugauccuggacugcgagcugaacuggcaccaggccagcgagggccugaccgacuacagcuucuacagaguguggggcaacaacaccgagacccuggugagcaagggcaaggaggccacccugaccaagcccauggugggccccgaggacgccggcagcuacagaugcgagcugggcagcgugaacagcagccccgccaccaucaucaacuuccacgugaccgugcugcccaagaugaucaaggaggagaagcccagccccaacaucgugacccccggcgaggccaccaccgagagcagcaucagccugcagccccugcagcccgagaagaugcuggccagcagacugcugggccugcugaucugcggcagccuggcccugaucaccggccugaccuucgccaucuucagaagaagaaaggugaucgacuucaucaagagcagccuguucggccugggcagcggcgccgccgagcagacccaggugcccaaggagaaggccaccgacagcagacagcaguaa

SEQ ID NO: 18715 - RNA, 2493 nt, Artificial Sequence
  JADE1__Homo_sapiens__NP_001274366
augaagagaggcagacugcccagcagcagcgaggacagcgacgacaacggcagccugagcaccaccuggagccagaacagcagaagccagcacagaagaagcagcugcagcagacacgaggacagaaagcccagcgagguguucagaaccgaccugaucaccgccaugaagcugcacgacagcuaccagcugaaccccgacgaguacuacgugcuggccgaccccuggagacaggagugggagaagggcgugcaggugcccgugagccccggcaccaucccccagcccguggccagacccaagaaguacaucgugagcagcggcagcgagccccccgagcugggcuacguggacaucagaacccuggccgacagcgugugcagauacgaccugaacgacauggacgccgccuggcuggagcugaccaacgaggaguucaaggagaugggcaugcccgagcuggacgaguacaccauggagagagugcuggaggaguucgagcagagaugcuacgacaacaugaaccacgccaucgagaccgaggagggccugggcaucgaguacgacgaggacguggugugcgacgugugccagagccccgacggcgaggacggcaacgagaugguguucugcgacaagugcaacaucugcgugcaccaggccugcuacggcauccugaaggugcccgagggcagcuggcugugcagaaccugcgcccugggcgugcagcccaagugccugcugugccccaagaagggcggcgccaugaagcccaccagaagcggcaccaagugggugcacgugagcugcgcccuguggauccccgaggugagcaucggcagccccgagaagauggagcccaucaccaaggugagccacauccccagcagcagaugggcccuggugugcagccugugcaacgagaaguucggcgccagcauccagugcagcgugaagaacugcagaaccgccuuccacgugaccugcgccuucgacagaggccuggagaugaagaccauccuggccgagaacgacgaggugaaguucaagagcuacugccccaagcacagcagccacagaaagcccgaggagagccugggcaagggcgccgcccaggagaacggcgcccccgagugcagccccagaaacccccuggagcccuucgccagccuggagcagaacagagaggaggcccacagagugagcgugagaaagcagaagcugcagcagcuggaggacgaguucuacaccuucgugaaccugcuggacguggccagagcccugagacugcccgaggaggugguggacuuccuguaccaguacuggaagcugaagagaaaggugaacuucaacaagccccugaucacccccaagaaggacgaggaggacaaccuggccaagagagagcaggacgugcuguucagaagacugcagcuguucacccaccugagacaggaccuggagagagugagaaaccugaccuacauggugaccagaagagagaagaucaagagaagcgugugcaaggugcaggagcagaucuucaaccuguacaccaagcugcuggagcaggagagagugagcggcgugcccagcagcugcagcagcagcagccuggagaacaugcugcuguucaacagccccagcgugggccccgacgcccccaagaucgaggaccugaaguggcacagcgccuucuucagaaagcagaugggcaccagccuggugcacagccugaagaagccccacaagagagacccccugcagaacagccccggcagcgagggcaagacccugcugaagcagcccgaccugugcggcagaagagagggcaugguggugcccgagagcuuccugggccuggagaagaccuucgccgaggccagacugaucagcgcccagcagaagaacggcguggugaugcccgaccacggcaagagaagagacaacagauuccacugcgaccugaucaagggcgaccugaaggacaagagcuucaagcagagccacaagccccugagaagcaccgacgugagccagagacaccuggacaacaccagagccgccaccagccccggcgugggccagagcgcccccggcaccagaaaggagaucgugcccaagugcaacggcagccugaucaaggugaacuacaaccagaccgccgugaaggugcccaccacccccgccagccccgugaagaacuggggcggcuucagaauccccaagaagggcgagagacagcagcagggcgaggcccacgacggcgccugccaccagcacagcgacuaccccuaccugggccugggcagagugcccgccaaggagagagccaagagcaagcugaagagcgacaacgagaacgacggcuacgugcccgacguggagaugagcgacagcgagagcgaggccagcgagaagaagugcauccacaccagcagcaccaucagcagaagaaccgacaucaucagaagaagcauccuggccagcuaa

SEQ ID NO: 18716 - RNA, 2553 nt, Artificial Sequence
  JADE2__Homo_sapiens__NP_001276914
auggugcccaccgccgccaucgccgugggcggcuacuuccugggcggcauggaggagaagagaagaaaguacagcaucagcagcgacaacagcgacaccaccgacagccacgccaccagcaccagcgccagcagaugcagcaagcugcccagcagcaccaagagcggcuggcccagacagaacgagaagaagcccagcgagguguucagaaccgaccugaucaccgccaugaagauccccgacagcuaccagcugagccccgacgacuacuacauccuggccgaccccuggagacaggagugggagaagggcgugcaggugcccgccggcgccgaggccauccccgagcccguggugagaauccugcccccccuggagggcccccccgcccaggccagccccagcagcaccaugcugggcgagggcagccagcccgacuggcccggcggcagcagauacgaccuggacgagaucgacgccuacuggcuggagcugaucaacagcgagcugaaggagauggagagacccgagcuggacgagcugacccuggagagagugcuggaggagcuggagacccugugccaccagaacauggccagagccaucgagacccaggagggccugggcaucgaguacgacgaggacguggugugcgacgugugcagaagccccgagggcgaggacggcaacgagaugguguucugcgacaagugcaacgugugcgugcaccaggccugcuacggcauccugaaggugcccaccggcagcuggcugugcagaaccugcgcccugggcgugcagcccaagugccugcugugccccaagagaggcggcgcccugaagcccaccagaagcggcaccaagugggugcacgugagcugcgcccuguggauccccgaggugagcaucggcugccccgagaagauggagcccaucaccaagaucagccacauccccgccagcagaugggcccugagcugcagccugugcaaggagugcaccggcaccugcauccagugcagcaugcccagcugcgugaccgccuuccacgugaccugcgccuucgaccacggccuggagaugagaaccauccuggccgacaacgacgaggugaaguucaagagcuucugccaggagcacagcgacggcggccccagaaacgagcccaccagcgagcccaccgagcccagccaggccggcgaggaccuggagaaggugacccugagaaagcagagacugcagcagcuggaggaggacuucuacgagcugguggagcccgccgagguggccgagagacuggaccuggccgaggcccugguggacuucaucuaccaguacuggaagcugaagagaaaggccaacgccaaccagccccugcugacccccaagaccgacgagguggacaaccuggcccagcaggagcaggacgugcuguacagaagacugaagcuguucacccaccugagacaggaccuggagagagugagaaaccugugcuacauggugaccagaagagagagaaccaagcacgccaucugcaagcugcaggagcagaucuuccaccugcagaugaagcugaucgagcaggaccugugcagagagagaagcggcagaagagccaagggcaagaagagcgacagcaagagaaagggcugcgagggcagcaagggcagcaccgagaagaaggagaaggugaaggccggccccgacagcgugcugggccagcuggccggccugagcaccagcuuccccaucgacggcaccuucuucaacagcuggcuggcccagagcgugcagaucaccgccgagaacauggccaugagcgaguggccccugaacaacggccacagagaggaccccgcccccggccugcugagcgaggagcugcugcaggacgaggagacccugcugagcuucaugagagaccccagccugagacccggcgaccccgccagaaaggccagaggcagaaccagacugcccgccaagaagaagcccccccccccccccccccaggacggccccggcagcagaaccacccccgacaaggcccccaagaagaccuggggccaggacgccggcagcggcaagggcggccagggcccccccaccagaaagccccccagaagaaccagcagccaccugcccagcagccccgccgccggcgacugccccauccuggccacccccgagagcccccccccccuggcccccgagacccccgacgaggccgccagcguggccgccgacagcgacgugcaggugcccggccccgccgccagccccaagccccugggcagacugagaccccccagagagagcaaggugaccagaagacugcccggcgccagacccgacgccggcaugggcccccccagcgccguggccgagagacccaaggugagccugcacuucgacaccgagaccgacggcuacuucagcgacggcgagaugagcgacagcgacguggaggccgaggacggcggcgugcagagaggccccagagaggccggcgccgaggagguggugagaaugggcgugcuggccagcuaa

SEQ ID NO: 18717 - RNA, 3657 nt, Artificial Sequence
  JAG1__Homo_sapiens__NP_000205
augagaagccccagaaccagaggcagaagcggcagaccccugagccugcugcuggcccugcugugcgcccugagagccaaggugugcggcgccagcggccaguucgagcuggagauccugagcaugcagaacgugaacggcgagcugcagaacggcaacugcugcggcggcgccagaaaccccggcgacagaaagugcaccagagacgagugcgacaccuacuucaaggugugccugaaggaguaccagagcagagugaccgccggcggccccugcagcuucggcagcggcagcacccccgugaucggcggcaacaccuucaaccugaaggccagcagaggcaacgacagaaacagaaucgugcugcccuucagcuucgccuggcccagaagcuacacccugcugguggaggccugggacagcagcaacgacaccgugcagcccgacagcaucaucgagaaggccagccacagcggcaugaucaaccccagcagacaguggcagacccugaagcagaacaccggcguggcccacuucgaguaccagaucagagugaccugcgacgacuacuacuacggcuucggcugcaacaaguucugcagacccagagacgacuucuucggccacuacgccugcgaccagaacggcaacaagaccugcauggagggcuggaugggccccgagugcaacagagccaucugcagacagggcugcagccccaagcacggcagcugcaagcugcccggcgacugcagaugccaguacggcuggcagggccuguacugcgacaagugcaucccccaccccggcugcgugcacggcaucugcaacgagcccuggcagugccugugcgagaccaacuggggcggccagcugugcgacaaggaccugaacuacugcggcacccaccagcccugccugaacggcggcaccugcagcaacaccggccccgacaaguaccagugcagcugccccgagggcuacagcggccccaacugcgagaucgccgagcacgccugccugagcgaccccugccacaacagaggcagcugcaaggagaccagccugggcuucgagugcgagugcagccccggcuggaccggccccaccugcagcaccaacaucgacgacugcagccccaacaacugcagccacggcggcaccugccaggaccuggugaacggcuucaagugcgugugccccccccaguggaccggcaagaccugccagcuggacgccaacgagugcgaggccaagcccugcgugaacgccaagagcugcaagaaccugaucgccagcuacuacugcgacugccugcccggcuggaugggccagaacugcgacaucaacaucaacgacugccugggccagugccagaacgacgccagcugcagagaccuggugaacggcuacagaugcaucugcccccccggcuacgccggcgaccacugcgagagagacaucgacgagugcgccagcaaccccugccugaacggcggccacugccagaacgagaucaacagauuccagugccugugccccaccggcuucagcggcaaccugugccagcuggacaucgacuacugcgagcccaaccccugccagaacggcgcccagugcuacaacagagccagcgacuacuucugcaagugccccgaggacuacgagggcaagaacugcagccaccugaaggaccacugcagaaccacccccugcgaggugaucgacagcugcaccguggccauggccagcaacgacacccccgagggcgugagauacaucagcagcaacgugugcggcccccacggcaagugcaagagccagagcggcggcaaguucaccugcgacugcaacaagggcuucaccggcaccuacugccacgagaacaucaacgacugcgagagcaaccccugcagaaacggcggcaccugcaucgacggcgugaacagcuacaagugcaucugcagcgacggcugggagggcgccuacugcgagaccaacaucaacgacugcagccagaaccccugccacaacggcggcaccugcagagaccuggugaacgacuucuacugcgacugcaagaacggcuggaagggcaagaccugccacagcagagacagccagugcgacgaggccaccugcaacaacggcggcaccugcuacgacgagggcgacgccuucaagugcaugugccccggcggcugggagggcaccaccugcaacaucgccagaaacagcagcugccugcccaaccccugccacaacggcggcaccugcguggugaacggcgagagcuucaccugcgugugcaaggagggcugggagggccccaucugcgcccagaacaccaacgacugcagcccccaccccugcuacaacagcggcaccugcguggacggcgacaacugguacagaugcgagugcgcccccggcuucgccggccccgacugcagaaucaacaucaacgagugccagagcagccccugcgccuucggcgccaccugcguggacgagaucaacggcuacagaugcgugugcccccccggccacagcggcgccaagugccaggaggugagcggcagacccugcaucaccaugggcagcgugauccccgacggcgccaagugggacgacgacugcaacaccugccagugccugaacggcagaaucgccugcagcaagguguggugcggccccagacccugccugcugcacaagggccacagcgagugccccagcggccagagcugcauccccauccuggacgaccagugcuucgugcaccccugcaccggcgugggcgagugcagaagcagcagccugcagcccgugaagaccaagugcaccagcgacagcuacuaccaggacaacugcgccaacaucaccuucaccuucaacaaggagaugaugagccccggccugaccaccgagcacaucugcagcgagcugagaaaccugaacauccugaagaacgugagcgccgaguacagcaucuacaucgccugcgagcccagccccagcgccaacaacgagauccacguggccaucagcgccgaggacaucagagacgacggcaaccccaucaaggagaucaccgacaagaucaucgaccuggugagcaagagagacggcaacagcagccugaucgccgccguggccgaggugagagugcagagaagaccccugaagaacagaaccgacuuccuggugccccugcugagcagcgugcugaccguggccuggaucugcugccuggugaccgccuucuacuggugccugagaaagagaagaaagcccggcagccacacccacagcgccagcgaggacaacaccaccaacaacgugagagagcagcugaaccagaucaagaaccccaucgagaagcacggcgccaacaccgugcccaucaaggacuacgagaacaagaacagcaagaugagcaagaucagaacccacaacagcgagguggaggaggacgacauggacaagcaccagcagaaggccagauucgccaagcagcccgccuacacccugguggacagagaggagaagccccccaacggcacccccaccaagcaccccaacuggaccaacaagcaggacaacagagaccuggagagcgcccagagccugaacagaauggaguacaucguguaa

SEQ ID NO: 18718 - RNA, 3717 nt, Artificial Sequence
  JAG2__Homo_sapiens__NP_002217
augagagcccagggcagaggcagacugcccagaagacugcugcugcugcuggcccugugggugcaggccgccagacccaugggcuacuucgagcugcagcugagcgcccugagaaacgugaacggcgagcugcugagcggcgccugcugcgacggcgacggcagaaccaccagagccggcggcugcggccacgacgagugcgacaccuacgugagagugugccugaaggaguaccaggccaaggugacccccaccggccccugcagcuacggccacggcgccacccccgugcugggcggcaacagcuucuaccugccccccgccggcgccgccggcgacagagccagagccagagccagagccggcggcgaccaggaccccggccugguggugauccccuuccaguucgccuggcccagaagcuucacccugaucguggaggccugggacugggacaacgacaccacccccaacgaggagcugcugaucgagagagugagccacgccggcaugaucaaccccgaggacagauggaagagccugcacuucagcggccacguggcccaccuggagcugcagaucagagugagaugcgacgagaacuacuacagcgccaccugcaacaaguucugcagacccagaaacgacuucuucggccacuacaccugcgaccaguacggcaacaaggccugcauggacggcuggaugggcaaggagugcaaggaggccgugugcaagcagggcugcaaccugcugcacggcggcugcaccgugcccggcgagugcagaugcagcuacggcuggcagggcagauucugcgacgagugcgugcccuaccccggcugcgugcacggcagcugcguggagcccuggcagugcaacugcgagaccaacuggggcggccugcugugcgacaaggaccugaacuacugcggcagccaccaccccugcaccaacggcggcaccugcaucaacgccgagcccgaccaguacagaugcaccugccccgacggcuacagcggcagaaacugcgagaaggccgagcacgccugcaccagcaaccccugcgccaacggcggcagcugccacgaggugcccagcggcuucgagugccacugccccagcggcuggagcggccccaccugcgcccuggacaucgacgagugcgccagcaaccccugcgccgccggcggcaccugcguggaccagguggacggcuucgagugcaucugccccgagcagugggugggcgccaccugccagcuggacgccaacgagugcgagggcaagcccugccugaacgccuucagcugcaagaaccugaucggcggcuacuacugcgacugcauccccggcuggaagggcaucaacugccacaucaacgugaacgacugcagaggccagugccagcacggcggcaccugcaaggaccuggugaacggcuaccagugcgugugccccagaggcuucggcggcagacacugcgagcuggagagagacgagugcgccagcagccccugccacagcggcggccugugcgaggaccuggccgacggcuuccacugccacugcccccagggcuucagcggcccccugugcgagguggacguggaccugugcgagcccagccccugcagaaacggcgccagaugcuacaaccuggagggcgacuacuacugcgccugccccgacgacuucggcggcaagaacugcagcgugcccagagagcccugccccggcggcgccugcagagugaucgacggcugcggcagcgacgccggccccggcaugcccggcaccgccgccagcggcgugugcggcccccacggcagaugcgugagccagcccggcggcaacuucagcugcaucugcgacagcggcuucaccggcaccuacugccacgagaacaucgacgacugccugggccagcccugcagaaacggcggcaccugcaucgacgagguggacgccuucagaugcuucugccccagcggcugggagggcgagcugugcgacaccaaccccaacgacugccugcccgaccccugccacagcagaggcagaugcuacgaccuggugaacgacuucuacugcgccugcgacgacggcuggaagggcaagaccugccacagcagagaguuccagugcgacgccuacaccugcagcaacggcggcaccugcuacgacagcggcgacaccuucagaugcgccugcccccccggcuggaagggcagcaccugcgccguggccaagaacagcagcugccugcccaaccccugcgugaacggcggcaccugcgugggcagcggcgccagcuucagcugcaucugcagagacggcugggagggcagaaccugcacccacaacaccaacgacugcaacccccugcccugcuacaacggcggcaucugcguggacggcgugaacugguucagaugcgagugcgcccccggcuucgccggccccgacugcagaaucaacaucgacgagugccagagcagccccugcgccuacggcgccaccugcguggacgagaucaacggcuacagaugcagcugcccccccggcagagccggccccagaugccaggaggugaucggcuucggcagaagcugcuggagcagaggcacccccuucccccacggcagcagcuggguggaggacugcaacagcugcagaugccuggacggcagaagagacugcagcaagguguggugcggcuggaagcccugccugcuggccggccagcccgaggcccugagcgcccagugcccccugggccagagaugccuggagaaggcccccggccagugccugagaccccccugcgaggccuggggcgagugcggcgccgaggagccccccagcacccccugccugcccagaagcggccaccuggacaacaacugcgccagacugacccugcacuucaacagagaccacgugccccagggcaccaccgugggcgccaucugcagcggcaucagaagccugcccgccaccagagccguggccagagacagacugcuggugcugcugugcgacagagccagcagcggcgccagcgccguggagguggccgugagcuucagccccgccagagaccugcccgacagcagccugauccagggcgccgcccacgccaucguggccgccaucacccagagaggcaacagcagccugcugcuggccgugaccgaggugaagguggagaccguggugaccggcggcagcagcaccggccugcuggugcccgugcugugcggcgccuucagcgugcuguggcuggccugcguggugcugugcgugugguggaccagaaagagaagaaaggagagagagagaagcagacugcccagagaggagagcgccaacaaccagugggccccccugaaccccaucagaaaccccaucgagagacccggcggccacaaggacgugcuguaccagugcaagaacuucacccccccccccagaagagccgacgaggcccugcccggccccgccggccacgccgccgugagagaggacgaggaggacgaggaccugggcagaggcgaggaggacagccuggaggccgagaaguuccugagccacaaguucaccaaggaccccggcagaagccccggcagacccgcccacugggccagcggccccaagguggacaacagagccgugagaagcaucaacgaggccagauacgccggcaaggaguaa

SEQ ID NO: 18719 - RNA, 552 nt, Artificial Sequence
  JAGN1__Homo_sapiens__NP_115881
auggccagcagagccggccccagagccgccggcaccgacggcagcgacuuccagcacagagagagaguggccaugcacuaccagaugagcgugacccugaaguacgagaucaagaagcugaucuacgugcaccuggugaucuggcugcugcugguggccaagaugagcgugggccaccugagacugcugagccacgaccagguggccaugcccuaccagugggaguaccccuaccugcugagcauccugcccagccugcugggccugcugagcuuccccagaaacaacaucagcuaccuggugcugagcaugaucagcaugggccuguucagcaucgccccccugaucuacggcagcauggagauguuccccgccgcccagcagcuguacagacacggcaaggccuacagauuccuguucggcuucagcgccgugagcaucauguaccuggugcuggugcuggccgugcaggugcacgccuggcagcuguacuacagcaagaagcugcuggacagcugguucaccagcacccaggagaagaagcacaaguaa

SEQ ID NO: 18720 - RNA, 3399 nt, Artificial Sequence
  JAK2__Homo_sapiens__NP_004963
augggcauggccugccugaccaugaccgagauggagggcaccagcaccagcagcaucuaccagaacggcgacaucagcggcaacgccaacagcaugaagcagaucgaccccgugcugcagguguaccuguaccacagccugggcaagagcgaggccgacuaccugaccuuccccagcggcgaguacguggccgaggagaucugcaucgccgccagcaaggccugcggcaucacccccguguaccacaacauguucgcccugaugagcgagaccgagagaaucugguacccccccaaccacguguuccacaucgacgagagcaccagacacaacgugcuguacagaaucagauucuacuuccccagaugguacugcagcggcagcaacagagccuacagacacggcaucagcagaggcgccgaggccccccugcuggacgacuucgugaugagcuaccuguucgcccaguggagacacgacuucgugcacggcuggaucaaggugcccgugacccacgagacccaggaggagugccugggcauggccgugcuggacaugaugagaaucgccaaggagaacgaccagaccccccuggccaucuacaacagcaucagcuacaagaccuuccugcccaagugcaucagagccaagauccaggacuaccacauccugaccagaaagagaaucagauacagauucagaagauucauccagcaguucagccagugcaaggccaccgccagaaaccugaagcugaaguaccugaucaaccuggagacccugcagagcgccuucuacaccgagaaguucgaggugaaggagcccggcagcggccccagcggcgaggagaucuucgccaccaucaucaucaccggcaacggcggcauccaguggagcagaggcaagcacaaggagagcgagacccugaccgagcaggaccugcagcuguacugcgacuuccccaacaucaucgacgugagcaucaagcaggccaaccaggagggcagcaacgagagcagaguggugaccauccacaagcaggacggcaagaaccuggagaucgagcugagcagccugagagaggcccugagcuucgugagccugaucgacggcuacuacagacugaccgccgacgcccaccacuaccugugcaaggagguggccccccccgccgugcuggagaacauccagagcaacugccacggccccaucagcauggacuucgccaucagcaagcugaagaaggccggcaaccagaccggccuguacgugcugagaugcagccccaaggacuucaacaaguacuuccugaccuucgccguggagagagagaacgugaucgaguacaagcacugccugaucaccaagaacgagaacgaggaguacaaccugagcggcaccaagaagaacuucagcagccugaaggaccugcugaacugcuaccagauggagaccgugagaagcgacaacaucaucuuccaguucaccaagugcugcccccccaagcccaaggacaagagcaaccugcugguguucagaaccaacggcgugagcgacgugcccaccagccccacccugcagagacccacccacaugaaccagaugguguuccacaagaucagaaacgaggaccugaucuucaacgagagccugggccagggcaccuucaccaagaucuucaagggcgugagaagagaggugggcgacuacggccagcugcacgagaccgaggugcugcugaaggugcuggacaaggcccacagaaacuacagcgagagcuucuucgaggccgccagcaugaugagcaagcugagccacaagcaccuggugcugaacuacggcgugugcgugugcggcgacgagaacauccuggugcaggaguucgugaaguucggcagccuggacaccuaccugaagaagaacaagaacugcaucaacauccuguggaagcuggagguggccaagcagcuggccugggccaugcacuuccuggaggagaacacccugauccacggcaacgugugcgccaagaacauccugcugaucagagaggaggacagaaagaccggcaacccccccuucaucaagcugagcgaccccggcaucagcaucaccgugcugcccaaggacauccugcaggagagaauccccugggugccccccgagugcaucgagaaccccaagaaccugaaccuggccaccgacaaguggagcuucggcaccacccugugggagaucugcagcggcggcgacaagccccugagcgcccuggacagccagagaaagcugcaguucuacgaggacagacaccagcugcccgcccccaagugggccgagcuggccaaccugaucaacaacugcauggacuacgagcccgacuucagacccagcuucagagccaucaucagagaccugaacagccuguucacccccgacuacgagcugcugaccgagaacgacaugcugcccaacaugagaaucggcgcccugggcuucagcggcgccuucgaggacagagaccccacccaguucgaggagagacaccugaaguuccugcagcagcugggcaagggcaacuucggcagcguggagaugugcagauacgacccccugcaggacaacaccggcgaggugguggccgugaagaagcugcagcacagcaccgaggagcaccugagagacuucgagagagagaucgagauccugaagagccugcagcacgacaacaucgugaaguacaagggcgugugcuacagcgccggcagaagaaaccugaagcugaucauggaguaccugcccuacggcagccugagagacuaccugcagaagcacaaggagagaaucgaccacaucaagcugcugcaguacaccagccagaucugcaagggcauggaguaccugggcaccaagagauacauccacagagaccuggccaccagaaacauccugguggagaacgagaacagagugaagaucggcgacuucggccugaccaaggugcugccccaggacaaggaguacuacaaggugaaggagcccggcgagagccccaucuucugguacgcccccgagagccugaccgagagcaaguucagcguggccagcgacguguggagcuucggcguggugcuguacgagcuguucaccuacaucgagaagagcaagagcccccccgccgaguucaugagaaugaucggcaacgacaagcagggccagaugaucguguuccaccugaucgagcugcugaagaacaacggcagacugcccagacccgacggcugccccgacgagaucuacaugaucaugaccgagugcuggaacaacaacgugaaccagagacccagcuucagagaccuggcccugagaguggaccagaucagagacaacauggccggcuaa

SEQ ID NO: 18721 - RNA, 3504 nt, Artificial Sequence
  JAK3__Homo_sapiens__XP_005259953
augaccguggcccaggagaccaagggccccacccaggagggcgccgagugggacuucccccuggccgccagcagacugugcccccccuucgagagccccggcagccugcccgccagacagguggcccugauggccccccccagcgaggagaccccccugaucccccagagaagcugcagccugcugagcaccgaggccggcgcccugcacgugcugcugcccgccagaggccccggccccccccagagacugagcuucagcuucggcgaccaccuggccgaggaccugugcgugcaggccgccaaggccagcggcauccugcccguguaccacagccuguucgcccuggccaccgaggaccugagcugcugguucccccccagccacaucuucagcguggaggacgccagcacccaggugcugcuguacagaaucagauucuacuuccccaacugguucggccuggagaagugccacagauucggccugagaaaggaccuggccagcgccauccuggaccugcccgugcuggagcaccuguucgcccagcacagaagcgaccuggugagcggcagacugcccgugggccugagccugaaggagcagggcgagugccugagccuggccgugcuggaccuggccagaauggccagagagcaggcccagagacccggcgagcugcugaagaccgugagcuacaaggccugccugccccccagccugagagaccugauccagggccugagcuucgugaccagaagaagaaucagaagaaccgugagaagagcccugagaagaguggccgccugccaggccgacagacacagccugauggccaaguacaucauggaccuggagagacuggaccccgccggcgccgccgagaccuuccacgugggccugcccggcgcccugggcggccacgacggccugggccugcugagaguggccggcgacggcggcaucgccuggacccagggcgagcaggaggugcugcagcccuucugcgacuuccccgagaucguggacaucagcaucaagcaggcccccagagugggccccgccggcgagcacagacuggugaccgugaccagaaccgacaaccagauccuggaggccgaguuccccggccugcccgaggcccugagcuucguggcccugguggacggcuacuucagacugaccaccgacagccagcacuucuucugcaaggagguggccccccccagacugcuggaggagguggccgagcagugccacggccccaucacccuggacuucgccaucaacaagcugaagaccggcggcagcagacccggcagcuacgugcugagaagaagcccccaggacuucgacagcuuccugcugaccgugugcgugcagaacccccugggccccgacuacaagggcugccugaucagaagaagccccaccggcaccuuccugcuggugggccugagcagaccccacagcagccugagagagcugcuggccaccugcugggacggcggccugcacguggacggcguggccgugacccugaccagcugcugcauccccagacccaaggagaagagcaaccugaucguggugcagagaggccacagcccccccaccagcagccuggugcagccccagagccaguaccagcugagccagaugaccuuccacaagauccccgccgacagccuggaguggcacgagaaccugggccacggcagcuucaccaagaucuacagaggcugcagacacgaggugguggacggcgaggccagaaagaccgaggugcugcugaaggugauggacgccaagcacaagaacugcauggagagcuuccuggaggccgccagccugaugagccaggugagcuacagacaccuggugcugcugcacggcgugugcauggccggcgacagcaccauggugcaggaguucgugcaccugggcgccaucgacauguaccugagaaagagaggccaccuggugcccgccagcuggaagcugcagguggugaagcagcuggccuacgcccugaacuaccuggaggacaagggccugccccacggcaacgugagcgccagaaaggugcugcuggccagagagggcgccgacggcagcccccccuucaucaagcugagcgaccccggcgugagccccgccgugcugagccuggagaugcugaccgacagaauccccuggguggcccccgagugccugagagaggcccagacccugagccuggaggccgacaaguggggcuucggcgccaccgugugggagguguucagcggcgugaccaugcccaucagcgcccuggaccccgccaagaagcugcaguucuacgaggacagacagcagcugcccgcccccaaguggaccgagcuggcccugcugauccagcagugcauggccuacgagcccgugcagagacccagcuucagagccgugaucagagaccugaacagccugaucagcagcgacuacgagcugcugagcgaccccacccccggcgcccuggcccccagagacggccuguggaacggcgcccagcuguacgccugccaggaccccaccaucuucgaggagagacaccugaaguacaucagccagcugggcaagggcaacuucggcagcguggagcugugcagauacgacccccugggcgacaacaccggcgcccugguggccgugaagcagcugcagcacagcggccccgaccagcagagagacuuccagagagagauccagauccugaaggcccugcacagcgacuucaucgugaaguacagaggcgugagcuacggccccggcagacagagccugagacuggugauggaguaccugcccagcggcugccugagagacuuccugcagagacacagagccagacuggacgccagcagacugcugcuguacagcagccagaucugcaagggcauggaguaccugggcagcagaagaugcgugcacagagaccuggccgccagaaacauccugguggagagcgaggcccacgugaagaucgccgacuucggccuggccaagcugcugccccuggacaaggacuacuacguggugagagagcccggccagagccccaucuucugguacgcccccgagagccugagcgacaacaucuucagcagacagagcgacguguggagcuucggcguggugcuguacgagcuguucaccuacugcgacaagagcugcagccccagcgccgaguuccugagaaugaugggcugcgagagagacgugcccgcccugugcagacugcuggagcugcuggaggagggccagagacugcccgccccccccgccugccccgccgaggugcacgagcugaugaagcugugcugggcccccagcccccaggacagacccagcuucagcgcccugggcccccagcuggacaugcuguggagcggcagcagaggcugcgagacccacgccuucaccgcccaccccgagggcaagcaccacagccugagcuucagcuaa

SEQ ID NO: 18722 - RNA, 2496 nt, Artificial Sequence
  JAKMIP1__Homo_sapiens__NP_001092903
augagcaagaagggcagaagcaagggcgagaagcccgagauggagaccgacgccgugcagauggccaacgaggagcugagagccaagcugaccagcauccagaucgaguuccagcaggagaagagcaaggugggcaagcugagagagagacugcaggaggccaagcuggagagagagcaggagcagagaagacacaccgccuacaucagcgagcugaaggccaagcugcacgaggagaagaccaaggagcugcaggcccugagagagggccugaucagacagcacgagcaggaggccgccagaaccgccaagaucaaggagggcgagcugcagagacugcaggccacccugaacgugcugagagacggcgccgccgacaaggugaagaccgcccugcugaccgaggccagagaggaggccagaagagccuucgacggcgagagacugagacugcagcaggagauccuggagcugaaggccgccagaaagcaggccgaggaggcccugagcaacugcaugcaggccgacaagaccaaggccgccgaccugagagccgccuaccaggcccaccaggacgaggugcacagaaucaagagagagugcgagagagacaucagaagacugauggacgagaucaagggcaaggacagagugauccuggcccuggagaaggagcugggcgugcaggccggccagacccagaagcugcugcugcagaaggaggcccuggacgagcagcuggugcaggugaaggaggccgagagacaccacagcagccccaagagagagcugccccccggcaucggcgacaugguggagcugaugggcgugcaggaccagcacauggacgagagagacgugagaagauuccagcugaagaucgccgagcugaacagcgugaucagaaagcuggaggacagaaacacccugcuggccgacgagagaaacgagcugcugaagagaagcagagagaccgaggugcagcugaagccccugguggagaagaacaagagaaugaacaagaagaacgaggaccugcugcagagcauccagagaauggaggagaagaucaagaaccugaccagagagaacguggagaugaaggagaagcugagcgcccaggccagccugaagagacacaccagccugaacgaccugagccugaccagagacgagcaggagaucgaguuccugagacugcaggugcuggagcagcagcacgugaucgacgaccugagccuggagagagagagacugcugagaagcaagagacacagaggcaagagccugaagccccccaagaagcacgugguggagaccuucuucggcuucgacgaggagagcguggacagcgagacccugagcgagaccagcuacaacaccgacagaaccgacagaacccccgccacccccgaggaggaccuggacgacgccaccgccagagaggaggccgaccugagauucugccagcugaccagagaguaccaggcccugcagagagccuacgcccugcugcaggagcaggugggcggcacccuggacgccgagagagaggccagaaccagagagcagcugcaggccgaccugcugagaugccaggccaagaucgaggaccuggagaagcugcugguggagaagggccaggacagcaaguggguggaggagaagcagcugcugaucagaaccaaccaggaccugcuggagaagaucuacagacuggagauggaggagaaccagcugaagaacgagaugcaggacgccaaggaccagaacgagcugcuggaguucagagugcuggagcuggaggagagagagagaagaagccccgccuucaaccugcagaucaccaccuuccccgagaaccacagcagcgcccugcagcuguucugccaccaggagggcgugaaggacgugaacgugagcgagcugaugaagaagcuggacauccugggcgacaacggcaaccugagaaacgaggagcagguggccaucauccaggccggcaccgugcuggcccugugcgagaaguggcugaagcagaucgagggcaccgaggccgcccugacccagaagaugcuggaccuggagaaggagaaggaccuguucagcagacagaagggcuaccuggaggaggagcuggacuacagaaagcaggcccuggaccaggccuaccugaagauccaggaccuggaggccacccuguacaccgcccugcagcaggagcccggcagaagagccggcgaggcccugagcgagggccagagagaggaccugcaggccgccguggagaaggugagaagacagauccugagacagagcagagaguucgacagccagauccugagagagagaauggagcugcugcagcaggcccagcagagaaucagagagcuggaggacaagcuggaguuccagaagagacaccugaaggagcuggaggagaaguuccuguuccuguuccuguucuucagccuggccuucauccuguggcccuaa

SEQ ID NO: 18723 - RNA, 2400 nt, Artificial Sequence
  JAKMIP2__Homo_sapiens__NP_001257863
augagcaagaagggcagaaacaagggcgagaagcccgaggcccugaucguggcccugcaggccgccaacgaggaccugagaaccaagcugaccgacauccagaucgagcugcaccaggagaagagcaaggugagcaagcuggagagagagaagacccaggaggccaagagaaucagagagcuggagcagagaaagcacaccgugcuggugaccgagcugaaggccaagcugcacgaggagaagaugaaggagcugcaggccgugagagagaaccugaucaagcagcacgagcaggagaugagcagaaccgugaaggugagagacggcgagauccagagacugaagagcgcccugugcgcccugagagacggcagcagcgacaaggugagaaccgcccugaccaucgaggccagagaggaggccagaaagcuguucgacaccgagagacugaagcugcugcaggagaucgccgaccugaagaccgccaagaagcagguggacgaggcccugagcaacaugauccaggccgacaagaucaaggccggcgaccugagaagcgagcaccagagccaccaggaggccaucagcaagaucaagugggagagcgagagagacaucagaagacugauggacgagaucaaggccaaggacagaaucaucuucagccuggagaaggagcuggagacccagaccggcuacgugcagaagcugcagcugcagaaggaggcccuggacgagcagcuguuccuggugaaggaggccgagugcaacaugagcagccccaagagagagauccccggcagagccggcgacggcagcgagcacugcagcagccccgaccugagaagaaaccagaagagaaucgccgagcugaacgccaccaucagaaagcuggaggacagaaacacccugcugggcgacgagagaaacgagcugcugaagagagugagagagaccgagaagcagugcaagccccugcuggagagaaacaagugccuggccaagagaaacgacgagcugauggugagccugcagagaauggaggagaagcugaaggccgugaccaaggagaacagcgagaugagagagaagaucaccagccaccccccccugaagaagcugaagagccugaacgaccuggaccaggccaacgaggagcaggagaccgaguuccugaagcugcaggugaucgagcagcagaacaucaucgacgagcugaccagagacagagagaagcugaucagaagaagaaagcacagaagaagcagcaagcccaucaagagacccgugcuggaccccuucaucggcuacgacgaggacagcauggacagcgagaccagcagcauggccagcuucagaaccgacagaacccccgccacccccgacgacgaccuggacgagagccuggccgccgaggagagcgagcugagauucagacagcugaccaaggaguaccaggcccugcagagagccuacgcccugcugcaggagcagaccggcggcaucaucgacgccgagagagaggccaaggcccaggagcagcugcaggccgaggugcugagauacaaggccaagaucgaggaccuggaggccacccuggcccagaagggccagaucgagaagcaggaggccgagaaccacagacugcagcaggagcugcaggacgccagagaccagaacgagcugcuggaguucagaaaccuggagcuggaggagagagagagaagaagcccccccuucaaccugcagauccaccccuucagcgacggcgugagcgcccugcagaucuacugcaugaaggagggcgugaaggacgugaacauccccgaccugaucaagcagcuggacauccugggcgacaacggcaaccugagaaacgaggagcagguggccaucauccaggccagcaccgugcugagccuggccgagaaguggauccagcagaucgagggcgccgaggccgcccugcaccagaagaugauggagcuggagagcgacauggagcaguucugcaagaucaagggcuaccuggaggaggagcuggacuacagaaagcaggcccuggaccaggccuacaugagaauccaggagcuggaggccacccuguacaacgcccugcagcaggagaccgugaucaaguucggcgagcugcugagcgagaagcagcaggaggagcugagaaccgccguggagaagcugagaagacagaugcugagaaagagcagagaguacgacugccagauccugcaggagagaauggagcugcugcagcaggcccaccagagaaucagagaccuggaggacaagaccgacauccagaagagacagaucaaggaccuggaggagaaguuccuguuccuguuccuguucuucagccuggccuucauccuguggcccuaa

SEQ ID NO: 18724 - RNA, 2535 nt, Artificial Sequence
  JAKMIP3__Homo_sapiens__XP_011537986
augagcaagagaggcaugagcagcagagccaagggcgacaaggccgaggcccuggccgcccugcaggccgccaacgaggaccugagagccaagcugaccgacauccagaucgagcugcagcaggagaagagcaaggugagcaagguggagagagagaagaaccaggagcugagacaggugagagagcacgagcagcacaagaccgccgugcugcugaccgagcugaagaccaagcugcacgaggagaagaugaaggagcugcaggccgugagagagacccugcugagacagcacgaggccgagcugcugagagugaucaagaucaaggacaacgagaaccagagacugcaggcccugcugagcgcccugagagacggcggccccgagaaggugaagaccgugcugcugagcgaggccaaggaggaggccaagaagggcuucgagguggagaaggugaagaugcagcaggagaucagcgagcugaagggcgccaagagacagguggaggaggcccugacccuggugauccaggccgacaagaucaaggccgccgagaucagaagcguguaccaccugcaccaggaggagaucaccagaaucaagaaggagugcgagagagagaucagaagacugauggaggagaucaaguucaaggacagagccguguucgugcuggagagagagcugggcgugcaggccggccacgcccagagacugcagcugcagaaggaggcccuggacgagcagcugagccaggugagagaggccgacagacaccccggcagccccagaagagagcugccccacgccgccggcgccggcgacgccagcgaccacagcggcagccccgagcagcagcuggacgagaaggacgccagaagauuccagcugaagaucgccgagcugagcgccaucaucagaaagcuggaggacagaaacgcccugcugagcgaggagagaaacgagcugcugaagagagugagagaggccgagagccaguacaagccccugcuggacaagaacaagagacugagcagaaagaacgaggaccugagccacgcccugagaagaauggagaacaagcugaaguucgugacccaggagaacaucgagaugagacagagagccggcaucaucagaagacccagcagccugaacgaccuggaccagagccaggacgagagagagguggacuuccugaagcugcagaucguggagcagcagaaccugaucgacgagcugagcaagacccuggagaccgccggcuacgugaagagcgugcuggagagagacaagcugcugagauucagaaagcagagaaagaagauggccaagcugcccaagcccguggugguggagaccuucuucggcuacgacgaggaggccagccuggagagcgacggcagcagcgugagcuaccagaccgacagaaccgaccagacccccugcacccccgacgacgaccuggaggagggcauggccaaggaggagaccgagcugagauucagacagcugaccauggaguaccaggcccugcagagagccuacgcccugcugcaggagcaggugggcggcacccuggacgccgagagagaggugaagaccagagagcagcugcaggccgaggugcagagagcccaggccagaaucgaggaccuggagaaggcccuggccgagcagggccaggacaugaaguggaucgaggagaagcaggcccuguacagaagaaaccaggagcugguggagaagaucaagcagauggagaccgaggaggccagacugagacacgaggugcaggacgccagagaccagaacgagcugcuggaguucagaauccuggagcuggaggagagagagagaaagagccccgccaucagcuuccaccacacccccuucguggacggcaagagcccccugcagguguacugcgaggccgagggcgugaccgacaucgugguggccgagcugaugaagaagcuggacauccugggcgacaacgccaaccugaccaacgaggagcaggugguggugauccaggccagaaccgugcugacccuggccgagaaguggcugcagcagaucgaggagaccgaggccgcccugcagagaaagaugguggaccuggagagcgagaaggagcuguucagcaagcagaagggcuaccuggacgaggagcuggacuacagaaagcaggcccuggaccaggccaacaagcacauccuggagcuggaggccaugcuguacgacgcccugcagcaggaggccggcgccaagguggccgagcugcugagcgaggaggagagagagaagcugaagguggccguggagcaguggaagagacaggugaugagcgagcugagagagagagacgcccagauccugagagagagaauggagcugcugcagcuggcccagcagagaaucaaggagcuggaggagagaaucgaggcccagaagagacagaucaaggagcuggaggagaaguuccuguuccuguuccuguucuucagccuggccuucauccuguggagcuaa

SEQ ID NO: 18725 - RNA, 789 nt, Artificial Sequence
  JAM2__Homo_sapiens__NP_001257336
auggccagaagaagcagacacagacugcugcugcugcugcugagauaccuggugguggcccugggcuaccacaaggccuacggcuucagcgcccccaaggaccagcagguggugaccgccguggaguaccagggcgacuucaagaacagagccgagaugaucgacuucaacaucagaaucaagaacgugaccagaagcgacgccggcaaguacagaugcgaggugagcgcccccagcgagcagggccagaaccuggaggaggacaccgugacccuggaggugcugguggcccccgccgugcccagcugcgaggugcccagcagcgcccugagcggcaccgugguggagcugagaugccaggacaaggagggcaaccccgcccccgaguacaccugguucaaggacggcaucagacugcuggagaaccccagacugggcagccagagcaccaacagcagcuacaccaugaacaccaagaccggcacccugcaguucaacaccgugagcaagcuggacaccggcgaguacagcugcgaggccagaaacagcgugggcuacagaagaugccccggcaagagaaugcagguggacgaccugaacaucagcggcaucaucgccgccgugguggugguggcccuggugaucagcgugugcggccugggcgugugcuacgcccagagaaagggcuacuucagcaaggagaccagcuuccagaagagcaacagcagcagcaaggccaccaccaugagcgagaacgacuucaagcacaccaagagcuucaucaucuaa

SEQ ID NO: 18726 - RNA, 780 nt, Artificial Sequence
  JAM3__Homo_sapiens__NP_001192258
auggcccugagaagaccccccagacugagacugugcgccagacugcccgacuucuuccugcugcugcuguucagaggcugccugaucggcgccgugaaccugaagagcagcaacagaacccccguggugcaggaguucgagagcguggagcugagcugcaucaucaccgacagccagaccagcgaccccagaaucgaguggaagaagauccaggacgagcagaccaccuacguguucuucgacaacaagauccaggugaagcccgugacccccgugugcagagugcccaaggccgugcccgugggcaagauggccacccugcacugccaggagagcgagggccaccccagaccccacuacagcugguacagaaacgacgugccccugcccaccgacagcagagccaaccccagauucagaaacagcagcuuccaccugaacagcgagaccggcacccugguguucaccgccgugcacaaggacgacagcggccaguacuacugcaucgccagcaacgacgccggcagcgccagaugcgaggagcaggagauggagguguacgaccugaacaucggcggcaucaucggcggcgugcugguggugcuggccgugcuggcccugaucacccugggcaucugcugcgccuacagaagaggcuacuucaucaacaacaagcaggacggcgagagcuacaagaaccccggcaagcccgacggcgugaacuacaucagaaccgacgaggagggcgacuucagacacaagagcagcuucgugaucuaa

SEQ ID NO: 18727 - RNA, 3225 nt, Artificial Sequence
  JARID2__Homo_sapiens__NP_001253969
augguguacuucggcagcagccaggacgaggaggagguggaggaggaggacgacgagaccgaggacgugaagaccgccaccaacaacgccagcagcagcugccagagcacccccagaaagggcaagacccacaagcacgugcacaacggccacguguucaacggcagcagcagaagcaccagagagaaggagcccgugcagaagcacaagagcaaggaggccacccccgccaaggagaagcacagcgaccacagagccgacagcagaagagagcaggccagcgccaaccaccccgccgccgcccccagcaccggcagcagcgccaagggccuggccgccacccaccaccaccccccccugcacagaagcgcccaggaccugagaaagcaggugagcaaggugaacggcgugaccagaaugagcagccugggcgccggcgugaccagcgccaagaagaugagagaggugagacccagccccagcaagaccgugaaguacaccgccaccgugaccaagggcgccgugaccuacaccaaggccaagagagagcuggugaaggacaccaagcccaaccaccacaagcccagcagcgccgugaaccacaccaucagcggcaagaccgagagcagcaacgccaagaccagaaagcaggugcugagccugggcggcgccagcaagagcaccggccccgccgugaacggccugaaggugagcggcagacugaaccccaagagcugcaccaaggaggugggcggcagacagcugagagagggccugcagcugagagagggccugagaaacagcaagagaagacuggaggaggcccaccaggccgagaagccccagagcccccccaagaagaugaagggcgccgccggccccgccgagggccccggcaagaaggcccccgccgagagaggccugcugaacggccacgugaagaaggaggugcccgagagaagccuggagagaaacagacccaagagagccaccgccggcaagagcacccccggcagacaggcccacggcaaggccgacagcgccagcugcgagaacagaagcaccagccagcccgagagcgugcacaagccccaggacagcggcaaggccgagaagggcggcggcaaggccggcugggccgccauggacgagauccccgugcugagacccagcgccaaggaguuccacgacccccugaucuacaucgagagcgugagagcccagguggagaaguucggcaugugcagagugauccccccccccgacuggagacccgagugcaagcugaacgacgagaugagauucgugacccagauccagcacauccacaagcugggcagaagauggggccccaacgugcagagacuggccugcaucaagaagcaccugaagagccagggcaucaccauggacgagcugccccugaucggcggcugcgagcuggaccuggccugcuucuucagacugaucaacgagaugggcggcaugcagcaggugaccgaccugaagaaguggaacaagcuggccgacaugcugagaauccccagaaccgcccaggacagacuggccaagcugcaggaggccuacugccaguaccugcugagcuacgacagccugagccccgaggagcacagaagacuggagaaggaggugcugauggagaaggagauccuggagaagagaaagggcccccuggagggccacaccgagaacgaccaccacaaguuccacccccugcccagauucgagcccaagaacggccugauccacggcguggcccccagaaacggcuucagaagcaagcugaaggaggugggccaggcccagcugaagaccggcagaagaagacuguucgcccaggagaaggagguggugaaggaggaggaggaggacaagggcgugcugaacgacuuccacaagugcaucuacaagggcagaagcgugagccugaccaccuucuacagaaccgccagaaacaucaugagcaugugcuucagcaaggagcccgcccccgccgagaucgagcaggaguacuggagacugguggaggagaaggacugccacguggccgugcacugcggcaagguggacaccaacacccacggcagcggcuuccccgugggcaagagcgagcccuucagcagacacggcuggaaccugaccgugcugcccaacaacaccggcagcauccugagacaccugggcgccgugcccggcgugaccauccccuggcugaacaucggcaugguguucagcaccagcugcuggagcagagaccagaaccaccugcccuacaucgacuaccugcacaccggcgccgacugcaucugguacugcauccccgccgaggaggagaacaagcuggaggacguggugcacacccugcugcaggccaacggcacccccggccugcagaugcuggagagcaacgugaugaucagccccgaggugcugugcaaggagggcaucaaggugcacagaaccgugcagcagagcggccaguucguggugugcuuccccggcagcuucgugagcaaggugugcugcggcuacagcgugagcgagaccgugcacuucgccaccacccaguggaccagcaugggcuucgagaccgccaaggagaugaagagaagacacaucgccaagcccuucagcauggagaagcugcuguaccagaucgcccaggccgaggccaagaaggagaacggccccacccugagcaccaucagcgcccugcuggacgagcugagagacaccgagcugagacagagaagacagcuguucgaggccggccugcacagcagcgccagauacggcagccacgacggcagcagcaccguggccgacggcaagaagaagcccagaaaguggcugcagcuggagaccagcgagagaagaugccagaucugccagcaccugugcuaccugagcaugguggugcaggagaacgagaacgugguguucugccuggagugcgcccugagacacguggagaagcagaagagcugcagaggccugaagcugauguacagauacgacgaggagcagaucaucagccuggugaaccagaucugcggcaaggugagcggcaagaacggcagcaucgagaacugccugagcaagcccacccccaagagaggccccagaaagagagccaccguggacgugccccccagcagacugagcgccagcagcagcagcaagagcgccagcagcagcagcuaa

SEQ ID NO: 18728 - RNA, 732 nt, Artificial Sequence
  JAZF1__Homo_sapiens__NP_778231
augaccggcaucgccgccgccagcuucuucagcaacaccugcagauucggcggcugcggccugcacuuccccacccuggccgaccugaucgagcacaucgaggacaaccacaucgacaccgaccccagagugcuggagaagcaggagcugcagcagcccaccuacguggcccugagcuacaucaacagauucaugaccgacgccgccagaagagagcaggagagccugaagaagaagauccagcccaagcugagccugacccugagcagcagcgugagcagaggcaacgugagcaccccccccagacacagcagcggcagccugaccccccccgugaccccccccaucacccccagcagcagcuucagaagcagcacccccaccggcagcgaguacgacgaggaggagguggacuacgaggagagcgacagcgacgagagcuggaccaccgagagcgccaucagcagcgaggccauccugagcagcaugugcaugaacggcggcgaggagaagcccuucgccugccccgugcccggcugcaagaagagauacaagaacgugaacggcaucaaguaccacgccaagaacggccacagaacccagaucagagugagaaagcccuucaagugcagaugcggcaagagcuacaagaccgcccagggccugagacaccacaccaucaacuuccacccccccgugagcgccgagaucaucagaaagaugcagcaguaa

SEQ ID NO: 18729 - RNA, 492 nt, Artificial Sequence
  JDP2__Homo_sapiens__XP_005267389
augaugcccggccagauccccgaccccagcgugaccaccggcagccugcccggccugggcccccugaccggccugcccagcagcgcccugaccguggaggagcugaaguacgccgacaucagaaaccugggcgccaugaucgccccccugcacuuccuggaggugaagcugggcaagagaccccagcccgugaagagcgagcuggacgaggaggaggagagaagaaagagaagaagagagaagaacaagguggccgccgccagaugcagaaacaagaagaaggagagaaccgaguuccugcagagagagagcgagagacuggagcugaugaacgccgagcugaagacccagaucgaggagcugaagcaggagagacagcagcugauccugaugcugaacagacacagacccaccugcaucgugagaaccgacagcgugaagacccccgagagcgagggcaacccccugcuggagcagcuggagaagaaguaa

SEQ ID NO: 18730 - RNA, 7077 nt, Artificial Sequence
  JMJD1C__Homo_sapiens__NP_001269877
augcagggccccuacagccugaacggcuacagagugagaguguacagacaggacagcgccacccagugguucaccggcaucaucacccaccacgaccuguucaccagaaccaugaucgugaugaacgaccaggugcuggagccccagaacguggaccccagcauggugcagaugaccuuccuggacgacguggugcacagccugcugaagggcgagaacaucggcaucaccagcagaagaagaagcagagccaaccagaacgugaacgccgugcacagccacuacaccagagcccaggccaacagccccagacccgccaugaacagccaggccgccgugcccaagcagaacacccaccagcagcagcagcagagaagcaucagacccaacaagagaaagggcagcgacagcagcauccccgacgaggagaagaugaaggaggagaaguacgacuacaucagcagaggcgagaaccccaagggcaagaacaagcaccugaugaacaagagaagaaagcccgaggaggacgagaagaagcugaacaugaagagacugagaaccgacaacgugagcgacuucagcgagagcagcgacagcgagaacagcaacaagagaaucaucgacaacagcagcgagcagaagcccgagaacgagcugaagaacaagaacaccagcaagaucaacggcgaggagggcaagccccacaacaacgagaaggccggcgaggagacccugaagaacagccagccccccugggaccagauccaggaggacaagaagcacgaggaggccgagaagagaaagagcguggacacccagcugcaggaggacaugaucauccacagcagcgagcagagcaccgugagcgaccacaacagcaacgaccugcugccccaggagugcaacauggacaagacccacaccauggagcugcugcccaaggagaaguucgugagcagaccccccacccccaagugcgugaucgacaucaccaacgacaccaaccuggagaagguggcccaggagaacagcagcaccuucggccugcagacccugcagaagauggaccccaacgugagcgacagcaagcacagcaucgccaacgccaaguuccuggagaccgccaagaaggacagcgaccagagcugggugagcgacguggugaagguggaccugacccagagcagcgugaccaacgccagcagcggcaacgaccaccugaacauggagaaggagaaguacgugagcuacaucagcccccugagcgccgugagcgugauggaggacaagcugcacaagagaagccccccccccgagaccaucaagagcaagcugaacaccagcguggacacccacaagaucaagagcagccccagccccgagguggugaagcccaagaucacccacagccccgacagcgugaagagcaaggccaccuacgugaacagccaggccaccggcgagagaagacuggccaacaagaucgagcacgagcugagcagaugcagcuuccaccccauccccaccagaagcagcacccuggagaccaccaagagcccccugaucaucgacaagaacgagcacuucaccguguacagagaccccgcccugaucggcagcgagaccggcgccaaccacaucagccccuuccugagccagcaccccuucccccugcacagcagcagccacagaaccugccugaaccccggcacccaccaccccgcccugacccccgccccccaccugcuggccggcagcagcagccagaccccccugcccaccaucaacacccacccccugaccagcggcccccaccacgccgugcaccacccccaccugcugcccaccgugcugcccggcgugcccaccgccagccugcugggcggccaccccagacuggagagcgcccacgccagcagccugagccaccuggcccuggcccaccagcagcagcagcagcugcugcagcaccagagcccccaccugcugggccaggcccaccccagcgccagcuacaaccagcugggccuguaccccaucaucuggcaguaccccaacggcacccacgccuacagcggccugggccugcccagcagcaagugggugcaccccgagaacgccgugaacgccgaggccagccugagaagaaacagccccagccccuggcugcaccagcccacccccgugaccagcgccgacggcaucggccugcugagccacauccccgugagacccagcagcgccgagccccacagaccccugaagaucaccgcccacagcagccccccccugaccaagacccugguggaccaccacaaggaggagcuggagagaaaggccuucauggagccccugagaagcguggccagcaccagcgccaagaacgaccuggaccugaacagaagccagaccggcaaggacugccaccugcacagacacuucguggaccccgugcugaaccagcugcagagacccccccaggagaccggcgagagacugaacaaguacaaggaggagcacagaagaauccugcaggagagcaucgacguggcccccuucaccaccaagaucaagggccuggagggcgagagagagaacuacagcagaguggccagcagcagcagcagccccaagagccacaucaucaagcaggacauggacguggagagaagcgugagcgaccuguacaagaugaagcacagcgugccccagagccugccccagagcaacuacuucaccacccugagcaacagcguggugaacgagccccccagaagcuaccccagcaaggaggugagcaacaucuacggcgacaagcagagcaacgcccuggccgccgccgccgccaacccccagacccugaccagcuucaucaccagccugagcaagccccccccccugaucaagcaccagcccgagagcgagggccuggugggcaagauccccgagcaccugccccaccagaucgccagccacagcgugaccaccuucagaaacgacugcagaagccccacccaccugaccgugagcagcaccaacacccugagaagcaugcccgcccugcacagagcccccguguuccacccccccauccaccacagccuggagagaaaggagggcagcuacagcagccugagcccccccacccugacccccgugaugcccgugaacgccggcggcaaggugcaggagagccagaagccccccacccugauccccgagcccaaggacagccaggccaacuucaagagcagcagcgagcagagccugaccgagauguggagacccaacaacaaccugagcaaggagaagaccgaguggcacguggagaagagcagcggcaagcugcaggccgccauggccagcgugaucgugagacccagcagcagcaccaagaccgacagcaugcccgccaugcagcuggccagcaaggacagagugagcgagagaagcagcgccggcgcccacaagaccgacugccugaagcuggccgaggccggcgagaccggcagaaucauccugcccaacgugaacagcgacagcgugcacaccaagagcgagaagaacuuccaggccgugagccagggcagcgugcccagcagcgugaugagcgccgugaacaccaugugcaacaccaagaccgacgugaucaccagcgccgccgacaccaccagcgugagcagcuggggcggcagcgaggugaucagcagccugagcaacaccauccuggccagcaccagcagcgagugcgugagcagcaagagcgugagccagcccguggcccagaagcaggagugcaaggugagcaccaccgcccccgugacccuggccagcagcaagaccggcagcguggugcagcccagcagcggcuucagcggcaccaccgacuucauccaccugaagaagcacaaggccgcccuggccgccgcccaguacaagagcagcaacgccagcgagaccgagcccaacgccaucaagaaccagacccugagcgccagccugccccuggacagcaccgugaucugcagcaccaucaacaaggccaacagcgugggcaacggccaggccagccagaccagccagcccaacuaccacaccaagcugaagaaggccuggcugaccagacacagcgaggaggacaagaacaccaacaagauggagaacagcggcaacagcgugagcgagaucaucaagcccugcagcgugaaccugaucgccagcaccagcagcgacauccagaacagcguggacagcaagaucaucguggacaaguacgugaaggacgacaaggugaacagaagaaaggccaagagaaccuacgagagcggcagcgagagcggcgacagcgacgagagcgagagcaagagcgagcagagaaccaagagacagcccaagcccaccuacaagaagaagcagaacgaccugcagaagagaaagggcgagaucgaggaggaccugaagcccaacggcgugcugagcagaagcgccaaggagagaagcaagcugaagcugcagagcaacagcaacaccggcauccccagaagcgugcugaaggacuggagaaaggugaagaagcugaagcagaccggcgagagcuuccugcaggacgacagcugcugcgagaucggccccaaccugcagaagugcagagagugcagacugaucagaagcaagaagggcgaggagcccgcccacagccccguguucugcagauucuacuacuucagaagacugagcuucagcaagaacggcguggugagaaucgacggcuucagcagccccgaccaguacgacgacgaggccaugagccuguggacccacgagaacuucgaggacgacgagcuggacaucgagaccagcaaguacauccuggacaucaucggcgacaaguucugccagcuggugaccagcgagaagaccgcccugagcugggugaagaaggacgccaagaucgccuggaagagagccgugagaggcgugagagagaugugcgacgccugcgaggccacccuguucaacauccacugggugugccagaagugcggcuucguggugugccuggacugcuacaaggccaaggagagaaagagcagcagagacaaggagcuguacgccuggaugaagugcgugaagggccagccccacgaccacaagcaccugaugcccacccagaucauccccggcagcgugcugaccgaccugcuggacgccaugcacacccugagagagaaguacggcaucaagagccacugccacugcaccaacaagcagaaccugcaggugggcaacuuccccaccaugaacggcgugagccaggugcugcagaacgugcugaaccacagcaacaagaucagccugugcaugcccgagagccagcagcagaacaccccccccaagagcgagaagaacggcggcagcagccccgagagcgacgugggcaccgacaacaagcugaccccccccgagagccagagcccccugcacuggcuggccgaccuggccgagcagaaggccagagaggagaagaaggagaacaaggagcugacccuggagaaccagaucaaggaggagagagagcaggacaacagcgagagccccaacggcagaaccagcccccuggugagccagaacaacgagcagggcagcacccugagagaccugcugaccaccaccgccggcaagcugagagugggcagcaccgacgccggcaucgccuucgcccccguguacagcaugggcgcccccagcagcaagagcggcagaaccaugcccaacauccuggacgacaucaucgccagcgugguggagaacaagaucccccccagcaagaccagcaagaucaacgugaagcccgagcugaaggaggagcccgaggagagcaucaucagcgccguggacgagaacaacaagcuguacagcgacaucccccacagcuggaucugcgagaagcacauccuguggcugaaggacuacaagaacagcagcaacuggaagcuguucaaggagugcuggaagcagggccagcccgccguggugagcggcgugcacaagaagaugaacaucagccuguggaaggccgagagcaucagccuggacuucggcgaccaccaggccgaccugcugaacugcaaggacagcaucaucagcaacgccaacgugaaggaguucugggacggcuucgaggaggugagcaagagacagaagaacaagagcggcgagaccguggugcugaagcugaaggacuggcccagcggcgaggacuucaagaccaugaugcccgccagauacgaggaccugcugaagagccugccccugcccgaguacugcaaccccgagggcaaguucaaccuggccagccaccugcccggcuucuucgugagacccgaccugggccccagacugugcagcgccuacggcgugguggccgccaaggaccacgacaucggcaccaccaaccugcacaucgaggugagcgacguggugaacauccugguguacgugggcaucgccaagggcaacggcauccugagcaaggccggcauccugaagaaguucgaggaggaggaccuggacgacauccugagaaagagacugaaggacagcagcgagauccccggcgcccuguggcacaucuacgccggcaaggacguggacaagaucagagaguuccugcagaagaucagcaaggagcagggccuggaggugcugcccgagcacgaccccaucagagaccagagcugguacgugaacaagaagcugagacagagacugcuggaggaguacggcgugagaaccugcacccugauccaguuccugggcgacgccaucgugcugcccgccggcgcccugcaccaggugcagaacuuccacagcugcauccaggugaccgaggacuucgugagccccgagcaccugguggagagcuuccaccugacccaggagcugagacugcugaaggaggagaucaacuacgacgacaagcugcaggugaagaacauccuguaccacgccgugaaggagauggugagagcccugaagauccacgaggacgagguggaggacauggaggagaacuaa

SEQ ID NO: 18731 - RNA, 1245 nt, Artificial Sequence
  JMJD6__Homo_sapiens__NP_001074930
augaaccacaagagcaagaagagaaucagagaggccaagagaagcgccagacccgagcugaaggacagccuggacuggaccagacacaacuacuacgagagcuucagccugagccccgccgccguggccgacaacguggagagagccgacgcccugcagcugagcguggaggaguucguggagagauacgagagacccuacaagcccguggugcugcugaacgcccaggagggcuggagcgcccaggagaaguggacccuggagagacugaagagaaaguacagaaaccagaaguucaagugcggcgaggacaacgacggcuacagcgugaagaugaagaugaaguacuacaucgaguacauggagagcaccagagacgacagcccccuguacaucuucgacagcagcuacggcgagcaccccaagagaagaaagcugcuggaggacuacaaggugcccaaguucuucaccgacgaccuguuccaguacgccggcgagaagagaagaccccccuacagaugguucgugaugggcccccccagaagcggcaccggcauccacaucgacccccugggcaccagcgccuggaacgcccuggugcagggccacaagagauggugccuguuccccaccagcacccccagagagcugaucaaggugaccagagacgagggcggcaaccagcaggacgaggccaucaccugguucaacgugaucuaccccagaacccagcugcccaccuggccccccgaguucaagccccuggagauccugcagaagcccggcgagaccguguucgugcccggcggcugguggcacguggugcugaaccuggacaccaccaucgccaucacccagaacuucgccagcagcaccaacuuccccgugguguggcacaagaccgugagaggcagacccaagcugagcagaaagugguacagaauccugaagcaggagcaccccgagcuggccgugcuggccgacagcguggaccugcaggagagcaccggcaucgccagcgacagcagcagcgacagcagcagcagcagcagcagcagcagcagcgacagcgacagcgagugcgagagcggcagcgagggcgacggcaccgugcacagaagaaagaagagaagaaccugcagcauggugggcaacggcgacaccaccagccaggacgacugcgugagcaaggagagaagcagcagcagaaucagagacaccugcggcggcagagcccaccccuaa

SEQ ID NO: 18732 - RNA, 2967 nt, Artificial Sequence
  JMY__Homo_sapiens__NP_689618
augagcuucgcccuggaggagacccuggagagcgacuggguggccgugagaccccacguguucgacgagagagagaagcacaaguucguguucaucguggccuggaacgagaucgagggcaaguucgccaucaccugccacaacagaaccgcccagagacagagaagcggcagcagagagcaggccggcgccagaggcggcgccgaggccggcggcgccgccagcgacggcagcagaggccccggcagccccgccggcagaggcagacccgaggccaccgccagcgccacccuggugagaagccccggccccagaagaagcagcgccugggccgagggcggcagccccagaagcaccagaagccugcugggcgaccccagacugagaagccccggcagcaagggcgccgagagcagacugagaagccccgugagagccaagcccauccccggccagaagaccagcgaggccgacgacgccgccggcgccgccgccgccgccgccagacccgcccccagagaggcccaggugagcagcgugagaaucgugagcgccagcggcaccgugagcgaggagaucgaggugcuggagauggugaaggaggacgaggccccccuggcccugagcgacgccgagcagcccccccccgccaccgagcuggagagccccgccgaggagugcagcugggccggccuguucagcuuccaggaccugagagccgugcaccagcagcugugcagcgugaacagccagcuggagcccugccugcccguguuccccgaggagcccagcggcauguggaccgugcuguucggcggcgcccccgagaugaccgagcaggagaucgacacccugugcuaccagcugcagguguaccugggccacggccuggacaccugcggcuggaagauccugagccaggugcuguucaccgagaccgacgaccccgaggaguacuacgagagccugagcgagcugagacagaagggcuacgaggaggugcugcagagagccagaaagagaauccaggagcugcuggacaagcacaagaacaccgagagcaugguggagcugcuggaccuguaccagauggaggacgaggccuacagcagccuggccgaggccaccaccgagcuguaccaguaccugcugcagcccuucagagacaugagagagcuggccaugcugagaagacagcagaucaagaucagcauggagaacgacuaccugggccccagaagaaucgagagccugcagaaggaggacgccgacuggcagagaaaggcccacauggccgugcugagcauccaggaccugaccgugaaguacuucgagaucaccgccaaggcccagaaggccguguacgacagaaugagagccgaccagaagaaguucggcaaggccagcugggccgccgccgccgagagaauggagaagcugcaguacgccgugagcaaggagacccugcagaugaugagagccaaggagaucugccuggagcagagaaagcacgcccugaaggaggagaugcagagccugagaggcggcaccgaggccaucgccagacuggaccagcuggaggccgacuacuacgaccugcagcugcagcuguacgaggugcaguucgagauccugaagugcgaggagcugcugcugaccgcccagcuggagagcaucaagagacugaucagcgagaagagagacgaggugguguacuacgacaccuacgagagcauggaggccaugcuggagaaggaggagauggccgccagcgccuaccugcagagagaggagcugcagaagcugcagcagaaggccagacagcuggaggccagaagaggcagagugagcgccaagaagagcuaccugagaaacaagaaggagaucugcaucgccaagcacaacgagaagauccagcagagaaccagaaucgaggacgaguacagaacccaccacaccgugcagcugaagagagagaagcugcacgacgaggaggagagaaagagcgccugggugagccaggagagacagagaacccuggacagacugagaaccuucaagcagagauaccccggccaggugauccugaagagcaccagacugagacuggcccacgccagaagaaagggcgccgccagccccgugcugcaggaggaccacugcgacagccugcccagcgugcugcagguggaggagaagaccgaggaggugggcgagggcagagugaagagaggccccagccagaccaccgagccccagagccuggugcagcuggaggacaccagccugacccagcuggaggccaccagccugccccugagcggcgugaccagcgagcugccccccaccaucagccugccccugcugaacaacaaccuggagcccugcagcgugaccaucaacccccugcccagcccccugccccccaccccccccccccccccccccccccccccccccccccccccccccccccugcccguggccaaggacagcggccccgagacccuggagaaggaccugcccagaaaggagggcaacgagaagagaauccccaagagcgccagcgcccccagcgcccaccuguucgacagcagccagcuggugagcgccagaaagaagcugagaaagaccgccgagggccugcagagaagaagagugagcagccccauggacgaggugcuggccagccugaagagaggcagcuuccaccugaagaagguggagcagagaacccugccccccuuccccgacgaggacgacagcaacaacauccuggcccagaucagaaagggcgugaagcugaagaaggugcagaaggacgugcugagagagagcuucacccugcugcccgacaccgacccccugaccagaagcauccacgaggcccugagaagaaucaaggaggccagccccgagagcgaggacgaggaggaggcccugcccugcaccgacugggagaacuaa

SEQ ID NO: 18733 - RNA, 390 nt, Artificial Sequence
  JPH2__Homo_sapiens__NP_787109
augagcggcggcagauucgacuucgacgacggcggcgccuacugcggcggcugggagggcggcaaggcccacggccacggccugugcaccggccccaagggccagggcgaguacagcggcagcuggaacuucggcuucgagguggccggcguguacaccuggcccagcggcaacaccuucgagggcuacuggagccagggcaagagacacggccugggcaucgagaccaagggcagauggcuguacaagggcgaguggacccacggcuucaagggcagauacggcaucagacagagcagcagcagcggcgccaaguacgagggcaccuggaacaacggccugcaggacggcuacggcaccgagaccuacgccgacggcggcaugugcuaa

SEQ ID NO: 18734 - RNA, 561 nt, Artificial Sequence
  JPH3__Homo_sapiens__NP_001258533
augagcagcggcggcagauucaacuucgacgacggcggcagcuacugcggcggcugggaggacggcaaggcccacggccacggcgugugcaccggccccaagggccagggcgaguacaccggcagcuggagccacggcuucgaggugcugggcguguacaccuggcccagcggcaacaccuaccagggcaccugggcccagggcaagagacacggcaucggccuggagagcaagggcaaguggguguacaagggcgaguggacccacggcuucaagggcagauacggcgugagagagugcgccggcaacggcgccaaguacgagggcaccuggagcaacggccugcaggacggcuacggcaccgagaccuacagcgacggcgacgccaccgccuucggcgccgagcccggccccgaggccagagagcugcccgccgccgccgccgccgccgccgccgccgccgccgccgccgugagaugguuccugugcagagagcccuggcccgcccugcagcugcccgccugccuggacagccccaucagcaccccccagugcaccuaa

SEQ ID NO: 18735 - RNA, 1887 nt, Artificial Sequence
  JPH4__Homo_sapiens__NP_115828
augagccccggcggcaaguucgacuucgacgacggcggcugcuacgugggcggcugggaggccggcagagcccacggcuacggcgugugcaccggccccggcgcccagggcgaguacagcggcugcugggcccacggcuucgagagccugggcguguucaccggccccggcggccacagcuaccagggccacuggcagcagggcaagagagagggccugggcguggagagaaagagcagauggaccuacagaggcgaguggcugggcggccugaagggcagaagcggcgugugggagagcgugagcggccugagauacgccggccuguggaaggacggcuuccaggacggcuacggcaccgagaccuacagcgacggcggcaccuaccagggccaguggcaggccggcaagagacacggcuacggcgugagacagagcgugcccuaccaccaggccgcccugcugagaagccccagaagaaccagccuggacagcggccacagcgacccccccacccccccccccccccugccccugcccggcgacgagggcggcagccccgccagcggcagcagaggcggcuucgugcuggccggccccggcgacgccgacggcgccagcagcagaaagagaacccccgccgccggcggcuucuucagaagaagccugcugcugagcggccugagagccggcggcagaagaagcagccugggcagcaagagaggcagccugagaagcgaggugagcagcgaggugggcagcaccggcccccccggcagcgaggccagcggcccccccgccgccgccccccccgcccugaucgagggcagcgccaccgagguguacgccggcgaguggagagccgacagaagaagcggcuucggcgugagccagagaagcaacggccugagauacgagggcgaguggcugggcaacagaagacacggcuacggcagaaccaccagacccgacggcagcagagaggagggcaaguacaagagaaacagacuggugcacggcggcagagugagaagccugcugccccuggcccugagaagaggcaaggugaaggagaagguggacagagccguggagggcgccagaagagccgugagcgccgccagacagagacaggagaucgccgccgccagagccgccgacgcccugcugaaggccguggccgccagcagcguggccgagaaggccguggaggccgccagaauggccaagcugaucgcccaggaccugcagcccaugcuggaggcccccggcagaagacccagacaggacagcgagggcagcgacaccgagccccuggacgaggacagccccggcguguacgagaacggccugacccccagcgagggcagccccgagcugcccagcagccccgccagcagcagacagcccuggagaccccccgccugcagaagcccccugccccccggcggcgaccagggccccuucagcagccccaaggccuggcccgaggaguggggcggcgccggcgcccaggccgaggagcuggccggcuacgaggccgaggacgaggccggcaugcagggccccggccccagagacggcagcccccugcugggcggcugcagcgacagcagcggcagccugagagaggaggagggcgaggacgaggagccccugcccccccugagagcccccgccggcaccgagcccgagcccaucgccaugcuggugcugagaggcagcagcagcagaggccccgacgccggcugccugaccgaggagcugggcgagcccgccgccaccgagagacccgcccagcccggcgccgccaacccccugguggugggcgccguggcccugcuggaccugagccuggccuuccuguucagccagcugcugaccuaa

SEQ ID NO: 18736 - RNA, 1671 nt, Artificial Sequence
  JRK__Homo_sapiens__NP_001070995
auggccagcaagcccgccgccggcaagagcagaggcgagaagagaaagagaguggugcugacccugaaggagaagaucgacaucugcaccagacuggagaagggcgagagcagaaaggcccugaugcaggaguacaacgugggcaugagcacccuguacgacaucagagcccacaaggcccagcugcugagauucuucgccagcagcgacagcaacaaggcccuggagcagagaagaacccugcacacccccaagcuggagcaccuggacagagugcuguacgagugguuccugggcaagagaagcgagggcgugcccgugagcggccccaugcugaucgagaaggccaaggacuucuacgagcagaugcagcugaccgagcccugcguguucagcggcggcuggcuguggagauucaaggccagacacggcaucaagaagcuggacgccagcagcgagaagcagagcgccgaccaccaggccgccgagcaguucugcgccuucuucagaagccuggccgccgagcacggccugagcgccgagcagguguacaacgccgacgagaccggccuguucuggagaugccugcccaaccccacccccgagggcggcgccgugcccggccccaagcagggcaaggacagacugaccgugcugaugugcgccaacgccaccggcagccacagacugaagccccuggccaucggcaagugcagcggccccagagccuucaagggcauccagcaccugcccguggccuacaaggcccagggcaacgccuggguggacaaggagaucuucagcgacugguuccaccacaucuucgugcccagcgugagagagcacuucagaaccaucggccugcccgaggacagcaaggccgugcugcugcuggacagcagcagagcccacccccaggaggccgagcuggugagcagcaacguguucaccaucuuccugcccgccagcguggccagccuggugcagcccauggagcagggcaucagaagagacuucaugagaaacuucaucaacccccccgugccccugcagggcccccacgccagauacaacaugaacgacgccaucuucagcguggccugcgccuggaacgccgugcccagccacguguucagaagagccuggagaaagcuguggcccagcguggccuucgccgagggcagcagcagcgaggaggagcuggaggccgagugcuuccccgugaagccccacaacaagagcuucgcccacauccuggagcuggugaaggagggcagcagcugccccggccagcugagacagagacaggccgccagcuggggcguggccggcagagaggccgagggcggcagaccccccgccgccaccagccccgccgaggugguguggagcagcgagaagacccccaaggccgaccaggacggcagaggcgaccccggcgagggcgaggagguggccugggagcaggccgccguggccuucgacgccgugcugagauucgccgagagacagcccugcuucagcgcccaggaggugggccagcugagagcccugagagccguguucagaagccagcagcaggagaccgugggccuggaggacgugguggugaccagccccgaggagcuggccauccccaagugcugccuggaggccagcaccgagaccuaa

SEQ ID NO: 18737 - RNA, 996 nt, Artificial Sequence
  JSRP1__Homo_sapiens__NP_653217
augagcaugaccaccagagccugggaggagcuggacggcggccugggcagcugccaggcccuggaggaccacagcgcccuggccgagacccaggaggacagagccagcgccacccccagacuggccgacagcggcagcgugccccacgacagccagguggccgagggccccagcguggacaccagacccaagaagauggagaaggagcccgccgccagaggcacccccggcaccggcaaggagagacugaaggccggcgccagccccagaagcgugcccgccagaaagaaggcccagaccgcccccccccugcagccccccccccccccccccgcccugagcgaggagcugcccuggggcgaccugagccugaacaagugccuggugcuggccagccugguggcccugcugggcagcgccuuccagcugugcagagacgccgugcccggcgaggccgcccugcaggccagagugcccgagcccugggugccccccagcagcgcccccagagagcccagcagcccccugcccaaguucgaggcccaggccccccccagcgccccccccgcccccagagccgaggccgaggugagacccaagauccccggcagcagagaggccgccgagaacgacgaggaggagcccggcgaggccaccggcgaggccgugagagaggacagagugacccuggccgacagaggccccaaggagagacccagaagagagggcaagcccagaaaggagaagcccagaaaggaggagagacccaagaaggagagacccagaaaggaggagagacccagagccgccagagagcccagagaggcccugccccagagaugggagagcagagagggcggccacagacccugggccagagacagcagagacgccgagcccagaaagaagcaggccugggugagccccagaagacccgacgaggagcagagacccggcagcagacagaagcugagagccggcaagggcagagacuaa

SEQ ID NO: 18738 - RNA, 441 nt, Artificial Sequence
  JTB__Homo_sapiens__NP_006685
augcuggccggcgccggcagacccggccugccccagggcagacaccugugcuggcugcugugcgccuucacccugaagcugugccaggccgaggcccccgugcaggaggagaagcugagcgccagcaccagcaaccugcccugcuggcugguggaggaguucgugguggccgaggagugcagccccugcagcaacuucagagccaagaccacccccgagugcggccccaccggcuacguggagaagaucaccugcagcagcagcaagagaaacgaguucaagagcugcagaagcgcccugauggagcagagacuguucuggaaguucgagggcgccguggugugcguggcccugaucuucgccugccuggugaucaucagacagagacagcuggacagaaaggcccuggagaaggugagaaagcagaucgagagcaucuaa

SEQ ID NO: 18739 - RNA, 1044 nt, Artificial Sequence
  JUNB__Homo_sapiens__NP_002220
augugcaccaagauggagcagcccuucuaccacgacgacagcuacaccgccaccggcuacggcagagcccccggcggccugagccugcacgacuacaagcugcugaagcccagccuggccgugaaccuggccgaccccuacagaagccugaaggcccccggcgccagaggccccggccccgagggcggcggcggcggcagcuacuucagcggccagggcagcgacaccggcgccagccugaagcuggccagcagcgagcuggagagacugaucgugcccaacagcaacggcgugaucaccaccacccccaccccccccggccaguacuucuaccccagaggcggcggcagcggcggcggcgccggcggcgccggcggcggcgugaccgaggagcaggagggcuucgccgacggcuucgugaaggcccuggacgaccugcacaagaugaaccacgugaccccccccaacgugagccugggcgccaccggcggcccccccgccggccccggcggcguguacgccggccccgagcccccccccguguacaccaaccugagcagcuacagccccgccagcgccagcagcggcggcgccggcgccgccgugggcaccggcagcagcuaccccaccaccaccaucagcuaccugccccacgccccccccuucgccggcggccaccccgcccagcugggccugggcagaggcgccagcaccuucaaggaggagccccagaccgugcccgaggccagaagcagagacgccaccccccccgugagccccaucaacauggaggaccaggagagaaucaagguggagagaaagagacugagaaacagacuggccgccaccaagugcagaaagagaaagcuggagagaaucgccagacuggaggacaaggugaagacccugaaggccgagaacgccggccugagcagcaccgccggccugcugagagagcagguggcccagcugaagcagaaggugaugacccacgugagcaacggcugccagcugcugcugggcgugaagggccacgccuucuaa

SEQ ID NO: 18740 - RNA, 1044 nt, Artificial Sequence
  JUND__Homo_sapiens__NP_005345
auggagacccccuucuacggcgacgaggcccugagcggccugggcggcggcgccagcggcagcggcggcagcuucgccagccccggcagacuguuccccggcgccccccccaccgccgccgccggcagcaugaugaagaaggacgcccugacccugagccugagcgagcagguggccgccgcccugaagcccgccgccgcccccccccccaccccccugagagccgacggcgcccccagcgccgccccccccgacggccugcuggccagccccgaccugggccugcugaagcuggccagccccgagcuggagagacugaucauccagagcaacggccuggugaccaccacccccaccagcagccaguuccuguaccccaagguggccgccagcgaggagcaggaguucgccgagggcuucgugaaggcccuggaggaccugcacaagcagaaccagcugggcgccggcgccgccgccgccgccgccgccgccgccgccggcggccccagcggcaccgccaccggcagcgccccccccggcgagcuggcccccgccgccgccgcccccgaggcccccguguacgccaaccugagcagcuacgccggcggcgccggcggcgccggcggcgccgccaccguggccuucgccgccgagcccgugcccuucccccccccccccccccccggcgcccugggcccccccagacuggccgcccugaaggacgagccccagaccgugcccgacgugcccagcuucggcgagagccccccccugagccccaucgacauggacacccaggagagaaucaaggccgagagaaagagacugagaaacagaaucgccgccagcaagugcagaaagagaaagcuggagagaaucagcagacuggaggagaaggugaagacccugaagagccagaacaccgagcuggccagcaccgccagccugcugagagagcagguggcccagcugaagcagaaggugcugagccacgugaacagcggcugccagcugcugccccagcaccaggugcccgccuacuaa

SEQ ID NO: 18741 - RNA, 2238 nt, Artificial Sequence
  JUP__Homo_sapiens__XP_006721941
auggaggugaugaaccugauggagcagcccaucaaggugaccgaguggcagcagaccuacaccuacgacagcggcauccacagcggcgccaacaccugcgugcccagcgugagcagcaagggcaucauggaggaggacgaggccugcggcagacaguacacccugaagaagaccaccaccuacacccagggcgugccccccagccagggcgaccuggaguaccagaugagcaccaccgccagagccaagagagugagagaggccaugugccccggcgugagcggcgaggacagcagccugcugcuggccacccagguggagggccaggccaccaaccugcagagacuggccgagcccagccagcugcugaagagcgccaucgugcaccugaucaacuaccaggacgacgccgagcuggccaccagagcccugcccgagcugaccaagcugcugaacgacgaggaccccgugguggugaccaaggccgccaugaucgugaaccagcugagcaagaaggaggccagcagaagagcccugaugggcagcccccagcugguggccgccguggugagaaccaugcagaacaccagcgaccuggacaccgccagaugcaccaccagcauccugcacaaccugagccaccacagagagggccugcuggccaucuucaagagcggcggcauccccgcccuggugagaaugcugagcagccccguggagagcgugcuguucuacgccaucaccacccugcacaaccugcugcuguaccaggagggcgccaagauggccgugagacuggccgacggccugcagaagauggugccccugcugaacaagaacaaccccaaguuccuggccaucaccaccgacugccugcagcugcuggccuacggcaaccaggagagcaagcugaucauccuggccaacggcggcccccaggcccuggugcagaucaugagaaacuacagcuacgagaagcugcuguggaccaccagcagagugcugaaggugcugagcgugugccccagcaacaagcccgccaucguggaggccggcggcaugcaggcccugggcaagcaccugaccagcaacagccccagacuggugcagaacugccuguggacccugagaaaccugagcgacguggccaccaagcaggagggccuggagagcgugcugaagauccuggugaaccagcugagcguggacgacgugaacgugcugaccugcgccaccggcacccugagcaaccugaccugcaacaacagcaagaacaagacccuggugacccagaacagcggcguggaggcccugauccacgccauccugagagccggcgacaaggacgacaucaccgagcccgccgugugcgcccugagacaccugaccagcagacaccccgaggccgagauggcccagaacagcgugagacugaacuacggcauccccgccaucgugaagcugcugaaccagcccaaccaguggccccuggugaaggccaccaucggccugaucagaaaccuggcccugugccccgccaaccacgccccccugcaggaggccgccgugauccccagacuggugcagcugcuggugaaggcccaccaggacgcccagagacacguggccgccggcacccagcagcccuacaccgacggcgugagaauggaggagaucguggagggcugcaccggcgcccugcacauccuggccagagaccccaugaacagaauggagaucuucagacugaacaccaucccccuguucgugcagcugcuguacagcagcguggagaacauccagagaguggccgccggcgugcugugcgagcuggcccaggacaaggaggccgccgacgccaucgacgccgagggcgccagcgccccccugauggagcugcugcacagcagaaacgagggcaccgccaccuacgccgccgccgugcuguucagaaucagcgaggacaagaaccccgacuacagaaagagagugagcguggagcugaccaacagccuguucaagcacgaccccgccgccugggaggccgcccagagcaugauccccaucaacgagcccuacggcgacgacauggacgccaccuacagacccauguacagcagcgacgugccccuggacccccuggagaugcacauggacauggacggcgacuaccccaucgacaccuacagcgacggccugagaccccccuaccccaccgccgaccacaugcuggccuaa

SEQ ID NO: 18742 - RNA, 2043 nt, Artificial Sequence
  KAL1__Homo_sapiens__NP_000207
auggugcccggcgugcccggcgccgugcugacccugugccuguggcuggccgccagcagcggcugccuggccgccggccccggcgccgccgccgccagaagacuggacgagagccugagcgccggcagcgugcagagagccagaugcgccagcagaugccugagccugcagaucaccagaaucagcgccuucuuccagcacuuccagaacaacggcagccugguguggugccagaaccacaagcagugcagcaagugccuggagcccugcaaggagagcggcgaccugagaaagcaccagugccagagcuucugcgagccccuguuccccaagaagagcuacgagugccugaccagcugcgaguuccugaaguacauccugcuggugaagcagggcgacugccccgcccccgagaaggccagcggcuucgccgccgccugcguggagagcugcgagguggacaacgagugcagcggcgugaagaagugcugcagcaacggcugcggccacaccugccaggugcccaagacccuguacaagggcgugccccugaagcccagaaaggagcugagauucaccgagcugcagagcggccagcuggaggugaaguggagcagcaaguucaacaucagcaucgagcccgugaucuacguggugcagagaagauggaacuacggcauccaccccagcgaggacgacgccacccacuggcagaccguggcccagaccaccgacgagagagugcagcugaccgacaucagacccagcagaugguaccaguucagaguggccgccgugaacgugcacggcaccagaggcuucaccgcccccagcaagcacuucagaagcagcaaggaccccagcgccccccccgcccccgccaaccugagacuggccaacagcaccgugaacagcgacggcagcgugaccgugaccaucgugugggaccugcccgaggagcccgacauccccgugcaccacuacaagguguucuggagcuggauggugagcagcaagagccuggugcccaccaagaagaagagaagaaagaccaccgacggcuuccagaacagcgugauccuggagaagcugcagcccgacugcgacuacgugguggagcugcaggccaucaccuacuggggccagaccagacugaagagcgccaaggugagccugcacuucaccagcacccacgccaccaacaacaaggagcagcuggugaagaccagaaagggcggcauccagacccagcugcccuuccagagaagaagacccaccagaccccuggaggugggcgcccccuucuaccaggacggccagcugcaggugaagguguacuggaagaagaccgaggaccccaccgugaacagauaccacgugagaugguuccccgaggccugcgcccacaacagaaccaccggcagcgaggccagcagcggcaugacccacgagaacuacaucauccugcaggaccugagcuucagcugcaaguacaaggugaccgugcagcccaucagacccaagagccacagcaaggccgaggccguguucuucaccaccccccccugcagcgcccugaagggcaagagccacaagcccgugggcugccugggcgaggccggccacgugcugagcaaggugcuggccaagcccgagaaccugagcgccagcuucaucgugcaggacgugaacaucaccggccacuucagcuggaagauggccaaggccaaccuguaccagcccaugaccggcuuccaggugaccugggccgaggugaccaccgagagcagacagaacagccugcccaacagcaucaucagccagagccagauccugcccagcgaccacuacgugcugaccgugcccaaccugagacccagcacccuguacagacuggaggugcaggugcugacccccggcggcgagggccccgccaccaucaagaccuucagaacccccgagcugccccccagcagcgcccacagaagccaccugaagcacagacacccccaccacuacaagcccagccccgagagauacuaa

SEQ ID NO: 18743 - RNA, 8961 nt, Artificial Sequence
  KALRN__Homo_sapiens__NP_001019831
augaccgacagauucugggaccagugguaccugugguaccugagacugcugagacugcuggacagaggcagcuucagaaacgacggccugaaggccagcgacgugcugcccauccugaaggagaagguggccuucgugagcggcggcagagacaagagaggcggccccauccugaccuuccccgccagaagcaaccacgacagaaucagacaggaggaccugagaaagcuggugaccuaccuggccagcgugcccagcgaggacgugugcaagagaggcuucaccgugaucaucgacaugagaggcagcaagugggaccugaucaagccccugcugaagacccugcaggaggccuuccccgccgagauccacguggcccugaucaucaagcccgacaacuucuggcagaagcagaagaccaacuucggcagcagcaaguucaucuucgagaccagcauggugagcguggagggccugaccaagcugguggaccccagccagcugaccgaggaguucgacggcagccuggacuacaaccacgaggaguggaucgagcugagacugagccuggaggaguucuucaacagcgccgugcaccugcugagcagacuggaggaccugcaggagaugcuggccagaaaggaguuccccguggacguggagggcagcagaagacugaucgacgagcacacccagcugaagaagaaggugcugaaggcccccguggaggagcuggacagagagggccagagacugcugcagugcaucagaugcagcgacggcuucagcggcagaaacugcauccccggcagcgccgacuuccagagccuggugcccaagaucaccagccugcuggacaagcugcacagcaccagacagcaccugcaccagauguggcacgugagaaagcugaagcuggaccagugcuuccagcugagacuguucgagcaggacgccgagaagauguucgacuggaucagccacaacaaggagcuguuccugcagagccacaccgagaucggcgugagcuaccaguacgcccuggaccugcagacccagcacaaccacuucgccaugaacagcaugaacgccuacgugaacaucaacagaaucaugagcguggccagcagacugagcgaggccggccacuacgccagccagcagaucaagcagaucagcacccagcuggaccaggaguggaagagcuucgccgccgcccuggacgagagaagcaccauccuggccaugagcgccguguuccaccagaaggccgagcaguuccugagcggcguggacgccuggugcaagaugugcagcgagggcggccugcccagcgagaugcaggaccuggagcuggccauccaccaccaccagacccuguacgagcaggugacccaggccuacaccgaggugagccaggacggcaaggcccugcuggacgugcugcagagaccccugagccccggcaacagcgagagccugaccgccaccgccaacuacagcaaggccgugcaccaggugcuggacguggugcacgaggugcugcaccaccagagaagacuggagagcaucuggcagcacagaaaggugagacugcaccagagacugcagcugugcguguuccagcaggacgugcagcaggugcuggacuggaucgagaaccacggcgaggccuuccugagcaagcacaccggcgugggcaagagccugcacagagccagagcccugcagaagagacacgacgacuucgaggagguggcccagaacaccuacaccaacgccgacaagcugcuggaggccgccgagcagcuggcccagaccggcgagugcgaccccgaggagaucuacaaggccgccagacaccuggaggugagaauccaggacuucgugagaagaguggagcagagaaagcugcugcuggacaugagcgugagcuuccacacccacaccaaggagcuguggaccuggauggaggaccugcagaaggagaugcuggaggacgugugcgccgacagcguggacgccgugcaggagcugaucaagcaguuccagcagcagcagaccgccacccuggacgccacccugaacgugaucaaggagggcgaggaccugauccagcagcugagaagcgccccccccagccugggcgagcccagcgaggccagagacagcgccgugagcaacaacaagaccccccacagcagcagcaucagccacaucgagagcgugcugcagcagcuggacgacgcccaggugcagauggaggagcuguuccacgagagaaagaucaagcuggacaucuuccugcagcugagaaucuucgagcaguacaccaucgaggugaccgccgagcuggacgccuggaacgaggaccugcugagacagaugaacgacuucaacaccgaggaccugacccuggccgagcagagacugcagagacacaccgagagaaagcuggccaugaacaacaugaccuucgaggugauccagcagggccaggaccugcaccaguacaucaccgaggugcaggccagcggcaucgagcugaucugcgagaaggacaucgaccuggccgcccaggugcaggagcugcuggaguuccugcacgagaagcagcacgagcuggagcugaacgccgagcagacccacaagagacuggagcagugccugcagcugagacaccugcaggccgaggugaagcaggugcugggcuggaucagaaacggcgagagcaugcugaacgccagccuggugaacgccagcagccugagcgaggccgagcagcugcagagagagcacgagcaguuccagcuggccaucgagagccuguuccacgccaccagccugcagaagacccaccagagcgcccugcaggugcagcagaaggccgaggugcugcugcaggccggccacuacgacgccgacgccaucagagagugcgccgagaagguggcccugcacuggcagcagcugaugcugaagauggaggacagacugaagcuggugaacgccagcguggccuucuacaagaccagcgagcaggugugcagcgugcuggagagccuggagcaggaguacagaagagacgaggacuggugcggcggcagagacaagcugggccccgccgccgagaucgaccacgugaucccccugaucagcaagcaccuggagcagaaggaggccuuccugaaggccugcacccuggccagaagaaacgccgagguguuccugaaguacauccacagaaacaacgugagcaugcccagcguggccagccacaccagaggccccgagcagcaggugaaggccauccugagcgagcugcugcagagagagaacagagugcugcacuucuggacccugaagaagagaagacuggaccagugccagcaguacgugguguucgagagaagcgccaagcaggcccuggacuggauccaggagaccggcgaguucuaccugagcacccacaccagcaccggcgagaccaccgaggagacccaggagcugcugaaggaguacggcgaguucagagugcccgccaagcagaccaaggagaaggugaagcugcugauccagcuggccgacagcuucguggagaagggccacauccacgccaccgagaucagaaagugggugaccaccguggacaagcacuacagagacuucagccugagaaugggcaaguacagauacagccuggagaaggcccugggcgugaacaccgaggacaacaaggaccuggagcuggacaucauccccgccagccugagcgacagagaggugaagcugagagacgccaaccacgaggugaacgaggagaagagaaagagcgccagaaagaaggaguucaucauggccgagcugcugcagaccgagaaggccuacgugagagaccugcacgagugccuggagaccuaccugugggagaugaccagcggcguggaggagaucccccccggcauccugaacaaggagcacaucaucuucggcaacauccaggagaucuacgacuuccacaacaacaucuuccugaaggagcuggagaaguacgagcagcugcccgaggacgugggccacugcuucgugaccugggccgacaaguuccagauguacgugaccuacugcaagaacaagcccgacagcaaccagcugauccuggagcacgccggcaccuucuucgacgagauccagcagagacacggccuggccaacagcaucagcagcuaccugaucaagcccgugcagagaaucaccaaguaccagcugcugcugaaggagcugcugaccugcugcgaggagggcaagggcgagcugaaggacggccuggaggugaugcugagcgugcccaagaaggccaacgacgccaugcacgugagcaugcuggagggcuucgacgagaaccuggacgugcagggcgagcugauccugcaggacgccuuccaggugugggaccccaagagccugaucagaaagggcagagagagacaccuguuccuguucgagaucagccugguguucagcaaggagaucaaggacagcagcggccacaccaaguacguguacaagaacaagcugcugaccagcgagcugggcgugaccgagcacguggagggcgaccccugcaaguucgcccuguggagcggcagaacccccagcagcgacaacaagaccgugcugaaggccagcaacaucgagaccaagcaggaguggaucaagaacaucagagaggugauccaggagagaaucauccaccugaagggcgcccugaaggagccccugcagcugcccaagacccccgccaagcagagaaacaacagcaagagagacggcguggaggacaucgacagccagggcgacggcagcagccagcccgacaccaucagcaucgccagcagaaccagccagaacaccguggacagcgacaagcugagcggcggcugcgagcugaccguggugcugcaggacuucagcgccggccacagcagcgagcugaccauccaggugggccagaccguggagcugcuggagagacccagcgagagacccggcuggugccuggugagaaccaccgagagaagccccccccuggagggccuggugcccagcagcgcccugugcaucagccacagcagaagcagcguggagauggacugcuucuucccccuggugaaggacgccuacagccacagcagcagcgagaacggcggcaagagcgagagcguggccaaccugcaggcccagcccagccugaacagcauccacagcagccccggccccaagagaagcaccaacacccugaagaaguggcugaccagccccgugagaagacugaacagcggcaaggccgacggcaacaucaagaagcagaagaaggugagagacggcagaaagagcuucgaccugggcagccccaagcccggcgacgagaccaccccccagggcgacagcgccgacgagaagagcaagaagggcuggggcgaggacgagcccgacgaggagagccacaccccccugcccccccccaugaagaucuucgacaacgaccccacccaggacgagaugagcagcagccugcuggccgccagacaggccagcaccgaggugcccaccgccgccgaccuggugaacgccaucgagaagcuggugaagaacaagcugagccuggagggcagcagcuacagaggcagccugaaggaccccgccggcugccugaacgagggcauggccccccccaccccccccaagaaccccgaggaggagcagaaggccaaggcccugagaggcagaauguucgugcugaacgagcuggugcagaccgagaaggacuacgugaaggaccugggcaucgugguggagggcuucaugaagagaaucgaggagaagggcgugcccgaggacaugagaggcaaggacaagaucguguucggcaacauccaccagaucuacgacuggcacaaggacuucuuccuggccgagcuggagaagugcauccaggagcaggacagacuggcccagcuguucaucaagcacgagagaaagcugcacaucuacgugugguacugccagaacaagcccagaagcgaguacaucguggccgaguacgacgccuacuucgaggaggugaagcaggagaucaaccagagacugacccugagcgacuuccugaucaagcccauccagagaaucaccaaguaccagcugcugcugaaggacuuccugagauacagcgagaaggccggccuggagugcagcgacaucgagaaggccguggagcugaugugccuggugcccaagagaugcaacgacaugaugaaccugggcagacugcagggcuucgagggcacccugaccgcccagggcaagcugcugcagcaggacaccuucuacgugaucgagcuggacgccggcaugcagagcagaaccaaggagagaagaguguuccuguucgagcagaucgugaucuucagcgagcugcugagaaagggcagccugacccccggcuacauguucaagagaagcaucaagaugaacuaccuggugcuggaggagaacguggacaacgaccccugcaaguucgcccugaugaacagagagaccagcgagagaguggugcugcaggccgccaacgccgacauccagcaggccugggugcaggacaucaaccaggugcuggagacccagagagacuuccugaacgcccugcagagccccaucgaguaccagagaaaggagagaagcaccgccgugaugagaagccagcccgccagacugccccaggccagccccagacccuacagcagcgugcccgccggcagcgagaagccccccaagggcagcagcuacaaccccccccugcccccccugaagaucagcaccagcaacggcagccccggcuucgaguaccaccagcccggcgacaaguucgaggccagcaagcagaacgaccugggcggcugcaacggcaccagcagcauggccgugaucaaggacuacuacgcccugaaggagaacgagaucugcgugagccagggcgagguggugcaggugcuggccgugaaccagcagaacaugugccugguguaccagcccgccagcgaccacagccccgccgccgagggcugggugcccggcagcauccuggccccccugaccaaggccaccgccgccgagagcagcgacggcagcaucaagaagagcugcagcuggcacacccugagaaugagaaagagagccgagguggagaacaccggcaagaacgaggccaccggccccagaaagcccaaggacauccugggcaacaaggugagcgugaaggagaccaacagcagcgaggagagcgagugcgacgaccuggaccccaacaccagcauggagauccugaaccccaacuucauccaggagguggcccccgaguuccuggugccccugguggacgugaccugccugcugggcgacaccgugauccugcagugcaaggugugcggcagacccaagcccaccaucaccuggaagggccccgaccagaacauccuggacaccgacaacagcagcgccaccuacaccgugagcagcugcgacagcggcgagaucacccugaagaucugcaaccugaugccccaggacagcggcaucuacaccugcaucgccaccaacgaccacggcaccaccagcaccagcgccaccgugaaggugcagggcgugcccgccgcccccaacagacccaucgcccaggagagaagcugcaccagcgugauccugagauggcugccccccagcagcaccggcaacugcaccaucagcggcuacaccguggaguacagagaggagggcagccagaucuggcagcagagcguggccagcacccuggacaccuaccuggugaucgaggaccugagccccggcugccccuaccaguucagagugagcgccagcaaccccuggggcaucagccugcccagcgagcccagcgaguucgugagacugcccgaguacgacgccgccgccgacggcgccaccaucagcuggaaggagaacuucgacagcgccuacaccgagcugaacgagaucggcagaggcagauucagcaucgugaagaagugcauccacaaggccaccagaaaggacguggccgugaaguucgugagcaagaagaugaagaagaaggagcaggccgcccacgaggccgcccugcugcagcaccugcagcacccccaguacaucacccugcacgacaccuacgagagccccaccagcuacauccugauccuggagcugauggacgacggcagacugcuggacuaccugaugaaccacgacgagcugauggaggagaagguggccuucuacaucagagacaucauggaggcccugcaguaccugcacaacugcagaguggcccaccuggacaucaagcccgagaaccugcugaucgaccugagaauccccgugcccagagugaagcugaucgaccuggaggacgccgugcagaucagcggccacuuccacauccaccaccugcugggcaaccccgaguucgccgcccccgaggugauccagggcauccccgugagccugggcaccgacaucuggagcaucggcgugcugaccuacgugaugcugagcggcgugagccccuuccuggacgagagcaaggaggagaccugcaucaacgugugcagaguggacuucagcuucccccacgaguacuucugcggcgugagcaacgccgccagagacuucaucaacgugauccugcaggaggacuucagaagaagacccaccgccgccaccugccugcagcaccccuggcugcagccccacaacggcagcuacagcaagaucccccuggacaccagcagacuggccugcuucaucgagagaagaaagcaccagaacgacgugagacccauccccaacgugaagagcuacaucgugaacagagugaaccagggcaccuaa

SEQ ID NO: 18744 - RNA, 4059 nt, Artificial Sequence
  KANK1__Homo_sapiens__NP_001243806
auggcccacaccaccaaggugaacggcagcgccagcggcaaggccggcgacauccugagcggcgaccaggacaaggagcagaaggaccccuacuucguggagacccccuacggcuaccagcuggaccuggacuuccugaaguacguggacgacauccagaagggcaacaccaucaagagacugaacauccagaagagaagaaagcccagcgugcccugccccgagcccagaaccaccagcggccagcagggcaucuggaccagcaccgagagccugagcagcagcaacagcgacgacaacaagcagugccccaacuuccugaucgccagaagccaggugaccagcacccccaucagcaagcccccccccccccuggagaccagccugcccuuccugaccauccccgagaacagacagcugcccccccccagcccccagcugcccaagcacaaccugcacgugaccaagacccugauggagaccagaagaagacuggagcaggagagagccaccaugcagaugacccccggcgaguucagaagacccagacuggccagcuucggcggcaugggcaccaccagcagccugcccagcuucgugggcagcggcaaccacaaccccgccaagcaccagcugcagaacggcuaccagggcaacggcgacuacggcagcuacgcccccgccgcccccaccaccagcagcaugggcagcagcaucagacacagcccccugagcagcggcaucagcacccccgugaccaacgugagccccaugcaccugcagcacaucagagagcagauggccaucgcccugaagagacugaaggagcuggaggagcaggugagaaccauccccgugcugcaggugaagaucagcgugcugcaggaggagaagagacagcuggugagccagcugaagaaccagagagccgccagccagaucaacgugugcggcgugagaaagagaagcuacagcgccggcaacgccagccagcuggagcagcugagcagagccagaagaagcggcggcgagcuguacaucgacuacgaggaggaggagauggagaccguggagcagagcacccagagaaucaaggaguucagacagcugaccgccgacaugcaggcccuggagcagaagauccaggacagcagcugcgaggccagcagcgagcugagagagaacggcgagugcagaagcguggccgugggcgccgaggagaacaugaacgacaucgugguguaccacagaggcagcagaagcugcaaggacgccgccgugggcacccugguggagaugagaaacugcggcgugagcgugaccgaggccaugcugggcgugaugaccgaggccgacaaggagaucgagcugcagcagcagaccaucgagagccugaaggagaagaucuacagacuggaggugcagcugagagagaccacccacgacagagagaugaccaagcugaagcaggagcugcaggccgccggcagcagaaagaagguggacaaggccaccauggcccagccccugguguucagcaaggugguggaggccguggugcagaccagagaccagauggugggcagccacauggaccugguggacaccugcgugggcaccagcguggagaccaacagcgugggcaucagcugccagcccgagugcaagaacaagguggugggccccgagcugcccaugaacugguggaucgugaaggagagaguggagaugcacgacagaugcgccggcagaagcguggagaugugcgacaagagcgugagcguggaggugagcgugugcgagaccggcagcaacaccgaggagagcgugaacgaccugacccugcugaagaccaaccugaaccugaaggaggugagaagcaucggcugcggcgacugcagcguggacgugaccgugugcagccccaaggagugcgccagcagaggcgugaacaccgaggccgugagccagguggaggccgccgugauggccgugcccagaaccgccgaccaggacaccagcaccgaccuggagcaggugcaccaguucaccaacaccgagaccgccacccugaucgagagcugcaccaacaccugccugagcacccuggacaagcagaccagcacccagaccguggagaccagaaccguggccgugggcgagggcagagugaaggacaucaacagcagcaccaagaccagaagcaucggcgugggcacccugcugagcggccacagcggcuucgacagacccagcgccgugaagaccaaggagagcggcgugggccagaucaacaucaacgacaacuaccuggugggccugaagaugagaaccaucgccugcggccccccccagcugaccgugggccugaccgccagcagaagaagcgugggcgugggcgacgaccccgugggcgagagccuggagaacccccagccccaggccccccugggcaugaugaccggccuggaccacuacaucgagagaauccagaagcugcuggccgagcagcagacccugcuggccgagaacuacagcgagcuggccgaggccuucggcgagccccacagccagaugggcagccugaacagccagcugaucagcacccugagcagcaucaacagcgugaugaagagcgccagcaccgaggagcugagaaaccccgacuuccagaagaccagccugggcaagaucaccggcaacuaccugggcuacaccugcaagugcggcggccugcagagcggcagcccccugagcagccagaccagccagcccgagcaggaggugggcaccagcgagggcaagcccaucagcagccuggacgccuuccccacccaggagggcacccugagccccgugaaccugaccgacgaccagaucgccgccggccuguacgccugcaccaacaacgagagcacccugaagagcaucaugaagaagaaggacggcaacaaggacagcaacggcgccaagaagaaccugcaguucgugggcaucaacggcggcuacgagaccaccagcagcgacgacagcagcagcgacgagagcagcagcagcgagagcgacgacgagugcgacgugaucgaguacccccuggaggaggaggaggaggaggaggacgaggacaccagaggcauggccgagggccaccacgccgugaacaucgagggccugaagagcgccagaguggaggacgagaugcaggugcaggagugcgagcccgagaagguggagaucagagagagauacgagcugagcgagaagaugcugagcgccugcaaccugcugaagaacaccaucaacgaccccaaggcccugaccagcaaggacaugagauucugccugaacacccugcagcacgagugguucagagugagcagccagaagagcgccauccccgccauggugggcgacuacaucgccgccuucgaggccaucagccccgacgugcugagauacgugaucaaccuggccgacggcaacggcaacaccgcccugcacuacagcgugagccacagcaacuucgagaucgugaagcugcugcuggacgccgacgugugcaacguggaccaccagaacaaggccggcuacacccccaucaugcuggccgcccuggccgccguggaggccgagaaggacaugagaaucguggaggagcuguucggcugcggcgacgugaacgccaaggccagccaggccggccagaccgcccugaugcuggccgugagccacggcagaaucgacauggugaagggccugcuggccugcggcgccgacgugaacauccaggacgacgagggcagcaccgcccugaugugcgccagcgagcacggccacguggagaucgugaagcugcugcuggcccagcccggcugcaacggccaccuggaggacaacgacggcagcaccgcccugagcaucgcccuggaggccggccacaaggacaucgccgugcugcuguacgcccacgugaacuucgccaaggcccagagccccggcacccccagacugggcagaaagaccagccccggccccacccacagaggcagcuucgacuaa

SEQ ID NO: 18745 - RNA, 2556 nt, Artificial Sequence
  KANK2__Homo_sapiens__NP_001129663
auggcccaggugcugcacgugcccgcccccuuccccggcacccccggccccgccagcccccccgccuuccccgccaaggaccccgacccccccuacagcguggagacccccuacggcuacagacuggaccuggacuuccugaaguacguggacgacaucgagaagggccacacccugagaagaguggccgugcagagaagacccagacugagcagccugcccagaggccccggcagcugguggaccagcaccgagagccugugcagcaacgccagcggcgacagcagacacagcgccuacagcuacugcggcagaggcuucuacccccaguacggcgcccuggagaccagaggcggcuucaaccccagaguggagagaacccugcuggacgccagaagaagacuggaggaccaggccgccacccccaccggccugggcagccugacccccagcgccgccggcagcaccgccagccuggugggcgugggccugcccccccccacccccagaagcagcggccugagcacccccgugccccccagcgccggccaccuggcccacgugagagagcagauggccggcgcccugagaaagcugagacagcuggaggagcaggugaagcugauccccgugcugcaggugaagcugagcgugcugcaggaggagaagagacagcugaccgugcagcugaagagccagaaguuccugggccaccccaccgccggcagaggcagaagcgagcugugccuggaccugcccgacccccccgaggaccccguggcccuggagaccagaagcgugggcaccugggugagagagagagaccugggcaugcccgacggcgaggccgcccuggccgccaagguggccgugcuggagacccagcugaagaaggcccugcaggagcugcaggccgcccaggccagacaggccgacccccagccccaggccuggcccccccccgacagccccgugagaguggacaccgugagagugguggagggccccagagagguggaggugguggccagcaccgccgccggcgcccccgcccagagagcccagagccuggagcccuacggcaccggccugagagcccuggccaugcccggcagacccgagagcccccccguguucagaagccaggaggugguggagaccaugugccccgugcccgccgccgccaccagcaacgugcacauggugaagaagaucagcaucaccgagagaagcugcgacggcgccgccggccugcccgaggugcccgccgagagcagcagcagcccccccggcagcgagguggccagccugacccagcccgagaagagcaccggcagagugcccacccaggagcccacccacagagagcccaccagacaggccgccagccaggagagcgaggaggccggcggcaccggcggcccccccgccggcgugagaagcaucaugaagagaaaggaggagguggccgaccccaccgcccacagaagaagccugcaguucgugggcgugaacggcggcuacgagagcagcagcgaggacagcagcaccgccgagaacaucagcgacaacgacagcaccgagaacgaggcccccgagcccagagagagagugcccagcguggccgaggccccccagcugagacccgccggcaccgccgccgccaagaccagcagacaggagugccagcugagcagagagagccagcacauccccaccgccgagggcgccagcggcagcaacaccgaggaggagaucagaauggagcugagccccgaccugaucagcgccugccuggcccuggagaaguaccuggacaaccccaacgcccugaccgagagagagcugaagguggccuacaccaccgugcugcaggaguggcugagacuggccugcagaagcgacgcccaccccgagcuggugagaagacaccuggugaccuucagagccaugagcgccagacugcuggacuacguggugaacaucgccgacagcaacggcaacaccgcccugcacuacagcgugagccacgccaacuuccccguggugcagcagcugcuggacagcggcgugugcaagguggacaagcagaacagagccggcuacagccccaucaugcugaccgcccuggccacccugaagacccaggacgacaucgagaccgugcugcagcuguucagacugggcaacaucaacgccaaggccagccaggccggccagaccgcccugaugcuggccgugagccacggcagaguggacguggugaaggcccugcuggccugcgaggccgacgugaacgugcaggacgacgacggcagcaccgcccugaugugcgccugcgagcacggccacaaggagaucgccggccugcugcuggccgugcccagcugcgacaucagccugaccgacagagacggcagcaccgcccugaugguggcccuggacgccggccagagcgagaucgccagcaugcuguacagcagaaugaacaucaagugcagcuucgcccccaugagcgacgacgagagccccaccagcagcagcgccgaggaguaa

SEQ ID NO: 18746 - RNA, 1104 nt, Artificial Sequence
  KANK4__Homo_sapiens__NP_001307198
auggagaagaccgacgagaucagccccagcaccagccugaagagcaucaugaagaagaaggacuacggcuucagagccggcggcaacggcaccaagaagaaccugcaguucgugggcgugaacggcggcuacgagaccaccagcagcgaggagaccagcggcgaggacagcacccccgaggaccugagcgacagcgaggccgagaagaagugcgacggccccgaccacaagcacgugaaggacgcccaccugaccugcgaggccggccagggcauccccgagggcaccugccacgccgcccaggagagcggccccggcgaggaggugccccacagcaaggccgagagauacaagcccagcgaggaguuccugaacgccugcagagcccugagccagcaccugcccgagaccggcaccaccaccgaccagcugcugagacagagccugaacaccaucagccaggagugguucagagugagcagcagaaagagcagcagccccgccgugguggccagcuaccugcacgaggugcagccccacagcccccacuuccugaagcugcuggugaaccuggccgaccacaacggcaacaccgcccugcacuacagcgugagccacagcaacuucagcaucgugaagcugcugcuggagaccggcgugugcaacguggaccaccagaacaaggccggcuacaccgccgugaugaucaccccccuggccagcgccgagaccaacgaggacauggccgugguguggaagcugcugagagagggcaacgugaacauccaggccacccagggcggccagaccgcccugaugcugggcgugagccacgacagagaggacauggugcaggcccugcugagcugccaggccgacgugaaccugcaggaccacgacggcagcagcgcccugaugguggccugccaccacggcaacguggaccuggugagacugcugcuggcccaccccgccugcgacagcagccugaccgacaaggccggcagaaccgcccugagcaucgcccugaagagccccacccacauggagaucgccggccugcugagagcccacgccgagcagggcagaagccugggccuguaa

SEQ ID NO: 18747 - RNA, 3318 nt, Artificial Sequence
  KANSL1__Homo_sapiens__XP_005275701
auggccgccauggcccccgcccugaccgacgccgccgccgaggcccaccacaucagauucaagcuggccccccccagcagcacccugagccccggcagcgccgagaacaacggcaacgccaacauccugaucgccgccaacggcaccaagagaaaggccaucgccgccgaggaccccagccuggacuucagaaacaaccccaccaaggaggaccugggcaagcugcagccccugguggccagcuaccugugcagcgacgugaccagcgugcccagcaaggagagccugaagcugcagggcguguucagcaagcagaccgugcugaagagccacccccugcugagccagagcuacgagcugagagccgagcugcugggcagacagcccgugcuggaguucagccuggagaaccugagaaccaugaacaccagcggccagaccgcccugccccaggcccccgugaacggccuggccaagaagcugaccaagagcagcacccacagcgaccacgacaacagcaccagccugaacggcggcaagagagcccugaccagcagcgcccugcacggcggcgagaugggcggcagcgagagcggcgaccugaagggcggcaugaccaacugcacccugccccacagaagccuggacguggagcacaccacccuguacagcaacaacagcaccgccaacaagagcagcgugaacagcauggagcagcccgcccugcagggcagcagcagacugagccccggcaccgacagcagcagcaaccugggcggcgugaagcuggagggcaagaagagcccccugagcagcauccuguucagcgcccuggacagcgacaccagaaucaccgcccugcugagaagacaggccgacaucgagagcagagccagaagacugcagaagagacugcagguggugcaggccaagcagguggagagacacauccagcaccagcugggcggcuuccuggagaagacccugagcaagcugcccaaccuggagagccugagacccagaagccagcugaugcugaccagaaaggccgaggccgcccugagaaaggccgccagcgagaccaccaccagcgagggccugagcaacuuccugaagagcaacagcaucagcgaggagcuggagagauucaccgccagcggcaucgccaaccugagaugcagcgagcaggccuucgacagcgacgugaccgacagcagcagcggcggcgagagcgacaucgaggaggaggagcugaccagagccgaccccgagcagagacacgugccccugagaagaagaagcgaguggaagugggccgccgacagagccgccaucgugagcagauggaacuggcugcaggcccacgugagcgaccuggaguacagaaucagacagcagaccgacaucuacaagcagaucagagccaacaagggccugaucgugcugggcgaggugcccccccccgagcacaccaccgaccuguuccugccccugagcagcgaggugaagaccgaccacggcaccgacaagcugaucgagagcgugagccagccccuggagaaccacggcgcccccaucaucggccacaucagcgagagccugagcaccaagagcugcggcgcccugagacccgugaacggcgugaucaacacccugcagcccgugcuggccgaccacauccccggcgacagcagcgacgccgaggagcagcugcacaagaagcagagacugaaccuggugagcagcagcagcgacggcaccugcguggccgccagaaccagacccgugcugagcugcaagaagagaagacuggugagacccaacagcaucgugccccugagcaagaaggugcacagaaacagcaccaucagacccggcugcgacgugaaccccagcugcgcccugugcggcagcggcagcaucaacaccaugccccccgagauccacuacgaggccccccugcuggagagacugagccagcuggacagcugcgugcaccccgugcuggccuuccccgacgacgugcccaccagccugcacuuccagagcaugcugaagagccaguggcagaacaagcccuucgacaagaucaagccccccaagaagcugagccugaagcacagagcccccaugcccggcagccugcccgaccccgccagaaaggacagacacaagcuggugagcagcuuccugaccaccgccaagcugagccaccaccagaccagacccgacagaacccacagacagcaccuggacgacgugggcgccgugcccaugguggagagagugaccgcccccaaggccgagagacugcugaacccccccccccccgugcacgaccccaaccacagcaagaugagacugagagaccacagcagcgagagaagcgaggugcugaagcaccacaccgacaugagcagcagcagcuaccuggccgccacccaccaccccccccacagcccccuggugagacagcugagcaccagcagcgacagccccgcccccgccagcagcagcagccaggugaccgccagcaccagccagcagcccgugagaagaagaagaggcgagagcagcuucgacaucaacaacaucgugauccccaugagcguggccgccaccaccagaguggagaagcugcaguacaaggagauccugacccccagcuggagagagguggaccugcagagccugaagggcagccccgacgaggagaacgaggagaucgaggaccugagcgacgccgccuucgccgcccugcacgccaagugcgaggagauggagagagccagauggcuguggaccaccagcgugcccccccagagaagaggcagcagaagcuacagaagcagcgacggcagaaccaccccccagcugggcagcgccaaccccagcaccccccagcccgccagccccgacgugagcagcagccacagccugagcgaguacagccacggccagagccccagaagccccaucagccccgagcugcacagcgccccccugacccccguggccagagacacccccagacaccuggccagcgaggacaccagaugcagcacccccgagcugggccuggacgagcagagcgugcagcccugggagagaagaaccuucccccuggcccacagcccccaggccgagugcgaggaccagcuggacgcccaggagagagccgccagaugcaccagaagaaccagcggcagcaagaccggcagagagaccgaggccgcccccaccagcccccccaccgugccccugaagagcagacaccugguggccgccgccaccgcccagagacccacccacagauaa

SEQ ID NO: 18748 - RNA, 2637 nt, Artificial Sequence
  KANSL3__Homo_sapiens__NP_001108488
auggcccacagaggcggcgagagagacuuccagaccagcgccagaagaaugggcaccagccugcuguuccagcugagcgugcacgagagagagcuggaccugguguuccuggaccacagcuacgccaagcccuggagcgcccaccccgacgccagcagcgccagacccaccagaaugcuguucgugacccccagaagacagcacgagagcaccaucgagagcgacgugcccaucgacguggagaccgugaccagcacccccaugccccuguacgacaaccagaaggccagaagcgugaugaacgagugcgagagacacgugaucuucgccagaaccgacgccgacgccccccccccccccgaggacugggaggagcacgugaacagaaccggcuggaccauggcccagaacaagcuguucaacaagauccugaaggcccugcagagcgacagacuggccagacuggccaacgagggcgccugcaacgagcccgugcugagaagaguggccguggacaagugcgccagaagagugagacaggcccuggccagcgugagcugggacaccaagcugauccaguggcugcacaccacccugguggagacccugagccugcccaugcuggccgccuaccuggacgcccugcagacccugaagggcaagauccccacccugaucgacagaaugcuggugagcagcaacaccaagaccggcgccgccggcgccgaggcccugagccugcugcugaagagacccugggaccccgccgugggcgugcugagccacaacaagcccagcaagcugcccggcagcccccugauccugaucgccagcagcggccccagcagcagcguguuccccaccagcagaagacacagauucuggcagagccagcugagcugccugggcaaggugauccccguggccacccaccugcugaacaacggcagcggcgugggcgugcugcagugccuggagcacaugaucggcgccgugagaagcaaggugcuggagauccacagccacuucccccacaagcccaucauccugaucggcuggaacaccggcgcccugguggccugccacgugagcgugauggaguacgugaccgccguggugugccugggcuucccccugcugaccguggacggccccagaggcgacguggacgacccccugcuggacaugaagacccccgugcuguucgugaucggccagaacagccugcagugccaccccgaggccauggaggacuucagagagaagaucagagccgagaacagccuggugguggugggcggcgccgacgacaaccugagaaucagcaaggccaagaagaagagcgagggccugacccagagcaugguggacagaugcauccaggacgagaucguggacuuccugaccggcgugcugaccagagccgagggccacaugggcagcgagcccagagaccaggacgccgagaagaagaagaagcccagagacguggccagaagagaccuggccuucgaggugcccgagagaggcagcagacccgccagccccgccgccaagcugcccgccagccccagcggcagcgaggaccugagcagcgugagcagcagccccaccagcagccccaagaccaaggugaccaccgugaccagcgcccagaagagcagccagaucggcagcagccagcugcugaagagacacgugcagagaaccgaggccgugcugacccacaagcaggcccaggugcccaucagcagcgagccccccgaggagggcgagaaggaggaccugagagugcagcugaagagacaccaccccagcagcccccugcccggcagcaagaccagcaagagacccaagaucaaggugagccugaucagccagggcgacaccgccggcggccccugcgcccccagccagggcagcgcccccgaggccgccggcggcaagcccaucaccaugacccugggccaggccagcgccggcgccaaggagcugaccggccugcugaccaccgccaagagcagcagcagcgagggcggcgugagcgccagccccgugcccagcguggugagcagcagcaccgcccccagcgcccugcacacccugcagagcagacugguggccaccagccccggcagcagccugcccggcgccaccagcgccagcagccugcugcagggccugagcuucagccugcaggacaucagcagcaagaccagcggccugcccgccaaccccagccccggccccgccccccaggccaccagcgugaagcugcccacccccaugcagagccugggcgccaucaccaccggcaccagcaccaucgugagaaccauccccguggccaccacccugagcagccugggcgccacccccggcggcaagcccaccgccauccaccagcugcugaccaacggcggccuggccaagcuggccagcagccugcccggccuggcccagaucagcaaccaggccagcggccugaaggugcccaccaccaucacccugacccugagaggccagcccagcagaaucaccacccugagccccaugggcagcggcgccgcccccagcgaggagagcagcagccaggugcugcccagcagcagccagagacugccccccgcccccuaa

SEQ ID NO: 18749 - RNA, 1878 nt, Artificial Sequence
  KARS__Homo_sapiens__NP_001123561
augcugacccaggccgccgugagacuggugagaggcagccugagaaagaccagcugggccgaguggggccacagagagcugagacugggccagcuggcccccuucaccgccccccacaaggacaagagcuucagcgaccagagaagcgagcugaagagaagacugaaggccgagaagaagguggccgagaaggaggccaagcagaaggagcugagcgagaagcagcugagccaggccaccgccgccgccaccaaccacaccaccgacaacggcgugggccccgaggaggagagcguggaccccaaccaguacuacaagaucagaagccaggccauccaccagcugaaggugaacggcgaggaccccuacccccacaaguuccacguggacaucagccugaccgacuucauccagaaguacagccaccugcagcccggcgaccaccugaccgacaucacccugaagguggccggcagaauccacgccaagagagccagcggcggcaagcugaucuucuacgaccugagaggcgagggcgugaagcugcaggugauggccaacagcagaaacuacaagagcgaggaggaguucauccacaucaacaacaagcugagaagaggcgacaucaucggcgugcagggcaaccccggcaagaccaagaagggcgagcugagcaucauccccuacgagaucacccugcugagccccugccugcacaugcugccccaccugcacuucggccugaaggacaaggagaccagauacagacagagauaccuggaccugauccugaacgacuucgugagacagaaguucaucaucagaagcaagaucaucaccuacaucagaagcuuccuggacgagcugggcuuccuggagaucgagacccccaugaugaacaucauccccggcggcgccguggccaagcccuucaucaccuaccacaacgagcuggacaugaaccuguacaugagaaucgcccccgagcuguaccacaagaugcugguggugggcggcaucgacagaguguacgagaucggcagacaguucagaaacgagggcaucgaccugacccacaaccccgaguucaccaccugcgaguucuacauggccuacgccgacuaccacgaccugauggagaucaccgagaagauggugagcggcauggugaagcacaucaccggcagcuacaaggugaccuaccaccccgacggccccgagggccaggccuacgacguggacuucaccccccccuucagaagaaucaacaugguggaggagcuggagaaggcccugggcaugaagcugcccgagaccaaccuguucgagaccgaggagaccagaaagauccuggacgacaucugcguggccaaggccguggagugccccccccccagaaccaccgccagacugcuggacaagcuggugggcgaguuccuggaggugaccugcaucaaccccaccuucaucugcgaccacccccagaucaugagcccccuggccaaguggcacagaagcaaggagggccugaccgagagauucgagcuguucgugaugaagaaggagaucugcaacgccuacaccgagcugaacgaccccaugagacagagacagcuguucgaggagcaggccaaggccaaggccgccggcgacgacgaggccauguucaucgacgagaacuucugcaccgcccuggaguacggccugccccccaccgccggcuggggcaugggcaucgacagaguggccauguuccugaccgacagcaacaacaucaaggaggugcugcuguuccccgccaugaagcccgaggacaagaaggagaacguggccaccaccgacacccuggagagcaccaccgugggcaccagcguguaa

SEQ ID NO: 18750 - RNA, 2514 nt, Artificial Sequence
  KAT2A__Homo_sapiens__NP_066564
auggccgagcccagccaggcccccacccccgcccccgccgcccagcccagaccccugcagagccccgcccccgcccccacccccacccccgcccccagccccgccagcgcccccauccccacccccacccccgcccccgcccccgcccccgccgccgcccccgccggcagcaccggcaccggcggccccggcgugggcagcggcggcgccggcagcggcggcgaccccgccagacccggccugagccagcagcagagagccagccagagaaaggcccaggugagaggccugcccagagccaagaagcuggagaagcugggcguguucagcgccugcaaggccaacgagaccugcaagugcaacggcuggaagaaccccaagccccccaccgcccccagaauggaccugcagcagcccgccgccaaccugagcgagcugugcagaagcugcgagcacccccuggccgaccacgugagccaccuggagaacgugagcgaggacgagaucaacagacugcugggcauggugguggacguggagaaccuguucaugagcgugcacaaggaggaggacaccgacaccaagcagguguacuucuaccuguucaagcugcugagaaagugcauccugcagaugaccagacccgugguggagggcagccugggcagcccccccuucgagaagcccaacaucgagcagggcgugcugaacuucgugcaguacaaguucagccaccuggcccccagagagagacagaccauguucgagcugagcaagauguuccugcugugccugaacuacuggaagcuggagacccccgcccaguucagacagagaagccaggccgaggacguggccaccuacaaggugaacuacaccagauggcugugcuacugccacgugccccagagcugcgacagccugcccagauacgagaccacccacguguucggcagaagccugcugagaagcaucuucaccgugaccagaagacagcugcuggagaaguucagaguggagaaggacaagcuggugcccgagaagagaacccugauccugacccacuuccccaaguuccugagcaugcuggaggaggagaucuacggcgccaacagccccaucugggagagcggcuucaccaugccccccagcgagggcacccagcuggugcccagacccgccagcgugagcgccgccguggugcccagcacccccaucuucagccccagcaugggcggcggcagcaacagcagccugagccuggacagcgccggcgccgagcccaugcccggcgagaagagaacccugcccgagaaccugacccuggaggacgccaagagacugagagugaugggcgacauccccauggagcuggugaacgaggugaugcugaccaucaccgaccccgccgccaugcugggccccgagaccagccugcugagcgccaacgccgccagagacgagaccgccagacuggaggagagaagaggcaucaucgaguuccacgugaucggcaacagccugacccccaaggccaacagaagagugcugcuguggcuggugggccugcagaacguguucagccaccagcugcccagaaugcccaaggaguacaucgccagacugguguucgaccccaagcacaagacccuggcccugaucaaggacggcagagugaucggcggcaucugcuucagaauguuccccacccagggcuucaccgagaucguguucugcgccgugaccagcaacgagcaggugaagggcuacggcacccaccugaugaaccaccugaaggaguaccacaucaagcacaacauccuguacuuccugaccuacgccgacgaguacgccaucggcuacuucaagaagcagggcuucagcaaggacaucaaggugcccaagagcagauaccugggcuacaucaaggacuacgagggcgccacccugauggagugcgagcugaaccccagaauccccuacaccgagcugagccacaucaucaagaagcagaaggagaucaucaagaagcugaucgagagaaagcaggcccagaucagaaagguguaccccggccugagcugcuucaaggagggcgugagacagauccccguggagagcgugcccggcaucagagagaccggcuggaagccccugggcaaggagaagggcaaggagcugaaggaccccgaccagcuguacaccacccugaagaaccugcuggcccagaucaagagccaccccagcgccuggcccuucauggagcccgugaagaagagcgaggcccccgacuacuacgaggugaucagauuccccaucgaccugaagaccaugaccgagagacugagaagcagauacuacgugaccagaaagcuguucguggccgaccugcagagagugaucgccaacugcagagaguacaacccccccgacagcgaguacugcagaugcgccagcgcccuggagaaguucuucuacuucaagcugaaggagggcggccugaucgacaaguaa

SEQ ID NO: 18751 - RNA, 2499 nt, Artificial Sequence
  KAT2B__Homo_sapiens__NP_003875
augagcgaggccggcggcgccggccccggcggcugcggcgccggcgccggcgccggcgccggccccggcgcccugcccccccagcccgccgcccugccccccgcccccccccagggcagccccugcgccgccgccgccggcggcagcggcgccugcggccccgccaccgccguggccgccgccggcaccgccgagggccccggcggcggcggcagcgccagaaucgccgugaagaaggcccagcugagaagcgcccccagagccaagaagcuggagaagcugggcguguacagcgccugcaaggccgaggagagcugcaagugcaacggcuggaagaaccccaaccccagccccaccccccccagagccgaccugcagcagaucaucgugagccugaccgagagcugcagaagcugcagccacgcccuggccgcccacgugagccaccuggagaacgugagcgaggaggagaugaacagacugcugggcaucgugcuggacguggaguaccuguucaccugcgugcacaaggaggaggacgccgacaccaagcagguguacuucuaccuguucaagcugcugagaaagagcauccugcagagaggcaagcccgugguggagggcagccuggagaagaagccccccuucgagaagcccagcaucgagcagggcgugaacaacuucgugcaguacaaguucagccaccugcccgccaaggagagacagaccaucguggagcuggccaagauguuccugaacagaaucaacuacuggcaccuggaggcccccagccagagaagacugagaagccccaacgacgacaucagcggcuacaaggagaacuacaccagauggcugugcuacugcaacgugccccaguucugcgacagccugcccagauacgagaccacccagguguucggcagaacccugcugagaagcguguucaccgugaugagaagacagcugcuggagcaggccagacaggagaaggacaagcugccccuggagaagagaacccugauccugacccacuuccccaaguuccugagcaugcuggaggaggagguguacagccagaacagccccaucugggaccaggacuuccugagcgccagcagcagaaccagccagcugggcauccagaccgugaucaaccccccccccguggccggcaccaucagcuacaacagcaccagcagcagccuggagcagcccaacgccggcagcagcagccccgccugcaaggccagcagcggccuggaggccaaccccggcgagaagagaaagaugaccgacagccacgugcuggaggaggccaagaagcccagagugaugggcgacauccccauggagcugaucaacgaggugaugagcaccaucaccgaccccgccgccaugcugggccccgagaccaacuuccugagcgcccacagcgccagagacgaggccgccagacuggaggagagaagaggcgugaucgaguuccacguggugggcaacagccugaaccagaagcccaacaagaagauccugauguggcuggugggccugcagaacguguucagccaccagcugcccagaaugcccaaggaguacaucaccagacugguguucgaccccaagcacaagacccuggcccugaucaaggacggcagagugaucggcggcaucugcuucagaauguuccccagccagggcuucaccgagaucguguucugcgccgugaccagcaacgagcaggugaagggcuacggcacccaccugaugaaccaccugaaggaguaccacaucaagcacgacauccugaacuuccugaccuacgccgacgaguacgccaucggcuacuucaagaagcagggcuucagcaaggagaucaagauccccaagaccaaguacgugggcuacaucaaggacuacgagggcgccacccugaugggcugcgagcugaaccccagaauccccuacaccgaguucagcgugaucaucaagaagcagaaggagaucaucaagaagcugaucgagagaaagcaggcccagaucagaaagguguaccccggccugagcugcuucaaggacggcgugagacagauccccaucgagagcauccccggcaucagagagaccggcuggaagcccagcggcaaggagaagagcaaggagcccagagaccccgaccagcuguacagcacccugaagagcauccugcagcaggugaagagccaccagagcgccuggcccuucauggagcccgugaagagaaccgaggcccccggcuacuacgaggugaucagauuccccauggaccugaagaccaugagcgagagacugaagaacagauacuacgugagcaagaagcuguucauggccgaccugcagagaguguucaccaacugcaaggaguacaacccccccgagagcgaguacuacaagugcgccaacauccuggagaaguucuucuucagcaagaucaaggaggccggccugaucgacaaguaa

SEQ ID NO: 18752 - RNA, 1485 nt, Artificial Sequence
  KAT5__Homo_sapiens__NP_001193762
auggccgagguggugagccccgugcccggcgccggcagaagagagcccggcgaggugggcagagccagaggcccccccguggccgaccccggcguggcccugagcccccagggcgagaucaucgagggcugcagacugcccgugcugagaagaaaccaggacaacgaggacgaguggccccuggccgagauccugagcgugaaggacaucagcggcagaaagcuguucuacgugcacuacaucgacuucaacaagagacuggacgagugggugacccacgagagacuggaccugaagaagauccaguuccccaagaaggaggccaagacccccaccaagaacggccugcccggcagcagacccggcagccccgagagagaggugaagagaaagguggagguggugagccccgccacccccgugcccagcgagaccgcccccgccagcguguucccccagaacggcgccgccagaagagccguggccgcccagcccggcagaaagagaaagagcaacugccugggcaccgacgaggacagccaggacagcagcgacggcauccccagcgcccccagaaugaccggcagccuggugagcgacagaagccacgacgacaucgugaccagaaugaagaacaucgagugcaucgagcugggcagacacagacugaagcccugguacuucagccccuacccccaggagcugaccacccugcccgugcuguaccugugcgaguucugccugaaguacggcagaagccugaagugccugcagagacaccugaccaagugcgaccugagacacccccccggcaacgagaucuacagaaagggcaccaucagcuucuucgagaucgacggcagaaagaacaagagcuacagccagaaccugugccugcuggccaagugcuuccuggaccacaagacccuguacuacgacaccgaccccuuccuguucuacgugaugaccgaguacgacugcaagggcuuccacaucgugggcuacuucagcaaggagaaggagagcaccgaggacuacaacguggccugcauccugacccugccccccuaccagagaagaggcuacggcaagcugcugaucgaguucagcuacgagcugagcaagguggagggcaagaccggcacccccgagaagccccugagcgaccugggccugcugagcuacagaagcuacuggagccagaccauccuggagauccugaugggccugaagagcgagagcggcgagagaccccagaucaccaucaacgagaucagcgagaucaccagcaucaagaaggaggacgugaucagcacccugcaguaccugaaccugaucaacuacuacaagggccaguacauccugacccugagcgaggacaucguggacggccacgagagagccaugcugaagagacugcugagaaucgacagcaagugccugcacuucacccccaaggacuggagcaagagaggcaagugguaa

SEQ ID NO: 18753 - RNA, 6015 nt, Artificial Sequence
  KAT6A__Homo_sapiens__NP_006757
auggugaagcuggccaacccccuguacaccgaguggauccuggaggccaucaagaaggugaagaagcagaagcagagacccagcgaggagagaaucugcaacgccgugagcagcagccacggccuggacagaaagaccgugcuggagcagcuggagcugagcgugaaggacggcaccauccugaaggugagcaacaagggccugaacagcuacaaggaccccgacaaccccggcagaaucgcccugcccaagcccagaaaccacggcaagcuggacaacaagcagaacguggacuggaacaagcugaucaagagagccguggagggccuggccgagagcggcggcagcacccugaagagcaucgagagauuccugaagggccagaaggacgugagcgcccuguucggcggcagcgccgccagcggcuuccaccagcagcugagacuggccaucaagagagccaucggccacggcagacugcugaaggacggcccccuguacagacugaacaccaaggccaccaacguggacggcaaggagagcugcgagagccugagcugccugccccccgugagccugcugccccacgagaaggacaagcccguggccgagcccauccccaucugcagcuucugccugggcaccaaggagcagaacagagagaagaagcccgaggagcugaucagcugcgccgacugcggcaacagcggccaccccagcugccugaaguucagccccgagcugaccgugagagugaaggcccugagauggcagugcaucgagugcaagaccugcagcagcugcagagaccagggcaagaacgccgacaacaugcuguucugcgacagcugcgacagaggcuuccacauggagugcugcgaccccccccugaccagaaugcccaagggcauguggaucugccagaucugcagacccagaaagaagggcagaaagcugcugcagaagaaggccgcccagaucaagagaagauacaccaaccccaucggcagacccaagaacagacugaagaagcagaacaccgugagcaagggccccuucagcaaggugagaaccggccccggcagaggcagaaagagaaagaucacccugagcagccagagcgccagcagcagcagcgaggagggcuaccuggagagaaucgacggccuggacuucugcagagacagcaacgugagccugaaguucaacaagaagaccaagggccugaucgacggccugaccaaguucuucacccccagccccgacggcagaaaggccagaggcgaggugguggacuacagcgagcaguacagaaucagaaagagaggcaacagaaagagcagcaccagcgacuggcccaccgacaaccaggacggcugggacggcaagcaggagaacgaggagagacuguucggcagccaggagaucaugaccgagaaggacauggagcuguucagagacauccaggagcaggcccugcagaaggugggcgugaccggcccccccgacccccaggugagaugccccagcgugaucgaguucggcaaguacgagauccacaccugguacagcagccccuacccccaggaguacagcagacugcccaagcuguaccugugcgaguucugccugaaguacaugaagagcagaaccauccugcagcagcacaugaagaagugcggcugguuccacccccccgccaacgagaucuacagaaagaacaacaucagcguguucgagguggacggcaacgugagcaccaucuacugccagaaccugugccugcuggccaagcuguuccuggaccacaagacccuguacuacgacguggagcccuuccuguucuacgugcugacccagaacgacgugaagggcugccaccuggugggcuacuucagcaaggagaagcacugccagcagaaguacaacgugagcugcaucaugauccugccccaguaccagagaaagggcuacggcagauuccugaucgacuucagcuaccugcugagcaagagagagggccaggccggcagccccgagaagccccugagcgaccugggcagacugagcuacauggccuacuggaagagcgugauccuggagugccuguaccaccagaacgacaagcagaucagcaucaagaagcugagcaagcugaccggcaucugcccccaggacaucaccagcacccugcaccaccugagaaugcuggacuucagaagcgaccaguucgugaucaucagaagagagaagcugauccaggaccacauggccaagcugcagcugaaccugagacccguggacguggaccccgagugccugagauggacccccgugaucgugagcaacagcguggugagcgaggaggaggaggaggaggccgaggagggcgagaacgaggagccccagugccaggagagagagcuggagaucagcgugggcaagagcgugagccacgagaacaaggagcaggacagcuacagcguggagagcgagaagaagcccgaggugauggcccccgugagcagcaccagacugagcaagcaggugcugccccacgacagccugcccgccaacagccagcccagcagaagaggcagauggggcagaaagaacagaaagacccaggagagauucggcgacaaggacagcaagcugcugcuggaggagaccagcagcgccccccaggagcaguacggcgagugcggcgagaagagcgaggccacccaggagcaguacaccgagagcgaggagcagcugguggccagcgaggagcagcccagccaggacggcaagcccgaccugcccaagagaagacugagcgagggcguggagcccuggagaggccagcugaagaagagccccgaggcccugaagugcagacugaccgagggcagcgagagacugcccagaagauacagcgagggcgacagagccgugcugagaggcuucagcgagagcagcgaggaggaggaggagcccgagagccccagaagcagcagcccccccauccugaccaagcccacccugaagagaaagaagcccuuccugcacagaagaagaagagugagaaagagaaagcaccacaacagcagcguggugaccgagaccaucagcgagaccaccgaggugcuggacgagcccuucgaggacagcgacagcgagagacccaugcccagacuggagcccaccuucgagaucgacgaggaggaggaggaggaggacgagaacgagcuguuccccagagaguacuucagaagacugagcagccaggacgugcugagaugccagagcagcagcaagagaaagagcaaggacgaggaggaggacgaggagagcgacgacgccgacgacacccccauccugaagcccgugagccugcugagaaagagagacgugaagaacagcccccuggagcccgacaccagcaccccccugaagaagaagaagggcuggcccaagggcaagagcagaaagcccauccacuggaagaagagacccggcagaaagcccggcuucaagcugagcagagagaucaugcccgugagcacccaggccugcgugaucgagcccaucgugagcauccccaaggccggcagaaagcccaagauccaggagagcgaggagaccguggagcccaaggaggacaugccccugcccgaggagagaaaggaggaggaggagaugcaggccgaggccgaggaggccgaggagggcgaggaggaggacgccgccagcagcgaggugcccgccgccagccccgccgacagcagcaacagccccgagaccgagaccaaggagcccgagguggaggaggaggaggagaagcccagagugagcgaggagcagagacagagcgaggaggagcagcaggagcuggaggagcccgagcccgaggaggaggaggacgccgccgccgagaccgcccagaacgacgaccacgacgccgacgacgaggacgacggccaccuggagagcaccaagaagaaggagcuggaggagcagcccaccagagaggacgugaaggaggagcccggcgugcaggagagcuuccuggacgccaacaugcagaagagcagagagaagaucaaggacaaggaggagaccgagcuggacagcgaggaggagcagcccagccacgacaccagcguggugagcgagcagauggccggcagcgaggacgaccacgaggaggacagccacaccaaggaggagcugaucgagcugaaggaggaggaggagaucccccacagcgagcuggaccuggagaccgugcaggccgugcagagccugacccaggaggagagcagcgagcacgagggcgccuaccaggacugcgaggagacccuggccgccugccagacccugcagagcuacacccaggccgacgaggacccccagaugagcaugguggaggacugccacgccagcgagcacaacagccccaucagcagcgugcagagccaccccagccagagcgugagaagcgugagcagccccaacgugcccgcccuggagagcggcuacacccagaucagccccgagcagggcagccugagcgcccccagcaugcagaacauggagaccagccccaugauggacgugcccagcgugagcgaccacagccagcaggugguggacagcggcuucagcgaccugggcagcaucgagagcaccaccgagaacuacgagaaccccagcagcuacgacagcaccaugggcggcagcaucugcggcaacagcagcagccagagcagcugcagcuacggcggccugagcagcagcagcagccugacccagagcagcugcguggugacccagcagauggccagcaugggcagcagcugcagcaugaugcagcagagcagcgugcagcccgccgccaacugcagcaucaagagcccccagagcugcgugguggagagaccccccagcaaccagcagcagcagcccccccccccccccccccagcagccccagcccccccccccccagccccagcccgccccccagcccccccccccccagcagcagccccagcagcagccccagccccagccccagcagccccccccccccccccccccccagcagcagcccccccugagccagugcagcaugaacaacagcuucacccccgcccccaugaucauggagauccccgagagcggcagcaccggcaacaucagcaucuacgagagaauccccggcgacuucggcgccggcagcuacagccagcccagcgccaccuucagccuggccaagcugcagcagcugaccaacaccaucauggacccccacgccaugcccuacagccacagccccgccgugaccagcuacgccaccagcgugagccugagcaacaccggccuggcccagcuggcccccagccacccccuggccggcaccccccaggcccaggccaccaugacccccccccccaaccuggccagcaccaccaugaaccugaccagcccccugcugcagugcaacaugagcgccaccaacaucggcaucccccacacccagagacugcagggccagaugcccgugaagggccacaucagcaucagaagcaagagcgccccccugcccagcgccgccgcccaccagcagcagcuguacggcagaagccccagcgccguggccaugcaggccggccccagagcccuggccgugcagagaggcaugaacaugggcgugaaccugaugcccacccccgccuacaacgugaacagcaugaacaugaacacccugaacgccaugaacagcuacagaaugacccagcccaugaugaacagcagcuaccacagcaaccccgccuacaugaaccagaccgcccaguaccccaugcagaugcagaugggcaugaugggcagccaggccuacacccagcagcccaugcagcccaacccccacggcaacaugauguacaccggccccagccaccacagcuacaugaacgccgccggcgugcccaagcagagccugaacggccccuacaugagaagauaa

SEQ ID NO: 18754 - RNA, 5673 nt, Artificial Sequence
  KAT6B__Homo_sapiens__NP_001243397
auggugaagcuggccaacccccuguacaccgaguggauccuggaggccauccagaagaucaagaagcagaagcagagacccagcgaggagagaaucugccacgccgugagcaccagccacggccuggacaagaagaccgugagcgagcagcuggagcugagcgugcaggacggcagcgugcugaaggugaccaacaagggccuggccagcuacaaggaccccgacaaccccggcagauucagcagcgugaagcccggcaccuuccccaagagcgccaagggcagcagaggcagcugcaacgaccugagaaacguggacuggaacaagcugcugagaagagccaucgagggccuggaggagcccaacggcagcagccugaagaacaucgagaaguaccugagaagccagagcgaccugaccagcaccaccaacaaccccgccuuccagcagagacugagacugggcgccaagagagccgugaacaacggcagacugcugaaggacggcccccaguacagagugaacuacggcagccuggacggcaagggcgccccccaguaccccagcgccuuccccagcagccugccccccgugagccugcugccccacgagaaggaccagcccagagccgaccccauccccaucugcagcuucugccugggcaccaaggagagcaacagagagaagaagcccgaggagcugcugagcugcgccgacugcggcagcagcggccaccccagcugccugaaguucugccccgagcugaccaccaacgugaaggcccugagauggcagugcaucgagugcaagaccugcagcgccugcagagugcagggcagaaacgccgacaacaugcuguucugcgacagcugcgacagaggcuuccacauggagugcugcgaccccccccugagcagaaugcccaagggcauguggaucugccaggugugcagacccaagaagaagggcagaaagcugcugcacgagaaggccgcccagaucaagagaagauacgccaagcccaucggcagacccaagaacaagcugaagcagagacugcugagcgugaccagcgacgagggcagcaugaacgccuucaccggcagaggcagccccggcagaggccagaagaccaaggugugcaccacccccagcagcggccacgccgccagcggcaaggacagcagcagcagacuggccgugaccgaccccaccagacccggcgccaccaccaagaucaccaccaccagcaccuacaucagcgccagcacccugaaggugaacaagaagaccaagggccugaucgacggccugaccaaguucuucacccccagccccgacggcagaagaagcagaggcgagaucaucgacuucagcaagcacuacagacccagaaagaaggugagccagaagcagagcugcaccagccacgugcuggccaccgacaccgagaucaagaucaacaucaagcaggagagcgccgacgugaacgugaucggcaacaaggacguggugaccgaggaggaccuggacguguucaagcaggcccaggagcugagcugggagaagaucgagugcgagagcggcguggaggacugcggcagauaccccagcgugaucgaguucggcaaguacgagauccagaccugguacagcagccccuacccccaggaguacgccagacugcccaagcuguaccugugcgaguucugccugaaguacaugaagagcaagaacauccugcugagacacagcaagaagugcggcugguuccacccccccgccaacgagaucuacagaagaaaggaccugagcguguucgagguggacggcaacaugagcaagaucuacugccagaaccugugccugcuggccaagcuguuccuggaccacaagacccuguacuacgacguggagcccuuccuguucuacgugcugaccaagaacgacgagaagggcugccaccuggugggcuacuucagcaaggagaagcugugccagcagaaguacaacgugagcugcaucaugaucaugccccagcaccagagacagggcuucggcagauuccugaucgacuucagcuaccugcugagcagaagagagggccaggccggcagccccgagaagccccugagcgaccugggcagacugagcuaccuggccuacuggaagagcgugauccuggaguaccuguaccaccaccacgagagacacaucagcaucaaggccaucagcagagccaccggcaugugcccccacgacaucgccaccacccugcagcaccugcacaugaucgacaagagagacggcagauucgugaucaucagaagagagaagcugauccugagccacauggagaagcugaagaccugcagcagagccaacgagcuggaccccgacagccugagauggacccccauccugaucagcaacgccgccgugagcgaggaggagagagaggccgagaaggaggccgagagacugauggagcaggccagcugcugggagaaggaggagcaggagauccugagcaccagagccaacagcagacagagccccgccaaggugcagagcaagaacaaguaccugcacagccccgagagcagacccgugaccggcgagagaggccagcugcuggagcugagcaaggagagcagcgaggaggaggaggaggaggaggacgaggaggaggaggaggaggaggaggaggaggaggaggacgaggaggaggaggaggaggaggaggaggaggaggaggaggagaacauccagagcagcccccccagacugaccaagccccagagcguggccaucaagagaaagagacccuucgugcugaagaagaagagaggcagaaagagaagaagaaucaacagcagcgugaccaccgagaccaucagcgagaccaccgaggugcugaacgagcccuucgacaacagcgacgaggagagacccaugccccagcuggagcccaccugcgagaucgagguggaggaggacggcagaaagcccgugcugagaaaggccuuccagcaccagcccggcaagaagagacagaccgaggaggaggagggcaaggacaaccacugcuucaagaacgccgaccccugcagaaacaacaugaacgacgacagcagcaaccugaaggagggcagcaaggacaaccccgagccccugaagugcaagcagguguggcccaagggcaccaagagaggccugagcaaguggagacagaacaaggagagaaagaccggcuucaagcugaaccuguacaccccccccgagacccccauggagcccgacgagcaggugaccguggaggagcagaaggagaccagcgagggcaagaccagccccagccccaucagaaucgaggaggaggugaaggagaccggcgaggcccugcugccccaggaggagaacagaagagaggagaccugcgcccccgugagccccaacaccagccccggcgagaagcccgaggacgaccugaucaagcccgaggaggaggaggaggaggaggaggaggaggaggaggaggaggaggaggaggagggcgaggaggaggagggcggcggcaacguggagaaggaccccgacggcgccaagagccaggagaaggaggagcccgagaucagcaccgagaaggaggacagcgccagacuggacgaccacgaggaggaggaggaggaggacgaggagcccagccacaacgaggaccacgacgccgacgacgaggacgacagccacauggagagcgccgagguggagaaggaggagcugcccagagagagcuucaaggaggugcuggagaaccaggagaccuuccuggaccugaacgugcagcccggccacagcaaccccgaggugcugauggacugcggcguggaccugaccgccagcugcaacagcgagcccaaggagcuggccggcgaccccgaggccgugcccgagagcgacgaggagcccccccccggcgagcaggcccagaagcaggaccagaagaacagcaaggagguggacaccgaguucaaggagggcaaccccgccaccauggagaucgacagcgagaccgugcaggccgugcagagccugacccaggagagcagcgagcaggacgacaccuuccaggacugcgccgagacccaggaggccugcagaagccugcagaacuacaccagagccgaccagagcccccagaucgccaccacccuggacgacugccagcagagcgaccacagcagccccgugagcagcgugcacagccaccccggccagagcgugagaagcgugaacagccccagcgugcccgcccuggagaacagcuacgcccagaucagccccgaccagagcgccaucagcgugcccagccugcagaacauggagaccagccccaugauggacgugcccagcgugagcgaccacagccagcaggugguggacagcggcuucagcgaccugggcagcaucgagagcaccaccgagaacuacgagaaccccagcagcuacgacagcaccaugggcggcagcaucugcggcaacggcagcagccagaacagcugcagcuacagcaaccugaccagcagcagccugacccagagcagcugcgccgugacccagcagaugagcaacaucagcggcagcugcagcaugcugcagcagaccagcaucagcagcccccccaccugcagcgugaagagcccccagggcugcgugguggagagaccccccagcagcagccagcagcuggcccagugcagcauggccgccaacuucaccccccccaugcagcuggccgagauccccgagaccagcaacgccaacaucggccuguacgagagaaugggccagagcgacuucggcgccggccacuacccccagcccagcgccaccuucagccuggccaagcugcagcagcugaccaacacccugaucgaccacagccugcccuacagccacagcgccgccgugaccagcuacgccaacagcgccagccugagcaccccccugagcaacaccggccuggugcagcugagccagagcccccacagcgugcccggcggcccccaggcccaggccaccaugacccccccccccaaccugacccccccccccaugaaccugccccccccccugcugcagagaaacauggccgccagcaacaucggcaucagccacagccagagacugcagacccagaucgccagcaagggccacaucagcaugagaaccaagagcgccagccugagccccgccgccgccacccaccagagccagaucuacggcagaagccagaccguggccaugcagggccccgccagaacccugaccaugcagagaggcaugaacaugagcgugaaccugaugcccgcccccgccuacaacgugaacagcgugaacaugaacaugaacacccugaacgccaugaacggcuacagcaugagccagcccaugaugaacagcggcuaccacagcaaccacggcuacaugaaccagaccccccaguaccccaugcagaugcagaugggcaugaugggcacccagcccuacgcccagcagcccaugcagacccccccccacggcaacaugauguacaccgcccccggccaccacggcuacaugaacaccggcaugagcaagcagagccugaacggcagcuacaugagaagauaa

SEQ ID NO: 18755 - RNA, 1746 nt, Artificial Sequence
  KAT7__Homo_sapiens__NP_001186084
augcccagaagaaagagaaacgccggcagcagcagcgacggcaccgaggacagcgacuucagcaccgaccuggagcacaccgacagcagcgagagcgacggcaccagcagaagaagcgccagagugaccagaagcagcgccagacugagccagagcagccaggacagcagccccgugagaaaccugcagagcuucggcaccgaggagcccgccuacagcaccagaagagugaccagaagccagcagcagcccacccccgugacccccaagaaguacccccugagacagaccagaagcagcggcagcgagaccgagcaggugguggacuucagcgacagagagaccaagaacaccgccgaccacgacgagagcccccccagaacccccaccggcaacgcccccagcagcgagagcgacaucgacaucagcagccccaacgugagccacgacgagagcaucgccaaggacaugagccugaaggacagcggcagcgaccugagccacagacccaagagaagaagauuccacgagagcuacaacuucaacaugaagugccccacccccggcugcaacagccugggccaccugaccggcaagcacgagagacacuucagcaucagcggcugcccccuguaccacaaccugagcgccgacgagugcaaggcccccaccgagagacagcugagauacaaggagaagguggccgagcugagaaagaagagaaacagcggccugagcaaggagcagaaggagaaguacauggagcacagacagaccuacggcaacaccagagagccccugcuggagaaccugaccagcgaguacgaccuggaccuguucagaagagcccaggccagagccagcgaggaccuggagaagcugagacugcagggccagaucaccgagggcagcaacaugaucaagaccaucgccuucggcagauacgagcuggacaccugguaccacagccccuaccccgaggaguacgccagacugggcagacuguacaugugcgaguucugccugaaguacaugaagagccagaccauccugagaagacacauggccaagugcguguggaagcacccccccggcgacgagaucuacagaaagggcagcaucagcguguucgagguggacggcaagaagaacaagaucuacugccagaaccugugccugcuggccaagcuguuccuggaccacaagacccuguacuacgacguggagcccuuccuguucuacgugaugaccgaggccgacaacaccggcugccaccugaucggcuacuucagcaaggagaagaacagcuuccugaacuacaacgugagcugcauccugaccaugccccaguacaugagacagggcuacggcaagaugcugaucgacuucagcuaccugcugagcaagguggaggagaaggugggcagccccgagagaccccugagcgaccugggccugaucagcuacagaagcuacuggaaggaggugcugcugagauaccugcacaacuuccagggcaaggagaucagcaucaaggagaucagccaggagaccgccgugaaccccguggacaucgugagcacccugcaggcccugcagaugcugaaguacuggaagggcaagcaccuggugcugaagagacaggaccugaucgacgaguggaucgccaaggaggccaagagaagcaacagcaacaagaccauggaccccagcugccugaaguggaccccccccaagggcaccuaa

SEQ ID NO: 18756 - RNA, 1377 nt, Artificial Sequence
  KAT8__Homo_sapiens__NP_115564
auggccgcccagggcgccgccgccgccguggccgccggcaccagcggcguggccggcgagggcgagcccggccccggcgagaacgccgccgccgagggcaccgcccccagccccggcagagugagcccccccacccccgccagaggcgagcccgaggugaccguggagaucggcgagaccuaccugugcagaagacccgacagcaccuggcacagcgccgaggugauccagagcagagugaacgaccaggagggcagagaggaguucuacgugcacuacgugggcuucaacagaagacuggacgaguggguggacaagaacagacuggcccugaccaagaccgugaaggacgccgugcagaagaacagcgagaaguaccugagcgagcuggccgagcagcccgagagaaagaucaccagaaaccagaagagaaagcacgacgagaucaaccacgugcagaagaccuacgccgagauggaccccaccaccgccgcccuggagaaggagcacgaggccaucaccaaggugaaguacguggacaagauccacaucggcaacuacgagaucgacgccugguacuucagccccuuccccgaggacuacggcaagcagcccaagcuguggcugugcgaguacugccugaaguacaugaaguacgagaagagcuacagauuccaccugggccagugccaguggagacagccccccggcaaggagaucuacagaaagagcaacaucagcguguacgagguggacggcaaggaccacaagaucuacugccagaaccugugccugcuggccaagcuguuccuggaccacaagacccuguacuucgacguggagcccuucguguucuacauccugaccgagguggacagacagggcgcccacaucgugggcuacuucagcaaggagaaggagagccccgacggcaacaacguggccugcauccugacccugccccccuaccagagaagaggcuacggcaaguuccugaucgccuucagcuacgagcugagcaagcuggagagcaccgugggcagccccgagaagccccugagcgaccugggcaagcugagcuacagaagcuacuggagcugggugcugcuggagauccugagagacuucagaggcacccugagcaucaaggaccugagccagaugaccagcaucacccagaacgacaucaucagcacccugcagagccugaacauggugaaguacuggaagggccagcacgugaucugcgugacccccaagcugguggaggagcaccugaagagcgcccaguacaagaagccccccaucaccguggacagcgugugccugaagugggccccccccaagcacaagcaggugaagcugagcaagaaguaa

SEQ ID NO: 18757 - RNA, 936 nt, Artificial Sequence
  KATNA1__Homo_sapiens__NP_001191005
augagccugcugaugaucagcgagaacgugaagcuggccagagaguacgcccugcugggcaacuacgacagcgccaugguguacuaccagggcgugcuggaccagaugaacaaguaccuguacagcgugaaggacaccuaccugcagcagaaguggcagcagguguggcaggagaucaacguggaggccaagcacgugaaggacaucaugaagacccuggagagcuucaagcuggacagcaccccccugaaggccgcccagcacgaccugcccgccagcgagggcgagguguggagcaugcccgugcccguggagagaagacccagccccggccccagaaagagacagagcagccaguacagcgaccccaagagccacggcaacagacccagcaccaccgugagagugcacagaagcagcgcccagaacgugcacaacgacagaggcaaggccgugagaugcagagagaagaaggagcagaacaagggcagagaggagaagggcgugcugauggugggcccccccggcaccggcaagacccugcuggccaaggccguggccaccgagugcaagaccaccuucuucaacgugagcagcagcacccugaccagcaaguacagaggcgagagcgagaagcuggugagacugcuguucgagauggccagauucuacagccccgccaccaucuucaucgacgagaucgacagcaucugcagcagaagaggcaccagcgaggagcacgaggccagcagaagagugaaggccgagcugcuggugcagauggacggcgugggcggcaccagcgagaacgacgaccccagcaagauggugauggugcuggccgccaccaacuuccccugggacaucgacgaggcccugagaagaagacuggagaagagaaucuacaucccccugcccagcggcaugagacccuaa

SEQ ID NO: 18758 - RNA, 1695 nt, Artificial Sequence
  KATNAL2__Homo_sapiens__XP_005258414
augaagaagaucgagcagagaaagaccagacccugcuucagcaccagcaacgagaacagagugcuggcccagugccugauggagcugagcuaccagacccugaaguucacccaccaggccagagaggccugcgagaugagaaccgaggccagaagaaagaaccugcugauccugaucagccacuaccugacccaggagggcuacaucgacaccgccaacgcccuggagcaggagaccaagcugggccugagaagauucgaggugugcgacaacaucgaccuggagaccauccugauggaguacgagagcuacuacuucgugaaguuccagaaguaccccaagaucgugaagaagagcagcgacaccgccgagaacaaccugccccagagaagcagaggcaagaccagaagaaugaugaacgacagcugccagaaccugcccaagaucaaccagcagagacccagaagcaagaccaccgccggcaagaccggcgacaccaagagccugaacaaggagcaccccaaccaggaggugguggacaacaccagacuggagagcgccaacuucggccugcacaucagcagaaucagaaaggacagcggcgaggagaacgcccaccccagaagaggccagaucaucgacuuccagggccugcugaccgacgccaucaagggcgccaccagcgagcuggcccugaacaccuucgaccacaaccccgaccccagcgagagacugcugaagccccugagcgccuucaucggcaugaacagcgagaugagagagcuggccgccguggugagcagagacaucuaccugcacaaccccaacaucaaguggaacgacaucaucggccuggacgccgccaagcagcuggugaaggaggccgugguguaccccaucagauacccccagcuguucaccggcauccugagccccuggaagggccugcugcuguacggcccccccggcaccggcaagacccugcuggccaaggccguggccaccgagugcaagaccaccuucuucaacaucagcgccagcaccaucgugagcaaguggagaggcgacagcgagaagcuggugagagugcuguucgagcuggccagauaccacgcccccagcaccaucuuccuggacgagcuggagagcgugaugagccagagaggcaccgccagcggcggcgagcacgagggcagccugagaaugaagaccgagcugcuggugcagauggacggccuggccagaagcgaggaccugguguucgugcuggccgccagcaaccugcccugggagcuggacugcgccaugcugagaagacuggagaagagaauccugguggaccugcccagcagagaggccagacaggccaugaucuaccacuggcugccccccgugagcaagagcagagcccuggagcugcacaccgagcuggaguacagcgugcugagccaggagaccgagggcuacagcggcagcgacaucaagcuggugugcagagaggccgccaugagacccgugagaaagaucuucgacgcccuggagaaccaccagagcgagagcagcgaccugcccagaauccagcuggacaucgugaccaccgccgacuuccuggacgugcugacccacaccaagcccagcgccaagaaccuggcccagagauacagcgacuggcagagagaguucgagagcguguaa

SEQ ID NO: 18759 - RNA, 1968 nt, Artificial Sequence
  KATNB1__Homo_sapiens__NP_005877
auggccacccccguggugaccaagaccgccuggaagcugcaggagaucguggcccacgccagcaacgugagcagccuggugcugggcaaggccagcggcagacugcuggccaccggcggcgacgacugcagagugaaccuguggagcaucaacaagcccaacugcaucaugagccugaccggccacaccagccccguggagagcgugagacugaacacccccgaggagcugaucguggccggcagccagagcggcagcaucagagugugggaccuggaggccgccaagauccugagaacccugaugggccacaaggccaacaucugcagccuggacuuccaccccuacggcgaguucguggccagcggcagccaggacaccaacaucaagcugugggacaucagaagaaagggcugcguguucagauacagaggccacagccaggccgugagaugccugagauucagccccgacggcaaguggcuggccagcgccgccgacgaccacaccgugaagcugugggaccugaccgccggcaagaugaugagcgaguuccccggccacaccggccccgugaacgugguggaguuccaccccaacgaguaccugcuggccagcggcagcagcgacagaaccaucagauucugggaccuggagaaguuccagguggugagcugcaucgagggcgagcccggccccgugagaagcgugcuguucaaccccgacggcugcugccuguacagcggcugccaggacagccugagaguguacggcugggagcccgagagaugcuucgacguggugcuggugaacuggggcaagguggccgaccuggccaucugcaacgaccagcugaucggcguggccuucagccagagcaacgugagcagcuacgugguggaccugaccagagugaccagaaccggcaccguggccagagaccccgugcaggaccacagaccccuggcccagccccugcccaaccccagcgccccccugagaagaaucuacgagagacccagcaccaccugcagcaagccccagagagugaagcagaacagcgagagcgagagaagaagccccagcagcgaggacgacagagacgagagagagagcagagccgagauccagaacgccgaggacuacaacgagaucuuccagcccaagaacagcaucagcagaaccccccccagaagaagcgagcccuuccccgccccccccgaggacgacgccgccaccgccaaggaggccgccaagcccagccccgccauggacgugcaguuccccgugcccaaccuggaggugcugcccagaccccccgugguggccagcacccccgcccccaaggccgagcccgccaucauccccgccaccagaaacgagcccaucggccugaaggccagcgacuuccugcccgccgugaagaucccccagcaggccgagcugguggacgaggacgccaugagccagaucagaaagggccacgacaccaugugcguggugcugaccagcagacacaagaaccuggacaccgugagagccguguggaccaugggcgacaucaagaccagcguggacagcgccguggccaucaacgaccugagcguggugguggaccugcugaacaucgugaaccagaaggccagccuguggaagcuggaccugugcaccaccgugcugccccagaucgagaagcugcugcagagcaaguacgagagcuacgugcagaccggcugcaccagccugaagcugauccugcagagauuccugccccugaucaccgacaugcuggccgccccccccagcgugggcguggacaucagcagagaggagagacugcacaagugcagacugugcuacaagcagcugaagagcaucagcggccuggugaagagcaagagcggccugagcggcagacacggcagcaccuucagagagcugcaccugcugauggccagccuggacuaa

SEQ ID NO: 18760 - RNA, 693 nt, Artificial Sequence
  KAZALD1__Homo_sapiens__XP_005270251
augcugcccccccccagacccgccgccgcccuggcccugcccgugcugcugcugcugcugguggugcugacccccccccccaccggcgccagacccagccccggccccgacuaccugagaagaggcuggaugagacugcuggccgagggcgagggcugcgcccccugcagacccgaggagugcgccgcccccagaggcugccuggccggcagagugagagacgccugcggcugcugcugggagugcgccaaccuggagggccagcugugcgaccuggaccccagcgcccacuucuacggccacugcggcgagcagcuggagugcagacuggacaccggcggcgaccugagcagaggcgaggugcccgagccccugugcgccugcagaagccagagcccccugugcggcagcgacggccacaccuacagccagaucugcagacugcaggaggccgccagagccagacccgacgccaaccugaccguggcccaccccggccccugcgagagcggcccccagaucgugagccaccccuacgacaccuggaacgugaccggccaggacgugaucuucggcugcgagguguucgccuaccccauggccagcaucgaguggagaaaggacggccuggacauccagcugcccggcgacgacccccacaucagcgugcagggcuggacccccgagguguaa

SEQ ID NO: 18761 - RNA, 2628 nt, Artificial Sequence
  KAZN__Homo_sapiens__XP_011539377
augagagccgccgacagcggcagcugggagagagugagacagcuggccgcccagggcgagcccgcccccagcugcggcgccggcgccggccccgccagaccccccggccccgccgccugcgagcagugcguggacgccgccggccccggcgacagacccagagccggcgugcccagagugagagccgacggcgacugcagccagcccgugcugcugagagaggaggugagcagacugcaggaggaggugcaccugcugagacagaugaaggagaugcuggccaaggaccuggaggagagccagggcggcaagagcagcgaggugcugagcgccaccgagcugagagugcagcuggcccagaaggagcaggagcuggccagagccaaggaggcccugcaggccaugaaggccgacagaaagagacugaagggcgagaagaccgaccuggugagccagaugcagcagcuguacgccacccuggagagcagagaggagcagcugagagacuucaucagaaacuacgagcagcacagaaaggagagcgaggacgccgugaaggcccuggccaaggagaaggaccugcuggagagagagaagugggagcugagaagacaggccaaggaggccaccgaccacgccaccgcccugagaagccagcuggaccugaaggacaacagaaugaaggagcuggaggccgagcuggccauggccaagcagagccuggccacccugaccaaggacgugcccaagagacacagccuggccaugcccggcgagaccgugcugaacggcaaccaggaguggguggugcaggccgaccugccccugaccgccgccaucagacagagccagcagacccuguaccacagccaccccccccaccccgccgacagacaggccgugagagugagccccugccacagcagacagcccagcgugaucagcgacgccagcgccgccgagggcgacagaagcagcacccccagcgacaucaacagccccagacacagaacccacagccugugcaacggcgacagccccggccccgugcagaagaaccugcacaaccccaucgugcagagccuggaggaccuggaggaccagaagagaaagaagaagaaggagaagaugggcuucggcagcaucagcagaguguucgccagaggcaagcagagaaagagccuggaccccggccuguucgacgacagcgacagccagugcagccccaccagacagagccugagccugagcgagggcgaggagcagauggacagacugcagcagguggagcuggugagaaccacccccaugagccacuggaaggccggcaccgugcaggccuggcuggagguggugauggccaugcccauguacgugaaggccugcaccgagaacgugaagagcggcaaggugcugcugagccugagcgacgaggaccugcagcugggccugggcgugugcagcagccugcacagaagaaagcugagacuggccaucgaggacuacagagacgccgaggccggcagaagccugagcaaggccgccgagcuggaccaccacuggguggccaaggccuggcugaacgacaucggccugagccaguacagccaggccuuccagaaccaccugguggacggcagaaugcugaacagccugaugaagagagaccuggagaagcaccugaacgugagcaagaaguuccaccaggugagcauccugcugggcaucgagcugcuguaccaggugaacuucagcagagaggcccugcaggagagaagagccagaugcgagacccagaacaucgaccccgugguguggaccaaccagagagugcugaagugggugagagacaucgaccugaaggaguacgccgacaaccugaccaacagcggcgugcacggcgccgugcuggugcuggagcccaccuucaacgccgaggccauggccaccgcccugggcauccccagcggcaagcacauccugagaagacaccuggccgaggagaugagcgccguguuccaccccgccaacagcaccggcaucagagaggccgagagauucggcaccccccccggcagagccagcagcgugaccagagccggcaaggaggagaacagcagcggccugaaguacaaggccggcagagugagccugagcauggaccugcccgugagccccgccgaccccggcaagguguucuucagcccccccggcagcagcguggcccccgugcuggccugcgagggcggcgugcccggcagagugaccggcgccagcagaaccgacgcccuggacgugcccagcagaaaccugcacgacgcccugggcaccgugcacaaggcccccgccggccugagaguggcccccggcagccagagcgccggccugaccugccugcacgagaaccaccugggccugcugcugaaccugcagauccugggccccacccuggugagcuggaagagaagcagccugggcagaggcggcagcugcauccagcugggcugccccgagggcagcggcgccgcccccaacagcgagccccagagccugaucagcaucugcgacuucagcgaccugaccaacagcaaggacgagcccagcggcgacagcaaccagaccguguaa

SEQ ID NO: 18762 - RNA, 1872 nt, Artificial Sequence
  KBTBD11__Homo_sapiens__NP_055682
auggagcacgccguggcccccugcgugcuguaccccggcaccgagcccggcgccgccggcgagagcgagagcgagggcgccgccagccccgcccagacccccugcagccugggcgccagccugugcuucagcagcggcgaggagagccccccccagagccuggccagcgccgccgagggcgccgccaccagcccccccagcagcggcggccccagagugguggagagacagugggaggccggcagcgccggcgccgccagccccgaggagcuggccagccccgaggagagagccugccccgaggagcccgccgcccccagccccgagcccagaguguggcuggaggaccccgccagccccgaggagcccggcgagcccgcccccgugccccccggcuucggcgccguguacggcgagcccgaccuggugcuggaggugagcggcagaagacugagagcccacaaggccgugcuggccgccagaagcgacuacuucagagccagagccagcagagacgugcugagagugcagggcgugagccugaccgcccugagacugcugcuggccgacgccuacagcggcagaauggccggcgugagacccgacaacguggccgaggugguggccggcgccagaagacugcagcugcccggcgccgcccagagagccaccgacgccgugggcccccagcugagccuggccaacugcuacgaggugcugagcgccgccaagagacagagacugaacgagcugagagacgccgccuacugcuucaugagcgaccacuaccuggaggugcugagagagcccgccguguucggcagacugagcggcgccgagagagaccugcugcugagaagaagacugagagccggcagagcccaccugcuggccgccgcccugggccccgccggcgagagagccggcagcagaccccagagccccagcggcgacgccgacgccagaggcgacgccgccguguacugcuuccacgccgccgccggcgaguggagagagcugaccagacugcccgagggcgcccccgccagaggcugcggccugugcgugcuguacaacuaccuguucguggccggcggcguggcccccgccggccccgacggcagagccagacccagcgaccagguguucugcuacaaccccgccaccgacagcuggagcgccgugagaccccugagacaggccagaagccagcugagacugcuggcccuggacggccaccuguacgccgugggcggcgagugccugcugagcguggagagauacgaccccagagccgacagaugggcccccguggccccccugcccagaggcgccuucgccguggcccacgaggccaccaccugccacggcgagaucuacgugagcggcggcagccuguucuacagacugcugaaguacgaccccagaagagacgaguggcaggagugccccugcagcagcagcagagagagaagcgccgacaugguggcccuggacggcuucaucuacagauucgaccugagcggcagcagaggcgaggcccaggccgccggccccagcggcgugagcgugagcagauaccacugccuggccaagcaguggagccccugcguggccccccugagacugcccggcggccccaccggccugcagcccuucagaugcgccgcccuggacggcgccaucuacugcgugagcagagccggcaccuggagauuccagcccgccagagagggcgaggccggcggcgacgccggccagggcggcggcuucgaggcccugggcgccccccuggacgugagaggcgugcugauccccuucgcccugagccugcccgagaagccccccagaggcgagcagggcgcccccuaa

SEQ ID NO: 18763 - RNA, 1377 nt, Artificial Sequence
  KBTBD13__Homo_sapiens__NP_001094832
auggccagaggcccccagacccuggugcaggugugggugggcggccagcuguuccaggccgacagagcccugcugguggagcacugcggcuucuucagaggccuguucagaagcggcaugagagagaccagagccgccgaggugagacugggcgugcugagcgccggcggcuucagagccacccugcaggugcugagaggcgacagacccgcccuggccgccgaggacgagcugcugcaggccguggagugcgccgccuuccugcaggcccccgcccuggccagauuccuggagcacaaccugaccagcgacaacugcgcccugcugugcgacgccgccgccgccuucggccugagagacguguuccacagcgccgcccuguucaucugcgacggcgagagagagcuggccgccgagcuggcccugcccgaggccagagccuacguggccgcccugagacccagcagcuacgccgccgugagcacccacacccccgcccccggcuuccuggaggacgccagcagaacccugugcuaccuggacgaggaggaggacgccuggagaacccuggccgcccugccccuggaggccagcacccugcuggccggcguggccacccugggcaacaagcuguacaucgugggcggcgugagaggcgccagcaaggaggugguggagcugggcuucugcuacgaccccgacggcggcaccuggcacgaguuccccagcccccaccagcccagauacgacaccgcccuggccggcuucgacggcagacuguacgccaucggcggcgaguuccagagaacccccaucagcagcguggagagauacgaccccgccgccggcugcuggagcuucguggccgaccugccccagcccgccgccggcgugcccugcgcccaggccugcggcagacuguucgugugccuguggagacccgccgacaccaccgccgugguggaguacgccgugagaaccgacgccuggcugcccguggccgagcugagaagaccccagagcuacggccacugcaugguggcccacagagacagccuguacguggugagaaacggccccagcgacgacuuccugcacugcgccaucgacugccugaaccuggccaccggccaguggaccgcccugcccggccaguucgugaacagcaagggcgcccuguucaccgccguggugagaggcgacaccguguacaccgugaacagaauguucacccugcuguacgccaucgagggcggcaccuggagacugcugagagagaaggccggcuuccccagacccggcagccugcagaccuuccugcugagacugccccccggcgcccccggccccgugaccagcaccaccgccgagcuguaa

SEQ ID NO: 18764 - RNA, 1806 nt, Artificial Sequence
  KBTBD8__Homo_sapiens__NP_115894
auggccgccagcgccgaccugagcaagagcagccccacccccaacggcauccccagcagcgaccccgccagcgacgccauggaccccuuccacgccugcagcauccugaagcagcugaagaccauguacgacgagggccagcugaccgacaucgugguggagguggaccacggcaagaccuucagcugccacagaaacgugcuggccgccaucagccccuacuucagaagcauguucaccagcggccugaccgagagcacccagaaggaggugagaaucgugggcguggaggccgagagcauggaccuggugcugaacuacgccuacaccagcagagugauccugaccgaggccaacgugcaggcccuguucaccgccgccagcaucuuccagauccccagcauccaggaccagugcgccaaguacaugaucagccaccuggacccccagaacagcaucggcguguucaucuucgccgaccacuacggccaccaggagcugggcgacagaagcaaggaguacaucagaaagaaguuccugugcgugaccaaggagcaggaguuccugcagcugaccaaggaccagcugaucagcauccuggacagcgacgaccugaacguggacagagaggagcacguguacgagagcaucaucagaugguucgagcacgagcagaacgagagagaggugcaccugcccgagaucuucgccaagugcaucagauucccccugauggaggacaccuucaucgagaagauccccccccaguucgcccaggccaucgccaagagcugcguggagaagggccccagcaacaccaacggcugcacccagagacugggcaugaccgccagcgagaugaucaucugcuucgacgccgcccacaagcacagcggcaagaagcagaccgugcccugccuggacaucgugaccggcagaguguucaagcugugcaagccccccaacgaccugagagaggugggcauccuggugagccccgacaacgacaucuacaucgccggcggcuacagacccagcagcagcgaggugagcaucgaccacaaggccgagaacgacuucuggauguacgaccacagcaccaacagauggcugagcaagcccagccugcugagagccagaaucggcugcaagcugguguacugcugcggcaagauguacgccaucggcggcagaguguacgagggcgacggcagaaacagccugaagagcguggagugcuacgacagcagagagaacugcuggaccaccgugugcgccaugcccguggccauggaguuccacaacgccguggaguacaaggagaagaucuacgugcugcagggcgaguucuuccuguucuacgagccccagaaggacuacuggggcuuccugacccccaugaccgugcccagaauccagggccuggccgccguguacaaggacagcaucuacuacaucgccggcaccugcggcaaccaccagagaauguucaccguggaggccuacgacaucgagcugaacaaguggaccagaaagaaggacuuccccugcgaccagagcaucaaccccuaccugaagcuggugcuguuccagaacaagcugcaccuguucgugagagccacccaggugaccguggaggagcacguguucagaaccagcagaaagaacagccuguaccaguacgacgacaucgccgaccaguggaugaagguguacgagacccccgacagacugugggaccugggcagacacuucgagugcgccguggccaagcuguacccccagugccugcagaaggugcuguaa

SEQ ID NO: 18765 - RNA, 1146 nt, Artificial Sequence
  KCMF1__Homo_sapiens__NP_064507
augagcagacacgagggcgugagcugcgacgccugccugaagggcaacuucagaggcagaagauacaagugccugaucugcuacgacuacgaccugugcgccagcugcuacgagagcggcgccaccaccaccagacacaccaccgaccaccccaugcagugcauccugaccagaguggacuucgaccuguacuacggcggcgaggccuucagcguggagcagccccagagcuucaccugccccuacugcggcaagaugggcuacaccgagaccagccugcaggagcacgugaccagcgagcacgccgagaccagcaccgaggugaucugccccaucugcgccgcccugcccggcggcgaccccaaccacgugaccgacgacuucgccgcccaccugacccuggagcacagagcccccagagaccuggacgagagcagcggcgugagacacgugagaagaauguuccaccccggcagaggccugggcggccccagagccagaagaagcaacaugcacuucaccagcagcagcaccggcggccugagcagcagccagagcagcuacagccccagcaacagagaggccauggaccccaucgccgagcugcugagccagcugagcggcgugagaagaagcgccggcggccagcugaacagcagcggccccagcgccagccagcugcagcagcugcagaugcagcugcagcuggagagacagcacgcccaggccgccagacagcagcuggagaccgccagaaacgccaccagaagaaccaacaccagcagcgugaccaccaccaucacccagagcaccgccaccaccaacaucgccaacaccgagagcagccagcagacccugcagaacagccaguuccugcugaccagacugaacgaccccaagaugagcgagaccgagagacagagcauggagagcgagagagccgacagaagccuguucgugcaggagcugcugcugagcacccuggugagagaggagagcagcagcagcgacgaggacgacagaggcgagauggccgacuucggcgccaugggcugcguggacaucaugccccuggacguggcccuggagaaccugaaccugaaggagagcaacaagggcaacgagccccccccccccccccuguaa

SEQ ID NO: 18766 - RNA, 1488 nt, Artificial Sequence
  KCNA1__Homo_sapiens__NP_000208
augaccgugaugagcggcgagaacguggacgaggccagcgccgcccccggccacccccaggacggcagcuaccccagacaggccgaccacgacgaccacgagugcugcgagagaguggugaucaacaucagcggccugagauucgagacccagcugaagacccuggcccaguuccccaacacccugcugggcaaccccaagaagagaaugagauacuucgacccccugagaaacgaguacuucuucgacagaaacagacccagcuucgacgccauccuguacuacuaccagagcggcggcagacugagaagacccgugaacgugccccuggacauguucagcgaggagaucaaguucuacgagcugggcgaggaggccauggagaaguucagagaggacgagggcuucaucaaggaggaggagagaccccugcccgagaaggaguaccagagacagguguggcugcuguucgaguaccccgagagcagcggccccgccagagugaucgccaucgugagcgugauggugauccugaucagcaucgugaucuucugccuggagacccugcccgagcugaaggacgacaaggacuucaccggcaccgugcacagaaucgacaacaccaccgugaucuacaacagcaacaucuucaccgaccccuucuucaucguggagacccugugcaucaucugguucagcuucgagcugguggugagauucuucgccugccccagcaagaccgacuucuucaagaacaucaugaacuucaucgacaucguggccaucauccccuacuucaucacccugggcaccgagaucgccgagcaggagggcaaccagaagggcgagcaggccaccagccuggccauccugagagugaucagacuggugagaguguucagaaucuucaagcugagcagacacagcaagggccugcagauccugggccagacccugaaggccagcaugagagagcugggccugcugaucuucuuccuguucaucggcgugauccuguucagcagcgccguguacuucgccgaggccgaggaggccgagagccacuucagcagcauccccgacgccuucuggugggccguggugagcaugaccaccgugggcuacggcgacauguaccccgugaccaucggcggcaagaucgugggcagccugugcgccaucgccggcgugcugaccaucgcccugcccgugcccgugaucgugagcaacuucaacuacuucuaccacagagagaccgagggcgaggagcaggcccagcugcugcacgugagcagccccaaccuggccagcgacagcgaccugagcagaagaagcagcagcaccaugagcaagagcgaguacauggagaucgaggaggacaugaacaacagcaucgcccacuacagacaggugaacaucagaaccgccaacugcaccaccgccaaccagaacugcgugaacaagagcaagcugcugaccgacguguaa

SEQ ID NO: 18767 - RNA, 1962 nt, Artificial Sequence
  KCNA4__Homo_sapiens__NP_002224
auggagguggccauggugagcgccgagagcagcggcugcaacagccacaugcccuacggcuacgccgcccaggccagagccagagagagagagagacuggcccacagcagagccgccgccgccgccgccguggccgccgccaccgccgccguggagggcagcggcggcagcggcggcggcagccaccaccaccaccagagcagaggcgccugcaccagccacgacccccagagcagcagaggcagcagaagaagaagaagacagagaagcgagaagaagaaggcccacuacagacagagcagcuucccccacugcagcgaccugaugcccagcggcagcgaggagaagauccugagagagcugagcgaggaggaggaggacgaggaggaggaggaggaggaggaggaggagggcagauucuacuacagcgaggacgaccacggcgacgagugcagcuacaccgaccugcugccccaggacgagggcggcggcggcuacagcagcgugagauacagcgacugcugcgagagaguggugaucaacgugagcggccugagauucgagacccagaugaagacccuggcccaguuccccgagacccugcugggcgaccccgagaagagaacccaguacuucgacccccugagaaacgaguacuucuucgacagaaacagacccagcuucgacgccauccuguacuacuaccagagcggcggcagacugaagagacccgugaacgugcccuucgacaucuucaccgaggaggugaaguucuaccagcugggcgaggaggcccugcugaaguucagagaggacgagggcuucgugagagaggaggaggacagagcccugcccgagaacgaguucaagaagcagaucuggcugcuguucgaguaccccgagagcagcagccccgccagaggcaucgccaucgugagcgugcuggugauccugaucagcaucgugaucuucugccuggagacccugcccgaguucagagacgacagagaccuggugauggcccugagcgccggcggccacggcggccugcugaacgacaccagcgccccccaccuggagaacagcggccacaccaucuucaacgaccccuucuucaucguggagaccgugugcaucgugugguucagcuucgaguucguggugagaugcuucgccugccccagccaggcccuguucuucaagaacaucaugaacaucaucgacaucgugagcauccugcccuacuucaucacccugggcaccgaccuggcccagcagcagggcggcggcaacggccagcagcagcaggccaugagcuucgccauccugagaaucaucagacuggugagaguguucagaaucuucaagcugagcagacacagcaagggccugcagauccugggccacacccugagagccagcaugagagagcugggccugcugaucuucuuccuguucaucggcgugauccuguucagcagcgccguguacuucgccgaggccgacgagcccaccacccacuuccagagcauccccgacgccuucuggugggccguggugaccaugaccaccgugggcuacggcgacaugaagcccaucaccgugggcggcaagaucgugggcagccugugcgccaucgccggcgugcugaccaucgcccugcccgugcccgugaucgugagcaacuucaacuacuucuaccacagagagaccgagaacgaggagcagacccagcugacccagaacgccgugagcugccccuaccugcccagcaaccugcugaagaaguucagaagcagcaccagcagcagccugggcgacaagagcgaguaccuggagauggaggagggcgugaaggagagccugugcgccaaggaggagaagugccagggcaagggcgacgacagcgagaccgacaagaacaacugcagcaacgccaaggccguggagaccgacguguaa

SEQ ID NO: 18768 - RNA, 1842 nt, Artificial Sequence
  KCNA5__Homo_sapiens__NP_002225
auggagaucgcccuggugccccuggagaacggcggcgccaugaccgugagaggcggcgacgaggccagagccggcugcggccaggccaccggcggcgagcugcagugcccccccaccgccggccugagcgacggccccaaggagcccgcccccaagggcagaggcgcccagagagacgccgacagcggcgugagaccccugcccccccugcccgaccccggcgugagaccccugcccccccugcccgaggagcugcccagacccagaagacccccccccgaggacgaggaggaggagggcgaccccggccugggcaccguggaggaccaggcccugggcaccgccagccugcaccaccagagagugcacaucaacaucagcggccugagauucgagacccagcugggcacccuggcccaguuccccaacacccugcugggcgaccccgccaagagacugagauacuucgacccccugagaaacgaguacuucuucgacagaaacagacccagcuucgacggcauccuguacuacuaccagagcggcggcagacugagaagacccgugaacgugagccuggacguguucgccgacgagaucagauucuaccagcugggcgacgaggccauggagagauucagagaggacgagggcuucaucaaggaggaggagaagccccugcccagaaacgaguuccagagacagguguggcugaucuucgaguaccccgagagcagcggcagcgccagagccaucgccaucgugagcgugcuggugauccugaucagcaucaucaccuucugccuggagacccugcccgaguucagagacgagagagagcugcugagacacccccccgccccccaccagccccccgcccccgcccccggcgccaacggcagcggcgugauggccccccccagcggccccaccguggccccccugcugcccagaacccuggccgaccccuucuucaucguggagaccaccugcgugaucugguucaccuucgagcugcuggugagauucuucgccugccccagcaaggccggcuucagcagaaacaucaugaacaucaucgacgugguggccaucuuccccuacuucaucacccugggcaccgagcuggccgagcagcagcccggcggcggcggcggcggccagaacggccagcaggccaugagccuggccauccugagagugaucagacuggugagaguguucagaaucuucaagcugagcagacacagcaagggccugcagauccugggcaagacccugcaggccagcaugagagagcugggccugcugaucuucuuccuguucaucggcgugauccuguucagcagcgccguguacuucgccgaggccgacaaccagggcacccacuucagcagcauccccgacgccuucuggugggccguggugaccaugaccaccgugggcuacggcgacaugagacccaucaccgugggcggcaagaucgugggcagccugugcgccaucgccggcgugcugaccaucgcccugcccgugcccgugaucgugagcaacuucaacuacuucuaccacagagagaccgaccacgaggagcccgccgugcugaaggaggagcagggcacccagagccagggccccggccuggacagaggcgugcagagaaaggugagcggcagcagaggcagcuucugcaaggccggcggcacccuggagaacgccgacagcgccagaagaggcagcugcccccuggagaagugcaacgugaaggccaagagcaacguggaccugagaagaagccuguacgcccugugccuggacaccagcagagagaccgaccuguaa

SEQ ID NO: 18769 - RNA, 1590 nt, Artificial Sequence
  KCNA6__Homo_sapiens__XP_011519257
augagaagcgagaagagccugacccuggccgcccccggcgaggugagaggccccgagggcgagcagcaggacgccggcgacuuccccgaggccggcggcggcggcggcugcugcagcagcgagagacuggugaucaacaucagcggccugagauucgagacccagcugagaacccugagccuguuccccgacacccugcugggcgaccccggcagaagagugagauucuucgacccccugagaaacgaguacuucuucgacagaaacagacccagcuucgacgccauccuguacuacuaccagagcggcggcagacugagaagacccgugaacgugccccuggacaucuuccuggaggagaucagauucuaccagcugggcgacgaggcccuggccgccuucagagaggacgagggcugccugcccgagggcggcgaggacgagaagccccugcccagccagcccuuccagagacagguguggcugcuguucgaguaccccgagagcagcggccccgccagaggcaucgccaucgugagcgugcuggugauccugaucagcaucgugaucuucugccuggagacccugccccaguucagaguggacggcagaggcggcaacaacggcggcgugagcagagugagccccgugagcagaggcagccaggaggaggaggaggacgaggacgacagcuacaccuuccaccacggcaucacccccggcgagaugggcaccggcggcagcagcagccugagcacccugggcggcagcuucuucaccgaccccuucuuccugguggagacccugugcaucgugugguucaccuucgagcugcuggugagauucagcgccugccccagcaagcccgccuucuucagaaacaucaugaacaucaucgaccugguggccaucuuccccuacuucaucacccugggcaccgagcuggugcagcagcaggagcagcagcccgccagcggcggcggcggccagaacggccagcaggccaugagccuggccauccugagagugaucagacuggugagaguguucagaaucuucaagcugagcagacacagcaagggccugcagauccugggcaagacccugcaggccagcaugagagagcugggccugcugaucuucuuccuguucaucggcgugauccuguucagcagcgccguguacuucgccgaggccgacgacgacgacagccuguuccccagcauccccgacgccuucuggugggccguggugaccaugaccaccgugggcuacggcgacauguaccccaugaccgugggcggcaagaucgugggcagccugugcgccaucgccggcgugcugaccaucgcccugcccgugcccgugaucgugagcaacuucaacuacuucuaccacagagagaccgagcaggaggagcagggccaguacacccacgugaccugcggccagcccgcccccgaccugagagccaccgacaacggccugggcaagcccgacuuccccgaggccaacagagagagaagacccagcuaccugcccaccccccacagagccuacgccgagaagagaaugcugaccgagguguaa

SEQ ID NO: 18770 - RNA, 1371 nt, Artificial Sequence
  KCNA7__Homo_sapiens__NP_114092
auggagcccagaugccccccccccugcggcugcugcgagagacuggugcugaacguggccggccugagauucgagaccagagccagaacccugggcagauuccccgacacccugcugggcgaccccgccagaagaggcagauucuacgacgacgccagaagagaguacuucuucgacagacacagacccagcuucgacgccgugcuguacuacuaccagagcggcggcagacugagaagacccgcccacgugccccuggacguguuccuggaggagguggccuucuacggccugggcgccgccgcccuggccagacugagagaggacgagggcugccccgugccccccgagagaccccugcccagaagagccuucgccagacagcuguggcugcuguucgaguuccccgagagcagccaggccgccagagugcuggccguggugagcgugcuggugauccuggugagcaucgugguguucugccuggagacccugcccgacuucagagacgacagagacggcaccggccuggccgccgccgccgccgccggccccuuccccgccccccugaacggcagcagccagaugcccggcaacccccccagacugcccuucaacgaccccuucuucgugguggagacccugugcaucugcugguucagcuucgagcugcuggugagacugcuggugugccccagcaaggccaucuucuucaagaacgugaugaaccugaucgacuucguggccauccugcccuacuucguggcccugggcaccgagcuggccagacagagaggcgugggccagcaggccaugagccuggccauccugagagugaucagacuggugagaguguucagaaucuucaagcugagcagacacagcaagggccugcagauccugggccagacccugagagccagcaugagagagcugggccugcugaucuucuuccuguucaucggcguggugcuguucagcagcgccguguacuucgccgagguggacagaguggacagccacuucaccagcauccccgagagcuucuggugggccguggugaccaugaccaccgugggcuacggcgacauggcccccgugaccgugggcggcaagaucgugggcagccugugcgccaucgccggcgugcugaccaucagccugcccgugcccgugaucgugagcaacuucagcuacuucuaccacagagagaccgagggcgaggaggccggcauguucagccacguggacaugcagcccugcggcccccuggagggcaaggccaacggcggccugguggacggcgaggugcccgagcugccccccccccugugggccccccccggcaagcaccuggugaccgagguguaa

SEQ ID NO: 18771 - RNA, 1227 nt, Artificial Sequence
  KCNAB1__Homo_sapiens__NP_003462
augcaccuguacaagcccgccugcgccgacauccccagccccaagcugggccugcccaagagcagcgagagcgcccugaagugcagauggcaccuggccgugaccaagacccagccccaggccgccugcaagcccgugagacccagcggcgccgccgagcagaaguacguggagaaguuccugagagugcacggcaucagccugcaggagaccaccagagccgagaccggcauggccuacagaaaccugggcaagagcggccugagagugagcugccugggccugggcaccugggugaccuucggcggccagaucagcgacgagguggccgagagacugaugaccaucgccuacgagagcggcgugaaccuguucgacaccgccgagguguacgccgccggcaaggccgaggugauccugggcagcaucaucaagaagaagggcuggagaagaagcagccuggugaucaccaccaagcuguacuggggcggcaaggccgagaccgagagaggccugagcagaaagcacaucaucgagggccugaagggcagccugcagagacugcagcuggaguacguggacgugguguucgccaacagacccgacagcaacacccccauggaggagaucgugagagccaugacccacgugaucaaccagggcauggccauguacuggggcaccagcagauggagcgccauggagaucauggaggccuacagcguggccagacaguucaacaugaucccccccgugugcgagcaggccgaguaccaccuguuccagagagagaagguggaggugcagcugcccgagcuguaccacaagaucggcgugggcgccaugaccuggagcccccuggccugcggcaucaucagcggcaaguacggcaacggcgugcccgagagcagcagagccagccugaagugcuaccaguggcugaaggagagaaucgugagcgaggagggcagaaagcagcagaacaagcugaaggaccugagccccaucgccgagagacugggcugcacccugccccagcuggccguggccuggugccugagaaacgagggcgugagcagcgugcugcugggcagcagcacccccgagcagcugaucgagaaccugggcgccauccaggugcugcccaagaugaccagccacguggugaacgagaucgacaacauccugagaaacaagcccuacagcaagaaggacuacagaagcuaa

SEQ ID NO: 18772 - RNA, 1203 nt, Artificial Sequence
  KCNAB2__Homo_sapiens__XP_011540622
augcugagcaugaccuacagcgagagccugagaagcgugagcagcagaugccacagcgagugggcccugcaccccgugagacagaccgacacccuggagcugcagagacugagagaggugagagccgccgcccaggccagaaacauggagagcuuccugagaaugcacggccugagccuggacggcugcaccgcccagagaaccggcaugaaguacagaaaccugggcaagagcggccugagagugagcugccugggccugggcaccugggugaccuucggcggccagaucaccgacgagauggccgagcagcugaugacccuggccuacgacaacggcaucaaccuguucgacaccgccgagguguacgccgccggcaaggccgagguggugcugggcaacaucaucaagaagaagggcuggagaagaagcagccuggugaucaccaccaagaucuucuggggcggcaaggccgagaccgagagaggccugagcagaaagcacaucaucgagggccugaaggccagccuggagagacugcagcuggaguacguggacgugguguucgccaacagacccgaccccaacacccccauggaggagaccgugagagccaugacccacgugaucaaccagggcauggccauguacuggggcaccagcagauggagcagcauggagaucauggaggccuacagcguggccagacaguucaaccugaccccccccaucugcgagcaggccgaguaccacauguuccagagagagaagguggaggugcagcugcccgagcuguuccacaagaucggcgugggcgccaugaccuggagcccccuggccugcggcaucgugagcggcaaguacgacagcggcaucccccccuacagcagagccagccugaagggcuaccaguggcugaaggacaagauccugagcgaggagggcagaagacagcaggccaagcugaaggagcugcaggccaucgccgagagacugggcugcacccugccccagcuggccaucgccuggugccugagaaacgagggcgugagcagcgugcugcugggcgccagcaacgccgaccagcugauggagaacaucggcgccauccaggugcugcccaagcugagcagcagcaucauccacgagaucgacagcauccugggcaacaagcccuacagcaagaaggacuacagaagcuaa

SEQ ID NO: 18773 - RNA, 1215 nt, Artificial Sequence
  KCNAB3__Homo_sapiens__NP_004723
augcaggugagcaucgccugcaccgagcagaaccugagaagcagaagcagcgaggacagacugugcggccccagacccggccccggcggcggcaacggcggccccgccggcggcggccacggcaacccccccggcggcggcggcagcggccccaaggccagagccgcccuggugcccagaccccccgcccccgccggcgcccugagagagagcaccggcagaggcaccggcaugaaguacagaaaccugggcaagagcggccugagagugagcugccugggccugggcaccugggugaccuucggcagccagaucagcgacgagaccgccgaggacgugcugaccguggccuacgagcacggcgugaaccuguucgacaccgccgagguguacgccgccggcaaggccgagagaacccugggcaacauccugaagagcaagggcuggagaagaagcagcuacgugaucaccaccaagaucuucuggggcggccaggccgagaccgagagaggccugagcagaaagcacaucaucgagggccugagaggcagccuggagagacugcagcugggcuacguggacaucguguucgccaacagaagcgaccccaacugccccauggaggagaucgugagagccaugaccuacgugaucaaccagggccuggcccuguacuggggcaccagcagauggggcgccgccgagaucauggaggccuacagcauggccagacaguucaaccugaucccccccgugugcgagcaggccgagcaccaccuguuccagagagagaagguggagaugcagcugcccgagcuguaccacaagaucggcgugggcagcgugaccugguacccccuggccugcggccugaucaccagcaaguacgacggcagagugcccgacaccugcagagccagcaucaagggcuaccaguggcugaaggacaaggugcagagcgaggacggcaagaagcagcaggccaaggugauggaccugcugcccguggcccaccagcugggcugcaccguggcccagcuggccaucgccuggugccugagaagcgagggcgugagcagcgugcugcugggcgugagcagcgccgagcagcugaucgagcaccugggcgcccugcaggugcugagccagcugaccccccagaccgugauggagaucgacggccugcugggcaacaagccccacagcaagaaguaa

SEQ ID NO: 18774 - RNA, 2577 nt, Artificial Sequence
  KCNB1__Homo_sapiens__XP_011527101
augcccgccggcaugaccaagcacggcagcagaagcaccagcagccugccccccgagcccauggagaucgugagaagcaaggccugcagcagaagagugagacugaacgugggcggccuggcccacgaggugcuguggagaacccuggacagacugcccagaaccagacugggcaagcugagagacugcaacacccacgacagccugcuggaggugugcgacgacuacagccuggacgacaacgaguacuucuucgacagacaccccggcgccuucaccagcauccugaacuucuacagaaccggcagacugcacaugauggaggagaugugcgcccugagcuucagccaggagcuggacuacuggggcaucgacgagaucuaccuggagagcugcugccaggccagauaccaccagaagaaggagcagaugaacgaggagcugaagagagaggccgagacccugagagagagagagggcgaggaguucgacaacaccugcugcgccgagaagagaaagaagcugugggaccugcuggagaagcccaacagcagcguggccgccaagauccuggccaucaucagcaucauguucaucgugcugagcaccaucgcccugagccugaacacccugcccgagcugcagagccuggacgaguucggccagagcaccgacaacccccagcuggcccacguggaggccgugugcaucgccugguucaccauggaguaccugcugagauuccugagcagccccaagaaguggaaguucuucaagggcccccugaacgccaucgaccugcuggccauccugcccuacuacgugaccaucuuccugaccgagagcaacaagagcgugcugcaguuccagaacgugagaagaguggugcagaucuucagaaucaugagaauccugagaauccugaagcuggccagacacagcaccggccugcagagccugggcuucacccugagaagaagcuacaacgagcugggccugcugauccuguuccuggccaugggcaucaugaucuucagcagccugguguucuucgccgagaaggacgaggacgacaccaaguucaagagcauccccgccagcuucuggugggccaccaucaccaugaccaccgugggcuacggcgacaucuaccccaagacccugcugggcaagaucgugggcggccugugcugcaucgccggcgugcuggugaucgcccugcccauccccaucaucgugaacaacuucagcgaguucuacaaggagcagaagagacaggagaaggccaucaagagaagagaggcccuggagagagccaagagaaacggcagcaucgugagcaugaacaugaaggacgccuucgccagaagcaucgagaugauggacaucgugguggagaagaacggcgagaacaugggcaagaaggacaaggugcaggacaaccaccugagccccaacaaguggaaguggaccaagagaacccugagcgagaccagcagcagcaagagcuucgagaccaaggagcagggcagccccgagaaggccagaagcagcagcagcccccagcaccugaacgugcagcagcuggaggacauguacaacaagauggccaagacccagagccagcccauccugaacaccaaggagagcgccgcccagagcaagcccaaggaggagcuggagauggagagcauccccagccccguggccccccugcccaccagaaccgagggcgugaucgacaugagaagcaugagcagcaucgacagcuucaucagcugcgccaccgacuuccccgaggccaccagauucagccacagcccccugaccagccugcccagcaagaccggcggcagcaccgcccccgaggugggcuggagaggcgcccugggcgccagcggcggcagauucguggaggccaaccccagccccgacgccagccagcacagcagcuucuucaucgagagccccaagagcagcaugaagaccaacaacccccugaagcugagagcccugaaggugaacuucauggagggcgaccccagcccccugcugcccgugcugggcauguaccacgacccccugagaaacagaggcagcgccgccgccgccguggccggccuggagugcgccacccugcuggacaaggccgugcugagccccgagagcagcaucuacaccaccgccagcgccaagaccccccccagaagccccgagaagcacaccgccaucgccuucaacuucgaggccggcgugcaccaguacaucgacgccgacaccgacgacgagggccagcugcuguacagcguggacagcagcccccccaagagccugcccggcagcaccagccccaaguucagcaccggcaccagaagcgagaagaaccacuucgagagcagcccccugcccaccagccccaaguuccugagacagaacugcaucuacagcaccgaggcccugaccggcaagggccccagcggccaggagaagugcaagcuggagaaccacaucagccccgacgugagagugcugcccggcggcggcgcccacggcagcaccagagaccagagcaucuaa

SEQ ID NO: 18775 - RNA, 2736 nt, Artificial Sequence
  KCNB2__Homo_sapiens__NP_004761
auggccgagaaggccccccccggccugaacagaaagaccagcagaagcacccugagccugccccccgagcccguggacaucaucagaagcaagaccugcagcagaagagugaagaucaacgugggcggccugaaccacgaggugcuguggagaacccuggacagacugcccagaaccagacugggcaagcugagagacugcaacacccacgagagccugcuggaggugugcgacgacuacaaccugaacgagaacgaguacuucuucgacagacaccccggcgccuucaccagcauccugaacuucuacagaaccggcaagcugcacaugauggaggagaugugcgcccugagcuucggccaggagcuggacuacuggggcaucgacgagaucuaccuggagagcugcugccaggccagauaccaccagaagaaggagcagaugaacgaggagcugagaagagaggccgagaccaugagagagagagagggcgaggaguucgacaacaccugcugccccgacaagagaaagaagcugugggaccugcuggagaagcccaacagcagcguggccgccaagauccuggccaucgugagcauccuguucaucgugcugagcaccaucgcccugagccugaacacccugcccgagcugcaggagaccgacgaguucggccagcugaacgacaacagacagcuggcccacguggaggccgugugcaucgccugguucaccauggaguaccugcugagauuccugagcagccccaacaaguggaaguucuucaagggcccccugaacgugaucgaccugcuggccauccugcccuacuacgugaccaucuuccugaccgagagcaacaagagcgugcugcaguuccagaacgugagaagaguggugcagaucuucagaaucaugagaauccugagaauccugaagcuggccagacacagcaccggccugcagagccugggcuucacccugagaagaagcuacaacgagcugggccugcugauccuguuccuggccaugggcaucaugaucuucagcagccugguguucuucgccgagaaggacgaggacgccaccaaguucaccagcauccccgccagcuucuggugggccaccaucaccaugaccaccgugggcuacggcgacaucuaccccaagacccugcugggcaagaucgugggcggccugugcugcaucgccggcgugcuggugaucgcccugcccauccccaucaucgugaacaacuucagcgaguucuacaaggagcagaagagacaggagaaggccaucaagagaagagaggcccuggagagagccaagagaaacggcagcaucgugagcaugaaccugaaggacgccuucgccagaagcauggagcugaucgacguggccguggagaaggccggcgagagcgccaacaccaaggacagcgccgacgacaaccaccugagccccagcagauggaagugggccagaaaggcccugagcgagaccagcagcaacaagagcuucgagaacaaguaccaggaggugagccagaaggacagccacgagcagcugaacaacaccagcagcagcagcccccagcaccugagcgcccagaagcuggagaugcuguacaacgagaucaccaagacccagccccacagccaccccaaccccgacugccaggagaagcccgagagacccagcgccuacgaggaggagaucgagauggaggagguggugugcccccaggagcagcuggccguggcccagaccgaggugaucguggacaugaagagcaccagcagcaucgacagcuucaccagcugcgccaccgacuucaccgagaccgagagaagcccccugcccccccccagcgccagccaccugcagaugaaguuccccaccgaccugcccggcaccgaggagcaccagagagccagaggcccccccuuccugacccugagcagagagaagggccccgccgccagagacggcacccuggaguacgcccccguggacaucaccgugaaccuggacgccagcggcagccagugcggccugcacagcccccugcagagcgacaacgccaccgacagccccaagagcagccugaagggcagcaacccccugaagagcagaagccugaaggugaacuucaaggagaacagaggcagcgccccccagaccccccccagcaccgccagaccccugcccgugaccaccgccgacuucagccugaccaccccccagcacaucagcaccauccugcuggaggagacccccagccagggcgacagaccccugcugggcaccgaggugagcgcccccugccagggccccagcaagggccugagccccagauuccccaagcagaagcuguuccccuucagcagcagagagagaagaagcuucaccgagaucgacaccggcgacgacgaggacuuccuggagcugcccggcgccagagaggagaagcagguggacagcagccccaacugcuucgccgacaagcccagcgacggcagagacccccugagagaggagggcagcgugggcagcagcagcccccaggacaccggccacaacugcagacaggacaucuaccacgccgugagcgaggugaagaaggacagcagccaggagggcugcaagauggagaaccaccuguucgcccccgagauccacagcaaccccggcgacaccggcuacugccccaccagagagaccagcauguaa

SEQ ID NO: 18776 - RNA, 1758 nt, Artificial Sequence
  KCNC1__Homo_sapiens__NP_001106212
augggccagggcgacgagagcgagagaaucgugaucaacgugggcggcaccagacaccagaccuacagaagcacccugagaacccugcccggcaccagacuggccuggcuggccgagcccgacgcccacagccacuucgacuacgaccccagagccgacgaguucuucuucgacagacaccccggcguguucgcccacauccugaacuacuacagaaccggcaagcugcacugccccgccgacgugugcggcccccuguacgaggaggagcuggccuucuggggcaucgacgagaccgacguggagcccugcugcuggaugaccuacagacagcacagagacgccgaggaggcccuggacagcuucggcggcgccccccuggacaacagcgccgacgacgccgacgccgacggccccggcgacagcggcgacggcgaggacgagcuggagaugaccaagagacuggcccugagcgacagccccgacggcagacccggcggcuucuggagaagauggcagcccagaaucugggcccuguucgaggaccccuacagcagcagauacgccagauacguggccuucgccagccuguucuucauccuggugagcaucaccaccuucugccuggagacccacgagagauucaaccccaucgugaacaagaccgagaucgagaacgugagaaacggcacccaggugagauacuacagagaggccgagaccgaggccuuccugaccuacaucgagggcgugugcguggugugguucaccuucgaguuccugaugagagugaucuucugccccaacaagguggaguucaucaagaacagccugaacaucaucgacuucguggccauccugcccuucuaccuggaggugggccugagcggccugagcagcaaggccgccaaggacgugcugggcuuccugagaguggugagauucgugagaauccugagaaucuucaagcugaccagacacuucgugggccugagagugcugggccacacccugagagccagcaccaacgaguuccugcugcugaucaucuuccuggcccugggcgugcugaucuucgccaccaugaucuacuacgccgagagaaucggcgcccagcccaacgaccccagcgccagcgagcacacccacuucaagaacauccccaucggcuucuggugggccguggugaccaugaccacccugggcuacggcgacauguacccccagaccuggagcggcaugcuggugggcgcccugugcgcccuggccggcgugcugaccaucgccaugcccgugcccgugaucgugaacaacuucggcauguacuacagccuggccauggccaagcagaagcugcccaagaagaagaagaagcacauccccagacccccccagcugggcagccccaacuacugcaagagcguggugaacagcccccaccacagcacccagagcgacaccugcccccuggcccaggaggagauccuggagaucaacagagccgacagcaagcugaacggcgagguggccaaggccgcccuggccaacgaggacugcccccacaucgaccaggcccugacccccgacgagggccugcccuucaccagaagcggcaccagagagagauacggccccugcuuccugcugagcaccggcgaguacgccugcccccccggcggcggcaugagaaaggaccugugcaaggagagccccgugaucgccaaguacaugcccaccgaggccgugagagugaccuaa

SEQ ID NO: 18777 - RNA, 1890 nt, Artificial Sequence
  KCNC2__Homo_sapiens__NP_001247427
augggcaagaucgagaacaacgagagagugauccugaacgugggcggcaccagacacgagaccuacagaagcacccugaagacccugcccggcaccagacuggcccugcuggccagcagcgagccccccggcgacugccugaccaccgccggcgacaagcugcagcccagcccccccccccugagccccccccccagagcccccccccugagccccggccccggcggcugcuucgagggcggcgccggcaacugcagcagcagaggcggcagagccagcgaccaccccggcggcggcagagaguucuucuucgacagacaccccggcguguucgccuacgugcugaacuacuacagaaccggcaagcugcacugccccgccgacgugugcggcccccuguucgaggaggagcuggccuucuggggcaucgacgagaccgacguggagcccugcugcuggaugaccuacagacagcacagagacgccgaggaggcccuggacaucuucgagacccccgaccugaucggcggcgaccccggcgacgacgaggaccuggccgccaagagacugggcaucgaggacgccgccggccugggcggccccgacggcaagagcggcagauggagaagacugcagcccagaaugugggcccuguucgaggaccccuacagcagcagagccgccagauucaucgccuucgccagccuguucuucauccuggugagcaucaccaccuucugccuggagacccacgaggccuucaacaucgugaagaacaagaccgagcccgugaucaacggcaccagcguggugcugcaguacgagaucgagaccgaccccgcccugaccuacguggagggcgugugcguggugugguucaccuucgaguuccuggugagaaucguguucagccccaacaagcuggaguucaucaagaaccugcugaacaucaucgacuucguggccauccugcccuucuaccuggaggugggccugagcggccugagcagcaaggccgccaaggacgugcugggcuuccugagaguggugagauucgugagaauccugagaaucuucaagcugaccagacacuucgugggccugagagugcugggccacacccugagagccagcaccaacgaguuccugcugcugaucaucuuccuggcccugggcgugcugaucuucgccaccaugaucuacuacgccgagagagugggcgcccagcccaacgaccccagcgccagcgagcacacccaguucaagaacauccccaucggcuucuggugggccguggugaccaugaccacccugggcuacggcgacauguacccccagaccuggagcggcaugcuggugggcgcccugugcgcccuggccggcgugcugaccaucgccaugcccgugcccgugaucgugaacaacuucggcauguacuacagccuggccauggccaagcagaagcugcccagaaagagaaagaagcacaucccccccgccccccaggccagcagccccaccuucugcaagaccgagcugaacauggccugcaacagcacccagagcgacaccugccugggcaaggacaacagacugcuggagcacaacagaagcgugcugagcggcgacgacagcaccggcagcgagcccccccugagcccccccgagagacugcccaucagaagaagcagcaccagagacaagaacagaagaggcgagaccugcuuccugcugaccaccggcgacuacaccugcgccagcgacggcggcaucagaaaggugcuguacagaaucuaccacggccugcugaccgccgagaagggcaccguggaguucagccacaccaaggacuacaccggcaacagacugcugcugcugaacgugcccuaa

SEQ ID NO: 18778 - RNA, 2274 nt, Artificial Sequence
  KCNC3__Homo_sapiens__XP_006723266
augcugagcagcgugugcgugagcagcuucagaggcagacagggcgccagcaagcagcagcccgccccccccccccagccccccgagagcccccccccccccccccugcccccccagcagcagcagcccgcccagcccggccccgccgccagccccgccggcccccccgcccccagaggccccggcgacagaagagccgagcccugccccggccugcccgccgccgccaugggcagacacggcggcggcggcggcgacagcggcaagaucgugaucaacgugggcggcgugagacacgagaccuacagaagcacccugagaacccugcccggcaccagacuggccggccugaccgagcccgaggccgccgccagauucgacuacgaccccggcgccgacgaguucuucuucgacagacaccccggcguguucgccuacgugcugaacuacuacagaaccggcaagcugcacugccccgccgacgugugcggcccccuguucgaggaggagcugggcuucuggggcaucgacgagaccgacguggaggccugcugcuggaugaccuacagacagcacagagacgccgaggaggcccuggacagcuucgaggcccccgaccccgccggcgccgccaacgccgccaacgccgccggcgcccacgacggcggccuggacgacgaggccggcgccggcggcggcggccuggacggcgccggcggcgagcugaagagacugugcuuccaggacgccggcggcggcgccggcggcccccccggcggcgccggcggcgccggcggcaccugguggagaagauggcagcccagagugugggcccuguucgaggaccccuacagcagcagagccgccagauacguggccuucgccagccuguucuucauccugaucagcaucaccaccuucugccuggagacccacgagggcuucauccacaucagcaacaagaccgugacccaggccagccccauccccggcgccccccccgagaacaucaccaacguggagguggagaccgagcccuuccugaccuacguggagggcgugugcguggugugguucaccuucgaguuccugaugagaaucaccuucugccccgacaagguggaguuccugaagagcagccugaacaucaucgacugcguggccauccugcccuucuaccuggaggugggccugagcggccugagcagcaaggccgccaaggacgugcugggcuuccugagaguggugagauucgugagaauccugagaaucuucaagcugaccagacacuucgugggccugagagugcugggccacacccugagagccagcaccaacgaguuccugcugcugaucaucuuccuggcccugggcgugcugaucuucgccaccaugaucuacuacgccgagagaaucggcgccgaccccgacgacauccugggcagcaaccacaccuacuucaagaacauccccaucggcuucuggugggccguggugaccaugaccacccugggcuacggcgacauguaccccaagaccuggagcggcaugcuggugggcgcccugugcgcccuggccggcgugcugaccaucgccaugcccgugcccgugaucgugaacaacuucggcauguacuacagccuggccauggccaagcagaagcugcccaagaagaagaacaagcacauccccagacccccccagcccggcagccccaacuacugcaagcccgacccccccccccccccccccccccacccccaccacggcagcggcggcaucagcccccccccccccaucaccccccccagcaugggcgugaccguggccggcgccuaccccgccggcccccacacccaccccggccugcugagaggcggcgccggcggccugggcaucaugggccugcccccccugcccgcccccggcgagcccugcccccuggcccaggaggaggugaucgagaucaacagagccgaccccagacccaacggcgaccccgccgccgccgcccuggcccacgaggacugccccgccaucgaccagcccgccaugagccccgaggacaagagccccaucacccccggcagcagaggcagauacagcagagacagagccugcuuccugcugaccgacuacgcccccagccccgacggcagcaucagaaaggccaccggcgcccccccccugcccccccaggacuggagaaagcccggcccccccagcuuccugcccgaccugaacgccaacgccgccgccuggaucagccccuaa

SEQ ID NO: 18779 - RNA, 1893 nt, Artificial Sequence
  KCND2__Homo_sapiens__NP_036413
auggccgccggcguggccgccuggcugcccuucgccagagccgccgccaucggcuggaugcccguggccagcggccccaugcccgccccccccagacaggagagaaagagaacccaggacgcccugaucgugcugaacgugagcggcaccagauuccagaccuggcaggacacccuggagagauaccccgacacccugcugggcagcagcgagagagacuucuucuaccaccccgagacccagcaguacuucuucgacagagaccccgacaucuucagacacauccugaacuucuacagaaccggcaagcugcacuaccccagacacgagugcaucagcgccuacgacgaggagcuggccuucuucggccugauccccgagaucaucggcgacugcugcuacgaggaguacaaggacagaagaagagagaacgccgagagacugcaggacgacgccgacaccgacaccgccggcgagagcgcccugcccaccaugaccgccagacagagaguguggagagccuucgagaacccccacaccagcaccauggcccugguguucuacuacgugaccggcuucuucaucgccgugagcgugaucgccaacgugguggagaccgugcccugcggcagcagccccggccacaucaaggagcugcccugcggcgagagauacgccguggccuucuucugccuggacaccgccugcgugaugaucuucaccguggaguaccugcugagacuggccgccgcccccagcagauacagauucgugagaagcgugaugagcaucaucgacgugguggccauccugcccuacuacaucggccuggugaugaccgacaacgaggacgugagcggcgccuucgugacccugagaguguucagaguguucagaaucuucaaguucagcagacacagccagggccugagaauccugggcuacacccugaagagcugcgccagcgagcugggcuuccugcuguucagccugaccauggccaucaucaucuucgccaccgugauguucuacgccgagaagggcagcagcgccagcaaguucaccagcauccccgccgccuucugguacaccaucgugaccaugaccacccugggcuacggcgacauggugcccaagaccaucgccggcaagaucuucggcagcaucugcagccugagcggcgugcuggugaucgcccugcccgugcccgugaucgugagcaacuucagcagaaucuaccaccagaaccagagagccgacaagagaagagcccagaagaaggccagacuggccagaaucagagccgccaagagcggcagcgccaacgccuacaugcagagcaagagaaacggccugcugagcaaccagcugcagagcagcgaggacgagcaggccuucgugagcaagagcggcagcagcuucgagacccagcaccaccaccugcugcacugccuggagaagaccaccaaccacgaguucguggacgagcagguguucgaggagagcugcauggagguggccaccgugaacagacccagcagccacagccccagccugagcagccagcagggcgugaccagcaccugcugcagcagaagacacaagaagaccuucagaauccccaacgccaacgugagcggcagccaccagggcagcauccaggagcugagcaccauccagaucagaugcguggagagaaccccccugagcaacagcagaagcagccugaacgccaagauggaggagugcgugaagcugaacugcgagcagcccuacgugaccaccgccaucaucagcauccccaccccccccgugaccacccccgagggcgacgacagacccgagagccccgaguacagcggcggcaacaucgugagagugagcgcccuguaa

SEQ ID NO: 18780 - RNA, 390 nt, Artificial Sequence
  KCNE1__Homo_sapiens__NP_001257334
augauccugagcaacaccaccgccgugacccccuuccugaccaagcuguggcaggagaccgugcagcagggcggcaacaugagcggccuggccagaagaagccccagaagcagcgacggcaagcuggaggcccuguacgugcugauggugcugggcuucuucggcuucuucacccugggcaucaugcugagcuacaucagaagcaagaagcuggagcacagcaacgaccccuucaacguguacaucgagagcgacgccuggcaggagaaggacaaggccuacgugcaggccagagugcuggagagcuacagaagcugcuacgugguggagaaccaccuggccaucgagcagcccaacacccaccugcccgagaccaagcccagccccuaa

SEQ ID NO: 18781 - RNA, 372 nt, Artificial Sequence
  KCNE2__Homo_sapiens__NP_751951
augagcacccugagcaacuucacccagacccuggaggacguguucagaagaaucuucaucaccuacauggacaacuggagacagaacaccaccgccgagcaggaggcccugcaggccaagguggacgccgagaacuucuacuacgugauccuguaccugauggugaugaucggcauguucagcuucaucaucguggccauccuggugagcaccgugaagagcaagagaagagagcacagcaacgaccccuaccaccaguacaucguggaggacuggcaggagaaguacaagagccagauccugaaccuggaggagagcaaggccaccauccacgagaacaucggcgccgccggcuucaagaugagccccuaa

SEQ ID NO: 18782 - RNA, 312 nt, Artificial Sequence
  KCNE3__Homo_sapiens__NP_005463
auggagaccaccaacggcaccgagaccugguacgagagccugcacgccgugcugaaggcccugaacgccacccugcacagcaaccugcugugcagacccggccccggccugggccccgacaaccagaccgaggagagaagagccagccugcccggcagagacgacaacagcuacauguacauccuguucgugauguuccuguucgccgugaccgugggcagccugauccugggcuacaccagaagcagaaagguggacaagagaagcgaccccuaccacguguacaucaagaacagagugagcaugaucuaa

SEQ ID NO: 18783 - RNA, 666 nt, Artificial Sequence
  KCNE4__Homo_sapiens__NP_542402
augcacuuccugaccaucuaccccaacugcagcagcggcguggugagagcccagagcagaaccgagcagaagaacccccugggccuggacgaccugggcauccagaaccugggccagaccgugagccuggcccccgccguggaggccgccagcaugcugaagauggagccccugaacagcacccaccccggcaccgccgccagcagcagcccccuggagagcagagccgccggcggcggcagcggcaacggcaacgaguacuucuacauccugguggugaugagcuucuacggcaucuuccugaucggcaucaugcugggcuacaugaagagcaagagaagagagaagaagagcagccugcugcugcuguacaaggacgaggagagacuguggggcgaggccaugaagccccugcccguggugagcggccugagaagcgugcaggugccccugaugcugaacaugcugcaggagagcguggcccccgcccugagcugcacccugugcagcauggagggcgacagcgugagcagcgagagcagcagccccgacgugcaccugaccauccaggaggagggcgccgacgacgagcuggaggagaccagcgagaccccccugaacgagagcagcgagggcagcagcgagaacauccaccagaacagcuaa

SEQ ID NO: 18784 - RNA, 429 nt, Artificial Sequence
  KCNE5__Homo_sapiens__NP_036414
augaacugcagcgagagccagagacugagaacccugcugagcagacugcugcuggagcugcaccacagaggcaacgccagcggccugggcgccggccccagacccagcaugggcaugggcguggugcccgaccccuucgugggcagagaggugaccagcgccaagggcgacgacgccuaccuguacauccugcugaucaugaucuucuacgccugccuggccggcggccugauccuggccuacaccagaagcagaaagcugguggaggccaaggacgagcccagccaggccugcgccgagcacgagugggcccccggcggcgcccugaccgccgacgccgaggccgccgccggcagccaggccgagggcagaagacagcuggccagcgagggccugcccgcccuggcccagggcgccgagagaguguaa

SEQ ID NO: 18785 - RNA, 1311 nt, Artificial Sequence
  KCNG3__Homo_sapiens__NP_579875
augaccuucggcagaagcggcgccgccagcguggugcugaacgugggcggcgccagauacagccugagcagagagcugcugaaggacuucccccugagaagagugagcagacugcacggcugcagaagcgagagagacgugcuggaggugugcgacgacuacgacagagagagaaacgaguacuucuucgacagacacagcgaggccuucggcuucauccugcuguacgugagaggccacggcaagcugagauucgcccccagaaugugcgagcugagcuucuacaacgagaugaucuacuggggccuggagggcgcccaccuggaguacugcugccagagaagacuggacgacagaaugagcgacaccuacaccuucuacagcgccgacgagcccggcgugcugggcagagacgaggccagacccggcggcgccgaggccgcccccagcagaagauggcuggagagaaugagaagaaccuucgaggagcccaccagcagccuggccgcccagauccuggccagcgugagcgugguguucgugaucgugagcaugguggugcugugcgccagcacccugcccgacuggagaaacgccgccgccgacaacagaagccuggacgacagaagcagauacagcgccggccccggcagagagcccagcggcaucaucgaggccaucugcaucggcugguucaccgccgagugcaucgugagauucaucgugagcaagaacaagugcgaguucgugaagagaccccugaacaucaucgaccugcuggccaucacccccuacuacaucagcgugcugaugaccguguucaccggcgagaacagccagcugcagagagccggcgugacccugagagugcugagaaugaugagaaucuucugggugaucaagcuggccagacacuucaucggccugcagacccugggccugacccugaagagaugcuacagagagauggugaugcugcugguguucaucugcguggccauggccaucuucagcgcccugagccagcugcuggagcacggccuggaccuggagaccagcaacaaggacuucaccagcauccccgccgccugcuggugggugaucaucagcaugaccaccgugggcuacggcgacauguaccccaucaccgugcccggcagaauccugggcggcgugugcguggugagcggcaucgugcugcuggcccugcccaucaccuucaucuaccacagcuucgugcagugcuaccacgagcugaaguucagaagcgccagauacagcagaagccugagcaccgaguuccugaacuaa

SEQ ID NO: 18786 - RNA, 1560 nt, Artificial Sequence
  KCNG4__Homo_sapiens__NP_758857
augcccaugcccagcagagacggcggccugcaccccagacaccaccacuacggcagccacagccccuggagccagcugcugagcagccccauggagacccccagcaucaagggccuguacuacagaagagugagaaaggugggcgcccuggacgccagccccguggaccugaagaaggagauccugaucaacgugggcggcagaagauaccugcugcccuggagcacccuggacagauucccccugagcagacugagcaagcugagacugugcagaagcuacgaggagaucgugcagcugugcgacgacuacgacgaggacagccaggaguucuucuucgacagaagccccagcgccuucggcgugaucgugagcuuccuggccgccggcaagcuggugcugcugcaggagaugugcgcccugagcuuccaggaggagcuggccuacuggggcaucgaggaggcccaccuggagagaugcugccugagaaagcugcugagaaagcuggaggagcuggaggagcuggccaagcugcacagagaggacgugcugagacagcagagagagaccagaagacccgccagccacagcagcagauggggccugugcaugaacagacugagagagaugguggagaacccccagagcggccugcccggcaagguguucgccugccugagcauccuguucguggccaccaccgccgugagccugugcgugagcaccaugcccgaccugagagccgaggaggaccagggcgagugcagcagaaagugcuacuacaucuucaucguggagaccaucugcguggccugguucagccuggaguucugccugagauucgugcaggcccaggacaagugccaguucuuccagggcccccugaacaucaucgacauccuggccaucagccccuacuacgugagccuggccgugagcgaggagccccccgaggacggcgagagacccagcggcagcagcuaccuggagaaggugggccuggugcugagagugcugagagcccugagaauccuguacgugaugagacuggccagacacagccugggccugcagacccugggccugaccgugagaagaugcaccagagaguucggccugcugcugcuguuccuggccguggccaucacccuguucagcccccugguguacguggccgagaaggagagcggcagagugcuggaguucaccagcauccccgccagcuacuggugggccaucaucagcaugaccaccgugggcuacggcgacauggugcccagaagcgugcccggccagaugguggcccugagcagcauccugagcggcauccugaucauggccuuccccgccaccagcaucuuccacaccuucagccacagcuaccuggagcugaagaaggagcaggagcagcugcaggccagacugagacaccugcagaacaccggccccgccagcgagugcgagcugcuggacccccacguggccagcgagcacgagcugaugaacgacgugaacgaccugauccuggagggccccgcccugcccaucaugcacauguaa

SEQ ID NO: 18787 - RNA, 2889 nt, Artificial Sequence
  KCNH1__Homo_sapiens__NP_002229
augaccauggccggcggcagaagaggccugguggccccccagaacaccuuccuggagaacaucgugagaagaagcaacgacaccaacuucgugcugggcaacgcccagaucguggacuggcccaucguguacagcaacgacggcuucugcaagcugagcggcuaccacagagccgaggugaugcagaagagcagcaccugcagcuucauguacggcgagcugaccgacaaggacaccaucgagaaggugagacagaccuucgagaacuacgagaugaacagcuucgagauccugauguacaagaagaacagaacccccgugugguucuucgugaagaucgcccccaucagaaacgagcaggacaagguggugcuguuccugugcaccuucagcgacaucaccgccuucaagcagcccaucgaggacgacagcugcaagggcuggggcaaguucgccagacugaccagagcccugaccagcagcagaggcgugcugcagcagcuggcccccagcgugcagaagggcgagaacgugcacaagcacagcagacuggccgaggugcugcagcugggcagcgacauccugccccaguacaagcaggaggcccccaagacccccccccacaucauccugcacuacugcguguucaagaccaccugggacuggaucauccugauccugaccuucuacaccgccauccuggugcccuacaacgugagcuucaagaccagacagaacaacguggccuggcuggugguggacagcaucguggacgugaucuuccugguggacaucgugcugaacuuccacaccaccuucgugggccccgccggcgaggugaucagcgaccccaagcugaucagaaugaacuaccugaagaccugguucgugaucgaccugcugagcugccugcccuacgacgugaucaacgccuucgagaacguggacgagggcaucagcagccuguucagcagccugaagguggugagacugcugagacugggcagaguggccagaaagcuggaccacuacaucgaguacggcgccgccgugcuggugcugcuggugugcguguucggccuggccgcccacuggauggccugcaucugguacagcaucggcgacuacgagaucuucgacgaggacaccaagaccaucagaaacaacagcuggcuguaccagcuggccauggacaucggcacccccuaccaguucaacggcagcggcagcggcaagugggagggcggccccagcaagaacagcguguacaucagcagccuguacuucaccaugaccagccugaccagcgugggcuucggcaacaucgcccccagcaccgacaucgagaagaucuucgccguggccaucaugaugaucggcagccugcuguacgccaccaucuucggcaacgugaccaccaucuuccagcagauguacgccaacaccaacagauaccacgagaugcugaacagcgugagagacuuccugaagcuguaccaggugcccaagggccugagcgagagagugauggacuacaucgugagcaccuggagcaugagcagaggcaucgacaccgagaaggugcugcagaucugccccaaggacaugagagccgacaucugcgugcaccugaacagaaagguguucaaggagcaccccgccuucagacuggccagcgacggcugccugagagcccuggccauggaguuccagaccgugcacugcgcccccggcgaccugaucuaccacgccggcgagagcguggacagccugugcuucguggugagcggcagccuggaggugauccaggacgacgaggugguggccauccugggcaagggcgacguguucggcgacguguucuggaaggaggccacccuggcccagagcugcgccaacgugagagcccugaccuacugcgaccugcacgugaucaagagagacgcccugcagaaggugcuggaguucuacaccgccuucagccacagcuucagcagaaaccugauccugaccuacaaccugagaaagagaaucguguucagaaagaucagcgacgugaagagagaggaggaggagagaaugaagagaaagaacgaggccccccugauccugccccccgaccaccccgugagaagacuguuccagagauucagacagcagaaggaggccagacuggccgccgagagaggcggcagagaccuggacgaccuggacguggagaagggcaacgugcugaccgagcacgccagcgccaaccacagccuggugaaggccagcguggugaccgugagagagagccccgccacccccgugagcuuccaggccgccagcaccagcggcgugcccgaccacgccaagcugcaggcccccggcagcgagugccugggccccaagggcggcggcggcgacugcgccaagagaaagagcugggccagauucaaggacgccugcggcaagagcgaggacuggaacaaggugagcaaggccgagagcauggagacccugcccgagagaaccaaggccagcggcgaggccacccugaagaagaccgacagcugcgacagcggcaucaccaagagcgaccugagacuggacaacgugggcgaggccagaagcccccaggacagaagccccauccuggccgaggugaagcacagcuucuaccccauccccgagcagacccugcaggccaccgugcuggaggugagacacgagcugaaggaggacaucaaggcccugaacgccaagaugaccaacaucgagaagcagcugagcgagauccugagaauccugaccagcagaagaagcagccagagcccccaggagcuguucgagaucagcagaccccagagccccgagagcgagagagacaucuucggcgccagcuaa

SEQ ID NO: 18788 - RNA, 3480 nt, Artificial Sequence
  KCNH2__Homo_sapiens__NP_000229
augcccgugagaagaggccacguggccccccagaacaccuuccuggacaccaucaucagaaaguucgagggccagagcagaaaguucaucaucgccaacgccagaguggagaacugcgccgugaucuacugcaacgacggcuucugcgagcugugcggcuacagcagagccgaggugaugcagagacccugcaccugcgacuuccugcacggccccagaacccagagaagagccgccgcccagaucgcccaggcccugcugggcgccgaggagagaaagguggagaucgccuucuacagaaaggacggcagcugcuuccugugccugguggacguggugcccgugaagaacgaggacggcgccgugaucauguucauccugaacuucgagguggugauggagaaggacauggugggcagccccgcccacgacaccaaccacagaggcccccccaccagcuggcuggcccccggcagagccaagaccuucagacugaagcugcccgcccugcuggcccugaccgccagagagagcagcgugagaagcggcggcgccggcggcgccggcgcccccggcgccguggugguggacguggaccugacccccgccgcccccagcagcgagagccuggcccuggacgaggugaccgccauggacaaccacguggccggccugggccccgccgaggagagaagagcccuggugggccccggcagcccccccagaagcgcccccggccagcugcccagccccagagcccacagccugaaccccgacgccagcggcagcagcugcagccuggccagaaccagaagcagagagagcugcgccagcgugagaagagccagcagcgccgacgacaucgaggccaugagagccggcgugcugccccccccccccagacacgccagcaccggcgccaugcacccccugagaagcggccugcugaacagcaccagcgacagcgaccuggugagauacagaaccaucagcaagaucccccagaucacccugaacuucguggaccugaagggcgaccccuuccuggccagccccaccagcgacagagagaucaucgcccccaagaucaaggagagaacccacaacgugaccgagaaggugacccaggugcugagccugggcgccgacgugcugcccgaguacaagcugcaggcccccagaauccacagauggaccauccugcacuacagccccuucaaggccgugugggacuggcugauccugcugcuggugaucuacaccgccguguucacccccuacagcgccgccuuccugcugaaggagaccgaggagggcccccccgccaccgagugcggcuacgccugccagccccuggccgugguggaccugaucguggacaucauguucaucguggacauccugaucaacuucagaaccaccuacgugaacgccaacgaggagguggugagccaccccggcagaaucgccgugcacuacuucaagggcugguuccugaucgacaugguggccgccauccccuucgaccugcugaucuucggcagcggcagcgaggagcugaucggccugcugaagaccgccagacugcugagacuggugagaguggccagaaagcuggacagauacagcgaguacggcgccgccgugcuguuccugcugaugugcaccuucgcccugaucgcccacuggcuggccugcaucugguacgccaucggcaacauggagcagccccacauggacagcagaaucggcuggcugcacaaccugggcgaccagaucggcaagcccuacaacagcagcggccugggcggccccagcaucaaggacaaguacgugaccgcccuguacuucaccuucagcagccugaccagcgugggcuucggcaacgugagccccaacaccaacagcgagaagaucuucagcaucugcgugaugcugaucggcagccugauguacgccagcaucuucggcaacgugagcgccaucauccagagacuguacagcggcaccgccagauaccacacccagaugcugagagugagagaguucaucagauuccaccagauccccaacccccugagacagagacuggaggaguacuuccagcacgccuggagcuacaccaacggcaucgacaugaacgccgugcugaagggcuuccccgagugccugcaggccgacaucugccugcaccugaacagaagccugcugcagcacugcaagcccuucagaggcgccaccaagggcugccugagagcccuggccaugaaguucaagaccacccacgccccccccggcgacacccuggugcacgccggcgaccugcugaccgcccuguacuucaucagcagaggcagcaucgagauccugagaggcgacguggugguggccauccugggcaagaacgacaucuucggcgagccccugaaccuguacgccagacccggcaagagcaacggcgacgugagagcccugaccuacugcgaccugcacaagauccacagagacgaccugcuggaggugcuggacauguaccccgaguucagcgaccacuucuggagcagccuggagaucaccuucaaccugagagacaccaacaugauccccggcagccccggcagcaccgagcuggagggcggcuucagcagacagagaaagagaaagcugagcuucagaagaagaaccgacaaggacaccgagcagcccggcgaggugagcgcccugggccccggcagagccggcgccggccccagcagcagaggcagacccggcggccccuggggcgagagccccagcagcggccccagcagccccgagagcagcgaggacgagggccccggcagaagcagcagcccccugagacuggugcccuucagcagccccagaccccccggcgagccccccggcggcgagccccugauggaggacugcgagaagagcagcgacaccugcaacccccugagcggcgccuucagcggcgugagcaacaucuucagcuucuggggcgacagcagaggcagacaguaccaggagcugcccagaugccccgcccccacccccagccugcugaacaucccccugagcagccccggcagaagacccagaggcgacguggagagcagacuggacgcccugcagagacagcugaacagacuggagaccagacugagcgccgacauggccaccgugcugcagcugcugcagagacagaugacccuggugccccccgccuacagcgccgugaccacccccggccccggccccaccagcaccagcccccugcugcccgugagcccccugcccacccugacccuggacagccugagccaggugagccaguucauggccugcgaggagcugccccccggcgcccccgagcugccccaggagggccccaccagaagacugagccugcccggccagcugggcgcccugaccagccagccccugcacagacacggcagcgaccccggcagcuaa

SEQ ID NO: 18789 - RNA, 3252 nt, Artificial Sequence
  KCNH3__Homo_sapiens__NP_036416
augcccgccaugagaggccugcuggccccccagaacaccuuccuggacaccaucgccaccagauucgacggcacccacagcaacuucgugcugggcaacgcccagguggccggccuguuccccgugguguacugcagcgacggcuucugcgaccugaccggcuucagcagagccgaggugaugcagagaggcugcgccugcagcuuccuguacggccccgacaccagcgagcuggugagacagcagaucagaaaggcccuggacgagcacaaggaguucaaggccgagcugauccuguacagaaagagcggccugcccuucuggugccugcuggacgugauccccaucaagaacgagaagggcgagguggcccuguuccuggugagccacaaggacaucagcgagaccaagaacagaggcggccccgacagauggaaggagaccggcggcggcagaagaagauacggcagagccagaagcaagggcuucaacgccaacagaagaagaagcagagccgugcuguaccaccugagcggccaccugcagaagcagcccaagggcaagcacaagcugaacaagggcguguucggcgagaagcccaaccugcccgaguacaagguggccgccaucagaaagagccccuucauccugcugcacugcggcgcccugagagccaccugggacggcuucauccugcuggccacccuguacguggccgugaccgugcccuacagcgugugcgugagcaccgccagagagcccagcgccgccagaggcccccccagcgugugcgaccuggccguggaggugcuguucauccuggacaucgugcugaacuucagaaccaccuucgugagcaagagcggccaggugguguucgcccccaagagcaucugccugcacuacgugaccaccugguuccugcuggacgugaucgccgcccugcccuucgaccugcugcacgccuucaaggugaacguguacuucggcgcccaccugcugaagaccgugagacugcugagacugcugagacugcugcccagacuggacagauacagccaguacagcgccguggugcugacccugcugauggccguguucgcccugcuggcccacuggguggccugcgugugguucuacaucggccagagagagaucgagagcagcgagagcgagcugcccgagaucggcuggcugcaggagcuggccagaagacuggagacccccuacuaccuggugggcagaagacccgccggcggcaacagcagcggccagagcgacaacugcagcagcagcagcgaggccaacggcaccggccuggagcugcugggcggccccagccugagaagcgccuacaucaccagccuguacuucgcccugagcagccugaccagcgugggcuucggcaacgugagcgccaacaccgacaccgagaagaucuucagcaucugcaccaugcugaucggcgcccugaugcacgccgugguguucggcaacgugaccgccaucauccagagaauguacgccagaagauuccuguaccacagcagaaccagagaccugagagacuacaucagaauccacagaauccccaagccccugaagcagagaaugcuggaguacuuccaggccaccugggccgugaacaacggcaucgacaccaccgagcugcugcagagccugcccgacgagcugagagccgacaucgccaugcaccugcacaaggaggugcugcagcugccccuguucgaggccgccagcagaggcugccugagagcccugagccuggcccugagacccgccuucugcacccccggcgaguaccugauccaccagggcgacgcccugcaggcccuguacuucgugugcagcggcagcauggaggugcugaagggcggcaccgugcuggccauccugggcaagggcgaccugaucggcugcgagcugcccagaagagagcagguggugaaggccaacgccgacgugaagggccugaccuacugcgugcugcagugccugcagcuggccggccugcacgacagccuggcccuguaccccgaguucgcccccagauucagcagaggccugagaggcgagcugagcuacaaccugggcgccggcggcggcagcgccgagguggacaccagcagccugagcggcgacaacacccugaugagcacccuggaggagaaggagaccgacggcgagcagggccccaccgugagccccgcccccgccgacgagcccagcagcccccugcugagccccggcugcaccagcagcagcagcgccgccaagcugcugagccccagaagaaccgcccccagacccagacugggcggcagaggcagacccggcagagccggcgcccugaaggccgaggccggccccagcgccccccccagagcccuggagggccugagacugccccccaugcccuggaacgugccccccgaccugagccccagagugguggacggcaucgaggacggcugcggcagcgaccagcccaaguucagcuucagagugggccagagcggccccgagugcagcagcagccccagccccggccccgagagcggccugcugaccgugccccacggccccagcgaggccagaaacaccgacacccuggacaagcugagacaggccgugaccgagcugagcgagcaggugcugcagaugagagagggccugcagagccugagacaggccgugcagcuggugcuggccccccacagagagggccccugccccagagccagcggcgagggccccugccccgccagcaccagcggccugcugcagccccugugcguggacaccggcgccagcagcuacugccugcagccccccgccggcagcgugcugagcggcaccuggccccaccccagacccggcccccccccccugauggcccccuggcccuggggcccccccgccagccagagcagccccuggcccagagccaccgccuucuggaccagcaccagcgacagcgagccccccgccagcggcgaccugugcagcgagcccagcacccccgccagccccccccccagcgaggagggcgccagaaccggccccgccgagcccgugagccaggccgaggccaccagcaccggcgagcccccccccggcagcggcggccuggcccugcccugggacccccacagccuggagauggugcugaucggcugccacggcagcggcaccgugcaguggacccaggaggagggcaccggcguguaa

SEQ ID NO: 18790 - RNA, 3054 nt, Artificial Sequence
  KCNH4__Homo_sapiens__NP_036417
augcccgugaugaagggccugcuggccccccagaacaccuuccuggacaccaucgccaccagauucgacggcacccacagcaacuuccugcuggccaacgcccagggcaccagaggcuuccccaucguguacugcagcgacggcuucugcgagcugaccggcuacggcagaaccgaggugaugcagaagaccugcagcugcagauuccuguacggccccgagaccagcgagcccgcccugcagagacugcacaaggcccuggagggccaccaggagcacagagccgagaucugcuucuacagaaaggacggcagcgccuucuggugccugcuggacaugaugcccaucaagaacgagaugggcgagguggugcuguuccuguucagcuucaaggacaucacccagagcggcagccccggccugggcccccagggcggcagaggcgacagcaaccacgagaacagccugggcagaagaggcgccaccuggaaguucagaagcgccagaagaagaagcagaaccgugcugcacagacugaccggccacuucggcagaagaggccagggcggcaugaaggccaacaacaacguguucgagcccaagcccagcgugcccgaguacaagguggccagcgugggcggcagcagaugccugcugcugcacuacagcgugagcaaggccaucugggacggccugauccugcuggccaccuucuacguggccgugaccgugcccuacaacgugugcuucagcggcgacgacgacacccccaucaccagcagacacacccuggugagcgacaucgccguggagaugcuguucauccuggacaucauccugaacuucagaaccaccuacgugagccagagcggccaggugaucagcgcccccagaagcaucggccugcacuaccuggccaccugguucuucaucgaccugaucgccgcccugcccuucgaccugcuguacaucuucaacaucaccgugaccagccuggugcaccugcugaagaccgugagacugcugagacugcugagacugcugcagaagcuggagagauacagccagugcagcgccguggugcugacccugcugaugagcguguucgcccugcuggcccacuggauggccugcaucugguacgugaucggcagaagagagauggaggccaacgacccccugcugugggacaucggcuggcugcacgagcugggcaagagacuggaggugcccuacgugaacggcagcgugggcggccccagcagaagaagcgccuacaucgccgcccuguacuucacccugagcagccugaccagcgugggcuucggcaacgugugcgccaacaccgacgccgagaagaucuucagcaucugcaccaugcugaucggcgcccugaugcacgccgugguguucggcaacgugaccgccaucauccagagaauguacagcagaagaagccuguaccacagcagaaugaaggaccugaaggacuucaucagagugcacagacugcccagaccccugaagcagagaaugcuggaguacuuccagaccaccugggccgugaacagcggcaucgacgccaacgagcugcugagagacuuccccgacgagcugagagccgacaucgccaugcaccugaacagagagauccugcagcugccccuguucggcgccgccagcagaggcugccugagagcccugagccugcacaucaagaccagcuucugcgcccccggcgaguaccugcugagaagaggcgacgcccugcaggcccacuacuacgugugcagcggcagccuggaggugcugagagacaacauggugcuggccauccugggcaagggcgaccugaucggcgccgacauccccgagcccggccaggagcccggccugggcgccgaccccaacuucgugcugaagaccagcgccgacgugaaggcccugaccuacugcggccugcagcagcugagcagcagaggccuggccgaggugcugagacuguaccccgaguacggcgccgccuucagagccggccugcccagagaccugaccuucaaccugagacagggcagcgacaccagcggccugagcagauucagcagaagccccagacugagccagcccagaagcgagagccugggcagcagcagcgacaagacccugcccagcaucaccgaggccgagagcggcgccgagcccggcggcggccccagacccagaagaccccugcugcugcccaaccugagccccgccagacccagaggcagccuggugagccugcugggcgaggagcugccccccuucagcgcccuggugagcagccccagccugagccccagccugagccccgcccuggccggccagggccacagcgccagcccccacggcccccccagaugcagcgccgccuggaagcccccccagcugcugauccccccccugggcaccuucggcccccccgaccugagccccagaaucguggacggcaucgaggacagcggcagcaccgccgaggcccccagcuucagauucagcagaagacccgagcugcccagacccagaagccaggccccccccaccggcaccagacccagccccgagcuggccagcgaggccgaggaggugaaggagaaggugugcagacugaaccaggagaucagcagacugaaccaggaggugagccagcugagcagagagcugagacacaucaugggccugcugcaggccagacugggcccccccggccaccccgccggcagcgccuggacccccgacccccccugcccccagcugagaccccccugccugagccccugcgccagcagacccccccccagccugcaggacaccacccuggccgaggugcacugccccgccagcgugggcaccauggagaccggcaccgcccugcuggaccugagacccagcauccugccccccuaccccagcgagcccgacccccugggccccagccccgugcccgaggccagcccccccacccccagccugcugagacacagcuuccagagcagaagcgacaccuuccacuaa

SEQ ID NO: 18791 - RNA, 2967 nt, Artificial Sequence
  KCNH5__Homo_sapiens__NP_647479
augcccggcggcaagagaggccugguggccccccagaacaccuuccuggagaacaucgugagaagaagcagcgagagcagcuuccugcugggcaacgcccagaucguggacuggcccgugguguacagcaacgacggcuucugcaagcugagcggcuaccacagagccgacgugaugcagaagagcagcaccugcagcuucauguacggcgagcugaccgacaagaagaccaucgagaaggugagacagaccuucgacaacuacgagagcaacugcuucgaggugcugcuguacaagaagaacagaacccccgugugguucuacaugcagaucgcccccaucagaaacgagcacgagaagguggugcuguuccugugcaccuucaaggacaucacccuguucaagcagcccaucgaggacgacagcaccaagggcuggaccaaguucgccagacugaccagagcccugaccaacagcagaagcgugcugcagcagcugacccccaugaacaagaccgagguggugcacaagcacagcagacuggccgaggugcugcagcugggcagcgacauccugccccaguacaagcaggaggcccccaagacccccccccacaucauccugcacuacugcgccuucaagaccaccugggacugggugauccugauccugaccuucuacaccgccaucauggugcccuacaacgugagcuucaagaccaagcagaacaacaucgccuggcuggugcuggacagcgugguggacgugaucuuccugguggacaucgugcugaacuuccacaccaccuucgugggccccggcggcgaggugaucagcgaccccaagcugaucagaaugaacuaccugaagaccugguucgugaucgaccugcugagcugccugcccuacgacaucaucaacgccuucgagaacguggacgagggcaucagcagccuguucagcagccugaagguggugagacugcugagacugggcagaguggccagaaagcuggaccacuaccuggaguacggcgccgccgugcuggugcugcuggugugcguguucggccugguggcccacuggcuggccugcaucugguacagcaucggcgacuacgaggugaucgacgaggugaccaacaccauccagaucgacagcuggcuguaccagcuggcccugagcaucggcacccccuacagauacaacaccagcgccggcaucugggagggcggccccagcaaggacagccuguacgugagcagccuguacuucaccaugaccagccugaccaccaucggcuucggcaacaucgcccccaccaccgacguggagaagauguucagcguggccaugaugauggugggcagccugcuguacgccaccaucuucggcaacgugaccaccaucuuccagcagauguacgccaacaccaacagauaccacgagaugcugaacaacgugagagacuuccugaagcuguaccaggugcccaagggccugagcgagagagugauggacuacaucgugagcaccuggagcaugagcaagggcaucgacaccgagaaggugcugagcaucugccccaaggacaugagagccgacaucugcgugcaccugaacagaaagguguucaacgagcaccccgccuucagacuggccagcgacggcugccugagagcccuggccguggaguuccagaccauccacugcgcccccggcgaccugaucuaccacgccggcgagagcguggacgcccugugcuucguggugagcggcagccuggaggugauccaggacgacgaggugguggccauccugggcaagggcgacguguucggcgacaucuucuggaaggagaccacccuggcccacgccugcgccaacgugagagcccugaccuacugcgaccugcacaucaucaagagagaggcccugcugaaggugcuggacuucuacaccgccuucgccaacagcuucagcagaaaccugacccugaccugcaaccugagaaagagaaucaucuucagaaagaucagcgacgugaagaaggaggaggaggagagacugagacagaagaacgaggugacccugagcauccccguggaccaccccgugagaaagcuguuccagaaguucaagcagcagaaggagcugagaaaccagggcagcacccagggcgaccccgagagaaaccagcugcagguggagagcagaagccugcagaacggcgccagcaucaccggcaccagcguggugaccgugagccagaucacccccauccagaccagccuggccuacgugaagaccagcgagagccugaagcagaacaacagagacgccauggagcugaagcccaacggcggcgccgaccagaagugccugaaggugaacagccccaucagaaugaagaacggcaacggcaagggcuggcugagacugaagaacaacaugggcgcccacgaggagaagaaggaggacuggaacaacgugaccaaggccgagagcaugggccugcugagcgaggaccccaagagcagcgacagcgagaacagcgugaccaagaacccccugagaaagaccgacagcugcgacagcggcaucaccaagagcgaccugagacuggacaaggccggcgaggccagaagcccccuggagcacagccccauccaggccgacgccaagcaccccuucuaccccauccccgagcaggcccugcagaccacccugcaggaggugaagcacgagcugaaggaggacauccagcugcugagcugcagaaugaccgcccuggagaagcagguggccgagauccugaagauccugagcgagaagagcgugccccaggccagcagccccaagagccagaugccccugcaggugcccccccagauccccugccaggacaucuucagcgugagcagacccgagagccccgagagcgacaaggacgagauccacuucuaa

SEQ ID NO: 18792 - RNA, 2985 nt, Artificial Sequence
  KCNH6__Homo_sapiens__NP_110406
augcccgugagaagaggccacguggccccccagaacaccuaccuggacaccaucaucagaaaguucgagggccagagcagaaaguuccugaucgccaacgcccagauggagaacugcgccaucaucuacugcaacgacggcuucugcgagcuguucggcuacagcagaguggaggugaugcagcagcccugcaccugcgacuuccugaccggccccaacacccccagcagcgccgugagcagacuggcccaggcccugcugggcgccgaggagugcaagguggacauccuguacuacagaaaggacgccagcagcuucagaugccugguggacguggugcccgugaagaacgaggacggcgccgugaucauguucauccugaacuucgaggaccuggcccagcugcuggccaagugcagcagcagaagccugagccagagacugcugagccagagcuuccugggcagcgagggcagccacggcagacccggcggccccggccccggcaccggcagaggcaaguacagaaccaucagccagaucccccaguucacccugaacuucguggaguucaaccuggagaagcacagaagcagcagcaccaccgagaucgagaucaucgccccccacaaggugguggagagaacccagaacgugaccgagaaggugacccaggugcugagccugggcgccgacgugcugcccgaguacaagcugcaggcccccagaauccacagauggaccauccugcacuacagccccuucaaggccgugugggacuggcugauccugcugcuggugaucuacaccgccguguucacccccuacagcgccgccuuccugcugagcgaccaggacgagagcagaagaggcgccugcagcuacaccugcagcccccugaccgugguggaccugaucguggacaucauguucgugguggacaucgugaucaacuucagaaccaccuacgugaacaccaacgacgagguggugagccaccccagaagaaucgccgugcacuacuucaagggcugguuccugaucgacaugguggccgccauccccuucgaccugcugaucuucagaaccggcagcgacgagaccaccacccugaucggccugcugaagaccgccagacugcugagacuggugagaguggccagaaagcuggacagauacagcgaguacggcgccgccgugcuguuccugcugaugugcaccuucgcccugaucgcccacuggcuggccugcaucugguacgccaucggcaacguggagagacccuaccuggagcacaagaucggcuggcuggacagccugggcgugcagcugggcaagagauacaacggcagcgaccccgccagcggccccagcgugcaggacaaguacgugaccgcccuguacuucaccuucagcagccugaccagcgugggcuucggcaacgugagccccaacaccaacagcgagaagguguucagcaucugcgugaugcugaucggcagccugauguacgccagcaucuucggcaacgugagcgccaucauccagagacuguacagcggcaccgccagauaccacacccagaugcugagagugaaggaguucaucagauuccaccagauccccaacccccugagacagagacuggaggaguacuuccagcacgccuggagcuacaccaacggcaucgacaugaacgccgugcugaagggcuuccccgagugccugcaggccgacaucugccugcaccugcacagagcccugcugcagcacugccccgccuucagcggcgccggcaagggcugccugagagcccuggccgugaaguucaagaccacccacgccccccccggcgacacccuggugcaccugggcgacgugcugagcacccuguacuucaucagcagaggcagcaucgagauccugagagacgacguggugguggccauccugggcaagaacgacaucuucggcgagcccgugagccugcacgcccagcccggcaagagcagcgccgacgugagagcccugaccuacugcgaccugcacaagauccagagagccgaccugcuggaggugcuggacauguaccccgccuucgccgagagcuucuggagcaagcuggaggugaccuucaaccugagagacgccgccggcggccugcacagcagccccagacaggcccccggcagccaggaccaccagggcuucuuccugagcgacaaccagagcggcagcccccacgagcugggcccccaguuccccagcaagggcuacagccugcugggccccggcagccagaacagcaugggcgccggccccugcgcccccggccaccccgacgccgcccccccccugagcaucagcgacgccagcggccuguggcccgagcugcugcaggagaugccccccagacacagcccccagagcccccaggaggaccccgacugcuggccccugaagcugggcagcagacuggagcagcugcaggcccagaugaacagacuggagagcagagugagcagcgaccugagcagaauccugcagcugcugcagaagcccaugccccagggccacgccagcuacauccuggaggcccccgccagcaacgaccuggcccuggugcccaucgccagcgagaccaccagccccggccccagacugccccagggcuuccugccccccgcccagacccccagcuacggcgaccuggacgacugcagccccaagcacagaaacagcagccccagaaugccccaccuggccguggccaccgacaagacccuggcccccagcagcgagcaggagcagcccgagggccuguggcccccccuggccagcccccugcacccccuggaggugcagggccugaucugcggccccugcuucagcagccugcccgagcaccugggcagcgugcccaagcagcuggacuuccagagacacggcagcgaccccggcuucgccggcagcuggggccacuaa

SEQ ID NO: 18793 - RNA, 3591 nt, Artificial Sequence
  KCNH7__Homo_sapiens__NP_150375
augcccgugagaagaggccacguggccccccagaacaccuuccugggcaccaucaucagaaaguucgagggccagaacaagaaguucaucaucgccaacgccagagugcagaacugcgccaucaucuacugcaacgacggcuucugcgagaugaccggcuucagcagacccgacgugaugcagaagcccugcaccugcgacuuccugcacggccccgagaccaagagacacgacaucgcccagaucgcccaggcccugcugggcagcgaggagagaaagguggaggugaccuacuaccacaagaacggcagcaccuucaucugcaacacccacaucauccccgugaagaaccaggagggcguggccaugauguucaucaucaacuucgaguacgugaccgacaacgagaacgccgccacccccgagagagugaaccccauccugcccaucaagaccgugaacagaaaguucuucggcuucaaguuccccggccugagagugcugaccuacagaaagcagagccugccccaggaggaccccgacgugguggugaucgacagcagcaagcacagcgacgacagcguggccaugaagcacuucaagagccccaccaaggagagcugcagccccagcgaggccgacgacaccaaggcccugauccagcccagcaagugcagcccccuggugaacaucagcggcccccuggaccacagcagccccaagagacagugggacagacuguaccccgacaugcugcagagcagcagccagcugagccacagcagaagcagagagagccugugcagcaucagaagagccagcagcgugcacgacaucgagggcuucggcgugcaccccaagaacaucuucagagacagacacgccagcgaggacaacggcagaaacgugaagggccccuucaaccacaucaagagcagccugcugggcagcaccagcgacagcaaccugaacaaguacagcaccaucaacaagaucccccagcugacccugaacuucagcgaggugaagaccgagaagaagaacagcagcccccccagcagcgacaagaccaucaucgcccccaaggugaaggacagaacccacaacgugaccgagaaggugacccaggugcugagccugggcgccgacgugcugcccgaguacaagcugcagacccccagaaucaacaaguucaccauccugcacuacagccccuucaaggccgugugggacuggcugauccugcugcuggugaucuacaccgccaucuucacccccuacagcgccgccuuccugcugaacgacagagaggagcagaagagaagagagugcggcuacagcugcagcccccugaacgugguggaccugaucguggacaucauguucaucaucgacauccugaucaacuucagaaccaccuacgugaaccagaacgaggagguggugagcgaccccgccaagaucgccauccacuacuucaagggcugguuccugaucgacaugguggccgccauccccuucgaccugcugaucuucggcagcggcagcgacgagaccaccacccugaucggccugcugaagaccgccagacugcugagacuggugagaguggccagaaagcuggacagauacagcgaguacggcgccgccgugcugaugcugcugaugugcaucuucgcccugaucgcccacuggcuggccugcaucugguacgccaucggcaacguggagagacccuaccugaccgacaagaucggcuggcuggacagccugggccagcagaucggcaagagauacaacgacagcgacagcagcagcggccccagcaucaaggacaaguacgugaccgcccuguacuucaccuucagcagccugaccagcgugggcuucggcaacgugagccccaacaccaacagcgagaagaucuucagcaucugcgugaugcugaucggcagccugauguacgccagcaucuucggcaacgugagcgccaucauccagagacuguacagcggcaccgccagauaccacaugcagaugcugagagugaaggaguucaucagauuccaccagauccccaacccccugagacagagacuggaggaguacuuccagcacgccuggaccuacaccaacggcaucgacaugaacauggugcugaagggcuuccccgagugccugcaggccgacaucugccugcaccugaaccagacccugcugcagaacugcaaggccuucagaggcgccagcaagggcugccugagagcccuggccaugaaguucaagaccacccacgccccccccggcgacacccuggugcacugcggcgacgugcugaccgcccuguacuuccugagcagaggcagcaucgagauccugaaggacgacaucgugguggccauccugggcaagaacgacaucuucggcgagauggugcaccuguacgccaagcccggcaagagcaacgccgacgugagagcccugaccuacugcgaccugcacaagauccagagagaggaccugcuggaggugcuggacauguaccccgaguucagcgaccacuuccugaccaaccuggagcugaccuucaaccugagacacgagagcgccaaggccgaccugcugagaagccagagcaugaacgacagcgagggcgacaacugcaagcugagaagaagaaagcugagcuucgagagcgagggcgagaaggagaacagcaccaacgaccccgaggacagcgccgacaccaucagacacuaccagagcagcaagagacacuucgaggagaagaagagcagaagcagcagcuucaucagcagcaucgacgacgagcagaagccccuguucagcggcaucguggacagcagccccggcaucggcaaggccagcggccuggacuucgaggagaccgugcccaccagcggcagaaugcacaucgacaagagaagccacagcugcaaggacaucaccgacaugagaagcugggagagagagaacgcccacccccagcccgaggacagcagccccagcgcccugcagagagccgccuggggcaucagcgagaccgagagcgaccugaccuacggcgagguggagcagagacuggaccugcugcaggagcagcugaacagacuggagagccagaugaccaccgacauccagaccauccugcagcugcugcagaagcagaccaccguggugccccccgccuacagcauggugaccgccggcagcgaguaccagagacccaucauccagcugaugagaaccagccagcccgaggccagcaucaagaccgacagaagcuucagccccagcagccagugccccgaguuccuggaccuggagaagagcaagcugaagagcaaggagagccugagcagcggcgugcaccugaacaccgccagcgaggacaaccugaccagccugcugaagcaggacagcgaccugagccuggagcugcaccugagacagagaaagaccuacgugcaccccaucagacaccccagccugcccgacagcagccugagcaccgugggcaucgugggccugcacagacacgugagcgaccccggccugcccggcaaguaa

SEQ ID NO: 18794 - RNA, 3324 nt, Artificial Sequence
  KCNH8__Homo_sapiens__NP_653234
augcccgugaugaagggccugcuggccccccagaacaccuuccuggacaccaucgccaccagauucgacggcacccacagcaacuucauccuggccaacgcccagguggccaagggcuuccccaucguguacugcagcgacggcuucugcgagcuggccggcuucgccagaaccgaggugaugcagaagagcugcagcugcaaguuccuguucggcguggagaccaacgagcagcugaugcugcagaucgagaagagccuggaggagaagaccgaguucaagggcgagaucauguucuacaagaagaacggcagccccuucuggugccugcuggacaucgugcccaucaagaacgagaagggcgacguggugcuguuccuggccagcuucaaggacaucaccgacaccaaggugaagaucacccccgaggacaagaaggaggacaaggugaagggcagaagcagagccggcacccacuucgacagcgccagaagaagaagcagagccgugcuguaccacaucagcggccaccugcagagaagagagaagaacaagcugaagaucaacaacaacguguucguggacaagcccgccuuccccgaguacaaggugagcgacgccaagaagagcaaguucauccugcugcacuucagcaccuucaaggccggcugggacuggcugauccugcuggccaccuucuacguggccgugaccgugcccuacaacgugugcuucaucggcaacgacgaccugagcaccaccagaagcaccaccgugagcgacaucgccguggagauccuguucaucaucgacaucauccugaacuucagaaccaccuacgugagcaagagcggccaggugaucuucgaggccagaagcaucugcauccacuacgugaccaccugguucaucaucgaccugaucgccgcccugcccuucgaccugcuguacgccuucaacgugaccguggugagccuggugcaccugcugaagaccgugagacugcugagacugcugagacugcugcagaagcuggacagauacagccagcacagcaccaucgugcugacccugcugaugagcauguucgcccugcuggcccacuggauggccugcaucugguacgugaucggcaagauggagagagaggacaacagccugcugaagugggaggugggcuggcugcacgagcugggcaagagacuggagagccccuacuacggcaacaacacccugggcggccccagcaucagaagcgccuacaucgccgcccuguacuucacccugagcagccugaccagcgugggcuucggcaacgugagcgccaacaccgacgccgagaagaucuucagcaucugcaccaugcugaucggcgcccugaugcacgcccugguguucggcaacgugaccgccaucauccagagaauguacagcagauggagccuguaccacaccagaaccaaggaccugaaggacuucaucagagugcaccaccugccccagcagcugaagcagagaaugcuggaguacuuccagaccaccuggagcgugaacaacggcaucgacagcaacgagcugcugaaggacuuccccgacgagcugagaagcgacaucaccaugcaccugaacaaggagauccugcagcugagccuguucgagugcgccagcagaggcugccugagaagccugagccugcacaucaagaccagcuucugcgcccccggcgaguaccugcugagacagggcgacgcccugcaggccaucuacuucgugugcagcggcagcauggaggugcugaaggacagcauggugcuggccauccugggcaagggcgaccugaucggcgccaaccugagcaucaaggaccaggugaucaagaccaacgccgacgugaaggcccugaccuacugcgaccugcagugcaucauccugaagggccuguucgaggugcuggaccuguaccccgaguacgcccacaaguucguggaggacauccagcacgaccugaccuacaaccugagagagggccacgagagcgacgugaucagcagacugagcaacaagagcauggugagccagagcgagcccaagggcaacggcaacaucaacaagagacugcccagcaucguggaggacgaggaggaggaggaggagggcgaggaggaggaggccgugagccugagccccaucugcaccagaggcagcagcagcagaaacaagaaggugggcagcaacaaggccuaccugggccugagccugaagcagcuggccagcggcaccgugcccuuccacagccccaucagagugagcagaagcaacagccccaagaccaagcaggagaucgacccccccaaccacaacaagagaaaggagaagaaccugaagcugcagcugagcacccugaacaacgccggcccccccgaccugagccccagaaucguggacggcaucgaggacggcaacagcagcgaggagagccagaccuucgacuucggcagcgagagaaucagaagcgagcccagaaucagccccccccugggcgaccccgagaucggcgccgccgugcuguucaucaaggccgaggagaccaagcagcagaucaacaagcugaacagcgaggugaccacccugacccaggaggugagccagcugggcaaggacaugagaaacgugauccagcugcuggagaacgugcugagcccccagcagcccagcagauucugcagccugcacagcaccagcgugugccccagcagagagagccugcagaccagaaccagcuggagcgcccaccagcccugccugcaccugcagaccggcggcgccgccuacacccaggcccagcugugcagcagcaacaucaccagcgacaucuggagcguggaccccagcagcgugggcagcagcccccagagaaccggcgcccacgagcagaaccccgccgacagcgagcuguaccacagccccagccuggacuacagccccagccacuaccagguggugcaggagggccaccugcaguuccugagaugcaucagcccccacagcgacagcacccugaccccccugcagagcaucagcgccacccugagcagcagcgugugcagcagcagcgagaccagccugcaccuggugcugcccagcagaagcgaggagggcagcuucagccagggcaccgugagcagcuucagccuggagaaccugcccggcagcuggaaccaggagggcauggccagcgccagcaccaagccccuggagaaccugccccuggagguggugaccagcaccgccgaggugaaggacaacaaggccaucaacguguaa

SEQ ID NO: 18795 - RNA, 684 nt, Artificial Sequence
  KCNIP1__Homo_sapiens__NP_001030009
augggcgccgugaugggcaccuucagcagccugcagaccaagcagagaagacccagcaaggacaucgccuggugguacuaccaguaccagagagacaagaucgaggacgagcuggagaugaccauggugugccacagacccgagggccuggagcagcuggaggcccagaccaacuucaccaagagagagcugcaggugcuguacagaggcuucaagaacgagugccccagcggcguggugaacgaggacaccuucaagcagaucuacgcccaguucuucccccacggcgacgccagcaccuacgcccacuaccuguucaacgccuucgacaccacccagaccggcagcgugaaguucgaggacuucgugaccgcccugagcauccugcugagaggcaccgugcacgagaagcugagauggaccuucaaccuguacgacaucaacaaggacggcuacaucaacaaggaggagaugauggacaucgugaaggccaucuacgacaugaugggcaaguacaccuaccccgugcugaaggaggacacccccagacagcacguggacguguucuuccagaagauggacaagaacaaggacggcaucgugacccuggacgaguuccuggagagcugccaggaggacgacaacaucaugagaagccugcagcuguuccagaacgugauguaa

SEQ ID NO: 18796 - RNA, 858 nt, Artificial Sequence
  KCNIP2__Homo_sapiens__NP_055406
augagaggccagggcagaaaggagagccugagcgacagcagagaccuggacggcagcuacgaccagcugaccggccacccccccggccccaccaagaaggcccugaagcagagauuccugaagcugcugcccugcugcggcccccaggcccugcccagcgugagcgagaucggcagaguguucagauuccugggcgacagcagccugcccagcgcccuggccgcccccgccagccugagaccccacagacccagacugcuggaccccgacagcguggacgacgaguucgagcugagcaccgugugccacagacccgagggccuggagcagcugcaggagcagaccaaguucaccagaaaggagcugcaggugcuguacagaggcuucaagaacgagugccccagcggcaucgugaacgaggagaacuucaagcagaucuacagccaguucuucccccagggcgacagcagcaccuacgccaccuuccuguucaacgccuucgacaccaaccacgacggcagcgugagcuucgaggacuucguggccggccugagcgugauccugagaggcaccguggacgacagacugaacugggccuucaaccuguacgaccugaacaaggacggcugcaucaccaaggaggagaugcuggacaucaugaagagcaucuacgacaugaugggcaaguacaccuaccccgcccugagagaggaggcccccagagagcacguggagagcuucuuccagaagauggacagaaacaaggacggcguggugaccaucgaggaguucaucgagagcugccagaaggacgagaacaucaugagaagcaugcagcuguucgacaacgugaucuaa

SEQ ID NO: 18797 - RNA, 693 nt, Artificial Sequence
  KCNIP3__Homo_sapiens__NP_001030086
augggcauccagggcauggagcugugcgccauggccgugguggugcugcuguucaucgccgugcugaagcaguucggcauccuggagcccaucagcauggaggacagcagcgacagcgagcuggagcugagcaccgugagacaccagcccgagggccuggaccagcugcaggcccagaccaaguucaccaagaaggagcugcagagccuguacagaggcuucaagaacgagugccccaccggccugguggacgaggacaccuucaagcugaucuacgcccaguucuucccccagggcgacgccaccaccuacgcccacuuccuguucaacgccuucgacgccgacggcaacggcgccauccacuucgaggacuucguggugggccugagcauccugcugagaggcaccgugcacgagaagcugaagugggccuucaaccuguacgacaucaacaaggacggcuacaucaccaaggaggagaugcuggccaucaugaagagcaucuacgacaugaugggcagacacaccuaccccauccugagagaggacgcccccgccgagcacguggagagauucuucgagaagauggacagaaaccaggacggcguggugaccaucgaggaguuccuggaggccugccagaaggacgagaacaucaugagcagcaugcagcuguucgagaacgugaucuaa

SEQ ID NO: 18798 - RNA, 678 nt, Artificial Sequence
  KCNIP4__Homo_sapiens__NP_001030175
augagcggcugcagaaagagaugcaagagagagauccugaaguucgcccaguaccugcugagacugcugaccggcagccugcacaccgacagcguggaggacgagcuggagauggccaccgugagacacagacccgaggcccuggagcugcuggaggcccagagcaaguucaccaagaaggagcugcagauccuguacagaggcuucaagaacgagugccccagcggcguggugaacgaggagaccuucaaggagaucuacagccaguucuucccccagggcgacagcaccaccuacgcccacuuccuguucaacgccuucgacaccgaccacaacggcgccgugagcuucgaggacuucaucaagggccugagcauccugcugagaggcaccgugcaggagaagcugaacugggccuucaaccuguacgacaucaacaaggacggcuacaucaccaaggaggagaugcuggacaucaugaaggccaucuacgacaugaugggcaagugcaccuaccccgugcugaaggaggacgcccccagacagcacguggagaccuucuuccagaagauggacaagaacaaggacggcguggugaccaucgacgaguucaucgagagcugccagaaggacgagaacaucaugagaagcaugcagcuguucgagaacgugaucuaa

SEQ ID NO: 18799 - RNA, 1140 nt, Artificial Sequence
  KCNJ10__Homo_sapiens__NP_002232
augaccagcguggccaagguguacuacagccagaccacccagaccgagagcagaccccugaugggccccggcaucagaagaagaagagugcugaccaaggacggcagaagcaacgugagaauggagcacaucgccgacaagagauuccuguaccugaaggaccuguggaccaccuucaucgacaugcaguggagauacaagcugcugcuguucagcgccaccuucgccggcaccugguuccuguucggcguggugugguaccugguggccguggcccacggcgaccugcuggagcuggacccccccgccaaccacacccccugcguggugcaggugcacacccugaccggcgccuuccuguucagccuggagagccagaccaccaucggcuacggcuucagauacaucagcgaggagugcccccuggccaucgugcugcugaucgcccagcuggugcugaccaccauccuggagaucuucaucaccggcaccuuccuggccaagaucgccagacccaagaagagagccgagaccaucagauucagccagcacgccgugguggccagccacaacggcaagcccugccugaugaucagaguggccaacaugagaaagagccugcugaucggcugccaggugaccggcaagcugcugcagacccaccagaccaaggagggcgagaacaucagacugaaccaggugaacgugaccuuccagguggacaccgccagcgacagccccuuccugauccugccccugaccuucuaccacgugguggacgagaccagcccccugaaggaccugccccugagaagcggcgagggcgacuucgagcuggugcugauccugagcggcaccguggagagcaccagcgccaccugccaggugagaaccagcuaccugcccgaggagauccuguggggcuacgaguucacccccgccaucagccugagcgccagcggcaaguacaucgccgacuucagccuguucgaccagguggugaagguggccagccccagcggccugagagacagcaccgugagauacggcgaccccgagaagcugaagcuggaggagagccugagagagcaggccgagaaggagggcagcgcccugagcgugagaaucagcaacguguaa

SEQ ID NO: 18800 - RNA, 1173 nt, Artificial Sequence
  KCNJ11__Homo_sapiens__NP_000516
augcugagcagaaagggcaucauccccgaggaguacgugcugaccagacuggccgaggaccccgccaagcccagauacagagccagacagagaagagccagauucgugagcaagaagggcaacugcaacguggcccacaagaacaucagagagcagggcagauuccugcaggacguguucaccacccugguggaccugaaguggccccacacccugcugaucuucaccaugagcuuccugugcagcuggcugcuguucgccauggccugguggcugaucgccuucgcccacggcgaccuggcccccagcgagggcaccgccgagcccugcgugaccagcauccacagcuucagcagcgccuuccuguucagcaucgaggugcaggugaccaucggcuucggcggcagaauggugaccgaggagugcccccuggccauccugauccugaucgugcagaacaucgugggccugaugaucaacgccaucaugcugggcugcaucuucaugaagaccgcccaggcccacagaagagccgagacccugaucuucagcaagcacgccgugaucgcccugagacacggcagacugugcuucaugcugagagugggcgaccugagaaagagcaugaucaucagcgccaccauccacaugcagguggugagaaagaccaccagccccgagggcgagguggugccccugcaccagguggacauccccauggagaacggcgugggcggcaacagcaucuuccugguggccccccugaucaucuaccacgugaucgacgccaacagcccccuguacgaccuggcccccagcgaccugcaccaccaccaggaccuggagaucaucgugauccuggagggcgugguggagaccaccggcaucaccacccaggccagaaccagcuaccuggccgacgagauccuguggggccagagauucgugcccaucguggccgaggaggacggcagauacagcguggacuacagcaaguucggcaacaccgugaaggugcccaccccccugugcaccgccagacagcuggacgaggaccacagccugcuggaggcccugacccuggccagcgccagaggcccccugagaaagagaagcgugcccauggccaaggccaagcccaaguucagcaucagccccgacagccugagcuaa

SEQ ID NO: 18801 - RNA, 1302 nt, Artificial Sequence
  KCNJ12__Homo_sapiens__NP_066292
augaccgccgccagcagagccaaccccuacagcaucgugagcagcgaggaggacggccugcaccuggugaccaugagcggcgccaacggcuucggcaacggcaaggugcacaccagaagaagaugcagaaacagauucgugaagaagaacggccagugcaacaucgaguucgccaacauggacgagaagagccagagauaccuggccgacauguucaccaccugcguggacaucagauggagauacaugcugcugaucuucagccuggccuuccuggccagcuggcugcuguucggcaucaucuucugggugaucgccguggcccacggcgaccuggagcccgccgagggcagaggcagaacccccugcgugaugcaggugcacggcuucauggccgccuuccuguucagcaucgagacccagaccaccaucggcuacggccugagaugcgugaccgaggagugccccguggccguguucauggugguggcccagagcaucgugggcugcaucaucgacagcuucaugaucggcgccaucauggccaagauggccagacccaagaagagagcccagacccugcuguucagccacaacgccgugguggcccugagagacggcaagcugugccugauguggagagugggcaaccugagaaagagccacaucguggaggcccacgugagagcccagcugaucaagcccagagugaccgaggagggcgaguacaucccccuggaccagaucgacaucgacgugggcuucgacaagggccuggacagaaucuuccuggugagccccaucaccauccugcacgagaucgacgaggccagcccccuguucggcaucagcagacaggaccuggagaccgacgacuucgagaucguggugauccuggagggcaugguggaggccaccgccaugaccacccaggccagaagcagcuaccuggccaacgagauccuguggggccacagauucgagcccgugcuguucgaggagaagaaccaguacaagaucgacuacagccacuuccacaagaccuacgaggugcccagcacccccagaugcagcgccaaggaccugguggagaacaaguuccugcugcccagcgccaacagcuucugcuacgagaacgagcuggccuuccugagcagagacgaggaggacgaggccgacggcgaccaggacggcagaagcagagacggccugagcccccaggccagacacgacuucgacagacugcaggccggcggcggcgugcuggagcagagacccuacagaagagagagcgagaucuaa

SEQ ID NO: 18802 - RNA, 285 nt, Artificial Sequence
  KCNJ13__Homo_sapiens__NP_001165887
auggacagcagcaacugcaaggugaucgccccccugcugagccagagauacagaagaauggugaccaaggacggccacagcacccugcagauggacggcgcccagagaggccuggccuaccugagagacgccuggggcauccugauggacaugagauggagauggaugaugcugguguucagcgccagcuucguggugcacuggcugguguucgccgugcuguggugcuucugcggcgaggacugccccgccaagaagagcagcuucuucaacagccuguacuaa

SEQ ID NO: 18803 - RNA, 1311 nt, Artificial Sequence
  KCNJ14__Homo_sapiens__NP_037480
augggccuggccagagcccugagaagacugagcggcgcccuggacagcggcgacagcagagccggcgacgaggaggaggccggccccggccugugcagaaacggcugggcccccgcccccgugcagagccccgugggcagaagaagaggcagauucgugaagaaggacggccacugcaacgugagauucgugaaccugggcggccagggcgccagauaccugagcgaccuguucaccaccugcguggacgugagauggagauggaugugccugcuguucagcugcagcuuccuggccagcuggcugcuguucggccuggccuucuggcugaucgccagccugcacggcgaccuggccgccccccccccccccgcccccugcuucagccacguggccagcuuccuggccgccuuccuguucgcccuggagacccagaccagcaucggcuacggcgugagaagcgugaccgaggagugccccgccgccguggccgccguggugcugcagugcaucgccggcugcgugcuggacgccuucguggugggcgccgugauggccaagauggccaagcccaagaagagaaacgagacccugguguucagcgagaacgccgugguggcccugagagaccacagacugugccugauguggagagugggcaaccugagaagaagccaccugguggaggcccacgugagagcccagcugcugcagcccagagugacccccgagggcgaguacaucccccuggaccaccaggacguggacgugggcuucgacggcggcaccgacagaaucuuccuggugagccccaucaccaucgugcacgagaucgacagcgccagcccccuguacgagcugggcagagccgagcuggccagagccgacuucgagcugguggugauccuggagggcaugguggaggccaccgccaugaccacccagugcagaagcagcuaccugcccggcgagcugcuguggggccacagauucgagcccgugcuguuccagagaggcagccaguacgagguggacuacagacacuuccacagaaccuacgaggugcccggcacccccgugugcagcgccaaggagcuggacgagagagccgagcaggccagccacagccugaagagcagcuuccccggcagccugaccgccuucugcuacgagaacgagcuggcccugagcugcugccaggaggaggacgaggacgacgagaccgaggagggcaacggcguggagaccgaggacggcgccgccagccccagagugcugacccccacccuggcccugacccugccccccuaa

SEQ ID NO: 18804 - RNA, 1128 nt, Artificial Sequence
  KCNJ15__Homo_sapiens__XP_011527863
auggacgccauccacaucggcaugagcagcaccccccuggugaagcacaccgccggcgccggccugaaggccaacagacccagagugaugagcaagagcggccacagcaacgugagaaucgacaagguggacggcaucuaccugcuguaccugcaggaccuguggaccaccgugaucgacaugaaguggagauacaagcugacccuguucgccgccaccuucgugaugaccugguuccuguucggcgugaucuacuacgccaucgccuucauccacggcgaccuggagcccggcgagcccaucagcaaccacacccccugcaucaugaagguggacagccugaccggcgccuuccuguucagccuggagagccagaccaccaucggcuacggcgugagaagcaucaccgaggagugcccccacgccaucuuccugcugguggcccagcuggugaucaccacccugaucgagaucuucaucaccggcaccuuccuggccaagaucgccagacccaagaagagagccgagaccaucaaguucagccacugcgccgugaucaccaagcagaacggcaagcugugccuggugauccagguggccaacaugagaaagagccugcugauccagugccagcugagcggcaagcugcugcagacccacgugaccaaggagggcgagagaauccugcugaaccaggccaccgugaaguuccacguggacagcagcagcgagagccccuuccugauccugcccaugaccuucuaccacgugcuggacgagaccagcccccugagagaccugaccccccagaaccugaaggagaaggaguucgagcugguggugcugcugaacgccaccguggagagcaccagcgccgugugccagagcagaaccagcuacauccccgaggagaucuacuggggcuucgaguucgugcccguggugagccugagcaagaacggcaaguacguggccgacuucagccaguucgagcagaucagaaagagccccgacugcaccuucuacugcgccgacagcgagaagcagcagcuggaggagaaguacagacaggaggaccagagagagagagagcugagaacccugcugcugcagcagagcaacguguaa

SEQ ID NO: 18805 - RNA, 1362 nt, Artificial Sequence
  KCNJ16__Homo_sapiens__NP_001278551
augcugaagauggugcugaccgagaaccccaaccaggagaucgccaccagccuggaguuccugcugcugcagaacagccccggcagccugagagcccagcagagaaugagcuacuacggcagcagcuaccacaucaucaacgccgacgccaaguaccccggcuacccccccgagcacaucaucgccgagaagagaagagccagaagaagacugcugcacaaggacggcagcugcaacguguacuucaagcacaucuucggcgaguggggcagcuacgugguggacaucuucaccacccugguggacaccaaguggagacacauguucgugaucuucagccugagcuacauccugagcuggcugaucuucggcagcguguucuggcugaucgccuuccaccacggcgaccugcugaacgaccccgacaucacccccugcguggacaacgugcacagcuucaccggcgccuuccuguucagccuggagacccagaccaccaucggcuacggcuacagaugcgugaccgaggagugcagcguggccgugcugauggugauccugcagagcauccugagcugcaucaucaacaccuucaucaucggcgccgcccuggccaagauggccaccgccagaaagagagcccagaccaucagauucagcuacuucgcccugaucggcaugagagacggcaagcugugccugauguggagaaucggcgacuucagacccaaccacgugguggagggcaccgugagagcccagcugcugagauacaccgaggacagcgagggcagaaugaccauggccuucaaggaccugaagcuggugaacgaccagaucauccuggugacccccgugaccaucgugcacgagaucgaccacgagagcccccuguacgcccuggacagaaaggccguggccaaggacaacuucgagauccuggugaccuucaucuacaccggcgacagcaccggcaccagccaccagagcagaagcagcuacgugcccagagagauccuguggggccacagauucaacgacgugcuggaggugaagagaaaguacuacaaggugaacugccugcaguucgagggcagcguggagguguacgcccccuucugcagcgccaagcagcuggacuggaaggaccagcagcugcacaucgagaaggccccccccgugagagagagcugcaccagcgacaccaaggccagaagaagaagcuucagcgccguggccaucgugagcagcugcgagaaccccgaggagaccaccaccagcgccacccacgaguacagagagacccccuaccagaaggcccugcugacccugaacagaaucagcguggagagccagauguaa

SEQ ID NO: 18806 - RNA, 1302 nt, Artificial Sequence
  KCNJ18__Homo_sapiens__NP_001181887
augaccgccgccagcagagccaaccccuacagcaucgugagccuggaggaggacggccugcaccuggugaccaugagcggcgccaacggcuucggcaacggcaaggugcacaccagaagaagaugcagaaacagauucgugaagaagaacggccagugcaacaucgccuucgccaacauggacgagaagagccagagauaccuggccgacauguucaccaccugcguggacaucagauggagauacaugcugcugaucuucagccuggccuuccuggccagcuggcugcuguucggcgugaucuucugggugaucgccguggcccacggcgaccuggagcccgccgagggccacggcagaacccccugcgugaugcaggugcacggcuucauggccgccuuccuguucagcaucgagacccagaccaccaucggcuacggccugagaugcgugaccgaggagugccugguggccguguucauggugguggcccagagcaucgugggcugcaucaucgacagcuucaugaucggcgccaucauggccaagauggccagacccaagaagagagcccagacccugcuguucagccacaacgccgugguggcccugagagacggcaagcugugccugauguggagagugggcaaccugagaaagagccacaucguggaggcccacgugagagcccagcugaucaagcccagagugaccgaggagggcgaguacaucccccuggaccagaucgacaucgacgugggcuucgacaagggccuggacagaaucuuccuggugagccccaucaccauccugcacgagaucgacgaggccagcccccuguucggcaucagcagacaggaccuggagaccgacgacuucgagaucguggugauccuggagggcaugguggaggccaccgccaugaccacccaggccagaagcagcuaccuggccaacgagauccuguggggccacagauucgagcccgugcuguucgaggagaagaaccaguacaagaucgacuacagccacuuccacaagaccuacgaggugcccagcacccccagaugcagcgccaaggaccugguggagaacaaguuccugcugcccagcgccaacagcuucugcuacgagaacgagcuggccuuccugagcagagacgaggaggacgaggccgacggcgaccaggacggcagaagcagagacggccugagcccccaggccagacacgacuucgacagacugcaggccggcggcggcgugcuggagcagagacccuacagaagaggcagcgagaucuaa

SEQ ID NO: 18807 - RNA, 1176 nt, Artificial Sequence
  KCNJ1__Homo_sapiens__NP_000211
augaacgccagcagcagaaacguguucgacacccugaucagagugcugaccgagagcauguucaagcaccugagaaaguggguggugaccagauucuucggccacagcagacagagagccagacuggugagcaaggacggcagaugcaacaucgaguucggcaacguggaggcccagagcagauucaucuucuucguggacaucuggaccaccgugcuggaccugaaguggagauacaagaugaccaucuucaucaccgccuuccugggcagcugguucuucuucggccugcugugguacgccguggccuacauccacaaggaccugcccgaguuccaccccagcgccaaccacacccccugcguggagaacaucaacggccugaccagcgccuuccuguucagccuggagacccaggugaccaucggcuacggcuucagaugcgugaccgagcagugcgccaccgccaucuuccugcugaucuuccagagcauccugggcgugaucaucaacagcuucaugugcggcgccauccuggccaagaucagcagacccaagaagagagccaagaccaucaccuucagcaagaacgccgugaucagcaagagaggcggcaagcugugccugcugaucagaguggccaaccugagaaagagccugcugaucggcagccacaucuacggcaagcugcugaagaccaccgugacccccgagggcgagaccaucauccuggaccagaucaacaucaacuucgugguggacgccggcaacgagaaccuguucuucaucagcccccugaccaucuaccacgugaucgaccacaacagccccuucuuccacauggccgccgagacccugcugcagcaggacuucgagcuggugguguuccuggacggcaccguggagagcaccagcgccaccugccaggugagaaccagcuacgugcccgaggaggugcuguggggcuacagauucgcccccaucgugagcaagaccaaggagggcaaguacagaguggacuuccacaacuucagcaagaccguggagguggagaccccccacugcgccaugugccuguacaacgagaaggacgugagagccagaaugaagagaggcuacgacaaccccaacuucauccugagcgaggugaacgagaccgacgacaccaagauguaa

SEQ ID NO: 18808 - RNA, 1284 nt, Artificial Sequence
  KCNJ2__Homo_sapiens__XP_011523081
augggcagcgugagaaccaacagauacagcaucgugagcagcgaggaggacggcaugaagcuggccaccauggccguggccaacggcuucggcaacggcaagagcaaggugcacaccagacagcagugcagaagcagauucgugaagaaggacggccacugcaacgugcaguucaucaacgugggcgagaagggccagagauaccuggccgacaucuucaccaccugcguggacaucagauggagauggaugcuggugaucuucugccuggccuucgugcugagcuggcuguucuucggcugcguguucuggcugaucgcccugcugcacggcgaccuggacgccagcaaggagggcaaggccugcgugagcgaggugaacagcuucaccgccgccuuccuguucagcaucgagacccagaccaccaucggcuacggcuucagaugcgugaccgacgagugccccaucgccguguucauggugguguuccagagcaucgugggcugcaucaucgacgccuucaucaucggcgccgugauggccaagauggccaagcccaagaagagaaacgagacccugguguucagccacaacgccgugaucgccaugagagacggcaagcugugccugauguggagagugggcaaccugagaaagagccaccugguggaggcccacgugagagcccagcugcugaagagcagaaucaccagcgagggcgaguacaucccccuggaccagaucgacaucaacgugggcuucgacagcggcaucgacagaaucuuccuggugagccccaucaccaucgugcacgagaucgacgaggacagcccccuguacgaccugagcaagcaggacaucgacaacgccgacuucgagaucguggugauccuggagggcaugguggaggccaccgccaugaccacccagugcagaagcagcuaccuggccaacgagauccuguggggccacagauacgagcccgugcuguucgaggagaagcacuacuacaagguggacuacagcagauuccacaagaccuacgaggugcccaacaccccccugugcagcgccagagaccuggccgagaagaaguacauccugagcaacgccaacagcuucugcuacgagaacgagguggcccugaccagcaaggaggaggacgacagcgagaacggcgugcccgagagcaccagcaccgacaccccccccgacaucgaccugcacaaccaggccagcgugccccuggagcccagaccccugagaagagagagcgagaucuaa

SEQ ID NO: 18809 - RNA, 708 nt, Artificial Sequence
  KCNJ3__Homo_sapiens__NP_001247437
augagcgcccugagaagaaaguucggcgacgacuaccagguggugaccaccagcagcagcggcagcggccugcagccccagggccccggccaggacccccagcagcagcuggugcccaagaagaagagacagagauucguggacaagaacggcagaugcaacgugcagcacggcaaccugggcagcgagaccagcagauaccugagcgaccuguucaccacccugguggaccugaaguggagauggaaccuguucaucuucauccugaccuacaccguggccuggcuguucauggccagcauguggugggugaucgccuacaccagaggcgaccugaacaaggcccacgugggcaacuacacccccugcguggccaacguguacaacuuccccagcgccuuccuguucuucaucgagaccgaggccaccaucggcuacggcuacagauacaucaccgacaagugccccgagggcaucauccuguuccuguuccagagcauccugggcagcaucguggacgccuuccugaucggcugcauguucaucaagaugagccagcccaagaagagagccgagacccugauguucagcgagcacgccgugaucagcaugagagacggcaagcugacccugauguucagagugggcaaccugagaaacagccacauggugagcgcccagaucagaugcaagcugcugaagggcuaa

SEQ ID NO: 18810 - RNA, 1338 nt, Artificial Sequence
  KCNJ4__Homo_sapiens__NP_690607
augcacggccacagcagaaacggccaggcccacgugcccagaagaaagagaagaaacagauucgugaagaagaacggccagugcaacguguacuucgccaaccugagcaacaagagccagagauacauggccgacaucuucaccaccugcguggacaccagauggagauacaugcugaugaucuucagcgccgccuuccuggugagcuggcuguucuucggccugcuguucuggugcaucgccuucuuccacggcgaccuggaggccagccccggcgugcccgccgccggcggccccgccgccggcggcggcggcgccgcccccguggcccccaagcccugcaucaugcacgugaacggcuuccugggcgccuuccuguucagcguggagacccagaccaccaucggcuacggcuucagaugcgugaccgaggagugcccccuggccgugaucgccgugguggugcagagcaucgugggcugcgugaucgacagcuucaugaucggcaccaucauggccaagauggccagacccaagaagagagcccagacccugcuguucagccaccacgccgugaucagcgugagagacggcaagcugugccugauguggagagugggcaaccugagaaagagccacaucguggaggcccacgugagagcccagcugaucaagcccuacaugacccaggagggcgaguaccugccccuggaccagagagaccugaacgugggcuacgacaucggccuggacagaaucuuccuggugagccccaucaucaucgugcacgagaucgacgaggacagcccccuguacggcaugggcaaggaggagcuggagagcgaggacuucgagaucguggugauccuggagggcaugguggaggccaccgccaugaccacccaggccagaagcagcuaccuggccagcgagauccuguggggccacagauucgagcccgugguguucgaggagaagagccacuacaagguggacuacagcagauuccacaagaccuacgagguggccggcacccccugcugcagcgccagagagcugcaggagagcaagaucaccgugcugcccgcccccccccccccccccagcgccuucugcuacgagaacgagcuggcccugaugagccaggaggaggaggagauggaggaggaggccgccgccgccgccgccguggccgccggccugggccuggaggccggcagcaaggaggaggccggcaucaucagaaugcuggaguucggcagccaccuggaccuggagagaaugcaggccagccugccccuggacaacaucagcuacagaagagagagcgccaucuaa

SEQ ID NO: 18811 - RNA, 1260 nt, Artificial Sequence
  KCNJ5__Homo_sapiens__XP_011541112
auggccggcgacagcagaaacgccaugaaccaggacauggagaucggcgugacccccugggaccccaagaagauccccaagcaggccagagacuacgugcccaucgccaccgacagaaccagacugcuggccgagggcaagaagcccagacagagauacauggagaagagcggcaagugcaacgugcaccacggcaacgugcaggagaccuacagauaccugagcgaccuguucaccacccugguggaccugaaguggagauucaaccugcugguguucaccaugguguacaccgugaccuggcuguucuucggcuucaucugguggcugaucgccuacaucagaggcgaccuggaccacgugggcgaccaggaguggauccccugcguggagaaccugagcggcuucgugagcgccuuccuguucagcaucgagaccgagaccaccaucggcuacggcuucagagugaucaccgagaagugccccgagggcaucauccugcugcuggugcaggccauccugggcagcaucgugaacgccuucauggugggcugcauguucgugaagaucagccagcccaagaagagagccgagacccugauguucagcaacaacgccgugaucagcaugagagacgagaagcugugccugauguucagagugggcgaccugagaaacagccacaucguggaggccagcaucagagccaagcugaucaagagcagacagaccaaggagggcgaguucaucccccugaaccagaccgacaucaacgugggcuucgacaccggcgacgacagacuguuccuggugagcccccugaucaucagccacgagaucaaccagaagagccccuucugggagaugagccaggcccagcugcaccaggaggaguucgaggugguggugauccuggagggcaugguggaggccaccggcaugaccugccaggccagaagcagcuacauggacaccgaggugcuguggggccacagauucacccccgugcugacccuggagaagggcuucuacgagguggacuacaacaccuuccacgacaccuacgagaccaacacccccagcugcugcgccaaggagcuggccgagaugaagagagagggcagacugcugcaguaccugcccagccccccccugcugggcggcugcgccgaggccggccuggacgccgaggccgagcagaacgaggaggacgagcccaagggccugggcggcagcagagaggccagaggcagcguguaa

SEQ ID NO: 18812 - RNA, 1272 nt, Artificial Sequence
  KCNJ6__Homo_sapiens__NP_002231
auggccaagcugaccgagagcaugaccaacgugcuggagggcgacagcauggaccaggacguggagagccccguggccauccaccagcccaagcugcccaagcaggccagagacgaccugcccagacacaucagcagagacagaaccaagagaaagauccagagauacgugagaaaggacggcaagugcaacgugcaccacggcaacgugagagagaccuacagauaccugaccgacaucuucaccacccugguggaccugaaguggagauucaaccugcugaucuucgugaugguguacaccgugaccuggcuguucuucggcaugaucugguggcugaucgccuacaucagaggcgacauggaccacaucgaggaccccagcuggacccccugcgugaccaaccugaacggcuucgugagcgccuuccuguucagcaucgagaccgagaccaccaucggcuacggcuacagagugaucaccgacaagugccccgagggcaucauccugcugcugauccagagcgugcugggcagcaucgugaacgccuucauggugggcugcauguucgugaagaucagccagcccaagaagagagccgagacccugguguucagcacccacgccgugaucagcaugagagacggcaagcugugccugauguucagagugggcgaccugagaaacagccacaucguggaggccagcaucagagccaagcugaucaagagcaagcagaccagcgagggcgaguucaucccccugaaccagaccgacaucaacgugggcuacuacaccggcgacgacagacuguuccuggugagcccccugaucaucagccacgagaucaaccagcagagccccuucugggagaucagcaaggcccagcugcccaaggaggagcuggagaucguggugauccuggagggcaugguggaggccaccggcaugaccugccaggccagaagcagcuacaucaccagcgagauccuguggggcuacagauucacccccgugcugacccuggaggacggcuucuacgagguggacuacaacagcuuccacgagaccuacgagaccagcacccccagccugagcgccaaggagcuggccgagcuggccagcagagccgagcugccccugagcuggagcgugagcagcaagcugaaccagcacgccgagcuggagaccgaggaggaggagaagaaccuggaggagcagaccgagagaaacggcgacguggccaaccuggagaacgagagcaagguguaa

SEQ ID NO: 18813 - RNA, 1275 nt, Artificial Sequence
  KCNJ8__Homo_sapiens__XP_005253415
augcuggccagaaagagcaucauccccgaggaguacgugcuggccagaaucgccgccgagaaccugagaaagcccagaaucagagacagacugcccaaggccagauucaucgccaagagcggcgccugcaaccuggcccacaagaacaucagagagcagggcagauuccugcaggacaucuucaccacccugguggaccugaaguggagacacacccuggugaucuucaccaugagcuuccugugcagcuggcugcuguucgccaucaugugguggcugguggccuucgcccacggcgacaucuacgccuacauggagaagagcggcauggagaagagcggccuggagagcaccgugugcgugaccaacgugagaagcuucaccagcgccuuccuguucagcaucgaggugcaggugaccaucggcuucggcggcagaaugaugaccgaggagugcccccuggccaucaccgugcugauccugcagaacaucgugggccugaucaucaacgccgugaugcugggcugcaucuucaugaagaccgcccaggcccacagaagagccgagacccugaucuucagcagacacgccgugaucgccgugagaaacggcaagcugugcuucauguucagagugggcgaccugagaaagagcaugaucaucagcgccagcgugagaauccagguggugaagaagaccaccacccccgagggcgagguggugcccauccaccagcuggacauccccguggacaaccccaucgagagcaacaacaucuuccugguggccccccugaucaucugccacgugaucgacaagagaagcccccuguacgacaucagcgccaccgaccuggccaaccaggaccuggaggugaucgugauccuggagggcgugguggagaccaccggcaucaccacccaggccagaaccagcuacaucgccgaggagauccaguggggccacagauucgugagcaucgugaccgaggaggagggcguguacagcguggacuacagcaaguucggcaacaccgugaagguggccgcccccagaugcagcgccagagagcuggacgagaagcccagcauccugauccagacccugcagaagagcgagcugagccaccagaacagccugagaaagagaaacagcaugagaagaaacaacagcaugagaagaaacaacagcaucagaagaaacaacagcagccugauggugcccaaggugcaguucaugacccccgagggcaaccagaacaccagcgagagcuaa

SEQ ID NO: 18814 - RNA, 1371 nt, Artificial Sequence
  KCNJ9__Homo_sapiens__XP_006711368
augagaagcagacuggaggagcugaaguuccuggagggcagauggagaaaccaggugcuggaccuggagaucgagccccugcaggaccccagaagaagacugggcgcccagagaagagccgccggcggcagcagcagcggccccagaagaacccccggcgccagaagcgccagacccgacgccgccgccauggcccaggagaacgccgccuucagccccggccaggaggagccccccagaagaagaggcagacagagauacguggagaaggacggcagaugcaacgugcagcagggcaacgugagagagaccuacagauaccugaccgaccuguucaccacccugguggaccugcaguggagacugagccugcuguucuucgugcuggccuacgcccugaccuggcuguucuucggcgccaucugguggcugaucgccuacggcagaggcgaccuggagcaccuggaggacaccgccuggacccccugcgugaacaaccugaacggcuucguggccgccuuccuguucagcaucgagaccgagaccaccaucggcuacggccacagagugaucaccgaccagugccccgagggcaucgugcugcugcugcugcaggccauccugggcagcauggugaacgccuucauggugggcugcauguucgugaagaucagccagcccaacaagagagccgccacccugguguucagcagccacgccguggugagccugagagacggcagacugugccugauguucagagugggcgaccugagaagcagccacaucguggaggccagcaucagagccaagcugaucagaagcagacagacccuggagggcgaguucaucccccugcaccagaccgaccugagcgugggcuucgacaccggcgacgacagacuguuccuggugagcccccuggugaucagccacgagaucgacgccgccagccccuucugggaggccagcagaagagcccuggagagagacgacuucgagaucguggugauccuggagggcaugguggaggccaccggcaugaccugccaggccagaagcagcuaccugguggacgaggugcuguggggccacagauucaccagcgugcugacccuggaggacggcuucuacgagguggacuacgccagcuuccacgagaccuucgaggugcccacccccagcugcagcgccagagagcuggccgaggccgccgccagacuggacgcccaccuguacuggagcauccccagcagacuggacgagaagguggaggaggagggcgccggcgagggcgccggcggcgaggccggcgccgacaaggagcagaacggcugccugcccccccccgagagcgagagcaagguguaa

SEQ ID NO: 18815 - RNA, 1617 nt, Artificial Sequence
  KCNK10__Homo_sapiens__NP_066984
auguucuuccuguacaccgacuucuuccugagccugguggccgugcccgccgccgcccccgugugccagcccaagagcgccaccaacggccagccccccgcccccgcccccacccccacccccagacugagcaucagcagcagagccaccgugguggccagaauggagggcaccagccagggcggccugcagaccgugaugaaguggaagaccgugguggccaucuucguggugguggugguguaccuggugaccggcggccugguguucagagcccuggagcagcccuucgagagcagccagaagaacaccaucgcccuggagaaggccgaguuccugagagaccacgugugcgugagcccccaggagcuggagacccugauccagcacgcccuggacgccgacaacgccggcgugagccccaucggcaacagcagcaacaacagcagccacugggaccugggcagcgccuucuucuucgccggcaccgugaucaccaccaucggcuacggcaacaucgcccccagcaccgagggcggcaagaucuucugcauccuguacgccaucuucggcaucccccuguucggcuuccugcuggccggcaucggcgaccagcugggcaccaucuucggcaagagcaucgccagaguggagaagguguucagaaagaagcaggugagccagaccaagaucagagugaucagcaccauccuguucauccuggccggcugcaucguguucgugaccauccccgccgugaucuucaaguacaucgagggcuggaccgcccuggagagcaucuacuucgugguggugacccugaccaccgugggcuucggcgacuucguggccggcggcaacgccggcaucaacuacagagagugguacaagccccuggugugguucuggauccuggugggccuggccuacuucgccgccgugcugagcaugaucggcgacuggcugagagugcugagcaagaagaccaaggaggaggugggcgagaucaaggcccacgccgccgaguggaaggccaacgugaccgccgaguucagagagaccagaagaagacugagcguggagauccacgacaagcugcagagagccgccaccaucagaagcauggagagaagaagacugggccuggaccagagagcccacagccuggacaugcugagccccgagaagagaagcguguucgccgcccuggacaccggcagauucaaggccagcagccaggagagcaucaacaacagacccaacaaccugagacugaagggccccgagcagcugaacaagcacggccagggcgccagcgaggacaacaucaucaacaaguucggcagcaccagcagacugaccaagagaaagaacaaggaccugaagaagacccugcccgaggacgugcagaagaucuacaagaccuucagaaacuacagccuggacgaggagaagaaggaggaggagaccgagaagaugugcaacagcgacaacagcagcaccgccaugcugaccgacugcauccagcagcacgccgagcuggagaacggcaugauccccaccgacaccaaggacagagagcccgagaacaacagccugcuggaggacagaaacuaa

SEQ ID NO: 18816 - RNA, 1293 nt, Artificial Sequence
  KCNK12__Homo_sapiens__NP_071338
augagcagcagaagccccagacccccccccagaagaagcagaagaagacugcccagacccagcugcugcugcugcugcugcagaagaagccaccugaacgaggacaccggcagauucgugcugcuggccgcccugaucggccuguaccugguggccggcgccaccguguucagcgcccuggagagccccggcgaggccgaggccagagccagauggggcgccacccugagaaacuucagcgccgcccacggcguggccgagcccgagcugagagccuuccugagacacuacgaggccgcccuggccgccggcgugagagccgacgcccugagacccagaugggacuuccccggcgccuucuacuucgugggcaccguggugagcaccaucggcuucggcaugaccacccccgccaccgugggcggcaaggccuuccugaucgccuacggccuguucggcugcgccggcaccauccuguucuucaaccuguuccuggagagaaucaucagccugcuggccuucaucaugagagccugcagagagagacagcugagaagaagcggccugcugcccgccaccuucagaagaggcagcgcccugagcgaggccgacagccuggccggcuggaagcccagcguguaccacgugcugcugauccugggccuguucgccgugcugcugagcugcugcgccagcgccauguacaccagcguggagggcugggacuacguggacagccuguacuucugcuucgugaccuucagcaccaucggcuucggcgaccuggugagcagccagcacgccgccuacagaaaccagggccuguacagacugggcaacuuccuguucauccugcugggcgugugcugcaucuacagccuguucaacgugaucagcauccugaucaagcaggugcugaacuggaugcugagaaagcugagcugcagaugcugcgccagaugcugccccgcccccggcgccccccuggccagaagaaacgccaucacccccggcagcagacugagaagaagacuggccgcccugggcgccgaccccgccgccagagacagcgacgccgagggcagaagacugagcggcgagcugaucagcaugagagaccugaccgccagcaacaaggugagccuggcccugcugcagaagcagcugagcgagaccgccaacggcuaccccagaagcgugugcgugaacaccagacagaacggcuucagcggcggcgugggcgcccugggcaucaugaacaacagacuggccgagaccagcgccagcagauaa

SEQ ID NO: 18817 - RNA, 969 nt, Artificial Sequence
  KCNK16__Homo_sapiens__NP_001128577
augcccagcgccggccugugcagcugcuggggcggcagagugcugccccugcugcuggccuacgugugcuaccugcugcugggcgccaccaucuuccagcugcuggagagacaggccgaggcccagagcagagaccaguuccagcuggagaagcugagauuccuggagaacuacaccugccuggaccagugggccauggagcaguucgugcaggugaucauggaggccugggugaagggcgugaaccccaagggcaacagcaccaaccccagcaacugggacuucggcagcagcuucuucuucgccggcaccguggugaccaccaucggcuacggcaaccuggcccccagcaccgaggccggccagguguucugcguguucuacgcccugcugggcaucccccugaacgugaucuuccugaaccaccugggcaccggccugagagcccaccuggccgccaucgagagaugggaggacagacccagaagaagccaggugcugcaggugcugggccuggcccuguuccugacccugggcacccuggugauccugaucuucccccccaugguguucagccacguggagggcuggagcuucagcgagggcuucuacuucgccuucaucacccugagcaccaucggcuucggcgacuacguggugggccacccccugaacuucaucacccccagcggccugcugcccagccaggagcccuuccagaccccccacggcaagcccgagagccagcagauccccggcagcuuccagaaggugagcagcaugaacguguggccccugagcggcaugcacagccccggccuggccuucccccugcccgacugcaacauccccgaccaggagagauucagaccccugcaccccggcgccuggaaguucuggccccugccccugcccagcagcaacagcaagugggcccccauguggcugggcagcagcgcccagguguaa

SEQ ID NO: 18818 - RNA, 816 nt, Artificial Sequence
  KCNK17__Homo_sapiens__NP_001128583
auguacagacccagagccagagccgcccccgagggcagagugagaggcugcgccgugcccagcaccgugcugcugcugcuggccuaccuggccuaccuggcccugggcaccggcguguucuggacccuggagggcagagccgcccaggacagcagcagaagcuuccagagagacaagugggagcugcugcagaacuucaccugccuggacagacccgcccuggacagccugaucagagacguggugcaggccuacaagaacggcgccagccugcugagcaacaccaccagcaugggcagaugggagcuggugggcagcuucuucuucagcgugagcaccaucaccaccaucggcuacggcaaccugagccccaacaccauggccgccagacuguucugcaucuucuucgcccuggugggcaucccccugaaccugguggugcugaacagacugggccaccugaugcagcagggcgugaaccacugggccagcagacugggcggcaccuggcaggaccccgacaaggccagauggcuggccggcagcggcgcccugcugagcggccugcugcuguuccugcugcugcccccccugcuguucagccacauggagggcuggagcuacaccgagggcuucuacuucgccuucaucacccugagcaccgugggcuucggcgacuacgugaucgccagcugccugaucagcgacaccagaaagcccaacagagacuggcagacccuggagagaaccagcaagagcagcggcggccugcugaaguacagauuccuggccggccacggcggcagccaccuguaa

SEQ ID NO: 18819 - RNA, 1155 nt, Artificial Sequence
  KCNK18__Homo_sapiens__NP_862823
auggaggugagcggccacccccaggccagaagaugcugccccgaggcccugggcaagcuguuccccggccugugcuuccugugcuuccuggugaccuacgcccuggugggcgccgugguguucagcgccaucgaggacggccaggugcugguggccgccgacgacggcgaguucgagaaguuccuggaggagcugugcagaauccugaacugcagcgagaccgugguggaggacagaaagcaggaccugcagggccaccugcagaaggugaagccccagugguucaacagaaccacccacuggagcuuccugagcagccuguucuucugcugcaccguguucagcaccgugggcuacggcuacaucuaccccgugaccagacugggcaaguaccugugcaugcuguacgcccuguucggcaucccccugauguuccuggugcugaccgacaccggcgacauccuggccaccauccugagcaccagcuacaacagauucagaaaguuccccuucuucaccagaccccugcugagcaaguggugccccaagagccuguucaagaagaagcccgaccccaagcccgccgacgaggccgugccccagaucaucaucagcgccgaggagcugcccggccccaagcugggcaccugccccagcagacccagcugcagcauggagcuguucgagagaagccacgcccuggagaagcagaacacccugcagcugcccccccaggccauggagagaagcaacagcugccccgagcuggugcugggcagacugagcuacagcaucaucagcaaccuggacgaggugggccagcagguggagagacuggacaucccccugcccaucaucgcccugaucguguucgccuacaucagcugcgccgccgccauccugcccuucugggagacccagcuggacuucgagaacgccuucuacuucugcuucgugacccugaccaccaucggcuucggcgacaccgugcuggagcaccccaacuucuuccuguucuucagcaucuacaucaucgugggcauggagaucguguucaucgccuucaagcuggugcagaacagacugaucgacaucuacaagaacgugaugcuguucuucgccaagggcaaguucuaccaccuggugaagaaguaa

SEQ ID NO: 18820 - RNA, 1011 nt, Artificial Sequence
  KCNK1__Homo_sapiens__NP_002236
augcugcagagccuggccggcagcagcugcgugagacugguggagagacacagaagcgccuggugcuucggcuuccuggugcugggcuaccugcuguaccugguguucggcgccgugguguucagcagcguggagcugcccuacgaggaccugcugagacaggagcugagaaagcugaagagaagauuccuggaggagcacgagugccugagcgagcagcagcuggagcaguuccugggcagagugcuggaggccagcaacuacggcgugagcgugcugagcaacgccagcggcaacuggaacugggacuucaccagcgcccuguucuucgccagcaccgugcugagcaccaccggcuacggccacaccgugccccugagcgacggcggcaaggccuucugcaucaucuacagcgugaucggcauccccuucacccugcuguuccugaccgccguggugcagagaaucaccgugcacgugaccagaagacccgugcuguacuuccacaucagauggggcuucagcaagcaggugguggccaucgugcacgccgugcugcugggcuucgugaccgugagcugcuucuucuucauccccgccgccguguucagcgugcuggaggacgacuggaacuuccuggagagcuucuacuucugcuucaucagccugagcaccaucggccugggcgacuacgugcccggcgagggcuacaaccagaaguucagagagcuguacaagaucggcaucaccugcuaccugcugcugggccugaucgccaugcugguggugcuggagaccuucugcgagcugcacgagcugaagaaguucagaaagauguucuacgugaagaaggacaaggacgaggaccaggugcacaucaucgagcacgaccagcugagcuucagcagcaucaccgaccaggccgccggcaugaaggaggaccagaagcagaacgagcccuucguggccacccagagcagcgccugcguggacggccccgccaaccacuaa

SEQ ID NO: 18821 - RNA, 1269 nt, Artificial Sequence
  KCNK2__Homo_sapiens__NP_001017424
augaugaaccccagagccaagagagacuucuaccuggccgcccccgaccugcuggaccccaagagcgccgcccagaacagcaagcccagacugagcuucagcaccaagcccaccgugcuggccagcagaguggagagcgacaccaccaucaacgugaugaaguggaagaccgugagcaccaucuuccuggugguggugcuguaccugaucaucggcgccaccguguucaaggcccuggagcagccccacgagaucagccagagaaccaccaucgugauccagaagcagaccuucaucagccagcacagcugcgugaacagcaccgagcuggacgagcugauccagcagaucguggccgccaucaacgccggcaucaucccccugggcaacaccagcaaccagaucagccacugggaccugggcagcagcuucuucuucgccggcaccgugaucaccaccaucggcuucggcaacaucagccccagaaccgagggcggcaagaucuucugcaucaucuacgcccugcugggcaucccccuguucggcuuccugcuggccggcgugggcgaccagcugggcaccaucuucggcaagggcaucgccaagguggaggacaccuucaucaaguggaacgugagccagaccaagaucagaaucaucagcaccaucaucuucauccuguucggcugcgugcuguucguggcccugcccgccaucaucuucaagcacaucgagggcuggagcgcccuggacgccaucuacuucguggugaucacccugaccaccaucggcuucggcgacuacguggccggcggcagcgacaucgaguaccuggacuucuacaagcccguggugugguucuggauccuggugggccuggccuacuucgccgccgugcugagcaugaucggcgacuggcugagagugaucagcaagaagaccaaggaggaggugggcgaguucagagcccacgccgccgaguggaccgccaacgugaccgccgaguucaaggagaccagaagaagacugagcguggagaucuacgacaaguuccagagagccaccagcaucaagagaaagcugagcgccgagcuggccggcaaccacaaccaggagcugacccccugcagaagaacccugagcgugaaccaccugaccagcgagagagacgugcugcccccccugcugaagaccgagagcaucuaccugaacggccugaccccccacugcgccggcgaggagaucgccgugaucgagaacaucaaguaa

SEQ ID NO: 18822 - RNA, 1185 nt, Artificial Sequence
  KCNK3__Homo_sapiens__NP_002237
augaagagacagaacgugagaacccuggcccugaucgugugcaccuucaccuaccugcuggugggcgccgccguguucgacgcccuggagagcgagcccgagcugaucgagagacagagacuggagcugagacagcaggagcugagagccagauacaaccugagccagggcggcuacgaggagcuggagagaguggugcugagacugaagccccacaaggccggcgugcaguggagauucgccggcagcuucuacuucgccaucaccgugaucaccaccaucggcuacggccacgccgcccccagcaccgacggcggcaagguguucugcauguucuacgcccugcugggcaucccccugacccuggugauguuccagagccugggcgagagaaucaacacccuggugagauaccugcugcacagagccaagaagggccugggcaugagaagagccgacgugagcauggccaacauggugcugaucggcuucuucagcugcaucagcacccugugcaucggcgccgccgccuucagccacuacgagcacuggaccuucuuccaggccuacuacuacugcuucaucacccugaccaccaucggcuucggcgacuacguggcccugcagaaggaccaggcccugcagacccagccccaguacguggccuucagcuucguguacauccugaccggccugaccgugaucggcgccuuccugaaccugguggugcugagauucaugaccaugaacgccgaggacgagaagagagacgccgagcacagagcccugcugaccagaaacggccaggccggcggcggcggcggcggcggcagcgcccacaccaccgacaccgccagcagcaccgccgccgccggcggcggcggcuucagaaacguguacgccgaggugcugcacuuccagagcaugugcagcugccugugguacaagagcagagagaagcugcaguacagcauccccaugaucauccccagagaccugagcaccagcgacaccugcguggagcagagccacagcagccccggcggcggcggcagauacagcgacacccccagcagaagaugccugugcagcggcgcccccagaagcgccaucagcagcgugagcaccggccugcacagccugagcaccuucagaggccugaugaagagaagaagcagcguguaa

SEQ ID NO: 18823 - RNA, 1500 nt, Artificial Sequence
  KCNK5__Homo_sapiens__NP_003731
augguggacagaggcccccugcugaccagcgccaucaucuucuaccuggccaucggcgccgccaucuucgaggugcuggaggagccccacuggaaggaggccaagaagaacuacuacacccagaagcugcaccugcugaaggaguuccccugccugggccaggagggccuggacaagauccuggagguggugagcgacgccgccggccagggcguggccaucaccggcaaccagaccuucaacaacuggaacuggcccaacgccaugaucuucgccgccaccgugaucaccaccaucggcuacggcaacguggcccccaagacccccgccggcagacuguucugcguguucuacggccuguucggcgugccccugugccugaccuggaucagcgcccugggcaaguucuucggcggcagagccaagagacugggccaguuccugaccaagagaggcgugagccugagaaaggcccagaucaccugcaccgugaucuucaucguguggggcgugcuggugcaccuggugaucccccccuucguguucauggugaccgagggcuggaacuacaucgagggccuguacuacagcuucaucaccaucagcaccaucggcuucggcgacuucguggccggcgugaaccccagcgccaacuaccacgcccuguacagauacuucguggagcuguggaucuaccugggccuggccuggcugagccuguucgugaacuggaaggugagcauguucguggaggugcacaaggccaucaagaagagaagaagaagaagaaaggagagcuucgagagcagcccccacagcagaaaggcccugcaggugaagggcagcaccgccagcaaggacgugaacaucuucagcuuccugagcaagaaggaggagaccuacaacgaccugaucaagcagaucggcaagaaggccaugaagaccagcggcggcggcgagaccggccccggccccggccugggcccccagggcggcggccugcccgcccugccccccagccuggugccccuggugguguacagcaagaacagagugcccacccuggaggaggugagccagacccugagaagcaagggccacgugagcagaagccccgacgaggaggccguggccagagcccccgaggacagcagccccgcccccgagguguucaugaaccagcuggacagaaucagcgaggagugcgagcccugggacgcccaggacuaccacccccugaucuuccaggacgccagcaucaccuucgugaacaccgaggccggccugagcgacgaggagaccagcaagagcagccuggaggacaaccuggccggcgaggagagcccccagcagggcgccgaggccaaggccccccugaacaugggcgaguuccccagcagcagcgagagcaccuucaccagcaccgagagcgagcugagcgugcccuacgagcagcugaugaacgaguacaacaaggccaacagccccaagggcaccuaa

SEQ ID NO: 18824 - RNA, 942 nt, Artificial Sequence
  KCNK6__Homo_sapiens__NP_004814
augagaagaggcgcccugcuggccggcgcccuggccgccuacgccgccuaccuggugcugggcgcccugcugguggccagacuggagggcccccacgaggccagacugagagccgagcuggagacccugagagcccagcugcugcagagaagccccugcguggccgcccccgcccuggacgccuucguggagagagugcuggccgccggcagacugggcagaguggugcuggccaacgccagcggcagcgccaacgccagcgaccccgccugggacuucgccagcgcccuguucuucgccagcacccugaucaccaccgugggcuacggcuacaccaccccccugaccgacgccggcaaggccuucagcaucgccuucgcccugcugggcgugcccaccaccaugcugcugcugaccgccagcgcccagagacugagccugcugcugacccacgugccccugagcuggcugagcaugagauggggcugggaccccagaagagccgccugcuggcaccugguggcccugcugggcgugguggugaccgugugcuuccuggugcccgccgugaucuucgcccaccuggaggaggccuggagcuuccuggacgccuucuacuucugcuucaucagccugagcaccaucggccugggcgacuacgugcccggcgaggcccccggccagcccuacagagcccuguacaaggugcuggugaccguguaccuguuccugggccugguggccauggugcuggugcugcagaccuucagacacgugagcgaccugcacggccugaccgagcugauccugcugcccccccccugccccgccagcuucaacgccgacgaggacgacagaguggacauccugggcccccagcccgagagccaccagcagcugagcgccagcagccacaccgacuacgccagcauccccagauaa

SEQ ID NO: 18825 - RNA, 1125 nt, Artificial Sequence
  KCNK9__Homo_sapiens__XP_011515404
augaagagacagaacgugagaacccugagccugaucgugugcaccuucaccuaccugcuggugggcgccgccguguucgacgcccuggagagcgaccacgagaugagagaggaggagaagcugaaggccgaggagaucagaaucaagggcaaguacaacaucagcagcgaggacuacagacagcuggagcuggugauccugcagagcgagccccacagagccggcgugcaguggaaguucgccggcagcuucuacuucgccaucaccgugaucaccaccaucggcuacggccacgccgcccccggcaccgacgccggcaaggccuucugcauguucuacgccgugcugggcaucccccugacccuggugauguuccagagccugggcgagagaaugaacaccuucgugagauaccugcugaagagaaucaagaagugcugcggcaugagaaacaccgacgugagcauggagaacauggugaccgugggcuucuucagcugcaugggcacccugugcaucggcgccgccgccuucagccagugcgaggaguggagcuucuuccacgccuacuacuacugcuucaucacccugaccaccaucggcuucggcgacuacguggcccugcagaccaagggcgcccugcagaagaagccccuguacguggccuucagcuucauguacauccuggugggccugaccgugaucggcgccuuccugaaccugguggugcugagauuccugaccaugaacagcgaggacgagagaagagacgccgaggagagagccagccuggccggcaacagaaacagcauggugauccacauccccgaggagcccagacccagcagacccagauacaaggccgacgugcccgaccugcagagcgugugcagcugcaccugcuacagaagccaggacuacggcggcagaagcguggccccccagaacagcuucagcgccaagcuggccccccacuacuuccacagcaucagcuacaagaucgaggagaucagccccagcacccugaagaacagccuguuccccagccccaucagcagcaucagccccggccugcacagcuucaccgaccaccagagacugaugaagagaagaaagagcguguaa

SEQ ID NO: 18826 - RNA, 3711 nt, Artificial Sequence
  KCNMA1__Homo_sapiens__NP_001154824
auggccaacggcggcggcggcggcggcggcagcagcggcggcggcggcggcggcggcggcagcagccugagaaugagcagcaacauccacgccaaccaccugagccuggacgccagcagcagcagcagcagcagcagcagcagcagcagcagcagcagcagcagcagcagcagcagcagcgugcacgagcccaagauggacgcccugaucauccccgugaccauggaggugcccugcgacagcagaggccagagaauguggugggccuuccuggccagcagcauggugaccuucuucggcggccuguucaucauccugcuguggagaacccugaaguaccuguggaccgugugcugccacugcggcggcaagaccaaggaggcccagaagaucaacaacggcagcagccaggccgacggcacccugaagcccguggacgagaaggaggaggccguggccgccgaggugggcuggaugaccagcgugaaggacugggccggcgugaugaucagcgcccagacccugaccggcagagugcugguggugcugguguucgcccugagcaucggcgcccuggugaucuacuucaucgacagcagcaaccccaucgagagcugccagaacuucuacaaggacuucacccugcagaucgacauggccuucaacguguucuuccugcuguacuucggccugagauucaucgccgccaacgacaagcugugguucuggcuggaggugaacagcgugguggacuucuucaccgugccccccguguucgugagcguguaccugaacagaagcuggcugggccugagauuccugagagcccugagacugauccaguucagcgagauccugcaguuccugaacauccugaagaccagcaacagcaucaagcuggugaaccugcugagcaucuucaucagcaccuggcugaccgccgccggcuucauccaccugguggagaacagcggcgaccccugggagaacuuccagaacaaccaggcccugaccuacugggagugcguguaccugcugauggugaccaugagcaccgugggcuacggcgacguguacgccaagaccacccugggcagacuguucaugguguucuucauccugggcggccuggccauguucgccagcuacgugcccgagaucaucgagcugaucggcaacagaaagaaguacggcggcagcuacagcgccgugagcggcagaaagcacaucguggugugcggccacaucacccuggagagcgugagcaacuuccugaaggacuuccugcacaaggacagagacgacgugaacguggagaucguguuccugcacaacaucagccccaaccuggagcuggaggcccuguucaagagacacuucacccagguggaguucuaccagggcagcgugcugaacccccacgaccuggccagagugaagaucgagagcgccgacgccugccugauccuggccaacaaguacugcgccgaccccgacgccgaggacgccagcaacaucaugagagugaucagcaucaagaacuaccaccccaagaucagaaucaucacccagaugcugcaguaccacaacaaggcccaccugcugaacauccccagcuggaacuggaaggagggcgacgacgccaucugccuggccgagcugaagcugggcuucaucgcccagagcugccuggcccagggccugagcaccaugcuggccaaccuguucagcaugagaagcuucaucaagaucgaggaggacaccuggcagaaguacuaccuggagggcgugagcaacgagauguacaccgaguaccugagcagcgccuucgugggccugagcuuccccaccgugugcgagcugugcuucgugaagcugaagcugcugaugaucgccaucgaguacaagagcgccaacagagagagcagaauccugaucaaccccggcaaccaccugaagauccaggagggcacccugggcuucuucaucgccagcgacgccaaggaggugaagagagccuucuucuacugcaaggccugccacgacgacaucaccgaccccaagagaaucaagaagugcggcugcaagagacccaagaugagcaucuacaagagaaugagaagagccugcugcuucgacugcggcagaagcgagagagacugcagcugcaugagcggcagagugagaggcaacguggacacccuggagagagccuucccccugagcagcgugagcgugaacgacugcagcaccagcuucagagccuucgaggacgagcagcccagcacccugagccccaagaagaagcagagaaacggcggcaugagaaacagccccaacaccagccccaagcugaugagacacgacccccugcugauccccggcaacgaccagaucgacaacauggacagcaacgugaagaaguacgacagcaccggcauguuccacuggugcgcccccaaggagaucgagaaggugauccugaccagaagcgaggccgccaugaccgugcugagcggccacgugguggugugcaucuucggcgacgugagcagcgcccugaucggccugagaaaccuggugaugccccugagagccagcaacuuccacuaccacgagcugaagcacaucguguucgugggcagcaucgaguaccugaagagagagugggagacccugcacaacuuccccaaggugagcauccugcccggcaccccccugagcagagccgaccugagagccgugaacaucaaccugugcgacaugugcgugauccugagcgccaaccagaacaacaucgacgacaccagccugcaggacaaggagugcauccuggccagccugaacaucaagagcaugcaguucgacgacagcaucggcgugcugcaggccaacagccagggcuucaccccccccggcauggacagaagcagccccgacaacagccccgugcacggcaugcugagacagcccagcaucaccaccggcgugaacauccccaucaucaccgagcuggugaacgacaccaacgugcaguuccuggaccaggacgacgacgacgaccccgacaccgagcuguaccugacccagcccuucgccugcggcaccgccuucgccgugagcgugcuggacagccugaugagcgccaccuacuucaacgacaacauccugacccugaucagaacccuggugaccggcggcgccacccccgagcuggaggcccugaucgccgaggagaacgcccugagaggcggcuacagcaccccccagacccuggccaacagagacagaugcagaguggcccagcuggcccugcuggacggccccuucgccgaccugggcgacggcggcugcuacggcgaccuguucugcaaggcccugaagaccuacaacaugcugugcuucggcaucuacagacugagagacgcccaccugagcacccccagccagugcaccaagagauacgugaucaccaacccccccuacgaguucgagcuggugcccaccgaccugaucuucugccugaugcaguucgaccacaacgccggccagagcagagccagccugagccacagcagccacagcagccagagcagcagcaagaagagcagcagcgugcacagcauccccagcaccgccaacagacagaacagacccaagagcagagagagcagagacaagcagaaguacgugcaggaggagagacuguaa

SEQ ID NO: 18827 - RNA, 576 nt, Artificial Sequence
  KCNMB1__Homo_sapiens__NP_004128
auggugaagaagcuggugauggcccagaagagaggcgagaccagagcccugugccugggcgugaccaugguggugugcgccgugaucaccuacuacauccuggugaccaccgugcugccccuguaccagaagagcguguggacccaggagagcaagugccaccugaucgagaccaacaucagagaccaggaggagcugaagggcaagaaggugccccaguaccccugccugugggugaacgugagcgccgccggcagaugggccgugcuguaccacaccgaggacaccagagaccagaaccagcagugcagcuacauccccggcagcguggacaacuaccagaccgccagagccgacguggagaaggugagagccaaguuccaggagcagcagguguucuacugcuucagcgcccccagaggcaacgagaccagcgugcuguuccagagacuguacggcccccaggcccugcuguucagccuguucuggcccaccuuccugcugaccggcggccugcugaucaucgccauggugaagagcaaccaguaccugagcauccuggccgcccagaaguaa

SEQ ID NO: 18828 - RNA, 708 nt, Artificial Sequence
  KCNMB2__Homo_sapiens__NP_001265840
auguucaucuggaccagcggcagaaccagcagcagcuacagacacgacgagaagagaaacaucuaccagaagaucagagaccacgaccugcuggacaagagaaagaccgugaccgcccugaaggccggcgaggacagagccauccugcugggccuggccaugauggugugcagcaucaugauguacuuccugcugggcaucacccugcugagaagcuacaugcagagcguguggaccgaggagagccagugcacccugcugaacgccagcaucaccgagaccuucaacugcagcuucagcugcggccccgacugcuggaagcugagccaguaccccugccugcagguguacgugaaccugaccagcagcggcgagaagcugcugcuguaccacaccgaggagaccaucaagaucaaccagaagugcagcuacauccccaagugcggcaagaacuucgaggagagcaugagccuggugaacguggugauggagaacuucagaaaguaccagcacuucagcugcuacagcgaccccgagggcaaccagaagagcgugauccugaccaagcuguacagcagcaacgugcuguuccacagccuguucuggcccaccugcaugauggccggcggcguggccaucguggccauggugaagcugacccaguaccugagccugcugugcgagagaauccagagaaucaacagauaa

SEQ ID NO: 18829 - RNA, 522 nt, Artificial Sequence
  KCNMB3__Homo_sapiens__NP_001157149
augcagcccuucagcauccccgugcagaucacccugcagggcagcagaagaagacagggcagaaccgccuuccccgccagcggcaagaagagagagaccgacuacagcgacggcgacccccuggacgugcacaagagacugcccagcagcgccggcgaggacagagccgugaugcugggcuucgccaugaugggcuucagcgugcugauguucuuccugcugggcaccaccauccugaagcccuucaugcugagcauccagagagaggagagcaccugcaccgccauccacaccgacaucauggacgacuggcuggacugcgccuucaccugcggcgugcacugccacggccagggcaaguaccccugccugcagguguucgugaaccugagccaccccggccagaaggcccugcugcacuacaacgaggaggccgugcagaucaaccccaagagagacgugaccgacugcagagugaaggagaagcagacccugaccgugagcgacgagcacaagcaguaa

SEQ ID NO: 18830 - RNA, 633 nt, Artificial Sequence
  KCNMB4__Homo_sapiens__NP_055320
auggccaagcugagaguggccuacgaguacaccgaggccgaggacaagagcaucagacugggccuguuccugaucaucagcggcguggugagccuguucaucuucggcuucugcuggcugagccccgcccugcaggaccugcaggccaccgaggccaacugcaccgugcugagcgugcagcagaucggcgagguguucgagugcaccuucaccugcggcgccgacugcagaggcaccagccaguaccccugcgugcagguguacgugaacaacagcgagagcaacagcagagcccugcugcacagcgacgagcaccagcugcugaccaaccccaagugcagcuacaucccccccugcaagagagagaaccagaagaaccuggagagcgugaugaacuggcagcaguacuggaaggacgagaucggcagccagcccuucaccugcuacuucaaccagcaccagagacccgacgacgugcugcugcacagaacccacgacgagaucgugcugcugcacugcuuccuguggccccuggugaccuucguggugggcgugcugaucguggugcugaccaucugcgccaagagccuggccgugaaggccgaggccaugaagaagagaaaguucagcuaa

SEQ ID NO: 18831 - RNA, 1632 nt, Artificial Sequence
  KCNN1__Homo_sapiens__NP_002239
augaacagccacagcuacaacggcagcgugggcagaccccugggcagcggccccggcgcccugggcagagacccccccgaccccgaggccggccaccccccccagcccccccacagccccggccugcagguggugguggccaagagcgagcccgccagacccagccccggcagccccagaggccagccccaggaccaggacgacgacgaggacgacgaggaggacgaggccggcagacagagagccagcggcaagcccagcaacgugggccacagacugggccacagaagagcccuguucgagaagagaaagagacugagcgacuacgcccugaucuucggcauguucggcaucguggugauggugaccgagaccgagcugagcuggggcguguacaccaaggagagccuguacagcuucgcccugaagugccugaucagccugagcaccgccauccugcugggccugguggugcuguaccacgccagagagauccagcuguucaugguggacaacggcgccgacgacuggagaaucgccaugaccugcgagagaguguuccugaucagccuggagcuggccgugugcgccauccaccccgugcccggccacuacagauucaccuggaccgccagacuggccuucaccuacgcccccagcguggccgaggccgacguggacgugcugcugagcauccccauguuccugagacuguaccugcugggcagagugaugcugcugcacagcaagaucuucaccgacgccagcagcagaagcaucggcgcccugaacaagaucaccuucaacaccagauucgugaugaagacccugaugaccaucugccccggcaccgugcugcugguguucagcaucagcagcuggaucaucgccgccuggaccgugagagugugcgagagauaccacgacaagcaggaggugaccagcaacuuccugggcgccauguggcugaucagcaucaccuuccugagcaucggcuacggcgacauggugccccacaccuacugcggcaagggcgugugccugcugaccggcaucaugggcgccggcugcaccgcccuggugguggccgugguggccagaaagcuggagcugaccaaggccgagaagcacgugcacaacuucaugauggacacccagcugaccaagagagugaagaacgccgccgccaacgugcugagagagaccuggcugaucuacaagcacaccagacuggugaagaagcccgaccaggccagagugagaaagcaccagagaaaguuccugcaggccauccaccaggcccagaagcugagaagcgugaagaucgagcagggcaagcugaacgaccaggccaacacccugaccgaccuggccaagacccagaccgugauguacgaccuggugagcgagcugcacgcccagcacgaggagcuggaggccagacuggccacccuggagagcagacuggacgcccugggcgccagccugcaggcccugcccggccugaucgcccaggccaucagaccccccccccccccccugccccccagacccggccccggcccccaggaccaggccgccagaagcagccccugcagauggacccccguggcccccagcgacugcggcuaa

SEQ ID NO: 18832 - RNA, 1740 nt, Artificial Sequence
  KCNN2__Homo_sapiens__NP_067627
augagcagcugcagauacaacggcggcgugaugagaccccugagcaaccugagcgccagcagaagaaaccugcacgagauggacagcgaggcccagccccugcagccccccgccagcgugggcggcggcggcggcgccagcagccccagcgccgccgccgccgccgccgccgccgugagcagcagcgcccccgagaucguggugagcaagcccgagcacaacaacagcaacaaccuggcccuguacggcaccggcggcggcggcagcaccggcggcggcggcggcggcggcggcagcggccacggcagcagcagcggcaccaagagcagcaagaagaagaaccagaacaucggcuacaagcugggccacagaagagcccuguucgagaagagaaagagacugagcgacuacgcccugaucuucggcauguucggcaucguggugauggugaucgagaccgagcugagcuggggcgccuacgacaaggccagccuguacagccuggcccugaagugccugaucagccugagcaccaucauccugcugggccugaucaucguguaccacgccagagagauccagcuguucaugguggacaacggcgccgacgacuggagaaucgccaugaccuacgagagaaucuucuucaucugccuggagauccuggugugcgccauccaccccauccccggcaacuacaccuucaccuggaccgccagacuggccuucagcuacgcccccagcaccaccaccgccgacguggacaucauccugagcauccccauguuccugagacuguaccugaucgccagagugaugcugcugcacagcaagcuguucaccgacgccagcagcagaagcaucggcgcccugaacaagaucaacuucaacaccagauucgugaugaagacccugaugaccaucugccccggcaccgugcugcugguguucagcaucagccuguggaucaucgccgccuggaccgugagagccugcgagagauaccacgaccagcaggacgugaccagcaacuuccugggcgccauguggcugaucagcaucaccuuccugagcaucggcuacggcgacauggugcccaacaccuacugcggcaagggcgugugccugcugaccggcaucaugggcgccggcugcaccgcccuggugguggccgugguggccagaaagcuggagcugaccaaggccgagaagcacgugcacaacuucaugauggacacccagcugaccaagagagugaagaacgccgccgccaacgugcugagagagaccuggcugaucuacaagaacaccaagcuggugaagaagaucgaccacgccaaggugagaaagcaccagagaaaguuccugcaggccauccaccagcugagaagcgugaagauggagcagagaaagcugaacgaccaggccaacacccugguggaccuggccaagacccagaacaucauguacgacaugaucagcgaccugaacgagagaagcgaggacuucgagaagagaaucgugacccuggagaccaagcuggagacccugaucggcagcauccacgcccugcccggccugaucagccagaccaucagacagcagcagagagacuucaucgaggcccagauggagagcuacgacaagcacgugaccuacaacgccgagagaagcagaagcagcagcagaagaagaagaagcagcagcaccgccccccccaccagcagcgagagcagcuaa

SEQ ID NO: 18833 - RNA, 2196 nt, Artificial Sequence
  KCNN3__Homo_sapiens__NP_002240
auggacaccagcggccacuuccacgacagcggcgugggcgaccuggacgaggaccccaagugccccugccccagcagcggcgacgagcagcagcagcagcagcagcagcagcagcagcagcagccccccccccccgccccccccgccgccccccagcagccccugggccccagccugcagccccagcccccccagcugcagcagcagcagcagcagcagcagcagcagcagcagcagcagcccccccacccccugagccagcuggcccagcugcagagccagcccgugcaccccggccugcugcacagcagccccaccgccuucagagccccccccagcagcaacagcaccgccauccugcaccccagcagcagacagggcagccagcugaaccugaacgaccaccugcugggccacagccccagcagcaccgccaccagcggccccggcggcggcagcagacacagacaggccagcccccuggugcacagaagagacagcaaccccuucaccgagaucgccaugagcagcugcaaguacagcggcggcgugaugaagccccugagcagacugagcgccagcagaagaaaccugaucgaggccgagaccgagggccagccccugcagcuguucagccccagcaacccccccgagaucgugaucagcagcagagaggacaaccacgcccaccagacccugcugcaccaccccaacgccacccacaaccaccagcacgccggcaccaccgccagcagcaccaccuuccccaaggccaacaagagaaagaaccagaacaucggcuacaagcugggccacagaagagcccuguucgagaagagaaagagacugagcgacuacgcccugaucuucggcauguucggcaucguggugauggugaucgagaccgagcugagcuggggccuguacagcaaggacagcauguucagccuggcccugaagugccugaucagccugagcaccaucauccugcugggccugaucaucgccuaccacaccagagaggugcagcuguucgugaucgacaacggcgccgacgacuggagaaucgccaugaccuacgagagaauccuguacaucagccuggagaugcuggugugcgccauccaccccauccccggcgaguacaaguucuucuggaccgccagacuggccuucagcuacacccccagcagagccgaggccgacguggacaucauccugagcauccccauguuccugagacuguaccugaucgccagagugaugcugcugcacagcaagcuguucaccgacgccagcagcagaagcaucggcgcccugaacaagaucaacuucaacaccagauucgugaugaagacccugaugaccaucugccccggcaccgugcugcugguguucagcaucagccuguggaucaucgccgccuggaccgugagagugugcgagagauaccacgaccagcaggacgugaccagcaacuuccugggcgccauguggcugaucagcaucaccuuccugagcaucggcuacggcgacauggugccccacaccuacugcggcaagggcgugugccugcugaccggcaucaugggcgccggcugcaccgcccuggugguggccgugguggccagaaagcuggagcugaccaaggccgagaagcacgugcacaacuucaugauggacacccagcugaccaagagaaucaagaacgccgccgccaacgugcugagagagaccuggcugaucuacaagcacaccaagcugcugaagaagaucgaccacgccaaggugagaaagcaccagagaaaguuccugcaggccauccaccagcugagaagcgugaagauggagcagagaaagcugagcgaccaggccaacacccugguggaccugagcaagaugcagaacgugauguacgaccugaucaccgagcugaacgacagaagcgaggaccuggagaagcagaucggcagccuggagagcaagcuggagcaccugaccgccagcuucaacagccugccccugcugaucgccgacacccugagacagcagcagcagcagcugcugagcgccaucaucgaggccagaggcgugagcguggccgugggcaccacccacacccccaucagcgacagccccaucggcgugagcagcaccagcuuccccacccccuacaccagcagcagcagcugcuaa

SEQ ID NO: 18834 - RNA, 1284 nt, Artificial Sequence
  KCNN4__Homo_sapiens__NP_002241
augggcggcgaccuggugcugggccugggcgcccugagaagaagaaagagacugcuggagcaggagaagagccuggccggcugggcccuggugcuggccggcaccggcaucggccugauggugcugcacgccgagaugcugugguucggcggcugcagcugggcccuguaccuguuccuggugaagugcaccaucagcaucagcaccuuccugcugcugugccugaucguggccuuccacgccaaggaggugcagcuguucaugaccgacaacggccugagagacuggagaguggcccugaccggcagacaggccgcccagaucgugcuggagcugguggugugcggccugcaccccgcccccgugagaggcccccccugcgugcaggaccugggcgccccccugaccagcccccagcccuggcccggcuuccugggccagggcgaggcccugcugagccuggccaugcugcugagacuguaccuggugcccagagccgugcugcugagaagcggcgugcugcugaacgccagcuacagaagcaucggcgcccugaaccaggugagauucagacacugguucguggccaagcuguacaugaacacccaccccggcagacugcugcugggccugacccugggccuguggcugaccaccgccugggugcugagcguggccgagagacaggccgugaacgccaccggccaccugagcgacacccuguggcugauccccaucaccuuccugaccaucggcuacggcgacguggugcccggcaccauguggggcaagaucgugugccugugcaccggcgugaugggcgugugcugcaccgcccugcugguggccgugguggccagaaagcuggaguucaacaaggccgagaagcacgugcacaacuucaugauggacauccaguacaccaaggagaugaaggagagcgccgccagagugcugcaggaggccuggauguucuacaagcacaccagaagaaaggagagccacgccgccagaagacaccagagaaagcugcuggccgccaucaacgccuucagacaggugagacugaagcacagaaagcugagagagcaggugaacagcaugguggacaucagcaagaugcacaugauccuguacgaccugcagcagaaccugagcagcagccacagagcccuggagaagcagaucgacacccuggccggcaagcuggacgcccugaccgagcugcugagcaccgcccugggccccagacagcugcccgagcccagccagcagagcaaguaa

SEQ ID NO: 18835 - RNA, 2031 nt, Artificial Sequence
  KCNQ1__Homo_sapiens__NP_000209
auggccgccgccagcagcccccccagagccgagagaaagagauggggcuggggcagacugcccggcgccagaagaggcagcgccggccuggccaagaagugccccuucagccuggagcuggccgagggcggccccgccggcggcgcccuguacgcccccaucgcccccggcgcccccggccccgccccccccgccagccccgccgcccccgccgccccccccguggccagcgaccugggccccagaccccccgugagccuggaccccagagugagcaucuacagcaccagaagacccgugcuggccagaacccacgugcagggcagaguguacaacuuccuggagagacccaccggcuggaagugcuucguguaccacuucgccguguuccugaucgugcuggugugccugaucuucagcgugcugagcaccaucgagcaguacgccgcccuggccaccggcacccuguucuggauggagaucgugcuggugguguucuucggcaccgaguacguggugagacuguggagcgccggcugcagaagcaaguacgugggccuguggggcagacugagauucgccagaaagcccaucagcaucaucgaccugaucguggugguggccagcaugguggugcugugcgugggcagcaagggccagguguucgccaccagcgccaucagaggcaucagauuccugcagauccugagaaugcugcacguggacagacagggcggcaccuggagacugcugggcagcgugguguucauccacagacaggagcugaucaccacccuguacaucggcuuccugggccugaucuucagcagcuacuucguguaccuggccgagaaggacgccgugaacgagagcggcagaguggaguucggcagcuacgccgacgcccugugguggggcguggugaccgugaccaccaucggcuacggcgacaaggugccccagaccugggugggcaagaccaucgccagcugcuucagcguguucgccaucagcuucuucgcccugcccgccggcauccugggcagcggcuucgcccugaaggugcagcagaagcagagacagaagcacuucaacagacagauccccgccgccgccagccugauccagaccgccuggagaugcuacgccgccgagaaccccgacagcagcaccuggaagaucuacaucagaaaggcccccagaagccacacccugcugagccccagccccaagcccaagaagagcgugguggugaagaagaagaaguucaagcuggacaaggacaacggcgugacccccggcgagaagaugcugaccgugccccacaucaccugcgacccccccgaggagagaagacuggaccacuucagcguggacggcuacgacagcagcgugagaaagagccccacccugcuggaggugagcaugccccacuucaugagaaccaacagcuucgccgaggaccuggaccuggagggcgagacccugcugacccccaucacccacaucagccagcugagagagcaccacagagccaccaucaaggugaucagaagaaugcaguacuucguggccaagaagaaguuccagcaggccagaaagcccuacgacgugagagacgugaucgagcaguacagccagggccaccugaaccugauggugagaaucaaggagcugcagagaagacuggaccagagcaucggcaagcccagccuguucaucagcgugagcgagaagagcaaggacagaggcagcaacaccaucggcgccagacugaacagaguggaggacaaggugacccagcuggaccagagacuggcccugaucaccgacaugcugcaccagcugcugagccugcacggcggcagcacccccggcagcggcggcccccccagagagggcggcgcccacaucacccagcccugcggcagcggcggcagcguggaccccgagcuguuccugcccagcaacacccugcccaccuacgagcagcugaccgugcccagaagaggccccgacgagggcagcuaa

SEQ ID NO: 18836 - RNA, 2535 nt, Artificial Sequence
  KCNQ2__Homo_sapiens__NP_004509
auggugcagaagagcagaaacggcggcguguaccccggccccagcggcgagaagaagcugaaggugggcuucgugggccuggaccccggcgcccccgacagcaccagagacggcgcccugcugaucgccggcagcgaggcccccaagagaggcagcauccugagcaagcccagagccggcggcgccggcgccggcaagccccccaagagaaacgccuucuacagaaagcugcagaacuuccuguacaacgugcuggagagacccagaggcugggccuucaucuaccacgccuacguguuccugcugguguucagcugccuggugcugagcguguucagcaccaucaaggaguacgagaagagcagcgagggcgcccuguacauccuggagaucgugaccaucgugguguucggcguggaguacuucgugagaaucugggccgccggcugcugcugcagauacagaggcuggagaggcagacugaaguucgccagaaagcccuucugcgugaucgacaucauggugcugaucgccagcaucgccgugcuggccgccggcagccagggcaacguguucgccaccagcgcccugagaagccugagauuccugcagauccugagaaugaucagaauggacagaagaggcggcaccuggaagcugcugggcagcgugguguacgcccacagcaaggagcuggugaccgccugguacaucggcuuccugugccugauccuggccagcuuccugguguaccuggccgagaagggcgagaacgaccacuucgacaccuacgccgacgcccugugguggggccugaucacccugaccaccaucggcuacggcgacaaguacccccagaccuggaacggcagacugcuggccgccaccuucacccugaucggcgugagcuucuucgcccugcccgccggcauccugggcagcggcuucgcccugaaggugcaggagcagcacagacagaagcacuucgagaagagaagaaaccccgccgccggccugauccagagcgccuggagauucuacgccaccaaccugagcagaaccgaccugcacagcaccuggcaguacuacgagagaaccgugaccgugcccauguacagacugauccccccccugaaccagcuggagcugcugagaaaccugaagagcaagagcggccuggccuucagaaaggaccccccccccgagcccagccccagccagaaggugagccugaaggacagaguguucagcagccccagaggcguggccgccaagggcaagggcagcccccaggcccagaccgugagaagaagccccagcgccgaccagagccuggaggacagccccagcaaggugcccaagagcuggagcuucggcgacagaagcagagccagacaggccuucagaaucaagggcgccgccagcagacagaacagcgaggaggccagccugcccggcgaggacaucguggacgacaagagcugccccugcgaguucgugaccgaggaccugacccccggccugaaggugagcaucagagccgugugcgugaugagauuccuggugagcaagagaaaguucaaggagagccugagacccuacgacgugauggacgugaucgagcaguacagcgccggccaccuggacaugcugagcagaaucaagagccugcagagcagaguggaccagaucgugggcagaggccccgccaucaccgacaaggacagaaccaagggccccgccgaggccgagcugcccgaggaccccagcaugaugggcagacugggcaagguggagaagcaggugcugagcauggagaagaagcuggacuuccuggugaacaucuacaugcagagaaugggcaucccccccaccgagaccgaggccuacuucggcgccaaggagcccgagcccgccccccccuaccacagccccgaggacagcagagagcacguggacagacacggcugcaucgugaagaucgugagaagcagcagcagcaccggccagaagaacuucagcgccccccccgccgccccccccgugcagugcccccccagcaccagcuggcagccccagagccaccccagacagggccacggcaccagccccgugggcgaccacggcagccuggugagaaucccccccccccccgcccacgagagaagccugagcgccuacggcggcggcaacagagccagcauggaguuccugagacaggaggacacccccggcugcagaccccccgagggcaaccugagagacagcgacaccagcaucagcauccccagcguggaccacgaggagcuggagagaagcuucagcggcuucagcaucagccagagcaaggagaaccuggacgcccugaacagcugcuacgccgccguggcccccugcgccaaggugagacccuacaucgccgagggcgagagcgacaccgacagcgaccugugcacccccugcggccccccccccagaagcgccaccggcgagggccccuucggcgacgugggcugggccggccccagaaaguaa

SEQ ID NO: 18837 - RNA, 2259 nt, Artificial Sequence
  KCNQ3__Homo_sapiens__NP_001191753
augaagcccgccgagcacgccaccauguuccugaucgugcugggcugccugauccuggccgugcugaccaccuucaaggaguacgagaccgugagcggcgacuggcugcugcugcuggagaccuucgccaucuucaucuucggcgccgaguucgcccugagaaucugggccgccggcugcugcugcagauacaagggcuggagaggcagacugaaguucgccagaaagccccugugcaugcuggacaucuucgugcugaucgccagcgugcccgugguggccgugggcaaccagggcaacgugcuggccaccagccugagaagccugagauuccugcagauccugagaaugcugagaauggacagaagaggcggcaccuggaagcugcugggcagcgccaucugcgcccacagcaaggagcugaucaccgccugguacaucggcuuccugacccugauccugagcagcuuccugguguaccugguggagaaggacgugcccgagguggacgcccagggcgaggagaugaaggaggaguucgagaccuacgccgacgcccugugguggggccugaucacccuggccaccaucggcuacggcgacaagacccccaagaccugggagggcagacugaucgccgccaccuucagccugaucggcgugagcuucuucgcccugcccgccggcauccugggcagcggccuggcccugaaggugcaggagcagcacagacagaagcacuucgagaagagaagaaagcccgccgccgagcugauccaggccgccuggagauacuacgccaccaaccccaacagaaucgaccugguggccaccuggagauucuacgagagcguggugagcuuccccuucuucagaaaggagcagcuggaggccgccagcagccagaagcugggccugcuggacagagugagacugagcaaccccagaggcagcaacaccaagggcaagcuguucaccccccugaacguggacgccaucgaggagagccccagcaaggagcccaagcccgugggccugaacaacaaggagagauucagaaccgccuucagaaugaaggccuacgccuucuggcagagcagcgaggacgccggcaccggcgaccccauggccgaggacagaggcuacggcaacgacuuccccaucgaggacaugauccccacccugaaggccgccaucagagccgugagaauccugcaguucagacuguacaagaagaaguucaaggagacccugagacccuacgacgugaaggacgugaucgagcaguacagcgccggccaccuggacaugcugagcagaaucaaguaccugcagaccagaaucgacaugaucuucacccccggcccccccagcacccccaagcacaagaagagccagaagggcagcgccuucaccuuccccagccagcagagccccagaaacgagcccuacguggccagacccagcaccagcgagaucgaggaccagagcaugaugggcaaguucgugaagguggagagacaggugcaggacaugggcaagaagcuggacuuccugguggacaugcacaugcagcacauggagagacugcaggugcaggugaccgaguacuaccccaccaagggcaccagcagccccgccgaggccgagaagaaggaggacaacagauacagcgaccugaagaccaucaucugcaacuacagcgagaccggcccccccgagccccccuacagcuuccaccaggugaccaucgacaaggugagccccuacggcuucuucgcccacgaccccgugaaccugcccagaggcggccccagcagcggcaaggugcaggccaccccccccagcagcgccaccaccuacguggagagacccaccgugcugcccauccugacccugcuggacagcagagugagcugccacagccaggccgaccugcagggccccuacagcgacagaaucagccccagacagagaagaagcaucaccagagacagcgacaccccccugagccugaugagcgugaaccacgaggagcuggagagaagccccagcggcuucagcaucagccaggacagagacgacuacguguucggccccaacggcggcagcagcuggaugagagagaagagauaccuggccgagggcgagaccgacaccgacaccgaccccuucacccccagcggcagcaugccccugagcagcaccggcgacggcaucagcgacagcguguggacccccagcaacaagcccaucuaa

SEQ ID NO: 18838 - RNA, 2772 nt, Artificial Sequence
  KCNQ5__Homo_sapiens__NP_001153602
augcccagacaccacgccggcggcgaggagggcggcgccgccggccugugggugaagagcggcgccgccgccgccgccgccggcggcggcagacugggcagcggcaugaaggacguggagagcggcagaggcagagugcugcugaacagcgccgccgccagaggcgacggccugcugcugcugggcaccagagccgccacccugggcggcggcggcggcggccugagagagagcagaagaggcaagcagggcgccagaaugagccugcugggcaagccccugagcuacaccagcagccagagcugcagaagaaacgugaaguacagaagagugcagaacuaccuguacaacgugcuggagagacccagaggcugggccuucaucuaccacgccuucguguuccugcugguguucggcugccugauccugagcguguucagcaccauccccgagcacaccaagcuggccagcagcugccugcugauccuggaguucgugaugaucgugguguucggccuggaguucaucaucagaaucuggagcgccggcugcugcugcagauacagaggcuggcagggcagacugagauucgccagaaagcccuucugcgugaucgacaccaucgugcugaucgccagcaucgccguggugagcgccaagacccagggcaacaucuucgccaccagcgcccugagaagccugagauuccugcagauccugagaauggugagaauggacagaagaggcggcaccuggaagcugcugggcagcgugguguacgcccacagcaaggagcugaucaccgccugguacaucggcuuccuggugcugaucuucagcagcuuccugguguaccugguggagaaggacgccaacaaggaguucagcaccuacgccgacgcccugugguggggcaccaucacccugaccaccaucggcuacggcgacaagaccccccugaccuggcugggcagacugcugagcgccggcuucgcccugcugggcaucagcuucuucgcccugcccgccggcauccugggcagcggcuucgcccugaaggugcaggagcagcacagacagaagcacuucgagaagagaagaaaccccgccgccaaccugauccagugcguguggagaagcuacgccgccgacgagaagagcgugagcaucgccaccuggaagccccaccugaaggcccugcacaccugcagccccaccaaccagaagcugagcuucaaggagagagugagaauggccagccccagaggccagagcaucaagagcagacaggccagcgugggcgacagaagaagccccagcaccgacaucaccgccgagggcagccccaccaaggugcagaagagcuggagcuucaacgacagaaccagauucagacccagccugagacugaagagcagccagcccaagcccgugaucgacgccgacaccgcccugggcaccgacgacguguacgacgagaagggcugccagugcgacgugagcguggaggaccugacccccccccugaagaccgugaucagagccaucagaaucaugaaguuccacguggccaagagaaaguucaaggagacccugagacccuacgacgugaaggacgugaucgagcaguacagcgccggccaccuggacaugcugugcagaaucaagagccugcagaccagaguggaccagauccugggcaagggccagaucaccagcgacaagaagagcagagagaagaucaccgccgagcacgagaccaccgacgaccugagcaugcugggcagaguggugaagguggagaagcaggugcagagcaucgagagcaagcuggacugccugcuggacaucuaccagcaggugcugagaaagggcagcgccagcgcccuggcccuggccagcuuccagaucccccccuucgagugcgagcagaccagcgacuaccagagccccguggacagcaaggaccugagcggcagcgcccagaacagcggcugccugagcagaagcaccagcgccaacaucagcagaggccugcaguucauccugacccccaacgaguucagcgcccagaccuucuacgcccugagccccaccaugcacagccaggccacccaggugcccaucagccagagcgacggcagcgccguggccgccaccaacaccaucgccaaccagaucaacaccgcccccaagcccgccgcccccaccacccugcagaucccccccccccugcccgccaucaagcaccugcccagacccgagacccugcaccccaaccccgccggccugcaggagagcaucagcgacgugaccaccugccugguggccagcaaggagaacgugcagguggcccagagcaaccugaccaaggacagaagcaugagaaagagcuucgacaugggcggcgagacccugcugagcgugugccccauggugcccaaggaccugggcaagagccugagcgugcagaaccugaucagaagcaccgaggagcugaacauccagcugagcggcagcgagagcagcggcagcagaggcagccaggacuucuaccccaaguggagagagagcaagcuguucaucaccgacgaggaggugggccccgaggagaccgagaccgacaccuucgacgccgccccccagcccgccagagaggccgccuucgccagcgacagccugagaaccggcagaagcagaagcagccagagcaucugcaaggccggcgagagcaccgacgcccugagccugccccacgugaagcugaaguaa

SEQ ID NO: 18839 - RNA, 819 nt, Artificial Sequence
  KCNRG__Homo_sapiens__NP_775876
augagcagccaggagcuggugacccugaacgugggcggcaagaucuucaccaccagauucagcaccaucaagcaguuccccgccagcagacuggccagaaugcuggacggcagagaccaggaguucaagauggugggcggccagaucuucguggacagagacggcgaccuguucagcuucauccuggacuuccugagaacccaccagcugcugcugcccaccgaguucagcgacuaccugagacugcagagagaggcccuguucuacgagcugagaagccugguggaccugcugaaccccuaccugcugcagcccagacccgcccugguggaggugcacuuccugagcagaaacacccaggccuucuucagaguguucggcagcugcagcaagaccaucgagaugcugaccggcagaaucaccguguucaccgagcagcccagcgcccccaccuggaacggcaacuucuuccccccccagaugacccugcugccccugcccccccagagacccagcuaccacgaccugguguuccagugcggcagcgacagcaccaccgacaaccagaccggcgugagauacgugagcaucaagcccgacaacagaaagcuggccaacggcaccaacgugcugggccugcugaucgacacccugcugaaggagggcuuccaccuggugagcaccagaaccgugagcagcgaggacaagaccgagugcuacagcuucgagagaaucaagagccccgaggugcugaucaccaacgagacccccaagcccgagaccaucaucauccccgagcagagccagaucaagaaguaa

SEQ ID NO: 18840 - RNA, 1581 nt, Artificial Sequence
  KCNS1__Homo_sapiens__XP_005260466
augcugaugcugcuggugagaggcacccacuacgagaaccugagaagcaagguggugcugcccaccccccugggcggcagaagcaccgagaccuucgugagcgaguuccccggccccgacaccggcaucagauggagaagaagcgacgaggcccugagagugaacgugggcggcgugagaagacagcugagcgccagagcccuggccagauuccccggcaccagacugggcagacugcaggccgccgccagcgaggagcaggccagaagacugugcgacgacuacgacgaggccgccagagaguucuacuucgacagacaccccggcuucuuccugagccugcugcacuucuacagaaccggccaccugcacgugcuggacgagcugugcguguucgccuucggccaggaggccgacuacuggggccugggcgagaacgcccuggccgccugcugcagagccagauaccuggagagaagacugacccagccccacgccugggacgaggacagcgacacccccagcagcguggaccccugccccgacgagaucagcgacgugcagagagagcuggccagauacggcgccgccagaugcggcagacugagaagaagacuguggcugaccauggagaaccccggcuacagccugcccagcaagcuguucagcugcgugagcaucagcguggugcuggccagcaucgccgccaugugcauccacagccugcccgaguaccaggccagagaggccgccgccgccguggccgccguggccgccggcagaagccccgagggcgugagagacgaccccgugcugagaagacuggaguacuucugcaucgccugguucagcuucgaggugagcagcagacugcugcuggcccccagcaccagaaacuucuucugccacccccugaaccugaucgacaucgugagcgugcugcccuucuaccugacccugcuggccggcguggcccugggcgaccagggcggcaaggaguucggccaccugggcaagguggugcagguguucagacugaugagaaucuucagagugcugaagcuggccagacacagcaccggccugagaagccugggcgccacccugaagcacagcuacagagaggugggcauccugcugcuguaccuggccgugggcgugagcguguucagcggcguggccuacaccgccgagaaggaggaggacgugggcuucaacaccauccccgccugcuggugguggggcaccgugagcaugaccaccgugggcuacggcgacguggugcccgugaccguggccggcaagcuggccgccagcggcugcauccugggcggcauccuggugguggcccugcccaucaccaucaucuucaacaaguucagccacuucuacagaagacagaaggcccuggaggccgccgugagaaacagcaaccaccaggaguucgaggaccugcugagcagcaucgacggcgugagcgaggccagccuggagaccagcagagagaccagccaggagggccagagcgccgaccuggagagccaggcccccagcgagcccccccacccccagauguacuaa

SEQ ID NO: 18841 - RNA, 1476 nt, Artificial Sequence
  KCNS3__Homo_sapiens__XP_011531127
augguguucggcgaguucuuccacagacccggccaggacgaggagcuggugaaccugaacgugggcggcuucaagcagagcguggaccagagcacccugcugagauucccccacaccagacugggcaagcugcugaccugccacagcgaggaggccauccuggagcugugcgacgacuacagcguggccgacaaggaguacuacuucgacagaaaccccagccuguucagauacgugcugaacuucuacuacaccggcaagcugcacgugauggaggagcugugcguguucagcuucugccaggagaucgaguacuggggcaucaacgagcuguucaucgacagcugcugcagcaacagauaccaggagagaaaggaggagaaccacgagaaggacugggaccagaagagccacgacgugagcaccgacagcagcuucgaggagagcagccuguucgagaaggagcuggagaaguucgacacccugagauucggccagcugagaaagaagaucuggaucagaauggagaaccccgccuacugccugagcgccaagcugaucgccaucagcagccugagcguggugcuggccagcaucguggccaugugcgugcacagcaugagcgaguuccagaacgaggacggcgagguggacgaccccgugcuggagggcguggagaucgccugcaucgccugguucaccggcgagcuggccgugagacuggccgccgcccccugccagaagaaguucuggaagaacccccugaacaucaucgacuucgugagcaucauccccuucuacgccacccuggccguggacaccaaggaggaggagagcgaggacaucgagaacaugggcaagguggugcagauccugagacugaugagaaucuucagaauccugaagcuggccagacacagcgugggccugagaagccugggcgccacccugagacacagcuaccacgaggugggccugcugcugcuguuccugagcgugggcaucagcaucuucagcgugcugaucuacagcguggagaaggacgaccacaccagcagccugaccagcauccccaucugcugguggugggccaccaucagcaugaccaccgugggcuacggcgacacccaccccgugacccuggccggcaagcugaucgccagcaccugcaucaucugcggcauccuggugguggcccugcccaucaccaucaucuucaacaaguucagcaaguacuaccagaagcagaaggacaucgacguggaccagugcagcgaggacgcccccgagaagugccacgagcugcccuacuucaacaucagagacaucuacgcccagagaaugcacaccuucaucaccagccugagcagcgugggcaucguggugagcgaccccgacagcaccgacgccagcagcaucgaggacaacgaggacaucugcaacaccaccagccuggagaacugcaccgccaaguaa

SEQ ID NO: 18842 - RNA, 3708 nt, Artificial Sequence
  KCNT1__Homo_sapiens__NP_065873
augccccugcccgacggcgccagaacccccggcggcgugugcagagaggccagaggcggcggcuacaccaacagaaccuucgaguucgacgacggccagugcgcccccagaagacccugcgccggcgacggcgcccugcuggacaccgccggcuucaagaugagcgaccuggacagcgaggugcugccccugccccccagauacagauucagagaccugcugcugggcgaccccagcuuccagaacgacgacagagugcagguggaguucuacgugaacgagaacaccuucaaggagagacugaagcuguucuucaucaagaaccagagaagcagccugagaaucagacuguucaacuucagccugaagcugcugaccugccugcuguacaucgugagagugcugcuggacgaccccgcccugggcaucggcugcuggggcugccccaagcagaacuacagcuucaacgacagcagcagcgagaucaacugggcccccauccuguggguggagagaaagaugacccugugggccauccaggugaucguggccaucaucagcuuccuggagaccaugcugcugaucuaccugagcuacaagggcaacaucugggagcagaucuucagagugagcuucgugcuggagaugaucaacacccugcccuucaucaucaccaucuucuggcccccccugagaaaccuguucauccccguguuccugaacugcuggcuggccaagcacgcccuggagaacaugaucaacgacuuccacagagccauccugagaacccagagcgccauguucaaccaggugcugauccuguucugcacccugcugugccugguguucaccggcaccugcggcauccagcaccuggagagagccggcgagaaccugagccugcugaccagcuucuacuucugcaucgugaccuucagcaccgugggcuacggcgacgugacccccaagaucuggcccagccagcugcugguggugaucaugaucugcguggcccugguggugcugccccugcaguucgaggagcugguguaccuguggauggagagacagaagagcggcggcaacuacagcagacacagagcccagaccgagaagcacguggugcugugcgugagcagccugaagaucgaccugcugauggacuuccugaacgaguucuacgcccaccccagacugcaggacuacuacguggugauccugugccccaccgagauggacgugcaggugagaagagugcugcagaucccccuguggagccagagagugaucuaccugcagggcagcgcccugaaggaccaggaccugaugagagccaagauggacaacggcgaggccugcuucauccugagcagcagaaacgagguggacagaaccgccgccgaccaccagaccauccugagagccugggccgugaaggacuucgcccccaacugcccccuguacgugcagauccugaagcccgagaacaaguuccacgugaaguucgccgaccacguggugugcgaggaggagugcaaguacgccaugcuggcccugaacugcaucugccccgccaccagcacccugaucacccugcuggugcacaccagcagaggccaggagggccaggagagccccgagcaguggcagagaauguacggcagaugcagcggcaacgagguguaccacaucagaaugggcgacagcaaguucuucagagaguacgagggcaagagcuucaccuacgccgccuuccacgcccacaagaaguacggcgugugccugaucggccugaagagagaggacaacaagagcauccugcugaaccccggccccagacacauccuggccgccagcgacaccugcuucuacaucaacaucaccaaggaggagaacagcgccuucaucuucaagcaggaggagaagagaaagaagagagccuucagcggccagggccugcacgagggccccgccagacugcccgugcacagcaucaucgccagcaugggcaccguggccauggaccugcagggcaccgagcacagacccacccagagcggcggcggcggcggcggcagcaagcuggcccugcccaccgagaacggcagcggcagcagaagacccagcaucgcccccgugcuggagcuggccgacagcagcgcccugcugcccugcgaccugcugagcgaccagagcgaggacgaggugacccccagcgacgacgagggccugagcgugguggaguacgugaagggcuacccccccaacagccccuacaucggcagcagccccacccugugccaccugcugcccgugaaggcccccuucugcugccugagacuggacaagggcugcaagcacaacagcuacgaggacgccaaggccuacggcuucaagaacaagcugaucaucgugagcgccgagaccgccggcaacggccuguacaacuucaucgugccccugagagccuacuacagaagcagaaaggagcugaaccccaucgugcugcugcuggacaacaagcccgaccaccacuuccuggaggccaucugcugcuuccccaugguguacuacauggagggcagcguggacaaccuggacagccugcugcagugcggcaucaucuacgccgacaaccugguggugguggacaaggagagcaccaugagcgccgaggaggacuacauggccgacgccaagaccaucgugaacgugcagaccauguucagacuguuccccagccugagcaucaccaccgagcugacccaccccagcaacaugagauucaugcaguucagagccaaggacagcuacagccuggcccugagcaagcuggagaagagagagagagagaacggcagcaaccuggccuucauguucagacugcccuucgccgccggcagaguguucagcaucagcaugcuggacacccugcuguaccagagcuucgugaaggacuacaugaucaccaucaccagacugcugcugggccuggacaccacccccggcagcggcuaccugugcgccaugaagaucaccgagggcgaccuguggaucagaaccuacggcagacuguuccagaagcugugcagcagcagcgccgagauccccaucggcaucuacagaaccgagagccacguguucagcaccagcgagccccacgaccugagagcccagagccagaucagcgugaacguggaggacugcgaggacaccagagaggugaagggccccuggggcagcagagccggcaccggcggcagcagccagggcagacacaccggcggcggcgaccccgccgagcacccccugcugagaagaaagagccugcagugggccagaagacugagcagaaaggcccccaagcaggccggcagagccgccgccgccgaguggaucagccagcagagacugagccuguacagaagaagcgagagacaggagcugagcgagcuggugaagaacagaaugaagcaccugggccugcccaccaccggcuacgacgagaugaacgaccaccagaacacccugagcuacgugcugaucaaccccccccccgacaccagacuggagcccagcgacaucguguaccugaucagaagcgacccccuggcccacguggccagcagcagccagagcagaaagagcagcugcagccacaagcugagcagcugcaaccccgagaccagagacgagacccagcuguaa

SEQ ID NO: 18843 - RNA, 3336 nt, Artificial Sequence
  KCNT2__Homo_sapiens__NP_001274748
augguggaccuggagagcgaggugcccccccugccccccagauacagauucagagaccugcugcugggcgaccagggcuggcagaacgacgacagagugcagguggaguucuacaugaacgagaacaccuucaaggagagacugaagcuguucuucaucaagaaccagagaagcagccugagaaucagacuguucaacuucagccugaagcugcugagcugccugcuguacaucaucagagugcugcuggagaaccccagccagggcaacgaguggagccacaucuucugggugaacagaagccugccccuguggggccugcaggugagcguggcccugaucagccuguucgagaccauccugcugggcuaccugagcuacaagggcaacaucugggagcagauccugagaauccccuucauccuggagaucaucaacgccgugcccuucaucaucagcaucuucuggcccagccugagaaaccuguucgugcccguguuccugaacugcuggcuggccaagcacgcccuggagaacaugaucaacgaccugcacagagccauccagagaacccagagcgccauguucaaccaggugcugauccugaucagcacccugcugugccugaucuucaccugcaucugcggcauccagcaccuggagagaaucggcaagaagcugaaccuguucgacagccuguacuucugcaucgugaccuucagcaccgugggcuucggcgacgugacccccgagaccuggagcagcaagcuguucgugguggccaugaucugcguggcccugguggugcugcccauccaguucgagcagcuggccuaccuguggauggagagacagaagagcggcggcaacuacagcagacacagagcccagaccgagaagcacguggugcugugcgugagcagccugaagaucgaccugcugauggacuuccugaacgaguucuacgcccaccccagacugcaggacuacuacguggugauccugugccccaccgagauggacgugcaggugagaagagugcugcagauccccauguggagccagagagugaucuaccugcagggcagcgcccugaaggaccaggaccugcugagagccaagauggacgacgccgaggccugcuucauccugagcagcagaugcgagguggacagaaccagcagcgaccaccagaccauccugagagccugggccgugaaggacuucgcccccaacugcccccuguacgugcagauccugaagcccgagaacaaguuccacaucaaguucgccgaccacguggugugcgaggaggaguucaaguacgccaugcuggcccugaacugcaucugccccgccaccagcacccugaucacccugcuggugcacaccagcagaggccaggagggccagcagagccccgagcaguggcagaagauguacggcagaugcagcggcaacgagguguaccacaucgugcuggaggagagcaccuucuucgccgaguacgagggcaagagcuucaccuacgccagcuuccacgcccacaagaaguucggcgugugccugaucggcgugagaagagaggacaacaagaacauccugcugaaccccggccccagauacaucaugaacagcaccgacaucugcuucuacaucaacaucaccaaggaggagaacagcgccuucaagaaccaggaccagcagagaaagagcaacgugagcagaagcuucuaccacggccccagcagacugcccgugcacagcaucaucgccagcaugggcaccguggccaucgaccugcaggacaccagcugcagaagcgccagcggccccacccugagccugcccaccgagggcagcaaggagaucagaagacccagcaucgcccccgugcuggagguggccgacaccagcagcauccagaccugcgaccugcugagcgaccagagcgaggacgagaccacccccgacgaggagaugagcagcaaccuggaguacgccaagggcuacccccccuacagccccuacaucggcagcagccccaccuucugccaccugcugcacgagaaggugcccuucugcugccugagacuggacaagagcugccagcacaacuacuacgaggacgccaaggccuacggcuucaagaacaagcugaucaucguggccgccgagaccgccggcaacggccuguacaacuucaucgugccccugagagccuacuacagacccaagaaggagcugaaccccaucgugcugcugcuggacaacccccuggacgaccugcugagaugcggcgugaccuucgccgccaacaugguggugguggacaaggagagcaccaugagcgccgaggaggacuacauggccgacgccaagaccaucgugaacgugcagacccuguucagacuguucagcagccugagcaucaucaccgagcugacccaccccgccaacaugagauucaugcaguucagagccaaggacugcuacagccuggcccugagcaagcuggagaagaaggagagagagagaggcagcaaccuggccuucauguucagacugcccuucgccgccggcagaguguucagcaucagcaugcuggacacccugcuguaccagagcuucgugaaggacuacaugaucagcaucaccagacugcugcugggccuggacaccacccccggcagcggcuuccugugcagcaugaagaucaccgccgacgaccuguggaucagaaccuacgccagacuguaccagaagcugugcagcagcaccggcgacgugcccaucggcaucuacagaaccgagagccagaagcugaccaccagcgagagccagaucagcaucagcguggaggagugggaggacaccaaggacagcaaggagcagggccaccacagaagcaaccacagaaacagcaccagcagcgaccagagcgaccacccccugcugagaagaaagagcaugcagugggccagaagacugagcagaaagggccccaagcacagcggcaagaccgccgagaagaucacccagcagagacugaaccuguacagaagaagcgagagacaggagcuggccgagcuggugaagaacagaaugaagcaccugggccugagcaccgugggcuacgacgagaugaacgaccaccagagcacccugagcuacauccugaucaaccccagccccgacaccagaaucgagcugaacgacgugguguaccugaucagacccgacccccuggccuaccugcccaacagcgagcccagcagaagaaacagcaucugcaacgugaccggccaggacagcagagaggagacccagcuguaa

SEQ ID NO: 18844 - RNA, 3450 nt, Artificial Sequence
  KCNU1__Homo_sapiens__NP_001027006
auguuccagaccaagcugagaaacgagaccugggaggaccugcccaagaugagcugcaccaccgagauccaggccgccuucauccugagcagcuucgugaccuucuucagcggccugaucauccugcugaucuucagacugaucuggagaagcgugaagaaguggcagaucaucaagggcaccggcaucauccuggagcuguucaccagcggcaccaucgccagaagccacgugagaagccugcacuuccagggccaguucagagaccacaucgagaugcugcugagcgcccagaccuucgugggccaggugcuggugauccugguguucgugcugagcaucggcagccugaucaucuacuucaucaacagcgccgaccccgugggcagcugcagcagcuacgaggacaagaccauccccaucgaccugguguucaacgccuucuucagcuucuacuucggccugagauucauggccgccgacgacaagaucaaguucuggcuggagaugaacagcaucguggacaucuucaccaucccccccaccuucaucagcuacuaccugaagagcaacuggcugggccugagauuccugagagcccugagacugcuggagcugccccagauccugcagauccugagagccaucaagaccagcaacagcgugaaguucagcaagcugcugagcaucauccugagcaccugguucaccgccgccggcuucauccaccugguggagaacagcggcgaccccuggcugaagggcagaaacagccagaacaucagcuacuucgagagcaucuaccuggugauggccaccaccagcaccgugggcuucggcgacgugguggccaagaccagccugggcagaaccuucaucauguucuucacccugggcagccugauccuguucgccaacuacauccccgagaugguggagcuguucgccaacaagagaaaguacaccagcagcuacgaggcccugaagggcaagaaguucaucguggugugcggcaacaucaccguggacagcgugaccgccuuccugagaaacuuccugagagacaagagcggcgagaucaacaccgagaucguguuccugggcgagaccccccccagccuggagcuggagaccaucuucaagugcuaccuggccuacaccaccuucaucagcggcagcgccaugaagugggaggaccugagaagaguggccguggagagcgccgaggccugccugaucaucgccaacccccugugcagcgacagccacgccgaggacaucagcaacaucaugagagugcugagcaucaagaacuacgacagcaccaccagaaucaucauccagauccugcagagccacaacaagguguaccugcccaagauccccagcuggaacugggacaccggcgacaacaucaucugcuucgccgagcugaagcugggcuucaucgcccagggcugccuggugcccggccugugcaccuuccugaccagccuguucguggagcagaacaagaaggugaugcccaagcagaccuggaagaagcacuuccugaacagcaugaagaacaagauccugacccagagacugagcgacgacuucgccggcaugagcuuccccgagguggccagacugugcuuccugaagaugcaccugcugcugaucgccaucgaguacaagagccuguucaccgacggcuucugcggccugauccugaacccccccccccaggugagaaucagaaagaacacccugggcuucuucaucgccgagacccccaaggacgugagaagagcccuguucuacugcagcgugugccacgacgacguguucauccccgagcugaucaccaacugcggcugcaagagcagaagcagacagcacaucaccgugcccagcgugaagagaaugaagaagugccugaagggcaucagcagcagaaucagcggccaggacagcccccccagagugagcgccagcaccagcagcaucagcaacuucaccaccagaacccugcagcacgacguggagcaggacagcgaccagcuggacagcagcggcauguuccacuggugcaagcccaccagccuggacaaggugacccugaagagaaccggcaagagcaaguacaaguucagaaaccacaucguggccugcguguucggcgacgcccacagcgcccccaugggccugagaaacuucgugaugccccugagagccagcaacuacaccagaaaggagcugaaggacaucguguucaucggcagccuggacuaccugcagagagaguggagauuccuguggaacuucccccagaucuacauccugcccggcugcgcccuguacagcggcgaccugcacgccgccaacaucgagcagugcagcaugugcgccgugcugagcccccccccccagcccagcagcaaccagacccugguggacaccgaggccaucauggccacccugaccaucggcagccugcagaucgacagcagcagcgaccccagccccagcgugagcgaggagacccccggcuacaccaacggccacaacgagaagagcaacugcagaaaggugcccauccugaccgagcugaagaaccccagcaacauccacuucaucgagcagcugggcggccuggagggcagccugcaggagaccaaccugcaccugagcaccgccuucagcaccggcaccguguucagcggcagcuuccuggacagccugcuggccaccgccuucuacaacuaccacgugcuggagcugcugcagaugcuggugaccggcggcgugagcagccagcuggagcagcaccuggacaaggacaagguguacggcguggccgacagcugcaccagccugcugagcggcagaaacagaugcaagcugggccugcugagccugcacgagaccauccugagcgacgugaaccccagaaacaccuucggccagcuguucugcggcagccuggaccuguucggcauccugugcgugggccuguacagaaucaucgacgaggaggagcugaaccccgagaacaagagauucgugaucaccagacccgccaacgaguucaagcugcugcccagcgaccugguguucugcgccauccccuucagcaccgccugcuacaagagaaacgaggaguucagccugcagaagagcuacgagaucgugaacaaggccagccagaccaccgagacccacagcgacaccaacugcccccccaccaucgacagcgugaccgagacccuguacagccccguguacagcuaccagcccagaaccaacagccugagcuuccccaagcagaucgccuggaaccagagcagaaccaacagcaucaucagcagccagaucccccugggcgacaacgccaaggagaacgagagaaagaccagcgacgagguguacgacgaggaccccuucgccuacagcgagccccuguaa

SEQ ID NO: 18845 - RNA, 1503 nt, Artificial Sequence
  KCNV1__Homo_sapiens__NP_055194
augcccagcagcggcagagcccugcuggacagcccccuggacagcggcagccugaccagccuggacagcagcguguucugcagcgagggcgagggcgagccccuggcccugggcgacugcuucaccgugaacgugggcggcagcagauucgugcugagccagcaggcccugagcugcuucccccacaccagacugggcaagcuggccguggugguggccagcuacagaagacccggcgcccuggccgccgugcccagcccccuggagcugugcgacgacgccaaccccguggacaacgaguacuucuucgacagaagcagccaggccuucagauacgugcugcacuacuacagaaccggcagacugcacgugauggagcagcugugcgcccugagcuuccugcaggagauccaguacuggggcaucgacgagcugagcaucgacagcugcugcagagacagauacuucagaagaaaggagcugagcgagacccuggacuucaagaaggacaccgaggaccaggagagccagcacgagagcgagcaggacuucagccagggccccugccccaccgugagacagaagcuguggaacauccuggagaagcccggcagcagcaccgccgccagaaucuucggcgugaucagcaucaucuucgugguggugagcaucaucaacauggcccugaugagcgccgagcugagcuggcuggaccugcagcugcuggagauccuggaguacgugugcaucagcugguucaccggcgaguucgugcugagauuccugugcgugagagacagaugcagauuccugagaaaggugcccaacaucaucgaccugcuggccauccugcccuucuacaucacccugcugguggagagccugagcggcagccagaccacccaggagcuggagaacgugggcagaaucgugcaggugcugagacugcugagagcccugagaaugcugaagcugggcagacacagcaccggccugagaagccugggcaugaccaucacccagugcuacgaggaggugggccugcugcugcuguuccugagcgugggcaucagcaucuucagcaccguggaguacuucgccgagcagagcauccccgacaccaccuucaccagcgugcccugcgccugguggugggccaccaccagcaugaccaccgugggcuacggcgacaucagacccgacaccaccaccggcaagaucguggccuucaugugcauccugagcggcauccuggugcuggcccugcccaucgccaucaucaacgacagauucagcgccugcuacuucacccugaagcugaaggaggccgccgugagacagagagaggcccugaagaagcugaccaagaacaucgccaccgacagcuacaucagcgugaaccugagagacguguacgccagaagcaucauggagaugcugagacugaagggcagagagagagccagcaccagaagcagcggcggcgacgacuucugguucuaa

SEQ ID NO: 18846 - RNA, 1638 nt, Artificial Sequence
  KCNV2__Homo_sapiens__NP_598004
augcugaagcagagcgagagaagaagaagcuggagcuacagacccuggaacaccaccgagaacgagggcagccagcacagaagaagcaucugcagccugggcgccagaagcggcagccaggccagcauccacggcuggaccgagggcaacuacaacuacuacaucgaggaggacgaggacggcgaggaggaggaccaguggaaggacgaccuggccgaggaggaccagcaggccggcgaggugaccaccgccaagcccgagggccccagcgacccccccgcccugcugagcacccugaacgugaacgugggcggccacagcuaccagcuggacuacugcgagcuggccggcuuccccaagaccagacugggcagacuggccaccagcaccagcagaagcagacagcugagccugugcgacgacuacgaggagcagaccgacgaguacuucuucgacagagaccccgccguguuccagcugguguacaacuucuaccugagcggcgugcugcuggugcuggacggccugugccccagaagauuccuggaggagcugggcuacuggggcgugagacugaaguacacccccagaugcugcagaaucugcuucgaggagagaagagacgagcugagcgagagacugaagauccagcacgagcugagagcccaggcccagguggaggaggccgaggagcuguucagagacaugagauucuacggcccccagagaagaagacuguggaaccugauggagaagcccuucagcagcguggccgccaaggccaucggcguggccagcagcaccuucgugcuggugagcgugguggcccuggcccugaacaccguggaggagaugcagcagcacagcggccagggcgagggcggccccgaccugagacccauccuggagcacguggagaugcugugcaugggcuucuucacccuggaguaccugcugagacuggccagcacccccgaccugagaagauucgccagaagcgcccugaaccugguggaccugguggccauccugccccuguaccugcagcugcugcuggagugcuucaccggcgagggccaccagagaggccagaccgugggcagcgugggcaaggugggccaggugcugagagugaugagacugaugagaaucuucagaauccugaagcuggccagacacagcaccggccugagagccuucggcuucacccugagacagugcuaccagcaggugggcugccugcugcuguucaucgccaugggcaucuucaccuucagcgccgccguguacagcguggagcacgacgugcccagcaccaacuucaccaccaucccccacagcugguggugggccgccgugagcaucagcaccgugggcuacggcgacauguaccccgagacccaccugggcagauucuucgccuuccugugcaucgccuucggcaucauccugaacggcaugcccaucagcauccuguacaacaaguucagcgacuacuacagcaagcugaaggccuacgaguacaccaccaucagaagagagagaggcgaggugaacuucaugcagagagccagaaagaagaucgccgagugccugcugggcagcaacccccagcugacccccagacaggagaacuaa

SEQ ID NO: 18847 - RNA, 942 nt, Artificial Sequence
  KCTD10__Homo_sapiens__NP_114160
auggaggagaugagcggcgagagcguggugagcagcgccgugcccgccgccgccaccagaaccaccagcuucaagggcaccagccccagcagcaaguacgugaagcugaacgugggcggcgcccuguacuacaccaccaugcagacccugaccaagcaggacaccaugcugaaggccauguucagcggcagaauggaggugcugaccgacagcgagggcuggauccugaucgacagaugcggcaagcacuucggcaccauccugaacuaccugagagacggcgccgugccccugcccgagagcagaagagagaucgaggagcugcuggccgaggccaaguacuaccuggugcagggccugguggaggagugccaggccgcccugcagaacaaggacaccuacgagcccuucugcaaggugcccgugaucaccagcagcaaggaggagcagaagcugaucgccaccagcaacaagcccgccgugaagcugcuguacaacagaagcaacaacaaguacagcuacaccagcaacagcgacgacaacaugcugaagaacaucgagcuguucgacaagcugagccugagauucaacggcagagugcuguucaucaaggacgugaucggcgacgagaucugcugcuggagcuucuacggccagggcagaaagaucgccgaggugugcugcaccagcaucguguacgccaccgagaagaagcagaccaagguggaguuccccgaggccagaaucuacgaggagacccugaacauccugcuguacgaggcccaggacggcagaggccccgacaacgcccugcuggaggccaccggcggcgccgccggcagaagccaccaccuggacgaggacgaggagagagagagaaucgagagagugagaagaauccacaucaagagacccgacgacagagcccaccugcaccaguaa

SEQ ID NO: 18848 - RNA, 699 nt, Artificial Sequence
  KCTD11__Homo_sapiens__NP_001002914
augcugggcgccauguucagagccggcacccccaugccccccaaccugaacagccagggcggcggccacuacuucaucgacagagacggcaaggccuucagacacauccugaacuuccugagacugggcagacuggaccugcccagaggcuacggcgagaccgcccugcugagagccgaggccgacuucuaccagaucagaccccugcuggacgcccugagagagcuggaggccagccagggcacccccgcccccaccgccgcccugcugcacgccgacguggacgugagccccagacuggugcacuucagcgccagaagaggcccccaccacuacgagcugagcagcgugcagguggacaccuucagagccaaccuguucugcaccgacagcgagugccugggcgcccugagagccagauucggcguggccagcggcgacagagccgagggcagcccccacuuccaccuggagugggcccccagacccguggagcugcccgagguggaguacggcagacugggccugcagccccuguggaccggcggccccggcgagagaagagagguggugggcacccccagcuuccuggaggaggugcugagaguggcccuggagcacggcuucagacuggacagcguguuccccgaccccgaggaccugcugaacagcagaagccugagauucgugagacacuaa

SEQ ID NO: 18849 - RNA, 978 nt, Artificial Sequence
  KCTD12__Homo_sapiens__NP_612453
auggcccuggccgacagcaccagaggccugcccaacggcggcggcggcggcggcggcagcggcagcagcagcagcagcgccgagcccccccuguuccccgacaucguggagcugaacgugggcggccagguguacgugaccagaagaugcaccguggugagcgugcccgacagccugcuguggagaauguucacccagcagcagccccaggagcuggccagagacagcaagggcagauucuuccuggacagagacggcuuccuguucagauacauccuggacuaccugagagaccugcagcuggugcugcccgacuacuuccccgagagaagcagacugcagagagaggccgaguacuucgagcugcccgagcuggugagaagacugggcgccccccagcagcccggccccggccccccccccagcagaagaggcgugcacaaggagggcagccugggcgacgagcugcugccccugggcuacagcgagcccgagcagcaggagggcgccagcgccggcgcccccagccccacccuggagcuggccagcagaagccccagcggcggcgccgccggcccccugcugacccccagccagagccuggacggcagcagaagaagcggcuacaucaccaucggcuacagaggcagcuacaccaucggcagagacgcccaggccgacgccaaguucagaagaguggccagaaucaccgugugcggcaagaccagccuggccaaggagguguucggcgacacccugaacgagagcagagaccccgacagaccccccgagagauacaccagcagauacuaccugaaguucaacuuccuggagcaggccuucgacaagcugagcgagagcggcuuccacaugguggccugcagcagcaccggcaccugcgccuucgccagcagcaccgaccagagcgaggacaagaucuggaccagcuacaccgaguacguguucugcagagaguaa

SEQ ID NO: 18850 - RNA, 990 nt, Artificial Sequence
  KCTD13__Homo_sapiens__NP_849194
augagcgccgaggccagcggccccgccgccgccgccgcccccagccuggaggcccccaagcccagcggccuggagcccggccccgccgccuacggccugaagccccugacccccaacagcaaguacgugaagcugaacgugggcggcagccugcacuacaccacccugagaacccugaccggccaggacaccaugcugaaggccauguucagcggcagaguggaggugcugaccgacgccggcggcugggugcugaucgacagaagcggcagacacuucggcaccauccugaacuaccugagagacggcagcgugccccugcccgagagcaccagagagcugggcgagcugcugggcgaggccagauacuaccuggugcagggccugaucgaggacugccagcuggcccugcagcagaagagagagacccugagcccccugugccugauccccauggugaccagccccagagaggagcagcagcugcuggccagcaccagcaagcccguggugaagcugcugcacaacagaagcaacaacaaguacagcuacaccagcaccagcgacgacaaccugcugaagaacaucgagcuguucgacaagcuggcccugagauuccacggcagacugcuguuccugaaggacgugcugggcgacgagaucugcugcuggagcuucuacggccagggcagaaagaucgccgaggugugcugcaccagcaucguguacgccaccgagaagaagcagaccaagguggaguuccccgaggccagaaucuucgaggagacccugaacauccugaucuacgagacccccagaggccccgaccccgcccugcuggaggccaccggcggcgccgccggcgccggcggcgccggcagaggcgaggacgaggagaacagagagcacagagugagaagaauccacgugagaagacacaucacccacgacgagagaccccacggccagcagaucguguucaaggacuaa

SEQ ID NO: 18851 - RNA, 705 nt, Artificial Sequence
  KCTD15__Homo_sapiens__NP_076981
augccccacagaaaggagagacccagcggcagcagccugcacacccacggcagcaccggcaccgccgagggcggcaacaugagcagacugagccugaccagaagccccgugagcccccuggccgcccagggcaucccccugcccgcccagcugaccaagagcaacgcccccgugcacaucgacgugggcggccacauguacaccagcagccuggccacccugaccaaguaccccgacagcagaaucagcagacuguucaacggcaccgagcccaucgugcuggacagccugaagcagcacuacuucaucgacagagacggcgagaucuucagauacgugcugagcuuccugagaaccagcaagcugcugcugcccgacgacuucaaggacuucagccugcuguacgaggaggccagauacuaccagcugcagcccauggugagagagcuggagagauggcagcaggagcaggagcagagaagaagaagcagagccugcgacugccugguggugagagugacccccgaccugggcgagagaaucgcccugagcggcgagaaggcccugaucgaggagguguuccccgagaccggcgacgugaugugcaacagcgugaacgccggcuggaaccaggaccccacccacgugaucagauucccccugaacggcuacugcagacugaacagcgugcaggacgugcuguaa

SEQ ID NO: 18852 - RNA, 1287 nt, Artificial Sequence
  KCTD16__Homo_sapiens__XP_005268550
auggcccugagcggcaacugcagcagauacuaccccagagagcagggcagcgccgugcccaacagcuuccccgaggugguggagcugaacgugggcggccagguguacuucaccagacacagcacccugaucagcaucccccacagccugcuguggaagauguucagccccaagagagacaccgccaacgaccuggccaaggacagcaagggcagauucuucaucgacagagacggcuuccuguucagauacauccuggacuaccugagagacagacagguggugcugcccgaccacuuccccgagaagggcagacugaagagagaggccgaguacuuccagcugcccgaccuggugaagcugcugacccccgacgagaucaagcagagccccgacgaguucugccacagcgacuucgaggacgccagccagggcagcgacaccagaaucugcccccccagcagccugcugcccgccgacagaaaguggggcuucaucaccgugggcuacagaggcagcugcacccugggcagagagggccaggccgacgccaaguucagaagagugcccagaauccuggugugcggcagaaucagccuggccaaggagguguucggcgagacccugaacgagagcagagaccccgacagagcccccgagagauacaccagcagauucuaccugaaguucaagcaccuggagagagccuucgacaugcugagcgagugcggcuuccacaugguggccugcaacagcagcgugaccgccagcuucaucaaccaguacaccgacgacaagaucuggagcagcuacaccgaguacguguucuacagagagcccagcagauggagccccagccacugcgacugcugcugcaagaacggcaagggcgacaaggagggcgagagcggcaccagcugcaacgaccugagcaccagcagcugcgacagccagagcgaggccagcagcccccaggagaccgugaucugcggccccgugaccagacagaccaacauccagacccuggacagacccaucaagaagggccccgugcagcugauccagcagagcgagaugagaagaaagagcgaccugcugagaacccugaccagcggcagcagagagagcaacaugagcagcaagaagaaggccgugaaggagaagcugagcaucgaggaggagcuggagaagugcauccaggacuuccugaagaucaagauccccgacagauuccccgagagaaagcaccccuggcagagcgagcugcugagaaaguaccaccuguaa

SEQ ID NO: 18853 - RNA, 2598 nt, Artificial Sequence
  KCTD1__Homo_sapiens__NP_001136202
auggccagaaugcccggcagcggcgacugcaacaccagcgccggcggcagcgccagcgccgccgccgccgccgccgagaacaacggcgagagaggcgagggcgagagaggcgccggcggcagaggcagaagacacagcagaccccacuacugcagcgccggcgaggaggaggaggaggaggaggaggaggacgagauccaggaggugcagaucaccggcgacgaggaggaggaggaggacggcggcggcggccuggaggaggacgaggaggaggaggaggaggaggagaugggccuggacugggacgagccccuggagcccgaggacagcgccggcgaggagcuggagcccgagcccgugcacaugaucaacauggaccagagcgccgcccuggagcccgaggccccccccagacugcuggcccccagagccagaggcggcccccccggcgacggcagcgagcuggaccccgacgugcugcagagacccgagagagccagacugagcgagaacaccagacuggccaccagauacgccgugagaaucuucagagaguaccugagcgagaaggcccagagccccgacuucgagaccauggacaagggcgcccugugcagagugcugagaagcuucuacgccgaggccagaagcaagagcggccagcuguacagcaagagcagccugaucagcaucagaagcagccugaacagauaccugaacgagccccccuacugcagaacccuggaccugaccaaggaccccgagcugagaagcgccaaccugacccuggccgccgugaucagaaagcuggaggagcagggcgccggccccguggugcagaagcaggccaucaccagagccgaccugagaaagcuguacaccagcagcguguucagcaccaacacccccuucggccugcugaacaaggugugguucgagaccugcauguacuucugcaccagaggcagagagaaccagagagagcuggaggaggacagcuucggccuggccauggacgaggacggcagaaaguucguguacuucaagagccugggccccuaccacaagagcagaagcagcagcuggagcaagaagagagccgagagcagcgacgaggagaaccugcccagaauguacgagaccggcaccgaguucugccccuacgccagcuucgugaaguaccugagcaagagaaacccccugugcaaggccuucuuccagagacccagagaccacugcagcgagggcgacgugaccugguacgagaacaaggccaucggcaagaaccugcugggcaccagaaugcagaugcugagcaaggccgccaagcugagcaagaccuacaccaaccacugcaucggcgccgugagcaucgccacccugaacagcaucgccggcaucggcaccaagcugggcagccccgccccccagggcugcuacgccgaggcccugaacggcgccgccagacaccacagccaccacccccccacccaccccagccaccaccacagaccccagccccccagccugggcaacaccuacauccugcccaaggacagccaggugggccccgacgugaagagcgaggccgcccccaagagagcccuguacgagagcguguucggcagcggcgagaucugcggccccaccagccccaagagacugugcaucagacccagcgagcccguggacgccguggugguggugagcgugaagcacgacccccugccccugcugcccgaggccaacggccacagaagcaccaacagccccaccaucgugagccccgccaucgugagccccacccaggacagcagacccaacaugagcagaccccugaucaccagaagccccgccagcccccugaacaaccagggcauccccacccccgcccagcugaccaagagcaacgcccccgugcacaucgacgugggcggccacauguacaccagcagccuggccacccugaccaaguaccccgagagcagaaucggcagacuguucgacggcaccgagcccaucgugcuggacagccugaagcagcacuacuucaucgacagagacggccagauguucagauacauccugaacuuccugagaaccagcaagcugcugauccccgacgacuucaaggacuacacccugcuguacgaggaggccaaguacuuccagcugcagcccaugcugcuggagauggagagauggaagcaggacagagagaccggcagauucagcagacccugcgagugccugguggugagaguggcccccgaccugggcgagagaaucacccugagcggcgacaagagccugaucgaggagguguuccccgagaucggcgacgugaugugcaacagcgugaacgccggcuggaaccacgacagcacccacgugaucagauucccccugaacggcuacugccaccugaacagcgugcaggugcuggagagacugcagcagagaggcuucgagaucgugggcagcugcggcggcggcguggacagcagccaguucagcgaguacgugcugagaagagagcugagaagaacccccagagugcccagcgugaucagaaucaagcaggagccccuggacuaa

SEQ ID NO: 18854 - RNA, 990 nt, Artificial Sequence
  KCTD21__Homo_sapiens__XP_005273982
auggaguucgcccuggacgcccccagcugcgaggagcccagagagaacuaccagagcagaaaggccgcccacagacccagaaccgccaccccccugggcugggcccccacccugagaccccccagaaaggccgcccuggccgccagaggcggcagaggcugcagagccagagccggcggccugcugcccgccacccagagccccgccaugagcgaccccaucacccugaacgugggcggcaagcuguacaccaccagccuggccacccugaccagcuuccccgacagcaugcugggcgccauguucagcggcaagaugcccaccaagagagacagccagggcaacugcuucaucgacagagacggcaagguguucagauacauccugaacuuccugagaaccagccaccuggaccugcccgaggacuuccaggagaugggccugcugagaagagaggccgacuucuaccaggugcagccccugaucgaggcccugcaggagaaggagguggagcugagcaaggccgagaagaacgccaugcugaacaucacccugaaccagagagugcagaccgugcacuucaccgugagagaggccccccagaucuacagccugagcagcagcagcauggagguguucaacgccaacaucuucagcaccagcugccuguuccugaagcugcugggcagcaagcuguucuacugcagcaacggcaaccugagcagcaucaccagccaccugcaggaccccaaccaccugacccuggacuggguggccaacguggagggccugcccgaggaggaguacaccaagcagaaccugaagagacuguggguggugcccgccaacaagcagaucaacagcuuccagguguucguggaggaggugcugaagaucgcccugagcgacggcuucugcaucgacagcagccacccccacgcccuggacuucaugaacaacaagaucaucagacugaucagauacagauaa

SEQ ID NO: 18855 - RNA, 792 nt, Artificial Sequence
  KCTD2__Homo_sapiens__NP_056168
auggccgagcugcagcuggaccccgccauggccggccugggcggcggcggcggcagcggcgugggcgacggcggcggccccgugagaggcccccccagccccagacccgccggccccacccccagaggccacggcagacccgccgccgccguggcccagccccuggagcccggccccggcccccccgagagagccggcggcggcggcgccgccagaugggugagacugaacgugggcggcaccuacuucgugaccaccagacagacccugggcagagagcccaagagcuuccugugcagacugugcugccaggaggaccccgagcuggacagcgacaaggacgagaccggcgccuaccugaucgacagagaccccaccuacuucggccccauccugaacuaccugagacacggcaagcugaucaucaccaaggagcuggccgaggagggcgugcuggaggaggccgaguucuacaacaucgccagccuggugagacuggugaaggagagaaucagagacaacgagaacagaaccagccagggccccgugaagcacguguacagagugcugcagugccaggaggaggagcugacccagauggugagcaccaugagcgacggcuggaaguucgagcagcugaucagcaucggcagcagcuacaacuacggcaacgaggaccaggccgaguuccugugcguggugagcagagagcugaacaacagcaccaacggcaucgugaucgagcccagcgagaaggccaagauccugcaggagagaggcagcagaauguaa

SEQ ID NO: 18856 - RNA, 2448 nt, Artificial Sequence
  KCTD3__Homo_sapiens__NP_057205
auggccggcggccacugcggcagcuuccccgccgccgccgccggcagcggcgagaucgugcagcugaacgugggcggcaccagauucagcaccagcagacagacccugauguggauccccgacagcuucuucagcagccugcugagcggcagaaucagcacccugagagacgagaccggcgccaucuucaucgacagagaccccgccgccuucgcccccauccugaacuuccugagaaccaaggagcuggaccugagaggcgugagcaucaacgugcugagacacgaggccgaguucuacggcaucaccccccuggugagaagacugcugcugugcgaggagcuggagagaagcagcugcggcagcgugcuguuccacggcuaccugcccccccccggcauccccagcagaaagaucaacaacaccgugagaagcgccgacagcagaaacggccugaacagcaccgagggcgaggccagaggcaacggcacccagcccgugcugagcggcaccggcgaggagaccgugagacugggcuuccccguggaccccagaaaggugcugaucguggccggccaccacaacuggaucguggccgccuacgcccacuucgccgugugcuacagaaucaaggagagcagcggcuggcagcagguguucaccagccccuaccuggacuggaccaucgagagaguggcccugaacgccaagguggugggcggcccccacggcgacaaggacaagaugguggccguggccagcgagagcagcaucauccuguggagcgugcaggacggcggcagcggcagcgagaucggcguguucagccugggcgugcccguggacgcccuguucuucaucggcaaccagcugguggccaccagccacaccggcaaggugggcguguggaacgccgugacccagcacuggcaggugcaggacguggugcccaucaccagcuacgacaccgccggcagcuuccugcugcugggcugcaacaacggcagcaucuacuacaucgacaugcagaaguucccccugagaaugaaggacaacgaccugcuggugaccgagcuguaccacgaccccagcaacgacgccaucaccgcccugagcguguaccugacccccaagaccagcgugagcggcaacuggaucgagaucgccuacggcaccagcagcggcgccgugagagugaucgugcagcaccccgagaccgugggcagcggcccccagcuguuccagaccuucaccgugcacagaagccccgugaccaagaucaugcugagcgagaagcaccuggugagcgugugcgccgacaacaaccacgugagaaccuggaccgugaccagauucagaggcaugaucagcacccagcccggcagcaccccccuggccagcuucaagauccugagccuggaggagaccgagagccacggcagcuacagcagcggcaacgacaucggccccuucggcgagagagacgaccagcagguguucauccagaagguggugcccaucaccaacaagcuguucgugagacugagcagcaccggcaagagaaucugcgagauccaggccguggacugcaccaccaucagcagcuucaccgugagagagugcgagggcagcagcagaaugggcagcagacccagaagauaccuguucaccggccacaccaacggcagcauccagaugugggaccugaccaccgccauggacauggugaacaagagcgaggacaaggacgugggcggccccaccgaggaggagcugcugaagcugcuggaccagugcgaccugagcaccagcagaugcgccacccccaacaucagccccgccaccagcguggugcagcacagccaccugagagagagcaacagcagccugcagcugcagcaccacgacaccacccacgaggccgccaccuacggcagcaugagacccuacagagagagcccccugcuggccagagccagaagaaccgagagcuuccacagcuacagagacuuccagaccaucaaccugaacagaaacguggagagagccgugcccgagaacggcaaccugggccccauccaggccgaggugaagggcgccaccggcgagugcaacaucagcgagagaaagagccccggcguggagaucaagagccugagagagcuggacagcggccuggaggugcacaagaucgccgagggcuucagcgagagcaagaagagaagcagcgaggacgagaacgagaacaagaucgaguucagaaagaagggcggcuucgagggcggcggcuuccugggcagaaagaaggugcccuaccuggccagcagccccagcaccagcgacggcggcaccgacagccccggcaccgccagccccagccccaccaagaccacccccagccccagacacaagaagagcgacagcagcggccaggaguacagccuguaa

SEQ ID NO: 18857 - RNA, 714 nt, Artificial Sequence
  KCTD6__Homo_sapiens__NP_699162
auggacaacggcgacuggggcuacaugaugaccgaccccgugacccugaacgugggcggccaccuguacaccaccagccugaccacccugaccagauaccccgacagcaugcugggcgccauguucggcggcgacuuccccaccgccagagacccccagggcaacuacuucaucgacagagacggcccccuguucagauacgugcugaacuuccugagaaccagcgagcugacccugccccuggacuucaaggaguucgaccugcugagaaaggaggccgacuucuaccagaucgagccccugauccagugccugaacgaccccaagccccuguaccccauggacaccuucgaggaggugguggagcugagcagcaccagaaagcugagcaaguacagcaaccccguggccgugaucaucacccagcugaccaucaccaccaaggugcacagccugcuggagggcaucagcaacuacuucaccaaguggaacaagcacaugauggacaccagagacugccaggugagcuucaccuucggccccugcgacuaccaccaggaggugagccugagagugcaccugauggaguacaucaccaagcagggcuucaccaucagaaacaccagagugcaccacaugagcgagagagccaacgagaacaccguggagcacaacuggaccuucugcagacuggccagaaagaccgacgacuaa

SEQ ID NO: 18858 - RNA, 867 nt, Artificial Sequence
  KCTD7__Homo_sapiens__NP_001161433
auggugguggugaccggcagagagcccgacagcagaagacaggacggcgccaugagcagcagcgacgccgaggacgacuuccuggagcccgccacccccaccgccacccaggccggccacgcccugccccugcugccccaggaguuccccgagguggugccccugaacaucggcggcgcccacuucaccaccagacugagcacccugagaugcuacgaggacaccaugcuggccgccauguucagcggcagacacuacauccccaccgacagcgagggcagauacuucaucgacagagacggcacccacuucggcgacgugcugaacuuccugagaagcggcgaccugccccccagagagagagugagagccguguacaaggaggcccaguacuacgccaucggcccccugcuggagcagcuggagaacaugcagccccugaagggcgagaaggugagacaggccuuccugggccugaugcccuacuacaaggaccaccuggagagaaucguggagaucgccagacugagagccgugcagagaaaggccagauucgccaagcugaaggugugcguguucaaggaggagaugcccaucacccccuacgagugcccccugcugaacagccugagauucgagagaagcgagagcgacggccagcuguucgagcaccacugcgagguggacgugagcuucggccccugggaggccguggccgacguguacgaccugcugcacugccuggugaccgaccugagcgcccagggccugaccguggaccaccagugcaucggcgugugcgacaagcaccuggugaaccacuacuacugcaagagacccaucuacgaguucaagaucaccugguaa

SEQ ID NO: 18859 - RNA, 1170 nt, Artificial Sequence
  KCTD9__Homo_sapiens__NP_060104
augagaagagugacccuguuccugaacggcagccccaagaacggcaaggugguggccguguacggcacccugagcgaccugcugagcguggccagcagcaagcugggcaucaaggccaccagcguguacaacggcaagggcggccugaucgacgacaucgcccugaucagagacgacgacgugcuguucgugugcgagggcgagcccuucaucgacccccagaccgacagcaagccccccgagggccugcugggcuuccacaccgacuggcugacccugaacgugggcggcagauacuucaccaccaccagaagcacccuggugaacaaggagcccgacagcaugcuggcccacauguucaaggacaagggcguguggggcaacaagcaggaccacagaggcgccuuccugaucgacagaagccccgaguacuucgagcccauccugaacuaccugagacacggccagcugaucgugaacgacggcaucaaccugcugggcgugcuggaggaggccagauucuucggcaucgacagccugaucgagcaccuggagguggccaucaagaacagccagccccccgaggaccacagccccaucagcagaaaggaguucgugagauuccugcuggccacccccaccaagagcgagcugagaugccagggccugaacuucagcggcgccgaccugagcagacuggaccugagauacaucaacuucaagauggccaaccugagcagaugcaaccuggcccacgccaaccugugcugcgccaaccuggagagagccgaccugagcggcagcgugcuggacugcgccaaccugcagggcgugaagaugcugugcagcaacgccgagggcgccagccugaagcugugcaacuucgaggaccccagcggccugaaggccaaccuggagggcgccaaccugaagggcguggacauggagggcagccagaugaccggcaucaaccugagaguggccacccugaagaacgccaagcugaagaacugcaaccugagaggcgccacccuggccggcaccgaccuggagaacugcgaccugagcggcugcgaccugcaggaggccaaccugagaggcagcaacgugaagggcgccaucuucgaggagaugcugaccccccugcacaugagccagagcgugagauaa

SEQ ID NO: 18860 - RNA, 1509 nt, Artificial Sequence
  KDELC1__Homo_sapiens__NP_076994
auguucggcacccugcugcuguacugcuucuuccuggccaccgugcccgcccuggccgagaccggcggcgagagacagcugagccccgagaagagcgagaucuggggccccggccugaaggccgacguggugcugcccgccagauacuucuacauccaggccguggacaccagcggcaacaaguucaccagcagccccggcgagaagguguuccaggugaaggugagcgcccccgaggagcaguucaccagagugggcgugcaggugcuggacagaaaggacggcagcuucaucgugagauacagaauguacgccagcuacaagaaccugaagguggagaucaaguuccagggccagcacguggccaagagccccuacauccugaagggccccguguaccacgagaacugcgacugcccccugcaggacagcgccgccuggcugagagagaugaacugccccgagaccaucgcccagauccagagagaccuggcccacuuccccgccguggaccccgagaagaucgccguggagauccccaagagauucggccagagacagagccugugccacuacacccugaaggacaacaagguguacaucaagacccacggcgagcacgugggcuucagaaucuucauggacgccauccugcugagccugaccagaaaggugaagaugcccgacguggagcuguucgugaaccugggcgacuggccccuggagaagaagaagagcaacagcaacauccaccccaucuucagcuggugcggcagcaccgacagcaaggacaucgugaugcccaccuacgaccugaccgacagcgugcuggagaccaugggcagagugagccuggacaugaugagcgugcaggccaacaccggcccccccugggagagcaagaacagcaccgccguguggagaggcagagacagcagaaaggagagacuggagcuggugaagcugagcagaaagcaccccgagcugaucgacgccgccuucaccaacuucuucuucuucaagcacgacgagaaccuguacggccccaucgugaagcacaucagcuucuucgacuucuucaagcacaaguaccagaucaacaucgacggcaccguggccgccuacagacugcccuaccugcuggugggcgacagcguggugcugaagcaggacagcaucuacuacgagcacuucuacaacgagcugcagcccuggaagcacuacauccccgugaagagcaaccugagcgaccugcuggagaagcugaagugggccaaggaccacgacgaggaggccaagaagaucgccaaggccggccaggaguucgccagaaacaaccugaugggcgacgacaucuucugcuacuacuucaagcuguuccaggaguacgccaaccugcaggugagcgagccccagaucagagagggcaugaagagaguggagccccagaccgaggacgaccuguuccccugcaccugccacagaaagaagaccaaggacgagcuguaa

SEQ ID NO: 18861 - RNA, 639 nt, Artificial Sequence
  KDELR1__Homo_sapiens__NP_006792
augaaccuguucagauuccugggcgaccugagccaccugcuggccaucauccugcugcugcugaagaucuggaagagcagaagcugcgccggcaucagcggcaagagccaggugcuguucgccgugguguucaccgccagauaccuggaccuguucaccaacuacaucagccuguacaacaccugcaugaaggugguguacaucgccugcagcuucaccaccguguggcugaucuacagcaaguucaaggccaccuacgacggcaaccacgacaccuucagaguggaguuccugguggugcccaccgccauccuggccuuccuggugaaccacgacuucaccccccuggagauccuguggaccuucagcaucuaccuggagagcguggccauccugccccagcuguucauggugagcaagaccggcgaggccgagaccaucaccagccacuaccuguucgcccugggcguguacagaacccuguaccuguucaacuggaucuggagauaccacuucgagggcuucuucgaccugaucgccaucguggccggccuggugcagaccgugcuguacugcgacuucuucuaccuguacaucaccaaggugcugaagggcaagaagcugagccugcccgccuaa

SEQ ID NO: 18862 - RNA, 2172 nt, Artificial Sequence
  KDM2A__Homo_sapiens__NP_001243334
augugcagcggcagauuccagaacauccaggugaaccccgacuuccccagaggcagaaucagcaacagcuucagaagaaccagcagcaccgagaacaagaccaagacccugggcaagcugcaccaggagcccagacagcugcagagcgacggcaagagaaagauccugcuggaggagcuggccaacagcgaccccaagcuggcccugaccggcgugcccaucgugcaguggcccaagagagacaagcugaaguuccccaccagacccaaggugagagugcccaccauccccaucaccaagccccacaccaugaagcccgcccccagacugacccccgugagacccgccgccgccagccccaucgugagcggcgccagaagaagaagagugagaugcagaaagugcaaggccugcgugcagggcgagugcggcgugugccacuacugcagagacaugaagaaguucggcggccccggcagaaugaagcagagcugcgugcugagacagugccuggcccccagacugccccacagcgugaccugcagccugugcggcgagguggaccagaacgaggagacccaggacuucgagaagaagcugauggagugcugcaucugcaacgagaucgugcaccccggcugccugcagauggacggcgagggccugcugaacgaggagcugcccaacugcugggagugccccaagugcuaccaggaggacagcagcgagaaggcccagaagagaaagauggaggagagcgacgaggaggccgugcaggccaaggugcugagaccccugagaagcugcgacgagccccugaccccccccccccacagccccaccagcaugcugcagcugauccacgaccccgugagccccagaggcauggugaccagaagcagccccggcgccggccccagcgaccaccacagcgccagcagagacgagagauucaagagaagacagcugcugagacugcaggccaccgagagaaccauggugagagagaaggagaacaaccccagcggcaagaaggagcugagcgagguggagaaggccaagaucagaggcagcuaccugaccgugacccugcagagacccaccaaggagcugcacggcaccagcaucgugcccaagcugcaggccaucaccgccagcagcgccaaccugagacacagccccagagugcuggugcagcacugccccgccagaaccccccagagaggcgacgaggagggccugggcggcgaggaggaggaggaggaggaggaggaggaggaggacgacagcgccgaggagggcggcgccgccagacugaacggcagaggcagcugggcccaggacggcgacgagagcuggaugcagagagagguguggaugagcguguucagauaccugagcagaagagagcugugcgagugcaugagagugugcaagaccugguacaaguggugcugcgacaagagacuguggaccaagaucgaccugagcagaugcaaggccaucgugccccaggcccugagcggcaucaucaagagacagcccgugagccuggaccugagcuggaccaacaucagcaagaagcagcugaccuggcuggugaacagacugcccggccugaaggaccugcugcuggccggcugcagcuggagcgccgugagcgcccugagcaccagcagcugcccccugcugagaacccuggaccugagaugggccgugggcaucaaggacccccagaucagagaccugcugaccccccccgccgacaagcccggccaggacaacagaagcaagcugagaaacaugaccgacuucagacuggccggccuggacaucaccgacgccacccugagacugaucaucagacacaugccccugcugagcagacuggaccugagccacugcagccaccugaccgaccagagcagcaaccugcugaccgccgugggcagcagcaccagauacagccugaccgagcugaacauggccggcugcaacaagcugaccgaccagacccugaucuaccugagaagaaucgccaacgugacccugaucgaccugagaggcugcaagcagaucaccagaaaggccugcgagcacuucaucagcgaccugagcaucaacagccuguacugccugagcgacgagaagcugauccagaagaucagcuaa

SEQ ID NO: 18863 - RNA, 3798 nt, Artificial Sequence
  KDM2B__Homo_sapiens__NP_001005366
auggaggccgagaaggacagcggcagaagacugagacccaucgacagacagagauacgacgagaacgaggaccugagcgacguggaggagaucgugagcgugagaggcuucagccuggaggagaagcugagaagccagcuguaccagggcgacuucgugcacgccauggagggcaaggacuucaacuacgaguacgugcagagagaggcccugagagugccccugaucuucagagagaaggacggccugggcaucaagaugcccgaccccgacuucaccgugagagacgugaagcugcuggugggcagcagaagacugguggacgugauggacgugaacacccagaagggcaccgagaugagcaugagccaguucgugagauacuacgagacccccgaggcccagagagacaagcuguacaacgugaucagccuggaguucagccacaccaagcuggagcaccuggugaagagacccaccgugguggaccugguggacuggguggacaacauguggccccagcaccugaaggagaagcagaccgaggccaccaacgccaucgccgagaugaaguaccccaaggugaagaaguacugccugaugagcgugaagggcugcuucaccgacuuccacaucgacuucggcggcaccagcgugugguaccacguguucagaggcggcaagaucuucuggcugaucccccccacccugcacaaccuggcccuguacgaggagugggugcugagcggcaagcagagcgacaucuuccugggcgacagaguggagagaugccagagaaucgagcugaagcagggcuacaccuucuucauccccagcggcuggauccacgccguguacacccccguggacagccugguguucggcggcaacauccugcacagcuucaacgugcccaugcagcugagaaucuacgagaucgaggacagaaccagagugcagcccaaguucagauaccccuucuacuacgagaugugcugguacgugcuggagagauacguguacugcgugacccagagaagccaccugacccaggaguaccagagagagagcaugcugaucgacgcccccagaaagcccagcaucgacggcuucagcagcgacagcuggcuggagauggaggaggaggccugcgaccagcagccccaggaggaggaggagaaggacgaggagggcgagggcagagacagagcccccaagccccccaccgacggcagcaccagccccaccagcacccccagcgaggaccaggaggcccugggcaagaagcccaaggcccccgcccugagauuccugaagagaacccugagcaacgagagcgaggagagcgugaagagcaccacccuggccguggacuaccccaagacccccaccggcagccccgccaccgaggugagcgccaaguggacccaccugaccgaguucgagcugaagggccugaaggcccugguggagaagcuggagagccugcccgagaacaagaagugcgugcccgagggcaucgaggacccccaggcccugcuggagggcgugaagaacgugcugaaggagcacgccgacgacgaccccagccuggccaucaccggcgugcccguggugaccuggcccaagaagacccccaagaacagagccgugggcagacccaagggcaagcugggccccgccagcgccgugaagcuggccgccaacagaaccaccgccggcgccagaagaagaagaaccagaugcagaaagugcgaggccugccugagaaccgagugcggcgagugccacuucugcaaggacaugaagaaguucggcggccccggcagaaugaagcagagcugcaucaugagacagugcaucgcccccgugcugccccacaccgccgugugccuggugugcggcgaggccggcaaggaggacaccguggaggaggaggagggcaaguucaaccugaugcugauggagugcagcaucugcaacgagaucauccaccccggcugccugaagaucaaggagagcgagggcguggugaacgacgagcugcccaacugcugggagugccccaagugcaaccacgccggcaagaccggcaagcagaagagaggccccggcuucaaguacgccagcaaccugcccggcagccugcugaaggagcagaagaugaacagagacaacaaggagggccaggagcccgccaagagaagaagcgagugcgaggaggcccccagaagaagaagcgacgagcacagcaagaaggugccccccgacggccugcugagaagaaagagcgacgacgugcaccugagaaagaagagaaaguacgagaagccccaggagcugagcggcagaaagagacugaagcccggcaaggaggacaagcuguucagaaagaagagaagaagcuggaagaacgccgaggacagaauggcccuggccaacaagccccugagaagauucaagcaggagcccgaggacgagcugcccgaggccccccccaagaccagagagagcgaccacagcagaagcagcagccccaccgccggccccagcaccgagggcgccgagggccccgaggagaagaagaaggugaagaugagaagaaagagaagacugcccaacaaggagcugagcagagagcugagcaaggagcugaaccacgagauccagagaaccgagaacagccuggccaacgagaaccagcagcccaucaagagcgagcccgagagcgagggcgaggagcccaagagaccccccggcaucugcgagagaccccacagauucagcaagggccugaacggcacccccagagagcugagacaccagcugggccccagccugagaagcccccccagagugaucagcagacccccccccagcgugagcccccccaagugcauccagauggagagacacgugaucagacccccccccaucagccccccccccgacagccugccccuggacgacggcgccgcccacgugaugcacagagagguguggauggccguguucagcuaccugagccaccaggaccugugcgugugcaugagagugugcagaaccuggaacagauggugcugcgacaagagacuguggaccagaaucgaccugaaccacugcaagagcaucaccccccugaugcugagcggcaucaucagaagacagcccgugagccuggaccugagcuggaccaacaucagcaagaagcagcugagcuggcugaucaacagacugcccggccugagagaccuggugcugagcggcugcagcuggaucgccgugagcgcccugugcagcagcagcugcccccugcugagaacccuggacgugcaguggguggagggccugaaggacgcccagaugagagaccugcugagcccccccaccgacaacagacccggccagauggacaacagaagcaagcugagaaacaucguggagcugagacuggccggccuggacaucaccgacgccagccugagacugaucaucagacacaugccccugcugagcaagcugcaccugagcuacugcaaccacgugaccgaccagagcaucaaccugcugaccgccgugggcaccaccaccagagacagccugaccgagaucaaccugagcgacugcaacaaggugaccgaccagugccugagcuucuucaagagaugcggcaacaucugccacaucgaccugagauacugcaagcaggugaccaaggagggcugcgagcaguucaucgccgagaugagcagcuuccagggcagaagcugcagcaccaccagacugggcgacgaguaa

SEQ ID NO: 18864 - RNA, 3966 nt, Artificial Sequence
  KDM3A__Homo_sapiens__NP_060903
auggugcugacccugggcgagagcuggcccgugcuggugggcagaagauuccugagccugagcgccgccgacggcagcgacggcagccacgacagcugggacguggagagaguggccgaguggcccuggcugagcggcaccaucagagccgugagccacaccgacgugaccaagaaggaccugaaggugugcguggaguucgacggcgagagcuggagaaagagaagauggaucgagguguacagccugcugagaagagccuuccugguggagcacaaccuggugcuggccgagagaaagagccccgagaucagcgagagaaucgugcaguggcccgccaucaccuacaagccccugcuggacaaggccggccugggcagcaucaccagcgugagauuccugggcgaccagcagagaguguuccugagcaaggaccugcugaagcccauccaggacgugaacagccugagacugagccugaccgacaaccagaucgugagcaaggaguuccaggcccugaucgugaagcaccuggacgagagccaccugcugaagggcgacaagaaccuggugggcagcgaggugaagaucuacagccuggaccccagcacccagugguucagcgccaccgugaucaacggcaaccccgccagcaagacccugcaggugaacugcgaggagauccccgcccugaagaucguggaccccagccugauccacguggagguggugcacgacaaccuggugaccugcggcaacagcgccagaaucggcgccgugaagagaaagagcagcgagaacaacggcacccuggugagcaagcaggccaagagcugcagcgaggccagccccagcaugugccccgugcagagcgugcccaccaccguguucaaggagauccugcugggcugcaccgccgccaccccccccagcaaggaccccagacagcagagcaccccccaggccgccaacagcccccccaaccugggcgccaagaucccccagggcugccacaagcagagccugcccgaggagaucagcagcugccugaacaccaagagcgaggcccugagaaccaagcccgacgugugcaaggccggccugcugagcaagagcagccagaucggcaccggcgaccugaagauccugaccgagcccaagggcagcugcacccagcccaagaccaacaccgaccaggagaacagacuggagagcgugccccaggcccugaccggccugcccaaggagugccugcccaccaaggccagcagcaaggccgagcuggagaucgccaacccccccgagcugcagaagcaccuggagcacgcccccagccccagcgacgugagcaacgcccccgaggugaaggccggcgugaacagcgacagccccaacaacugcagcggcaagaagguggagcccagcgcccuggccugcagaagccagaaccugaaggagagcagcgugaagguggacaacgagagcugcugcagcagaagcaacaacaagauccagaacgcccccagcagaaagagcgugcugaccgaccccgccaagcugaagaagcugcagcagagcggcgaggccuucgugcaggacgacagcugcgugaacaucguggcccagcugcccaagugcagagagugcagacuggacagccugagaaaggacaaggagcagcagaaggacagccccguguucugcagauucuuccacuucagaagacugcaguucaacaagcacggcgugcugagaguggagggcuuccugacccccaacaaguacgacaacgaggccaucggccuguggcugccccugaccaagaacguggugggcaucgaccuggacaccgccaaguacauccuggccaacaucggcgaccacuucugccagauggugaucagcgagaaggaggccaugagcaccaucgagccccacagacagguggccuggaagagagccgugaagggcgugagagagaugugcgacgugugcgacaccaccaucuucaaccugcacugggugugccccagaugcggcuucggcgugugcguggacugcuacagaaugaagagaaagaacugccagcagggcgccgccuacaagaccuucagcuggcugaagugcgugaagagccagauccacgagcccgagaaccugaugcccacccagaucauccccggcaaggcccuguacgacgugggcgacaucgugcacagcgugagagccaaguggggcaucaaggccaacugccccugcagcaacagacaguucaagcuguucagcaagcccgccagcaaggaggaccugaagcagaccagccuggccggcgagaagcccacccugggcgccgugcugcagcagaaccccagcgugcuggagcccgccgccgugggcggcgaggccgccagcaagcccgccggcagcaugaagcccgccugccccgccagcaccagcccccugaacuggcuggccgaccugaccagcggcaacgugaacaaggagaacaaggagaagcagcccaccaugcccauccugaagaacgagaucaagugccugcccccccugcccccccugagcaagagcagcaccgugcugcacaccuucaacagcaccauccugacccccgugagcaacaacaacagcggcuuccugagaaaccugcugaacagcagcaccggcaagaccgagaacggccugaagaacacccccaagauccuggacgacaucuucgccagccuggugcagaacaagaccaccagcgaccugagcaagagaccccagggccugaccaucaagcccagcauccugggcuucgacaccccccacuacuggcugugcgacaacagacugcugugccugcaggaccccaacaacaagagcaacuggaacguguucagagagugcuggaagcagggccagcccgugauggugagcggcgugcaccacaagcugaacagcgagcuguggaagcccgagagcuucagaaaggaguucggcgagcaggagguggaccuggugaacugcagaaccaacgagaucaucaccggcgccaccgugggcgacuucugggacggcuucgaggacgugcccaacagacugaagaacgagaaggagcccauggugcugaagcugaaggacuggccccccggcgaggacuucagagacaugaugcccagcagauucgacgaccugauggccaacaucccccugcccgaguacaccagaagagacggcaagcugaaccuggccagcagacugcccaacuacuucgugagacccgaccugggccccaagauguacaacgccuacggccugaucacccccgaggacagaaaguacggcaccaccaaccugcaccuggacgugagcgacgccgccaacgugaugguguacgugggcauccccaagggccagugcgagcaggaggaggaggugcugaagaccauccaggacggcgacagcgacgagcugaccaucaagagauucaucgagggcaaggagaagcccggcgcccuguggcacaucuacgccgccaaggacaccgagaagaucagagaguuccugaagaaggugagcgaggagcagggccaggagaaccccgccgaccacgaccccauccacgaccagagcugguaccuggacagaagccugagaaagagacugcaccaggaguacggcgugcagggcugggccaucgugcaguuccugggcgacgugguguucauccccgccggcgccccccaccaggugcacaaccuguacagcugcaucaagguggccgaggacuucgugagccccgagcacgugaagcacugcuucuggcugacccaggaguucagauaccugagccagacccacaccaaccacgaggacaagcugcaggugaagaacgugaucuaccacgccgugaaggacgccguggccaugcugaaggccagcgagagcagcuucggcaagcccuaa

SEQ ID NO: 18865 - RNA, 5286 nt, Artificial Sequence
  KDM3B__Homo_sapiens__NP_057688
auggccgacgccgccgccagccccgugggcaagagacugcugcugcuguucgccgacaccgccgccagcgccagcgccagcgcccccgccgccgccgccgccagcggcgaccccggccccgcccugagaaccagagccuggagagccggcaccgugagagccaugagcggcgccgugccccaggaccuggccaucuucguggaguucgacggcugcaacuggaagcagcacagcugggugaaggugcacgccgaggaggugaucgugcugcugcuggagggcagccuggugugggcccccagagaggaccccgugcugcugcagggcaucagagugagcaucgcccaguggcccgcccugaccuucaccccccugguggacaagcugggccugggcagcguggugcccguggaguaccugcuggacagagagcugagauuccugagcgacgccaacggccugcaccuguuccagaugggcaccgacagccagaaccagauccugcuggagcacgccgcccugagagagaccgugaacgcccugaucagcgaccagaagcugcaggagaucuucagcagaggccccuacagcgugcagggccacagagugaagaucuaccagcccgagggcgaggagggcuggcuguacggcguggugagccaccaggacagcaucaccagacugauggaggugagcgugaccgagagcggcgagaucaagagcguggaccccagacugauccacgugaugcugauggacaacagcaccccccagagcgagggcggcacccugaaggccgugaagagcagcaagggcaagaagaagagagagagcaucgagggcaaggacggcagaagaagaaagagcgccagcgacagcggcugcgaccccgccagcaagaagcugaagggcgacagaggcgagguggacagcaacggcagcgacggcggcgaggccagcagaggccccuggaagggcggcaacgccagcggcgagcccggccuggaccagagagccaagcagccccccagcaccuucgugccccagaucaacagaaacaucagauucgccaccuacaccaaggagaacggcagaacccugguggugcaggacgagcccgugggcggcgacacccccgccagcuucacccccuacagcaccgccaccggccagaccccccuggcccccgaggugggcggcgccgagaacaaggaggccggcaagacccuggagcaggugggccagggcaucguggccagcgccgccguggugaccaccgccagcagcacccccaacaccgugagaaucagcgacaccggccuggccgccggcaccgugcccgagaagcagaagggcagcagaagccaggccagcggcgagaacagcagaaacagcauccuggccagcagcggcuucggcgccccccugcccagcagcagccagccccugaccuucggcagcggcagaagccagagcaacggcgugcuggccaccgagaacaagccccugggcuucagcuucggcugcagcagcgcccaggaggcccagaaggacaccgaccugagcaagaaccuguucuuccagugcaugagccagacccugcccaccagcaacuacuucaccaccgugagcgagagccuggccgacgacagcagcagcagagacagcuucaagcagagccuggagagccugagcagcggccugugcaagggcagaagcgugcugggcaccgacaccaagcccggcagcaaggccggcagcagcguggacagaaaggugcccgccgagagcaugcccacccugacccccgccuuccccagaagccugcugaacgccagaacccccgagaaccacgagaaccuguuccugcagccccccaagcugagcagagaggagcccagcaaccccuuccuggccuucguggagaagguggagcacagccccuucagcagcuucgccagccaggccagcggcagcagcagcagcgccaccaccgugaccagcaagguggcccccagcuggcccgagagccacagcagcgccgacagcgccagccuggccaagaagaagccccuguucaucaccaccgacagcagcaagcuggugagcggcgugcugggcagcgcccugaccagcggcggccccagccugagcgccaugggcaacggcagaagcagcagccccaccagcagccugacccagcccaucgagaugcccacccugagcagcagccccaccgaggagagacccaccgugggccccggccagcaggacaacccccugcugaagaccuucagcaacguguucggcagacacagcggcggcuuccugagcagccccgccgacuucagccaggagaacaaggcccccuucgaggccgugaagagauucagccuggacgagagaagccuggccugcagacaggacagcgacagcagcaccaacagcgaccugagcgaccugagcgacagcgaggagcagcugcaggccaagaccggccugaagggcauccccgagcaccugaugggcaagcugggccccaacggcgagagaagcgccgagcugcugcugggcaagagcaagggcaagcaggcccccaagggcagacccagaaccgccccccugaaggugggccagagcgugcugaaggacgugagcaaggugaagaagcugaagcagagcggcgagcccuuccugcaggacggcagcugcaucaacguggccccccaccugcacaagugcagagagugcagacuggagagauacagaaaguucaaggagcaggagcaggacgacagcaccguggccugcagauucuuccacuucagaagacugaucuucaccagaaagggcgugcugagaguggagggcuuccugagcccccagcagagcgaccccgacgccaugaaccuguggauccccagcagcagccuggccgagggcaucgaccuggagaccagcaaguacauccuggccaacgugggcgaccaguucugccagcuggugaugagcgagaaggaggccaugaugaugguggagccccaccagaagguggccuggaagagagccgugagaggcgugagagagaugugcgacgugugcgagaccacccuguucaacauccacugggugugcagaaagugcggcuucggcgugugccuggacugcuacagacugagaaagagcagacccagaagcgagaccgaggagaugggcgacgaggagguguucagcuggcugaagugcgccaagggccagagccacgagcccgagaaccugaugcccacccagaucauccccggcaccgcccuguacaacaucggcgacauggugcacgccgccagaggcaaguggggcaucaaggccaacugccccugcaucagcagacagaacaagagcgugcugagacccgccgugaccaacggcaugagccagcugcccagcaucaaccccagcgccagcagcggcaacgagaccaccuucagcggcggcggcggccccgcccccgugaccacccccgagcccgaccacgugcccaaggccgacagcaccgacaucagaagcgaggagccccugaagaccgacagcagcgccagcaacagcaacagcgagcugaaggccaucagaccccccugccccgacaccgccccccccagcagcgcccugcacuggcuggccgaccuggccacccagaaggccaaggaggagaccaaggaggccggcagccugagaagcgugcugaacaaggagagccacagccccuucggccuggacagcuucaacagcaccgccaaggugagcccccugacccccaagcuguucaacagccugcugcugggccccaccgccagcaacaacaagaccgagggcagcagccugagagaccugcugcacagcggccccggcaagcugccccagaccccccuggacaccggcauccccuucccccccguguucagcaccagcagcgccggcgugaagagcaaggccagccugcccaacuuccuggaccacaucaucgccagcgugguggagaacaagaagaccagcgacgccagcaagagagccugcaaccugaccgacacccagaaggaggugaaggagauggugaugggccugaacgugcuggacccccacaccagccacagcuggcugugcgacggcagacugcugugccugcacgaccccagcaacaagaacaacuggaagaucuucagagagugcuggaagcagggccagcccgugcuggugagcggcgugcacaagaagcugaagagcgagcuguggaagcccgaggccuucagccaggaguucggcgaccaggacguggaccuggugaacugcagaaacugcgccaucaucagcgacgugaaggugagagacuucugggacggcuucgagaucaucugcaagagacugagaagcgaggacggccagcccauggugcugaagcugaaggacuggccccccggcgaggacuucagagacaugaugcccaccagauucgaggaccugauggagaaccugccccugcccgaguacaccaagagagacggcagacugaaccuggccagcagacugcccagcuacuucgugagacccgaccugggccccaagauguacaacgccuacggccugaucaccgccgaggacagaagagugggcaccaccaaccugcaccuggacgugagcgacgccgugaacgugaugguguacgugggcauccccaucggcgagggcgcccacgacgaggaggugcugaagaccaucgacgagggcgacgccgacgaggugaccaagcagagaauccacgacggcaaggagaagcccggcgcccuguggcacaucuacgccgccaaggacgccgagaagaucagagagcugcugagaaaggugggcgaggagcagggccaggagaacccccccgaccacgaccccauccacgaccagagcugguaccuggaccagacccugagaaagagacuguacgaggaguacggcgugcagggcugggccaucgugcaguuccugggcgacgccguguucauccccgccggcgccccccaccaggugcacaaccuguacagcugcaucaagguggccgaggacuucgugagccccgagcacgugaagcacugcuucagacugacccaggaguucagacaccugagcaacacccacaccaaccacgaggacaagcugcaggugaagaacaucaucuaccacgccgugaaggacgccgugggcacccugaaggcccacgagagcaagcuggccagaagcuaa

SEQ ID NO: 18866 - RNA, 3291 nt, Artificial Sequence
  KDM4B__Homo_sapiens__NP_055830
augggcagcgaggaccacggcgcccagaaccccagcugcaagaucaugaccuucagacccaccauggaggaguucaaggacuucaacaaguacguggccuacaucgagagccagggcgcccacagagccggccuggccaagaucaucccccccaaggaguggaagcccagacagaccuacgacgacaucgacgacguggugauccccgcccccauccagcagguggugaccggccagagcggccuguucacccaguacaacauccagaagaaggccaugaccgugggcgaguacagaagacuggccaacagcgagaaguacugcacccccagacaccaggacuucgacgaccuggagagaaaguacuggaagaaccugaccuucgugagccccaucuacggcgccgacaucagcggcagccuguacgacgacgacguggcccaguggaacaucggcagccugagaaccauccuggacaugguggagagagagugcggcaccaucaucgagggcgugaacacccccuaccuguacuucggcauguggaagaccaccuucgccuggcacaccgaggacauggaccuguacagcaucaacuaccugcacuucggcgagcccaagagcugguacgccaucccccccgagcacggcaagagacuggagagacuggccaucggcuucuuccccggcagcagccagggcugcgacgccuuccugagacacaagaugacccugaucagccccaucauccugaagaaguacggcauccccuucagcagaaucacccaggaggccggcgaguucaugaucaccuuccccuacggcuaccacgccggcuucaaccacggcuucaacugcgccgagagcaccaacuucgccacccugagauggaucgacuacggcaagguggccacccagugcaccugcagaaaggacauggugaagaucagcauggacguguucgugagaauccugcagcccgagagauacgagcuguggaagcagggcaaggaccugaccgugcuggaccacaccagacccaccgcccugaccagccccgagcugagcagcuggagcgccagcagagccagccugaaggccaagcugcugagaagaagccacagaaagagaagccagcccaagaagcccaagcccgaggaccccaaguuccccggcgagggcaccgccggcgccgcccugcuggaggaggccggcggcagcgugaaggaggaggccggccccgagguggaccccgaggaggaggaggaggagccccagccccugccccacggcagagaggccgagggcgccgaggaggacggcagaggcaagcugagacccaccaaggccaagagcgagagaaagaagaagagcuucggccugcugcccccccagcugccccccccccccgcccacuuccccagcgaggaggcccuguggcugcccagcccccuggagccccccgugcugggccccggccccgccgccauggaggagagcccccugcccgccccccugaacguggugccccccgaggugcccagcgaggagcuggaggccaagcccagacccaucauccccaugcuguacguggugcccagacccggcaaggccgccuucaaccaggagcacgugagcugccagcaggccuucgagcacuucgcccagaagggccccaccuggaaggagcccgugagccccauggagcugaccggccccgaggacggcgccgccagcagcggcgccggcagaauggagaccaaggccagagccggcgagggccaggcccccagcaccuucagcaagcugaagauggagaucaagaagagcagaagacacccccugggcagaccccccaccagaagcccccugagcguggugaagcaggaggccagcagcgacgaggaggccagccccuucagcggcgaggaggacgugagcgaccccgacgcccugagaccccugcugagccugcaguggaagaacagagccgccagcuuccaggccgagagaaaguucaacgccgccgccgccagaaccgagcccuacugcgccaucugcacccuguucuaccccuacugccaggcccugcagaccgagaaggaggcccccaucgccagccugggcgagggcugccccgccacccugcccagcaagagcagacagaagaccagaccccugauccccgagaugugcuucaccagcggcggcgagaacaccgagccccugcccgccaacagcuacaucggcgacgacggcaccagcccccugaucgccugcggcaagugcugccugcaggugcacgccagcugcuacggcaucagacccgagcuggugaacgagggcuggaccugcagcagaugcgccgcccacgccuggaccgccgagugcugccugugcaaccugagaggcggcgcccugcagaugaccaccgacagaagauggauccacgugaucugcgccaucgccgugcccgaggccagauuccugaacgugaucgagagacaccccguggacaucagcgccauccccgagcagagauggaagcugaagugcguguacugcagaaagagaaugaagaaggugagcggcgccugcauccagugcagcuacgagcacugcagcaccagcuuccacgugaccugcgcccacgccgccggcgugcugauggagcccgacgacuggcccuacguggugagcaucaccugccugaagcacaagagcggcggccacgccgugcagcugcugagagccgugagccugggccagguggugaucaccaagaacagaaacggccuguacuacagaugcagagugaucggcgccgccagccagaccugcuacgaggugaacuucgacgacggcagcuacagcgacaaccuguaccccgagagcaucaccagcagagacugcgugcagcugggcccccccagcgagggcgagcugguggagcugagauggaccgacggcaaccuguacaaggccaaguucaucagcagcgugaccagccacaucuaccagguggaguucgaggacggcagccagcugaccgugaagagaggcgacaucuucacccuggaggaggagcugcccaagagagugagaagcagacugagccugagcaccggcgccccccaggagcccgccuucagcggcgaggaggccaaggccgccaagagacccagagugggcaccccccuggccaccgaggacagcggcagaagccaggacuacguggccuucguggagagccugcugcaggugcagggcagacccggcgcccccuucuaa

SEQ ID NO: 18867 - RNA, 2442 nt, Artificial Sequence
  KDM4C__Homo_sapiens__NP_001140167
auggagguggccgagguggagagcccccugaaccccagcugcaagaucaugaccuucagacccagcauggaggaguucagagaguucaacaaguaccuggccuacauggagagcaagggcgcccacagagccggccuggccaaggugaucccccccaaggaguggaagcccagacagugcuacgacgacaucgacaaccugcugauccccgcccccauccagcagauggugaccggccagagcggccuguucacccaguacaacauccagaagaaggccaugaccgugaaggaguucagacagcuggccaacagcggcaaguacugcacccccagauaccuggacuacgaggaccuggagagaaaguacuggaagaaccugaccuucguggcccccaucuacggcgccgacaucaacggcagcaucuacgacgagggcguggacgaguggaacaucgccagacugaacaccgugcuggacgugguggaggaggagugcggcaucagcaucgagggcgugaacacccccuaccuguacuucggcauguggaagaccaccuucgccuggcacaccgaggacauggaccuguacagcaucaacuaccugcacuucggcgagcccaagagcugguacgccaucccccccgagcacggcaagagacuggagagacuggcccagggcuucuuccccagcagcagccagggcugcgacgccuuccugagacacaagaugacccugaucagccccagcgugcugaagaaguacggcauccccuucgacaagaucacccaggaggccggcgaguucaugaucaccuuccccuacggcuaccacgccggcuucaaccacggcuucaacugcgccgagagcaccaacuucgccaccgugagauggaucgacuacggcaagguggccaagcugugcaccugcagaaaggacauggugaagaucagcauggacaucuucgugagaaaguuccagcccgacagauaccagcuguggaagcagggcaaggacaucuacaccaucgaccacaccaagcccacccccgccagcacccccgaggugaaggccuggcugcagagaagaagaaaggugagaaaggccagcagaagcuuccagugcgccagaagcaccagcaagagacccaaggccgacgaggaggaggaggugagcgacgagguggacggcgccgaggugcccaaccccgacagcgugaccgacgaccugaaggugagcgagaagagcgaggccgccgugaagcugagaaacaccgaggccagcagcgaggaggagagcagcgccagcagaaugcagguggagcagaaccugagcgaccacaucaagcugagcggcaacagcugccugagcaccagcgugaccgaggacaucaagaccgaggacgacaaggccuacgccuacagaagcgugcccagcaucagcagcgaggccgacgacagcaucccccugagcagcggcuacgagaagcccgagaagagcgaccccagcgagcugagcuggcccaagagccccgagagcugcagcagcguggccgagagcaacggcgugcugaccgagggcgaggagagcgacguggagagccacggcaacggccuggagcccggcgagauccccgccgugcccagcggcgagagaaacagcuucaaggugcccagcaucgccgagggcgagaacaagaccagcaagagcuggagacacccccugagcagaccccccgccagaagccccaugacccuggugaagcagcaggcccccagcgacgaggagcugcccgaggugcugagcaucgaggaggagguggaggagaccgagagcugggccaagccccugauccaccuguggcagaccaagagccccaacuucgccgccgagcaggaguacaacgccaccguggccagaaugaagccccacugcgccaucugcacccugcugaugcccuaccacaagcccgacagcagcaacgaggagaacgacgccagaugggagaccaagcuggacgagguggugaccagcgagggcaagaccaagccccugauccccgagaugugcuucaucuacagcgaggagaacaucgaguacagcccccccaacgccuuccuggaggaggacggcaccagccugcugaucagcugcgccaagugcugcgugagagugcacgccagcugcuacggcauccccagccacgagaucugcgacggcuggcugugcgccagaugcaagagaaacgccuggaccgccgagugcugccugugcaaccugagaggcggcgcccugaagcagaccaagaacaacaagugggcccacgugaugugcgccguggccgugcccgaggugagauucaccaacgugcccgagagaacccagaucgacgugggcagaaucccccugcagagacugaagcugggcagacugggcaucuaa

SEQ ID NO: 18868 - RNA, 5073 nt, Artificial Sequence
  KDM5A__Homo_sapiens__NP_001036068
auggccggcgugggccccggcggcuacgccgccgaguucgugcccccccccgagugccccguguucgagcccagcugggaggaguucaccgacccccugagcuucaucggcagaaucagaccccuggccgagaagaccggcaucugcaagaucagaccccccaaggacuggcagccccccuucgccugcgaggugaagagcuucagauucacccccagagugcagagacugaacgagcuggaggccaugaccagagugagacuggacuuccuggaccagcuggccaaguucugggagcugcagggcagcacccugaagauccccgugguggagagaaagauccuggaccuguacgcccugagcaagaucguggccagcaagggcggcuucgagauggugaccaaggagaagaaguggagcaaggugggcagcagacugggcuaccugcccggcaagggcaccggcagccugcugaagagccacuacgagagaauccuguaccccuacgagcuguuccagagcggcgugagccugaugggcgugcagaugcccaaccuggaccugaaggagaagguggagcccgaggugcugagcaccgacacccagaccagccccgagcccggcaccagaaugaacauccugcccaagagaaccagaagagugaagacccagagcgagagcggcgacgugagcagaaacaccgagcugaagaagcugcagaucuucggcgccggccccaagguggugggccuggccaugggcaccaaggacaaggaggacgaggugaccagaagaagaaaggugaccaacagaagcgacgccuucaacaugcagaugagacagagaaagggcacccugagcgugaacuucguggaccuguacgugugcauguucugcggcagaggcaacaacgaggacaagcugcugcugugcgacggcugcgacgacagcuaccacaccuucugccugauccccccccugcccgacgugcccaagggcgacuggagaugccccaagugcguggccgaggagugcagcaagcccagagaggccuucggcuucgagcaggccgugagagaguacacccugcagagcuucggcgagauggccgacaacuucaagagcgacuacuucaacaugcccgugcacauggugcccaccgagcugguggagaaggaguucuggagacuggugagcagcaucgaggaggacgugaucguggaguacggcgccgacaucagcagcaaggacuucggcagcggcuuccccgugaaggacggcagaagaaagauccugcccgaggaggaggaguacgcccugagcggcuggaaccugaacaacaugcccgugcuggagcagagcgugcuggcccacaucaacguggacaucagcggcaugaaggugcccuggcuguacgugggcaugugcuucagcagcuucugcuggcacaucgaggaccacuggagcuacagcaucaacuaccugcacuggggcgagcccaagaccugguacggcgugcccagccacgccgccgagcagcuggaggaggugaugagagagcuggcccccgagcuguucgagagccagcccgaccugcugcaccagcuggugaccaucaugaaccccaacgugcugauggagcacggcgugcccguguacagaaccaaccagugcgccggcgaguucguggugaccuuccccagagccuaccacagcggcuucaaccagggcuacaacuucgccgaggccgugaacuucugcaccgccgacuggcugcccaucggcagacagugcgugaaccacuacagaagacugagaagacacugcguguucagccacgaggagcugaucuucaagauggccgccgaccccgagugccuggacgugggccuggccgccauggugugcaaggagcugacccugaugaccgaggaggagaccagacugagagagagcguggugcagaugggcgugcugaugagcgaggaggagguguucgagcuggugcccgacgacgagagacagugcagcgccugcagaaccaccugcuuccugagcgcccugaccugcagcugcaaccccgagagacuggugugccuguaccaccccaccgaccugugccccugccccaugcagaagaagugccugagauacagauacccccuggaggaccugcccagccugcuguacggcgugaaggugagagcccagagcuacgacaccugggugagcagagugaccgaggcccugagcgccaacuucaaccacaagaaggaccugaucgagcugagagugaugcuggaggacgccgaggacagaaaguaccccgagaacgaccuguucagaaagcugagagacgccgugaaggaggccgagaccugcgccagcguggcccagcugcugcugagcaagaagcagaagcacagacagagccccgacagcggcagaaccagaaccaagcugaccguggaggagcugaaggccuucgugcagcagcuguucagccugcccugcgugaucagccaggccagacaggugaagaaccugcuggacgacguggaggaguuccacgagagagcccaggaggccaugauggacgagacccccgacagcagcaagcugcagaugcugaucgacaugggcagcagccuguacguggagcugcccgagcugcccagacugaagcaggagcugcagcaggccagauggcuggacgaggugagacugacccugagcgacccccagcaggugacccuggacgugaugaagaagcugaucgacagcggcgugggccuggccccccaccacgccguggagaaggccauggccgagcugcaggagcugcugaccgugagcgagagaugggaggagaaggccaaggugugccugcaggccagacccagacacagcguggccagccuggagagcaucgugaacgaggccaagaacauccccgccuuccugcccaacgugcugagccugaaggaggcccugcagaaggccagagaguggaccgccaagguggaggccauccagagcggcagcaacuacgccuaccuggagcagcuggagagccugagcgccaagggcagacccauccccgugagacuggaggcccugccccagguggagagccagguggccgccgccagagccuggagagagagaaccggcagaaccuuccugaagaagaacagcagccacacccugcugcaggugcugagccccagaaccgacaucggcguguacggcagcggcaagaacagaagaaagaaggugaaggagcugaucgagaaggagaaggagaaggaccuggaccuggagccccugagcgaccuggaggagggccuggaggagaccagagacaccgccauggugguggccguguucaaggagagagagcagaaggagaucgaggccaugcacagccugagagccgccaaccuggccaagaugaccaugguggacagaaucgaggaggugaaguucugcaucugcagaaagaccgccagcggcuucaugcugcagugcgagcugugcaaggacugguuccacaacagcugcgugccccugcccaagagcagcagccagaagaagggcagcagcuggcaggccaaggaggugaaguuccugugcccccugugcaugagaagcagaagacccagacuggagaccauccugagccugcuggugagccugcagaagcugcccgugagacugcccgagggcgaggcccugcagugccugaccgagagagccaugagcuggcaggacagagccagacaggcccuggccaccgacgagcugagcagcgcccuggccaagcugagcgugcugagccagagaaugguggagcaggccgccagagagaagaccgagaagaucaucagcgccgagcugcagaaggccgccgccaaccccgaccugcagggccaccugcccagcuuccagcagagcgccuucaacagaguggugagcagcgugagcagcagccccagacagaccauggacuacgacgacgaggagaccgacagcgacgaggacaucagagagaccuacggcuacgacaugaaggacaccgccagcgugaagagcagcagcagccuggagcccaaccuguucugcgacgaggagauccccaucaagagcgaggagguggugacccacauguggaccgcccccagcuucugcgccgagcacgccuacagcagcgccagcaagagcugcagccagggcagcagcacccccagaaagcagcccagaaagagcccccuggugcccagaagccuggagccccccgugcuggagcugagccccggcgccaaggcccagcuggaggagcugaugauggugggcgaccugcuggaggugagccuggacgagacccagcacaucuggagaauccugcaggccacccacccccccagcgaggacagauuccugcacaucauggaggacgacagcauggaggagaagccccugaaggugaagggcaaggacagcagcgagaagaagagaaagagaaagcuggagaagguggagcagcuguucggcgagggcaagcagaagagcaaggagcugaagaagauggacaagcccagaaagaagaagcugaagcugggcgccgacaagagcaaggagcugaacaagcuggccaagaagcuggccaaggaggaggagagaaagaagaagaaggagaaggccgccgccgccaagguggagcuggugaaggagagcaccgagaagaagagagagaagaaggugcuggacauccccagcaaguacgacuggagcggcgccgaggagagcgacgacgagaacgccgugugcgccgcccagaacugccagagacccugcaaggacaagguggacugggugcagugcgacggcggcugcgacgagugguuccaccaggugugcgugggcgugagccccgagauggccgagaacgaggacuacaucugcaucaacugcgccaagaagcagggccccgugagccccggccccgcccccccccccagcuucaucaugagcuacaagcugcccauggaggaccugaaggagaccagcuaa

SEQ ID NO: 18869 - RNA, 4635 nt, Artificial Sequence
  KDM5B__Homo_sapiens__NP_006609
auggaggccgccaccacccugcaccccggccccagacccgcccugccccugggcggccccggcccccugggcgaguuccugcccccccccgagugccccguguucgagcccagcugggaggaguucgccgaccccuucgccuucauccacaagaucagacccaucgccgagcagaccggcaucugcaaggugagacccccccccgacuggcagccccccuucgccugcgacguggacaagcugcacuucacccccagaauccagagacugaacgagcuggaggcccagaccagagugaagcugaacuuccuggaccagaucgccaaguacugggagcugcagggcagcacccugaagaucccccacguggagagaaagauccuggaccuguuccagcugaacaagcugguggccgaggagggcggcuucgccguggugugcaaggacagaaaguggaccaagaucgccaccaagaugggcuucgcccccggcaaggccgugggcagccacaucagaggccacuacgagagaauccugaaccccuacaaccuguuccugagcggcgacagccugagaugccugcagaagcccaaccugaccaccgacaccaaggacaaggaguacaagccccacgacaucccccagagacagagcgugcagcccagcgagaccugcccccccgccagaagagccaagagaaugagagccgaggccaugaacaucaagaucgagcccgaggagaccaccgaggccagaacccacaaccugagaagaagaaugggcugccccacccccaagugcgagaacgagaaggagaugaagagcagcaucaagcaggagcccaucgagagaaaggacuacaucguggagaacgagaaggagaagcccaagagcagaagcaagaaggccaccaacgccguggaccuguacgugugccugcugugcggcagcggcaacgacgaggacagacugcugcugugcgacggcugcgacgacagcuaccacaccuucugccugauccccccccugcacgacgugcccaagggcgacuggagaugccccaagugccuggcccaggagugcagcaagccccaggaggccuucggcuucgagcaggccgccagagacuacacccugagaaccuucggcgagauggccgacgccuucaagagcgacuacuucaacaugcccgugcacauggugcccaccgagcugguggagaaggaguucuggagacuggugagcaccaucgaggaggacgugaccguggaguacggcgccgacaucgccagcaaggaguucggcagcggcuuccccgugagagacggcaagaucaagcugagccccgaggaggaggaguaccuggacagcggcuggaaccugaacaacaugcccgugauggagcagagcgugcuggcccacaucaccgccgacaucugcggcaugaagcugcccuggcuguacgugggcaugugcuucagcagcuucugcuggcacaucgaggaccacuggagcuacagcaucaacuaccugcacuggggcgagcccaagaccugguacggcgugcccggcuacgccgccgagcagcuggagaacgugaugaagaagcuggcccccgagcuguucgugagccagcccgaccugcugcaccagcuggugaccaucaugaaccccaacacccugaugacccacgaggugcccguguacagaaccaaccagugcgccggcgaguucgugaucaccuuccccagagccuaccacagcggcuucaaccagggcuucaacuucgccgaggccgugaacuucugcaccguggacuggcugccccugggcagacagugcguggagcacuacagacugcugcacagauacugcguguucagccacgacgagaugaucugcaagauggccagcaaggccgacgugcuggacguggugguggccagcaccgugcagaaggacauggccaucaugaucgaggacgagaaggcccugagagagaccgugagaaagcugggcgugaucgacagcgagagaauggacuucgagcugcugcccgacgacgagagacagugcgugaagugcaagaccaccugcuucaugagcgccaucagcugcagcugcaagcccggccugcuggugugccugcaccacgugaaggagcugugcagcugcccccccuacaaguacaagcugagauacagauacacccuggacgaccuguaccccaugaugaacgcccugaagcugagagccgagagcuacaacgagugggcccugaacgugaacgaggcccuggaggccaagaucaacaagaagaagagccuggugagcuucaaggcccugaucgaggagagcgagaugaagaaguuccccgacaacgaccugcugagacaccugagacuggugacccaggacgccgagaagugcgccagcguggcccagcagcugcugaacggcaagagacagaccagauacagaagcggcggcggcaagagccagaaccagcugaccgugaacgagcugagacaguucgugacccagcuguacgcccugcccugcgugcugagccagaccccccugcugaaggaccugcugaacagaguggaggacuuccagcagcacagccagaagcugcugagcgaggagacccccagcgccgccgagcugcaggaccugcuggacgugagcuucgaguucgacguggagcugccccagcuggccgagaugagaaucagacuggagcaggccagauggcuggaggaggugcagcaggccugccuggaccccagcagccugacccuggacgacaugagaagacugaucgaccugggcgugggccuggcccccuacagcgccguggagaaggccauggccagacugcaggagcugcugaccgugagcgagcacugggacgacaaggccaagagccugcugaaggccagacccagacacagccugaacagccuggccaccgccgugaaggagaucgaggagauccccgccuaccugcccaacggcgccgcccugaaggacagcgugcagagagccagagacuggcugcaggacguggagggccugcaggccggcggcagagugcccgugcuggacacccugaucgagcuggugaccagaggcagaagcauccccgugcaccugaacagccugcccagacuggagacccugguggccgaggugcaggccuggaaggagugcgccgugaacaccuuccugaccgagaacagccccuacagccugcuggaggugcugugccccagaugcgacaucggccugcugggccugaagagaaagcagagaaagcugaaggagccccugcccaacggcaagaagaagagcaccaagcuggagagccugagcgaccuggagagagcccugaccgagagcaaggagaccgccagcgccauggccacccugggcgaggccagacugagagagauggaggcccugcagagccugagacuggccaacgagggcaagcugcugagcccccugcaggacguggacaucaagaucugccugugccagaaggcccccgccgcccccaugauccagugcgagcugugcagagacgccuuccacaccagcugcguggccgugcccagcaucagccagggccugagaaucuggcugugcccccacugcagaagaagcgagaagcccccccuggagaagauccugccccugcuggccagccugcagagaaucagagugagacugcccgagggcgacgcccugagauacaugaucgagagaaccgugaacuggcagcacagagcccagcagcugcugagcagcggcaaccugaaguucgugcaggacagagugggcagcggccugcuguacagcagauggcaggccagcgccggccaggugagcgacaccaacaaggugagccagccccccggcaccaccagcuucagccugcccgacgacugggacaacagaaccagcuaccugcacagccccuucagcaccggcagaagcugcaucccccugcacggcgugagccccgaggugaacgagcugcugauggaggcccagcugcugcaggugagccugcccgagauccaggagcuguaccagacccugcuggccaagcccagccccgcccagcagaccgacagaagcagccccgugagacccagcagcgagaagaacgacugcugcagaggcaagagagacggcaucaacagccuggagagaaagcugaagagaagacuggagagagagggccugagcagcgagagaugggagagagugaagaagaugagaacccccaagaagaagaagaucaagcugagccaccccaaggacaugaacaacuucaagcuggagagagagagaagcuacgagcuggugagaagcgccgagacccacagccugcccagcgacaccagcuacagcgagcaggaggacagcgaggacgaggacgccaucugccccgccgugagcugccugcagcccgagggcgacgagguggacugggugcagugcgacggcagcugcaaccagugguuccaccaggugugcgugggcgugagccccgagauggccgagaaggaggacuacaucugcgugagaugcaccgugaaggacgcccccagcagaaaguaa

SEQ ID NO: 18870 - RNA, 4140 nt, Artificial Sequence
  KDM5C__Homo_sapiens__NP_001140174
auggagcccggcagcgacgacuuccugcccccccccgagugccccguguucgagcccagcugggccgaguucagagacccccugggcuacaucgccaagaucagacccaucgccgagaagagcggcaucugcaagaucagaccccccgccaucgugguggaggagggcggcuacgaggccaucugcaaggacagaagaugggccagaguggcccagagacugaacuacccccccggcaagaacaucggcagccugcugagaagccacuacgagagaaucguguaccccuacgagauguaccagagcggcgccaaccuggugcagugcaacaccagacccuucgacaacgaggagaaggacaaggaguacaagccccacagcaucccccugagacagagcgugcagcccagcaaguucaacagcuacggcagaagagccaagagacugcagcccgaccccgagcccaccgaggaggacaucgagaagaaccccgagcugaagaagcugcagaucuacggcgccggccccaagaugaugggccugggccugauggccaaggacaagacccugagaaagaaggacaaggagggccccgagugcccccccaccgugguggugaaggaggagcugggcggcgacgugaagguggagagcaccagccccaagaccuuccuggagagcaaggaggagcugagccacagccccgagcccugcaccaagaugaccaugagacugagaagaaaccacagcaacgcccaguucaucgagagcuacgugugcagaaugugcagcagaggcgacgaggacgacaagcugcugcugugcgacggcugcgacgacaacuaccacaucuucugccugcugcccccccugcccgagauccccaagggcguguggagaugccccaagugcgugauggccgagugcaagagaccccccgaggccuucggcuucgagcaggccaccagagaguacacccugcagagcuucggcgagauggccgacagcuucaaggccgacuacuucaacaugcccgugcacauggugcccaccgagcugguggagaaggaguucuggagacuggugaacagcaucgaggaggacgugaccguggaguacggcgccgacauccacagcaaggaguucggcagcggcuuccccgugagcgacagcaagagacaccugacccccgaggaggaggaguacgccaccagcggcuggaaccugaacgugaugcccgugcuggagcagagcgugcugugccacaucaacgccgacaucagcggcaugaaggugcccuggcuguacgugggcaugguguucagcgccuucugcuggcacaucgaggaccacuggagcuacagcaucaacuaccugcacuggggcgagcccaagaccugguacggcgugcccagccuggccgccgagcaccuggaggaggugaugaagaagcugacccccgagcuguucgacagccagcccgaccugcugcaccagcuggugacccugaugaaccccaacacccugaugagccacggcgugcccguggugagaaccaaccagugcgccggcgaguucgugaucaccuuccccagagccuaccacagcggcuucaaccagggcuacaacuucgccgaggccgugaacuucugcaccgccgacuggcugcccgccggcagacagugcaucgagcacuacagaagacugagaagauacugcguguucagccacgaggagcugaucugcaagauggccgccugccccgagaagcuggaccugaaccuggccgccgccgugcacaaggagauguucaucauggugcaggaggagagaagacugagaaaggcccugcuggagaagggcaucaccgaggccgagagagaggccuucgagcugcugcccgacgacgagagacagugcaucaagugcaagaccaccugcuuccugagcgcccuggccugcuacgacugccccgacggccuggugugccugagccacaucaacgaccugugcaagugcagcagcagcagacaguaccugagauacagauacacccuggacgagcugcccgccaugcugcacaagcugaaggugagagccgagagcuucgacaccugggccaacaaggugagaguggcccuggagguggaggacggcagaaagagaagccuggaggagcugagagcccuggagagcgaggccagagagagaagauuccccaacagcgagcugcugcagcagcugaagaacugccugagcgaggccgaggccugcgugagcagagcccugggccuggugagcggccaggaggccggcccccacagaguggccggccugcagaugacccugaccgagcugagagccuuccuggaccagaugaacaaccugcccugcgccaugcaccagaucggcgacgugaagggcgugcuggagcagguggaggccuaccaggccgaggccagagaggcccuggccagccugcccagcagccccggccugcugcagagccugcuggagagaggcagacagcugggcguggaggugcccgaggcccagcagcugcagagacagguggagcaggccagauggcuggacgaggugaagagaacccuggcccccagcgccagaagaggcacccuggccgugaugagaggccugcugguggccggcgccagcguggcccccagccccgccguggacaaggcccaggccgagcugcaggagcugcugaccaucgccgagagaugggaggagaaggcccaccugugccuggaggccagacagaagcacccccccgccacccuggaggccaucaucagagaggccgagaacauccccgugcaccugcccaacauccaggcccugaaggaggcccuggccaaggccagagccuggaucgccgacguggacgagauccagaacggcgaccacuaccccugccuggacgaccuggagggccugguggccgugggcagagaccugcccgugggccuggaggagcugagacagcuggagcugcaggugcugaccgcccacagcuggagagagaaggccagcaagaccuuccugaagaagaacagcugcuacacccugcuggaggugcugugccccugcgccgacgccggcagcgacagcaccaagagaagcagauggauggagaaggagcugggccuguacaagagcgacaccgagcugcugggccugagcgcccaggaccugagagaccccggcagcgugaucguggccuucaaggagggcgagcagaaggagaaggagggcauccugcagcugagaagaaccaacagcgccaagcccagcccccuggccagcagcagcaccgccagcagcaccaccagcaucugcgugugcggccaggugcuggccggcgccggcgcccugcagugcgaccugugccaggacugguuccacggcagaugcgugagcgugcccagacugcugagcagccccagacccaaccccaccagcagcccccugcuggccuggugggagugggacaccaaguuccugugcccccugugcaugagaagcagaagacccagacuggagaccauccuggcccugcugguggcccugcagagacugcccgugagacugcccgagggcgaggcccugcagugccugaccgagagagccaucagcuggcagggcagagccagacaggcccuggccagcgaggacgugaccgcccugcugggcagacuggccgagcugagacagagacugcaggccgagcccagacccgaggagccccccaacuaccccgccgcccccgccagcgacccccugagagagggcagcggcaaggacaugcccaaggugcagggccugcuggagaacggcgacagcgugaccagccccgagaagguggcccccgaggagggcagcgaccuggagcugcugagcagccugcugccccagcugaccggccccgugcuggagcugcccgaggccaccagagccccccuggaggagcugaugauggagggcgaccugcuggaggugacccuggacgagaaccacagcauccccgagagccuggacuucugcauccugacccccagauacugcagcgaccugagcagcuggggccccgcccccggcguguucccccccugguaa

SEQ ID NO: 18871 - RNA, 4713 nt, Artificial Sequence
  KDM5D__Homo_sapiens__NP_001140177
auggagcccggcugcgacgaguuccugcccccccccgagugccccguguucgagcccagcugggccgaguuccaggacccccugggcuacaucgccaagaucagacccaucgccgagaagagcggcaucugcaagaucagaccccccgccgacuggcagccccccuucgccguggagguggacaacuucagauucacccccagagugcagagacugaacgagcuggaggcccagaccagagugaagcugaacuaccuggaccagaucgccaaguucugggagauccagggcagcagccugaagauccccaacguggagagaaagauccuggaccuguacagccugagcaagaucgugaucgaggagggcggcuacgaggccaucugcaaggacagaagaugggccagaguggcccagagacugcacuacccccccggcaagaacaucggcagccugcugagaagccacuacgagagaaucaucuaccccuacgagauguuccagagcggcgccaaccacgugcagugcaacacccaccccuucgacaacgaggugaaggacaaggaguacaagccccacagcaucccccugagacagagcgugcagcccagcaaguucagcagcuacagcagaagagccaagagacugcagcccgaccccgagcccaccgaggaggacaucgagaagcaccccgagcugaagaagcugcagaucuacggccccggccccaagaugaugggccugggccugauggccaaggacaaggacaagaccgugcacaagaaggugaccugcccccccaccgugaccgugaaggacgagcagagcggcggcggcaacgugagcagcacccugcugaagcagcaccugagccuggagcccugcaccaagaccaccaugcagcugagaaagaaccacagcagcgcccaguucaucgacagcuacaucugccaggugugcagcagaggcgacgaggacgacaagcugcuguucugcgacggcugcgacgacaacuaccacaucuucugccugcugcccccccugcccgagauccccagaggcaucuggagaugccccaagugcauccuggccgagugcaagcagccccccgaggccuucggcuucgagcaggccacccaggaguacagccugcagagcuucggcgagauggccgacagcuucaagagcgacuacuucaacaugcccgugcacauggugcccaccgagcugguggagaaggaguucuggagacuggugagcagcaucgaggaggacgugaccguggaguacggcgccgacauccacagcaaggaguucggcagcggcuuccccgugagcaacagcaagcagaaccugagccccgaggagaagagacagagccugaccgugcugaccagacugaucagcagcuucugggcccaggccgugcugccccccuggccccccaaggugcugggccugcaggaguacgccaccagcggcuggaaccugaacgugaugcccgugcuggaccagagcgugcugugccacaucaacgccgacaucagcggcaugaaggugcccuggcuguacgugggcaugguguucagcgccuucugcuggcacaucgaggaccacuggagcuacagcaucaacuaccugcacuggggcgagcccaagaccugguacggcgugcccagccuggccgccgagcaccuggaggaggugaugaagaugcugacccccgagcuguucgacagccagcccgaccugcugcaccagcuggugacccugaugaaccccaacacccugaugagccacggcgugcccguggugagaaccaaccagugcgccggcgaguucgugaucaccuuccccagagccuaccacagcggcuucaaccagggcuacaacuucgccgaggccgugaacuucugcaccgccgacuggcugcccgccggcagacagugcaucgagcacuacagaagacugagaagauacugcguguucagccacgaggagcugaucugcaagauggccgccuuccccgagacccuggaccugaaccuggccguggccgugcacaaggagauguucaucauggugcaggaggagagaagacugagaaaggcccugcuggagaagggcgugaccgaggccgagagagaggccuucgagcugcugcccgacgacgagagacagugcaucaagugcaagaccaccugcuuccugagcgcccuggccugcuacgacugccccgacggccuggugugccugagccacaucaacgaccugugcaagugcagcagcagcagacaguaccugagauacagauacacccuggacgagcugcccaccaugcugcacaagcugaagaucagagccgagagcuucgacaccugggccaacaaggugagaguggcccuggagguggaggacggcagaaagagaagcuucgaggagcugagagcccuggagagcgaggccagagagagaagauuccccaacagcgagcugcugcagagacugaagaacugccugagcgagguggaggccugcaucgcccaggugcugggccuggugagcggccagguggccagaauggacaccccccagcugacccugaccgagcugagagugcugcuggagcagaugggcagccugcccugcgccaugcaccagaucggcgacgugaaggacgugcuggagcagguggaggccuaccaggccgaggccagagaggcccuggccacccugcccagcagccccggccugcugagaagccugcuggagagaggccagcagcugggcguggaggugcccgaggcccaccagcugcagcagcagguggagcaggcccaguggcuggacgaggugaagcaggcccuggcccccagcgcccacagaggcagccuggugaucaugcagggccugcuggugaugggcgccaagaucgccagcagccccagcguggacaaggccagagccgagcugcaggagcugcugaccaucgccgagagaugggaggagaaggcccacuucugccuggaggccagacagaagcacccccccgccacccuggaggccaucaucagagagaccgagaacauccccgugcaccugcccaacauccaggcccugaaggaggcccugaccaaggcccaggccuggaucgccgacguggacgagauccagaacggcgaccacuaccccugccuggacgaccuggagggccugguggccgugggcagagaccugcccgugggccuggaggagcugagacagcuggagcugcaggugcugaccgcccacagcuggagagagaaggccagcaagaccuuccugaagaagaacagcugcuacacccugcuggaggugcugugccccugcgccgacgccggcagcgacagcaccaagagaagcagauggauggagaaggcccugggccuguaccagugcgacaccgagcugcugggccugagcgcccaggaccugagagaccccggcagcgugaucguggccuucaaggagggcgagcagaaggagaaggagggcauccugcagcugagaagaaccaacagcgccaagcccagcccccuggcccccagccugauggccagcagccccaccagcaucugcgugugcggccaggugcccgccggcgugggcgugcugcagugcgaccugugccaggacugguuccacggccagugcgugagcgugccccaccugcugaccagccccaagcccagccugaccagcagcccccugcuggccuggugggagugggacaccaaguuccugugcccccugugcaugagaagcagaagacccagacuggagaccauccuggcccugcugguggcccugcagagacugcccgugagacugcccgagggcgaggcccugcagugccugaccgagagagccaucggcuggcaggacagagccagaaaggcccuggccagcgaggacgugaccgcccugcugagacagcuggccgagcugagacagcagcugcaggccaagcccagacccgaggaggccagcguguacaccagcgccaccgccugcgaccccaucagagagggcagcggcaacaacaucagcaaggugcagggccugcuggagaacggcgacagcgugaccagccccgagaacauggcccccggcaagggcagcgaccuggagcugcugagcagccugcugccccagcugaccggccccgugcuggagcugcccgaggccaucagagccccccuggaggagcugaugauggagggcgaccugcuggaggugacccuggacgagaaccacagcaucuggcagcugcugcaggccggccagccccccgaccuggacagaaucagaacccugcuggagcuggagaaguucgagcaccagggcagcagaaccagaagcagagcccuggagagaagaagaagaagacagaagguggaccagggcagaaacguggagaaccuggugcagcaggagcugcagagcaagagagccagaagcagcggcaucaugagccaggugggcagagaggaggagcacuaccaggagaaggccgacagagagaacauguuccugacccccagcaccgaccacagccccuuccugaagggcaaccagaacagccugcagcacaaggacagcggcagcagcgccgccugccccagccugaugccccugcugcagcugagcuacagcgacgagcagcagcuguaa

SEQ ID NO: 18872 - RNA, 4362 nt, Artificial Sequence
  KDM6A__Homo_sapiens__NP_001278344
augaagagcugcggcgugagccuggccaccgccgccgccgccgccgccgccuucggcgacgaggagaagaagauggccgccggcaaggccagcggcgagagcgaggaggccagccccagccugaccgccgaggagagagaggcccugggcggccuggacagcagacuguucggcuucgugagauuccacgaggacggcgccagaaccaaggcccugcugggcaaggccgugagaugcuacgagagccugauccugaaggccgagggcaagguggagagcgacuucuucugccagcugggccacuucaaccugcugcuggaggacuaccccaaggcccugagcgccuaccagagauacuacagccugcagagcgacuacuggaagaacgccgccuuccuguacggccugggccugguguacuuccacuacaacgccuuccagugggccaucaaggccuuccaggaggugcuguacguggaccccagcuucugcagagccaaggagauccaccugagacugggccugauguucaaggugaacaccgacuacgagagcagccugaagcacuuccagcuggcccugguggacugcaaccccugcacccugagcaacgccgagauccaguuccacaucgcccaccuguacgagacccagagaaaguaccacagcgccaaggaggccuacgagcagcugcugcagaccgagaaccugagcgcccaggugaaggccaccgugcugcagcagcugggcuggaugcaccacaccguggaccugcugggcgacaaggccaccaaggagagcuacgccauccaguaccugcagaagagccuggaggccgaccccaacagcggccagagcugguacuuccugggcagaugcuacagcagcaucggcaaggugcaggacgccuucaucagcuacagacagagcaucgacaagagcgaggccagcgccgacaccuggugcagcaucggcgugcuguaccagcagcagaaccagcccauggacgcccugcaggccuacaucugcgccgugcagcuggaccacggccacgccgccgccuggauggaccugggcacccuguacgagagcugcaaccagccccaggacgccaucaagugcuaccugaacgccaccagaagcaagagcugcagcaacaccagcgcccuggccgccagaaucaaguaccugcaggcccagcugugcaaccugccccagggcagccugcagaacaagaccaagcugcugcccagcaucgaggaggccuggagccugcccauccccgccgagcugaccagcagacagggcgccaugaacaccgcccagcaggccugcaagccccaccaccccaacaccgagcccgugcugggccugagccagacccccaucagccagcagagccugccccugcacaugauccccagcagccagguggacgaccugagcagccccgccaagagaaagagaaccagcagccccaccaagaacaccagcgacaacuggagcggcggccacgccgugagccacccccccgugcagcagcaggcccacagcuggugccugaccccccagaagcugcagcaccuggagcagcugagagccaacagaaacaaccugaaccccgcccagaagcugaugcuggagcagcuggagagccaguucgugcugaugcagcagcaccagaugagacccaccggcguggcccaggugagaagcaccggcauccccaacggccccaccgccgacagcagccugcccaccaacagcgugagcggccagcagccccagcuggcccugaccagagugcccagcgugagccagcccggcgugagacccgccugccccggccagccccuggccaacggccccuucagcgccggccacgugcccugcagcaccagcagaacccugggcagcaccgacaccauccugaucggcaacaaccacaucaccggcagcggcagcaacggcaacgugcccuaccugcagagaaacgcccugacccugccccacaacagaaccaaccugaccagcagcgccgaggagcccuggaagaaccagcugagcaacagcacccagggccugcacaagggccagagcagccacagcgccggccccaacggcgagagaccccugagcagcaccggccccagccagcaccugcaggccgccggcagcggcauccagaaccagaacggccaccccacccugcccagcaacagcgugacccagggcgccgcccugaaccaccugagcagccacaccgccaccagcggcggccagcagggcaucacccugaccaaggagagcaagcccagcggcaacauccugaccgugcccgagaccagcagacacaccggcgagacccccaacagcaccgccagcguggagggccugcccaaccacgugcaccagaugaccgccgacgccgugugcagccccagccacggcgacagcaagagccccggccugcugagcagcgacaacccccagcugagcgcccugcugaugggcaaggccaacaacaacgugggcaccggcaccugcgacaaggugaacaacauccaccccgccgugcacaccaagaccgacaacagcguggccagcagccccagcagcgccaucagcaccgccacccccagccccaagagcaccgagcagaccaccaccaacagcgugaccagccugaacagcccccacagcggccugcacaccaucaacggcgagggcauggaggagagccagagccccaugaagaccgaccugcugcuggugaaccacaagcccagcccccagaucauccccagcaugagcgugagcaucuaccccagcagcgccgaggugcugaaggccugcagaaaccugggcaagaacggccugagcaacagcagcauccugcuggacaagugccccccccccagaccccccagcagccccuaccccccccugcccaaggacaagcugaacccccccacccccagcaucuaccuggagaacaagagagacgccuucuuccccccccugcaccaguucugcaccaaccccaacaaccccgugaccgugaucagaggccuggccggcgcccugaagcuggaccugggccuguucagcaccaagacccugguggaggccaacaacgagcacaugguggaggugagaacccagcugcugcagcccgccgacgagaacugggaccccaccggcaccaagaagaucuggcacugcgagagcaacagaagccacaccaccaucgccaaguacgcccaguaccaggccagcagcuuccaggagagccugagagaggagaacgagaagagaagccaccacaaggaccacagcgacagcgagagcaccagcagcgacaacagcggcagaagaagaaagggccccuucaagaccaucaaguucggcaccaacaucgaccugagcgacgacaagaaguggaagcugcagcugcacgagcugaccaagcugcccgccuucgugagaguggugagcgccggcaaccugcugagccacgugggccacaccauccugggcaugaacaccgugcagcuguacaugaaggugcccggcagcagaacccccggccaccaggagaacaacaacuucugcagcgugaacaucaacaucggccccggcgacugcgagugguucguggugcccgagggcuacuggggcgugcugaacgacuucugcgagaagaacaaccugaacuuccugaugggcagcugguggcccaaccuggaggaccuguacgaggccaacgugcccguguacagauucauccagagacccggcgaccugguguggaucaacgccggcaccgugcacugggugcaggccaucggcuggugcaacaacaucgccuggaacgugggcccccugaccgccugccaguacaagcuggccguggagagauacgaguggaacaagcugcagagcgugaagagcaucgugcccauggugcaccugagcuggaacauggccagaaacaucaaggugagcgaccccaagcuguucgagaugaucaaguacugccugcugagaacccugaagcagugccagacccugagagaggcccugaucgccgccggcaaggagaucaucuggcacggcagaaccaaggaggagcccgcccacuacugcagcaucugcgagguggagguguucgaccugcuguucgugaccaacgagagcaacagcagaaagaccuacaucgugcacugccaggacugcgccagaaagaccagcggcaaccuggagaacuucguggugcuggagcaguacaagauggaggaccugaugcagguguacgaccaguucacccuggcccccccccugcccagcgccagcagcuaa

SEQ ID NO: 18873 - RNA, 5049 nt, Artificial Sequence
  KDM6B__Homo_sapiens__NP_001073893
augcacagagccguggacccccccggcgccagagccgccagagaggccuucgcccugggcggccugagcugcgccggcgccuggagcagcugccccccccaccccccccccagaagcgccuggcugcccggcggcagaugcagcgccagcaucggccagcccccccugcccgccccccugccccccagccacggcagcagcagcggccaccccagcaagcccuacuacgcccccggcgcccccacccccagaccccugcacggcaagcuggagagccugcacggcugcgugcaggcccugcugagagagcccgcccagcccggccugugggagcagcugggccagcuguacgagagcgagcacgacagcgaggaggccaccagaugcuaccacagcgcccugagauacggcggcagcuucgccgagcugggccccagaaucggcagacugcagcaggcccagcuguggaacuuccacaccggcagcugccagcacagagccaaggugcugcccccccuggagcagguguggaaccugcugcaccuggagcacaagagaaacuacggcgccaagagaggcggcccccccgugaagagagccgccgagccccccguggugcagcccgugccccccgccgcccugagcggccccagcggcgaggagggccugagccccggcggcaagagaagaagaggcugcaacagcgagcagaccggccugccccccggccugccccugcccccccccccccugccccccccccccccccccccccccccccccccccccccccugcccggccuggccaccagcccccccuuccagcugaccaagcccggccuguggagcacccugcacggcgacgccuggggccccgagagaaagggcagcgccccccccgagagacaggagcagagacacagccugccccaccccuaccccuaccccgcccccgccuacaccgcccacccccccggccacagacuggugcccgccgccccccccggccccggccccagaccccccggcgccgagagccacggcugccugcccgccaccagaccccccggcagcgaccugagagagagcagagugcagagaagcagaauggacagcagcgugagccccgccgccaccaccgccugcgugcccuacgcccccagcagaccccccggccugcccggcaccaccaccagcagcagcagcagcagcagcagcaacaccggccugagaggcguggagcccaaccccggcauccccggcgccgaccacuaccagacccccgcccuggaggugagccaccacggcagacugggccccagcgcccacagcagcagaaagcccuuccugggcgcccccgccgccaccccccaccugagccugccccccggccccagcagccccccccccccccccugccccagacugcugagacccccccccccccccgccuggcugaagggccccgccugcagagccgccagagaggacggcgagauccuggaggagcuguucuucggcaccgagggcccccccagacccgccccccccccccugccccacagagagggcuuccugggcccccccgccagcagauucagcgugggcacccaggacagccacaccccccccaccccccccacccccaccaccagcagcagcaacagcaacagcggcagccacagcagcagccccgccggccccgugagcuucccccccccccccuaccuggccagaagcaucgacccccugcccagaccccccagccccgcccagaacccccaggaccccccccuggugccccugacccuggcccugccccccgccccccccagcagcugccaccagaacaccagcggcagcuucagaagacccgagagccccagacccagagugagcuuccccaagacccccgaggugggccccggccccccccccggcccccugagcaaggccccccagcccgugccccccggcgugggcgagcugcccgccagaggccccagacuguucgacuucccccccaccccccuggaggaccaguucgaggagcccgccgaguucaagauccugcccgacggccuggccaacaucaugaagaugcuggacgagagcaucagaaaggaggaggagcagcagcagcacgaggccggcguggccccccagcccccccugaaggagcccuucgccagccugcagagccccuuccccaccgacaccgcccccaccaccaccgcccccgccguggccgugaccaccaccaccaccaccaccaccaccaccaccgccacccaggaggaggagaagaagcccccccccgcccugccccccccccccccccuggccaaguuccccccccccagccagccccagcccccccccccccccccccccagccccgccagccugcugaagagccuggccagcgugcuggagggccagaaguacugcuacagaggcaccggcgccgccgugagcaccagacccggcccccugcccaccacccaguacagccccggcccccccagcggcgccaccgcccugccccccaccagcgccgcccccagcgcccagggcagcccccagcccagcgccagcagcagcagccaguucagcaccagcggcggccccugggccagagagagaagagccggcgaggagcccgugcccggccccaugacccccacccagcccccccccccccugagccugccccccgccagaagcgagagcgaggugcuggaggagaucagcagagccugcgagacccugguggagagagugggcagaagcgccaccgaccccgccgaccccguggacaccgccgagcccgccgacagcggcaccgagagacugcugccccccgcccaggccaaggaggaggccggcggcguggccgccgugagcggcagcugcaagagaagacagaaggagcaccagaaggagcacagaagacacagaagagccugcaaggacagcgugggcagaagacccagagagggcagagccaaggccaaggccaaggugcccaaggagaagagcagaagagugcugggcaaccuggaccugcagagcgaggagauccagggcagagagaagagcagacccgaccugggcggcgccagcaaggccaagccccccaccgcccccgccccccccagcgcccccgcccccagcgcccagcccaccccccccagcgccagcgugcccggcaagaaggccagagaggaggcccccggcccccccggcgugagcagagccgacaugcugaagcugagaagccugagcgagggcccccccaaggagcugaagaucagacugaucaagguggagagcggcgacaaggagaccuucaucgccagcgagguggaggagagaagacugagaauggccgaccugaccaucagccacugcgccgccgacguggugagagccagcagaaacgccaaggugaagggcaaguucagagagagcuaccugagccccgcccagagcgugaagcccaagaucaacaccgaggagaagcugcccagagagaagcugaacccccccacccccagcaucuaccuggagagcaagagagacgccuucagccccgugcugcugcaguucugcaccgaccccagaaaccccaucaccgugaucagaggccuggccggcagccugagacugaaccugggccuguucagcaccaagacccugguggaggccagcggcgagcacaccguggaggugagaacccaggugcagcagcccagcgacgagaacugggaccugaccggcaccagacagaucuggcccugcgagagcagcagaagccacaccaccaucgccaaguacgcccaguaccaggccagcagcuuccaggagagccugcaggaggagaaggagagcgaggacgaggagagcgaggagcccgacagcaccaccggcaccccccccagcagcgcccccgaccccaagaaccaccacaucaucaaguucggcaccaacaucgaccugagcgacgccaagagauggaagccccagcugcaggagcugcugaagcugcccgccuucaugagagugaccagcaccggcaacaugcugagccacgugggccacaccauccugggcaugaacaccgugcagcuguacaugaaggugcccggcagcagaacccccggccaccaggagaacaacaacuucugcagcgugaacaucaacaucggccccggcgacugcgagugguucgccgugcacgagcacuacugggagaccaucagcgccuucugcgacagacacggcguggacuaccugaccggcagcugguggcccauccuggacgaccuguacgccagcaacauccccguguacagauucgugcagagacccggcgaccugguguggaucaacgccggcaccgugcacugggugcaggccaccggcuggugcaacaacaucgccuggaacgugggcccccugaccgccuaccaguaccagcuggcccuggagagauacgaguggaacgaggugaagaacgugaagagcaucgugcccaugauccacgugagcuggaacguggccagaaccgugaagaucagcgaccccgaccuguucaagaugaucaaguucugccugcugcagagcaugaagcacugccaggugcagagagagagccuggugagagccggcaagaagaucgccuaccagggcagagugaaggacgagcccgccuacuacugcaacgagugcgacguggagguguucaacauccuguucgugaccagcgagaacggcagcagaaacaccuaccuggugcacugcgagggcugcgccagaagaagaagcgccggccugcagggcgugguggugcuggagcaguacagaaccgaggagcuggcccaggccuacgacgccuucacccuggugagagccagaagagccagaggccagagaagaagagcccugggccaggccgccggcaccggcuucggcagccccgccgcccccuuccccgagcccccccccgccuucagcccccaggcccccgccagcaccagcagauaa

SEQ ID NO: 18874 - RNA, 4071 nt, Artificial Sequence
  KDR__Homo_sapiens__NP_002244
augcagagcaaggugcugcuggccguggcccuguggcugugcguggagaccagagccgccagcgugggccugcccagcgugagccuggaccugcccagacugagcauccagaaggacauccugaccaucaaggccaacaccacccugcagaucaccugcagaggccagagagaccuggacuggcuguggcccaacaaccagagcggcagcgagcagagaguggaggugaccgagugcagcgacggccuguucugcaagacccugaccauccccaaggugaucggcaacgacaccggcgccuacaagugcuucuacagagagaccgaccuggccagcgugaucuacguguacgugcaggacuacagaagccccuucaucgccagcgugagcgaccagcacggcgugguguacaucaccgagaacaagaacaagaccguggugauccccugccugggcagcaucagcaaccugaacgugagccugugcgccagauaccccgagaagagauucgugcccgacggcaacagaaucagcugggacagcaagaagggcuucaccauccccagcuacaugaucagcuacgccggcaugguguucugcgaggccaagaucaacgacgagagcuaccagagcaucauguacaucguggugguggugggcuacagaaucuacgacguggugcugagccccagccacggcaucgagcugagcgugggcgagaagcuggugcugaacugcaccgccagaaccgagcugaacgugggcaucgacuucaacugggaguaccccagcagcaagcaccagcacaagaagcuggugaacagagaccugaagacccagagcggcagcgagaugaagaaguuccugagcacccugaccaucgacggcgugaccagaagcgaccagggccuguacaccugcgccgccagcagcggccugaugaccaagaagaacagcaccuucgugagagugcacgagaagcccuucguggccuucggcagcggcauggagagccugguggaggccaccgugggcgagagagugagaauccccgccaaguaccugggcuaccccccccccgagaucaagugguacaagaacggcaucccccuggagagcaaccacaccaucaaggccggccacgugcugaccaucauggaggugagcgagagagacaccggcaacuacaccgugauccugaccaaccccaucagcaaggagaagcagagccacguggugagccuggugguguacgugcccccccagaucggcgagaagagccugaucagccccguggacagcuaccaguacggcaccacccagacccugaccugcaccguguacgccaucccccccccccaccacauccacugguacuggcagcuggaggaggagugcgccaacgagcccagccaggccgugagcgugaccaaccccuaccccugcgaggaguggagaagcguggaggacuuccagggcggcaacaagaucgaggugaacaagaaccaguucgcccugaucgagggcaagaacaagaccgugagcacccuggugauccaggccgccaacgugagcgcccuguacaagugcgaggccgugaacaaggugggcagaggcgagagagugaucagcuuccacgugaccagaggccccgagaucacccugcagcccgacaugcagcccaccgagcaggagagcgugagccuguggugcaccgccgacagaagcaccuucgagaaccugaccugguacaagcugggcccccagccccugcccauccacgugggcgagcugcccacccccgugugcaagaaccuggacacccuguggaagcugaacgccaccauguucagcaacagcaccaacgacauccugaucauggagcugaagaacgccagccugcaggaccagggcgacuacgugugccuggcccaggacagaaagaccaagaagagacacugcguggugagacagcugaccgugcuggagagaguggcccccaccaucaccggcaaccuggagaaccagaccaccagcaucggcgagagcaucgaggugagcugcaccgccagcggcaacccccccccccagaucaugugguucaaggacaacgagacccugguggaggacagcggcaucgugcugaaggacggcaacagaaaccugaccaucagaagagugagaaaggaggacgagggccuguacaccugccaggccugcagcgugcugggcugcgccaagguggaggccuucuucaucaucgagggcgcccaggagaagaccaaccuggagaucaucauccuggugggcaccgccgugaucgccauguucuucuggcugcugcuggugaucauccugagaaccgugaagagagccaacggcggcgagcugaagaccggcuaccugagcaucgugauggaccccgacgagcugccccuggacgagcacugcgagagacugcccuacgacgccagcaagugggaguuccccagagacagacugaagcugggcaagccccugggcagaggcgccuucggccaggugaucgaggccgacgccuucggcaucgacaagaccgccaccugcagaaccguggccgugaagaugcugaaggagggcgccacccacagcgagcacagagcccugaugagcgagcugaagauccugauccacaucggccaccaccugaacguggugaaccugcugggcgccugcaccaagcccggcggcccccugauggugaucguggaguucugcaaguucggcaaccugagcaccuaccugagaagcaagagaaacgaguucgugcccuacaagaccaagggcgccagauucagacagggcaaggacuacgugggcgccauccccguggaccugaagagaagacuggacagcaucaccagcagccagagcagcgccagcagcggcuucguggaggagaagagccugagcgacguggaggaggaggaggcccccgaggaccuguacaaggacuuccugacccuggagcaccugaucugcuacagcuuccagguggccaagggcauggaguuccuggccagcagaaagugcauccacagagaccuggccgccagaaacauccugcugagcgagaagaacguggugaagaucugcgacuucggccuggccagagacaucuacaaggaccccgacuacgugagaaagggcgacgccagacugccccugaaguggauggcccccgagaccaucuucgacagaguguacaccauccagagcgacguguggagcuucggcgugcugcugugggagaucuucagccugggcgccagccccuaccccggcgugaagaucgacgaggaguucugcagaagacugaaggagggcaccagaaugagagcccccgacuacaccacccccgagauguaccagaccaugcuggacugcuggcacggcgagcccagccagagacccaccuucagcgagcugguggagcaccugggcaaccugcugcaggccaacgcccagcaggacggcaaggacuacaucgugcugcccaucagcgagacccugagcauggaggaggacagcggccugagccugcccaccagccccgugagcugcauggaggaggaggaggugugcgaccccaaguuccacuacgacaacaccgccggcaucagccaguaccugcagaacagcaagagaaagagcagacccgugagcgugaagaccuucgaggacaucccccuggaggagcccgaggugaaggugauccccgacgacaaccagaccgacagcggcauggugcuggccagcgaggagcugaagacccuggaggacagaaccaagcugagccccagcuucggcggcauggugcccagcaagagcagagagagcguggccagcgagggcagcaaccagaccagcggcuaccagagcggcuaccacagcgacgacaccgacaccaccguguacagcagcgaggaggccgagcugcugaagcugaucgagaucggcgugcagaccggcagcaccgcccagauccugcagcccgacagcggcaccacccugagcagcccccccguguaa

SEQ ID NO: 18875 - RNA, 999 nt, Artificial Sequence
  KDSR__Homo_sapiens__NP_002026
augcugcugcuggccgccgccuuccugguggccuucgugcugcugcuguacauggugagcccccugaucagccccaagccccuggcccugcccggcgcccacgugguggugaccggcggcagcagcggcaucggcaagugcaucgccaucgagugcuacaagcagggcgccuucaucacccugguggccagaaacgaggacaagcugcugcaggccaagaaggagaucgagaugcacagcaucaacgacaagcagguggugcugugcaucagcguggacgugagccaggacuacaaccagguggagaacgugaucaagcaggcccaggagaagcugggccccguggacaugcuggugaacugcgccggcauggccgugagcggcaaguucgaggaccuggaggugagcaccuucgagagacugaugagcaucaacuaccugggcagcguguaccccagcagagccgugaucaccaccaugaaggagagaagagugggcagaaucguguucgugagcagccaggccggccagcugggccuguucggcuucaccgccuacagcgccagcaaguucgccaucagaggccuggccgaggcccugcagauggaggugaagcccuacaacguguacaucaccguggccuacccccccgacaccgacacccccggcuucgccgaggagaacagaaccaagccccuggagaccagacugaucagcgagaccaccagcgugugcaagcccgagcagguggccaagcagaucgugaaggacgccauccagggcaacuucaacagcagccugggcagcgacggcuacaugcugagcgcccugaccugcggcauggcccccgugaccagcaucaccgagggccugcagcagguggugaccaugggccuguucagaaccaucgcccuguucuaccugggcagcuucgacagcaucgugagaagaugcaugaugcagagagagaagagcgagaacgccgacaagaccgccuaa

SEQ ID NO: 18876 - RNA, 1875 nt, Artificial Sequence
  KEAP1__Homo_sapiens__NP_036421
augcagcccgaccccagacccagcggcgccggcgccugcugcagauuccugccccugcagagccagugccccgagggcgccggcgacgccgugauguacgccagcaccgagugcaaggccgaggugacccccagccagcacggcaacagaaccuucagcuacacccuggaggaccacaccaagcaggccuucggcaucaugaacgagcugagacugagccagcagcugugcgacgugacccugcaggugaaguaccaggacgcccccgccgcccaguucauggcccacaagguggugcuggccagcagcagccccguguucaaggccauguucaccaacggccugagagagcagggcauggagguggugagcaucgagggcauccaccccaaggugauggagagacugaucgaguucgccuacaccgccagcaucagcaugggcgagaagugcgugcugcacgugaugaacggcgccgugauguaccagaucgacagcguggugagagccugcagcgacuuccuggugcagcagcuggaccccagcaacgccaucggcaucgccaacuucgccgagcagaucggcugcguggagcugcaccagagagccagagaguacaucuacaugcacuucggcgagguggccaagcaggaggaguucuucaaccugagccacugccagcuggugacccugaucagcagagacgaccugaacgugagaugcgagagcgagguguuccacgccugcaucaacugggugaaguacgacugcgagcagagaagauucuacgugcaggcccugcugagagccgugagaugccacagccugacccccaacuuccugcagaugcagcugcagaagugcgagauccugcagagcgacagcagaugcaaggacuaccuggugaagaucuucgaggagcugacccugcacaagcccacccaggugaugcccugcagagcccccaaggugggcagacugaucuacaccgccggcggcuacuucagacagagccugagcuaccuggaggccuacaaccccagcgacggcaccuggcugagacuggccgaccugcaggugcccagaagcggccuggccggcugcguggugggcggccugcuguacgccgugggcggcagaaacaacagccccgacggcaacaccgacagcagcgcccuggacugcuacaaccccaugaccaaccaguggagccccugcgcccccaugagcgugcccagaaacagaaucggcgugggcgugaucgacggccacaucuacgccgugggcggcagccacggcugcauccaccacaacagcguggagagauacgagcccgagagagacgaguggcaccugguggcccccaugcugaccagaagaaucggcgugggcguggccgugcugaacagacugcuguacgccgugggcggcuucgacggcaccaacagacugaacagcgccgagugcuacuaccccgagagaaacgaguggagaaugaucaccgccaugaacaccaucagaagcggcgccggcgugugcgugcugcacaacugcaucuacgccgccggcggcuacgacggccaggaccagcugaacagcguggagagauacgacguggagaccgagaccuggaccuucguggcccccaugaagcacagaagaagcgcccugggcaucaccgugcaccagggcagaaucuacgugcugggcggcuacgacggccacaccuuccuggacagcguggagugcuacgaccccgacaccgacaccuggagcgaggugaccagaaugaccagcggcagaagcggcgugggcguggccgugaccauggagcccugcagaaagcagaucgaccagcagaacugcaccugcuaa

SEQ ID NO: 18877 - RNA, 2199 nt, Artificial Sequence
  KEL__Homo_sapiens__NP_000411
auggagggcggcgaccagagcgaggaggagcccagagagagaagccaggccggcggcaugggcacccuguggagccaggagagcacccccgaggagagacugcccguggagggcagcagacccugggccguggccagaagagugcugaccgccauccugauccugggccugcugcugugcuucagcgugcugcuguucuacaacuuccagaacugcggccccagacccugcgagaccagcgugugccuggaccugagagaccacuaccuggccagcggcaacaccagcguggcccccugcaccgacuucuucagcuucgccugcggcagagccaaggagaccaacaacagcuuccaggagcuggccaccaagaacaagaacagacugagaagaauccuggaggugcagaacagcuggcaccccggcagcggcgaggagaaggccuuccaguucuacaacagcugcauggacacccuggccaucgaggccgccggcaccggcccccugagacaggugaucgaggagcugggcggcuggagaaucagcggcaaguggaccagccugaacuucaacagaacccugagacugcugaugagccaguacggccacuuccccuucuucagagccuaccugggcccccaccccgccagcccccacacccccgugauccagaucgaccagcccgaguucgacgugccccugaagcaggaccaggagcagaagaucuacgcccagaucuucagagaguaccugaccuaccugaaccagcugggcacccugcugggcggcgaccccagcaaggugcaggagcacagcagccugagcaucagcaucaccagcagacuguuccaguuccugagaccccuggagcagagaagagcccagggcaagcuguuccagauggugaccaucgaccagcugaaggagauggcccccgccaucgacuggcugagcugccugcaggccaccuucacccccaugagccugagccccagccagagccugguggugcacgacguggaguaccugaagaacaugagccagcugguggaggagaugcugcugaagcagagagacuuccugcagagccacaugauccugggccugguggugacccugagccccgcccuggacagccaguuccaggaggccagaagaaagcugagccagaagcugagagagcugaccgagcagccccccaugcccgccagacccagauggaugaagugcguggaggagaccggcaccuucuucgagcccacccuggccgcccuguucgugagagaggccuucggccccagcaccagaagcgccgccaugaagcuguucaccgccaucagagacgcccugaucaccagacugagaaaccugcccuggaugaacgaggagacccagaacauggcccaggacaagguggcccagcugcagguggagaugggcgccagcgagugggcccugaagcccgagcuggccagacaggaguacaacgacauccagcugggcagcagcuuccugcagagcgugcugagcugcgugagaagccugagagccagaaucgugcagagcuuccugcagccccacccccagcacagauggaaggugagccccugggacgugaacgccuacuacagcgugagcgaccacguggugguguuccccgccggccugcugcagccccccuucuuccaccccggcuaccccagagccgugaacuucggcgccgccggcagcaucauggcccacgagcugcugcacaucuucuaccagcugcugcugcccggcggcugccuggccugcgacaaccacgcccugcaggaggcccaccugugccugaagagacacuacgccgccuucccccugcccagcagaaccagcuucaacgacagccugaccuuccuggagaacgccgccgacgugggcggccuggccaucgcccugcaggccuacagcaagagacugcugagacaccacggcgagaccgugcugcccagccuggaccugagcccccagcagaucuucuucagaagcuacgcccaggugaugugcagaaagcccagcccccaggacagccacgacacccacagccccccccaccugagagugcacggcccccugagcagcacccccgccuucgccagauacuucagaugcgccagaggcgcccugcugaaccccagcagcagaugccagcugugguaa

SEQ ID NO: 18878 - RNA, 1059 nt, Artificial Sequence
  KERA__Homo_sapiens__XP_011536083
auggccggcaccaucugcuucaucaugugggugcuguucaucaccgacaccguguggagcagaagcgugagacagguguacgaggugcacgacagcgacgacuggaccauccacgacuucgagugccccauggagugcuucugcccccccagcuuccccaccgcccuguacugcgagaacagaggccugaaggagauccccgccauccccagcagaaucugguaccuguaccugcagaacaaccugaucgagaccauccccgagaagcccuucgagaacgccacccagcugagauggaucaaccugaacaagaacaagaucaccaacuacggcaucgagaagggcgcccugagccagcugaagaagcugcuguuccuguuccuggaggacaacgagcuggaggaggugcccagcccccugcccagaagccuggagcagcugcagcuggccagaaacaaggugagcagaaucccccagggcaccuucagcaaccuggagaaccugacccugcuggaccugcagaacaacaagcugguggacaacgccuuccagagagacaccuucaagggccugaagaaccugaugcagcugaacauggccaagaacgcccugagaaacaugccccccagacugcccgccaacaccaugcagcuguuccuggacaacaacagcaucgagggcauccccgagaacuacuucaacgugauccccaagguggccuuccugagacugaaccacaacaagcugagcgacgagggccugcccagcagaggcuucgacgugagcagcauccuggaccugcagcugagccacaaccagcugaccaaggugcccagaaucagcgcccaccugcagcaccugcaccuggaccacaacaagaucaagagcgugaacgugagcgugaucugccccagccccagcaugcugcccgccgagagagacagcuucagcuacggcccccaccugagauaccugagacuggacggcaacgagaucaagccccccauccccauggcccugaugaccugcuucagacugcugcaggccgugaucaucuaa

SEQ ID NO: 18879 - RNA, 654 nt, Artificial Sequence
  KHDC3L__Homo_sapiens__NP_001017361
auggacgcccccagaagauuccccacccuggugcagcugaugcagcccaaggccaugcccguggaggugcugggccaccugcccaagagauucagcugguuccacagcgaguuccugaagaaccccaagguggugagacuggagguguggcugguggagaagaucuucggcagaggcggcgagagaaucccccacgugcagggcaugagccagauccugauccacgugaacagacuggaccccaacggcgaggccgagauccugguguucggcagacccagcuaccaggaggacaccaucaagaugaucaugaaccuggccgacuaccacagacagcugcaggccaagggcagcggcaaggcccuggcccaggacguggccacccagaaggccgagacccagagaagcagcaucgaggugagagaggccggcacccagagaagcguggaggugagagaggccggcacccagagaagcguggaggugcaggaggugggcacccagggcagccccguggaggugcaggaggccggcacccagcagagccugcaggccgccaacaagagcggcacccagagaagccccgaggccgccagcaaggccgugacccagagauucagagaggacgccagagaccccgugaccagacuguaa

SEQ ID NO: 18880 - RNA, 1050 nt, Artificial Sequence
  KHDRBS2__Homo_sapiens__NP_689901
auggaggaggagaaguaccugcccgagcugauggccgagaaggacagccuggaccccagcuucgugcacgccagcagacugcuggccgaggagaucgagaaguuccagggcagcgacggcaagaaggaggacgaggagaagaaguaccuggacgugaucagcaacaagaacaucaagcugagcgagagagugcugauccccgugaagcaguaccccaaguucaacuucgugggcaagcugcugggccccagaggcaacagccugaagagacugcaggaggagaccggcgccaagaugagcauccugggcaagggcagcaugagagacaaggccaaggaggaggagcugagaaagagcggcgaggccaaguacgcccaccugagcgacgagcugcacgugcugaucgagguguucgccccccccggcgaggccuacagcagaaugagccacgcccuggaggagaucaagaaguuccuggugcccgacuacaacgacgagaucagacaggagcagcugagagagcugagcuaccugaacggcagcgaggacagcggcagaggcagaggcaucagaggcagaggcaucagaaucgcccccaccgcccccagcagaggcagaggcggcgccaucccccccccccccccccccggcagaggcgugcugacccccagaggcagcaccgugaccagaggcgcccugcccgugccccccguggccagaggcgugcccacccccagagccagaggcgcccccaccgugcccggcuacagagccccccccccccccgcccacgaggccuacgaggaguacggcuacgacgacggcuacggcggcgaguacgacgaccagaccuacgagaccuacgacaacagcuacgccacccagacccagagcgugcccgaguacuacgacuacggccacggcgugagcgaggacgccuacgacagcuacgcccccgaggagugggccaccaccagaagcagccugaaggcccccccccagagaagcgccagaggcggcuacagagagcaccccuacggcagauacuaa

SEQ ID NO: 18881 - RNA, 1041 nt, Artificial Sequence
  KHDRBS3__Homo_sapiens__NP_006549
auggaggagaaguaccugcccgagcugauggccgagaaggacagccuggaccccagcuucacccacgcccugagacuggugaaccaggagaucgagaaguuccagaagggcgagggcaaggacgaggagaaguacaucgacguggugaucaacaagaacaugaagcugggccagaaggugcugauccccgugaagcaguuccccaaguucaacuucgugggcaagcugcugggccccagaggcaacagccugaagagacugcaggaggagacccugaccaagaugagcauccugggcaagggcagcaugagagacaaggccaaggaggaggagcugagaaagagcggcgaggccaaguacuuccaccugaacgacgaccugcacgugcugaucgagguguucgccccccccgccgaggccuacgccagaaugggccacgcccuggaggagaucaagaaguuccugauccccgacuacaacgacgagaucagacaggcccagcugcaggagcugaccuaccugaacggcggcagcgagaacgccgacgugcccguggugagaggcaagcccacccugagaaccagaggcgugcccgcccccgccaucaccagaggcagaggcggcgugaccgccagacccgugggcgugguggugcccagaggcacccccacccccagaggcgugcugagcaccagaggccccgugagcagaggcagaggccugcugacccccagagccagaggcgugccccccaccggcuacagaccccccccccccccccccacccaggagaccuacggcgaguacgacuacgacgacggcuacggcaccgccuacgacgagcagagcuacgacagcuacgacaacagcuacagcacccccgcccagagcggcgccgacuacuacgacuacggccacggccugagcgaggagaccuacgacagcuacggccaggaggaguggaccaacagcagacacaaggcccccagcgccagaaccgccaagggcguguacagagaccagcccuacggcagauacuaa

SEQ ID NO: 18882 - RNA, 897 nt, Artificial Sequence
  KHK__Homo_sapiens__NP_000212
auggaggagaagcagauccugugcgugggccugguggugcuggacgugaucagccugguggacaaguaccccaaggaggacagcgagaucagaugccugagccagagauggcagagaggcggcaacgccagcaacagcugcaccgugcugagccugcugggcgcccccugcgccuucaugggcagcauggcccccggccacguggccgacuucgugcuggacgaccugagaagauacagcguggaccugagauacaccguguuccagaccaccggcagcgugcccaucgccaccgugaucaucaacgaggccagcggcagcagaaccauccuguacuacgacagaagccugcccgacgugagcgccaccgacuucgagaagguggaccugacccaguucaaguggauccacaucgagggcagaaacgccagcgagcaggugaagaugcugcagagaaucgacgcccacaacaccagacagccccccgagcagaagaucagagugagcguggagguggagaagcccagagaggagcuguuccagcuguucggcuacggcgacgugguguucgugagcaaggacguggccaagcaccugggcuuccagagcgccgaggaggcccugagaggccuguacggcagagugagaaagggcgccgugcuggugugcgccugggccgaggagggcgccgacgcccugggccccgacggcaagcugcugcacagcgacgccuuccccccccccagagugguggacacccugggcgccggcgacaccuucaacgccagcgugaucuucagccugagccagggcagaagcgugcaggaggcccugagauucggcugccagguggccggcaagaagugcggccugcagggcuucgacggcaucguguaa

SEQ ID NO: 18883 - RNA, 2136 nt, Artificial Sequence
  KHSRP__Homo_sapiens__NP_003676
augagcgacuacagcaccggcggccccccccccggcccccccccccccgccggcggcggcggcggcgccggcggcgccggcggcggccccccccccggcccccccggcgccggcgacagaggcggcggcggccccggcggcggcggccccggcggcggcagcgccggcggccccagccagccccccggcggcggcggccccggcaucagaaaggacgccuucgccgacgccgugcagagagccagacagaucgccgccaagaucggcggcgacgccgccaccaccgugaacaacagcacccccgacuucggcuucggcggccagaagagacagcuggaggacggcgaccagcccgagagcaagaagcuggccagccagggcgacagcaucagcagccagcugggccccauccaccccccccccagaaccagcaugaccgaggaguacagagugcccgacggcauggugggccugaucaucggcagaggcggcgagcagaucaacaagauccagcaggacagcggcugcaaggugcagaucagccccgacagcggcggccugcccgagagaagcgugagccugaccggcgcccccgagagcgugcagaaggccaagaugaugcuggacgacaucgugagcagaggcagaggcggcccccccggccaguuccacgacaacgccaacggcggccagaacggcaccgugcaggagaucaugauccccgccggcaaggccggccuggugaucggcaagggcggcgagaccaucaagcagcugcaggagagagccggcgugaagaugauccugauccaggacggcagccagaacaccaacguggacaagccccugagaaucaucggcgaccccuacaaggugcagcaggccugcgagauggugauggacauccugagagagagagaccagggcggcuucggcgacagaaacgaguacggcagcagaaucggcggcggcaucgacgugcccgugcccagacacagcgugggcguggugaucggcagaagcggcgagaugaucaagaagauccagaacgacgccggcgugagaauccaguucaagcaggacgacggcaccggccccgagaagaucgcccacaucaugggcccccccgacagaugcgagcacgccgccagaaucaucaacgaccugcugcagagccugagaagcggcccccccggcccccccggcggccccggcaugccccccggcggcagaggcagaggcagaggccagggcaacuggggcccccccggcggcgagaugaccuucagcauccccacccacaagugcggccuggugaucggcagaggcggcgagaacgugaaggccaucaaccagcagaccggcgccuucguggagaucagcagacagcugccccccaacggcgaccccaacuucaagcuguucaucaucagaggcagcccccagcagaucgaccacgccaagcagcugaucgaggagaagaucgagggcccccugugccccgugggccccggccccggcggccccggccccgccggccccaugggccccuucaaccccggccccuucaaccagggcccccccggcgcccccccccacgccggcggcccccccccccaccaguaccccccccagggcuggggcaacaccuacccccaguggcagccccccgccccccacgaccccagcaaggccgccgccgccgccgccgaccccaacgccgccugggccgccuacuacagccacuacuaccagcagccccccggccccgugcccggccccgcccccgcccccgccgccccccccgcccagggcgagcccccccagcccccccccaccggccagagcgacuacaccaaggccugggaggaguacuacaagaagaucggccagcagccccagcagcccggcgcccccccccagcaggacuacaccaaggccugggaggaguacuacaagaagcaggcccagguggccaccggcggcggccccggcgccccccccggcagccagcccgacuacagcgccgccugggccgaguacuacagacagcaggccgccuacuacggccagacccccggccccggcggcccccagcccccccccacccagcagggccagcagcaggcccaguaa

SEQ ID NO: 18884 - RNA, 1947 nt, Artificial Sequence
  KIAA0020__Homo_sapiens__NP_055693
auggaggugaagggcaagaagcaguucaccggcaagagcaccaagaccgcccaggagaagaacagauuccacaagaacagcgacagcggcagcagcaagaccuuccccaccagaaagguggccaaggagggcggccccaaggugaccagcagaaacuucgagaagagcaucaccaagcugggcaagaagggcgugaagcaguucaagaacaagcagcagggcgacaagagccccaagaacaaguuccagcccgccaacaaguucaacaagaagagaaaguuccagcccgacggcagaagcgacgagagcgccgccaagaagcccaagugggacgacuucaagaagaagaagaaggagcugaagcagagcagacagcugagcgacaagaccaacuacgacaucguggugagagccaagcagaugugggagauccugagaagaaaggacugcgacaaggagaagagagugaagcugaugagcgaccugcagaagcugauccagggcaagaucaagaccaucgccuucgcccacgacagcaccagagugauccagugcuacauccaguacggcaacgaggagcagagaaagcaggccuucgaggagcugagagacgaccugguggagcugagcaaggccaaguacagcagaaacaucgugaagaaguuccugauguacggcagcaagccccagaucgccgagaucaucagaagcuucaagggccacgugagaaagaugcugagacacgccgaggccagcgccaucguggaguacgccuacaacgacaaggccauccuggagcagagaaacaugcugaccgaggagcuguacggcaacaccuuccagcuguacaagagcgccgaccacagaacccuggacaaggugcuggaggugcagcccgagaagcuggagcugaucauggacgagaugaagcagauccugacccccauggcccagaaggaggccgugaucaagcacagccuggugcacaagguguuccuggacuucuucaccuacgccccccccaagcugagaagcgagaugaucgaggccaucagagaggccgugguguaccuggcccacacccacgacggcgccagaguggccaugcacugccuguggcacggcacccccaaggacagaaaggugaucgugaagaccaugaagaccuacguggagaagguggccaacggccaguacagccaccuggugcugcuggccgccuucgacugcaucgacgacaccaagcuggugaagcagaucaucaucagcgagaucaucagcagccugcccagcaucgugaacgacaaguacggcagaaaggugcugcuguaccugcugagccccagagaccccgcccacaccgugagagagaucaucgaggugcugcagaagggcgacggcaacgcccacagcaagaaggacaccgaggugagaagaagagagcugcuggagagcaucagccccgcccugcugagcuaccugcaggagcacgcccaggagguggugcuggacaagagcgccugcgugcuggugagcgacauccugggcagcgccaccggcgacgugcagcccaccaugaacgccaucgccagccuggccgccaccggccugcaccccggcggcaaggacggcgagcugcacaucgccgagcaccccgccggccaccuggugcugaaguggcugaucgagcaggacaagaagaugaaggagaacggcagagagggcugcuucgccaagacccugguggagcacgugggcaugaagaaccugaagagcugggccagcgugaacagaggcgccaucauccugagcagccugcugcagagcugcgaccuggagguggccaacaaggugaaggccgcccugaagagccugauccccacccuggagaagaccaagagcaccagcaagggcaucgagauccugcuggagaagcugagcaccuaa

SEQ ID NO: 18885 - RNA, 300 nt, Artificial Sequence
  KIAA0040__Homo_sapiens__NP_055471
auggagagaaucagcgccuucuucagcagcaucugggacaccauccugaccaagcaccaggagggcaucuacaacaccaucugccugggcgugcugcugggccugccccugcuggugaucaucacccugcuguucaucugcugccacugcugcuggagcccccccggcaagagaggccagcagcccgagaagaacaagaagaagaagaagaagaagaagaagaaggacgaggaggaccuguggaucagcgcccagcccaagcugcugcagauggagaagagacccagccugcccguguaa

SEQ ID NO: 18886 - RNA, 6708 nt, Artificial Sequence
  KIAA0100__Homo_sapiens__NP_055495
augccccuguucuucagcgcccugcuggugcugcugcugguggcccugagcgcccuguuccugggcagauggcugguggugagacuggccaccaaguggugccagagaaagcugcaggccgagcugaagaucggcagcuucagauucuucuggauccagaacgugagccugaaguuccagcagcaccagcagaccguggagaucgacaaccuguggaucagcagcaagcugcugagccacgaccugccccacuacguggcccugugcuucggcgaggugagaaucagaaccgaccugcagaaggugagcgaccugagcgcccccuucagccagagcgccggcguggaccagaaggagcugagcuucagccccagccugcugaagaucuucugccagcuguucagcauccacguggacgccaucaacaucauggugcugaagguggacaccagcgagagccuguggcacauccagaucagcagaagcagauuccugcuggacagcgacggcaagagacugaucugcgaggugagccugugcaagaucaacagcaaggugcugaagagcggccagcuggaggacaccugccugguggagcugagccuggcccuggaccugugccugaaggugggcaucagcagcagacaccugaccgccaucaccguggacguguggacccugcacgccgagcugcacgagggccuguuccagagccagcugcugugccagggccccagccuggccagcaagcccgugcccugcagcgaggugaccgagaaccugguggagcccacccugcccggccuguuccugcugcagcagcugcccgaccaggugaaggugaagauggagaacaccagcguggugcugagcaugaacagccagaagagacaccugaccuggacccugaagcugcugcaguuccuguaccacagagacgaggaccagcugccccugagaagcuucaccgccaacagcgacauggcccagaugagcaccgagcugcugcuggaggacggccugcugcugagccagagcagacagagaaucgugugccugaacagccugaaggccagcgugcaggugaccaccaucgaccugagcgccagccuggugcugaacaccugcaucauccacuacagacaccaggaguucagccacuggcugcaccugcuggcccuggagacccagggcagcagcagccccgugcugaagcagagaaagaagagaaccuucccccagauccuggcccccaucaucuucagcaccagcaucagcaacgugaacaucagcauccagcugggcgacaccccccccuucgcccugggcuucaacagcaucagccuggacuaccagcaccugagaccccagagcauccaccagagaggcgugcugaccguggaccaccugugcuggagagugggcagcgacagccacauccagagagccccccacccccccaacaugcacguguggggcgaggcccuggugcuggacagcuucacccugcagggcagcuacaaccagccccugggccugagcagcacccagagcgacacccuguuccuggacugcaccaucagaggccugcagguggaggccagcgacaccugcgcccagugccugagcagaauccugagccugaugggcccccagagcggcaagagcgccgugagcagacacagcagcuucggcgagagcgugagccugcuguggaagguggaccugaagguggaggacaugaaccuguucacccugagcgcccuggugggcgccagcgaggugagacuggacacccugaccauccugggcagcgccgagaccagcaccgugggcauccagggccuggugcuggcccuggugaagagcgugaccgagaagaugcagcccugcugcaaggcccccgacauccccacccccgugcugagccugagcaugcugagcaucaccuaccacagcagcaucagaagccuggaggugcagugcggcgccggccugacccugcuguggagcccccccgaccacauguaccuguaccagcacgugcuggccacccugcagugcagagaccugcugagagccaccguguuccccgagaccgugcccagccuggcccuggagaccagcggcaccaccagcgagcuggagggcagagcccccgagccccugccccccaagagacugcugaaccugacccuggaggugagcaccgccaagcugaccgccuucguggccgaggacaaguucaucacccuggccgccgagagcgugagccugagcagacacggcggcagccugcaggccuacugccccgagcuggccgccggcuucgacggcaacagcaucuucaacuucaaggagguggaggugcagcugcugcccgagcuggaggagaugauccugcacagaaaccccuuccccgcccugcagacccugagaaacagaguguggcugcugagcuucggcagcgugagcguggaguuccccuaccaguacgacuucagcagaacccuggacgaggccgugggcgugcagaaguggcugaagggccugcaccagggcaccagagccugggccagccccagccccgugccccugccccccgaccugcugcugaagguggagcacuucagcuggguguuccuggacgacguguucgaggugaagcugcacgacaacuacgagcugaugaaggacgagagcaaggagagcgccaagagacugcagcugcuggacgccaagguggccgcccugagaaagcagcacggcgagcugcugcccgccagaaagaucgaggagcuguacgccagccuggagagaaagaacaucgagaucuacauccagagaagcagaagacuguacggcaacacccccaugagaagagcccugcugaccuggagccuggccggccuggagcugguggcccuggccgacgccagcuuccacggccccgagcacgugguggagcaggugcaggagcuggaccccggcagccccuucccccccgagggccuggaccuggugauccaguggugcagaaugcugaagugcaacgugaagagcuuccuggugagaaucagagacuaccccagauaccuguucgagaucagagacuggagacugaugggcagacuggugggcaccgagcagagcggccagcccugcagcagaagaagacagauccugcaccugggccugcccuggggcaacguggccguggagagaaacaugcccccccugaaguucuaccacgacuuccacagcgagaucuuccaguacaccgugguguggggccccugcugggaccccgccuggacccugaucggccagugcguggaccugcugaccaagcccagcgccgaccccagccccccccugcccuggugggacaagagcagacugcuguuccacggcgacuggcacauggacaucgagcaggccaaccugcaccagcuggccaccgaggaccccuacaacaccaccgagaacaugcacugggaguggagccaccugagcuuccacuggaagcccggccaguucguguucaagggcgaccuggacaucaacgugagaaccgccagcaaguacgacgacugcugcuuccugcaccugcccgaccugugcaugacccuggaccugcaguggcugugccacggcaacccccacgaccaccacagcgugacccugagagcccccgaguuccugcccgaggugccccugggccagcugcacgacagcuacagagccuucagaagcgagaaccugaaccugagcaucaagauggaccugaccagacacagcggcaccaucagccagcccagaauccugcuguacagcagcacccugagauggaugcagaacuucugggccaccuggaccagcgugaccagacccaucugcagaggcaagcuguucaacaaccugaagcccagcaagaagaagcugggccagcacuacaagcagcugagcuacaccgcccuguucccccagcugcaggugcacuacugggccagcuucgcccagcagagaggcauccagaucgagugcagccagggccacguguucaccagaggcacccagagacugaucccccaggccggcaccgugaugagaagacugaucagcgacuggagcgugacccagauggugagcgaccugagccaggugaccgugcaccugauggccagccccaccgaggagaacgccgaccacugccuggacccccuggugaccaagacccaccugcugagccugagcagccugaccuaccagagacacagcaacagaaccgccgaggaggagcugagcgccagagacggcgaccccaccuuccacacccaccagcugcaccugguggaccugagaaucagcuggaccaccaccaacagagacaucgccuucggccuguacgacggcuacaagaaggccgccgugcugaagagaaaccugagcaccgaggcccugaagggccugaagaucgacccccagaugcccgccaagaagcccaagagaggcgugcccaccagcgccagcgccccccccagagugaacacccccagcuucagcggccagcccgacaagggcagcagcggcggcgccuacaugcugcagaagcugaucgaggagaccgacagauucgugguguucaccgaggaggagagcggcaugagcgaccagcugugcggcaucgccgccugccagaccgacgacaucuacaacagaaacugccugaucgagcuggugaacugccagauggugcugagaggcgccgagaccgagggcugcgugaucgugagcgccgccaaggcccagcugcugcagugccagcaccaccccgccugguacggcgacacccugaagcagaagaccagcuggaccugccugcuggacggcaugcaguacuucgccaccaccgagagcagccccaccgagcaggacggcagacagcuguggcuggaggugaagaacaucgaggagcacagacagagaagccuggacagcgugcaggagcugauggagagcggccaggccgugggcggcauggugaccaccaccaccgacuggaaccagcccgccgaggcccagcaggcccagcaggugcagagaaucaucagcagaugcaacugcagaauguacuacaucagcuacagccacgacaucgaccccgagcuggccacccagaucaagccccccgaggugcuggagaaccaggagaaggaggaccugcugaagaagcaggagggcgccguggacaccuucacccugauccaccacgagcuggagaucagcaccaaccccgcccaguacgccaugauccuggacaucgugaacaaccugcugcugcacguggagcccaagagaaaggagcacagcgagaagaagcagagagugagauuccagcuggagaucagcagcaaccccgaggagcagagaagcagcauccugcaccugcaggaggccgugagacagcacguggcccagaucagacagcuggagaagcagauguacagcaucaugaagagccugcaggacgacagcaagaacgagaaccugcuggaccugaaccagaagcugcagcugcagcugaaccaggagaaggccaaccugcagcuggagagcgaggagcugaacauccugaucagaugcuucaaggacuuccagcugcagagagccaacaagauggagcugagaaagcagcaggaggacgugagcguggugagaagaaccgaguucuacuucgcccaggccagauggagacugaccgaggaggacggccagcugggcaucgccgagcuggagcugcagagauuccuguacagcaaggugaacaagagcgacgacaccgccgagcaccugcuggagcugggcugguucaccaugaacaaccugcugcccaacgccguguacaagguggugcugagaccccagagcagcugccagagcggcagacagcuggcccugagacuguucagcaaggugagaccccccgugggcggcaucagcgugaaggagcacuucgaggugaacguggugccccugaccauccagcugacccaccaguucuuccacagaaugaugggcuucuucuuccccggcagaagcguggaggacgacgaggugggcgacgaggaggacaagagcaagcuggugaccaccggcauccccguggugaagcccagacagcugaucgccaccgacgacgccgugccccugggccccggcaagggcguggcccagggccugaccagaagcagcggcgugagaagaagcuucagaaagagccccgagcaccccguggacgacaucgacaagaugaaggagagagccgccaugaacaacagcuucaucuacaucaagaucccccaggugccccugugcgugagcuacaagggcgagaagaacagcguggacuggggcgaccugaaccuggugcugcccugccuggaguaccacaacaacaccuggaccuggcuggacuucgccauggccgugaagagagacagcagaaaggcccugguggcccaggugaucaaggagaagcugagacugaagagcgccaccggcagcgaggugagaggcaagcuggagaccaagagcgaccugaacaugcagcagcaggaggaggaggagaaggccagacugcugaucggccugagcgugggcgacaagaaccccggcaagaagagcaucuucggcagaagaaaguaa

SEQ ID NO: 18887 - RNA, 198 nt, Artificial Sequence
  KIAA0101__Homo_sapiens__NP_001025160
auggugagaaccaaggccgacagcgugcccggcaccuacagaaaggugguggccgccagagcccccagaaaggugcugggcagcagcaccagcgccaccaacagcaccagcgugagcagcagaaaggagcacgugcugugcaaccugaucacccagaugaugaagaagaacagaaccuucagcuucaucuucgaguaa

SEQ ID NO: 18888 - RNA, 3480 nt, Artificial Sequence
  KIAA0196__Homo_sapiens__NP_055661
augcuggacuuccuggccgagaacaaccugugcggccaggccauccugagaaucgugagcugcggcaacgccaucaucgccgagcugcugagacugagcgaguucauccccgccguguucagacugaaggacagagccgaccagcagaaguacggcgacaucaucuucgacuucagcuacuucaagggccccgagcugugggagagcaagcuggacgccaagcccgagcugcaggaccuggacgaggaguucagagagaacaacaucgagaucgugaccagauucuaccuggccuuccagagcgugcacaaguacaucguggaccugaacagauaccuggacgaccugaacgagggcguguacauccagcagacccuggagaccgugcugcugaacgaggacggcaagcagcugcugugcgaggcccuguaccuguacggcgugaugcugcuggugaucgaccagaagaucgagggcgaggugagagagagaaugcuggugagcuacuacagauacagcgccgccagaagcagcgccgacagcaacauggacgacaucugcaagcugcugagaagcaccggcuacagcagccagcccggcgccaagagacccagcaacuaccccgagagcuacuuccagagagugcccaucaacgagagcuucaucagcauggugaucggcagacugagaagcgacgacaucuacaaccaggugagcgccuacccccugcccgagcacagaagcaccgcccuggccaaccaggccgccaugcuguacgugauccuguacuucgagcccagcauccugcacacccaccaggccaagaugagagagaucguggacaaguacuuccccgacaacugggugaucagcaucuacaugggcaucaccgugaaccugguggacgccugggagcccuacaaggccgccaagaccgcccugaacaacacccuggaccugagcaacgugagagagcaggccagcagauacgccaccgugagcgagagagugcacgcccaggugcagcaguuccugaaggagggcuaccugagagaggagauggugcuggacaacauccccaagcugcugaacugccugagagacugcaacguggccaucagauggcugaugcugcacaccgccgacagcgccugcgaccccaacaacaagagacugagacagaucaaggaccagauccugaccgacagcagauacaaccccagaauccuguuccagcugcugcuggacaccgcccaguucgaguucauccugaaggagauguucaagcagaugcugagcgagaagcagaccaagugggagcacuacaagaaggagggcagcgagagaaugaccgagcuggccgacguguucagcggcgugaagccccugaccagaguggagaagaacgagaaccugcaggccugguucagagagaucagcaagcagauccugagccugaacuacgacgacagcaccgccgccggcagaaagaccgugcagcugauccaggcccuggaggaggugcaggaguuccaccagcuggagagcaaccugcaggugugccaguuccuggccgacaccagaaaguuccugcaccagaugaucagaaccaucaacaucaaggaggaggugcugaucaccaugcagaucgugggcgaccugagcuucgccuggcagcugaucgacagcuucaccagcaucaugcaggagagcaucagagugaaccccagcauggugaccaagcugagagccaccuuccugaagcuggccagcgcccuggaccugccccugcugagaaucaaccaggccaacagccccgaccugcugagcgugagccaguacuacagcggcgagcuggugagcuacgugagaaaggugcugcagaucauccccgagagcauguucaccagccugcugaagaucaucaagcugcagacccacgacaucaucgaggugcccaccagacuggacaaggacaagcugagagacuacgcccagcugggccccagauacgagguggccaagcugacccacgccaucagcaucuucaccgagggcauccugaugaugaagaccacccuggugggcaucaucaagguggaccccaagcagcugcuggaggacggcaucagaaaggagcuggugaagagaguggccuucgcccugcacagaggccugaucuucaaccccagagccaagcccagcgagcugaugcccaagcugaaggagcugggcgccaccauggacggcuuccacagaagcuucgaguacauccaggacuacgugaacaucuacggccugaagaucuggcaggaggaggugagcagaaucaucaacuacaacguggagcaggagugcaacaacuuccugagaaccaagauccaggacuggcagagcauguaccagagcacccacauccccauccccaaguucacccccguggacgagagcgugaccuucaucggcagacugugcagagagauccugagaaucaccgaccccaagaugaccugccacaucgaccagcugaacaccugguacgacaugaagacccaccaggaggugaccagcagcagacuguucagcgagauccagaccacccugggcaccuucggccugaacggccuggacagacugcugugcuucaugaucgugaaggagcugcagaacuuccugagcauguuccagaagaucauccugagagacagaaccgugcaggacacccugaagacccugaugaacgccgugagcccccugaagagcaucguggccaacagcaacaagaucuacuucagcgccaucgccaagacccagaagaucuggaccgccuaccuggaggccaucaugaaggugggccagaugcagauccugagacagcagaucgccaacgagcugaacuacagcugcagauucgacagcaagcaccuggccgccgcccuggagaaccugaacaaggcccugcuggccgacaucgaggcccacuaccaggaccccagccugcccuaccccaaggaggacaacacccugcuguacgagaucaccgccuaccuggaggccgccggcauccacaacccccugaacaagaucuacaucaccaccaagagacugcccuacuuccccaucgugaacuuccuguuccugaucgcccagcugcccaagcugcaguacaacaagaaccugggcauggugugcagaaagcccaccgaccccguggacuggcccccccuggugcugggccugcugacccugcugaagcaguuccacagcagauacaccgagcaguuccuggcccugaucggccaguucaucugcagcaccguggagcagugcaccagccagaagauccccgagauccccgccgacguggugggcgcccugcuguuccuggaggacuacgugagauacaccaagcugcccagaagaguggccgaggcccacgugcccaacuucaucuucgacgaguucagaaccgugcuguaa

SEQ ID NO: 18889 - RNA, 2784 nt, Artificial Sequence
  KIAA0226__Homo_sapiens__NP_001139114
augcagagcauccuguaccacggccugaucagagaccaggccugcagaagacagaccgacuacuggcaguucgugaaggacaucagauggcugagcccccacagcgcccugcacguggagaaguucaucagcgugcacgagaacgaccagagcagcgccgacggcgccagcgagagagccguggccgagcuguggcugcagcacagccugcaguaccacugccugagcgcccagcugagaccccugcugggcgacagacaguacaucagaaaguucuacaccgacgccgccuuccugcugagcgacgcccacgugaccgccaugcugcagugccuggaggccguggagcagaacaaccccagacugcuggcccagaucgacgccagcauguucgccagaaagcacgagagcccccugcuggugaccaagagccagagccugaccgcccugcccagcagcaccuacaccccccccaacagcuacgcccagcacagcuacuucggcagcuucagcagccugcaccagagcgugcccaacaacggcagcgagagaagaagcaccagcuucccccugagcggcccccccagaaagccccaggagagcagaggccacgugagccccgccgaggaccagaccauccaggccccccccgugagcgugagcgcccuggccagagacagcccccugacccccaacgagaugagcagcagcacccugaccagccccaucgaggccagcugggugagcagccagaacgacagccccggcgacgccagcgagggccccgaguaccuggccaucggcaaccuggaccccagaggcagaaccgccagcugccagagccacagcagcaacgccgagagcagcagcagcaaccuguucagcagcagcagcagccagaagcccgacagcgccgccagcagccugggcgaccaggagggcggcggcgagagccagcugagcagcgugcugagaagaagcagcuucagcgagggccagacccugaccgugaccagcggcgccaagaagagccacaucagaagccacagcgacaccagcaucgccagcagaggcgcccccggcggccccagaaacaucaccaucaucguggaggaccccaucgccgagagcugcaacgacaaggccaagcugagaggcccccugcccuacagcggccagagcagcgaggugagcacccccagcagccuguacauggaguacgagggcggcagauaccugugcagcggcgagggcauguucagaagacccagcgagggccagagccugaucagcuaccugagcgagcaggacuucggcagcugcgccgaccuggagaaggagaacgcccacuucagcaucagcgagagccugaucgccgccaucgagcugaugaagugcaacaugaugagccagugccuggaggaggaggagguggaggaggaggacagcgacagagagauccaggagcugaagcagaagaucagacugagaagacagcagaucagaaccaagaaccugcugcccauguaccaggaggccgagcacggcagcuucagagugaccagcagcagcagccaguucagcagcagagacagcgcccagcugagcgacagcggcagcgccgacgagguggacgaguucgagauccaggacgccgacaucagaagaaacaccgccagcagcagcaagagcuucgugagcagccagagcuucagccacugcuuccugcacagcaccagcgccgaggccguggccaugggccugcugaagcaguucgagggcaugcagcugcccgccgccagcgagcuggaguggcuggugcccgagcacgacgccccccagaagcugcugcccauccccgacagccugcccaucagccccgacgacggccagcacgccgacaucuacaagcugagaaucagagugagaggcaaccuggagugggccccccccagaccccagaucaucuucaacgugcaccccgcccccaccagaaagaucgccguggccaagcagaacuacagaugcgccggcugcggcaucagaaccgaccccgacuacaucaagagacugagauacugcgaguaccugggcaaguacuucugccagugcugccacgagaacgcccagauggccauccccagcagagugcugagaaagugggacuucagcaaguacuacgugagcaacuucagcaaggaccugcugaucaagaucuggaacgacccccuguucaacgugcaggacaucaacagcgcccuguacagaaaggugaagcugcugaaccaggugagacugcugagagugcagcugugccacaugaagaacauguucaagaccugcagacuggccaaggagcugcuggacagcuucgacaccgugcccggccaccugaccgaggaccugcaccuguacagccugaacgaccugaccgccaccagaaagggcgagcugggccccagacuggccgagcugaccagagccggcgccacccacguggagagaugcaugcugugccaggccaagggcuucaucugcgaguucugccagaacgaggacgacaucaucuuccccuucgagcugcacaagugcagaaccugcgaggagugcaaggccugcuaccacaaggccugcuucaagagcggcagcugccccagaugcgagagacugcaggccagaagagaggcccuggccagacagagccuggagagcuaccugagcgacuacgaggaggagcccgccgaggcccuggcccuggaggccgccgugcuggaggccaccuaa

SEQ ID NO: 18890 - RNA, 1908 nt, Artificial Sequence
  KIAA0226L__Homo_sapiens__NP_001273691
auggugagccagagcaccgugagacaggacagccccguggagcccugggagggcaucagcgaccacagcggcaucaucgacggcagccccagacugcugaacaccgaccacccccccugccagcuggacaucagacugaugagacacaaggccguguggaucaacccccaggacgugcagcagcagccccaggaccugcagagccaggugcccgccgccggcaacagcggcacccacuucgugaccgacgccgccagccccagcggccccagccccagcugccugggcgacagccuggccgagaccacccugagcgaggacaccaccgacagcgugggcagcgccagcccccacggcagcagcgagaagagcagcagcuucagccugagcagcaccgaggugcacauggugagacccggcuacagccacagagugagccugcccaccagccccggcauccuggccaccagccccuaccccgagaccgacagcgccuucuucgagcccagccaccugaccagcgccgccgacgagggcgccgugcaggugagcagaagaaccaucagcagcaacagcuucagccccgagguguucgugcugcccguggacguggagaaggagaacgcccacuucuacguggccgacaugaucaucagcgccauggagaagaugaagugcaacauccugagccagcagcagaccgagagcuggagcaaggaggugagcggccugcugggcagcgaccagcccgacagcgagaugaccuucgacaccaacaucaagcaggagagcggcagcagcaccagcagcuacagcggcuacgagggcugcgccgugcugcaggugagccccgugaccgagaccagaaccuaccacgacgugaaggagaucugcaagugcgacguggacgaguucgugauccuggagcugggcgacuucaacgacaucaccgagaccugcagcugcagcugcagcagcagcaagagcgugaccuacgagcccgacuucaacagcgccgagcugcuggccaaggagcuguacagaguguuccagaagugcuggauccugagcguggugaacagccagcuggccggcagccugagcgccgccggcagcaucguggugaacgaggagugcgugagaaaggacuucgagagcagcaugaacguggugcaggagaucaaguucaagagcagaaucagaggcaccgaggacugggccccccccagauuccagaucaucuucaacauccaccccccccugaagagagaccuggugguggccgcccagaacuucuucugcgccggcugcggcacccccguggagcccaaguucgugaagagacugagauacugcgaguaccugggcaaguacuucugcgacugcugccacagcuacgccgagagcugcauccccgccagaauccugaugaugugggacuucaagaaguacuacgugagcaacuucagcaagcagcugcuggacagcaucuggcaccagcccaucuucaaccugcugagcaucggccagagccuguacgccaaggccaaggagcuggacagagugaaggagauccaggagcagcuguuccacaucaagaagcugcugaagaccugcagauucgccaacagcugcgugaaggagagagcccuguucgugaacuucgccagaaucagacugagcagcagccacuucagacagcagcacguggaggacgugcagagagccggccuggccuucaccaacagcgccagcagcccccccagcgcccccggcgugagaggcagccagagaggcgagaacuucuggaagguguggccccugcagcagcacgacgcccccgaguacugcgagaaggacugcagcaccugccugaugaucacccccaucugcguguacuacugguaa

SEQ ID NO: 18891 - RNA, 4188 nt, Artificial Sequence
  KIAA0232__Homo_sapiens__NP_001094060
auguaccccaucugcaccguggugguggacggccugcccagcgagagcagcagcagcagcuaccccggccccgugagcgugagcgagaugagccugcugcacgcccugggccccgugcagaccuggcugggccaggagcuggagaagugcggcaucgacgccaugaucuacaccagauacgugcugagccugcugcugcacgacagcuacgacuacgaccugcaggagcaggagaacgacaucuuccugggcugggagaagggcgccuacaagaaguggggcaagagcaagaagaagugcagcgaccugacccuggaggagaugaagaagcaggccgccgugcagugccugagaagcgccagcgacgagagcagcggcaucgagacccugguggaggagcugugcagcagacugaaggaccugcagagcaagcaggaggagaagauccacaagaagcuggagggcagccccagccccgaggccgagcugagcccccccgccaaggaccagguggagauguacuacgaggccuuccccccccugagcgagaagcccgugugccugcaggagaucaugaccguguggaacaagagcaaggugugcagcuacagcagcagcagcagcagcagcaccgccccccccgccagcaccgacaccagcagccccaaggacugcaacagcgagagcgaggugaccaaggagagaagcagcgaggugcccaccaccgugcacgagaagacccagagcaagagcaagaacgagaaggagaacaaguucagcaacggcaccaucgaggagaagcccgcccuguacaagaagcagaucagacacaagcccgagggcaagaucagacccagaagcuggagcagcggcagcagcgaggccggcagcagcagcagcggcaaccagggcgagcugaaggccagcaugaaguacgugaaggugagacacaaggccagagagaucagaaacaagaagggcagaaacggccagagcagacugagccugaagcacggcgagaaggccgagagaaacauccacaccggcagcagcagcagcagcagcagcggcagcgugaagcagcugugcaagagaggcaagagaccccugaaggagaucggcagaaaggaccccggcagcaccgagggcaaggaccuguacauggagaacagaaaggacaccgaguacaaggaggagccccugugguacaccgagcccaucgccgaguacuucgugccccugagcagaaagagcaagcuggagaccaccuacagaaacagacaggacaccagcgaccugaccagcgaggccguggaggagcugagcgagagcgugcacggccugugcaucagcaacaacaaccugcacaagaccuaccuggccgccggcaccuucaucgacggccacuucguggagaugcccgccgugaucaacgaggacaucgaccugaccggcaccagccugugcagccugcccgaggacaacaaguaccuggacgacauccaccugagcgagcugacccacuucuacgagguggacaucgaccagagcaugcuggaccccggcgccagcgagaccaugcagggcgagagcagaauccugaacaugaucagacagaagagcaaggagaacaccgacuucgaggccgagugcugcaucgugcuggacggcauggagcugcagggcgagagagccaucuggaccgacagcaccagcagcgugggcgccgagggccuguuccugcaggaccugggcaaccuggcccaguucugggagugcugcagcagcagcagcggcgacgccgacggcgagagcuucggcggcgacagccccgugagacugagccccauccuggacagcaccgugcugaacagccaccugcuggccggcaaccaggagcuguucagcgacaucaacgagggcagcggcaucaacagcugcuucagcguguucgaggugcagugcagcaacagcgugcugcccuucagcuucgagacccugaaccugggcaacgagaacaccgacagcagcgccaacaugcugggcaagacccagagcagacugcugaucuggaccaagaacagcgccuucgaggagaacgagcacugcagcaaccugagcaccagaaccugcagccccuggagccacagcgaggagaccagaagcgacaacgagacccugaacauccaguucgaggagagcacccaguucaacgccgaggacaucaacuacguggugcccagagugagcagcaacuacguggacgaggagcugcuggacuuccugcaggacgagaccugccagcagaacagcagaacccugggcgagauccccacccugguguucaagaagaccagcaagcuggagagcgugugcggcauccagcuggagcagaagaccgagaacaagaacuucgagaccacccaggugugcaacgagagcccccacggcgacggcuacagcagcggcgugaucaaggacaucuggaccaagauggccgacaccaacagcguggccaccguggagaucgagagaaccgacgccgagcuguucagcgccgacgugaacaacuacugcugcugccuggacgccgaggccgagcuggagacccugcaggagcccgacaaggccgugagaagaagcgaguaccaccugugggagggccagaaggagagccuggagaagagagccuucgccagcagcgagcugagcaacguggacggcggcgacuacaccacccccagcaagcccugggacguggcccaggacaaggagaacaccuucauccugggcggcguguacggcgagcugaagaccuucaacagcgacggcgagugggccguggugccccccagccacaccaagggcagccugcugcagugcgccgccagcgacguggugaccaucgccggcaccgacguguucaugacccccggcaacagcuucgcccccggccacagacagcuguggaagcccuucgugagcuucgagcagaacgaccagcccaagagcggcgagaacggccugaacaagggcuucagcuucaucuuccacgaggaccugcugggcgccugcggcaacuuccagguggaggaccccggccuggaguacagcuucagcagcuucgaccugagcaaccccuucagccaggugcugcacguggagugcagcuucgagcccgagggcaucgccagcuucagccccagcuucaagcccaagagcauccugugcagcgacagcgacagcgagguguuccaccccagaaucugcggcguggacagaacccaguacagagccaucagaaucagccccagaacccacuucagacccaucagcgccagcgagcugagccccggcggcggcagcgagagcgaguucgagagcgagaaggacgaggccaacauccccauccccagccagguggacaucuucgaggacccccaggccgaccugaagccccuggaggaggacgccgagaaggagggccacuacuacggcaagagcgagcuggagagcggcaaguuccugcccagacugaagaagagcggcauggagaagagcgcccagaccagccuggacagccaggaggagagcaccggcauccugagcgugggcaagcagaaccagugccuggagugcagcaugaacgagagccuggagaucgaccuggagagcagcgaggccaacugcaagaucauggcccagugcgaggaggagaucaacaacuucugcggcugcaaggccggcugccaguuccccgccuacgaggacaaccccgugagcagcggccagcuggaggaguuccccgugcugaacaccgacauccagggcaugaacagaagccaggagaagcagaccuggugggagaaggcccuguacagcccccuguuccccgccagcgagugcgaggagugcuacaccaacgccaagggcgagagcggccuggaggaguaccccgacgccaaggagacccccagcaacgaggagagacugcuggacuucaacagagugagcagcguguacgaggccagaugcaccggcgagagagacagcggcgccaagagcgacggcuucagaggcaagaugugcagcagcgccagcagcaccagcgaggagaccggcagcgagggcggcggcgagugggugggccccagcgaggaggagcuguucagcagaacccaccuguaa

SEQ ID NO: 18892 - RNA, 3192 nt, Artificial Sequence
  KIAA0319__Homo_sapiens__NP_001161846
augaccagacugggcuggcccagccccugcugcgccagaaagcagugcagcgagggcagaaccuacagcaacgccgugaucagccccaaccuggagaccaccagaaucaugagagugagccacaccuuccccgugguggacugcaccgccgccugcugcgaccugagcagcugcgaccuggccuggugguucgagggcagaugcuaccuggugagcugcccccacaaggagaacugcgagcccaagaagaugggccccaucagaagcuaccugaccuucgugcugagacccgugcagagacccgcccagcugcuggacuacggcgacaugaugcugaacagaggcagccccagcggcaucuggggcgacagccccgaggacaucagaaaggaccugaccuuccugggcaaggacuggggccuggaggagaugagcgaguacagcgacgacuacagagagcuggagaaggaccugcugcagcccagcggcaagcaggagcccagaggcagcgccgaguacaccgacuggggccugcugcccggcagcgagggcgccuucaacagcagcgugggcgacagccccgccgugcccgccgagacccagcaggaccccgagcugcacuaccugaacgagagcgccagcacccccgcccccaagcugcccgagagaagcgugcugcugccccugcccaccacccccagcagcggcgaggugcuggagaaggagaaggccagccagcugcaggagcagagcagcaacagcagcggcaaggaggugcugaugcccagccacagccugccccccgccagccuggagcugagcagcgugaccguggagaagagccccgugcugaccgugacccccggcagcaccgagcacagcauccccaccccccccaccagcgccgcccccagcgagagcacccccagcgagcugcccaucagccccaccaccgcccccagaaccgugaaggagcugaccgugagcgccggcgacaaccugaucaucacccugcccgacaacgagguggagcugaaggccuucguggcccccgccccccccguggagaccaccuacaacuacgaguggaaccugaucagccaccccaccgacuaccagggcgagaucaagcagggccacaagcagacccugaaccugagccagcugagcgugggccuguacguguucaaggugaccgugagcagcgagaacgccuucggcgagggcuucgugaacgugaccgugaagcccgccagaagagugaaccugccccccguggccguggugagcccccagcugcaggagcugacccugccccugaccagcgcccugaucgacggcagccagagcaccgacgacaccgagaucgugagcuaccacugggaggagaucaacggccccuucaucgaggagaagaccagcguggacagccccgugcugagacugagcaaccuggaccccggcaacuacagcuucagacugaccgugaccgacagcgacggcgccaccaacagcaccaccgccgcccugaucgugaacaacgccguggacuacccccccguggccaacgccggccccaaccacaccaucacccugccccagaacagcaucacccugaacggcaaccagagcagcgacgaccaccagaucgugcuguacgaguggagccugggccccggcagcgagggcaagcacguggugaugcagggcgugcagacccccuaccugcaccugagcgccaugcaggagggcgacuacaccuuccagcugaaggugaccgacagcagcagacagcagagcaccgccguggugaccgugaucgugcagcccgagaacaacagaccccccguggccguggccggccccgacaaggagcugaucuuccccguggagagcgccacccuggacggcagcagcagcagcgacgaccacggcaucguguucuaccacugggagcacgugagaggccccagcgccguggagauggagaacaucgacaaggccaucgccaccgugaccggccugcaggugggcaccuaccacuucagacugaccgugaaggaccagcagggccugagcagcaccagcacccugaccguggccgugaagaaggagaacaacagcccccccagagccagagccggcggcagacacgugcuggugcugcccaacaacagcaucacccuggacggcagcagaagcaccgacgaccagagaaucgugagcuaccuguggaucagagacggccagagccccgccgccggcgacgugaucgacggcagcgaccacagcguggcccugcagcugaccaaccugguggagggcguguacaccuuccaccugagagugaccgacagccagggcgccagcgacaccgacaccgccaccguggaggugcagcccgaccccagaaagagcggccugguggagcugacccugcaggugggcgugggccagcugaccgagcagagaaaggacacccuggugagacagcuggccgugcugcugaacgugcuggacagcgacaucaaggugcagaagaucagagcccacagcgaccugagcaccgugaucguguucuacgugcagagcagaccccccuucaaggugcugaaggccgccgagguggccagaaaccugcacaugagacugagcaaggagaaggccgacuuccugcuguucaaggugcugagaguggacaccgccggcugccugcugaagugcagcggccacggccacugcgacccccugaccaagagaugcaucugcagccaccuguggauggagaaccugauccagagauacaucugggacggcgagagcaacugcgaguggagcaucuucuacgugaccgugcuggccuucacccugaucgugcugaccggcggcuucaccuggcugugcaucugcugcugcaagagacagaagagaaccaagaucagaaagaagaccaaguacaccauccuggacaacauggacgagcaggagagaauggagcugagacccaaguacggcaucaagcacagaagcaccgagcacaacagcagccugauggugagcgagagcgaguucgacagcgaccaggacaccaucuucagcagagagaagauggagagaggcaaccccaaggugagcaugaacggcagcaucagaaacggcgccagcuucagcuacugcagcaaggacagauaa

SEQ ID NO: 18893 - RNA, 2547 nt, Artificial Sequence
  KIAA0319L__Homo_sapiens__XP_011540484
auggagaagagacugggcgugaagcccaaccccgccagcuggauccugagcggcuacuacuggcagaccagcgccaaguggcugagaagccuguaccuguucuacaccugcuucugcuucagcgugcuguggcugagcaccgacgccagcgagagcagaugccagcagggcaagacccaguucggcgugggccugagaagcggcggcgagaaccaccuguggcugcuggagggcacccccagccugcagagcugcugggccgccugcugccaggacagcgccugccacguguucugguggcuggagggcaugugcauccaggccgacugcagcagaccccagagcugcagagccuucagaacccacagcagcaacagcaugcugguguuccugaagaaguuccagaccgccgacgaccugggcuuccugcccgaggacgacgugccccaccugcugggccugggcuggaacugggccagcuggagacagagcccccccagagccgcccugagacccgccgugagcagcagcgaccagcagagccugaucagaaagcugcagaagagaggcagccccagcgacguggugacccccaucgugacccagcacagcaaggugaacgacagcaacgagcugggcggccugaccaccagcggcagcgccgaggugcacaaggccaucaccaucagcagcccccugaccaccgaccugaccgccgagcugagcggcggccccaagaacgugagcgugcagcccgagaucagcgagggccuggccaccacccccagcacccagcaggugaagagcagcgagaagacccagaucgccgugccccagcccguggcccccagcuacagcuacgccacccccaccccccaggccagcuuccagagcaccagcgcccccuaccccgugaucaaggagcugguggugagcgccggcgagagcgugcagaucacccugcccaagaacgaggugcagcugaacgccuacgugcugcaggagccccccaagggcgagaccuacaccuacgacuggcagcugaucacccaccccagagacuacagcggcgagauggagggcaagcacagccagauccugaagcugagcaagcugacccccggccuguacgaguucaaggugaucguggagggccagaacgcccacggcgagggcuacgugaacgugaccgugaagcccgagcccagaaagaacagaccccccaucgccaucgugagcccccaguuccaggagaucagccugcccaccaccagcaccgugaucgacggcagccagagcaccgacgacgacaagaucgugcaguaccacugggaggagcugaagggcccccugagagaggagaagaucagcgaggacaccgccauccugaagcugagcaagcuggugcccggcaacuacaccuucagccugaccgugguggacagcgacggcgccaccaacagcaccaccgccaaccugaccgugaacaaggccguggacuacccccccguggccaacgccggccccaaccaggugaucacccugccccagaacagcaucacccuguucggcaaccagagcaccgacgaccacggcaucaccagcuacgaguggagccugagccccagcagcaagggcaaggugguggagaugcagggcgugagaacccccacccugcagcugagcgccaugcaggagggcgacuacaccuaccagcugaccgugaccgacaccaucggccagcaggccaccgcccaggugaccgugaucgugcagcccgagaacaacaagcccccccaggccgacgccggccccgacaaggagcugacccugcccguggacagcaccacccuggacggcagcaagagcagcgacgaccagaagaucaucagcuaccugugggagaagacccagggccccgacggcgugcagcuggagaacgccaacagcagcguggccaccgugaccggccugcaggugggcaccuacguguucacccugaccgugaaggacgagagaaaccugcagagccagagcagcgugaacgugaucgugaaggaggagaucaacaagccccccaucgccaagaucaccggcaacguggugaucacccugcccaccagcaccgccgagcuggacggcagcaagagcagcgacgacaagggcaucgugagcuaccuguggaccagagacgagggcagccccgccgccggcgaggugcugaaccacagcgaccaccaccccauccuguuccugagcaaccugguggagggcaccuacaccuuccaccugaaggugaccgacgccaagggcgagagcgacaccgacagaaccaccguggaggugaagcccgaccccagaaagaacaaccugguggagaucauccuggacaucaacgugagccagcugaccgagagacugaagggcauguucaucagacagaucggcgugcugcugggcgugcuggacagcgacaucaucgugcagaagauccagcccuacaccgagcagagaaagaucagcagcguggaggccagccugaaguaa

SEQ ID NO: 18894 - RNA, 3213 nt, Artificial Sequence
  KIAA0355__Homo_sapiens__NP_055501
auguacugcugcagcgcccaggacagcaagauggacuacaagagaagauuccugcugggcggcagcaagcagaaggugcagcagcaccagcaguaccccaugcccgagcugggcagagcccugagcgccccccuggccagcaccgccaccaccgccccccugggcagccugaccgccgccggcagcugccaccacgccaugccccacaccacccccaucgccgacauccagcagggcaucagcaaguaccuggacgcccugaacguguucugcagagccagcaccuuccugaccgaccuguucagcaccguguucagaaacagccacuacagcaaggccgccacccagcugaaggacgugcaggagcacgugauggaggccgccagcagacugaccagcgccaucaagcccgagaucgccaagaugcugauggagcugagcgccggcgccgccaacuucaccgaccagaaggaguucagccugcaggacaucgaggugcugggcagaugcuuccugaccguggugcaggugcacuuccaguuccugacccacgcccugcagaaggugcagcccguggcccacagcugcuucgccgaggugaucgugcccgagaagaagaacagcggcagcggcggcggccugagcggcaugggccacacccccgagguggaggaggccgugagaagcuggagaggcgccgccgaggccaccagcagacugagagagagaggcugcgacggcugccuggccggcaucgaggugcagcagcuguucugcagccagagcgccgccauccccgagcaccagcugaaggagcugaacaucaagaucgacagcgcccugcaggccuacaagaucgcccuggagagccugggccacugcgaguacgccaugaaggccggcuuccaccugaaccccaaggccaucgaggccagccugcagggcugcugcagcgaggccgaggcccagcagaccggcagaagacagacccccccccagcccaugcagugcgagcugcccaccgugcccgugcagaucggcagccacuuccugaagggcgugagcuucaacgagagcgccgccgacaaccugaagcugaagacccacaccaugcugcagcugaugaaggaggccggcugcuacaacggcaucaccagcagagacgacuuccccgugaccgaggugcugaaccaggugugccccagcaccuggagaggcgccugcaagaccgccgugcagcugcuguucggccaggccggccugguggugguggacaccgcccagaucgagaacaaggaggccuacgccccccagaucagccuggagggcagcagaaucguggugcaggugcccagcaccuggugccugaaggaggaccccgccaccaugagccugcugcagagaagccuggaccccgagaagacccugggccugguggacgugcuguacaccgccgugcuggaccugaacagauggagagccggcagagagcaggcccugcccugcauccagauccagcugcagagagagaucugcgacuucggcaaccaggccgaccugcccagcggcaacggcaacaagagcagcggcggccugcagaagaccuucagcaagcugaccagcagauucaccaagaaggccagcugcaccagcagcagcagcagcaccaacuacagcauccagaacacccccagcaagaacaucuucaucgccggcugcagcgaggagaaggccaagaugcccggcaacaucgacaccagacugcagagcauccugaacaucggcaacuuccccagaaccaccgaccccagccagagcgcccagaacagcagcaacaccguggccaacggcuuccugauggagagaagagagaacuuccugcacggcgacgacggcaaggacgagaagggcaugaaccugcccaccgaccaggagaugcaggaggugaucgacuuccugagcggcuucaacaugggccagagccaccagggcagcccccuggugaccagacacaacagcgccgccaccgccauggugaccgagcagaaggccggcgccaugcagccccagcagcccagccugcccgugccccccccccccagagccccccaggccggcgcccacaccccccugaccccccagcccggccuggccccccagcagcagagccccaagcagcagcagccccaggugcaguacuaccagcaccugcugcagcccaucggcccccagcagccccccccccagcccagagcccccggcaagugggugcacggcagcagccagcagcccgcccaggccgugggcgccggccugagcccccugggccaguggcccggcaucagcgaccugagcagcgaccuguacagccugggccuggugagcagcuacauggacaacgugaugagcgaggugcugggccagaagccccagggccccagaaacaacaccuggcccaacagagaccagagcgacggcguguucggcaugcugggcgagauccugcccuucgaccccgccgugggcagcgaccccgaguucgccagauacguggccggcgugagccaggccaugcagcagaagagacaggcccagcacggcagaagacccggcaaccccagaggcaacuggccccccauggacgacgcccacagaaccuggcccuuccccgaguucuucaccgagggcgacggccugcacggcggcuggagcggcgcccagggcgacagcgccagcagcagcgacgagaccagcagcgccaacggcgacagccuguucagcauguucagcggccccgaccugguggccgccgugaagcagagaagaaagcacagcagcggcgagcaggacaccagcacccugcccagccccccccugcugaccaccguggaggacgugaaccaggacaacaagaccaagaccuggccccccaaggcccccuggcagcaccccagcccccugcccagcacccugcccagccccagcgccccccuguacgccgugaccagccccggcagccaguggaacgacaccaugcagaugcugcagagccccgugugggccgccaccaacgacugcagcgccgccgccuucagcuacgugcagacccccccccagcccccccccccccccgcccacaaggccgcccccaagggcuucaaggccuuccccggcaagggcgagagaagacccgccuaccugccccaguacuaa

SEQ ID NO: 18895 - RNA, 1704 nt, Artificial Sequence
  KIAA0391__Homo_sapiens__NP_001243607
augaccuucuaccuguucggcaucagaagcuuccccaagcuguggaagagccccuaccugggccugggccccggccacagcuacgugagccuguuccuggccgacagaugcggcaucagaaaccagcagagacuguucagccugaagaccaugagcccccagaacaccaaggccaccaaccugaucgccaaggccagauaccugagaaaggacgagggcagcaacaagcagguguacagcgugccccacuucuuccuggccggcgccgccaaggagagaagccagaugaacagccagaccgaggaccacgcccuggcccccgugagaaacaccauccagcugcccacccagccccugaacagcgaggagugggacaagcugaaggaggaccugaaggagaacaccggcaagaccagcuucgagagcuggaucaucagccagauggccggcugccacagcagcaucgacguggccaagagccugcuggccuggguggccgccaagaacaacggcaucgugagcuacgaccugcuggugaaguaccuguaccugugcguguuccacaugcagaccagcgaggugaucgacguguucgagaucaugaaggccagauacaagacccuggagcccagaggcuacagccugcugaucagaggccugauccacagcgacagauggagagaggcccugcugcugcuggaggacaucaagaaggugaucacccccagcaagaagaacuacaacgacugcauccagggcgcccugcugcaccaggacgugaacaccgccuggaaccuguaccaggagcugcugggccacgacaucgugcccaugcuggagacccugaaggccuucuucgacuucggcaaggacaucaaggacgacaacuacagcaacaagcugcuggacauccugagcuaccugagaaacaaccagcuguaccccggcgagagcuucgcccacagcaucaagaccugguucgagagcggccagugcagcggcugcggcaagaccaucgagagcauccagcugagccccgaggaguacgagugccugaagggcaagaucaugagagacgugaucgacggcggcgaccaguacagaaagaccaccccccaggagcugaagagauucgagaacuucaucaagagcagaccccccuucgacguggugaucgacggccugaacguggccaagauguuccccaaggugagagagagccagcugcugcugaacguggugagccagcuggccaagagaaaccugagacugcuggugcugggcagaaagcacaugcugagaagaagcagccaguggagcagagacgagauggaggaggugcagaagcaggccagcugcuucuucgccgacgacaucagcgaggacgaccccuuccugcuguacgccacccugcacagcggcaaccacugcagauucaucaccagagaccugaugagagaccacaaggccugccugcccgacgccaagacccagagacuguucuucaaguggcagcagggccaccagcuggccaucgugaacagauuccccggcagcaagcugaccuuccagagaauccugagcuacgacaccguggugcagaccaccggcgacagcuggcacauccccuacgacgaggaccugguggagagaugcagcugcgaggugcccaccaaguggcugugccugcaccagaagaccuaa

SEQ ID NO: 18896 - RNA, 4935 nt, Artificial Sequence
  KIAA0586__Homo_sapiens__NP_001231118
auguucuggugcggcaccugcuucgugaccaacaacaugaagggcagcgaggugagccuggagaagaagaagaagaucaagaugcccgugaagagacugagagagguggugagccagaaccacggcgaccaccuggugcugcugaaggacgagcugcccugcgugccccccgcccugagcgccaacaagagacugcccgugggcaccggcaccagccugaacggcaccagcagaggcagcagcgaccugaccagcgccagaaacugcuaccagccccugcuggagaaccccauggugagcgagagcgacuucagcaaggacguggccgugcaggugcugccccuggacaagaucgaggagaacaacaagcagaaggccaacgacaucuucaucagccaguacaccaugggccagaaggacgcccugagaaccgugcugaagcagaacgugagccugugccugaccggcuggagcgaccacagcggcgugaucaccacccacugcagccuguaccugcugagacugaugagaagcagccaccugagccugcccagcagcugggacuacagagcccagagcaugcccguguucaaggaggugaaggugcaccugcuggaggacgccggcaucgagaaggacgccgugacccaggagaccagaaucagccccagcggcaucgacagcgccaccaccguggccgccgccaccgccgccgccaucgccaccgccgccccccugaucaaggugcagagcgaccuggaggccaaggugaacagcgugaccgagcugcugagcaagcugcaggagaccgacaagcaccugcagagagugaccgagcagcagaccagcauccagagaaagcaggagaagcugcacugccacgaccacgagaagcagaugaacguguucauggagcagcacaucagacaccuggagaagcugcagcagcagcagaucgacauccagacccacuucaucagcgccgcccugaagaccagcagcuuccagcccgugagcaugcccagcagcagagccguggagaaguacagcgugaagcccgagcaccccaaccugggcagcugcaaccccagccuguacaacaccuucgccagcaagcaggccccccugaaggagguggaggacaccagcuucgacaagcagaagagcccccuggagacccccgcccccagaagauucgcccccgugcccgugagcagagacgacgagcugagcaagagagagaaccugcuggaggagaaggagaacauggaggugagcugccacagaggcaacgugagacugcuggagcagauccugaacaacaacgacagccugaccagaaagagcgagagcagcaacaccaccagccugaccagaagcaagaucggcuggacccccgagaagaccaacagauuccccagcugcgaggagcuggagaccaccaaggugaccaugcagaagagcgacgacgugcugcacgaccugggccagaaggagaaggagaccaacagcauggugcagcccaaggagagccugagcaugcugaagcugcccgaccugccccagaacagcgugaagcugcagaccaccaacaccaccagaagcgugcugaaggacgccgagaagauccugagaggcgugcagaacaacaagaaggugcuggaggagaaccuggaggccaucaucagagccaaggacggcgccgccauguacagccugaucaacgcccugagcaccaacagagagaugagcgagaagaucagaaucagaaagaccguggacgaguggaucaagaccaucagcgccgagauccaggacgagcugagcagaaccgacuacgagcagaagagauucgaccagaagaaccagagaaccaagaagggccagaacaugaccaaggacaucagaaccaacacccaggacaagaccgugaacaagagcgugauccccagaaagcacagccagaagcagaucgaggagcacuucagaaaccugcccaugagaggcaugcccgccagcagccugcagaaggagagaaaggagggccugcugaaggccaccaccgugauccaggacgaggacuacaugcugcagguguacggcaagcccguguaccagggccacagaagcacccugaagaagggccccuaccugagauucaacagccccagccccaagagcagaccccagagacccaaggugaucgagagagugaagggcaccaaggugaagagcaucagaacccagaccgacuucuacgccaccaagcccaagaagauggacagcaagaugaagcacagcgugcccgugcugccccacggcgaccagcaguaccuguucagccccagcagagagaugcccaccuucagcggcacccuggagggccaccugauccccauggccauccugcugggccagacccagagcaacagcgacaccaugccccccgccggcgugaucgugagcaagccccaccccgugaccgugaccaccagcaucccccccagcagcagaaagguggagaccggcgugaagaagcccaacaucgccaucguggagaugaagagcgagaagaaggaccccccccagcugaccgugcaggugcugcccagcguggacaucgacagcaucagcaacagcagcgccgacgugcugagcccccugagcagccccaaggaggccagccugccccccgugcagaccuggaucaagacccccgagaucaugaagguggacgaggaggaggugaaguuccccggcaccaacuucgacgagaucaucgacgugauccaggaggaggagaagugcgacgagauccccgacagcgagcccauccuggaguucaacagaagcgugaaggccgacagcaccaaguacaacggcccccccuucccccccguggccagcaccuuccagcccaccgccgacauccuggacaaggugaucgagagaaaggagacccuggagaacagccugauccaguggguggagcaggagaucaugagcagaaucaucagcggccuguuccccgugcagcagcagaucgcccccagcaucagcgugagcgugagcgagaccagcgagccccugaccagcgacaucguggagggcaccagcagcggcgcccugcagcuguucguggacgccggcgugcccgugaacagcaacgugaucaagcacuucgugaacgaggcccuggccgagaccaucgccgugaugcugggcgacagagaggccaagaagcagggccccguggccaccggcgugagcggcgacgccagcaccaacgagaccuaccugcccgccagagugugcaccccccugcccaccccccagcccaccccccccugcagccccagcagccccgccaaggagugcgugcuggugaagacccccgacagcagccccugcgacagcgaccacgacauggccuuccccgugaaggagaucugcgccgagaagggcgacgacaugcccgccaucaugcuggugaacacccccaccgugacccccaccaccacccccccccccgccgccgccguguucacccccacccugagcgacaucagcaucgacaagcugaaggugagcagccccgagcugcccaagcccuggggcgacggcgaccugccccuggaggaggagaaccccaacagcccccaggaggagcugcaccccagagccaucgugaugagcguggccaaggacgaggagcccgagagcauggacuuccccgcccagccccccccccccgagcccgugcccuucaugcccuuccccgccggcaccaaggcccccagccccagccagaugcccggcagcgacagcagcacccuggagagcacccugagcgugaccgugaccgagaccgagacccuggacaagcccaucagcgagggcgagauccuguucagcugcggccagaagcuggcccccaagauccuggaggacaucggccuguaccugaccaaccugaacgacagccugagcagcacccugcacgacgccguggagauggaggacgacccccccagcgagggccaggugaucagaaugagccacaagaaguuccacgccgacgccauccugagcuucgccaagcagaaccaggagagcgccgugagccagcaggccguguaccacagcgaggaccuggagaacagcgugggcgagcugagcgagggccagagaccccagcugaccgccgccgccgagaacauccugaugggccacagccuguacaugcagccccccgugaccaacacccagagccuggaccagcagugcgaccccaagccccugagcagacaguucgacaccgugagcggcagcaucuacgaggacagcugcgccagccacggccccaugagccugggcgagcuggagcuggagcccaacagcaagcuggugcugcccaccacccugcugaccgcccaggagaacgacgugaaccugcccguggccgccgaggacuucagccaguaccagcugaagcagaaccaggacgugaagcagguggagcacaagcccagccagagcuaccugagagugagaaacaagagcgacaucgcccccagccagcagcaggugagccccggcgacauggacagaacccagaucgagcugaaccccuaccugaccugcguguucagcggccugggcgugcacgugaagaaggugagcugcaucggcaagcugggccuguggagauucgugauccagaucaucagcagccccagaugggagagcagcgccacccugagauucaccgacgcccccugccaggacgugagcgacgccgccgugagcgagcccagaggccugcugagcgugagcgagagccagcacaacgccggcggccacggcguguucggcggcagauaccugcugaacggcaagagacagcccgcccagugccugugccacugguucuaa

SEQ ID NO: 18897 - RNA, 3828 nt, Artificial Sequence
  KIAA0825__Homo_sapiens__NP_001139150
auggacugggacgacgaguacagccacaacagcuucgaccugcacugccugcugaacagcuuccccggcgaccuggaguucgagcagaucuucagcgacaucgacgagaagaucgagcagaacgccgccagcaucaagcacugcaucaaggagauccagagcgagaucaacaagcagugccccggcgugcagcugcagaccaccaccgacugcuucgaguggcugaccaacuacaacuacagcaccagcgagagcagcuucaucagccacggcgaccugaucaaguucuucaagacccugcaggaccugcugaagaacgagcagaaccaggaggagaugacccuggaccugcugugggaccugagcugccacagcagcgugagcuuccccagcacccugagcggcaccagcuuccacuuccugagcagaaccagccugcacagcguggaggacaacagcagcauggacgugaagagcaugugggacgacaucagacugcaccugagaagauuccuggugagcaagcugcagagccacaacgagaucaacaacagccagcagaagauccugcugaagaagcagugccugcagcagcugcuguuccuguaccccgagagcgaggugaucaucaaguaccagaacauccagaacaagcugcuggccaaccugcuguggaacugcuuccccagcuacaacagagacagcaaccuggacgugaucgcccacggcuaccagagcaccaugcugaagcuguacagcgugaucaaggaggacuucaacacccugugcgagauccuggcccccagcagcauggugaaguucaucaaggagaccuaccuggacaccgugaccgaggagauggccaaguuccuggagaacuucugcgagcugcaguucagagagaacgccgugagaguggugaagaccagcaagagcagcagcaagcacagaggcgccgugcacgcccuggugaccaccgagugcccccagaagggcagaaacuucagccugccccuggacaagguggaguuccugagccagcugaucaagagcuucaugaagcuggagaagggcgugcaggagcuguucgacgagauccugcugagccugaagaucaccagagacaccagcggcauccuggagaagagcgacagagagguggugauggagaagcccagagccaacgagaccaacauccccagcgagcagagccugcccggcaaggaggccacccugcuggacuucggcuggagaagcgccuucaaggaggugagccugcccauggcccacugcguggugaccgccaucgagggcuucagcaccaagauccugcagcaggagcagaacgagagaagcagcgccgugagcuacgccaugaaccuggugaacgugcagcagguguggcaggacagccacauguuccccgaggaggagcagcccaagaagaucggcaaguucugcagcgacaucauggagaagcuggacaccaugcugccccuggcccuggccugcagagacgacagcuuccaggagaucagagccaaccugguggaggccugcugcaagguggccaccgccgugcugcagagacugcaggagagagccaaggaggugcccagcaaggccccccugaagaaccugcacaccuaccugagcaccgccguguacguguuccagcacuucaagagauacgacaaccugaugaaggagaugaccaagaagcccaucuuccuggugcuggugcagagauaccaggaguucaucaacacccugcaguuccaggugaccaacuacugcgugagagugugcgccaccagcauccugcaggacgccgagagccaccacugggacgacuacaaggccuucuacgagggcgagagaugcagcuucagcauccagauguggcacuacuucugcuggagccugcacuacgaccuguggaccauccugccccccaagcuggcccaggagauccugguggaggugcuggagaagagccugagccugcuggccagcagauacgccagagcccaccccagcagaaagagaaccccccagcugagacuggacgugaccaccauccugaucugcaccgagaacaugcuguggagcgugugcaccagcgugcagaagcugcugaacccccaccagcacaccgacgacaagaucuucaagauccacacccacugcaacaaccuguucaccacccuggugauccugaccagcccccugaccgagcuguacaagaccuuccagcacggccuggacgagagcgccagcgacagccugaagagcuucuucaagcagccccuguacugggugagcugcaucagccacuucuaccccagccugcugagaacccccagcgccggcggccugaaggccgagggccagcugaagcugcugcugagccagcccagaugcaacuggaaccugcugcuggagacccugcugcaccacgacggccugcugcugagaauccugcugaagagcagcaagcaggugagcgacaccgagaacaaccugaaccagggccccagccugauggaggccaucuucaagauccuguaccacugcagcuucagcccccagaccuucgccaacguguucgugagcuacauggaggaggagcagcugugggacuuccuguacaacauccccgugagcaccugcguggaguacgagcuggaggugaucagaugccugagacuggcccugaccgacgccaucaaggacaccgugcagcagaucgugagcgugaugagcagcagaagaaacugcgagaccaaccugaacaagcacaucgugcccgacugccugcuggagagcaugcccaaggaguggaacuacagccccaaggagaccaacagaaaggagagcugcaagagcuucaccagacugaccgcccaggccgugagcaucgugaucagcaagcugcccaccgugaucgccugccugcccccccccgugaaguacuucuucuuccugagcgagagaaagaugagcaagaaguucguggagcugaagaaggccggccugcugguguggaaccugaucgugaucaucugcagaaucuucgaggacggcaacaccguggagcugcugaccggcgccagccuggacagauggagcaaggagaagcugggccugaucugcaugugccugaagagcaucaugggcgaccagaccagcauccacaaccagaugauccagaaggugauccagagcaucgagcagcagaagcccaacuggaucgagagacagcugcugaaggccagaaagcugagcaccgagugcgccuucaugaccaucgagaagagcaccgcccugcaggagggcgacguggcccuggagcugaccgagcagaagaucaacaccauggugcuggaccugugccacaagcccggcggcagagaguaccugagacagaucuaccacaucaugcagcugaacgaggaguaccugaaggagcagcuguucagcaugaacagcagcgaggagaagccccugcccaucagaccccugaagaccacccugagaagcaucgaggaccagcccagcgccuucaaccccuuccacguguacaaggccuucagcgagaacaugcuggaccaggugagcaucaccaaguggaacuggaacugggccaagcugcugcccaacuaccugagacuggacaagaugaccuucagcgugcugcugaagaacagaugggagaugaagaaggacgagacccuggaggaggaggagaaggccauccuggagcaccugaagcagaucugcaccccccagaacagcagcgccagcgacaacaucgaggagcaguaa

SEQ ID NO: 18898 - RNA, 1845 nt, Artificial Sequence
  KIAA0907__Homo_sapiens__NP_055764
augagcgccggcagcgccacccaccccggcgccggcggcagaagaagcaagugggaccagcccgcccccgccccccugcuguuccugccccccgccgcccccggcggcgaggugaccagcagcggcggcagccccggcggcaccaccgccgcccccagcggcgcccuggacgccgccgccgccguggccgccaagaucaacgccaugcugauggccaagggcaagcugaagcccacccagaacgccagcgagaagcugcaggcccccggcaagggccugaccagcaacaagagcaaggacgaccuggugguggccgagguggagaucaacgacgugccccugaccugcagaaaccugcugaccagaggccagacccaggacgagaucagcagacugagcggcgccgccgugagcaccagaggcagauucaugaccaccgaggagaaggccaaggugggccccggcgacagaccccuguaccugcacgugcagggccagaccagagagcugguggacagagccgugaacagaaucaaggagaucaucaccaacggcguggugaaggccgccaccggcaccagccccaccuucaacggcgccaccgugaccguguaccaccagcccgcccccaucgcccagcugagccccgccgugagccagaagccccccuuccagagcggcaugcacuacgugcaggacaagcuguucgugggccuggagcacgccgugcccaccuucaacgugaaggagaagguggagggccccggcugcagcuaccugcagcacauccagaucgagaccggcgccaagguguuccugagaggcaagggcagcggcugcaucgagcccgccagcggcagagaggccuucgagcccauguacaucuacaucagccaccccaagcccgagggccuggccgccgccaagaagcugugcgagaaccugcugcagaccgugcacgccgaguacagcagauucgugaaccagaucaacaccgccgugccccugcccggcuacacccagcccagcgccaucagcagcgugcccccccagccccccuacuaccccagcaacggcuaccagagcggcuaccccguggugccccccccccagcagcccgugcagccccccuacggcgugcccagcaucgugccccccgccgugagccuggcccccggcgugcugcccgcccugcccaccggcgugccccccgugcccacccaguaccccaucacccaggugcagccccccgccagcaccggccagagccccaugggcggccccuucauccccgccgcccccgugaagaccgcccugcccgccggcccccagccccagccccagccccagcccccccugcccagccagccccaggcccagaagagaagauucaccgaggagcugcccgacgagagagagagcggccugcugggcuaccagcacggccccauccacaugaccaaccugggcaccggcuucagcagccagaacgagaucgagggcgccggcagcaagcccgccagcagcagcggcaaggagagagagagagacagacagcugaugcccccccccgccuuccccgugaccggcaucaagaccgagagcgacgagagaaacggcagcggcacccugaccggcagccacgacuaccccgccaagaagaugaagaccaccgagaagggcuucggccugguggccuacgccgccgacagcagcgacgaggaggaggagcacggcggccacaagaacgccagcagcuucccccagggcuggagccugggcuaccaguaccccagcagccagcccagagccaagcagcagaugcccuucuggauggcccccuaa

SEQ ID NO: 18899 - RNA, 4833 nt, Artificial Sequence
  KIAA0922__Homo_sapiens__NP_001124479
auggccggccugagaagaccccagcccggcugcuacugcagaaccgccgccgccgugaaccugcugcugggcguguuccaggugcugcugcccugcugcagacccggcggcgcccagggccaggccaucgagccccugcccaacgugguggagcuguggcaggccgaggagggcgagcugcugcugcccacccagggcgacagcgaggagggccuggaggagcccagccaggagcagagcuucagcgacaagcuguucagcggcaagggccugcacuuccagcccagcgugcuggacuucggcauccaguuccugggccaccccguggccaagauccugcacgccuacaaccccagcagagacagcgaggugguggugaacagcguguucgccgccgccggccacuuccacgugccccccgugcccugcagagugauccccgccaugggcaagaccagcuucagaaucaucuuccugcccaccgaggagggcagcaucgagagcagccuguucaucaacaccagcagcuacggcgugcugagcuaccacgugagcggcaucggcaccagaagaaucagcaccgagggcagcgccaagcagcugcccaacgccuacuuccugcugcccaaggugcagagcauccagcugagccagaugcaggccgagaccaccaacaccagccugcugcaggugcagcuggagugcagccugcacaacaaggugugccagcagcugaagggcugcuaccuggagagcgacgacgugcugagacugcagaugagcaucauggugaccauggagaacuucagcaaggaguucgaggagaacacccagcaccugcuggaccaccugagcaucguguacguggccaccgacgagagcgagaccagcgacgacagcgccgugaacauguacauccugcacagcggcaacagccugaucuggauccaggacaucagacacuucagccagagagacgcccugagccugcaguucgagcccgugcugcugcccaccagcaccaccaacuucaccaagaucgccagcuucaccugcaaggccgccaccagcugcgacagcggcaucaucgaggacgugaagaagaccacccacacccccacccugaaggccugccuguucagcagcguggcccagggcuacuucagaauggacagcagcgccacccaguuccacaucgagacccacgagaacaccagcggccuguggagcaucugguacagaaaccacuucgacagaagcguggugcugaacgacguguuccugagcaaggagaccaagcacaugcugaagauccugaacuucaccggcccccuguuccugccccccggcugcuggaacaucuucagccugaagcuggccgugaaggacaucgccaucaaccuguucaccaacguguuccugaccaccaacaucggcgccaucuucgccaucccccugcagaucuacagcgcccccaccaaggagggcagccugggcuucgaggugaucgcccacugcggcaugcacuacuucaugggcaagagcaaggccggcaaccccaacuggaacggcagccugagccuggaccagagcaccuggaacguggacagcgagcuggccaacaagcuguacgagagauggaagaaguacaagaacggcgacgugugcaagagaaacgugcugggcaccaccagauucgcccaccugaagaagagcaaggagagcgagagcuucguguucuuccugcccagacugaucgccgagcccggccugaugcugaacuucagcgccaccgcccugagaagcagaaugaucaaguacuucguggugcagaaccccagcagcuggcccgugagccugcagcugcugccccugagccuguaccccaagcccgaggcccuggugcaccugcugcacagaugguucggcaccgacaugcagaugaucaacuucaccaccggcgaguuccagcugaccgaggccugccccuaccugggcacccacagcgaggagagcagauucggcauccugcaccugcaccugcagccccuggagaugaagagagugggcgugguguucacccccgccgacuacggcaaggugaccagccugauccugaucagaaacaaccugaccgugaucgacaugaucggcguggagggcuucggcgccagagagcugcugaaggugggcggcagacugcccggcgccggcggcagccugagauucaaggugcccgagagcacccugauggacugcagaagacagcugaaggacagcaagcagauccugagcaucaccaagaacuucaagguggagaacaucggcccccugcccaucaccgugagcagccugaagaucaacggcuacaacugccagggcuacggcuucgaggugcuggacugccaccaguucagccuggaccccaacaccagcagagacaucagcaucguguucacccccgacuucaccagcagcugggugaucagagaccugagccuggugaccgccgccgaccuggaguucagauucacccugaacgugacccugccccaccaccugcugccccugugcgccgacguggugcccggccccagcugggaggagagcuucuggagacugaccguguucuucgugagccugagccugcugggcgugauccugaucgccuuccagcaggcccaguacauccugauggaguucaugaagaccagacagagacagaacgccagcagcagcagccagcagaacaacggccccauggacgugaucagcccccacagcuacaagagcaacugcaagaacuuccuggacaccuacggccccagcgacaagggcagaggcaagaacugccugcccgugaacaccccccagagcagaauccagaacgccgccaagagaagccccgccaccuacggccacagccagaagaagcacaagugcagcguguacuacagcaagcacaagaccagcaccgccgccgccagcagcaccagcaccaccaccgaggagaagcagaccagcccccugggcagcagccugcccgccgccaaggaggacaucugcaccgacgccaugagagagaacuggaucagccugagauacgccagcggcaucaacgugaaccugcagaagaaccugacccugcccaagaaccugcugaacaaggaggagaacacccugaagaacaccaucguguucagcaaccccagcagcgagugcagcaugaaggagggcauccagaccugcauguuccccaaggagaccgacaucaagaccagcgagaacaccgccgaguucaaggagagagagcugugcccccugaagaccagcaagaagcugcccgagaaccaccugcccagaaacagcccccaguaccaccagcccgaccugcccgagaucagcagaaagaacaacggcaacaaccagcaggugcccgugaagaacgagguggaccacugcgagaaccugaagaagguggacaccaagcccagcagcgagaagaagauccacaagaccagcagagaggacauguucagcgagaagcaggacauccccuucguggagcaggaggaccccuacagaaagaagaagcugcaggagaagagagagggcaaccugcagaaccugaacuggagcaagagcagaaccugcagaaagaacaagaagagaggcguggcccccgugagcagaccccccgagcagagcgaccugaagcuggugugcagcgacuucgagagaagcgagcugagcagcgacaucaacgugagaagcuggugcauccaggagagcaccagagaggugugcaaggccgacgccgagaucgccagcagccugcccgccgcccagagagaggccgagggcuacuaccagaagcccgagaagaagugcguggacaaguucugcagcgacagcagcagcgacugcggcagcagcagcggcagcgugagagccagcagaggcagcuggggcagcuggagcagcaccagcagcagcgacggcgacaagaagcccaugguggacgcccagcacuuccugcccgccggcgacagcgugagccagaacgacuuccccagcgaggcccccaucagccugaaccugagccacaacaucugcaaccccaugaccgugaacagccugccccaguacgccgagcccagcugccccagccugcccgccggccccaccggcguggaggaggacaagggccuguacagccccggcgaccuguggcccaccccccccgugugcgugaccagcagccugaacugcacccuggagaacggcgugcccugcgugauccaggagagcgcccccgugcacaacagcuucaucgacuggagcgccaccugcgagggccaguucagcagcgccuacugcccccuggagcugaacgacuacaacgccuuccccgaggagaacaugaacuacgccaacggcuuccccugccccgccgacgugcagaccgacuucaucgaccacaacagccagagcaccuggaacaccccccccaacaugcccgccgccuggggccacgccagcuucaucagcagcccccccuaccugaccagcaccagaagccugagccccaugagcggccuguucggcagcaucugggccccccagagcgacguguacgagaacugcugccccaucaaccccaccaccgagcacagcacccacauggagaaccaggccguggugugcaaggaguacuaccccggcuucaaccccuucagagccuacaugaaccuggacaucuggaccaccaccgccaacagaaacgccaacuucccccugagcagagacagcagcuacugcggcaacguguaa

SEQ ID NO: 18900 - RNA, 2751 nt, Artificial Sequence
  KIAA1024__Homo_sapiens__NP_056021
auggagaccagccaggagaccagccuguuccuggugaagauccuggaggagcuggacagcaagcagaacaccgugagcuaccaggaccugugcaagagccugugcgccagauucgaccugagccagcuggccaagcugagaagcgugcuguucuacaccgccugccuggaccccaacuuccccgccacccuguucaaggacaagaugaagugcaccgugaacaaccagcagagcaagaagaucaugguggccgccgacaucgugaccaucuucaaccugauccagaugaacggcggcgccgccaaggagaagcugcccaccggcagacagaaggugagaaagaaggaggccagcuucgagagcugcagaagcgacaccgagaucugcaacgccgccgagugcgagccccugaacugcgagcugagcgagagaagcuucagcagaggcuaccccaucagacagagcagcaagugcagaaagauggacugcaaggacugcccccaguucgugcccgccagcgagcccaacuuccugcugggcgugagcaaggaggugaagaacagagccgccagccuggacagacugcaggcccuggcccccuacagcgugaccagcccccagcccugcgagaugcagagaaccuacuuccccaugaacaucgagaacgagagcaucagcgaccaggacagccugcccaucaaccagagcaucaaggagaccuucaucagcaacgaggagcccuucguggugcagagcugcgugcagaagagaaacaucuucaaggaggacuuccacaaccugauggccgugagccccagccuggugggccccaucagcaaggccgagaacgagcacagagagccccagagcagaaaggagccccacaagccccccuucuucaaccacagcuucgagaugcccuacaacagccaguaccugaaccccguguacagccccgugcccgacaagagaagagccaagcacgagagccuggacgaccugcaggccagcaccuacuucggccccacccccgugaugggcacccaggaggccagaagaugccugggcaagcccaacaagcagacccccuggcccgccaagagcuggagccugaacaccgaggaggugcccgacuucgagagaagcuucuucaacagaaaccccagcgaggagaagcugcacuaccccaacgccagcagccagacccccaacuuccccgcccccgagagaagacccaccuaccuggugcccaaggaccagcagcccauccugcccaucgccuacgccgccaagcagaacggccugaagagcaaggagaucagcagccccguggaccuggagaagcacgagcccgugaagaaguucaaggacaagagcaucaacugcaccagcggccagcugagcagcgacaccagcagcgugggcacccagaccgagcacgugcuggagcccaagaagugcagagaccugugcaccagcggccagggcaaguacagcgacagacacaccaugaagcacagcgacgacgacagcgagaucgugagcgacgacaucagcgacaucuucagauuccuggacgacaugagcaucagcggcagcaccggcgugauccagagcagcugcuacaacagcaccggcagccugagccagcugcacaagagcgacugcgacagcagccccgagcacaaccugaccaagaucgccaacggcgugcccaacagcaagggcgacaagggcaacagacccgagaacacccaccacagcgaggaggagcugaagaccagcgugugcaagcuggugcugagaaucggcgagaucgagagaaagcuggagagccugagcggcgugagagacgagaucagccaggugcugggcaagcugaacaagcuggaccagaagaugcagcagcccgagaaggugagcgugcagaucgaccugaacagccugaccagcgagggccccagcgacgacagcgccagccccagaauguuccacgcccacagcggcagccacggccccaagcuggagaacaaccccgacuggugcugcagcgacgccagcggcagcaacagcgagagccugagagugaaggcccugaagaagagccuguucaccagacccagcagcagaagccugaccgaggagaacagcgccaccgagagcaagaucgccagcaucagcaacagccccagagacuggagaaccaucaccuacaccaacagagugggccugaacgaggaggagaucaaggacaccggccccggcgacaacaaggacuggcacagaaagagcaaggaggccgacagacaguacgacauccccccccagcacagacugcccaagcagcccaaggacggcuuccugguggagcagguguucagcccccaccccuaccccgccagccugaaggcccacaugaagagcaacccccuguacaccgacaugagacugaccgagcuggccgaggugaagagaggccagcccagcuggaccaucgaggaguacgccagaaacgccggcgacaagggcaagcugaccgcccuggaccugcagacccaggagagccugaaccccaacaaccuggaguacuggauggaggacaucuacacccccggcuacgacagccugcugaagagaaaggaggccgaguucagaagagccaaggugugcaagaucgccgcccugaucgccgccgccgccugcaccgugauccuggugaucguggugcccaucugcaccaugaagagcuaa

SEQ ID NO: 18901 - RNA, 3522 nt, Artificial Sequence
  KIAA1033__Homo_sapiens__NP_056090
auggccguggagacccugagccccgacugggaguucgacagaguggacgacggcagccagaagauccacgccgaggugcagcugaagaacuacggcaaguuccuggaggaguacaccagccagcugagaagaaucgaggacgcccuggacgacagcaucggcgacgugugggacuucaaccuggaccccaucgcccugaagcugcugcccuacgagcagagcagccugcuggagcugaucaagaccgagaacaaggugcugaacaaggugaucaccguguacgccgcccugugcugcgagaucaagaagcugaaguacgaggccgagaccaaguucuacaacggccugcuguucuacggcgagggcgccaccgacgccagcaugguggagggcgacugccagauccagaugggcagauucaucagcuuccugcaggagcugagcugcuucgugaccagaugcuacgagguggugaugaacguggugcaccagcuggccgcccuguacaucagcaacaagaucgcccccaagaucaucgagaccaccggcgugcacuuccagaccauguacgagcaccugggcgagcugcugaccgugcugcugacccuggacgagaucaucgacaaccacaucacccugaaggaccacuggaccauguacaagagacugcugaagagcgugcaccacaaccccagcaaguucggcauccaggaggagaagcugaagcccuucgagaaguuccugcugaagcuggagggccagcugcuggacggcaugaucuuccaggccugcaucgagcagcaguucgacagccugaacggcggcgugagcgugagcaagaacagcaccuucgccgaggaguucgcccacagcaucagaagcaucuucgccaacguggaggccaagcugggcgagcccagcgagaucgaccagagagacaaguacgugggcaucugcggccuguucgugcugcacuuccagaucuucagaaccaucgacaagaaguucuacaagagccugcuggacaucugcaagaaggugcccgccaucacccugaccgccaacaucaucugguuccccgacaacuuccugauccagaagauccccgccgccgccaagcugcuggacagaaagagccugcaggccaucaagauccacagagacaccuuccugcagcagaaggcccagagccugaccaaggacgugcagagcuacuacguguucgugagcagcuggaugaugaagauggagagcauccugagcaaggagcagagaauggacaaguucgccgaggaccugaccaacagaugcaacguguucauccagggcuuccuguacgccuacagcaucagcaccaucaucaagaccaccaugaaccuguacaugagcaugcagaagcccaugaccaagaccagcgugaaggcccugugcagacugguggagcugcugaaggccaucgagcacauguucuacagaagaagcauggugguggccgacagcgugagccacaucacccagcaccugcagcaccaggcccugcacagcaucagcguggccaagaagagagugaucagcgacaagaaguacagcgagcagagacuggacgugcugagcgcccuggugcuggccgagaacacccugaacggccccagcaccaagcagagaagacugaucgugagccuggcccugagcgugggcacccagaugaagaccuucaaggacgaggagcuguucccccugcagguggugaugaagaagcuggaccugaucagcgagcugagagagagagugcagacccagugcgacugcugcuuccuguacuggcacagagccguguuccccaucuaccuggacgacguguacgagaacgccguggacgccgccagacugcacuacauguucagcgcccugagagacugcgugcccgccaugaugcacgccagacaccuggagagcuacgagauccugcuggacugcuacgacaaggagaucauggagauccugaacgagcaccugcuggacaagcugugcaaggagaucgagaaggaccugagacugagcgugcacacccaccugaagcuggacgacagaaaccccuucaaggugggcaugaaggaccuggcccuguucuucagccugaaccccaucagauucuucaacagauucaucgacaucagagccuacgugacccacuaccuggacaagaccuucuacaaccugaccaccguggcccugcacgacugggccaccuacagcgagaugagaaaccuggccacccagagauacggccuggugaugaccgaggcccaccugcccagccagacccuggagcagggccuggacgugcuggagaucaugagaaacauccacaucuucgugagcagauaccuguacaaccugaacaaccagaucuucaucgagagaaccagcaacaacaagcaccugaacaccaucaacaucagacacaucgccaacagcaucagaacccacggcaccggcaucaugaacaccaccgugaacuucaccuaccaguuccugaagaagaaguucuacaucuucagccaguucauguacgacgagcacaucaagagcagacugaucaaggacaucagauucuucagagagaucaaggaccagaacgaccacaaguaccccuucgacagagccgagaaguucaacagaggcaucagaaagcugggcgugacccccgagggccagagcuaccuggaccaguucagacagcugaucagccagaucggcaacgccaugggcuacgugagaaugaucagaagcggcggccugcacugcagcagcaacgccaucagauucgugcccgaccuggaggacaucgugaacuucgaggagcuggugaaggaggagggccuggccgaggagacccugaaggccgccagacaccuggacagcgugcugagcgaccacaccagaaacagcgccgagggcaccgaguacuucaagaugcugguggacguguucgcccccgaguucagaagacccaagaacauccaccugagaaacuucuacaucaucgugcccccccugacccugaacuucguggagcacagcaucagcugcaaggagaagcugaacaagaagaacaagaucggcgccgccuucaccgacgacggcuucgccaugggcguggccuacauccugaagcugcuggaccaguacagagaguucgacagccugcacugguuccagagcgugagagagaaguaccugaaggagaucagagccguggccaagcagcagaacgugcagagcgccagccaggacgagaagcugcugcagaccaugaaccugacccagaagagacuggacguguaccugcaggaguucgagcugcuguacuucagccugagcagcgccagaaucuucuucagagccgacaagaccgccgccgaggagaaccaggagaagaaggagaaggaggaggagaccaagaccagcaacggcgaccugagcgacagcaccgugagcgccgaccccguggugaaguaa

SEQ ID NO: 18902 - RNA, 15018 nt, Artificial Sequence
  KIAA1109__Homo_sapiens__XP_005263344
auggaccagagaaagaacgagagcaucgugcccagcaucacccagcuggaggacuuccugaccgagcacaacagcaacgugguguggcugcugguggccaccauccugagcugcggcuggaucaucuaccugaccuacuacaacagcagaaacgugggccugauccugacccuggugcugaacagacuguacaagcacggcuacauccacaucggcagcuucagcuucagcgugcugagcggcaaggugauggugagagagaucuacuacaucaccgaggacaugagcaucagaauccaggacggcuucaucaucuucagaugguggaagauguacaaccccaagcagaagcagcacgaccccaaggccgagaccagacuguacaucaccgugaacgacuucgaguuccacguguacaacagaagcgaccuguacggcagacugcaggagcuguucggccuggagcccaccaucaucccccccaagaaggacgacgacaagaccagagagaucggcagaaccagaacccagagcaagaucgagagagugaaggugaagaccgagagccaggaccccaccagcagcuggagaagccugauccccgugaucaaggugaacgugagcaccggcagacuggccuucggcaaccacuaccagccccagacccugugcaucaacuucgacgacgccuuccugaccuacaccaccaagccccccagcagccaccuggaccaguucaugcacaucgugaagggcaagcuggagaacgugagagugaugcuggugcccagccccagauacgugggccugcagaacgacgagccccccagacugaugggcgagggcuucguggugaugcagagcaacgacguggacaucuacuacuacauggacgagcccggccuggugcccgaggagaccgaggagaacaucgagggcgagaugagcagcgaggacugcaagcugcaggaccugccccccugcuggggccuggacaucgugugcggcaagggcaccgacuucaacuacggccccugggccgacagacagagagacugccuguggaaguucuucuucccccccgacuaccaggugcugaaggugagcgagaucgcccagcccggcagacccagacagauccuggccuucgagcugagaaugaacaucaucgccgacgccaccaucgaccugcuguucaccaagaacagagagaccaacgccgugcacgugaacgugggcgccggcagcuaccuggagaucaacauccccaugaccguggaggagaacggcuacacccccgccaucaagggccagcugcugcacguggacgccaccaccagcaugcaguacagaacccugcuggaggccgagaugcuggccuuccacaucaacgccagcuaccccagaaucuggaacaugccccagaccuggcagugcgagcuggagguguacaaggccaccuaccacuucaucuucgcccagaagaacuucuucaccgaccugauccaggacuggagcagcgacagcccccccgacaucuucagcuucgugcccuacaccuggaacuucaagaucauguuccaccaguucgagaugaucugggccgccaaccagcacaacuggaucgacugcagcaccaagcagcaggagaacguguaccuggccgccugcggcgagacccugaacaucgacuucagccugcccuucaccgacuucgugcccgccaccugcaacaccaaguucagccugagaggcgaggacguggaccugcaccuguuccugcccgacugccaccccagcaaguacagccuguucaugcuggugaagaacugccaccccaacaagaugauccacgacaccggcauccccgccgagugccagagcggccagaagaccgugaagcccaaguggagaaacgugacccaggagaagagcggcuggguggagugcuggaccgugcccagcgugaugcugaccaucgacuacaccuggcaccccaucuacccccagaaggccgacgagcagcugaagcagagccugagcgagauggaggagaccaugcugagcgugcugagacccagccagaagaccagcgacagaguggugagcagccccagcaccagcagcagaccccccaucgaccccagcgagcugccccccgacaagcugcacguggagauggagcugagccccgacagccagaucacccuguacggcccccugcugaacgccuuccugugcaucaaggagaacuacuucggcgaggacgacauguacauggacuucgaggaggugaucagcagccccgugcugagccugagcaccagcagcagcagcggcuggaccgccgugggcauggagaacgacaagaaggagaacgagggcagcgccaagagcauccacccccuggcccugagacccugggacaucaccgugcuggugaaccuguacaaggugcacggcagacugcccgugcacggcaccaccgacggccccgagugccccaccgccuuccuggagagacugugcuucgagaugaagaagggcuucagagagaccaugcugcagcugauccugagcccccugaacguguucgugagcgacaacuaccagcagagaccccccguggacgaggugcugagagagggccacaucaaccugagcggccugcagcugagagcccacgccauguucagcgccgagggccugccccugggcagcgacagccuggaguacgccuggcugaucgacgugcaggccggcagccugaccgccaaggugaccgccccccagcuggccugccugcuggaguggggccagaccuucguguuccacguggugugcagagaguacgagcuggagagacccaagagcgugaucaucugccagcacggcaucgacagaagauucugcgagagcaagcugagcugcauccccggccccugccccaccagcgacgaccugaaguacaccaugaucagacuggccguggacggcgccgacaucuacaucguggagcacggcugcgccaccaacaucaagaugggcgccaucagaguggccaacugcaaccugcacaaccagagcgugggcgagggcaucagcgccgccauccaggacuuccaggugagacaguacaucgagcagcugaacaacugcagaaucggccugcagcccgccgugcugagaagagccuacuggcuggaggccggcagcgccaaccugggccugaucaccguggacaucgcccuggccgccgaccaccacagcaagcacgaggcccagagacacuuccuggagacccacgacgccagaaccaagagacugugguuccuguggcccgacgacauccugaagaacaagagaugcagaaacaagugcggcugccugggcggcugcagauucuucggcggcaccgugaccggccuggacuucuucaagcuggaggagcugacccccagcagcagcagcgccuucagcagcaccagcgccgagagcgacauguacuacggccagagccugcugcagcccggcgaguggaucaucaccaaggagauccccaagaucaucgacggcaacgugaacggcaugaagagaaaggagugggagaacaagagcgugggcaucgagguggagagaaagacccagcaccugagccugcaggugccccugagaagccacagcagcagcagcagcagcgaggagaacagcagcagcagcgccgcccagccccugcuggccggcgagaaggagagccccagcagcguggccgacgaccaccuggugcagaaggaguuccugcacggcaccaagagagacgacggccaggccagcauccccaccgagaucagcggcaacagccccgugagccccaacacccaggacaagagcgugggccagagcccccugagaagcccccugaagagacaggccagcgugugcagcaccagacugggcagcaccaagagccugaccgccgccuucuacggcgacaagcagcccgugaccgugggcgugcaguucagcagcgacgugagcagaagcgacgagaacgugcuggacagccccaagcagagaagaagcuucggcagcuuccccuacacccccagcgccgacagcaacagcuuccaccaguacagaagcauggacagcagcaugagcauggccgacagcgaggccuacuucagcgccgccgaggaguucgagcccaucagcagcgacgagggccccggcaccuaccccggcagaaagaagaagaagaagcagacccagcagaucgacuacagcagaggcagcaucuaccacagcguggagggcccccugaccggccacggcgagagcauccaggacagcagaacccugcccuucaagacccaccccagccaggccagcuucgugagcgcccugggcggcgaggacgacgugaucgagcaccuguacaucguggagggcgagaagaccguggagagcgagcagaucaccccccagcagcccgugaugaacugcuaccagaccuaccugacccaguuccaggugaucaacuggagcgugaagcaccccaccaacaagagaaccagcaagagcagccugcacagaccccuggaccuggacacccccaccagcgaggagagcagcagcagcuucgagcagcugagcgugcccaccuucaaggugaucaagcagggccugaccgccaacagccugcuggacagaggcaugcagcugagcggcagcaccagcaacacccccuacaccccccuggagaagaagcuggccgacaacaccgacgacgagacccugaccgaggaguggacccuggaccagcccgugagccagaccagaaccaccgccaucguggaggugaagggcaccguggacaucgugcugaccccccugguggccgaggcccuggacagauacaucgaggccauggugcacugcgccagcaccagacaccccgccgccaucguggacgaccugcacgccaaggugcugagagaggccgugcagaacagcaagaccaccuucagcgagaaccugagcagcaagcaggacaucagaggcaccaagaccgagcagagcaccaucggcaccaccaaccagggccaggcccagaccaaccugaccaugaagcaggacaacgugaccaucaagggccugcagaccaacgugagcauccccaaggugaaccugugccugcugcaggccagcguggaggagagccccaccaccgcccccagcagaagcgugacccacgugagccugguggcccugugcuucgacagaaucgccacccaggugagaaugaacagaggcgugguggaggagaccagcaacaacgccgagcccggcagaaccagcaacuucgacagauacgugcacgccaccaagaugcagccccagagcagcggcagccugagaagcaacgccggcgccgagaagggcaaggagaucgccgccaagcugaacauccacagagugcacggccagcugagaggccuggacaccaccgacaucggcaccugcgccaucaccgccauccccuucgagaagagcaaggugcuguucacccuggaggagcuggacgaguucaccuucguggacgagaccgaccagcaggccgugcccgacgugaccagaaucggccccagccaggagaaguggggcuggaucauguucgagugcggccuggagaaccugaccaucaagggcggcagacagagcggcgccgugcuguacaacagcuucggcaucaugggcaaggccagcgacaccgagagaggcggcgugcugaccagcaacaacagcagcgacagccccaccggcagcggcuacaacaccgacgugagcgacgacaaccugcccugcgacagaaccagccccagcagcgaccugaacggcaacagcgugagcgacgagcaggacgagggcguggagagcgacgaccugaagaaggaccugccccugaugccccccccccccgacagcugcagcaugaagcugaccaucaaggagaucugguucagcuucgccgcccccaccaacgugagaagccacacccacgccuucagcagacagcugaaccugcugagcaccgccacccccgccgugggcgccuggcuggugcccaucgaccagcugaagagcagccugaacaagcuggagaccgagggcacccugagaaucugcgccgugaugggcugcaucaugaccgaggcccuggagaacaagagcgugcacuucccccugagaagcaaguacaacagacugaccaagguggccagauuccugcaggagaaccccagcugccugcugugcaacauccugcaccacuaccugcaccaggccaacuacagcaucaucgacgacgccaccaugagcgacggccugcccgcccuggugacccugaagaagggccugguggcccuggccagacaguggaugaaguucaucguggugacccccgccuucaagggcgugagccugcacagacccgcccagccccugaagccccagaucgccauggaccacgagcacgaggacggccugggccuggacaacggcggcggccugcagagcgacaccagcgccgacggcgccgaguucgaguucgacgccgccaccgugagcgagcacaccaugcugcuggagggcaccgccaacagacccccccccggcagcagcggccccgugaccggcgccgagaucaugagaaagcugagcaagacccacacccacagcgacagcgcccugaagaucaagggcauccaccccuaccacagccugagcuacaccagcggcgacaccgccaccgacagccccgugcacgugggcagagccggcaugcccgugaaggacagccccagaaaggagagccugcugagcuaccugaccggcagcuuccccagccugcacaaccugcuggagggcaccccccagagaagcagcgccgccgugaagagcagcagccugaccagaaccggcaacaccguggccaccgacaugcugagcgagcacccccugcugagcgagcccagcagcgugagcuucuacaacuggaugagcaacgccgugggcaacagaggcagcgugcugcaggagagccccgugaccaagagcggccacaacagccugcccaccggcguggcccccaaccugcccaccauccccagcgccagcgacuucaacaccgugcugagcagcgaccagaacacccuggacggcacccacagccagcacagcaccagccaggacgacguggccggcguggaggaggccaaccagggcuuccccgccgugcagcuggccgacgcccaggugguguucaagccccugcugagccacaccggcauccagagccaggacaccaugcccuucugcuacagaauguacuucggcgagcaccugagcuucagcggcacccuggacugccugagagccgacaucguggacagcgacaccgccaaggagagaaagggcaagagagccagaagacagggccacgugaaccugcccccccuggaguucaagcccgcccugaugcugggcaccuucagcaucagcgccguggugauggagaagagcgugugcaccccccagaacagcaccagcgcccugagcuuccacgaccugagcaagagauacuacaacaccuuccacugcaacuucaccaucagcugccagagcaucagccagcacguggacauggcccuggugagacugauccaccaguucagcaccaugaucgacgacaucaaggccacccagaccgacaucaagcugagcagauacaccgccggcagcgccagccccacccccaccuucaagaccagaaagcacagagacuucagaagcagcgacuucagcagaagcagcagaggcagccugaacggcggcaacagagugaacaacgccaagaacaagagaaccaacaacgagaacaacaagaaggagagcagaaacaagaacagccugggcagaagcgagagaagaaccagcaaggugagcagaaagggcagcaaggacgugguggaccacaugaccauccacauggacgacagcgacagcaucaccgugagcgagcagagcgagcccagcgccgagugcuggcagaacauguacaagcugcugaacuucuacagccugaucagcgaccccaccggcauccuggagaagagcagcgagaccuucggccccgccggcgugagaagccccaccgagcccaccugcaaggugguguucgagaacgagcaggacaacagcagccugaccaagacccagagaaagagaagccuggugaccagcgagccccagcacgugacccugaucguguucggcaucggcauggugaacagaacccaccuggaggccgacaucggcggccugaccauggagagcgagcugaagagaauccacggcagcuucacccugaaggagaagaugaaggacgugcugcaccagaagaugaccgagaccugcgccaccgcccacaucggcggcgugaacaucgugcugcuggagggcaucacccccaacauccagcuggaggacuuccccaccagccccaccagcaccgccaagcaggaguuccugaccguggugaagugcagcaucgccaagagccaggcccuguacagcgcccagagaggccugaagaccaacaacgccgccguguucaaggugggcgccaucagcaucaacaucccccagcaccccgccacccugcacagcaugauggugagaagcagccaccagcugagcaagcagaucagcgaccugaucagacagcccagcaccgccccccagcccgugaaggaggacaucgccaccccccugcccagcgagaagacccccaccagcgugaaccagacccccguggagaccaacgaguucccccagcugcccgagggccuggagaagaagcccaucgugcugaaguucagcgccaugcuggacggcaucgccaucggcgccgcccugcugcccagccugaaggccgaguacaagaugggcagaaugagaagccacggcaugaccggcgcccagaccagauucaccuucgagcugcccaaccacagacugagauucaccagcaaggugagcgccaccgacaugagcaccaucccccccagcgccagccugaaccugccccccgugaccaugagcggcaaguacaucauggaggagcacgacagcuacagcgaccagguguggagcaucgacgagcugcccagcaagcagggcuacuaccugcagggcaacuaccugagaugcguggccgaggugggcagcuucgagcacaaccugaccaccgaccugcugaaccaccugguguucgugcagaagguguucaugaaggaggugaacgaggugauccagaaggugagcggcggcgagcagcccaucccccuguggaacgagcacgacggcaccgccgacggcgacaagcccaagauccugcuguacagccugaaccugcaguucaagggcauccaggugaccgccaccacccccagcaugagagccgugagauucgagaccggccugaucgagcuggagcugagcaacagacugcagaccaaggccagccccggcagcagcagcuaccugaagcuguucggcaagugccagguggaccugaaccuggcccugggccagaucgugaagcaccagguguacgaggaggccggcagcgacuuccaccagguggccuacuucaagaccagaaucggccugagaaacgcccugagagaggagaucagcggcagcagcgacagagaggccgugcugaucacccugaacagacccaucguguacgcccagcccguggccuucgacagagccgugcuguucuggcugaacuacaaggccgccuacgacaacuggaacgagcagagaauggcccugcacaaggacauccacauggccaccaaggaggugguggacaugcugcccggcauccagcagaccagcgcccaggccuucggcacccuguuccugcagcugaccgugaacgaccugggcaucugccugcccaucaccaacaccgcccagagcaaccacaccggcgaccuggacaccggcagcgcccuggugcugaccaucgagagcacccugaucaccgccugcagcagcgagagccuggugagcaagggccacuucaagaacuucugcaucagauucgccgacggcuucgagaccagcugggacgacuggaagcccgagauccacggcgaccuggugaugaacgccugcguggugcccgacggcaccuacgaggugugcagcagaaccaccggccaggccgccgccgagagcagcagcgccggcaccuggacccugaacgugcuguggaagaugugcggcaucgacgugcacauggaccccaacaucggcaagagacugaacgcccugggcaacacccugaccacccugaccggcgaggaggacaucgacgacaucgccgaccugaacagcgugaacaucgccgaccugagcgacgaggacgagguggacaccaugagccccaccauccacaccgaggccaccgacuacagaagacaggccgccagcgccagccagcccggcgagcugagaggcagaaagaucaugaagagaaucguggacaucagagagcugaacgagcaggccaaggugaucgacgaccugaagaagcugggcgccagcgagggcaccaucaaccaggagauccagagauaccagcagcuggagagcguggccgugaacgacaucagaagagacgugagaaagaagcugagaagaagcagcaugagagccgccagccugaaggacaaguggggccugagcuacaagcccagcuacagcagaagcaagagcaucagcgccagcggcagacccccccugaagagaauggagagagccagcagcagagugggcgagaccgaggagcugcccgagaucagaguggacgccgccagccccggccccagagugaccuucaacauccaggacaccuuccccgaggagaccgagcuggaccugcugagcgugaccaucgagggccccagccacuacagcagcaacagcgagggcagcugcagcguguucagcagccccaagacccccggcggcuucagccccggcauccccuuccagaccgaggagggcagaagagacgacagccugagcagcaccagcgaggacagcgagaaggacgagaaggacgaggaccacgagagagagagauucuacaucuacagaaagcccagccacaccagcagaaagaaggccaccggcuucgccgccgugcaccagcuguucaccgagagauggcccaccacccccgugaacagaagccugagcggcaccgccaccgagagaaacaucgacuucgagcuggacaucagaguggagaucgacagcggcaagugcgugcugcaccccaccacccugcugcaggagcacgacgacaucagccugagaagaagcuacgacagaagcagcagaagccuggaccaggacagccccagcaagaagaagaaguuccagaccaacuacgccagcaccacccaccugaugaccggcaagaaggugcccagcagccugcagaccaagcccagcgaccuggagaccaccguguucuacauccccggcguggacgugaagcugcacuacaacagcaagacccugaagaccgagagccccaacgccagcagaggcagcagccugcccagaacccugagcaaggagagcaagcuguacggcaugaaggacagcgccaccagcccccccagccccccccugcccagcaccgugcagagcaagaccaacacccugcugcccccccagcccccccccauccccgccgccaagggcaagggcagcggcggcgugaagaccgccaagcuguacgccuggguggcccugcagagccugcccgaggagauggugaucagccccugccugcuggacuuccuggagaaggcccuggagaccauccccaucacccccguggagagaaacuacaccgccgugagcagccaggacgaggacaugggccacuucgagauccccgaccccauggaggagagcaccaccagccuggugagcagcagcaccagcgccuacagcagcuuccccguggacguggugguguacgugagagugcagcccagccagaucaaguucagcugccugcccgugagcagaguggagugcaugcugaagcugcccagccuggaccugguguucagcagcaacagaggcgagcuggagacccugggcaccaccuaccccgccgagacccugagccccggcggcaacgccacccagagcggcaccaagaccagcgccagcaagaccggcauccccggcagcagcggccugggcagcccccugggcagaagcagacacagcagcagccagagcgaccugaccagcagcagcagcagcagcagcggccugagcuucaccgccugcaugagcgacuucagccuguacguguuccaccccuacggcgccggcaagcagaagaccgccgugagcggccugacccccggcagcggcggccugggcaacguggacgaggagcccaccagcgugaccggcagaaaggacagccugagcaucaaccuggaguucgugaaggugagccugagcagaaucagaagaagcggcggcgccagcuucuucgagagccagagcgugagcaagagcgccagcaagauggacaccacccugaucaacaucagcgccgugugcgacaucggcagcgccagcuucaaguacgacaugagaagacugagcgagauccuggccuuccccagagccugguacagaagaagcaucgccagaagacuguuccugggcgaccagaccaucaaccugcccaccagcggccccggcacccccgacagcaucgagggcgugagccagcaccugagccccgagagcagcagaaaggccuacugcaagaccugggagcagcccagccagagcgccagcuucacccacaugccccagagccccaacguguucaacgagcacaugaccaacagcaccaugagccccggcaccgugggccagagccugaagagccccgccagcaucagaagcagaagcgugagcgacagcagcgugcccagaagagacagccugagcaagaccagcacccccuucaacaagagcaacaaggccgccagccagcagggcacccccugggagacccuggugguguucgccaucaaccugaagcagcugaacgugcagaugaacaugagcaacgugaugggcaacaccaccuggaccaccagcggccugaagagccagggcagacugagcgugggcagcaacagagacagagagaucagcaugagcgugggccugggcagaagccagcuggacagcaagggcggcguggugggcggcaccaucgacgugaacgcccuggagaugguggcccacaucagcgagcaccccaaccagcagcccagccacaagauccagaucaccaugggcagcaccgaggccagaguggacuacaugggcagcagcauccugaugggcaucuucagcaacgccgaccugaagcugcaggacgaguggaaggugaaccuguacaacacccuggacagcagcaucaccgacaagagcgagaucuucgugcacggcgaccugaagugggacaucuuccaggugaugaucagcagaagcaccacccccgaccugaucaagaucggcaugaagcugcaggaguucuucacccagcaguucgacaccagcaagagagcccugagcaccuggggccccgugcccuaccugccccccaagaccaugaccagcaaccuggagaagagcagccaggagcagcugcuggacgccgcccaccacagacacuggcccggcgugcugaagguggugagcggcugccacaucagccuguuccagaucccccugcccgaggacggcaugcaguucggcggcagcaugagccugcacggcaaccacaugacccuggccugcuuccacggccccaacuucagaagcaagagcugggcccuguuccaccuggaggagcccaacaucgccuucuggaccgaggcccagaagaucugggaggacggcagcagcgaccacagcaccuacaucgugcagacccuggacuuccaccugggccacaacaccauggugaccaagcccugcggcgcccuggagagccccauggccaccaucaccaagaucaccagaagaagacacgagaaccccccccacggcguggccagcgugaaggagugguucaacuacgugaccgccaccagaaacgaggagcugaaccugcugagaaacguggacgccaacaacaccgagaacagcaccaccgugaagaacagcagccugcugagcggcuucagaggcggcagcagcuacaaccacgagaccgagaccaucuucgcccugcccagaaugcagcuggacuucaagagcauccacgugcaggagccccaggagcccagccugcaggacgccagccugaagcccaagguggagugcagcguggugaccgaguucaccgaccacaucugcgugaccauggacgccgagcugaucauguuccugcacgaccuggugagcgccuaccugaaggagaaggagaaggccaucuucccccccagaauccugagcaccagacccggccagaagagccccaucaucauccacgacgacaacagcagcgacaaggacagagaggacagcaucaccuacaccaccguggacuggagagacuucaugugcaacaccuggcaccuggagcccacccugagacugaucagcuggaccggcagaaagaucgaccccgugggcguggacuacauccugcagaagcugggcuuccaccacgccagaaccaccauccccaaguggcugcagagaggcgugauggacccccuggacaaggugcugagcgugcugaucaagaagcugggcaccgcccugcaggacgagaaggagaagaagggcaaggacaaggaggagcacuaa

SEQ ID NO: 18903 - RNA, 1368 nt, Artificial Sequence
  KIAA1147__Homo_sapiens__NP_001073861
augguggagcagggcgacgccgccccccugcugagaugggccgagggccccgccgugagccugccccaggccccccagccccaggccggcggcuggggcagaggcggcggcggcggcgccagacccgccgccgagccccccagaagaagagagcccgaggagcccgccgcccccgaggugcugcugcagcccggcagacuggagcugggcgacguggaggaggaccaggugguggccguguucguggugaccuucgaccccagaagcggcaacaugguggaguggugccugccccaggacaucgaccuggagggcguggaguucaagagcauggccagcggcagccacaagauccagagcgacuucaucuacuucagaaagggccccuucuucggccuggccugcuucgccaacaugcccguggagagcgagcuggagagaggcgccagaaugaagagcgugggcauccugagccccagcuacacccugcuguacagauacaugcacuuccuggagaaccaggugagacaccagcuggagaugcccggccacuacagccaccuggccgccuucuacgaggacaagaagggcgugcugcacgccggccccggcagaggcagcagccugccccccguguacuggcugcccagcauccacagauacauguaccccgagaugaagaucacccaccccgccggcugcaugagccaguucaucaaguucuucggcgagcagauccugauccuguggaaguucgcccugcugagaaagagaauccugaucuucagccccccccccgugggcguggugugcuacagaguguacugcugcugcugccuggccaacgugagccugcccggcaucggcggcaccauccccgagagcaagcccuucuucuacgugaacguggccgacaucgagagccuggagguggaggugagcuacguggccugcaccaccgagaagaucuucgaggagaagagagagcuguacgacguguacguggacaaccagaacgugaagacccaccacgaccaccugcagccccugcugaagaucaacagcgccgacagagagaaguacagaagacugaacgagcagagacagaugcugcuguacagccaggagguggaggaggacuacaaccccugcgaggaggaccuguucgugcuguucuuccuggagcagaacaacagaaucuuccagacccugcuggaggugagcgccagccaggacaagacccugaccgccgagcacgccagaggcaugggccuggacccccagggcgacagaagcuuccugcuggaccugcuggaggccuacggcaucgacgugaugcuggugaucgacaaccccugcugccccuaa

SEQ ID NO: 18904 - RNA, 2145 nt, Artificial Sequence
  KIAA1161__Homo_sapiens__NP_065753
augcugcagaacccccaggagaagagccaggccuaccccagaagaagaagacccggcugcuacgccuacagacagaaccccgaggccaucgccgccgccgccauguacaccuuccugcccgacaacuucagccccgccaagcccaagcccagcaaggaccugaagccccugcugggcagcgccgugcugggccugcugcuggugcuggccgccgugguggccuggugcuacuacagcgugagccugagaaaggccgagagacugagagccgagcugcuggaccugaaggccggcggcuucagcaucagaaaccagaagggcgagcagguguucagacuggccuucagaagcggcgcccuggaccuggacagcugcagcagagacggcgcccugcugggcugcagccugaccgccgacggccugccccugcacuucuucauccagaccgugagacccaaggacaccgugaugugcuacagagugagaugggaggaggccgcccccggcagagccguggagcacgccauguuccugggcgacgccgccgcccacugguacggcggcgccgagaugagaacccagcacuggcccaucagacuggacggccagcaggagccccagcccuucgugaccagcgacguguacagcagcgacgccgccuucggcggcauccuggagagauacuggcugagcagcagagccgccgccaucaaggugaacgacagcgugcccuuccaccugggcuggaacagcaccgagagaagccugagacugcaggccagauaccacgacacccccuacaagccccccgccggcagagccgccgcccccgagcugagcuacagagugugcgugggcagcgacgugaccagcauccacaaguacauggugagaagauacuucaacaagcccagcagagugcccgcccccgaggccuucagagaccccaucuggagcaccugggcccuguacggcagagccguggaccaggacaaggugcugagauucgcccagcagaucagacugcaccacuucaacagcagccaccuggagaucgacgacauguacacccccgccuacggcgacuucgacuucgacgaggugaaguuccccaacgccagcgacauguucagaagacugagagacgccggcuucagagugacccugugggugcaccccuucgugaacuacaacagcagcagauucggcgagggcguggagagagagcuguucgugagagagcccaccggcagacugcccgcccuggugagaugguggaacggcaucggcgccgugcuggacuucacccaccccaaggccagagacugguuccagggccaccugagaagacugagaagcagauacagcguggccagcuucaaguucgacgccggcgaggugagcuaccugcccagagacuucagcaccuacagaccccugcccgaccccagcguguggagcagaagauacaccgagauggcccugcccuucuucagccuggccgaggugagagugggcuaccagagccagaacaucagcugcuucuucagacugguggacagagacagcguguggggcuacgaccugggccugagaagccugauccccgccgugcugaccgugagcaugcugggcuaccccuucauccugcccgacauggugggcggcaacgccgugccccagagaaccgccggcggcgacgugcccgagagagagcuguacaucagauggcuggagguggccgccuucaugcccgccaugcaguucagcaucccccccuggagauacgacgccgaggugguggccaucgcccagaaguucgccgcccugagagccagccugguggccccccugcugcuggagcuggccggcgaggugaccgacaccggcgaccccaucgugagaccccugugguggaucgcccccggcgacgagaccgcccacagaaucgacagccaguuccugaucggcgacacccugcugguggcccccgugcuggagcccggcaagcaggagagagacguguaccugcccgccggcaaguggagaagcuacaagggcgagcuguucgacaagacccccgugcugcugaccgacuaccccguggaccuggacgagaucgccuacuucaccugggccagcuaa

SEQ ID NO: 18905 - RNA, 3702 nt, Artificial Sequence
  KIAA1211__Homo_sapiens__NP_065773
augggcaccagagccuucagccacgacagcaucuucauccccgacggcggcgccgagagcgagcagaccgugcaggccaugagccaggacaacauccugggcaaggugaagacccugcagcagcagcugggcaagaacaucaaguucggccagagaagccccaacgccauccccaugaacaaggccaacagcggcgaggccagccuggaggaggaccuguuccugaccagccccauggagaucgugacccagcaggacaucgugcugagcgacgccgagaacaagagcagcgacacccccagcagccugagcccccugaaccugcccggcgccggcagcgagauggaggagaagguggcccccgugaagcccagcagacccaagagacacuucagcagcgccggcaccaucgagagcgugaaccuggacgccaucccccuggccaucgccagacuggacaacagcgccgccaagcacaagcuggccgugaagcccaagaagcagagagugagcaagaagcacagaagacuggcccaggacccccagcacgagcagggcggccuggagagcagacccugccuggaccagaacggccaccccggcgaggacaagcccaccuggcacgaggaggagcccaacccccuggacagcgaggaggagagaagaagacaggaggacuacuggagagagcuggaggccaagugcaagagacagaaggccgaggccgccgagaagagaagacuggaggagcagagacugcaggcccuggagagaagacugugggaggagaacagaagacaggagcugcuggaggaggagggcgagggccaggagcccccccuggaggccgagagagcccccagagaggagcagcagagaagccuggaggcccccggcugggaggacgccgagagaagagagagagaggagagagagagacuggaggccgaggaggagagaagaagacugcaggcccaggcccaggccgaggagagaagaagacuggaggaggacgccagacuggaggagagaagaagacaggaggaggaggagggcagaugcgccgaggagcugaagagacaggaggaggaggaggccgagggcugggaggagcuggagcagcaggaggccgaggugcagggcccccccgaggcccuggaggagaccggcgagggcagaagaggcgccgaggaggaggaccugggcgaggaggaggaggagggccaggcccaccuggaggacuggagaggccagcugagcgagcugcugaacgacuucgaggagagacuggaggaccaggagagacugaagcccgagggccagagagagcacagcgaggagcccggcaucugcgaggagcagaaccccgaggccgagagaagaagagagcagcagggcagaagcggcgacuuccagggcgccgacagacccggccccgaggagaagagagaggagggcgacaccgagccccugcugaagcaggagggccccguggaggccgcccagccccccguggagagaaaggaggccgccgcccuggagcagggcagaaagguggaggagcugagauggcaggagguggacgagagacagaccaugcccagacccuacaccuuccaggugagcagcggcggcaagcagauccuguuccccaaggugaaccugagccccgugacccccgccaaggacaccggccugaccgccgccccccaggagcccaaggcccccaaggccagccccgugcagcacgcccugcccagcagccugagcgugccccacaccgccauccuggugaccggcgcccagcugugcggccccgccgugaaccugagccagaucaaggacaccgccugcaagagccugcugggccuggaggagaagaagcacgccgaggcccccgccggcgagaacccccccagaggccccggcgacgccagagccggcagcggcaaggccaagcccagacaggagagccccagcagcgccagcgcccuggccgagugggccagcaucagaagcagaauccugaagaacgccgagagcgaccccagaagcagcgagagagaccagcugagacccggcgacgagagcacccccagaggcagaugcgacagcagaggcaaccagagaaagaccccccccgugaacgccaaguucagcaucaugcccgccuggcagaaguucagcgacggcggcaccgagaccagcaagcagagcaccgaggccgagagcaucagaaagagacccaugcugggccccagcgaggagaccgccccccagcccccccccgccggcgugagagagcugggcaagggccccgagaagagcgagaugcacagagagcccgccgacaccaccgagggcugcaaguucgccaaggaccugcccagcuuccuggugcccagccugcccuaccccccccagaaggugguggcccacaccgaguucaccaccagcagcgacagcgagaccgccaacggcaucgccaagcccgaccccgugaugcccggcggcgaggagaaggccagccccuucggcaucaagcugagaagaaccaacuacagccugagauucaacugcgaccagcaggccgagcagaagaagaagaagagacacagcagcaccggcgacagcgccgacgccggcccccccgccgccggcagcgccagaggcgagaaggagauggagggcguggcccugaagcacggccccagccugccccaggagagaaagcaggcccccagcaccagaagagacagcgccgagcccagcagcagcagaagcgugcccguggcccaccccggccccccccccgccagcagccagacccccgcccccgagcacgacaaggccgccaacaagaugccccuggcccagaagcccgcccuggcccccaagcccaccagccagaccccccccgccagcccccugagcaagcugagcagacccuaccugguggagcugcugagcagaagagccggcagacccgaccccgagcccagcgagcccagcaaggaggaccaggagagcagcgacagaagaccccccagcccccccggccccgaggagagaaagggccagaagagagacgaggaggaggaggccaccgagagaaagcccgccagccccccccugcccgccacccagcaggagaagcccagccagacccccgaggccggcagaaaggagaagcccaugcugcagagcagacacagccuggacggcagcaagcugaccgagaagguggagaccgcccagccccuguggaucacccuggcccugcagaagcagaagggcuucagagagcagcaggccaccagagaggagagaaagcaggccagagaggccaagcaggccgagaagcugagcaaggagaacgugagcgugagcgugcagcccggcagcagcagcgugagcagagccggcagccugcacaagagcaccgcccugcccgaggagaagagacccgagaccgccgugagcagacuggagagaagagagcagcugaagaaggccaacacccugcccaccagcgugaccguggagaucagcgacagcgccccccccgccccccuggugaaggaggugaccaagagauucagcacccccgacgccgcccccgugagcaccgagcccgccuggcuggcccuggccaagagaaaggccaaggccuggagcgacugcccccagaucaucaaguaa

SEQ ID NO: 18906 - RNA, 2973 nt, Artificial Sequence
  KIAA1211L__Homo_sapiens__XP_005263981
augagagagcuggaggcccacagcacccugagaagaauggccgccuucuaccagugcaucagacccgaccccagcgagcuggacaugaucagcaccagagugauggacaucaagcugagagaggccgccgagggccugggcgaggacagcaccggcaagaagaagagcaaguucaagaccuucaagaaguucuucggcaagaagaagagaaaggagagccccagcagcaccggcagcagcaccuggaagcagagccagaccagaaacgaggugaucgccaucgagagcggccccgugggcuacgacagcgaggacgagcuggaggagagcagaggcacccugggcagcagagcccugagccacgacagcaucuucauccccgagagcggccaggacgccaccagacccgugagaguguucagccaggagaacgugugcgacagaaucaaggcccugcagcugaagauccagugcaacgugaagaugggccccccccccccccccggcggccugcccgccaagagaggcgaggacgccggcaugagcagcgaggacgacggccugcccagaagcccccccgagaugagccugcugcacgacgugggccccggcaccaccaucaaggugagcguggugagccccgaccacgugagcgacagcaccgugagcgccagaaucagcgacaacagccuggcccccguggccgacuucagcuaccccgccgagagcagcagcugccuggacaacagcgccgccaagcacaagcugcaggugaagcccagaaaccagagaagcagcaagaugagaagacugagcagcagagcccagagcgagagccugagcgaccugaccugcacccccgaggaggaggagaacgaggagaagccccugcuggaggugagccccgaggagagacccagcagcggccagcaggacguggcccccgacagaggccccgagcccggcccccccgccccccugcccccccccggcggcgccagagccagaagagccagacugcagcacagcagcgcccugaccgccagcguggaggagggcggcgugcccggcgaggaccccagcagcagacccgccacccccgagcuggccgagcccgagagcgcccccacccugagaguggagccccccagcccccccgagggcccccccaaccccggccccgacggcggcaagcaggacggcgaggccccccccgccggccccugcgcccccgccaccgacaaggccgaggagguggugugcgcccccgaggacguggccagccccuuccccaccgccauccccgagggcgacaccaccccccccgagaccgaccccgccgccaccagcgaggcccccagcgccagagacggccccgagagaagcgugcccaaggaggccgagcccaccccccccgugcugcccgacgaggagaagggcccccccggccccgcccccgagcccgagagagaggccgagaccgagcccgagagaggcgccggcaccgagcccgagagaaucggcaccgagcccagcaccgcccccgcccccagcccccccgcccccaagagcugccugaagcacagacccgccgccgccagcgagggccccgccgccagccccccccuggccgccgccgagagcccccccguggagcccggccccggcagccuggacgccgaggccgccgcccccgagagacccaaggccgagagagccgaggccccccccgccggcgccgagagagccgcccccgagagaaaggccgagagaggcggcgccgagcugagaggcgccaagaaguucagcgugagcagcugcagagccagacccagacccggcgugagcagaccccuggagagagccagcggcagacugccccuggccagaagcggccccguguggagaagcgaggccgcccuggacgaccugcagggccugcccgagccccagcacgccaagcccggccccagaaagcuggccgagagaggcccccaggacagcggcgacagagccgccagccccgccggccccagaaagagcccccaggaggccgccgccgcccccggcaccagagagcccugccccgccgcccaggagcccgcccccagcgaggacagaaaccccuuccccgugaagcugagaagcaccagccugagccugaaguacagagacggcgccagccaggaggugaagggcgugaagagauacagcgccgaggugagacuggagagaagccugaccgugcugcccaaggaggagaagugcccccugggcaccgcccccgcccugagaggcaccagagcccccagcgaccagggcaagggcaaggccagaccccccgagccccugagcagcaagcccccccugcccagaaagccccugcugcagagcuucacccugccccaccagcccgccccccccgacgccggccccggcgagagagagcccagaaaggagcccagaaccgccgagaagagaccccugagaagaggcgccgagaagagccugccccccgccgccaccggccccggcgccgacggccagcccgccccccccuggaucaccgugaccagacagaagagaagaggcacccuggaccagccccccaaccaggaggacaagcccggcgccagaacccugaagagcgagcccggcaagcaggccaaggugcccgagagaggccaggagcccgugaagcaggccgacuucgugagaagcaagagcuuccugaucacccccgugaagcccgccguggacagaaagcagggcgccaagcugaacuucaaggagggccugcagagaggcaucagccugagccaccagaaccuggcccagagcgccgugaugauggagaaggagcugcaccagcugaagagagccagcuacgccagcaccgaccagcccagcuggauggagcuggccagaaagaagagccaggccuggagcgacaugccccagaucaucaaguaa

SEQ ID NO: 18907 - RNA, 3795 nt, Artificial Sequence
  KIAA1217__Homo_sapiens__NP_001091970
augcagaccagcgagauggacagaaagagagaggccuuccuggagcaccugaagcagaaguacccccaccacgccagcgccaucaugggccaccaggagagacugagagaccagaccagaagccccaagcugagccacagcccccagccccccagccugggcgaccccguggagcaccugagcgagaccagcgccgacagccuggaggccaugagcgagggcgacgcccccacccccuucagcagaggcagcagaaccagagccagccugcccguggugagaagcaccaaccagaccaaggagagaagccugggcgugcuguaccugcaguacggcgacgagaccaagcagcugagaaugcccaacgagaucaccagcgccgacaccaucagagcccuguucgugagcgccuucccccagcagcugaccaugaagaugcuggagagccccagcguggccaucuacaucaaggacgagagcagaaacguguacuacgagcugaacgacgugagaaacauccaggacagaagccugcugaagguguacaacaaggaccccgcccacgccuucaaccacacccccaagaccaugaacggcgacaugagaaugcagagagagcugguguacgccagaggcgacggccccggcgcccccagacccggcagcaccgcccaccccccccacgccauccccaacagcccccccagcacccccgugccccacagcaugccccccagccccagcagaauccccuacggcggcaccagaagcaugguggugcccggcaacgccaccauccccagagacagaaucagcagccugcccgugagcagacccaucagccccagccccagcgccauccuggagagaagagacgugaagcccgacgaggacaugagcggcaagaacaucgccauguacagaaacgagggcuucuacgccgaccccuaccuguaccacgagggcagaaugagcaucgccagcagccacggcggccacccccuggacgugcccgaccacaucaucgccuaccacagaaccgccaucagaagcgccagcgccuacugcaaccccagcaugcaggccgagaugcacauggagcagagccuguacagacagaagagcagaaaguaccccgacagccaccugcccacccugggcagcaagaccccccccgccagcccccacagagugagcgaccugagaaugaucgacaugcacgcccacuacaacgcccacggccccccccacaccaugcagcccgacagagccagccccagcagacaggccuucaagaaggagcccggcacccugguguacaucgagaagcccagaagcgccgccggccugagcagccugguggaccugggccccccccugauggagaagcagguguucgccuacagcaccgccaccauccccaaggacagagagaccagagagagaaugcaggccauggagaagcagaucgccagccugaccggccuggugcagagcgcccuguucaagggccccaucaccagcuacagcaaggacgccagcagcgagaagaugaugaagaccaccgccaacagaaaccacaccgacagcgccggcaccccccacgugagcggcggcaagaugcugagcgcccuggagagcaccgugccccccagccagcccccccccgugggcaccagcgccauccacaugagccugcuggagaugagaagaagcguggccgagcugagacugcagcugcagcagaugagacagcugcagcugcagaaccaggagcugcugagagccaugaugaagaaggccgagcuggagaucagcggcaaggugauggagaccaugaagagacuggaggaccccgugcagagacagagagugcugguggagcaggagagacagaaguaccugcacgaggaggagaagaucgugaagaagcugugcgagcuggaggacuucguggaggaccugaagaaggacagcaccgccgccagcagacuggugacccugaaggacguggaggacggcgccuuccugcugagacaggugggcgaggccguggccacccugaagggcgaguuccccacccugcagaacaagaugagagccauccugagaaucgagguggaggccgugagauuccugaaggaggagccccacaagcuggacagccugcugaagagagugagaagcaugaccgacgugcugaccaugcugagaagacacgugaccgacggccugcugaagggcaccgacgccgcccaggccgcccaguacauggccauggagaaggccaccgccgccgaggugcugaagagccaggaggaggccgcccacaccagcggccagcccuuccacagcaccggcgcccccggcgacgccaagagcgagguggugccccugagcggcaugauggugagacacgcccagagcagccccguggugauccagcccagccagcacagcguggcccugcugaaccccgcccagaaccugccccacguggccagcagccccgccgugccccaggaggccaccagcacccugcagaugagccaggccccccagagcccccagauccccaugaacggcagcgccaugcagagccuguucaucgaggagauccacagcgugagcgccaagaacagagccgugagcaucgagaaggccgagaagaagugggaggagaagagacagaaccuggaccacuacaacggcaaggaguucgagaagcugcuggaggaggcccaggccaacaucaugaagagcauccccaaccuggagaugccccccgccaccggcccccugcccagaggcgacgcccccguggacaagguggagcugagcgaggacagccccaacagcgagcaggaccuggagaagcugggcggcaagagcccccccccccccccccccccccccagaagaagcuaccugcccggcagcggccugaccaccaccagaagcggcgacgugguguacaccggcagaaaggagaacaucaccgccaaggccagcagcgaggacgccggccccagcccccagaccagagccaccaaguaccccgccgaggagcccgccagcgccuggacccccagccccccccccgugaccaccagcagcagcaaggacgaggaggaggaggaggaggagggcgacaagaucauggccgagcugcagggcagcagcggcgccccccagaccagcagaaugcccgugcccaugagcgccaagaacagacccggcacccuggacaagcccggcaagcagagcaagcugcaggaccccagacaguacagacaggccaacggcagcgccaagaagagcggcggcgacuucaagcccaccagccccagccugcccgccagcaagauccccgcccugagccccagcagcggcaagagcagcagccugcccagcagcagcggcgacagcagcaaccugcccaacccccccgccaccaagcccagcaucgccagcaacccccugagcccccagaccggcccccccgcccacagcgccagccugauccccagcgugagcaacggcagccugaaguuccagagccugacccacaccggcaagggccaccaccugagcuucagcccccagagccagaacggcagagccccccccccccugagcuucagcagcagcccccccagccccgccagcagcgugagccugaaccagggcgccaagggcaccagaaccauccacacccccagccugaccagcuacaaggcccagaacggcagcagcagcaaggccacccccagcaccgccaaggagaccagcuaa

SEQ ID NO: 18908 - RNA, 1866 nt, Artificial Sequence
  KIAA1279__Homo_sapiens__NP_056449
auggccaacgugcccugggccgaggugugcgagaaguuccaggccgcccuggcccugagcagaguggagcugcacaagaaccccgagaaggagcccuacaagagcaaguacagcgccagagcccugcuggaggaggugaaggcccugcugggccccgcccccgaggacgaggacgagagacccgaggccgaggacggccccggcgccggcgaccacgcccugggccugcccgccgaggugguggagcccgagggccccguggcccagagagccgugagacuggccgugaucgaguuccaccugggcgugaaccacaucgacaccgaggagcugagcgccggcgaggagcaccuggugaagugccugagacugcugagaagauacagacugagccacgacugcaucagccugugcauccaggcccagaacaaccugggcauccuguggagcgagagagaggagaucgagaccgcccaggccuaccuggagagcagcgaggcccuguacaaccaguacaugaaggaggugggcagccccccccuggaccccaccgagagauuccugcccgaggaggagaagcugaccgagcaggagagaagcaagagauucgagaagguguacacccacaaccuguacuaccuggcccagguguaccagcaccuggagauguucgagaaggccgcccacuacugccacagcacccugaagagacagcuggagcacaacgccuaccaccccaucgagugggccaucaacgccgccacccugagccaguucuacaucaacaagcugugcuucauggaggccagacacugccugagcgccgccaacgugaucuucggccagaccggcaagaucagcgccaccgaggacacccccgaggccgagggcgaggugcccgagcuguaccaccagagaaagggcgagaucgccagaugcuggaucaaguacugccugacccugaugcagaacgcccagcugagcaugcaggacaacaucggcgagcuggaccuggacaagcagagcgagcugagagcccugagaaagaaggagcuggacgaggaggagagcaucagaaagaaggccgugcaguucggcaccggcgagcugugcgacgccaucagcgccguggaggagaaggugagcuaccugagaccccuggacuucgaggaggccagagagcuguuccugcugggccagcacuacguguucgaggccaaggaguucuuccagaucgacggcuacgugaccgaccacaucgagguggugcaggaccacagcgcccuguucaaggugcuggccuucuucgagaccgacauggagagaagaugcaagaugcacaagagaagaaucgccaugcuggagccccugaccguggaccugaacccccaguacuaccugcuggugaacagacagauccaguucgagaucgcccacgccuacuacgacaugauggaccugaagguggccaucgccgacagacugagagaccccgacagccacaucgugaagaagaucaacaaccugaacaagagcgcccugaaguacuaccagcuguuccuggacagccugagagaccccaacaagguguuccccgagcacaucggcgaggacgugcugagacccgccaugcuggccaaguucagaguggccagacuguacggcaagaucaucaccgccgaccccaagaaggagcuggagaaccuggccaccagccuggagcacuacaaguucaucguggacuacugcgagaagcaccccgaggccgcccaggagaucgagguggagcuggagcugagcaaggagauggugagccugcugcccaccaagauggagagauucagaaccaagauggcccugaccuaa

SEQ ID NO: 18909 - RNA, 3015 nt, Artificial Sequence
  KIAA1324__Homo_sapiens__XP_011540127
auggccgagcccggccacagccaccaccugagcgccagagugagaggcagaaccgagagaagaauccccagacuguggagacugcugcugugggccggcaccgccuuccaggugacccagggcaccggccccgagcugcacgccugcaaggagagcgaguaccacuacgaguacaccgccugcgacagcaccggcagcagauggagaguggccgugccccacacccccggccugugcaccagccugcccgaccccaucaagggcaccgagugcagcuucagcugcaacgccggcgaguuccuggacaugaaggaccagagcugcaagcccugcgccgagggcagauacagccugggcaccggcaucagauucgacgagugggacgagcugccccacggcuucgccagccugagcgccaacauggagcuggacgacagcgccgccgagagcaccggcaacugcaccagcagcaagugggugcccagaggcgacuacaucgccagcaacaccgacgagugcaccgccacccugauguacgccgugaaccugaagcagagcggcaccgugaacuucgaguacuacuaccccgacagcagcaucaucuucgaguucuucgugcagaacgaccagugccagcccaacgccgacgacagcagauggaugaagaccaccgagaagggcugggaguuccacagcguggagcugaacagaggcaacaacgugcuguacuggagaaccaccgccuucagcguguggaccaaggugcccaagcccgugcuggugagaaacaucgccaucaccggcguggccuacaccagcgagugcuuccccugcaagcccggcaccuacgccgacaagcagggcagcagcuucugcaagcugugccccgccaacagcuacagcaacaagggcgagaccagcugccaccagugcgaccccgacaaguacagcgagaagggcagcagcagcugcaacgugagacccgccugcaccgacaaggacuacuucuacacccacaccgccugcgacgccaacggcgagacccagcugauguacaagugggccaagcccaagaucugcagcgaggaccuggagggcgccgugaagcugcccgccagcggcgugaagacccacugcccccccugcaaccccggcuucuucaagaccaacaacagcaccugccagcccugccccuacggcagcuacagcaacggcagcgacugcaccagaugccccgccggcaccgagcccgccgugggcuucgaguacaagugguggaacacccugcccaccaacauggagaccaccgugcugagcggcaucaacuucgaguacaagggcaugaccggcugggagguggccggcgaccacaucuacaccgccgccggcgccagcgacaacgacuucaugauccugacccugguggugcccggcuucagacccccccagagcgugauggccgacaccgagaacaaggagguggccagaaucaccuucguguucgagacccugugcagcgugaacugcgagcuguacuucauggugggcgugaacagcagaaccaacacccccguggagaccuggaagggcagcaagggcaagcagagcuacaccuacaucaucgaggagaacaccaccaccagcuucaccugggccuuccagagaaccaccuuccacgaggccagcagaaaguacaccaacgacguggccaagaucuacagcaucaacgugaccaacgugaugaacggcguggccagcuacugcagacccugcgcccuggaggccagcgacgugggcagcagcugcaccagcugccccgccggcuacuacaucgacagagacagcggcaccugccacagcugccccaccaacaccauccugaaggcccaccagcccuacggcgugcaggccugcgugcccugcggccccggcaccaagaacaacaagauccacagccugugcuacaacgacugcaccuucagcagaaacacccccaccagaaccuucaacuacaacuucagcgcccuggccaacaccgugacccuggccggcggccccagcuucaccagcaagggccugaaguacuuccaccacuucacccugagccugugcggcaaccagggcagaaagaugagcgugugcaccgacaacgugaccgaccugagaauccccgagggcgagagcggcuucagcaagagcaucaccgccuacgugugccaggccgugaucaucccccccgaggugaccggcuacaaggccggcgugagcagccagcccgugagccuggccgacagacugaucggcgugaccaccgacaugacccuggacggcaucaccagccccgccgagcuguuccaccuggagagccugggcauccccgacgugaucuucuucuacagaagcaacgacgugacccagagcugcagcagcggcagaagcaccaccaucagagugagaugcagcccccagaagaccgugcccggcagccugcugcugcccggcaccugcagcgacggcaccugcgacggcugcaacuuccacuuccugugggagagcgccgccgccugcccccugugcagcguggccgacuaccacgccaucgugagcagcugcguggccggcauccagaagaccaccuacguguggagagagcccaagcugugcagcggcggcaucagccugcccgagcagagagugaccaucugcaagaccaucgacuucuggcugaaggugggcaucagcgccggcaccugcaccgccauccugcugaccgugcugaccugcuacuucuggaagaagaaccagaagcuggaguacaaguacagcaagcuggugaugaacgccacccugaaggacugcgaccugcccgccgccgacagcugcgccaucauggagggcgaggacguggaggacgaccugaucuucaccagcaagaagagccuguucggcaagaucaagagcuucaccagcaagcagcccgcccccgugaccaucagccugagcgaggacagcuaa

SEQ ID NO: 18910 - RNA, 3090 nt, Artificial Sequence
  KIAA1324L__Homo_sapiens__NP_001136221
augcuguucagagccagaggccccgugagaggcagaggcuggggcagacccgccgaggcccccagaagaggcagaagcccccccuggagccccgccuggaucugcugcugggcccuggccggcugccaggccgccugggccggcgaccugcccagcagcagcagcagaccccugccccccugccaggagaaggacuaccacuucgaguacaccgagugcgacagcagcggcagcagauggagaguggccauccccaacagcgccguggacugcagcggccugcccgaccccgugagaggcaaggagugcaccuucagcugcgccagcggcgaguaccuggagaugaagaaccaggugugcagcaagugcggcgagggcaccuacagccugggcagcggcaucaaguucgacgagugggacgagcugcccgccggcuucagcaacaucgccaccuucauggacaccguggugggccccagcgacagcagacccgacggcugcaacaacagcagcuggauccccagaggcaacuacaucgagagcaacagagacgacugcaccgugagccugaucuacgccgugcaccugaagaagagcggcuacguguucuucgaguaccaguacguggacaacaacaucuucuucgaguucuucauccagaacgaccagugccaggagauggacaccaccaccgacaagugggugaagcugaccgacaacggcgaguggggcagccacagcgugaugcugaagagcggcaccaacauccuguacuggagaaccaccggcauccugaugggcagcaaggccgugaagcccgugcuggugaagaacaucaccaucgagggcguggccuacaccagcgagugcuuccccugcaagcccggcaccuucagcaacaagcccggcagcuucaacugccaggugugccccagaaacaccuacagcgagaagggcgccaaggagugcaucagaugcaaggacgacagccaguucagcgaggagggcagcagcgagugcaccgagagaccccccugcaccaccaaggacuacuuccagauccacacccccugcgacgaggagggcaagacccagaucauguacaaguggaucgagcccaagaucugcagagaggaccugaccgacgccaucagacugccccccagcggcgagaagaaggacugcccccccugcaaccccggcuucuacaacaacggcagcagcagcugccaccccugcccccccggcaccuucagcgacggcaccaaggagugcagacccugccccgccggcaccgagcccgcccugggcuucgaguacaagugguggaacgugcugcccggcaacaugaagaccagcugcuucaacgugggcaacagcaagugcgacggcaugaacggcugggagguggccggcgaccacauccagagcggcgccggcggcagcgacaacgacuaccugauccugaaccugcacauccccggcuucaagccccccaccagcaugaccggcgccaccggcagcgagcugggcagaaucaccuucguguucgagacccugugcagcgccgacugcgugcuguacuucaugguggacaucaacagaaagagcaccaacgugguggagagcuggggcggcaccaaggagaagcaggccuacacccacaucaucuucaagaacgccaccuucaccuucaccugggccuuccagagaaccaaccagggccaggacaacagaagauucaucaacgacauggugaagaucuacagcaucaccgccaccaacgccguggacggcguggccagcagcugcagagccugcgcccugggcagcgagcagagcggcagcagcugcgugcccugcccccccggccacuacaucgagaaggagaccaaccagugcaaggagugcccccccgacaccuaccugagcauccaccagguguacggcaaggaggccugcauccccugcggccccggcagcaagaacaaccaggaccacagcgugugcuacagcgacugcuucuucuaccacgagaaggagaaccagagccugcacuacgacuucagcaaccugagcagcgugggcagccugaugaacggccccagcuucaccagcaagggcaccaaguacuuccacuucuucaacaucagccugugcggccacgagggcaagaagauggcccugugcaccaacaacaucaccgacuucaccgugaaggagaucguggccggcagcgacgacuacaccaaccuggugggcgccuucgugugccagagcaccaucauccccagcgagagcaagggcuucagagccgcccugagcagccagagcaucauccuggccgacaccuucaucggcgugaccguggagaccacccugaagaacaucaacaucaaggaggacauguuccccgugcccaccagccagauccccgacgugcacuucuucuacaagagcagcaccgccaccaccagcugcaucaacggcagaagcaccgccgugaagaugagaugcaaccccaccaagagcggcgccggcgugaucagcgugcccagcaagugccccgccggcaccugcgacggcugcaccuucuacuuccugugggagagcgccgaggccugcccccugugcaccgagcacgacuuccacgagaucgagggcgccugcaagagaggcuuccaggagacccuguacguguggaacgagcccaaguggugcaucaagggcaucagccugcccgagaagaagcuggccaccugcgagaccguggacuucuggcugaaggugggcgccggcgugggcgccuucaccgccgugcugcugguggcccugaccugcuacuucuggaagaagaaccagaagcuggaguacaaguacagcaagcuggugaugaccaccaacagcaaggagugcgagcugcccgccgccgacagcugcgccaucauggagggcgaggacaacgaggaggaggugguguacagcaacaagcagagccugcugggcaagcugaagagccuggccaccaaggagaaggaggaccacuucgagagcgugcagcugaagaccagcagaagccccaacaucuaa

SEQ ID NO: 18911 - RNA, 3354 nt, Artificial Sequence
  KIAA1377__Homo_sapiens__NP_065853
augcuggccggcagacccggcaccagaagcgccgugggcgagcugggcaccgagagcagcgacaaccuggacagagccccccugggccccagagagagcggcggccaccacagacccggcagcuaccuggacaugaagauccaccuggagaagaaccuggaggaggagagacagauccugcugcagcagcagaagaucugcagaaacagagccagaaaguacuucguggagagcaacagaagaaagaaggccuucgaggagaagagaaaggagcaggaggagaaggagcaccagaucagagagcagauccugcagcagagaaagcagaaguucgaggaggugaccgagaaguuccagagagcccacgugccccugagccagagaagaaaggccgugagcagaaagcccgugcccccccuggaggaggcccugaagcagauccaggagagcaaccugaagagcgaggugaaccugcccuucagcagaagacccaccaucaacuggagagccaucgacagcgcccugcccagcgcccugagcaagaacgaccacaagcaccagaagcagcugcugagcaagaucaacugcgagaaggagaugaacgagaacaugagagccacccuggccaccagcaagaacguguuccagcugaagcuggaggagacccagaagcugcuggaggaccagcaccugagcaaccugcagaaguucugcgacgaggugaaccagaucaccaacagcgagacccugagcagcaucgacagccuggaggccaccgagcacgaggagaucuaccugacccugaacaaggagcacagcaccagcauccagagaaacaccaucagccugaagcccgccaacaugcagagcaccaaccugagcugcuucgacgaggacaagcuggccuucagcaagacccagcacaucaacaacuggcugaccaaccuggacgccagcaacacccagaacgugaccgccuucagcgacauccugagcaagagcaacgugcugcccagcugggaguacuucaacagcaaggagcagaaccccagcccccugaacggcaccguggagagagccaccaacaccgccaacaacagcgugcccuucgugagcagcccccccauguucgugcuggacaagaagugcgagaagaccagcgagaccagcaccaugagaaccaccgacagcaccagcggcgccuucaagagagagagaccccuggugaccgagagccccaccuucaaguucagcaagagccagagcaccagcgacagccugacccaggagguggccaccuuccccgaccaggagaaguacagcgagcugaaccaggagaacggcaccaccagcauccccaccagcugcgugcccguggccaccccccuggugcugcccagcaacauccagagcgccagacccagcgccaagaacagcauccacaucaaggagaucgacgccgugcagugcagcgacaagcuggacgagcugaaggacggcaaggaggaggagaucaaguacuucaacugcaacaaggaggagcugccccuguucagcgacagcuuccaggacgccuacaucccccacaaccccgacagcaaggacgagaagcagaagcuggccgagaccagcagccugagcaacgugaccagcaacuacgacuucgugggccagcacaagaagaugaaguacaacauccacgagagaaacggcgugagauuccugaagagcauccugaagaaggagagcaaguacgagcacggcuaccugaaggcccugaucaucaaccagagcuucaaguucggcaaccagaaggccgccgccaucagagacagcaucgagcugaccaaggagaagggcgccgagauccccaagaccaucaagaagcugagaugguucgacgagaccagcaacaucgagaacaacgccgagaacagccacagccugaagaacaagaccggcaccacccagcagcacagccagcaguuccacauccagagcggcgccggcagcaacaucaucagcgugagcaccugcgccgugaacagcgccgacaccaagaagagcagagaggacagcaucagcgagaacgugaccacccugggcggcagcggcgccgaccacaugccccugaacugcuucauccccagcggcuacaacuucgccaagcacgccuggcccgccagcaagaaggaggagagcaagauccccgugcacgacgacagcaagaccaagcagggcaagccccagagaggcagagccaagaucaucagaaagcccggcagcgccaaggugcagagcggcuucaucugcaccaacagaaagggcgccgugauccagccccagagcgccagcaaggugaacaucuucacccaggcccagggcaagcugaucauccccugcccccccccccagagcaccagcaacaucagaagcggcaagaacauccaggugagccagugccagcccgugacccccgagaacccccagaacaucaucacccacaacagcuucaacagcaagcacgugcugcccaccgagcacagccugaaccaguggaaccaggagagcagcagcccccugagcaacgccugcagcgaccuggugaccgugauccccagccugcccagcuacugcagcagcgagugccagaccuucgccaagaucaaccacagcaacggcacccaggccguggccagacaggacgccacccuguacugcacccagagaagccccgugugcgaggagagcuaccccagcgugacccugagaaccgccgaggaggagagcgugccccuguggaagagaggccccaacgugcugcaccagaacaagagagccaccggcagcaccgugaugagaagaaagagaaucgccgagaccaagagaagaaacauccuggagcagaagagacagaaccccggcagcgugggccagaaguacagcgagcagaucaacaacuucggccagagcgugcugcugagcagcagcgagcccaagcagaccaccagaggcaccagcuacaucgaggaggugagcgacagcaccagcgaguuccugauggccgagaaccuggugaaggccagcgugcccgaggacgagauccugaccgugcugaacagcaagcagauccagaagagcaaccugccccugaacaagacccagcaguucaacaucugcacccugagcgccgaggagcagaagauccuggagagccugaacgaccugagcgagagacugcacuacauccaggagagcaucugcaagaaccccagcaucaagaacacccugcagaucaucccccugcuggagaagagagaggacagaaccagcagcugcagagacaagagauaa

SEQ ID NO: 18912 - RNA, 1572 nt, Artificial Sequence
  KIAA1456__Homo_sapiens__XP_005273641
augaagauccaguucaagaaggagugccagaacagaaagggccugugcuuccugcagagacugacccaggagguguaccacgagaaggacagaaccaucagcuuccacagcuacaaguucagcuucacccugcacaucgagaaggugaugagaagcaacugccacagccuggagguggagaccgccgugauccacaaggacaagagaauggaccacgaggccgcccagcuggagaagcagcacgugcacaacguguacgagagcaccgcccccuacuucagcgaccugcagagcaaggccuggcccagagugagacaguuccugcaggagcagaagcccggcagccugaucgccgacaucggcugcggcaccggcaaguaccugaaggugaacagccaggugcacaccgugggcugcgacuacugcggcccccugguggagaucgccagaaacagaggcugcgaggccauggugugcgacaaccugaaccugcccuucagagacgagggcuucgacgccaucaucagcaucggcgugauccaccacuucagcaccaagcagagaagaaucagagccaucaaggagauggccagagugcuggugcccggcggccagcugaugaucuacgugugggccauggagcagaagaacagacacuucgagaagcaggacgugcuggugcccuggaacagagcccugugcagccagcuguucagcgagagcagccagagcggcagaaagagacagugcggcuaccccgagagaggccaccccuaccacccccccugcagcgagugcagcugcagcgugugcuucaaggagcagugcggcagcaagagaagccacagcgugggcuacgagcccgccauggccagaaccugcuucgccaacaucagcaaggagggcgaggaggaguacggcuucuacagcacccugggcaagagcuucagaagcugguucuucagcagaagccuggacgagagcacccugagaaagcagaucgagagagugagaccccugaagaacaccgaggugugggccagcagcaccgugaccgugcagcccagcagacacagcagccuggacuucgaccaccaggagcccuucagcaccaagggccagagccuggacgaggagguguucguggagagcagcagcggcaagcaccuggaguggcugagagcccccggcacccugaagcaccugaacggcgaccaccagggcgagaugagaagaaacggcggcggcaacuuccuggacagcaccaacaccggcgugaacugcguggacgccggcaacaucgaggacgacaaccccagcgccagcaagauccugagaagaaucagcgccguggacagcaccgacuucaaccccgacgacaccaugagcguggaggacccccagaccgacgugcuggacagcaccgccuucaugagauacuaccacguguucagagagggcgagcugugcagccugcugaaggagaacgugagcgagcugagaauccugagcagcggcaacgaccacggcaacuggugcaucaucgccgagaagaagagaggcugcgacuaa

SEQ ID NO: 18913 - RNA, 4080 nt, Artificial Sequence
  KIAA1462__Homo_sapiens__XP_011517910
auguacagcguggaggaccugcugaucagccacggcuacaagcugagcagagacccccccgccagcagagaggacaaccccaagggcagacaggccgccagaaccggcaccagagccggccagggccugcagaacggccacgaggacggccccgccgcccuggcccacagaaagaccagcgccggcaagggccacgugagcgacagcgagagcagaagaagcacccccagaggccacggcgagccccagagcaccagcgccagcagaaccagcgaggccggcuucugcaaccagccccccagcgccuggagcagccacccccccaccggcaacgaccaggccuacagaagaagaggcagacaggaggccagaagccagaagcccagagagcacgagaaccuggaggccagaggcauggcccaggcccacagccugcccgugcacgugagagagggccccugggaggugggcggcagaagcgagcacgugaugaagaagcccgugugggaggaggagcugagaaugagcggccccgccaaguggcagaacgugagccuggagagcuggaaccagcccagaaagcugggcagacagaugagcgacggcgacggcgagagacuguuccaggaccuguaccccuucauccagggcgagcacgugcugaacagccagaacaagggcaagagcagaagccugcccagagugcugagccccgagagccugagcugcaccgagauccccaucccccugaacgagagacacagccccaagaugccccccuacccccccaccugcgcccccaaccuggacagcaccagaaacagcgagaagagcggcugcagcgcccccuuccccagacccaaguucggcagaccccugaagccccccagcuacagcagccaccagcagagcagaggcggcgccgacagcagcgacagccaggacagccagcagauggacgccuacgugcccagacacgagcugugccugagcgaccccggccuggagccccccguguacgugcccccccccagcuacagaagccccccccagaacauccccaaccccuaccuggaggacaccgugcccaucaacgugugcggcggccacagccagcagcagagccccaccgagaaggccggcgccagcggccagccccccagcggcccccccggcaccggcaacgaguacggcgugagccccagacugccccagggccugcccgcccaccccagacccgugaccgccuacgacggcuucgugcaguacauccccuucgacgaccccagacugagacacuucaagcuggcccagccccagggcuucugcgaggacaucaagcuggacgacaagagcuacaacagcagccccgugaccgcccaggagcccgcccacggcggcaugcagcccgacggcgccaucuggaacccccagagccugaucccccccagcggcgacgagagaggccuggugcuggccgacagcagccccagauggcuguggggccagccccccggcgacggcgagaacagcggccugcccaaccagagagacagaugcguggccagaggccaguggcccgacgugagaggcagccagcacggccacaccggcagacaggugagcagccccuacagccagggcgagagcaccugcgagacccagaccaagcugaagaaguuccagaccggcaccagaaccaagaagagcagcaagaagaagaugaacgagaccaucuucugccuggugagcauccccgugaagagcgagagccaccugcccgacagagacauggacaacaacgaccugaagcccagcgccgaccagaagaacggcagcgacaagagccccgcccugcaggagcagagccugcugagcaugagcagcaccgaccuggagcugcaggcccugaccggcagcaugggcggcagaaccgaguuccagaagcaggaccugggcgagcccgaggaggacagacagaccaacgaccugagcuucauccaccugaccaagcacagagagcugaagcacagcggcagcuggcccggccacagauacagagaccagcagacccagaccagcuucagcgaggagccccagagcagccagcugcugcccggcgccaagcugggcggccccagcagagccgcccugagccccaagugcagcgaccccgccgccagcgaggcccagacccacaccgccuuccccaccggcgaccacaagcagagacccagcgccagaaaccugaagggccacagaagccugagccccagcagcaacagcgccuucagcagaaccagccugagcguggaccaggcccccacccccaaggccggcagaagccagcccugcguggacgugcacggccugggcgcccaccccggccccaagagagagguggugaagggcgagcccaccggccccugcaacagcaagcagcuguucggccaguuccugcugaagcccgugagcagaagacccugggaccugaucagccagcuggagagcuucaacaaggagcugcaggaggaggaggagagcagcagcagcagcagcagcagcagcagcagcagcgaggagagcgaggccgagccccagcaggagaacagagcccacugcagacaggaggacgugggcuucagaggcaacagccccgagaugagaguggagccccagcccagaaugugggugcccgagagccccgugugcagaagcggcagaggcgagagcaagagcgagagcuggagcgaggagcugcagcccggccaccccagagccuggccccccagccccggcagauucagaguggaggagggcggcggcgcccccuucugcagcgccgacggcagcaccagcgccgagaagagacaccuggaggugagcaacggcauggacgagcuggccggcagccccuuccccgugaccagaaugagcagcagaagcagcgacgccaagccccugcccgccagcuaccccgccgagcccagagagccccaggagagccccaagaucaccagcgccuucagcagcgugaagcccagcgaggccgugcccagaaaguucgacagcggcggcgagagaggcgccggccugccccugagccugagcaacaagaacagaggccugagcgcccccgaccugagaagcgugggccugacccccggccaggagcagggcgccagcgagcuggagggcagccugggcgaggccagcaccaucgagaucccccccggcgagagccugcaggccagagccgccagaauccugggcaucgagguggccguggagagccugcugcccggcaucagaagagccggccagaaccagcccgccgagcccgacgccagcgccugcacccccgagagcccccaggaggagcugcugagcagacccgcccccgccgacgugcccagagugagcaccgacgccuucuacggcagaagaaagugcggcuggaccaagagcccccuguucgugggcgacagagacagcgccagaagagccccccaggccuucgagcacagcgacguggacggcguggugaccagcaccgaccccgugcccgagcccgagcccagcccccuggagagcaaguucuucgagcagaaggacguggagaccaagccccccuucagaagcacccuguuccacuucguggagagaacccccagcguggccggcagcgagaagagacugagaagccccagcaaggugaucgagagccugcaggagaagcuggccagcccccccagaagagccgaccccgacagacugaugagaaugaaggaggugagcagcgugagcagaaugagagugcugagcuucagaaacgccgacagccaggaggacgccgaggagcugaaggccaccaccagaggccaggccggccugcccggcggccuggugagccccggcagcggcgacagagcccagagacugggccacagccugagcgugagcaaggacagcaucagcagagaggagaaggagcaccccgccgcccagaaggagaagagcauggaccaggacuucuggugccccgacagcuacgaccccagcagaguggagagaguguaa

SEQ ID NO: 18914 - RNA, 3651 nt, Artificial Sequence
  KIAA1468__Homo_sapiens__NP_065905
auggccgccauggcccccggcggcagcggcagcggcggcggcgugaaccccuuccugagcgacagcgacgaggacgacgacgagguggccgccaccgaggagagaagagccgugcugagacugggcgccggcagcggccuggaccccggcagcgccggcagccugagcccccaggaccccguggcccugggcagcagcgccagacccggccugcccggcgaggccagcgccgccgccguggcccugggcggcaccggcgagacccccgccagacugagcaucgacgccaucgccgcccagcugcugagagaccaguaccugcugaccgcccuggagcugcacaccgagcugcuggagagcggcagagagcugcccagacugagagacuacuucagcaaccccggcaacuucgagagacagagcggcaccccccccggcaugggcgcccccggcgugcccggcgccgccggcgugggcggcgccggcggcagagagcccagcaccgccagcggcggcggccagcugaacagagccggcagcaucagcacccuggacagccuggacuucgccagauacagcgacgacggcaacagagagaccgacgagaagguggccgugcuggaguucgagcugagaaaggccaaggagaccauccaggcccugagagccaaccugaccaaggccgccgagcacgaggugccccugcaggagagaaagaacuacaagagcagccccgagauccaggagcccaucaagccccuggagaagagagcccugaacuuccuggugaacgaguuccugcugaagaacaacuacaagcugaccagcaucaccuucagcgacgagaacgacgaccaggacuucgagcugugggacgacgugggccugaacauccccaagccccccgaccugcugcagcuguacagagacuucggcaaccaccaggugaccggcaaggaccugguggacguggccagcggcguggaggaggacgagcuggaggcccugacccccaucaucagcaaccugccccccacccuggagaccccccagcccgccgagaacagcaugcuggugcagaagcuggaggacaagaucagccugcugaacagcgagaaguggagccugauggagcagaucagaagacugaagagcgagauggacuuccugaagaacgagcacuucgccauccccgccgugugcgacagcgugcagcccccccuggaccagcugccccacaaggacagcgaggacagcggccagcaccccgacgugaacagcagcgacaagggcaagaacaccgacauccaccugagcaucagcgacgaggccgacagcaccauccccaaggagaacagccccaacagcuuccccagaagagagagagagggcaugccccccagcagccugagcagcaagaagaccgugcacuucgacaagcccaacagaaagcugagccccgccuuccaccaggcccugcugagcuucugcagaaugagcgccgacagcagacugggcuacgaggugagcagaaucgccgacagcgagaagagcgugaugcugaugcugggcagaugccugccccacaucgugcccaacgugcugcuggccaagagagaggagcugaucccccugauccugugcaccgccugccugcaccccgagcccaaggagagagaccagcugcugcacauccuguucaaccugaucaagagacccgacgacgagcagagacagaugauccugaccggcugcguggccuucgccagacacgugggccccaccagaguggaggccgagcugcugccccagugcugggagcagaucaaccacaaguaccccgagagaagacugcugguggccgagagcugcggcgcccuggcccccuaccugcccaaggagaucagaagcagccuggugcugagcaugcugcagcagaugcugauggaggacaaggccgaccuggugagagaggccgugaucaagagccugggcaucaucaugggcuacaucgacgaccccgacaaguaccaccagggcuucgagcugcugcugagcgcccugggcgaccccagcgagagaguggugagcgccacccaccagguguuccugcccgccuacgccgccuggaccaccgagcugggcaaccugcagagccaccugauccugacccugcugaacaagaucgagaagcugcugagagagggcgagcacggccuggacgagcacaagcugcacauguaccugagcgcccugcagagccugauccccagccuguucgcccuggugcugcagaacgcccccuucagcagcaaggccaagcugcacggcgaggugccccagaucgaggugaccagauuccccagacccaugagcccccugcaggacgugagcaccaucaucggcagcagagagcagcuggccgugcugcugcagcuguacgacuaccagcuggagcaggagggcaccaccggcugggagagccugcuguggguggugaaccagcugcugccccagcugaucgagaucgugggcaagaucaacgugaccagcaccgccugcgugcacgaguucagcagauucuucuggagacugugcagaaccuucggcaagaucuucaccaacaccaaggugaagccccaguuccaggagauccugagacugagcgaggagaacaucgacagcagcgccggcaacggcgugcugaccaaggccaccgugcccaucuacgccaccggcgugcugaccugcuacauccaggaggaggacagaaagcugcuggugggcuuccuggaggacgugaugacccugcugagccugagccacgccccccuggacagccugaaggccagcuucguggagcugggcgccaaccccgccuaccacgagcugcugcugaccgugcugugguacggcguggugcacaccagcgcccuggugagaugcaccgccgccagaauguucgagcugacccugagaggcaugagcgaggcccugguggacaagagaguggcccccgcccuggugacccugagcagcgaccccgaguucagcgugagaaucgccaccauccccgccuucggcaccaucauggagaccgugauccagagagagcugcuggagagagugaagaugcagcuggccagcuuccuggaggacccccaguaccaggaccagcacagccugcacaccgagaucaucaagaccuucggcagagugggccccaacgccgagcccagauucagagacgaguucgugaucccccaccugcacaagcuggcccuggugaacaaccugcagaucguggacagcaagagacuggacaucgccacccaccuguucgaggccuacagcgcccugagcugcugcuucaucagcgaggaccugauggugaaccacuuccugcccggccugagaugccugagaaccgacauggagcaccugagccccgagcacgaggugauccugagcagcaugaucaaggagugcgagcagaagguggagaacaagaccgugcaggagccccagggcagcaugagcaucgccgccagccuggugagcgaggacaccaagaccaaguuccugaacaagaugggccagcugaccaccagcggcgccaugcuggccaacguguuccagagaaagaaguaa

SEQ ID NO: 18915 - RNA, 2718 nt, Artificial Sequence
  KIAA1524__Homo_sapiens__NP_065941
auggacagcaccgccugccugaagagccugcugcugaccgugagccaguacaaggccgugaagagcgaggccaacgccacccagcugcugagacaccuggaggugaucagcggccagaagcugaccagacuguucaccagcaaccagauccugaccagcgagugccugagcugccugguggagcugcuggaggaccccaacaucagcgccagccugauccugagcaucaucggccugcugagccagcuggccguggacaucgagaccagagacugccugcagaacaccuacaaccugaacagcgugcuggccggcguggugugcagaagcagccacaccgacagcguguuccugcagugcauccagcugcugcagaagcugaccuacaacgugaagaucuucuacagcggcgccaacaucgacgagcugaucaccuuccugaucgaccacauccagagcagcgaggacgagcugaagaugcccugccugggccugcuggccaaccugugcagacacaaccugagcgugcagacccacaucaagacccugagcaacgugaagagcuucuacagaacccugaucacccugcuggcccacagcagccugaccguggugguguucgcccugagcauccugagcagccugacccugaacgaggaggugggcgagaagcuguuccacgccagaaacauccaccagaccuuccagcugaucuucaacauccugaucaacggcgacggcacccugaccagaaaguacagcguggaccugcugauggaccugcugaagaaccccaagaucgccgacuaccugaccagauacgagcacuucagcagcugccugcaccaggugcugggccugcugaacggcaaggaccccgacagcagcagcaaggugcuggagcugcugcuggccuucugcagcgugacccagcugagacacaugcugacccagaugauguucgagcagagcccccccggcagcgccacccugggcagccacaccaagugccuggagcccaccguggcccugcugagauggcugagccagccccuggacggcagcgagaacugcagcgugcuggcccuggagcuguucaaggagaucuucgaggacgugaucgacgccgccaacugcagcagcgccgacagauucgugacccugcugcugcccaccauccuggaccagcugcaguucaccgagcagaaccuggacgaggcccugaccagaaagaagugcgagagaaucgccaaggccaucgaggugcugcugacccugugcggcgacgacacccugaagaugcacaucgccaagauccugaccaccgugaagugcaccacccugaucgagcagcaguucaccuacggcaagaucgaccugggcuucggcaccaagguggccgacagcgagcugugcaagcuggccgccgacgugauccugaagacccuggaccugaucaacaagcugaagccccuggugcccggcauggaggugagcuucuacaagauccugcaggaccccagacugaucaccccccuggccuucgcccugaccagcgacaacagagagcaggugcagagcggccugagaauccugcuggaggccgccccccugcccgacuuccccgcccuggugcugggcgagagcaucgccgccaacaacgccuacagacagcaggagaccgagcacauccccagaaagaugcccuggcagagcagcaaccacagcuuccccaccagcaucaagugccugaccccccaccugaaggacggcgugcccggccugaacaucgaggagcugaucgagaagcugcagagcggcaugguggugaaggaccagaucugcgacgugagaaucagcgacaucauggacguguacgagaugaagcugagcacccuggccagcaaggagagcagacugcaggaccugcuggagaccaaggcccuggcccuggcccaggccgacagacugaucgcccagcacagaugccagagaacccaggccgagaccgaggccagaacccuggccagcaugcugagagagguggagagaaagaacgaggagcugagcgugcugcugaaggcccagcagguggagagcgagagagcccagagcgacaucgagcaccuguuccagcacaacagaaagcuggagagcguggccgaggagcacgagauccugaccaagagcuacauggagcugcugcagagaaacgagagcaccgagaagaagaacaaggaccugcagaucaccugcgacagccugaacaagcagaucgagaccgugaagaagcugaacgagagccugaaggagcagaacgagaagagcaucgcccagcugaucgagaaggaggagcagagaaaggaggugcagaaccagcugguggacagagagcacaagcuggccaaccugcaccagaagaccaaggugcaggaggagaagaucaagacccugcagaaggagagagaggacaaggaggagaccaucgacauccugagaaaggagcugagcagaaccgagcagaucagaaaggagcugagcaucaaggccagcagccuggaggugcagaaggcccagcuggagggcagacuggaggagaaggagagccuggugaagcugcagcaggaggagcugaacaagcacagccacaugaucgccaugauccacagccugagcggcggcaagaucaaccccgagaccgugaaccugagcaucuaa

SEQ ID NO: 18916 - RNA, 5853 nt, Artificial Sequence
  KIAA1549__Homo_sapiens__NP_001158137
augcccggcgccagaagaagaagaagaggcgccgccauggagggcaagcccagagccggcguggcccuggcccccggccccagcggcagaagacccagcgccagaugcgccagaagaagaagacccggccugcugcugcccggccuguggcugcugcugcuggccagacccgccagcugcgcccccgacgagcugagccccgagcagcacaaccugagccuguacagcauggagcuggugcugaagaagagcaccggccacagcgccgcccagguggcccugaccgagaccgcccccggcagccagcacagcagcccccugcacgugaccgccccccccagcgccaccaccuucgacaccgccuucuucaaccagggcaagcagaccaagagcaccgccgaccccagcaucuucguggccaccuacgugagcgugaccagcaaggagguggccgugaacgacgacgagauggacaacuuccugcccgacacccacuggaccacccccagaauggugagccccauccaguacaucaccgugagcccccccggccugcccagagaggcccuggagcccaugcugacccccagccugcccauggugagccugcaggacgaggaggugaccagcggcuggcagaacaccaccagacagcccgccgccuacgccgagagcgccagccacuuccacaccuucagaagcgccuucagaaccagcgagggcaucgugcccacccccggcagaaaccuggugcuguaccccaccgacgccuacagccaccugagcagcagaacccugcccgagaucguggccagccugaccgagggcguggagaccacccuguuccugagcagcagaagccugaugccccagccccugggcgacggcaucaccaucccccugcccagccugggcgaggugagccagccccccgaggaggugugggccaccagcgccgacagauacaccgacgugaccaccgugcugagccagagccuggaggagaccaucagccccagaaccuaccccaccgugaccgccagccacgccgcccuggccuucagcagaacccacagcccccugcugagcaccccccuggccuucgccagcagcgccagccccaccgacgugagcagcaaccccuuccugcccagcgacagcagcaagaccagcgagcugcacagcaacagcgcccugcccggccccguggacaacacccacauccugagccccgugagcagcuucagacccuacaccuggugcgccgccugcaccgugcccagcccccagcaggugcuggccaccagccugauggagaaggacgugggcagcggcgacggcgccgagacccugugcaugaccgugcuggaggagagcagcaucagccugaugagcagcgugguggccgacuucagcgaguucgaggaggacccccagguguucaacacccuguuccccagcagacccaucgugccccugagcagcagaagcauggagaucagcgagaccagcgugggcaucagcgccgagguggacaugagcagcgugaccaccacccaggugccccccgcccacggcagacugagcgugcccgccagccuggaccccaccgccggcagccugagcguggccgagacccaggugacccccagcagcgugaccaccgccuucuucagcgugaucaccagcauccugcuggacagcagcuucagcgugaucgccaacaagaacacccccagccuggccgugagagaccccagcguguucacccccuacagccuggugcccagcguggagagcagccuguucagcgaccaggagagaagcagcuucagcgagcacaagcccagaggcgcccuggacuucgccagcagcuucuucagcacccccccccuggagcugagcggcagcaucagcagccccagcgaggcccccgccagccugagccugaugcccagcgaccugagccccuucaccagccagagcuucagcccccugguggagaccuucacccuguucgacagcagcgaccugcagagcagccagcugagccugcccagcagcaccaaccuggaguucagccagcugcagcccagcagcgagcugccccugaacaccaucaugcugcugcccagcagaagcgaggugagccccuggagcagcuuccccagcgacagccuggaguucguggaggccagcaccgugagccugaccgacagcgaggcccacuucaccagcgccuucaucgagaccaccagcuaccuggagagcagccugaucagccacgagagcgccgugaccgcccuggugccccccggcagcgagagcuucgacauccugaccgccggcauccaggccaccagcccccugaccaccgugcacaccacccccauccugaccgagagcagccuguucagcacccugaccccccccgacgaccagaucagcgcccuggacggccacgugagcgugcuggccagcuucagcaaggccauccccaccggcaccgugcugaucaccgacgccuaccugcccagcggcagcagcuucgugagcgaggccacccccuucccccugcccaccgagcugaccguggugggccccagccugacccccaccgaggugccccugaacaccagcaccgaggugagcaccaccagcaccggcgccgccaccggcggcccccuggacagcacccugaugggcgacgccgccagccagagcccccccgagagcagcgccgcccccccccugcccagccugagacccgugaccgccuucacccuggaggccaccguggacacccccacccuggccaccgccaagccccccuacgugugcgacaucaccgugcccgacgccuaccugaucaccaccgugcuggccagaagagccgugcaggaguacaucaucaccgccaucaaggaggugcugagaauccacuucaacagagccguggagcugaagguguacgagcuguucaccgacuucaccuuccuggugaccagcggccccuucguguacaccgccaucagcgugaucaacgugcugaucaacagcaagcuggugagagaccagaccccccugauccugagcgugaagcccagcuuccuggugcccgagagcagauuccaggugcagaccgugcugcaguucgugccccccagcguggacaccggcuucugcaacuucacccagagaaucgagaagggccugaugaccgcccuguucgaggugagaaagcaccaccagggcaccuacaaccugaccgugcagauccugaacaucaccaucagcagcagcagagugacccccagaagaggccccgugaacaucaucuucgccgugaagagcacccagggcuuccugaacggcagcgaggugagcgagcugcugagaaaccugagcgugguggaguucagcuucuaccugggcuaccccgugcugcagaucgccgagcccuuccaguacccccagcugaaccugagccagcugcugaagagcagcugggugagaaccgugcugcugggcgugauggagaagcagcugcagaacgagguguuccaggccgagauggagagaaagcuggcccagcugcugagcgaggugagcaccagaagaagaauguggagaagagccaccguggccgccggcaacagcguggugcagguggugaacgugagcagacuggagggcgacgacaaccccgugcagcugaucuacuucguggaggaccaggacggcgagagacugagcgccgugaagagcagcgaccugaucaacaagauggaccugcagagagccgccaucauccugggcuacagaauccagggcgugaucgcccagcccguggacagagugaagagacccagccccgagagccagagcaacaaccugugggugaucgugggcguggugauccccgugcugguggugauggugaucguggugauccuguacuggaagcugugcagaaccgacaagcuggacuuccagcccgacaccguggccaacauccagcagagacagaagcugcagauccccagcgugaagggcuucgacuucgccaagcagcaccugggccagcacaacaaggacgacauccugaucauccacgagcccgccccccugcccggcccccugaaggaccacaccacccccagcgagaacggcgacgugcccagccccaagagcaagauccccagcaagaacgugagacacagaggcagagugagccccagcgacgccgacagcaccgugagcgaggagagcagcgagagagacgccggcgacaagacccccggcgccgugaacgacggcagaagccacagagccccccagagcggccccccccugcccagcagcggcaacgagcagcacagcagcgccagcaucuucgagcacguggacagaaucagcagaccccccgaggccagcagaagagugcccagcaagauccagcugaucgccaugcagcccauccccgccccccccgugcagagacccagccccgccgacagaguggccgagagcaacaagaucaacaaggagauccagaccgcccugagacacaagagcgagaucgagcaccacagaaacaagaucagacugagagccaagagaagaggccacuacgaguuccccgugguggacgaccugagcagcggcgacaccaaggagagacacagaguguacagaagagcccagaugcagaucgacaagauccuggaccccaccgccagcgugcccagcguguucaucgagcccagaaagagcagcagaaucaagagaagccccaagcccagaagaaagcaccaggugaacggcugccccgccgacgccgagaaggacagacugaucaccaccgacagcgacggcaccuacagaagaccccccggcgugcacaacagcgccuacaucggcugccccagcgaccccgaccugcccgccgacgugcagacccccagcagcguggagcugggcagauaccccgcccugcccuuccccgccagccaguacauccccccccagcccagcaucgaggaggccagacagaccaugcacagccugcuggacgacgccuucgcccugguggcccccagcagccagcccgccagcaccgccggcgugggccccggcgugccccccggccugcccgccaacagcacccccagccaggaggagagaagagccacccaguggggcagcuucuacagccccgcccagaccgccaacaaccccugcagcagauacgaggacuacggcaugaccccccccaccggcccccugcccagacccggcuucggccccggccugcugcagagcaccgagcuggugccccccgacccccagcagccccaggccagcgccgaggcccccuucgccgccagaggcaucuacagcgaggagaugcccagcguggccagacccagacccgugggcggcaccaccggcagccagauccagcaccugacccaggugggcaucgccagcagaaucggcgcccagcccguggagaucccccccagcagaggcagccaguacggcggccccggcuggcccagcuacggcgaggacgaggccggcagaagagaggccacccacaugcugggccaccaggaguacagcagcagcccccuguuccaggugcccagaaccagcggcagagagcccagcgcccccagcggcaaccugccccacagaggccugcagggccccggccugggcuaccccaccagcagcaccgaggaccugcagcccggccacagcagcgccagccugaucaaggccaucagagaggagcugcugagacugagccagaagcagagcaccgugcagaacuuccacagcuaa

SEQ ID NO: 18917 - RNA, 5244 nt, Artificial Sequence
  KIAA1551__Homo_sapiens__XP_005253462
augaacuggaacgagaagcccaagagcgccacccugcccccccuguaccccaagagccagccccccuuccugcaccagagccugaucaaccagaucaccaccaccagccagagcagcuucagcuaccccggcagcaaccaggaggccugcauguaccccggcaacagcaaccccaucagccagccccugcugaacauccagaacuacccccagcagaucagcgugagcgacaugcacaacggcaccgugguggccagccacaccagcguggagagaaucaccuacgccaacgugaacggccccaagcagcugacccacaaccugcagaugagcagcggcgugacccagaacguguggcugaacagccccaugagaaaccccgugcacagccacaucggcgccaccgugagccaccagaccgacuucggcgccaacgugcccaacaugcccgcccugcagagccagcugaucaccagcgacaccuacagcaugcagaugcagaugauccccagcaacagcaccagacugcccguggccuaccagggcaaccagggccugaaccagagcuucagcgagcagcagguggacuggacccagcagugcaucagcaagggccugaccuaccccgacuacagacccccccccaagcuguacagauacagcccccagagcuuccugcccgacagcaccauccagaagcagaacuucaucccccacaccagccugcaggugaagaacagccagcugcugaacagcgugcugacccugcccagcagacagaccagcgccgugcccagccagcaguacgccacccagaccgacaagagacccccccccccccccuacaacugcagauacggcagccagccccugcagagcacccagcacaucaccaagcaccugagcauggaggugccccagagcagagagaugcugagcagcgagaucagaaccagcuuccagcagcaguggcagaaccccaacgagaacgugagcaccaucggcaacuucaccaaccugaaggugaacaccaacagcaagcagcccuucaacagccccaucagaagcagcguggacggcgugcagacccuggcccagaccaacgaggagaagaucauggacagcugcaaccccaccagcaaccaggugcuggacaccagcguggccaaggagaagcuggugagagacaucaagacccugguggagaucaagcagaaguucagcgagcuggccagaaagaucaagaucaacaaggaccugcugauggccgccggcugcaucaagaugaccaacaccagcuacagcgagcccgcccagaacagcaagcugagccugaagcagaccgccaagauccagagcggcccccagaucacccccgugaugcccgagaacgccgagagacagacccccaccgugguggagagcgccgagaccaacaagacccagugcaugcugaacagcgacauccaggaggugaacugcagaagauucaaccagguggacagcgugcugcccaaccccguguacagcgagaagagacccaugcccgacagcagccacgacgugaaggugcugaccagcaagaccagcgccguggagaugacccaggccgugcugaacacccagcugagcagcgagaacgugaccaagguggagcagaacagccccgccgugugcgagaccaucagcgugcccaagagcaugagcaccgaggaguacaagagcaagauccagaacgagaacaugcugcugcuggcccugcugagccaggccagaaagacccagaagaccgugcugaaggacgccaaccagaccauccaggacagcaagcccgacagcugcgagaugaaccccaacacccagaugaccggcaaccagcugaaccugaagaacauggagacccccagcaccagcaacgugagcggcagagugcuggacaacagcuucugcagcggccaggagagcagcaccaagggcaugcccgccaagagcgacagcagcugcagcauggaggugcuggccaccugccugagccuguggaagaagcagcccagcgacaccgccaaggagaaggagugcgacaagcugagaaccaacaccaccgccgugggcaucagcaagcccgccaacauccacgugaagagccccugcagcguggugggcaacagcaacagccagaacaagaucagcaaccccagccagcagaccgcccugagcauggugaugcacaacuacgagagcagcggcaucaacaucaccaagggcaccgagcugcagaucgccguggugagcccccuggugcugagcgaggugaagacccugagcgugaagggcaucacccccgccgugcugcccgagaccguguaccccgugaucaaggagggcagcgugugcagccugcagaaccagcuggccgagaacgccaaggccaccgccgcccugaagguggacgugagcggccccguggccagcaccgccaccagcaccaagaucuucccccugacccagaaggagaagcagaacgagagcaccaacggcaacagcgaggugacccccaacgugaaccagggcaagcacaacaagcuggagagcgccauccacagccccaugaacgaccagcagaucagccaggagagcagaaacagcaccguggugagcagcgacacccugcagaucgacaacaucugcagccugguggagggcgacaccagcuacaacagccagaucgccaagaucuucagcagccugccccugaagaugguggagccccagaagcccagccugcccaaccagcagggcaucggcagcagagagcccgagaagcagcuggacaacaccaccgagaacaaggacuucggcuuccagaaggacaagcccgugcagugcaccgacgugagccacaagaucugcgaccagagcaagagcgagcccccccuggagagcagcuucaacaaccuggagaccaacagagugauccuggagaagagcagccuggagcacgccaccgagaagagcaccgccaacgacaccugcagcagcgccgccauccaggaggacaucuacccccaggagaucgacgccagcagcaacuacaccccccaggaccccgccagaaacgagauccacagcgacaaggcccccgugcuguaccugcacgaccagcugagcgagcugcugaaggaguuccccuacggcaucgaggccgugaacaccagagagggcagcgugggccagcagaccaccuaccagaccagcgaggaccagaccgccgacaagaccagcagcgacagcaaggaccccgccgaccagauccagaucaccauccugagcagcgagcagaugaaggagaucuuccccgagcaggacgaccagcccuacgugguggacaagcuggccgagccccagaaggaggagcccaucaccgagguggugagccagugcgaccugcaggcccccgccgccggccagagcagagacagcgugauccuggacagcgagaaggacgacauccacugcugcgcccugggcuggcugagcaugguguacgagggcgugccccagugccagugcaacagcaucaagaacagcagcagcgaggaggagaagcagaaggagcagugcagcccccuggacaccaacagcugcaagcagggcgagagaaccagcgacagagacgugaccguggugcaguucaagagccuggugaacaaccccaagaccccccccgacggcaagagccacuuccccgagcugcaggacgacagcagaaaggacacccccaagaccaagcacaagagccugcccagaaccgagcaggagcugguggccggccaguucagcagcaagugcgacaagcugaacccccugcagaaccacaagagaaagaagcugagauuccacgaggugaccuuccacagcagcaacaagaugaccgccagcuacgagcaggccagccaggagaccagacagaagaagcacgugacccagaacagcagaccccugaagaccaagaccgccuuccugcccaacaaggacguguacaagaagcacagcagccugggccagagccugagccccgagaagaucaagcugaagcugaagagcgugagcuucaagcagaagagaaagcuggaccagggcaacgugcuggacauggaggugaagaagaagaagcacgacaagcaggagcagaagggcagcgugggcgccaccuucaagcugggcgacagccugagcaaccccaacgagagagccaucgugaaggagaagauggugagcaacaccaagagcguggacaccaaggccagcagcagcaaguucagcagaauccugacccccaaggaguaccugcagagacagaagcacaaggaggcccugagcaacaaggccagcaagaagaucugcgugaagaacgugcccugcgacagcgagcacaugagacccagcaagcuggccgugcagguggagagcugcggcaagagcaacgagaagcacagcagcggcgugcagaccagcaaggagagccugaacggccugaccagccacggcaagaaccugaagauccaccacagccaggagagcaagaccuacaacauccugagaaacgugaaggagaaggugggcggcaagcagcccgacaagaucuggaucgacaagaccaagcuggacaagcugaccaacaucagcaacgaggcccaguucagccagaugcccccccaggugaaggaccagaagaagcuguaccugaacagagugggcuucaagugcaccgagagagagagcaucagccugaccaagcuggagagcagccccagaaagcugcacaaggacaagagacaggagaacaagcacaagaccuuccugcccgugaagggcaacaccgagaagagcaacaugcuggaguucaagcugugccccgacauccugcugaagaacaccaacagcguggaggagagaaaggacgugaagccccaccccagaaaggagcaggccccccugcaggugagcggcaucaagagcaccaaggaggacuggcugaaguucguggccaccaagaagagaacccagaaggacagccaggagagagacaacgugaacagcagacugagcaagagaagcuucagcgccgacggcuucgagaugcugcagaaccccgugaaggacagcaaggagauguuccagaccuacaagcagauguaccuggagaagagaagcagaagccugggcagcagccccgugaaguaa

SEQ ID NO: 18918 - RNA, 1896 nt, Artificial Sequence
  KIAA1598__Homo_sapiens__NP_001120683
augaacagcagcgacgaggagaagcagcugcagcugaucaccagccugaaggagcaggccaucggcgaguacgaggaccugagagccgagaaccagaagaccaaggagaagugcgacaagaucagacaggagagagacgaggccgugaagaagcuggaggaguuccagaagaucagccacauggugaucgaggaggugaacuucaugcagaaccaccuggagaucgagaagaccugcagagagagcgccgaggcccuggccaccaagcugaacaaggagaacaagacccugaagagaaucagcaugcuguacauggccaagcugggccccgacgugaucaccgaggagaucaacaucgacgacgaggacagcaccaccgacaccgacggcgccgccgagaccugcgugagcgugcagugccagaagcagaucaaggagcugagagaccagaucgugagcgugcaggaggagaagaagauccuggccaucgagcuggagaaccugaagagcaagcugguggaggugaucgaggaggugaacaaggugaagcaggagaagaccgugcugaacagcgaggugcuggagcagagaaaggugcuggagaagugcaacagagugagcaugcuggccguggaggaguacgaggagaugcaggugaaccuggagcuggagaaggaccugagaaagaaggccgagagcuucgcccaggagauguucaucgagcagaacaagcugaagagacagagccaccugcugcugcagagcagcauccccgaccagcagcugcugaaggcccuggacgagaacgccaagcugacccagcagcuggaggaggagagaauccagcaccagcagaaggugaaggagcuggaggagcagcuggagaacgagacccugcacaaggagauccacaaccugaagcagcagcuggagcugcuggaggaggacaagaaggagcuggagcugaaguaccagaacagcgaggagaaggccagaaaccugaagcacagcguggacgagcugcagaagagagugaaccagagcgagaacagcgugccccccccccccccccccccccccccccugcccccccccccccccaaccccaucagaagccugaugagcaugaucagaaagagaagccaccccagcggcagcggcgccaagaaggagaaggccacccagcccgagaccaccgaggaggugaccgaccugaagagacaggccguggaggagaugauggacagaaucaagaagggcgugcaccugagacccgugaaccagaccgccagacccaagaccaagcccgagagcagcaagggcugcgagagcgccguggacgagcugaagggcauccugggcacccugaacaagagcaccagcagcagaagccugaagagccuggaccccgagaacagcgagaccgagcuggagagaauccugagaagaagaaaggugaccgccgaggccgacagcagcagccccaccggcauccuggccaccagcgagagcaagagcaugcccgugcugggcagcgugagcagcgugaccaagaccgcccugaacaagaagacccuggaggccgaguucaacagccccagcccccccacccccgagcccggcgagggccccagaaagcuggagggcugcaccagcagcaaggugaccuuccagccccccagcagcaucggcugcagaaagaaguacaucgacggcgagaagcaggccgagcccgugguggugcuggaccccgugagcacccacgagccccagaccaaggaccagguggccgagaaggaccccacccagcacaaggaggacgagggcgagauccagcccgagaacaaggaggacagcaucgagaacgugagagagaccgacagcagcaacugcuaa

SEQ ID NO: 18919 - RNA, 1485 nt, Artificial Sequence
  KIAA1715__Homo_sapiens__NP_001291937
augggcagaagcuggcccggccugagccugugccaguggagacugcugcccgcccuggaggccggcugggccguggccgccgagaccggcggcggcggcagacccggcagagccgcccccgccagcugcagcugcgaguuccuguggaccaucgacgacaucuaccacugcgcccaguuccugcagaucaaggacggcuggaucaucuucagcauggagggcaagaccaagcccagcaccguggaggugcuggagagcaucgacaaggagauccaggcccuggaggaguucagagagaagaaccagagacugcagaagcugugggugggcagacugauccuguacagcagcgugcuguaccuguucaccugccugaucguguaccugugguaccugcccgacgaguucaccgccagacuggccaugacccugcccuucuucgccuucccccugaucaucuggagcaucagaaccgugaucaucuucuucuucagcaagagaaccgagagaaacaacgaggcccuggacgaccugaagagccagagaaagaagauccuggaggaggugauggagaaggagaccuacaagaccgccaagcugauccuggagagauucgaccccgacagcaagaaggccaaggagugcgagccccccagcgccggcgccgccgugaccgccagacccggccaggagaucagacagagaaccgccgcccagagaaaccugagccccacccccgccagccccaaccagggcccccccccccaggugcccgugagccccggcccccccaaggacagcagcgcccccggcggcccccccgagagaaccgugacccccgcccugagcagcaacgugcugcccagacaccugggcagccccgccaccagcgugcccggcaugggccugcacccccccggccccccccuggccagacccauccugcccagagagagaggcgcccuggacagaaucguggaguaccuggugggcgacggcccccagaacagauacgcccugaucugccagcagugcuucagccacaacggcauggcccugaaggaggaguucgaguacaucgccuucagaugcgccuacugcuucuuccugaaccccgccagaaagaccagaccccaggcccccagacugcccgaguucagcuucgagaagagacaggugguggagggcagcagcagcgugggcccccugcccagcggcagcgugcugagcagcgacaaccaguucaacgaggagagccuggagcacgacgugcuggacgacaacaccgagcagaccgacgacaagauccccgccaccgagcagaccaaccaggugaucgagaaggccagcgacagcgaggagcccgaggagaagcaggagaccgagaacgaggaggccagcgugaucgagaccaacagcaccgugcccggcgccgacagcauccccgaccccgagcugagcggcgagagccugaccgccgaguaa

SEQ ID NO: 18920 - RNA, 3111 nt, Artificial Sequence
  KIAA1804__Homo_sapiens__NP_115811
auggcccugagaggcgccgccggcgccaccgacacccccgugagcagcgccggcggcgcccccggcggcagcgccagcagcagcagcaccagcagcggcggcagcgccagcgccggcgccggccugugggccgcccuguacgacuacgaggccagaggcgaggacgagcugagccugagaagaggccagcugguggaggugcugagccaggacgccgccgugagcggcgacgagggcuggugggccggccaggugcagagaagacugggcaucuuccccgccaacuacguggcccccugcagacccgccgccagccccgcccccccccccagcagacccagcagccccgugcacguggccuucgagagacuggagcugaaggagcugaucggcgccggcggcuucggccagguguacagagccaccuggcagggccaggagguggccgugaaggccgccagacaggaccccgagcaggacgccgccgccgccgccgagagcgugagaagagaggccagacuguucgccaugcugagacaccccaacaucaucgagcugagaggcgugugccugcagcagccccaccugugccuggugcuggaguucgccagaggcggcgcccugaacagagcccuggccgccgccaacgccgcccccgaccccagagcccccggccccagaagagccagaagaauccccccccacgugcuggugaacugggccgugcagaucgccagaggcaugcuguaccugcacgaggaggccuucgugcccauccugcacagagaccugaagagcagcaacauccugcugcuggagaagaucgagcacgacgacaucugcaacaagacccugaagaucaccgacuucggccuggccagagaguggcacagaaccaccaagaugagcaccgccggcaccuacgccuggauggcccccgaggugaucaagagcagccuguucagcaagggcagcgacaucuggagcuacggcgugcugcugugggagcugcugaccggcgaggugcccuacagaggcaucgacggccuggccguggccuacggcguggccgugaacaagcugacccugcccauccccagcaccugccccgagcccuucgccaagcugaugaaggagugcuggcagcaggacccccacaucagacccagcuucgcccugauccuggagcagcugaccgccaucgagggcgccgugaugaccgagaugccccaggagagcuuccacagcaugcaggacgacuggaagcuggagauccagcagauguucgacgagcugagaaccaaggagaaggagcugagaagcagagaggaggagcugaccagagccgcccugcagcagaagagccaggaggagcugcugaagagaagagagcagcagcuggccgagagagagaucgacgugcuggagagagagcugaacauccugaucuuccagcugaaccaggagaagcccaaggugaagaagagaaagggcaaguucaagagaagcagacugaagcugaaggacggccacagaaucagccugcccagcgacuuccagcacaagaucaccgugcaggccagccccaaccuggacaagagaagaagccugaacagcagcagcagcagcccccccagcagccccaccaugaugcccagacugagagccauccagcugaccagcgacgagagcaacaagaccuggggcagaaacaccguguucagacaggaggaguucgaggacgugaagagaaacuucaagaagaagggcugcaccuggggccccaacagcauccagaugaaggacagaaccgacugcaaggagagaaucagaccccugagcgacggcaacagccccuggagcaccauccugaucaagaaccagaagaccaugccccuggccagccuguucguggaccagcccggcagcugcgaggagcccaagcugagccccgacggccuggagcacagaaagcccaagcagaucaagcugcccagccaggccuacaucgaccugccccugggcaaggacgcccagagagagaaccccgccgaggccgagagcugggaggaggccgccagcgccaacgccgccaccgugagcaucgagaugacccccaccaacagccugagcagaagcccccagagaaagaagaccgagagcgcccuguacggcugcaccgugcugcuggccagcguggcccugggccuggaccugagagagcugcacaaggcccaggccgccgaggagccccugcccaaggaggagaagaagaagagagagggcaucuuccagagagccagcaagagcagaagaagcgccagcccccccaccagccugcccagcaccugcggcgaggccagcagcccccccagccugccccugagcagcgcccugggcauccugagcacccccagcuucagcaccaagugccugcugcagauggacagcgaggacccccugguggacagcgcccccgugaccugcgacagcgagaugcugacccccgacuucugccccaccgcccccggcagcggcagagagcccgcccugaugcccagacuggacaccgacugcagcgugagcagaaaccugcccagcagcuuccugcagcagaccugcggcaacgugcccuacugcgccagcagcaagcacagacccagccaccacagaagaaccaugagcgacggcaaccccacccccaccggcgccaccaucaucagcgccaccggcgccagcgcccugccccugugccccagccccgccccccacagccaccugcccagagaggugagccccaagaagcacagcaccgugcacaucgugccccagagaagacccgccagccugagaagcagaagcgaccugccccaggccuacccccagaccgccgugagccagcuggcccagaccgccugcguggugggcagacccggcccccaccccacccaguuccuggccgccaaggagagaaccaagagccacgugcccagccugcuggacgccgacguggagggccagagcagagacuacaccgugccccugugcagaaugagaagcaagaccagcagacccagcaucuacgagcuggagaaggaguuccugagcuaa

SEQ ID NO: 18921 - RNA, 2124 nt, Artificial Sequence
  KIAA1841__Homo_sapiens__XP_005264663
augagcagaggcuacagcgagaacaacaacuuccugaacaacaacaaccagauggugcuggacaugauccuguacccccugaucggcaucccccagaccaucaacugggagaccaucgccagacuggugcccggccugacccccaaggagugcgccaagagauucgacgagcugaagagcagcggcagcagccccguggacaaccaguacaacagccugauggccgccggcgagagccccguggagacccuggccaccuacaucaagagcagccugcuggacauccacggcgaguuccaggagacccccgugggccacgacgccgugagcaagaccggcagacacagcaucgccagcaccagaaacugcagcagcgagagcgagaacugcaccacccacaacggcggcgagaugaccgaggagagcgagggccccaacauggugauccacgugugcgacgaggccaagaaccugaaggaggacuucaccugccccagagaccugcugaucagcgagaugaaguacuucgccgaguaccugagcauggacgcccagagaugggaggagguggacaucagcgugcacugcgacgugcacaucuucaacuggcugaucaaguacaucaagagaaacaccaaggagaacaaggacugcgagaugcccacccuggagcccggcaacgugaucagcauccugaucagcagcgaguuccugaagauggacagccugguggagcagugcauccaguacugccacaagaacaugaacgccaucguggccacccccugcaacaugaacugcaucaacgccaaccugcugaccagaaucgccgaccuguucagccacaacgagguggacgaccugaaggacaagaaggacaaguucaagagcaagcuguucugcaagaagaucgagagacuguucgaccccgaguaccugaaccccgacagcagaagcaacgccgccacccuguacagaugcugccugugcaagaagcugcugaccaaggagaccgagagaagaauccccugcauccccggcaagaucaacguggacagaagaggcaacaucguguacauccacaucagagacaagaccugggacgugcacgaguaccugaacagccuguucgaggagcugaagagcuggagagacguguacuggagacuguggggcaccaucaacuggcugaccugcagcagaugcuaccaggccuuccugugcaucgaguucagccacugccaguaccacagcgagaccgugguguaccccaccgccgccagcagccugaacaccgugggcaccggcaucuaccccugcugcaaccagaaggugcugagauucgaccccacccagcugaccaagggcugcaaggugagagaccacauggugacccugagagaccagggcgagggcggcgaccugcccagcugccccaccgccagaaugcuggacgaccugcacaaguacagagacgugaucguggugcccuucagcaaggacaccgugagcgacgugggcgugggccugugcgacgagaagggcaucgagugcgacgugcugcuggagcccaacacccccuggggccccaagaccggcgagcugaacgccuuccugagccugaagaacuggacccugcagcugaagcagcagagccuguucagcgaggaggaggaguacaccaccggcagcgaggugaccgaggacgaggugggcgacgaggaggaggugagcaagaagcagagaaagaaggagaagcccaagaaguucaccagacagcccaagaagcaggugagcagccccugcgcccagagaaaggagaaggcccuggagaagagcgccagcagagacgugagccccuucgugaugagcaugcagaagaacaagugggacgccaccagaagccugagauucaaccaggacgcccagagagaggacgaccagagaagaaugaccgagaucaccggccaccugaucaagaugagacugggcgaccuggacagagugaagagcaaggaggccaaggagaccgacaagcugagacccagagacggcaccgugagcaagagcaacagaaagagcggccugagcagcgugcugcugaugaccgugcugcugugcuaa

SEQ ID NO: 18922 - RNA, 1557 nt, Artificial Sequence
  KIAA1919__Homo_sapiens__NP_699200
augcugugcgccagcuuccugggccugggccugagcguggccaucgugggccccaccuuccaggaccuggccaccaacgugaacagaaacaucagcagccugagcuucaucuucgugggcagagcccugggcuaccugagcggcagcgugaucggcggcuuccugguggacgugaugaacuacuuccugcugcugggcaucagcaugagcgccaccaccgugggccuguaccuggugcccuucugcaagaccgccauccugcugaccgugaugaugagcaucuucggcgugagcaucggcauccuggacaccggcggcaacgugcugauccuggccaucuggggcgacaagggcgccccccacaugcaggcccugcacuucagcuucgcccugggcgccuuccuggccccccugcuggccaagcuggcccugggccccaccgccagcgccgagaaccacaccgagagcgacuuccaccccgcccugaaccagagcagcgacgccgacagcgaggcccuguucggcgugcccaacgacaagaaccugcugugggccuacgccgugaucggcaccuacauguuccuggugagcgugaucuucuucugccuguuccugaagaacagcagcaagcaggagaaggccagagccagcgccgagaccuucagaagagccaaguaccacaacgcccugcugugccugcuguuccuguucuucuucuucuacgugggcgccgaggugaccuacggcagcuacguguucagcuucgccaccacccacgccggcaugaaggagagcgaggccgccggccugaacagcaucuucuggggcaccuucgccgccugcagaggccuggccaucuucuucgccaccugccugcagcccggcaccaugaucgugcugagcaacaucggcagccugaccagcagccuguuccuggugcuguucgacaagaaccccaucugccuguggaucgccaccagcguguacggcgccagcauggccaccaccuuccccagcggcgugagcuggaucgagcaguacaccaccauccacggcaagagcgccgccuucuucgugaucggcgccagccugggcgagauggccauccccgccgugaucggcauccugcagggcaaguaccccgaccugcccguggugcuguacaccagccugggcgccagcaucgccaccggcauccuguuccccgugcuguacaagcuggccaccagcccccuggacagacagagaaaggaggacagaaagagcgaggaccagaaggcccugcugagcagcagcggccugaacgaguacgaggaggagaacgaggaggaggacgccgagaaguggaacgagauggacuucgagaugaucgagaccaacgacaccaugagacacagcaucaucgagaccagcagaagcagccugaccgagcccaccgccgagguguacaaccaguaccccagcaacgcccugguguucgagagcagccccuucaacaccggcagcgcccacgugaagcaccugcccgagaccagaaccaagggcaccaacguguaa

SEQ ID NO: 18923 - RNA, 4551 nt, Artificial Sequence
  KIAA2022__Homo_sapiens__NP_001008537
auggacaaccagcaggacaaggccaucguggccagcgccaacggcgagaacacccugaucaacggcgugaaggagaacgacagcgaggaccaggacguggccaugaagagcuucgccgcccuggaggccgccgcccccauccagcccacccccguggcccagaaggagacccugauguaccccagaggccugcugccccugcccagcaagaagcccugcaugcagagcccccccagcccccugggccugaucgaggcccccgagcacgccgccaacagcgccagcgugaacgccaucagccugaccagcggcaucgccaagggccugaacaccuggagccugcccaacgagugcgagaaggcccccuucgccaucauggagcccgccggcaugagcgcccugaacggcgacugccugaugcagcccagcagaaccugccugggcugcuucauggagagcaaggacgccguggaccccgagcccggcaucagccugaaggugggcgaccugaacagagacuacgagaccugcgccgugagcgacaucggcauccagugcaucaacgccggcgagaacaugaaguacggcgagcagcugcugagcgaccagcugcugggcuucccccugcacaagagcagagccggcgacagaagagagaccgagaagcccgacaucgaccuggaggaccccgcccagaagagcuacuacgaggcccugcugcuggacaagugcaacaccgaggaggcccugcuggccaacagcaaccaggacuggggcuacuucgagaccuucaucagcgagagcaagaucgagcugcuggaccugugcagcaagaacgagcugagcgugaaccuguucagcgaggaggacguggacaacuacauguucgacgacgacgagagcacccugggcagcgacgugugcagccugaagaucagauacgagagcuuccaggacaacgugagagacaagaccacccugcugaugcaggaggacgcccaguucaacuucuuccccagcguguucaccaccugccccaagagagagagcaagagcggcgcccugaagcagagcagcgacuucagccaguucaaggugcccgacgugagcaucaucuggggcgaggaggacaagaaccuggacaagaagaagggcaaggaggagggccaggaggacaagggcguggagaagaaggacggcaaggacaacggcgagaagcccgcccugaacaagcccugcagcggcaccgagguggagcagcugaagaaccccaagcagggccaccuggccaacagccuggagaccagcggcagcuucagcgacgacagcagcuucaucgagaucagcuacgacgccaugggcgagaucaaggacugcagcagauacauggccagagacaccaacagcggcagcagcagcagccagcagaacuacggccugagagccaagagaaaggugagauacagcgaggacuaccuguacgacguggacagccuggagggcgagaaggugaacgagagaaaggaguggcugcccgugggcagcaaggaggaggacgacgacgaguggugccccaagaagagaagaaaggugaccagaaaggagccccccgugaucaucaaguacaucaucaucaacagauucaagggcgagaagaacaugcuggugaagcugggcaagguggacgccagcgagaccaccgugaaccugagcgagaaccagcugaacaaguacgccaagcuggccccccugaagggcuucuggcagaagaagaagaagcagagaaacaccaacaccgacagcaucaagacccccuucagccagaagcagagcuucgagcccggcagcuucgaggugagcuuccugccccccgccagaaagagaaagagcaagcugggcaacagacacagaauccagagaauccccagcaucgagaucagcgccagcagcaagcagaucagccugugcaacgaccagagacacgccagcaaccacaaggaggacggcggccugaagggcacccugaagagcgccccccugggcgcccccagcugcgccaacggcagccaccugaacgacaucaccggccccgacagcgugaaggugaaggcccaggacaccgaguucaagggccccgagagaaaggugcugaacaagaucaaguucaagagcgaggccagacugaagagcaagaaggugaaggccgccggccaggagagcaagcccaucgugcagaugagcccccugcuggagaaccagagcagcaaggccaaccugaagaacgaggugauccccggcaccagcaacagcagcagacugagcgaguuccacgaggccaaggccgccaagagcagcaccuuccugcccaccaccugcagcagcgagaugccccugagcagcgccaacgugaccaccaacauccccgugauccccggcggcuaccugcagacccugcuggacgccagcgaccugagcaacaacaccagcaucagcuacuucagccaccacagccccgagcagaacgagggcagccugacccagaccgagaagagcuucgugccccugcagcccacccaggacugcgugcugaccagcagcagcgacagcgagcugcagcagagcagccacaacuucaagauggagagcagcaacuacagaaacguguggcccaacaaggccaccagcggcacccaggaguucauggccgaggugagcagagagaucgcccccacccagagcagcgaguucggcgccagccagguggugagcauggagaacaaccugacccccaccaccuacaaccccaucugccugaacagcggcggcagcaacugcaacaaggugcuguacgacagcaugcaggacacccagcugcccagcgacgacagcuaccagcugugccacuucaacaacggcgagaucugcuuccccuuccagcagggccccgugaacauggacgacggcagacuguucagcuucgacagcauggccccccugagcgugagcagcagcaacuacugcagccugagccugaagagcugcgagaaggacggcgacgacgacaucaccgacgacuuccuggcccacugcagccccaagcuggugauccagcagagcaucgacgagaucgccccccugaaggagagcaccgaccugcuggacaucagcaacuucacccccgacaaguucagacacagcagccugagcgagaugagcccccccgacacccccagccugagcccccagaucaccagaugcgagagcaugaagacccugggcacccugaagggcuuccaggagggcgugcccggcccccuggacagcguggagaagaucaagugggacugcagcacccugagcagacaggugcagauggaggacggcuucacccugaacaaccaccaguuccaguuccacauguucaacgacgaggacagcgugagccugcugcagaagaaccccugccugagcaccuucaacgaccccagcggccagaucagcaccaacaacaaggugagcaagagcagaaagaagagcagccccagcaagagcggcgccaugaaccagagcagcagccagaagaacaccagaaagaagagccugaagggcaacaacaagggcaucgagaagccccccggcaagaacagcagacaggugcccaagagcaccaagaagggcaaguacauggccgccaucaacggcgagaagaugcagaucggcaucggcagaggcggcagccagaccaacaccaucagcagcaccggcaagacccuggccgagugcauccagcacggcggccccauggccagcaugaagaugcccagccagaagggccugagcggcgacugggcccugggcaaggagagcagccccggcuggagcgacaugagcaugggcaccaacaccaacagccugcuggacgacgaccagagagaguuccaggagcccagcuacauccugagcaacaucgccagcggcauggccgacgugcagagauucaugauggccagcaucgagccccugugggagcccauggagcaccacggcgaccccaacaucuucuacagccccgagagcaacagccugaagcugaagacccugaagauccuggccggcaccccccaggagagcaagaagaagaucaacagcggcagccagggcgccaccaagaaccacagaagcaucaagggcgugagcaagagcaacggcaagaccgccaucggcgaccccggcagagccaacaugcccggcuacaacgaggacagcagaagcaccuucuucgacaagaaguacagcaacaugagcacccugggcaacaacggccccacccacaagaagcuguacagacacaagagcagcagcaaggcccugagagacgagaagugcaagggcaagcacauggagagagagcaggugcacaaggacgagagcggcaccgccagcuucgagaagcugagagacagcgacuacaaccugcugaaggccgagaccaccuucugggugcugcccguguucgaggaggagaccagaaucuuccagaaggacaucuaa

SEQ ID NO: 18924 - RNA, 5316 nt, Artificial Sequence
  KIDINS220__Homo_sapiens__NP_065789
augagcgugcugaucagccagagcgugaucaacuacguggaggaggagaacauccccgcccugaaggcccugcuggagaagugcaaggacguggacgagagaaacgagugcggccagaccccccugaugaucgccgccgagcagggcaaccuggagaucgugaaggagcugaucaagaacggcgccaacugcaaccuggaggaccuggacaacuggaccgcccugaucagcgccagcaaggagggccacgugcacaucguggaggagcugcugaagugcggcgugaaccuggagcacagagacaugggcggcuggaccgcccugaugugggccugcuacaagggcagaaccgacgugguggagcugcugcugagccacggcgccaaccccagcgugaccggccuguacagcguguaccccaucaucugggccgccggcagaggccacgccgacaucgugcaccugcugcugcagaacggcgccaaggugaacugcagcgacaaguacggcaccaccccccuggugugggccgccagaaagggccaccuggagugcgugaagcaccugcuggccaugggcgccgacguggaccaggagggcgccaacagcaugaccgcccugaucguggccgugaagggcggcuacacccagagcgugaaggagauccugaagagaaaccccaacgugaaccugaccgacaaggacggcaacaccgcccugaugaucgccagcaaggagggccacaccgagaucgugcaggaccugcuggacgccggcaccuacgugaacauccccgacagaagcggcgacaccgugcugaucggcgccgugagaggcggccacguggagaucgugagagcccugcugcagaaguacgccgacaucgacaucagaggccaggacaacaagaccgcccuguacugggccguggagaagggcaacgccaccauggugagagacauccugcagugcaaccccgacaccgagaucugcaccaaggacggcgagaccccccugaucaaggccaccaagaugagaaacaucgaggugguggagcugcugcuggacaagggcgccaaggugagcgccguggacaagaagggcgacaccccccugcacaucgccaucagaggcagaagcagaaagcuggccgagcugcugcugagaaaccccaaggacggcagacugcuguacagacccaacaaggccggcgagacccccuacaacaucgacugcagccaccagaagagcauccugacccagaucuucggcgccagacaccugagccccaccgagaccgacggcgacaugcugggcuacgaccuguacagcagcgcccuggccgacauccugagcgagcccaccaugcagccccccaucugcgugggccuguacgcccaguggggcagcggcaagagcuuccugcugaagaagcuggaggacgagaugaagaccuucgccggccagcagaucgagccccuguuccaguucagcuggcugaucguguuccugacccugcugcugugcggcggccugggccugcuguucgccuucaccgugcaccccaaccugggcaucgccgugagccugagcuuccuggcccugcuguacaucuucuucaucgugaucuacuucggcggcagaagagagggcgagagcuggaacugggccugggugcugagcaccagacuggccagacacaucggcuaccuggagcugcugcugaagcugauguucgugaacccccccgagcugcccgagcagaccaccaaggcccugcccgugagauuccuguucaccgacuacaacagacugagcagcgugggcggcgagaccagccuggccgagaugaucgccacccugagcgacgccugcgagagagaguucggcuuccuggccaccagacuguucagaguguucaagaccgaggacacccagggcaagaagaaguggaagaagaccugcugccugcccagcuucgugaucuuccuguucaucaucggcugcaucaucagcggcaucacccugcuggccaucuucagaguggaccccaagcaccugaccgugaacgccgugcugaucagcaucgccagcguggugggccuggccuucgugcugaacugcagaaccugguggcaggugcuggacagccugcugaacagccagagaaagagacugcacaacgccgccagcaagcugcacaagcugaagagcgagggcuucaugaaggugcugaagugcgagguggagcugauggccagaauggccaagaccaucgacagcuucacccagaaccagaccagacugguggugaucaucgacggccuggacgccugcgagcaggacaaggugcugcagaugcuggacaccgugagagugcuguucagcaagggccccuucaucgccaucuucgccagcgacccccacaucaucaucaaggccaucaaccagaaccugaacagcgugcugagagacagcaacaucaacggccacgacuacaugagaaacaucgugcaccugcccguguuccugaacagcagaggccugagcaacgccagaaaguuccuggugaccagcgccaccaacggcgacgugcccugcagcgacaccaccggcauccaggaggacgccgacagaagagugagccagaacagccugggcgagaugaccaagcugggcagcaagaccgcccugaacagaagagacaccuacagaagaagacagaugcagagaaccaucaccagacagaugagcuucgaccugaccaagcugcuggugaccgaggacugguucagcgacaucagcccccagaccaugagaagacugcugaacaucgugagcgugaccggcagacugcugagagccaaccagaucagcuucaacugggacagacuggccagcuggaucaaccugaccgagcaguggcccuacagaaccagcuggcugauccuguaccuggaggagaccgagggcauccccgaccagaugacccugaagaccaucuacgagagaaucagcaagaacauccccaccaccaaggacguggagccccugcuggagaucgacggcgacaucagaaacuucgagguguuccugagcagcagaacccccgugcugguggccagagacgugaagguguuccugcccugcaccgugaaccuggaccccaagcugagagagaucaucgccgacgugagagccgccagagagcagaucagcaucggcggccuggccuaccccccccugccccugcacgagggcccccccagagcccccagcggcuacagccagccccccagcgugugcagcagcaccagcuucaacggccccuucgccggcggcguggugagcccccagccccacagcagcuacuacagcggcaugaccggcccccagcaccccuucuacaacagacccuucuucgcccccuaccuguacacccccagauacuaccccggcggcagccagcaccugaucagcagacccagcgugaagaccagccugcccagagaccagaacaacggccuggaggugaucaaggaggacgccgccgagggccugagcagccccaccgacagcagcagaggcagcggccccgcccccggccccguggugcugcugaacagccugaacguggacgccgugugcgagaagcugaagcagaucgagggccuggaccagagcaugcugccccaguacugcaccaccaucaagaaggccaacaucaacggcagagugcuggcccagugcaacaucgacgagcugaagaaggagaugaacaugaacuucggcgacuggcaccuguucagaagcaccgugcuggagaugagaaacgccgagagccacguggugcccgaggaccccagauuccugagcgagagcagcagcggccccgccccccacggcgagcccgccagaagagccagccacaacgagcugccccacaccgagcugagcagccagacccccuacacccugaacuucagcuucgaggagcugaacacccugggccuggacgagggcgcccccagacacagcaaccugagcuggcagagccagaccagaagaacccccagccugagcagccugaacagccaggacagcagcaucgagaucagcaagcugaccgacaaggugcaggccgaguacagagacgccuacagagaguacaucgcccagaugagccagcuggagggcggccccggcagcaccaccaucagcggcagaagcagcccccacagcaccuacuacaugggccagagcagcagcggcggcagcauccacagcaaccuggagcaggagaagggcaaggacagcgagcccaagcccgacgacggcagaaagagcuuccugaugaagagaggcgacgugaucgacuacagcagcagcggcgugagcaccaacgacgccagcccccuggaccccaucaccgaggaggacgagaagagcgaccagagcggcagcaagcugcugcccggcaagaagagcagcgagagaagcagccuguuccagaccgaccugaagcugaagggcagcggccugagauaccagaagcugcccagcgacgaggacgagagcggcaccgaggagagcgacaacaccccccugcugaaggacgacaaggacagaaaggccgagggcaagguggagagagugcccaagagccccgagcacagcgccgagcccaucagaaccuucaucaaggccaaggaguaccugagcgacgcccugcuggacaagaaggacagcagcgacagcggcgugagaagcagcgagagcagccccaaccacagccugcacaacgagguggccgacgacagccagcuggagaaggccaaccugaucgagcuggaggacgacagccacagcggcaagagaggcaucccccacagccugagcggccugcaggaccccaucaucgccagaaugagcaucugcagcgaggacaagaagagccccagcgagugcagccugaucgccagcagccccgaggagaacuggcccgccugccagaaggccuacaaccugaacagaacccccagcaccgugacccugaacaacaacagcgcccccgccaacagagccaaccagaacuucgacgagauggagggcaucagagagaccagccaggugauccugagacccagcagcagccccaaccccaccaccauccagaacgagaaccugaagagcaugacccacaagagaagccagagaagcagcuacaccagacugagcaaggacccccccgagcugcacgccgccgccagcagcgagagcaccggcuucggcgaggagagagagagcauccuguaa

SEQ ID NO: 18925 - RNA, 3171 nt, Artificial Sequence
  KIF11__Homo_sapiens__NP_004514
auggccagccagcccaacagcagcgccaagaagaaggaggagaagggcaagaacauccaggugguggugagaugcagacccuucaaccuggccgagagaaaggccagcgcccacagcaucguggagugcgaccccgugagaaaggaggugagcgugagaaccggcggccuggccgacaagagcagcagaaagaccuacaccuucgacaugguguucggcgccagcaccaagcagaucgacguguacagaagcguggugugccccauccuggacgaggugaucaugggcuacaacugcaccaucuucgccuacggccagaccggcaccggcaagaccuucaccauggagggcgagagaagccccaacgaggaguacaccugggaggaggacccccuggccggcaucauccccagaacccugcaccagaucuucgagaagcugaccgacaacggcaccgaguucagcgugaaggugagccugcuggagaucuacaacgaggagcuguucgaccugcugaaccccagcagcgacgugagcgagagacugcagauguucgacgaccccagaaacaagagaggcgugaucaucaagggccuggaggagaucaccgugcacaacaaggacgagguguaccagauccuggagaagggcgccgccaagagaaccaccgccgccacccugaugaacgccuacagcagcagaagccacagcguguucagcgugaccauccacaugaaggagaccaccaucgacggcgaggagcuggugaagaucggcaagcugaaccugguggaccuggccggcagcgagaacaucggcagaagcggcgccguggacaagagagccagagaggccggcaacaucaaccagagccugcugacccugggcagagugaucaccgcccugguggagagaaccccccacgugcccuacagagagagcaagcugaccagaauccugcaggacagccugggcggcagaaccagaaccagcaucaucgccaccaucagccccgccagccugaaccuggaggagacccugagcacccuggaguacgcccacagagccaagaacauccugaacaagcccgaggugaaccagaagcugaccaagaaggcccugaucaaggaguacaccgaggagaucgagagacugaagagagaccuggccgccgccagagagaagaacggcguguacaucagcgaggagaacuucagagugaugagcggcaagcugaccgugcaggaggagcagaucguggagcugaucgagaagaucggcgccguggaggaggagcugaacagagugaccgagcuguucauggacaacaagaacgagcuggaccagugcaagagcgaccugcagaacaagacccaggagcuggagaccacccagaagcaccugcaggagaccaagcugcagcuggugaaggaggaguacaucaccagcgcccuggagagcaccgaggagaagcugcacgacgccgccagcaagcugcugaacaccguggaggagaccaccaaggacgugagcggccugcacagcaagcuggacagaaagaaggccguggaccagcacaacgccgaggcccaggacaucuucggcaagaaccugaacagccuguucaacaacauggaggagcugaucaaggacggcagcagcaagcagaaggccaugcuggaggugcacaagacccuguucggcaaccugcugagcagcagcgugagcgcccuggacaccaucaccaccguggcccugggcagccugaccagcauccccgagaacgugagcacccacgugagccagaucuucaacaugauccugaaggagcagagccuggccgccgagagcaagaccgugcugcaggagcugaucaacgugcugaagaccgaccugcugagcagccuggagaugauccugagccccaccguggugagcauccugaagaucaacagccagcugaagcacaucuucaagaccagccugaccguggccgacaagaucgaggaccagaagaaggagcuggacggcuuccugagcauccugugcaacaaccugcacgagcugcaggagaacaccaucugcagccugguggagagccagaagcagugcggcaaccugaccgaggaccugaagaccaucaagcagacccacagccaggagcugugcaagcugaugaaccuguggaccgagagauucugcgcccuggaggagaagugcgagaacauccagaagccccugagcagcgugcaggagaacauccagcagaagagcaaggacaucgugaacaagaugaccuuccacagccagaaguucugcgccgacagcgacggcuucagccaggagcugagaaacuucaaccaggagggcaccaagcugguggaggagagcgugaagcacagcgacaagcugaacggcaaccuggagaagaucagccaggagaccgagcagagaugcgagagccugaacaccagaaccguguacuucagcgagcagugggugagcagccugaacgagagagagcaggagcugcacaaccugcuggagguggugagccagugcugcgaggccagcagcagcgacaucaccgagaagagcgacggcagaaaggccgcccacgagaagcagcacaacaucuuccuggaccagaugaccaucgacgaggacaagcugaucgcccagaaccuggagcugaacgagaccaucaagaucggccugaccaagcugaacugcuuccuggagcaggaccugaagcuggacauccccaccggcaccaccccccagagaaagagcuaccuguaccccagcacccuggugagaaccgagcccagagagcaccugcuggaccagcugaagagaaagcagcccgagcugcugaugaugcugaacugcagcgagaacaacaaggaggagaccauccccgacguggacguggaggaggccgugcugggccaguacaccgaggagccccugagccaggagcccagcguggacgccggcguggacugcagcagcaucggcggcgugcccuucuuccagcacaagaagagccacggcaaggacaaggagaacagaggcaucaacacccuggagagaagcaagguggaggagaccaccgagcaccuggugaccaagagcagacugccccugagagcccagaucaaccuguaa

SEQ ID NO: 18926 - RNA, 5313 nt, Artificial Sequence
  KIF13A__Homo_sapiens__NP_001099036
augagcgacaccaaggugaagguggccgugagagugagacccaugaacagaagagagcuggagcugaacaccaagugcgugguggagauggagggcaaccagaccgugcugcaccccccccccagcaacaccaagcagggcgagagaaagccccccaagguguucgccuucgacuacugcuucuggagcauggacgagagcaacaccaccaaguacgccggccaggaggugguguucaagugccugggcgagggcauccuggagaaggccuuccagggcuacaacgccugcaucuucgccuacggccagaccggcagcggcaagagcuucagcaugaugggccacgccgagcagcugggccugauccccagacugugcugcgcccuguucaagagaaucagccuggagcagaacgagagccagaccuucaagguggaggugagcuacauggagaucuacaacgagaaggugagagaccugcuggaccccaagggcagcagacagagccugaaggugagagagcacaaggugcugggccccuacguggacggccugagccagcuggccgugaccagcuucgaggacaucgagagccugaugagcgagggcaacaagagcagaaccguggccgccaccaacaugaacgaggagagcagcagaagccacgccguguucaacaucaucaucacccagacccuguacgaccugcagagcggcaacagcggcgagaaggugagcaaggugagccugguggaccuggccggcagcgagagagugagcaagaccggcgccgccggcgagagacugaaggagggcagcaacaucaacaagagccugaccacccugggccuggugaucagcagccuggccgaccaggccgccggcaagggcaagagcaaguucgugcccuacagagacagcgugcugaccuggcugcugaaggacaaccugggcggcaacagccagaccagcaugaucgccaccaucagccccgccgccgacaacuacgaggagacccugagcacccugagauacgccgacagagccaagagaaucgugaaccacgccguggugaacgaggaccccaacgccaaggugaucagagagcugagagaggagguggagaagcugagagagcagcugagccaggccgaggccaugaaggcccccgagcugaaggagaagcuggaggagagcgagaagcugaucaaggagcugaccgugaccugggaggagaagcugagaaagaccgaggagaucgcccaggagagacagagacagcuggagagcaugggcaucagccuggagaugagcggcaucaaggugggcgacgacaagugcuaccuggugaaccugaacgccgaccccgcccugaacgagcugcugguguacuaccugaaggaccacaccagagugggcgccgacaccagccaggacauccagcuguucggcaucggcauccagccccagcacugcgagaucgacaucgccagcgacggcgacgugacccugacccccaaggagaacgccagaagcugcgugaacggcacccuggugugcagcaccacccagcuguggcacggcgacagaauccuguggggcaacaaccacuucuucagaaucaaccugcccaagagaaagagaagagacuggcugaaggacuucgagaaggagaccggcccccccgagcacgaccuggacgccgccagcgaggccagcagcgagcccgacuacaacuacgaguucgcccagauggaggugaucaugaagacccugaacagcaacgaccccgugcagaacguggugcaggugcuggagaagcaguaccuggaggagaagagaagcgcccuggaggagcagagacugauguacgagagagagcuggagcagcugagacagcagcugagccccgacagacagccccagagcagcggccccgacagacuggccuacagcagccagaccgcccagcagaaggugacccagugggccgaggagagagacgagcuguucagacagagccuggccaagcugagagagcagcuggugaaggccaacacccuggugagagaggccaacuuccuggccgaggagaugagcaagcugaccgacuaccaggugacccugcagauccccgccgccaaccugagcgccaacagaaagagaggcgccaucgugagcgagcccgccauccaggugagaagaaagggcaagagcacccagguguggaccaucgagaagcuggagaacaagcugaucgacaugagagaccuguaccaggaguggaaggagaaggugcccgaggccaagagacuguacggcaagagaggcgaccccuucuacgaggcccaggagaaccacaaccugaucggcguggccaacguguuccuggagugccuguucugcgacgugaagcugcaguacgccgugcccaucaucagccagcagggcgagguggccggcagacugcacguggaggugaugagagugaccggcgccgugcccgagagagugguggaggacgacagcagcgagaacagcagcgagagcggcagccuggaggugguggacagcagcggcgagaucauccacagagugaagaagcugaccugcagagugaagaucaaggaggccaccggccugccccugaaccugagcaacuucguguucugccaguacaccuucugggaccagugcgagagcaccguggccgcccccgugguggaccccgaggugcccagcccccagagcaaggacgcccaguacaccgugaccuucagccacugcaaggacuacguggugaacgugaccgaggaguuccuggaguucaucagcgacggcgcccuggccaucgagguguggggccacagaugcgccggcaacggcagcagcaucugggagguggacagccugcacgccaagaccagaacccugcacgacagauggaacgaggugaccagaagaaucgagauguggaucagcauccuggagcugaacgagcugggcgaguacgccgccguggagcugcaccaggccaaggacgugaacaccggcggcaucuuccagcugagacagggccacagcagaagagugcaggugaccgugaagcccgugcagcacagcggcacccugccccugaugguggaggccauccugagcgugagcaucggcugcgugaccgccagaagcaccaagcugcagagaggccuggacagcuaccagagagacgacgaggacggcgacgacauggacagcuaccaggaggaggaccugaacugcgugagagagagauggagcgacgcccugaucaagagaagagaguaccuggacgagcagaucaagaaggugagcaacaagaccgagaagaccgaggacgacguggagagagaggcccagcugguggagcagugggugggccugaccgaggagagaaacgccgugcuggugcccgcccccggcagcggcauccccggcgcccccgccgacuggauccccccccccggcauggagacccacauccccgugcuguuccuggaccugaacgccgacgaccugagcgccaacgagcagcuggugggcccccacgccagcggcgugaacagcauccugcccaaggagcacggcagccaguucuucuaccugcccaucaucaagcacagcgacgacgaggugagcgccaccgccagcugggacagcagcgugcacgacagcgugcaccugaacagagugaccccccagaacgagagaaucuaccugaucgugaagaccaccgugcagcugagccaccccgccgccauggagcuggugcugagaaagagaaucgccgccaacaucuacaacaagcagagcuucacccagagccugaagagaagaaucagccugaagaacaucuucuacagcugcggcgugaccuacgagaucgugagcaacauccccaaggccaccgaggagaucgaggacagagagacccuggcccugcuggccgccagaagcgagaacgagggcaccagcgacggcgagaccuacaucgagaaguacaccagaggcgugcugcagguggagaacauccugagccuggagagacugagacaggccgugaccgugaaggaggcccugagcaccaaggccagacacaucagaagaagccugagcacccccaacgugcacaacgugagcagcagcagacccgaccugagcggcuucgacgaggacgacaagggcuggcccgagaaccagcuggacaugagcgacuacagcagcagcuaccaggacguggccugcuacggcacccugcccagagacagccccagaagaaacaaggagggcugcaccagcgagaccccccacgcccugaccgugagccccuucaaggccuucagcccccagccccccaaguucuucaagccccugaugcccgugaaggaggagcacaagaagagaaucgcccuggaggccagaccccugcugagccaggaggacagcgaggaggaggagaacgagcuggaggccaucaacagaaagcugaucagcagccagcccuacgugcccguggaguucgccgacuucagcguguacaacgccagccuggagaacagagagugguucagcagcaagguggaccugagcaacagcagagugcuggagaaggaggugagcagaagccccaccaccagcagcaucaccagcggcuacuucagccacagcgccagcaacgccacccugagcgacaugguggugcccagcagcgacagcagcgaccagcuggccauccagaccaaggacgccgacagcaccgagcacagcacccccagccuggugcacgacuucagacccagcagcaacaaggagcugaccgagguggagaagggccuggugaaggacaagaucaucguggugccccugaaggagaacagcgcccuggccaagggcagccccagcagccagagcauccccgagaagaacagcaagagccugugcagaaccggcagcugcagcgagcuggacgccugccccagcaagaucagccagcccgccagaggcuucugccccagagaggugaccguggagcacaccaccaacauccuggaggaccacagcuucaccgaguucaugggcgugagcgagggcaaggacuucgacggccugaccgacagcagcgccggcgagcugagcagcagaagaagccugcccaacaagaccggcggcaagaccgugagcgacggccugcaccaccccagccagcugcacagcaagcuggagaacgaccaggugaucauccccgaggccgccuucugggugcugugcugccaguaa

SEQ ID NO: 18927 - RNA, 4947 nt, Artificial Sequence
  KIF14__Homo_sapiens__NP_055690
augagccugcacagcacccacaacagaaacaacagcggcgacauccuggacauccccagcagccagaacagcagcagccugaacgcccugacccacagcagcagacugaagcugcaccugaagagcgacaugagcgagugcgagaacgacgacccccugcugagaagcgccggcaaggugagagacaucaacagaaccuacgugaucagcgccagcagaaagaccgccgacaugccccugacccccaaccccgugggcagacuggcccugcagagaagaaccaccagaaacaaggagagcagccugcuggugagcgagcuggaggacaccaccgagaagaccgccgagaccagacugacccugcagagaagagccaagaccgacagcgccgagaaguggaagaccgccgagaucgacagcgugaagaugacccugaacgugggcggcgagaccgagaacaacggcgugagcaaggagagcagaaccaacgugagaaucgugaacaacgccaagaacagcuucguggccagcagcgugccccuggacgaggacccccaggugaucgagaugauggccgacaagaaguacaaggagaccuucagcgcccccagcagagccaacgagaacguggcccugaaguacagcagcaacagaccccccaucgccagccugagccagaccgagguggugagaagcggccaccugaccaccaagcccacccagagcaagcuggacaucaaggugcugggcaccggcaaccuguaccacagaagcaucggcaaggagaucgccaagaccagcaacaaguucggcagccuggagaagagaacccccaccaagugcaccaccgagcacaagcugaccaccaagugcagccugccccagcugaagagccccgcccccagcauccugaagaacagaaugagcaaccugcaggugaagcagagacccaagagcagcuuccuggccaacaagcaggagagaagcgccgagaacaccauccugcccgaggaggagaccguggugcagaacaccagcgccggcaaggacccccugaagguggagaacagccaggugaccguggccgugagagugagacccuucaccaagagagagaagaucgagaaggccagccaggugguguucaugagcggcaaggagaucaccguggagcaccccgacaccaagcagguguacaacuucaucuacgacgugagcuucuggagcuucgacgagugccacccccacuacgccagccagaccaccguguacgagaagcuggccgccccccugcuggagagagccuucgagggcuucaacaccugccuguucgccuacggccagaccggcagcggcaagagcuacaccaugaugggcuucagcgaggagcccggcaucauccccagauucugcgaggaccuguucagccagguggccagaaagcagacccaggaggugagcuaccacaucgagaugagcuucuucgagguguacaacgagaagauccacgaccugcuggugugcaaggacgagaacggccagagaaagcagccccugagagugagagagcaccccguguacggccccuacguggaggcccugagcaugaacaucgugagcagcuacgccgacauccagagcuggcuggagcugggcaacaagcagagagccaccgccgccaccggcaugaacgacaagagcagcagaagccacagcguguucacccuggugaugacccagaccaagaccgaguucguggagggcgaggagcacgaccacagaaucaccagcagaaucaaccugaucgaccuggccggcagcgagagaugcagcaccgcccacaccaacggcgacagacugaaggagggcgugagcaucaacaagagccugcugacccugggcaaggugaucagcgcccugagcgagcaggccaaccagagaagcguguucauccccuacagagagagcgugcugaccuggcugcugaaggagagccugggcggcaacagcaagaccgccaugaucgccaccaucagccccgccgccagcaacaucgaggagacccugagcacccugagauacgccaaccaggccagacugaucgugaacaucgccaaggugaacgaggacaugaacgccaagcugaucagagagcugaaggccgagaucgccaagcugaaggccgcccagagaaacagcagaaacaucgaccccgagagauacagacugugcagacaggagaucaccagccugagaaugaagcugcaccagcaggagagagacauggccgagaugcagagaguguggaaggagaaguucgagcaggccgagaagagaaagcugcaggagaccaaggagcugcagaaggccggcaucauguuccagauggacaaccaccugcccaaccuggugaaccugaacgaggacccccagcugagcgagaugcugcuguacaugaucaaggagggcaccaccaccgugggcaaguacaagcccaacagcagccacgacauccagcugagcggcgugcugaucgccgacgaccacugcaccaucaagaacuucggcggcaccgugagcaucauccccgugggcgaggccaagaccuacgugaacggcaagcacauccuggagaucaccgugcugagacacggcgacagagugauccugggcggcgaccacuacuucagauucaaccaccccguggaggugcagaagggcaagagacccagcggcagagacacccccaucagcgagggccccaaggacuucgaguucgccaagaacgagcugcugauggcccagagaagccagcuggaggccgagaucaaggaggcccagcugaaggccaaggaggagaugaugcagggcauccagaucgccaaggagauggcccagcaggagcugagcagccagaaggccgccuacgagagcaagaucaaggcccuggaggccgagcugagagaggagagccagagaaagaagaugcaggagaucaacaaccagaaggccaaccacaagaucgaggagcuggagaaggccaagcagcaccuggagcaggagaucuacgugaacaagaagagacuggagauggagacccuggccaccaagcaggcccuggaggaccacagcaucagacacgccagaauccuggaggcccuggagaccgagaagcagaagaucgccaaggaggugcagauccugcagcagaacagaaacaacagagacaagaccuucaccgugcagaccaccuggagcagcaugaagcugagcaugaugauccaggaggccaacgccaucagcagcaagcugaagaccuacuacguguucggcagacacgacaucagcgacaagagcagcagcgacaccagcaucagagugagaaaccugaagcugggcaucagcaccuucuggagccuggagaaguucgagagcaagcuggccgccaugaaggagcuguacgagagcaacggcagcaacagaggcgaggacgccuucugcgaccccgaggacgagugggagcccgacaucaccgacgcccccgugagcagccugagcagaagaagaagcagaagccugaugaagaacagaagaaucagcggcugccugcacgacauccaggugcaccccaucaagaaccugcacagcagccacagcagcggccugauggacaagagcagcaccaucuacagcaacagcgccgagagcuuccugcccggcaucugcaaggagcugaucggcagcagccuggacuucuucggccagagcuacgacgaggagagaaccaucgccgacagccugaucaacagcuuccugaagaucuacaacggccuguucgccaucagcaaggcccacgaggagcaggacgaggagagccaggacaaccuguucagcagcgacagagccauccagagccugaccauccagaccgccugcgccuucgagcagcugguggugcugaugaagcacuggcugagcgaccugcugcccugcaccaacaucgccagacuggaggacgagcugagacaggaggugaagaagcugggcggcuaccugcagcuguuccugcagggcugcugccuggacaucagcagcaugaucaaggaggcccagaagaacgccauccagaucgugcagcaggccgugaaguacgugggccagcuggccgugcugaagggcagcaagcugcacuuccuggagaacggcaacaacaaggccgccagcgugcaggaggaguucauggacgccgugugcgacggcgugggccugggcaugaagauccugcuggacagcggccuggagaaggccaaggagcugcagcacgagcuguucagacagugcaccaagaacgaggugaccaaggagaugaagaccaacgccaugggccugaucagaagccuggagaacaucuucgccgagagcaagaucaagagcuucagaagacaggugcaggaggagaacuucgaguaccaggacuucaagagaauggugaacagagcccccgaguuccugaagcugaagcacugccuggagaaggccaucgagaucaucaucagcgcccugaagggcugccacagcgacaucaaccugcugcagaccugcguggagagcaucagaaaccuggccagcgacuucuacagcgacuucagcgugcccagcaccagcgugggcagcuacgagagcagagugacccacaucgugcaccaggagcuggagagccuggccaagagccugcuguucugcuucgagagcgaggagagccccgaccugcugaagcccugggagaccuacaaccagaacaccaaggaggagcaccagcagagcaagagcagcggcaucgacggcagcaagaacaagggcgugcccaagagaguguacgagcugcacggcagcagccccgccgugagcagcgaggagugcacccccagcagaauccaguggguguaa

SEQ ID NO: 18928 - RNA, 4167 nt, Artificial Sequence
  KIF15__Homo_sapiens__NP_064627
auggcccccggcugcaagaccgagcugagaagcgugaccaacggccagagcaaccagcccagcaacgagggcgacgccaucaagguguucgugagaaucagaccccccgccgagagaagcggcagcgccgacggcgagcagaaccugugccugagcgugcugagcagcaccagccugagacugcacagcaaccccgagcccaagaccuucaccuucgaccacguggccgacguggacaccacccaggagagcguguucgccaccguggccaagagcaucguggagagcugcaugagcggcuacaacggcaccaucuucgccuacggccagaccggcagcggcaagaccuucaccaugaugggccccagcgagagcgacaacuucagccacaaccugagaggcgugauccccagaagcuucgaguaccuguucagccugaucgacagagagaaggagaaggccggcgccggcaagagcuuccugugcaagugcagcuucaucgagaucuacaacgagcagaucuacgaccugcuggacagcgccagcgccggccuguaccugagagagcacaucaagaagggcguguucguggugggcgccguggagcagguggugaccagcgccgccgaggccuaccaggugcugagcggcggcuggagaaacagaagaguggccagcaccagcaugaacagagagagcagcagaagccacgccguguucaccaucaccaucgagagcauggagaagagcaacgagaucgugaacaucagaaccagccugcugaaccugguggaccuggccggcagcgagagacagaaggacacccacgccgagggcaugagacugaaggaggccggcaacaucaacagaagccugagcugccugggccaggugaucaccgcccugguggacgugggcaacggcaagcagagacacgugugcuacagagacagcaagcugaccuuccugcugagagacagccugggcggcaacgccaagaccgccaucaucgccaacgugcaccccggcagcagaugcuucggcgagacccugagcacccugaacuucgcccagagagccaagcugaucaagaacaaggccguggugaacgaggacacccagggcaacgugagccagcugcaggccgaggugaagagacugaaggagcagcuggccgagcuggccagcggccagaccccccccgagagcuuccugaccagagacaagaagaagaccaacuacauggaguacuuccaggaggccaugcuguucuucaagaagagcgagcaggagaagaagagccugaucgagaaggugacccagcuggaggaccugacccugaagaaggagaaguucauccagagcaacaagaugaucgugaaguucagagaggaccagaucaucagacuggagaagcugcacaaggagagcagaggcggcuuccugcccgaggagcaggacagacugcugagcgagcugagaaacgagauccagacccugagagagcagaucgagcaccaccccagaguggccaaguacgccauggagaaccacagccugagagaggagaacagaagacugagacugcuggagcccgugaagagagcccaggagauggacgcccagaccaucgccaagcuggagaaggccuucagcgagaucagcggcauggagaagagcgacaagaaccagcagggcuucagccccaaggcccagaaggagcccugccuguucgccaacaccgagaagcugaaggcccagcugcugcagauccagaccgagcugaacaacagcaagcaggaguacgaggaguucaaggagcugaccagaaagagacagcuggagcuggagagcgagcugcagagccugcagaaggccaaccugaaccuggagaaccugcuggaggccaccaaggccugcaagagacaggaggugagccagcugaacaagauccacgccgagacccugaagaucaucaccacccccaccaaggccuaccagcugcacagcagacccgugcccaagcugagccccgagaugggcagcuucggcagccuguacacccagaacagcagcauccuggacaacgacauccugaacgagcccgugccccccgagaugaacgagcaggccuucgaggccaucagcgaggagcugagaaccgugcaggagcagaugagcgcccugcaggccaagcuggacgaggaggagcacaagaaccugaagcugcagcagcacguggacaagcuggagcaccacagcacccagaugcaggagcuguucagcagcgagagaaucgacuggaccaagcagcaggaggagcugcugagccagcugaacgugcuggagaagcagcugcaggagacccagaccaagaacgacuuccugaagagcgaggugcacgaccugagaguggugcugcacagcgccgacaaggagcugagcagcgugaagcuggaguacagcagcuucaagaccaaccaggagaaggaguucaacaagcugagcgagagacacaugcacgugcagcugcagcuggacaaccugagacuggagaacgagaagcugcuggagagcaaggccugccugcaggacagcuacgacaaccugcaggagaucaugaaguucgagaucgaccagcugagcagaaaccugcagaacuucaagaaggagaacgagacccugaagagcgaccugaacaaccugauggagcugcuggaggccgagaaggagagaaacaacaagcugagccugcaguucgaggaggacaaggagaacagcagcaaggagauccugaaggugcuggaggccgugagacaggagaagcagaaggagaccgccaagugcgagcagcagauggccaaggugcagaagcuggaggagagccugcuggccaccgagaaggugaucagcagccuggagaagagcagagacagcgacaagaaggugguggccgaccugaugaaccagauccaggagcugagaaccagcgugugcgagaagaccgagaccaucgacacccugaagcaggagcugaaggacaucaacugcaaguacaacagcgcccugguggacagagaggagagcagagugcugaucaagaagcaggagguggacauccuggaccugaaggagacccugagacugagaauccugagcgaggacaucgagagagacaugcugugcgaggaccuggcccacgccaccgagcagcugaacaugcugaccgaggccagcaagaagcacagcggccugcugcagagcgcccaggaggagcugaccaagaaggaggcccugauccaggagcugcagcacaagcugaaccagaagaaggaggagguggagcagaagaagaacgaguacaacuucaagaugagacagcuggagcacgugauggacagcgccgccgaggacccccagagccccaagacccccccccacuuccagacccaccuggccaagcugcuggagacccaggagcaggagaucgaggacggcagagccagcaagaccagccuggagcaccuggugaccaagcugaacgaggacagagaggugaagaacgccgagauccugagaaugaaggagcagcugagagagauggagaaccugagacuggagagccagcagcugaucgagaagaacuggcugcugcagggccagcuggacgacaucaagagacagaaggagaacagcgaccagaaccaccccgacaaccagcagcugaagaacgagcaggaggagagcaucaaggagagacuggccaagagcaagaucguggaggagaugcugaagaugaaggccgaccuggaggaggugcagagcgcccuguacaacaaggagauggagugccugagaaugaccgacgagguggagagaacccagacccuggagagcaaggccuuccaggagaaggagcagcugagaagcaagcuggaggagauguacgaggagagagagagaaccagccaggagauggagaugcugagaaagcagguggagugccuggccgaggagaacggcaagcuggugggccaccagaaccugcaccagaagauccaguacguggugagacugaagaaggagaacgugagacuggccgaggagaccgagaagcugagagccgagaacguguuccugaaggagaagaagagaagcgagagcuaa

SEQ ID NO: 18929 - RNA, 4179 nt, Artificial Sequence
  KIF16B__Homo_sapiens__NP_001186795
auggccagcgugaagguggccgugagagugagacccaugaacagaagagagaaggaccuggaggccaaguucaucauccagauggagaagagcaagaccaccaucaccaaccugaagauccccgagggcggcaccggcgacagcggcagagagagaaccaagaccuucaccuacgacuucagcuucuacagcgccgacaccaagagccccgacuacgugagccaggagaugguguucaagacccugggcaccgacguggugaagagcgccuucgagggcuacaacgccugcguguucgccuacggccagaccggcagcggcaagagcuacaccaugaugggcaacagcggcgacagcggccugauccccagaaucugcgagggccuguucagcagaaucaacgagaccaccagaugggacgaggccagcuucagaaccgaggugagcuaccuggagaucuacaacgagagagugagagaccugcugagaagaaagagcagcaagaccuucaaccugagagugagagagcaccccaaggagggccccuacguggaggaccugagcaagcaccuggugcagaacuacggcgacguggaggagcugauggacgccggcaacaucaacagaaccaccgccgccaccggcaugaacgacgugagcagcagaagccacgccaucuucaccaucaaguucacccaggccaaguucgacagcgagaugcccugcgagaccgugagcaagauccaccugguggaccuggccggcagcgagagagccgacgccaccggcgccaccggcgugagacugaaggagggcggcaacaucaacaagagccuggugacccugggcaacgugaucagcgcccuggccgaccugagccaggacgccgccaacacccuggccaagaagaagcagguguucgugcccuacagagacagcgugcugaccuggcugcugaaggacagccugggcggcaacagcaagaccaucaugaucgccaccaucagccccgccgacgugaacuacggcgagacccugagcacccugagauacgccaacagagccaagaacaucaucaacaagcccaccaucaacgaggacgccaacgugaagcugaucagagagcugagagccgagaucgccagacugaagacccugcuggcccagggcaaccagaucgcccugcuggacagccccaccgcccugagcauggaggagaagcugcagcagaacgaggccagagugcaggagcugaccaaggaguggaccaacaaguggaacgagacccagaacauccugaaggagcagacccuggcccugagaaaggagggcaucggcguggugcuggacagcgagcugccccaccugaucggcaucgacgacgaccugcugagcaccggcaucauccuguaccaccugaaggagggccagaccuacgugggcagagacgacgccagcaccgagcaggacaucgugcugcacggccuggaccuggagagcgagcacugcaucuucgagaacaucggcggcaccgugacccugaucccccugagcggcagccagugcagcgugaacggcgugcagaucguggaggccacccaccugaaccagggcgccgugauccugcugggcagaaccaacauguucagauucaaccaccccaaggaggccgccaagcugagagagaagagaaagagcggccugcugagcagcuucagccugagcaugaccgaccugagcaagagcagagagaaccugagcgccgugaugcuguacaaccccggccuggaguucgagagacagcagagagaggagcuggagaagcuggagagcaagagaaagcugaucgaggagauggaggagaagcagaagagcgacaaggccgagcuggagagaaugcagcaggagguggagacccagagaaaggagaccgagaucgugcagcugcagaucagaaagcaggaggagagccugaagagaagaagcuuccacaucgagaacaagcugaaggaccugcuggccgagaaggagaaguucgaggaggagagacugagagagcagcaggagaucgagcugcagaagaagagacaggaggaggagaccuuccugagagugcaggaggagcugcagagacugaaggagcugaacaacaacgagaaggccgagaaguuccagaucuuccaggagcuggaccagcugcagaaggagaaggacgagcaguacgccaagcuggagcuggagaagaagagacuggaggagcaggagaaggagcaggugaugcugguggcccaccuggaggagcagcugagagagaagcaggagaugauccagcugcugagaagaggcgaggugcaguggguggaggaggagaagagagaccuggagggcaucagagagagccugcugagagugaaggaggccagagccggcggcgacgaggacggcgaggagcuggagaaggcccagcugagauucuucgaguucaagagaagacagcuggugaagcuggugaaccuggagaaggaccuggugcagcagaaggacauccugaagaaggaggugcaggaggagcaggagauccuggagugccugaagugcgagcacgacaaggagagcagacugcuggagaagcacgacgagagcgugaccgacgugaccgaggugccccaggacuucgagaagaucaagcccguggaguacagacugcaguacaaggagagacagcugcaguaccugcugcagaaccaccugcccacccugcuggaggagaagcagagagccuucgagauccuggacagaggcccccugagccuggacaacacccuguaccagguggagaaggagauggaggagaaggaggagcagcuggcccaguaccaggccaacgccaaccagcugcagaagcugcaggccaccuucgaguucaccgccaacaucgccagacaggaggagaaggugagaaagaaggagaaggagauccuggagagcagagagaagcagcagagagaggcccuggagagagcccuggccagacuggagagaagacacagcgcccugcagagacacagcacccugggcauggagaucgaggagcagagacagaagcuggccagccugaacagcggcagcagagagcagagcggccugcaggccagccuggaggccgagcaggaggcccuggagaaggaccaggagagacuggaguacgagauccagcagcugaagcagaagaucuacgagguggacggcgugcagaaggaccaccacggcacccuggagggcaagguggccagcagcagccugcccgugagcgccgagaagagccaccuggugccccugauggacgccagaaucaacgccuacaucgaggaggaggugcagagaagacugcaggaccugcacagagugaucagcgagggcugcagcaccagcgccgacaccaugaaggacaacgagaagcugcacaacggcaccauccagagaaagcugaaguacgagcugugcagagaccugcugugcgugcugaugcccgagcccgacgccgccgccugcgccaaccacccccugcugcagcaggaccuggugcagcugagccuggacuggaagaccgagauccccgaccuggugcugcccaacggcgugcaggugagcagcaaguuccagaccacccugguggacaugaucuacuuccugcacggcaacauggaggugaacgugcccagccuggccgaggugcagcugcugcuguacaccaccgugaaggugaugggcgacagcggccacgaccagugccagagccuggugcugcugaacacccacaucgcccuggugaaggaggacugcguguucuaccccagaaucagaagcagaaacauccccccccccggcgcccaguucgacgugaucaagugccacgcccugagcgaguucagaugcgugguggugcccgagaagaagaacgugagcaccguggagcugguguuccugcagaagcugaagcccagcgugggcagcagaaacagcccccccgagcaccugcaggaggcccccaacgugcagcuguucaccaccccccuguaccugcagggcagccagaacguggcccccgagguguggaagcugaccuucaacagccaggacgaggcccuguggcugaucagccaccugaccagacuguaa

SEQ ID NO: 18930 - RNA, 3117 nt, Artificial Sequence
  KIF17__Homo_sapiens__XP_011540143
auggccagcgaggccgugaaggugguggugagaugcagacccaugaaccagagagagagagagcugagaugccagcccguggugaccguggacugcgccagagcccagugcugcauccagaaccccggcgccgccgacgagccccccaagcaguucaccuucgacggcgccuaccacguggaccacgugaccgagcagaucuacaacgagaucgccuacccccugguggagggcgugaccgagggcuacaacggcaccaucuucgccuacggccagaccggcagcggcaagagcuucaccaugcagggccugcccgacccccccagccagagaggcaucauccccagagccuucgagcacguguucgagagcgugcagugcgccgagaacaccaaguuccuggugagagccagcuaccuggagaucuacaacgaggacgugagagaccugcugggcgccgacaccaagcagaagcuggagcugaaggagcaccccgagaagggcguguacgugaagggccugagcaugcacaccgugcacagcguggcccagugcgagcacaucauggagaccggcuggaagaacagaagcgugggcuacacccugaugaacaaggacagcagcagaagccacagcaucuucaccaucagcaucgagaugagcgccguggacgagagaggcaaggaccaccugagagccggcaagcugaaccugguggaccuggccggcagcgagagacagagcaagaccggcgccaccggcgagagacugaaggaggccaccaagaucaaccugagccugagcgcccugggcaacgugaucagcgcccugguggacggcagaugcaagcacgugcccuacagagacagcaagcugaccagacugcugcaggacagccugggcggcaacaccaagacccugaugguggccugccugagccccgccgacaacaacuacgacgagacccugagcacccugagauacgccaacagagccaagaacaucagaaacaagcccagaaucaacgaggaccccaaggacgcccugcugagagaguaccaggaggagaucaagaagcugaaggccauccugacccagcagaugagccccagcagccugagcgcccugcugagcagacaggugccccccgaccccgugcagguggaggagaagcugcugccccagcccgugauccagcacgacguggaggccgagaagcagcugaucagagaggaguacgaggagagacuggccagacugaaggccgacuacaaggccgagcaggagagcagagccagacuggaggaggacaucaccgccaugagaaacagcuacgacgugagacugagcacccuggaggagaaccugagaaaggagaccgaggccgugcugcaggugggcgugcuguacaaggccgaggugaugagcagagccgaguucgccagcagcgccgaguacccccccgccuuccaguacgagaccguggugaagcccaagguguucagcaccaccgacacccugcccagcgacgacgugagcaagacccaggugagcagcagauucgccgagcugcccaagguggagcccagcaagagcgagaucagccugggcagcagcgagagcagcagccuggaggagaccagcgugagcgaggccuuccccggccccgaggagcccagcaacguggaggugagcaugcccaccgaggagagcagaagcagauacuuccuggacgagugccugggccaggaggccgccggccaccugcugggcgagcagaacuaccugccccaggaggagccccaggaggugccccugcagggccugcugggccugcaggaccccuucgccgagguggaggccaagcuggccagacugagcagcaccguggccagaaccgacgccccccaggccgacgugcccaaggugcccgugcaggugcccgcccccaccgaccugcuggagcccagcgacgccagacccgaggccgaggccgccgacgacuucccccccagacccgagguggaccuggccagcgagguggcccuggagguggugagaaccgccgagcccggcguguggcuggaggcccaggcccccguggcccugguggcccagcccgagccccugcccgccaccgccggcgugaagagagagagcgugggcauggagguggccgugcugaccgacgacccccugcccgugguggaccagcagcaggugcuggccagacugcagcugcuggagcagcagguggugggcggcgagcaggccaagaacaaggaccugaaggagaagcacaagagaagaaagagauacgccgacgagagaagaaagcagcugguggccgcccugcagaacagcgacgaggacagcggcgacugggugcugcugaacguguacgacagcauccaggaggaggugagagccaagagcaagcugcuggagaagaugcagagaaagcugagagccgccgagguggagaucaaggaccugcagagcgaguuccagcuggagaagaucgacuaccuggccaccaucagaagacaggagagagacagcaugcugcugcagcagcugcuggagcaggugcagccccugaucagaagagacugcaacuacagcaaccuggagaagauccugagagagagcugcugggacgaggacaacggcuucuggaagaucccccaccccgugaucaccaagaccagccugccccaguuccagcugggccacagaaccaaccagcccgccaagccccugcagcagaccauggccagcagaaccuggagaaccaccgccaccggcagcugcagcgugggcgccaccgugaagacccugcccgccaccaccagcgaccugagcggccccgccagaagcagcgcccagacccccggcagagccagccacaucaccaccagacaccaggccagcgccgcccacagcgccaccacccugcccagccacccccccagaccccugaagugccccagccccggccccagcgccagcagccccagcaccagccugagccccagacccagccugcccagcccccuggccagcggccuguggcugggccccagaggcagauggaagagcugcugccugugguaa

SEQ ID NO: 18931 - RNA, 2697 nt, Artificial Sequence
  KIF18A__Homo_sapiens__NP_112494
augagcgugaccgaggaggaccugugccaccacaugaaggugguggugagagugagacccgagaacaccaaggagaaggccgccggcuuccacaagguggugcacgugguggacaagcacauccugguguucgaccccaagcaggaggaggugagcuucuuccacggcaagaagaccaccaaccagaacgugaucaagaagcagaacaaggaccugaaguucguguucgacgccguguucgacgagaccagcacccagagcgagguguucgagcacaccaccaagcccauccugagaagcuuccugaacggcuacaacugcaccgugcuggccuacggcgccaccggcgccggcaagacccacaccaugcugggcagcgccgacgagcccggcgugauguaccugaccaugcugcaccuguacaagugcauggacgagaucaaggaggagaagaucugcagcaccgccgugagcuaccuggagguguacaacgagcagaucagagaccugcuggugaacagcggcccccuggccgugagagaggacacccagaagggcgugguggugcacggccugacccugcaccagcccaagagcagcgaggagauccugcaccugcuggacaacggcaacaagaacagaacccagcaccccaccgacaugaacgccaccagcagcagaagccacgccguguuccagaucuaccugagacagcaggacaagaccgccagcaucaaccagaacgugagaaucgccaagaugagccugaucgaccuggccggcagcgagagagccagcaccagcggcgccaagggcaccagauucguggagggcaccaacaucaacagaagccugcuggcccugggcaacgugaucaacgcccuggccgacagcaagagaaagaaccagcacauccccuacagaaacagcaagcugaccagacugcugaaggacagccugggcggcaacugccagaccaucaugaucgccgccgugagccccagcagcguguucuacgacgacaccuacaacacccugaaguacgccaacagagccaaggacaucaagagcagccugaagagcaacgugcugaacgugaacaaccacaucacccaguacgugaagaucugcaacgagcagaaggccgagauccugcugcugaaggagaagcugaaggccuacgaggagcagaaggccuucaccaacgagaacgaccaggccaagcugaugaucagcaacccccaggagaaggagaucgagagauuccaggagauccugaacugccuguuccagaacagagaggagaucagacaggaguaccugaagcuggagaugcugcugaaggagaacgagcugaagagcuucuaccagcagcagugccacaagcagaucgagaugaugugcagcgaggacaagguggagaaggccaccggcaagagagaccacagacuggccaugcugaagaccagaagaagcuaccuggagaagagaagagaggaggagcugaagcaguucgacgagaacaccaacuggcugcacagaguggagaaggagaugggccugcugagccagaacggccacauccccaaggagcugaagaaggaccugcacugccaccaccugcaccugcagaacaaggaccugaaggcccagaucagacacaugauggaccuggccugccugcaggagcagcagcacagacagaccgaggccgugcugaacgcccugcugcccacccugagaaagcaguacugcacccugaaggaggccggccugagcaacgccgccuucgagagcgacuucaaggagaucgagcaccugguggagagaaagaaggugguggugugggccgaccagaccgccgagcagcccaagcagaacgaccugcccggcaucagcgugcugaugaccuucccccagcugggccccgugcagcccauccccugcugcagcagcagcggcggcaccaaccuggugaagauccccaccgagaagagaaccagaagaaagcugaugcccagcccccugaagggccagcacacccugaagagcccccccagccagagcgugcagcugaacgacagccugagcaaggagcugcagcccaucguguacacccccgaggacugcagaaaggccuuccagaaccccagcaccgugacccugaugaagcccagcagcuucaccaccagcuuccaggccaucagcagcaacaucaacagcgacaacugccugaagaugcugugcgagguggccaucccccacaacagaagaaaggagugcggccaggaggaccuggacagcaccuucaccaucugcgaggacaucaagagcagcaagugcaagcugcccgagcaggagagccugcccaacgacaacaaggacauccugcagagacuggaccccagcagcuucagcaccaagcacagcaugcccgugcccagcauggugcccagcuacauggccaugaccaccgccgccaagagaaagagaaagcugaccagcagcaccagcaacagcagccugaccgccgacgugaacagcggcuucgccaagagagugagacaggacaacagcagcgagaagcaccugcaggagaacaagcccaccauggagcacaagagaaacaucugcaagaucaaccccagcauggugagaaaguucggcagaaacaucagcaagggcaaccugagauaa

SEQ ID NO: 18932 - RNA, 5376 nt, Artificial Sequence
  KIF1A__Homo_sapiens__NP_001230937
auggccggcgccagcgugaagguggccgugagagugagacccuucaacagcagagagaugagcagagacagcaagugcaucauccagaugagcggcagcaccaccaccaucgugaaccccaagcagcccaaggagacccccaagagcuucagcuucgacuacagcuacuggagccacaccagccccgaggacaucaacuacgccagccagaagcagguguacagagacaucggcgaggagaugcugcagcacgccuucgagggcuacaacgugugcaucuucgccuacggccagaccggcgccggcaagagcuacaccaugaugggcaagcaggagaaggaccagcagggcaucaucccccagcugugcgaggaccuguucagcagaaucaacgacaccaccaacgacaacaugagcuacagcguggaggugagcuacauggagaucuacugcgagagagugagagaccugcugaaccccaagaacaagggcaaccugagagugagagagcacccccugcugggccccuacguggaggaccugagcaagcuggccgugaccagcuacaacgacauccaggaccugauggacagcggcaacaaggccagaaccguggccgccaccaacaugaacgagaccagcagcagaagccacgccguguucaacaucaucuucacccagaagagacacgacgccgagaccaacaucaccaccgagaaggugagcaagaucagccugguggaccuggccggcagcgagagagccgacagcaccggcgccaagggcaccagacugaaggagggcgccaacaucaacaagagccugaccacccugggcaaggugaucagcgcccuggccgagauggacagcggccccaacaagaacaagaagaagaagaagaccgacuucauccccuacagagacagcgugcugaccuggcugcugagagagaaccugggcggcaacagcagaaccgccaugguggccgcccugagccccgccgacaucaacuacgacgagacccugagcacccugagauacgccgacagagccaagcagaucagaugcaacgccgugaucaacgaggaccccaacaacaagcugaucagagagcugaaggacgaggugaccagacugagagaccugcuguacgcccagggccugggcgacaucaccgacaccaacaccgugcccggcggccccaagcugaccaacgcccuggugggcaugagccccagcagcagccugagcgcccugagcagcagagccgccagcgugagcagccugcacgagagaauccuguucgcccccggcagcgaggaggccaucgagagacugaaggagaccgagaagaucaucgccgagcugaacgagaccugggaggagaagcugagaagaaccgaggccaucagaauggagagagaggcccugcuggccgagaugggcguggccaugagagaggacggcggcacccugggcguguucagccccaagaagaccccccaccuggugaaccugaacgaggacccccugaugagcgagugccugcuguacuacaucaaggacggcaucaccagagugggcagagaggacggcgagagaagacaggacaucgugcugagcggccacuucaucaaggaggagcacugcguguucagaagcgacagcagaggcggcagcgaggccguggugacccuggagcccugcgagggcgccgacaccuacgugaacggcaagaaggugaccgagcccagcauccugagaagcggcaacagaaucaucaugggcaagagccacguguucagauucaaccaccccgagcaggccagacaggagagagagagaacccccugcgccgagacccccgccgagcccguggacugggccuucgcccagagagagcugcuggagaagcagggcaucgacaugaagcaggagauggagcagagacugcaggagcuggaggaccaguacagaagagagagagaggaggccaccuaccugcuggagcagcagagacuggacuacgagagcaagcuggaggcccugcagaagcagauggacagcagauacuaccccgaggugaacgaggaggaggaggagcccgaggacgaggugcaguggaccgagagagagugcgagcuggcccugugggccuucagaaaguggaagugguaccaguucaccagccugagagaccugcuguggggcaacgccaucuuccugaaggaggccaacgccaucagcguggagcugaagaagaaggugcaguuccaguucgugcugcugaccgacacccuguacagcccccugccccccgaccugcugccccccgaggccgccaaggacagagagaccagacccuuccccagaaccaucguggccguggaggugcaggaccagaagaacggcgccacccacuacuggacccuggagaagcugagacagagacuggaccugaugagagagauguacgacagagccgccgaggugcccagcagcgugaucgaggacugcgacaacguggugaccggcggcgaccccuucuacgacagauuccccugguucagacuggugggcagcagcgccaucagcggcugcaacagcuacccccugcugaacaccugcaugagcgagagaauggccgcccugacccccagccccaccuucagcagccccgacagcgacgccaccgagcccgccgaggagcagagcgugggcgaggaggaggaggaggaggaggaggaggaggacgaggaggaggaggaccuggaggacgacguguuccccgagcacgcccugugcgacggcagagaccccuucuacgacagacccccccuguucagccuggugggcagagccuucguguaccugagcaaccugcuguaccccgugccccuggugcacagaguggccaucgugagcgagaagggcgaggugaagggcuuccugagaguggccgugcaggccaucagcgccgacgaggaggcccccgacuacggcagcggcgugagacagagcggcaccgccaagaucagcuucgacgaccagcacuucgagaaguuccagagcgagagcugccccguggugggcaugagcagaagcggcaccagccaggaggagcugagaaucguggagggccagggccagggcgccgacgugggccccagcgccgacgaggugaacaacaacaccugcagcgccgugccccccgagggccugcugcuggacagcagcgagaaggccgcccuggacggcccccuggacgccgcccuggaccaccugagacugggcaacaccuucaccuucagagugaccgugcugcaggccagcagcaucagcgccgaguacgccgacaucuucugccaguucaacuucauccacagacacgacgaggccuucagcaccgagccccugaagaacaccggcagaggccccccccugggcuucuaccacgugcagaacaucgccguggaggugaccaagagcuucaucgaguacaucaagagccagcccaucguguucgagguguucggccacuaccagcagcaccccuuccccccccugugcaaggacgugcugagcccccugagacccagcagaagacacuuccccagagugaugccccugagcaagcccgugcccgccaccaagcugagcacccugaccagacccugccccggccccugccacugcaaguacgaccugcugguguacuucgagaucugcgagcuggaggccaacggcgacuacauccccgccgugguggaccacagaggcggcaugcccugcaugggcaccuuccugcugcaccagggcauccagagaagaaucaccgugacccugcugcacgagaccggcagccacaucagauggaaggaggugagagagcugguggugggcagaaucagaaacacccccgagaccgacgagagccugaucgaccccaacauccugagccugaacauccugagcagcggcuacauccaccccgcccaggacgacagaaccuucuaccaguucgaggccgccugggacagcagcaugcacaacagccugcugcugaacagagugacccccuacagagagaagaucuacaugacccugagcgccuacaucgagauggagaacugcacccagcccgccguggugaccaaggacuucugcaugguguucuacagcagagacgccaagcugcccgccagcagaagcaucagaaaccuguucggcagcggcagccugagagccagcgagagcaacagagugaccggcguguacgagcugagccugugccacguggccgacgccggcagccccggcaugcagagaagaagaagaagagugcuggacaccagcguggccuacgugagaggcgaggagaaccuggccggcuggagacccagaagcgacagccugauccuggaccaccagugggagcuggagaagcugagccugcugcaggagguggagaagaccagacacuaccugcugcugagagagaagcuggagaccgcccagagacccgugcccgaggcccugagccccgccuucagcgaggacagcgagagccacggcagcagcagcgccagcagcccccugagcgccgagggcagacccagcccccuggaggcccccaacgagagacagagagagcuggccgugaagugccugagacugcugacccacaccuucaacagagaguacacccacagccacgugugcgugagcgccagcgagagcaagcugagcgagaugagcgugacccugcugagagaccccagcaugagcccccugggcguggccacccugacccccagcagcaccugccccagccugguggagggcagauacggcgccaccgaccugagaaccccccagcccugcagcagacccgccagccccgagcccgagcugcugcccgaggccgacagcaagaagcugcccagccccgccagagccaccgagaccgacaaggagccccagagacugcuggugcccgacauccaggagaucagagugagccccaucgugagcaagaagggcuaccugcacuuccuggagccccacaccagcggcugggccagaagauucgugguggugagaagacccuacgccuacauguacaacagcgacaaggacaccguggagagauucgugcugaaccuggccaccgcccagguggaguacagcgaggaccagcaggccaugcugaagacccccaacaccuucgccgugugcaccgagcacagaggcauccugcugcaggccgccagcgacaaggacaugcacgacuggcuguacgccuucaacccccugcuggccggcaccaucagaagcaagcugagcagaagaagaagcgcccagaugagaguguaa

SEQ ID NO: 18933 - RNA, 3312 nt, Artificial Sequence
  KIF1C__Homo_sapiens__NP_006603
auggccggcgccagcgugaagguggccgugagagugagacccuucaacgccagagagaccagccaggacgccaagugcguggugagcaugcagggcaacaccaccagcaucaucaaccccaagcagagcaaggacgcccccaagagcuucaccuucgacuacagcuacuggagccacaccagcaccgaggacccccaguucgccagccagcagcagguguacagagacaucggcgaggagaugcugcugcacgccuucgagggcuacaacgugugcaucuucgccuacggccagaccggcgccggcaagagcuacaccaugaugggcagacaggagcccggccagcagggcaucgugccccagcugugcgaggaccuguucagcagagugagcgagaaccagagcgcccagcugagcuacagcguggaggugagcuacauggagaucuacugcgagagagugagagaccugcugaaccccaagagcagaggcagccugagagugagagagcaccccauccugggccccuacgugcaggaccugagcaagcuggccgugaccagcuacgccgacaucgccgaccugauggacugcggcaacaaggccagaaccguggccgccaccaacaugaacgagaccagcagcagaagccacgccguguucaccaucguguucacccagagaugccacgaccagcugaccggccuggacagcgagaaggugagcaagaucagccugguggaccuggccggcagcgagagagccgacagcagcggcgccagaggcaugagacugaaggagggcgccaacaucaacaagagccugaccacccugggcaaggugaucagcgcccuggccgacaugcagagcaagaagagaaagagcgacuucauccccuacagagacagcgugcugaccuggcugcugaaggagaaccugggcggcaacagcagaaccgccaugaucgccgcccugagccccgccgacaucaacuacgaggagacccugagcacccugagauacgccgacagaaccaagcagaucagaugcaacgccaucaucaacgaggaccccaacgccagacugaucagagagcugcaggaggagguggccagacugagagagcugcugauggcccagggccugagcgccagcgcccuggagggccugaagaccgaggagggcagcgugagaggcgcccugcccgccgugagcagcccccccgcccccgugagccccagcagccccaccacccacaacggcgagcuggagcccagcuucagccccaacaccgagagccagaucggccccgaggaggccauggagagacugcaggagaccgagaagaucaucgccgagcugaacgagaccugggaggagaagcugagaaagaccgaggcccugagaauggagagagaggcccugcuggccgagaugggcguggccgugagagaggacggcggcaccgugggcguguucagccccaagaagaccccccaccuggugaaccugaacgaggacccccugaugagcgagugccugcuguaccacaucaaggacggcgugaccagagugggccagguggacauggacaucaagcugaccggccaguucaucagagagcagcacugccuguucagaagcaucccccagcccgacggcgaggugguggugacccuggagcccugcgagggcgccgagaccuacgugaacggcaagcuggugaccgagccccuggugcugaagagcggcaacagaaucgugaugggcaagaaccacguguucagauucaaccaccccgagcaggccagacuggagagagagagaggcgugccccccccccccggcccccccagcgagcccguggacuggaacuucgcccagaaggagcugcuggagcagcagggcaucgacaucaagcuggagauggagaagagacugcaggaccuggagaaccaguacagaaaggagaaggaggaggccgaccugcugcuggagcagcagagacuguacgccgacagcgacagcggcgacgacagcgacaagagaagcugcgaggagagcuggagacugaucagcagccugagagagcagcugccccccaccaccgugcagaccaucgugaagagaugcggccugcccagcagcggcaagagaagagcccccagaagaguguaccagaucccccagagaagaagacugcagggcaaggaccccagaugggccaccauggccgaccugaagaugcaggccgugaaggagaucugcuacgagguggcccuggccgacuucagacacggcagagccgagaucgaggcccuggccgcccugaagaugagagagcugugcagaaccuacggcaagcccgacggccccggcgacgccuggagagccguggccagagacgugugggacaccgugggcgaggaggagggcggcggcgccggcagcggcggcggcagcgaggagggcgccagaggcgccgagguggaggaccugagagcccacaucgacaagcugaccggcauccugcaggaggugaagcugcagaacagcagcaaggacagagagcugcaggcccugagagacagaaugcugagaauggagagagugaucccccuggcccaggaccacgaggacgagaacgaggagggcggcgaggugcccugggccccccccgagggcagcgaggccgccgaggaggccgcccccagcgacagaaugcccagcgccagaccccccagccccccccugagcagcugggagagagugagcagacugauggaggaggaccccgccuucagaagaggcagacugagauggcugaagcaggagcagcugagacugcagggccugcagggcagcggcggcagaggcggcggccugagaagaccccccgccagauucgugcccccccacgacugcaagcugagauuccccuucaagagcaacccccagcacagagagagcuggcccggcaugggcagcggcgaggcccccaccccccugcagccccccgaggaggugaccccccaccccgccacccccgccagaagaccccccagccccagaagaagccaccaccccagaagaaacagccuggacggcggcggcagaagcagaggcgccggcagcgcccagcccgagccccagcacuuccagcccaagaagcacaacagcuacccccagcccccccagcccuaccccgcccagagaccccccggccccagauacccccccuacaccaccccccccagaaugagaagacagagaagcgcccccgaccugaaggagagcggcgccgccguguaa

SEQ ID NO: 18934 - RNA, 2673 nt, Artificial Sequence
  KIF20A__Homo_sapiens__NP_005724
augagccagggcauccugagcccccccgccggccugcugagcgacgacgacgugguggugagccccauguucgagagcaccgccgccgaccugggcagcguggugagaaagaaccugcugagcgacugcagcguggugagcaccagccuggaggacaagcagcaggugcccagcgaggacagcauggagaaggugaagguguaccugagagugagaccccugcugcccagcgagcuggagagacaggaggaccagggcugcgugagaaucgagaacguggagacccuggugcugcaggcccccaaggacagcuucgcccugaagagcaacgagagaggcaucggccaggccacccacagauucaccuucagccagaucuucggccccgaggugggccaggccagcuucuucaaccugaccgugaaggagauggugaaggacgugcugaagggccagaacuggcugaucuacaccuacggcgugaccaacagcggcaagacccacaccauccagggcaccaucaaggacggcggcauccugcccagaagccuggcccugaucuucaacagccugcagggccagcugcaccccacccccgaccugaagccccugcugagcaacgaggugaucuggcuggacagcaagcagaucagacaggaggagaugaagaagcugagccugcugaacggcggccugcaggaggaggagcugagcaccagccugaagagaagcguguacaucgagagcagaaucggcaccagcaccagcuucgacagcggcaucgccggccugagcagcaucagccagugcaccagcagcagccagcuggacgagaccagccacagaugggcccagcccgacaccgccccccugcccgugcccgccaacaucagauucagcaucuggaucagcuucuucgagaucuacaacgagcugcuguacgaccugcuggagccccccagccagcagagaaagagacagacccugagacugugcgaggaccagaacggcaaccccuacgugaaggaccugaacuggauccacgugcaggacgccgaggaggccuggaagcugcugaaggugggcagaaagaaccagagcuucgccagcacccaccugaaccagaacagcagcagaagccacagcaucuucagcaucagaauccugcaccugcagggcgagggcgacaucgugcccaagaucagcgagcugagccugugcgaccuggccggcagcgagagaugcaaggaccagaagagcggcgagagacugaaggaggccggcaacaucaacaccagccugcacacccugggcagaugcaucgccgcccugagacagaaccagcagaacagaagcaagcagaaccuggugcccuucagagacagcaagcugaccagaguguuccagggcuucuucaccggcagaggcagaagcugcaugaucgugaacgugaaccccugcgccagcaccuacgacgagacccugcacguggccaaguucagcgccaucgccagccagcuggugcacgccccccccaugcagcugggcuuccccagccugcacagcuucaucaaggagcacagccugcaggugagccccagccuggagaagggcgccaaggccgacaccggccuggacgacgacaucgagaacgaggccgacaucagcauguacggcaaggaggagcugcugcaggugguggaggccaugaagacccugcugcugaaggagagacaggagaagcugcagcuggagaugcaccugagagacgagaucugcaacgagaugguggagcagaugcagcagagagagcaguggugcagcgagcaccuggacacccagaaggagcugcuggaggagauguacgaggagaagcugaacauccugaaggagagccugaccagcuucuaccaggaggagauccaggagagagacgagaagaucgaggagcuggaggcccugcugcaggaggccagacagcagagcguggcccaccagcagagcggcagcgagcuggcccugagaagaagccagagacuggccgccagcgccagcacccagcagcugcaggaggugaaggccaagcugcagcagugcaaggccgagcugaacagcaccaccgaggagcugcacaaguaccagaagaugcuggagcccccccccagcgccaagcccuucaccaucgacguggacaagaagcuggaggagggccagaagaacaucagacugcugagaaccgagcugcagaagcugggcgagagccugcagagcgccgagagagccugcugccacagcaccggcgccggcaagcugagacaggcccugaccaccugcgacgacauccugaucaagcaggaccagacccuggccgagcugcagaacaacauggugcuggugaagcuggaccugagaaagaaggccgccugcaucgccgagcaguaccacaccgugcugaagcugcagggccaggugagcgccaagaagagacugggcaccaaccaggagaaccagcagcccaaccagcagccccccggcaagaagcccuuccugagaaaccugcugcccagaacccccaccugccagagcagcaccgacugcagccccuacgccagaauccugagaagcagaagaagcccccugcugaagagcggccccuucggcaagaaguacuaa

SEQ ID NO: 18935 - RNA, 5463 nt, Artificial Sequence
  KIF20B__Homo_sapiens__NP_001271188
auggagagcaacuucaaccaggagggcgugcccagacccagcuacguguucagcgccgaccccaucgccagacccagcgagaucaacuucgacggcaucaagcuggaccugagccacgaguucagccugguggcccccaacaccgaggccaacagcuucgagagcaaggacuaccugcaggugugccugagaaucagacccuucacccagagcgagaaggagcuggagagcgagggcugcgugcacauccuggacagccagaccguggugcugaaggagccccagugcauccugggcagacugagcgagaagagcagcggccagauggcccagaaguucagcuucagcaagguguucggccccgccaccacccagaaggaguucuuccagggcugcaucaugcagcccgugaaggaccugcugaagggccagagcagacugaucuucaccuacggccugaccaacagcggcaagaccuacaccuuccagggcaccgaggagaacaucggcauccugcccagaacccugaacgugcuguucgacagccugcaggagagacuguacaccaagaugaaccugaagccccacagaagcagagaguaccugagacugagcagcgagcaggagaaggaggagaucgccagcaagagcgcccugcugagacagaucaaggaggugaccgugcacaacgacagcgacgacacccuguacggcagccugaccaacagccugaacaucagcgaguucgaggagagcaucaaggacuacgagcaggccaaccugaacauggccaacagcaucaaguucagcgugugggugagcuucuucgagaucuacaacgaguacaucuacgaccuguucgugcccgugagcagcaaguuccagaagagaaagaugcugagacugagccaggacgugaagggcuacagcuucaucaaggaccugcaguggauccaggugagcgacagcaaggaggccuacagacugcugaagcugggcaucaagcaccagagcguggccuucaccaagcugaacaacgccagcagcagaagccacagcaucuucaccgugaagauccugcagaucgaggacagcgagaugagcagagugaucagagugagcgagcugagccugugcgaccuggccggcagcgagagaaccaugaagacccagaacgagggcgagagacugagagagaccggcaacaucaacaccagccugcugacccugggcaagugcaucaacgugcugaagaacagcgagaagagcaaguuccagcagcacgugcccuucagagagagcaagcugacccacuacuuccagagcuucuucaacggcaagggcaagaucugcaugaucgugaacaucagccagugcuaccuggccuacgacgagacccugaacgugcugaaguucagcgccaucgcccagaaggugugcgugcccgacacccugaacagcagccaggagaagcuguucggccccgugaagagcagccaggacgugagccuggacagcaacagcaacagcaagauccugaacgugaagagagccaccaucagcugggagaacagccuggaggaccugauggaggacgaggaccugguggaggagcuggagaacgccgaggagacccagaacguggagaccaagcugcuggacgaggaccuggacaagacccuggaggagaacaaggccuucaucagccacgaggagaagagaaagcugcuggaccugaucgaggaccugaagaagaagcugaucaacgagaagaaggagaagcugacccuggaguucaagaucagagaggaggugacccaggaguucacccaguacugggcccagagagaggccgacuucaaggagacccugcugcaggagagagagauccuggaggagaacgccgagagaagacuggccaucuucaaggaccuggugggcaagugcgacaccagagaggaggccgccaaggacaucugcgccaccaagguggagaccgaggagacccacaacuacgugggcuucgaggacaucaucgacagccugcaggacaacguggccgacaucaagaagcaggccgagaucgcccaccuguacaucgccagccugcccgacccccaggaggccaccgccugccuggagcugaaguucaaccagaucaaggccgagcuggccaagaccaagggcgagcugaucaagaccaaggaggagcugaagaagagagagaacgagagcgacagccugauccaggagcuggagaccagcaacaagaagaucaucacccagaaccagagaaucaaggagcugaucaacaucaucgaccagaaggaggacaccaucaacgaguuccagaaccugaagagccacauggagaacaccuucaagugcaacgacaaggccgacaccagcagccugaucaucaacaacaagcugaucugcaacgagaccguggaggugcccaaggacagcaagagcaagaucugcagcgagagaaagagagugaacgagaacgagcugcagcaggacgagccccccgccaagaagggcagcauccacgugagcagcgccaucaccgaggaccagaagaagagcgaggaggugagacccaacaucgccgagaucgaggacaucagagugcugcaggagaacaacgagggccugagagccuuccugcugaccaucgagaacgagcugaagaacgagaaggaggagaaggccgagcugaacaagcagaucgugcacuuccagcaggagcugagccugagcgagaagaagaaccugacccugagcaaggaggugcagcagauccagagcaacuacgacaucgccaucgccgagcugcacgugcagaagagcaagaaccaggagcaggaggagaagaucaugaagcugagcaacgagaucgagaccgccaccagaagcaucaccaacaacgugagccagaucaagcugaugcacaccaagaucgacgagcugagaacccuggacagcgugagccagaucagcaacaucgaccugcugaaccugagagaccugagcaacggcagcgaggaggacaaccugcccaacacccagcuggaccugcugggcaacgacuaccuggugagcaagcaggugaaggaguacagaauccaggagcccaacagagagaacagcuuccacagcagcaucgaggccaucugggaggagugcaaggagaucgugaaggccagcagcaagaagagccaccagaucgaggagcuggagcagcagaucgagaagcugcaggccgaggugaagggcuacaaggacgagaacaacagacugaaggagaaggagcacaagaaccaggacgaccugcugaaggagaaggagacccugauccagcagcugaaggaggagcugcaggagaagaacgugacccuggacgugcagauccagcacgugguggagggcaagagagcccugagcgagcugacccagggcgugaccugcuacaaggccaagaucaaggagcuggagaccauccuggagacccagaagguggagugcagccacagcgccaagcuggagcaggacauccuggagaaggagagcaucauccugaagcuggagagaaaccugaaggaguuccaggagcaccugcaggacagcgugaagaacaccaaggaccugaacgugaaggagcugaagcugaaggaggagaucacccagcugaccaacaaccugcaggacaugaagcaccugcugcagcugaaggaggaggaggaggagaccaacagacaggagaccgagaagcugaaggaggagcugagcgccagcagcgccagaacccagaaccugaaggccgaccugcagagaaaggaggaggacuacgccgaccugaaggagaagcugaccgacgccaagaagcagaucaagcaggugcagaaggaggugagcgugaugagagacgaggacaagcugcugagaaucaagaucaacgagcuggagaagaagaagaaccagugcagccaggagcuggacaugaagcagagaaccauccagcagcugaaggagcagcugaacaaccagaagguggaggaggccauccagcaguacgagagagccugcaaggaccugaacgugaaggagaagaucaucgaggacaugagaaugacccuggaggagcaggagcagacccagguggagcaggaccaggugcuggaggccaagcuggaggagguggagagacuggccaccgagcuggagaaguggaaggagaagugcaacgaccuggagaccaagaacaaccagagaagcaacaaggagcacgagaacaacaccgacgugcugggcaagcugaccaaccugcaggacgagcugcaggagagcgagcagaaguacaacgccgacagaaagaaguggcuggaggagaagaugaugcugaucacccaggccaaggaggccgagaacaucagaaacaaggagaugaagaaguacgccgaggacagagagagauucuucaagcagcagaacgagauggagauccugaccgcccagcugaccgagaaggacagcgaccugcagaaguggagagaggagagagaccagcugguggccgcccuggagauccagcugaaggcccugaucagcagcaacgugcagaaggacaacgagaucgagcagcugaagagaaucaucagcgagaccagcaagaucgagacccagaucauggacaucaagcccaagagaaucagcagcgccgaccccgacaagcugcagaccgagccccugagcaccagcuucgagaucagcagaaacaagaucgaggacggcagcguggugcuggacagcugcgaggugagcaccgagaacgaccagagcaccagauuccccaagcccgagcuggagauccaguucaccccccugcagcccaacaagauggccgugaagcaccccggcugcaccacccccgugaccgugaagauccccaaggccagaaagagaaagagcaacgagauggaggaggaccuggugaagugcgagaacaagaagaacgccacccccagaaccaaccugaaguuccccaucagcgacgacagaaacagcagcgugaagaaggagcagaagguggccaucagacccagcagcaagaagaccuacagccugagaagccaggccagcaucaucggcgugaaccuggccaccaagaagaaggagggcacccugcagaaguucggcgacuuccugcagcacagccccagcauccugcagagcaaggccaagaagaucaucgagaccaugagcagcagcaagcugagcaacguggaggccagcaaggagaacgugagccagcccaagagagccaagagaaagcuguacaccagcgagaucagcagccccaucgacaucagcggccaggugauccugauggaccagaagaugaaggagagcgaccaccagaucaucaagagaagacugagaaccaagaccgccaaguaa

SEQ ID NO: 18936 - RNA, 4914 nt, Artificial Sequence
  KIF21A__Homo_sapiens__NP_001166934
augcugggcgcccccgacgagagcagcgugagaguggccgugagaaucagaccccagcuggccaaggagaagaucgagggcugccacaucugcaccagcgugacccccggcgagccccagguguuccugggcaaggacaaggccuucaccuucgacuacguguucgacaucgacagccagcaggagcagaucuacauccagugcaucgagaagcugaucgagggcugcuucgagggcuacaacgccaccguguucgccuacggccagaccggcgccggcaagaccuacaccaugggcaccggcuucgacgugaacaucguggaggaggagcugggcaucaucagcagagccgugaagcaccuguucaagagcaucgaggagaagaagcacaucgccaucaagaacggccugcccgcccccgacuucaaggugaacgcccaguuccuggagcuguacaacgaggaggugcuggaccuguucgacaccaccagagacaucgacgccaagagcaagaagagcaacaucagaauccacgaggacagcaccggcggcaucuacaccgugggcgugaccaccagaaccgugaacaccgagagcgagaugaugcagugccugaagcugggcgcccugagcagaaccaccgccagcacccagaugaacgugcagagcagcagaagccacgccaucuucaccauccacgugugccagaccagagugugcccccagaucgacgccgacaacgccaccgacaacaagaucaucagcgagagcgcccagaugaacgaguucgagacccugaccgccaaguuccacuucguggaccuggccggcagcgagagacugaagagaaccggcgccaccggcgagagagccaaggagggcaucagcaucaacugcggccugcuggcccugggcaacgugaucagcgcccugggcgacaagagcaagagagccacccacgugcccuacagagacagcaagcugaccagacugcugcaggacagccugggcggcaacagccagaccaucaugaucgccugcgugagccccagcgacagagacuucauggagacccugaacacccugaaguacgccaacagagccagaaacaucaagaacaaggugauggugaaccaggacagagccagccagcagaucaacgcccugagaagcgagaucaccagacugcagauggagcugauggaguacaagaccggcaagagaaucaucgacgaggagggcguggagagcaucaacgacauguuccacgagaacgccaugcugcagaccgagaacaacaaccugagagugagaaucaaggccaugcaggagaccguggacgcccugagaagcagaaucacccagcuggugagcgaccaggccaaccacgugcuggccagagccggcgagggcaacgaggagaucagcaacaugauccacagcuacaucaaggagaucgaggaccugagagccaagcugcuggagagcgaggccgugaacgagaaccugagaaagaaccugaccagagccaccgccagagcccccuacuucagcggcagcagcaccuucagccccaccauccugagcagcgacaaggagaccaucgagaucaucgaccuggccaagaaggaccuggagaagcugaagagaaaggagaagagaaagaagaagagcguggccggcaaggaggacaacaccgacaccgaccaggagaagaaggaggagaagggcgugagcgagagagagaacaacgagcuggagguggaggagagccaggaggugagcgaccacgaggacgaggaggaggaggaggaggaggaggaggacgacaucgacggcggcgagagcagcgacgagagcgacagcgagagcgacgagaaggccaacuaccaggccgaccuggccaacaucaccugcgagaucgccaucaagcagaagcugaucgacgagcuggagaacagccagaagagacugcagacccugaagaagcaguacgaggagaagcugaugaugcugcagcacaagaucagagacacccagcuggagagagaccaggugcugcagaaccugggcagcguggagagcuacagcgaggagaaggccaagaaggugagaagcgaguacgagaagaagcugcaggccaugaacaaggagcugcagagacugcaggccgcccagaaggagcacgccagacugcugaagaaccagagccaguacgagaagcagcugaagaagcugcagcaggacgugauggagaugaagaagaccaaggugagacugaugaagcagaugaaggaggagcaggagaaggccagacugaccgagagcagaagaaacagagagaucgcccagcugaagaaggaccagagaaagagagaccaccagcugagacugcuggaggcccagaagagaaaccaggagguggugcugagaagaaagaccgaggaggugaccgcccugagaagacaggugagacccaugagcgacaagguggccggcaaggugaccagaaagcugagcagcagcgacgcccccgcccaggacaccggcagcagcgccgccgccguggagaccgacgccagcagaaccggcgcccagcagaagaugagaauccccguggccagagugcaggcccugcccacccccgccaccaacggcaacagaaagaaguaccagagaaagggccugaccggcagaguguucaucagcaagaccgccagaaugaaguggcagcugcuggagagaagagugaccgacaucaucaugcagaagaugaccaucagcaacauggaggccgacaugaacagacugcugaagcagagagaggagcugaccaagagaagagagaagcugagcaagagaagagagaagaucgugaaggagaacggcgagggcgacaagaacguggccaacaucaacgaggagauggagagccugaccgccaacaucgacuacaucaacgacagcaucagcgacugccaggccaacaucaugcagauggaggaggccaaggaggagggcgagacccuggacgugaccgccgugaucaacgccugcacccugaccgaggccagauaccugcuggaccacuuccugagcaugggcaucaacaagggccugcaggccgcccagaaggaggcccagaucaaggugcuggagggcagacugaagcagaccgagaucaccagcgccacccagaaccagcugcuguuccacaugcugaaggagaaggccgagcugaaccccgagcuggacgcccugcugggccacgcccugcaggagaacguggaggacagcaccgacgaggacgccccccugaacagccccggcagcgagggcagcacccugagcagcgaccugaugaagcugugcggcgaggugaagcccaagaacaaggccagaagaagaaccaccacccagauggagcugcuguacgccgacagcagcgagcuggccagcgacaccagcaccggcgacgccagccugcccggcccccugacccccguggccgagggccaggagaucggcaugaacaccgagaccagcggcaccagcgccagagagaaggagcugagccccccccccggccugcccagcaagaucggcagcaucagcagacagagcagccugagcgagaagaagauccccgagcccagccccgugaccagaagaaaggccuacgagaaggccgagaagagcaaggccaaggagcagaagcacagcgacagcggcaccagcgaggccagccugagcccccccagcagcccccccagcagacccagaaacgagcugaacguguucaacagacugaccgugagccagggcaacaccagcgugcagcaggacaagggcaucaucaaccccuuccccgccagcaagggcaucagagccuucccccugcagugcauccacaucgccgagggccacaccaaggccgugcugugcguggacagcaccgacgaccugcuguucaccggcagcaaggacagaaccugcaagguguggaaccuggugaccggccaggagaucaugagccugggcggccaccccaacaacguggugagcgugaaguacugcaacuacaccagccugguguucaccgugagcaccagcuacaucaaggugugggacaucagagacagcgccaagugcaucagaacccugaccagcagcggccaggugacccugggcgacgccugcagcgccagcaccagcagaaccguggccauccccagcggcgagaaccagaucaaccagaucgcccugaaccccaccggcaccuuccuguacgccgccagcggcaacgccgugagaaugugggaccugaagagauuccagagcaccggcaagcugaccggccaccugggccccgugaugugccugaccguggaccagaucagcagcggccaggaccugaucaucaccggcagcaaggaccacuacaucaagauguucgacgugaccgagggcgcccugggcaccgugagccccacccacaacuucgagcccccccacuacgacggcaucgaggcccugaccauccagggcgacaaccuguucagcggcagcagagacaacggcaucaagaagugggaccugacccagaaggaccugcugcagcaggugcccaacgcccacaaggacugggugugcgcccugggcguggugcccgaccaccccgugcugcugagcggcugcagaggcggcauccugaagguguggaacauggacaccuucaugcccgugggcgagaugaagggccacgacagccccaucaacgccaucugcgugaacagcacccacaucuucaccgccgccgacgacagaaccgugagaaucuggaaggccagaaaccugcaggacggccagaucagcgacaccggcgaccugggcgaggacaucgccagcaacuaa

SEQ ID NO: 18937 - RNA, 4914 nt, Artificial Sequence
  KIF21B__Homo_sapiens__NP_001239029
auggccggccagggcgacugcugcgugaagguggccgugagaaucagaccccagcugagcaaggagaagaucgagggcugccacaucugcaccagcgugacccccggcgagccccaggugcugcugggcaaggacaaggccuucaccuacgacuucguguucgaccuggacaccuggcaggagcagaucuacagcaccugcgugagcaagcugaucgagggcugcuucgagggcuacaacgccaccgugcuggccuacggccagaccggcgccggcaagaccuacaccaugggcaccggcuucgacauggccaccagcgaggaggagcagggcaucauccccagagccaucgcccaccuguucggcggcaucgccgagagaaagagaagagcccaggagcagggcguggccggccccgaguucaaggugagcgcccaguuccuggagcuguacaacgaggagauccuggaccuguucgacagcaccagagaccccgacaccagacacagaagaagcaacaucaagauccacgaggacgccaacggcggcaucuacaccaccggcgugaccagcagacugauccacagccaggaggagcugauccagugccugaagcagggcgcccugagcagaaccaccgccagcacccagaugaacgugcagagcagcagaagccacgccaucuucaccauccaccugugccagaugagaaugugcacccagcccgaccuggugaacgaggccgugaccggccugcccgacggcaccccccccagcagcgaguacgagacccugaccgccaaguuccacuucguggaccuggccggcagcgagagacugaagagaaccggcgccaccggcgagagagccaaggagggcaucagcaucaacugcggccugcuggcccugggcaacgugaucagcgcccugggcgaccagagcaagaagguggugcacgugcccuacagagacagcaagcugaccagacugcugcaggacagccugggcggcaacagccagaccaucaugaucgccugcgugagccccagcgacagagacuucauggagacccugaacacccugaaguacgccaacagagccagaaacaucaagaacaaggugguggugaaccaggacaagaccagccagcagaucagcgcccugagagccgagaucgccagacugcagauggagcugauggaguacaaggccggcaagagagugaucggcgaggacggcgccgagggcuacagcgaccuguucagagagaacgccaugcugcagaaggagaacggcgcccugagacugagagugaaggccaugcaggaggccaucgacgccaucaacaacagagugacccagcugaugagccaggaggccaaccugcugcuggccaaggccggcgacggcaacgaggccaucggcgcccugauccagaacuacaucagagagaucgaggagcugagaaccaagcugcuggagagcgaggccaugaacgagagccugagaagaagccugagcagagccagcgccagaagccccuacagccugggcgccagccccgccgcccccgccuucggcggcagccccgccagcagcauggaggacgccagcgaggugaucagaagagccaagcaggaccuggagagacugaagaagaaggaggugagacagagaagaaagagccccgagaaggaggccuucaagaagagagccaagcugcagcaggagaacagcgaggagaccgacgagaacgaggccgaggaggaggaggaggagagagacgagagcggcugcgaggaggaggagggcagagaggacgaggacgaggacagcggcagcgaggagagccugguggacagcgacagcgaccccgaggagaaggaggugaacuuccaggccgaccuggccgaccugaccugcgagaucgagaucaagcagaagcugaucgacgagcuggagaacagccagagaagacugcagacccugaagcaccaguacgaggagaagcugauccugcugcagaacaagaucagagacacccagcuggagagagacagagugcugcagaaccugagcaccauggagugcuacaccgaggagaaggccaacaagaucaaggccgacuacgagaagagacugagagagaugaacagagaccugcagaagcugcaggccgcccagaaggagcacgccagacugcugaagaaccagagcagauacgagagagagcugaagaagcugcaggccgagguggccgagaugaagaaggccaagguggcccugaugaagcagaugagagaggagcagcagagaagaagacugguggagaccaagagaaacagagagaucgcccagcugaagaaggagcagagaagacaggaguuccagaucagagcccuggagagccagaagagacagcaggagauggugcugagaagaaagacccaggaggugagcgcccugagaagacuggccaagcccaugagcgagagaguggccggcagagccggccugaagccccccaugcuggacagcggcgccgaggugagcgccagcaccaccagcagcgaggccgagagcggcgccagaagcgugagcagcaucgugagacaguggaacagaaagaucaaccacuuccugggcgaccaccccgcccccaccgugaacggcaccagacccgccagaaagaaguuccagaagaagggcgccagccagagcuucagcaaggccgccagacugaaguggcagagccuggagagaagaaucaucgacaucgugaugcagagaaugaccaucgugaaccuggaggccgacauggagagacugaucaagaagagagaggagcuguuccugcugcaggaggcccugagaagaaagagagagagacugcaggccgagagccccgaggaggagaagggccugcaggagcuggccgaggagaucgaggugcuggccgccaacaucgacuacaucaacgacggcaucaccgacugccaggccaccaucgugcagcuggaggagaccaaggaggagcuggacagcaccgacaccagcguggugaucagcagcugcagccuggccgaggccagacugcugcuggacaacuuccugaaggccagcaucgacaagggccugcagguggcccagaaggaggcccagaucagacugcuggagggcagacugagacagaccgacauggccggcagcagccagaaccaccugcugcuggacgcccugagagagaaggccgaggcccaccccgagcugcaggcccugaucuacaacgugcagcaggagaacggcuacgccagcaccgacgaggagaucagcgaguucagcgagggcagcuucagccagagcuucaccaugaagggcagcaccagccacgacgacuucaaguucaagagcgagcccaagcugagcgcccagaugaaggccgugagcgccgagugccugggccccccccuggacaucagcaccaagaacaucaccaagagccuggccagccugguggagaucaaggaggacggcgugggcuucagcgugagagaccccuacuacagagacagagugagcagaaccgugagccugcccaccagaggcagcaccuuccccagacagagcagagccaccgagaccagcccccugaccagaagaaagagcuacgacagaggccagcccaucagaagcaccgacgugggcuucaccccccccagcagcccccccaccagacccagaaacgacagaaacguguucagcagacugaccagcaaccagagccagggcagcgcccuggacaagagcgacgacagcgacagcagccugagcgaggugcugagaggcaucaucagccccgugggcggcgccaagggcgccagaaccgccccccugcagugcgugagcauggccgagggccacaccaagcccauccugugccuggacgccaccgacgagcugcuguucaccggcagcaaggacagaagcugcaagauguggaaccuggugaccggccaggagaucgccgcccugaagggccaccccaacaacguggugagcaucaaguacugcagccacagcggccugguguucagcgugagcaccagcuacaucaaggugugggacaucagagacagcgccaagugcaucagaacccugaccagcagcggccaggugaucagcggcgacgccugcgccgccaccagcaccagagccaucaccagcgcccagggcgagcaccagaucaaccagaucgcccugagccccagcggcaccaugcuguacgccgccagcggcaacgccgugagaaucugggagcugagcagauuccagcccgugggcaagcugaccggccacaucggccccgugaugugccugaccgugacccagaccgccagccagcacgaccugguggugaccggcagcaaggaccacuacgugaagauguucgagcugggcgagugcgugaccggcaccaucggccccacccacaacuucgagcccccccacuacgacggcaucgagugccuggccauccagggcgacauccuguucagcggcagcagagacaacggcaucaagaagugggaccuggaccagcaggagcugauccagcagauccccaacgcccacaaggacugggugugcgcccuggccuucauccccggcagacccaugcugcugagcgccugcagagccggcgugaucaagguguggaacguggacaacuucacccccaucggcgagaucaagggccacgacagccccaucaacgccaucugcaccaacgccaagcacaucuucaccgccagcagcgacugcagagugaagcuguggaacuacgugcccggccugacccccugccugcccagaagagugcuggccaucaagggcagagccaccacccugcccuaa

SEQ ID NO: 18938 - RNA, 1794 nt, Artificial Sequence
  KIF22__Homo_sapiens__NP_001243199
auggacagcugcagccuggagaucgccaacuggagaaaccaccaggagacccugaaguaccaguucgacgccuucuacggcgagagaagcacccagcaggacaucuacgccggcagcgugcagcccauccugagacaccugcuggagggccagaacgccagcgugcuggccuacggccccaccggcgccggcaagacccacaccaugcugggcagccccgagcagcccggcgugauccccagagcccugauggaccugcugcagcugaccagagaggagggcgccgagggcagacccugggcccugagcgugaccaugagcuaccuggagaucuaccaggagaaggugcuggaccugcuggaccccgccagcggcgaccuggugaucagagaggacugcagaggcaacauccugauccccggccugagccagaagcccaucagcagcuucgccgacuucgagagacacuuccugcccgccagcagaaacagaaccgugggcgccaccagacugaaccagagaagcagcagaagccacgccgugcugcuggugaagguggaccagagagagagacuggcccccuucagacagagagagggcaagcuguaccugaucgaccuggccggcagcgaggacaacagaagaaccggcaacaagggccugagacugaaggagagcggcgccaucaacaccagccuguucgugcugggcaaggugguggacgcccugaaccagggccugcccagagugcccuacagagacagcaagcugaccagacugcugcaggacagccugggcggcagcgcccacagcauccugaucgccaacaucgcccccgagagaagauucuaccuggacaccgugagcgcccugaacuucgccgccagaagcaaggaggugaucaacagacccuucaccaacgagagccugcagccccacgcccugggccccgugaagcugagccagaaggagcugcugggcccccccgaggccaagagagccagaggccccgaggaggaggagaucggcagccccgagcccauggccgcccccgccagcgccagccagaagcugagcccccugcagaagcugagcagcauggaccccgccaugcuggagagacugcugagccuggacagacugcuggccagccagggcagccagggcgccccccugcugagcacccccaagagagagagaauggugcugaugaagaccguggaggagaaggaccuggagaucgagagacugaagaccaagcagaaggagcuggaggccaagaugcuggcccagaaggccgaggagaaggagaaccacugccccaccaugcugagaccccugagccacagaaccgugaccggcgccaagccccugaagaaggccguggugaugccccugcagcugauccaggagcaggccgccagccccaacgccgagauccacauccugaagaacaagggcagaaagagaaagcuggagagccuggacgcccuggagcccgaggagaaggccgaggacugcugggagcugcagaucagccccgagcugcuggcccacggcagacagaagauccuggaccugcugaacgagggcagcgccagagaccugagaagccugcagagaaucggccccaagaaggcccagcugaucgugggcuggagagagcugcacggccccuucagccagguggaggaccuggagagaguggagggcaucaccggcaagcagauggagagcuuccugaaggccaacauccugggccuggccgccggccagagaugcggcgccagcuaa

SEQ ID NO: 18939 - RNA, 2571 nt, Artificial Sequence
  KIF23__Homo_sapiens__NP_004847
augaagagcgccagagccaagacccccagaaagcccaccgugaagaagggcagccagaccaaccugaaggaccccgugggcguguacugcagagugagaccccugggcuuccccgaccaggagugcugcaucgaggugaucaacaacaccaccgugcagcugcacacccccgagggcuacagacugaacagaaacggcgacuacaaggagacccaguacagcuucaagcagguguucggcacccacaccacccagaaggagcuguucgacgugguggccaacccccuggugaacgaccugauccacggcaagaacggccugcuguucaccuacggcgugaccggcagcggcaagacccacaccaugaccggcagccccggcgagggcggccugcugcccagaugccuggacaugaucuucaacagcaucggcagcuuccaggccaagagauacguguucaagagcaacgacagaaacagcauggacauccagugcgagguggacgcccugcuggagagacagaagagagaggccaugcccaaccccaagaccagcagcagcaagagacagguggaccccgaguucgccgacaugaucaccgugcaggaguucugcaaggccgaggagguggacgaggacagcguguacggcguguucgugagcuacaucgagaucuacaacaacuacaucuacgaccugcuggaggaggugcccuucgaccccaucaagcccaagcccccccagagcaagcugcugagagaggacaagaaccacaacauguacguggccggcugcaccgagguggaggugaagagcaccgaggaggccuucgagguguucuggagaggccagaagaagagaagaaucgccaacacccaccugaacagagagagcagcagaagccacagcguguucaacaucaagcuggugcaggccccccuggacgccgacggcgacaacgugcugcaggagaaggagcagaucaccaucagccagcugagccugguggaccuggccggcagcgagagaaccaacagaaccagagccgagggcaacagacugagagaggccggcaacaucaaccagagccugaugacccugagaaccugcauggacgugcugagagagaaccagauguacggcaccaacaagauggugcccuacagagacagcaagcugacccaccuguucaagaacuacuucgacggcgagggcaaggugagaaugaucgugugcgugaaccccaaggccgaggacuacgaggagaaccugcaggugaugagauucgccgaggugacccaggagguggagguggccagacccguggacaaggccaucugcggccugacccccggcagaagauacagaaaccagcccagaggccccgugggcaacgagccccuggugaccgacguggugcugcagagcuuccccccccugcccagcugcgagauccuggacaucaacgacgagcagacccugcccagacugaucgaggcccuggagaagagacacaaccugagacagaugaugaucgacgaguucaacaagcagagcaacgccuucaaggcccugcugcaggaguucgacaacgccgugcugagcaaggagaaccacaugcagggcaagcugaacgagaaggagaagaugaucagcggccagaagcuggagaucgagagacuggagaagaagaacaagacccuggaguacaagaucgagauccuggagaagaccaccaccaucuacgaggaggacaagagaaaccugcagcaggagcuggagacccagaaccagaagcugcagagacaguucagcgacaagagaagacuggaggccagacugcagggcauggugaccgagaccaccaugaagugggagaaggagugcgagagaagaguggccgccaagcagcuggagaugcagaacaagcugugggugaaggacgagaagcugaagcagcugaaggccaucgugaccgagcccaagaccgagaagcccgagagacccagcagagagagagacagagagaaggugacccagagaagcgugagccccagccccgugccccugcuguuccagcccgaccagaacgccccccccaucagacugagacacagaagaagcagaagcgccggcgacagauggguggaccacaagcccgccagcaacaugcagaccgagaccgugaugcagccccacgugccccacgccaucaccgugagcguggccaacgagaaggcccuggccaagugcgagaaguacaugcugacccaccaggagcuggccagcgacggcgagaucgagaccaagcugaucaagggcgacaucuacaagaccagaggcggcggccagagcgugcaguucaccgacaucgagacccugaagcaggagagccccaacggcagcagaaagagaagaagcagcaccguggcccccgcccagcccgacggcgccgagagcgaguggaccgacguggagaccagaugcagcguggccguggagaugagagccggcagccagcugggccccggcuaccagcaccacgcccagcccaagagaaagaagcccuaa

SEQ ID NO: 18940 - RNA, 4107 nt, Artificial Sequence
  KIF24__Homo_sapiens__NP_919289
auggccagcuggcuguacgagugccugugcgaggccgagcuggcccaguacuacagccacuucaccgcccugggccugcagaagaucgacgagcuggccaagaucaccaugaaggacuacagcaagcugggcgugcacgacaugaacgacagaaagagacuguuccagcugaucaagaucaucaagaucaugcaggaggaggacaaggccgugagcauccccgagagacaccugcagaccagcagccugagaaucaagagccaggagcugagaagcggccccagaagacagcugaacuucgacagccccgccgacaacaaggacagaaacgccagcaacgacggcuucgagaugugcagccugagcgacuucagcgccaacgagcagaagagcaccuaccugaaggugcuggagcacaugcugcccgacgacagccaguaccacaccaagaccggcauccugaacgccaccgccggcgacagcuacgugcagaccgagaucagcaccagccuguucagccccaacuaccugagcgccauccugggcgacugcgacauccccaucauccagagaaucagccacgugagcggcuacaacuacggcaucccccacagcugcaucagacagaacaccagcgagaagcagaaccccuggaccgagauggagaagaucagagugugcgugagaaagagaccccugggcaugagagaggugagaagaggcgagaucaacaucaucaccguggaggacaaggagacccugcuggugcacgagaagaaggaggccguggaccugacccaguacauccugcagcacguguucuacuucgacgagguguucggcgaggccugcaccaaccaggacguguacaugaagaccacccacccccugauccagcacaucuucaacggcggcaacgccaccugcuucgccuacggccagaccggcgccggcaagaccuacaccaugaucggcacccacgagaaccccggccuguacgcccuggccgccaaggacaucuucagacagcuggaggugagccagcccagaaagcaccuguucguguggaucagcuucuacgagaucuacugcggccagcuguacgaccugcugaacagaagaaagagacuguucgccagagaggacagcaagcacauggugcagaucgugggccugcaggagcugcagguggacagcguggagcugcugcuggaggugauccugaagggcagcaaggagagaagcaccggcgccaccggcgugaacgccgacagcagcagaagccacgccgugauccagauccagaucaaggacagcgccaagagaaccuucggcagaaucagcuucaucgaccuggccggcagcgagagagccgccgacgccagagacagcgacagacagaccaagauggagggcgccgagaucaaccagagccugcuggcccugaaggagugcaucagagcccuggaccaggagcacacccacacccccuucagacagagcaagcugacccaggugcugaaggacagcuucaucggcaacgccaagaccugcaugaucgccaacaucagccccagccacguggccaccgagcacacccugaacacccugagauacgccgacagagugaaggagcugaagaagggcaucaagugcugcaccagcgugaccagcagaaacagaaccagcggcaacagcagccccaagagaauccagagcagccccggcgcccugagcgaggacaagugcagccccaagaaggugaagcugggcuuccagcagagccugaccguggccgcccccggcagcaccagaggcaaggugcacccccugaccagccacccccccaacauccccuucaccagcgcccccaaggugagcggcaagagaggcggcagcagaggcagccccagccaggagugggugauccacgccagccccgugaagggcaccgugagaagcggccacguggccaagaagaagcccgaggagagcgccccccugugcagcgagaagaacagaaugggcaacaagaccgugcugggcugggagagcagagccagcggccccggcgagggccuggugagaggcaagcugagcaccaagugcaagaaggugcagaccgugcagcccgugcagaagcagcuggugagcagaguggagcugagcuucggcaacgcccaccacagagccgaguacagccaggacagccagagaggcacccccgccagacccgccagcgaggccuggaccaacauccccccccaccagaaggagagagaggagcaccugagauucuaccaccagcaguuccagcagcccccccugcugcagcagaagcugaaguaccagccccugaagagaagccugagacaguacagaccccccgagggccagcugaccaacgagacccccccccuguuccacagcuacagcgagaaccacgacggcgcccagguggaggagcuggacgacagcgacuucagcgaggacagcuucagccacaucagcagccagagagccaccaagcagagaaacacccuggagaacagcgaggacagcuucuuccugcaccagaccuggggccagggccccgagaagcagguggccgagagacagcagagccuguucagcagccccagaaccggcgacaagaaggaccugaccaagagcuggguggacagcagagaccccaucaaccacagaagagccgcccuggaccacagcugcagccccagcaagggccccguggacuggagcagagagaacagcaccagcagcggccccagccccagagacagccuggccgagaagcccuacugcagccagguggacuucaucuacagacaggagagaggcggcggcagcagcuucgaccugagaaaggacgccagccagagcgaggugagcggcgagaacgagggcaaccugcccagccccgaggaggacggcuucaccaucagccugagccacguggccgugcccggcagccccgaccagagagacaccgugaccaccccccugagagaggugagcgccgacggccccauccaggugaccagcaccgugaagaacggccacgccgugcccggcgaggaccccagaggccagcugggcacccacgccgaguacgccagcggccugaugagcccccugaccaugagccugcuggagaaccccgacaacgagggcagcccccccagcgagcagcuggugcaggacggcgccacccacagccugguggccgagagcaccggcggccccguggugagccacaccgugcccagcggcgaccaggaggccgcccugcccgugagcagcgccaccagacaccuguggcugagcagcagcccccccgacaacaagcccggcggcgaccugcccgcccugagccccagccccaucagacagcaccccgccgacaagcugcccagcagagaggccgaccugggcgaggccugccagagcagagagaccgugcuguucagccacgagcacaugggcagcgagcaguacgacgccgacgccgaggagaccggccuggacggcagcuggggcuuccccggcaagcccuucaccaccauccacaugggcgugccccacagcggccccacccugacccccagaaccggcagcagcgacguggccgaccagcugugggcccaggagagaaagcaccccaccagacugggcuggcaggaguucggccugagcaccgaccccaucaagcugcccugcaacagcgagaacgugaccuggcugaagcccagacccaucagcagaugccuggccagacccagcagcccccuggugcccagcugcagccccaagaccgccggcacccugagacagcccacccuggagcaggcccagcagguggugaucagagcccaccaggagcagcuggacgagauggccgagcugggcuucaaggaggagacccugaugagccagcuggccagcaacgacuucgaggacuucgugacccagcuggacgagaucauggugcugaagagcaagugcauccagagccugagaagccagcugcagcuguaccugaccugccacggccccaccgccgcccccgagggcaccgugcccagcuaa

SEQ ID NO: 18941 - RNA, 999 nt, Artificial Sequence
  KIF25__Homo_sapiens__NP_005346
augaccuggaccagcggccagcugcagagagagaagcaggccagacccggcagcggcgccgugcuggccuuccccgacgacaaggaccugagaguguacggccccgccgagagccagagcgccguguucggcgacgugugcccccugcugaccagccugcuggacggcuacaacgugugcgugauggccuacggccagaccggcagcggcaagagcuacaccaugcugggcagacacagcgacgacggccccgugcugccccuggacccccagagcgaccugggcaucauccccagaguggccgaggagcuguucagacugauccuggagaacaccagcagaagccccaagguggaggugagcaucguggagguguacaacaacgacaucuucgaccugcuggccaaggacagcaucgccgccgugagcggcgugaagagagagguggugaccgccaaggacggcagaaccgagguggcccugcuggccagcgaggccgugggcagcgccagcaagcugauggagcuggugcacggcggccugcagcugagagccaagcaccccacccuggugcacgccgacagcagcagaagccaccugaucaucaccgugacccugaccaccgccagcugcagcgacagcaccgccgaccaggccugcagcgccacccugcccagagagcagaccgaggccggcagagccggcagaagcagaagagccagccagggcgcccuggccccccagcuggugcccggcaaccccgccggccacgccgagcaggugcaggccagacugcagcugguggacagcgccggcagcgagugcgugggcggcgacgccaagcugcuggugauccugugcaucagccccagccagagacaccuggcccagacccugcagggccugggcuucggcaucagagccagacaggugcagagaggccccgccagaaagaagccccccagcagccagaccgagggcaagagaagacccgacuaa

SEQ ID NO: 18942 - RNA, 5649 nt, Artificial Sequence
  KIF26A__Homo_sapiens__NP_056471
auggugggcagaggcgugccccugugcgccgcccagcccgccguggccgagggcggccccgccagagagccccccccccugcuggaggugagccccagaaagagacugcccgccggccccgaccaggaccccugcggcagcagacccgcccccgagggcgccggcgccggccccgagcagggccacagcgccggcggcggcggcuggugcagacacugccacaccaagcugguggagcugaagagacaggccuggaagcuggugagcggccccggcaccacccugagagaccccugccugagcgcccugcugcuggacaagcugcccgcccccggcgcccugcccgccugcagacccgaggccgagagaagaugcgacgugugcgccacccaccugcagcagcugaccagagaggccaugcaccugcugcaggcccccgccagccacgaggaccuggacgccccccacggcggccccagccuggccccccccagcaccaccaccagcagcagagacacccccggccccgccggccccgccggcagacagcccggcagagccggccccgacagaaccaagggccuggccuggagccccggccccagcgugcaggugagcguggcccccgccggccugggcggcgcccugagcaccgugaccauccaggcccagcagugccuggagggcauguggagcgugagcagagugaacagcuuccugccccccgccugccuggccgaggccgccguggccgccguggccguggccgacaccgugagagagugcccccccguggccggccccgacggccugagcaaggccuggggcagaggcggcgugugcaccagcgcccuggugacccccacccccggcagcgugggcggcagcaccggccccagcgccgccgccagcuucuucaucagagccaugcagaagcugagccuggccagcaagagaaagaagccccaccccccccccccccccgccaccagaggcaccagcaccuaccccaccgacuucagcggcgugcugcagcuguggcccccccccgccccccccugccugcugagagccgccagcaagaccaaggacaaccccggcagcaucggcaaggugaaggugaugcugagaaucuggcccgcccagggcgcccagagaagcgccgaggccaugagcuuccugaagguggaccccagaaagaagcaggugauccuguacgaccccgccgccggcccccccggcagcgccggccccagaagagccgccaccgccgccgugcccaagauguucgccuucgacgccguguucccccaggacagcgagcaggccgaggugugcagcggcaccguggccgacgugcugcagagcguggugagcggcgccgacggcugcaucuucagcuucggccacaugagccugggcaagagcuacaccaugaucggcaaggacagcagcccccagagccugggcaucgugcccugcgccaucagcuggcuguucagacugaucgaggagagaagagagagaaccggcaccagauucagcgugagagugagcgccguggaggugugcggcagagaccagagccugagagaccugcuggccgagguggcccccggcagccugcaggacacccagagccccggcguguaccugagagaggaccccgugugcggcgcccagcugcagaaccagagcgagcugagagcccccaccgccgagaaggccgccuucuaccuggacgccgcccuggccgccagaagcaccagcagagccggcugcggcgaggacgccagaagaagcagccacaugcuguucacccugcacguguaccaguacagaauggagaagugcggcagaggcggcaugagcggcggcagaagcagacugcaccugaucgaccugggcagcugcgaggccgccgccggcagagccggcgaggccgccggcggcccccugugccugagccugagcgcccugggcagcgugauccuggcccuggugaacggcgccaagcacgugcccuacagagaccacagacugaccaugcugcugagagagagccuggccaccgccggcugcagaaccaccaugaucgcccacgugagcgacgcccccgcccagcacgccgagacccugagcaccgugcagcuggccgccagaauccacagacugagaagaaagaaggccaaguacgccagcagcagcagcggcggcgagagcagcugcgaggagggcagagccagaagacccccccaccugagacccuuccaccccagaaccguggcccuggaccccgacagaaccccccccugccugcccggcgaccccgacuacagcagcagcagcgagcagagcugcgacaccgugaucuacgugggccccggcggcgccgcccugagcgacagagagcugaccgacaacgagggcccccccgacuucgugcccaucauccccgcccugagcagacacagacccagcaagggccccagagacgccgaccacuucagaugcagcaccuucgccgagcugcaggagagacuggagugcauggacggcaacgagggccccagcggcggccccggcggcaccgacggcgcccaggccagccccgccagaggcggcagaaagcccagcccccccgaggccgccagccccagaaaggccgugggcacccccauggccgccagcacccccagaggcagcagcggccccgacacccaccagggcacccccgagcccugcaaggccaucguguggggcgaccagagagaggacagcagcgccuggcccgagcugcuggugcccgagaaggccgccgugagcggcggcagaagaccccugcccagccccgcccccccccccccccagcugcuggaggccugcagagcccccgaggagcccggcggcggcggcaccgacggcguggccagaaccccccccgugggcaugagcggccagguggccggcagccccaugcugcccggcgccaccugccccagacuggccgccggcagcagaugccccgagagaggccugcugaccaccaccgugacccugcagagacccguggagcugaacggcgaggacgagcugguguucaccgugguggaggagcugagccugggcgcccuggccggcgccggcagacccaccagccuggccagcuucgacagcgacugcagccugagagcccuggccagcggcagcagacccgugagcaucaucagcagcaucaacgacgaguucgacgccuacaccagccaggcccccgagggcggcccccuggagggcgccgccugggccggcagcagccacggcagcagcaucagcagcuggcugagcgaggugagcgugugcaccgccgacagcagagaccccaccccccagcccagauucagccccgacagccuggccggccuggaccccggcggcccccccgcccuggacggcagccugggcgacggcagcagcggcuuccugggccccgacagacccgacagccccggccccaccuggggccccugccccggcgagguggccgccguggcccccagcagacccggcagagagccccaggccggccccagcagaugggccagcgccgcccagaccauccacagcagccugcccagaaagcccagaaccgccagcgccaccaccagagugggcugcgccagacugggccagagcccccccggcagaggcggccuguucgaggaccccuggcugcugagagugggcgagugcgacacccaggccgccagcgccggcagagcccccagccccacccugggcagccccagacugcccgaggcccaggugaugcuggccugcgcccagagagugguggacggcugcgagguggccgccagagccgccagaagacccgaggccguggccagaauccccccccugagaagaggcgccaccacccugggcgugaccacccccgccgugagcuggggcgacgcccccaccgaggugguggccugcagcggcagccugaaggccagccccaccagcaagaagggccuggcccccaaggccggcuuccugcccagacccagcggcgccgccccccccgccccccccaccagaaagagcagccuggagcagagaagcagccccgccagcgcccccccccacgccgugaaccccgccagagugggcgccgccgccgugcugagaggcgaggaggagcccagacccagcagcagagccgaccacagcgugcccagagccaccagcagccugaaggccagagccagcaagguggaggccgcccacagacuggccggccacgccagccuggagagauacgagggccuggcccacagcagcagcaagggcagagaggcccccggcagaccccccagagccgugcccaagcugggcgugccccccagcagccccacccacggccccgcccccgccugcagaagcggcgccgccaaggccgugggcgcccccaagccccccgugggcggcggcaagggcagaggccugguggccggcggcagcagagcccugggccccagcgugaagcugagcaccgccagcgugaccggcagaagccccggcggccccguggccggccccagagccgcccccagagccggccccagcgugggcgccaaggccggcagaggcaccgugaugggcaccaagcaggcccugagagccgcccacagcagagugcacgagcugagcgccagcggcgcccccggcagaggcggcagcagcuggggcagcgccgacagcgacagcggccacgacagcggcgugaacgugggcgaggagagaccccccaccggccccgcccugcccagccccuacagcaaggugaccgcccccagaagaccccagagauacagcagcggccacggcagcgacaacagcagcgugcugagcggcgagcugccccccgccaugggcagaaccgcccuguuccaccacagcggcggcagcagcggcuacgagagccugagaagagacagcgaggccaccggcagcgccagcagcgcccccgacagcaugagcgagagcggcgccgccagccccggcgccagaaccagaagccugaagagccccaagaagagagccaccggccugcagagaagaagacugauccccgccccccugcccgacaccaccgcccugggcagaaagcccagccugcccggccaguggguggaccugccccccccccuggccggcagccugaaggagcccuucgagaucaagguguacgagaucgacgacguggagagacugcagagacccagacccacccccagagaggcccccacccagggccuggccugcgugagcaccagacugagacuggccgagagaagacagcagagacugagagaggugcaggccaagcacaagcaccugugcgaggagcuggccgagacccagggcagacugaugcuggagcccggcagauggcuggagcaguucgagguggaccccgagcuggagcccgagagcgccgaguaccuggccgcccuggagagagccaccgccgcccuggagcagugcgugaaccugugcaaggcccacgugaugauggugaccugcuucgacaucagcguggccgccagcgccgccauccccggcccccaggagguggacguguaa

SEQ ID NO: 18943 - RNA, 6327 nt, Artificial Sequence
  KIF26B__Homo_sapiens__NP_060482
augaacagcguggccggcaacaaggagagacuggccgugagcaccagaggcaagaaguacggcgugaacgaggugugcagccccaccaagcccgccgcccccuucagccccgagagcugguacagaaaggccuacgaggagagcagagccggcagcagacccacccccgagggcgccggcagcgcccugggcagcagcggcacccccagccccggcagcggcaccagcagccccagcagcuucaccggcagccccggccccgccagccccggcaucggcaccagcagccccggcagccugggcggcagccccggcuucggcaccggcagccccggcagcggcagcggcggcggcagcagccccggcagcgacagaggcguguggugcgagaacugcaacgccagacugguggagcugaagagacaggcccugagacugcugcugcccggccccuuccccggcaaggaccccgccuucagcgccgugauccacgacaagcugcaggugcccaacaccaucagaaaggccuggaacgacagagacaacagaugcgacaucugcgccacccaccugaaccagcugaagcaggaggccauccagauggugcugacccuggagcaggccgccggcagcgagcacuacgacgccagccccugcagcccccccccccugagcaacauccccacccuggugggcagcagacacgugggcggccugcagcagcccagagacugggccuucgugcccgcccccugcgccaccagcaacuacaccggcuucgccaacaagcacggcagcaagcccagcagccugggcgugagcaacggcgccgagaagaagagcggcagccccacccaccaggccaaggugagccugcagauggccaccagccccagcaacggcaacauccugaacagcguggccauccaggcccaccaguaccuggacggcaccuggagccugagcagaaccaacggcgugacccuguaccccuaccagaucagccagcugaugaccgagagcagcagagagggccugaccgaggccgugcugaacagauacaacgccgacaagcccagcgccugcagcgugcccgccagccagggcagcugcguggccagcgagaccagcaccggcaccagcguggccgccagcuucuucgccagagccgcccagaagcugaaccugagcagcaagaagaagaagcacagacccagcaccagcagcgccgccgagcccccccuguucgccaccagcuucagcggcauccugcagaccagccccccccccgccccccccugccugcugagagccgugaacaaggugaaggacacccccggccugggcaaggugaaggugaugcugagaaucugcagcacccuggccagagacaccagcgagagcagcagcuuccugaagguggaccccagaaagaagcagaucacccuguacgacccccugaccugcggcggccagaacgccuuccagaagagaggcaaccaggugccccccaagauguucgccuucgacgccguguucccccaggacgccagccaggccgaggugugcgccggcaccguggccgaggugauccagagcguggugaacggcgccgacggcugcguguucugcuucggccacgccaagcugggcaagagcuacaccaugaucggcaaggacgacagcaugcagaaccugggcaucauccccugcgccaucagcuggcuguucaagcugaucaacgagagaaaggagaagaccggcgccagauucagcgugagagugagcgccguggagguguggggcaaggaggagaaccugagagaccugcugagcgagguggccaccggcagccugcaggacggccagagccccggcguguaccugugcgaggaccccaucugcggcacccagcugcagaaccagagcgagcugagagcccccaccgccgagaaggccgccuucuuccuggacgccgccaucgccagcagaagaagccaccagcaggacugcgacgaggacgaccacagaaacagccacguguucuucacccugcacaucuaccaguacagaauggagaagagcggcaagggcggcaugagcggcggcagaagcagacugcaccugaucgaccugggcagcugcgugaaggcccugagcaagaacagagagggcggcagcggccugugccugagccugagcgcccugggcaacgugauccuggcccuggugaacggcagcaagcacauccccuacaaggagagcaagcuggccaugcugcugagagagagccugggcaacaugaacugcagaaccaccaugaucgcccacaucagcgccgccgugggcagcuacgccgagacccugagcaccauccagaucgccagcagagugcugagaaugaagaagaagaagaccaaguacaccagcagcagcagcggcggcgagagcagcugcgaggagggcagaaugagaagacccacccagcugagacccuuccacaccagagccaccguggaccccgacuuccccaucgcccaccugagcagcgaccccgacuacagcagcagcagcgagcagagcugcgacaccgugaucuacaucggccccaacggcaccgcccugagcgacaaggagcugaccgacaacgagggcccccccgacuucgugcccaucgugcccgcccugcagaagaccagaggcgacagcagacccgccgaggccggcgaggccgccgccggcaagagcgagagagacugccugaagugcaacaccuucgccgagcugcaggagagacuggacugcaucgacggcagcgaggagcccagcagcuuccccuucgaggagcugcccgcccaguucggccccgagcaggccagcagaggccccagacugagccaggccgccggcgccagcccccugagcgagagcgacaaggaggacaacggcagcgagggccagcugaccaacagagagggccccgagcugcccgccagcaagaugcagagaagccacagccccgugcccgccgccgcccccgcccacagccccagccccgccagccccagaagcgugcccggcagcagcagccagcacagcgccagcccccuggugcagagccccagccugcagagcagcagagagagccugaacagcugcggcuucguggagggcaagcccagacccaugggcagccccagacugggcaucgccagccugagcaagaccagcgaguacaagccccccagcagccccagccagagaugcaagguguacacccagaagggcgugcugcccagccccgccccccugccccccagcagcaaggacagcggcguggccagcagagagagccugcugcagcccgaggugagaaccccccccgugggcaugagcccccaggugcugaagaagagcaugagcgccggcagcgagggcuuccccgagacccccguggacgacgagcagcaggccgccacccccagcgagagcaagaaggagauccugagcaccaccauggugaccgugcagcagccccuggagcugaacggcgaggacgagcugguguucacccugguggaggagcugaccaucagcggcgugcuggacagcggcagacccaccagcaucaucagcuucaacagcgacugcagcgccagagcccuggccagcggcagcagacccgugagcaucaucagcagcaucagcgaggaccuggagugcuacagcagcaccgcccccgugagcgaggugagcaucacccaguuccugccccugcccaagaugagccuggacgagaaggcccaggacgccggcagcagaagaagcagcaucagcagcuggcugagcgagaugagcgccggcagcgagggcgagcagagcugccacagcuucaucgcccagaccugcuucggccacggcgaggccauggccgagcccguggccagcgaguucgugagcagccugcagaacaccgccguggugugcagagagaagcccaaggccagccccgacaaccugcugauccugagcgagaugggcgacgacagcuucaacaaggccgcccccaucaagggcugcaagaucagcaccgugagcaaggccauggugaccaucagcaacaccgccaaccugagcagcugcgagggcuacauccccaugaagaccaacaucaccguguaccccugcaucgccaugagccccagaaacauccaggagcccgaggcccccaccgccacccccaaggccggccccacccuggcccagagcagagagagcaaggagaacagcgccaagaaggagaugaaguucgaggaccccuggcugaagagagaggaggaggugaagaaggagaccgcccaccccaacgaggagggcaugaugagaugcgagaccgccaccggccccagcaacgccgagaccagagccgagcaggagcaggacggcaagcccagccccggcgacagacugagcagcagcagcggcgaggugagcgccagccccgugaccgacaacuucagaagagugguggacggcugcgagauggcccugcccggccuggccacccagagccccgugcaccccaacaagagcgugaagagcagcagccugcccagagccuuccagaaggccagcagacaggaggagcccgacagccugagcuacuacugcgccgccgagaccaacggcgugggcgccgccagcggcaccccccccagcaaggccacccuggagggcaagguggccagccccaagcacugcgugcuggccagacccaagggcacccccccccugccccccgugagaaagagcagccuggaccagaagaacagagccagcccccagcacagcgccagcggcagcggcaccagcagcccccugaaccagcccgccgccuuccccgccggccugcccgacgagcccagcggcaagaccaaggacgccagcagcagcagcaagcuguucagcgccaagcuggagcagcuggccagcagaagcaacagccugggcagagccaccgugagccacuacgagugccugagccuggagagagccgagagccugagcagcgugagcagcagacugcacgccggcaaggacggcaccaugcccagagccggcagaagccugggcagaagcgccggcaccagcccccccagcagcggcgccagccccaaggccggccagagcaagaucagcgccgugagcagacugcugcuggccagccccagagccagaggccccagcgccagcaccaccaagacccugagcuucagcaccaagagccugccccaggccgugggccagggcagcagcagcccccccggcggcaagcacacccccuggagcacccagagccugagcagaaacagaagcagcggccuggccagcaagcugccccugagagccgugagcggcagaaucagcgagcugcugcagggcggcgccggcgccagaggccugcagcugagagccggccccgaggccgaggccagaggcggcgcccuggccgaggacgagcccgccgccgcccaccugcugcccagccccuacagcaagaucaccccccccagaagaccccacagaugcagcagcggccacggcagcgacaacagcagcgugcugagcggcgagcugccccccgccaugggcaagaccgcccuguucuaccacagcggcggcagcagcggcuacgagagcgugaugagagacagcgaggccaccggcagcgccagcagcgcccaggacagcaccagcgagaacagcagcagcgugggcggcagaugcagaagccugaagacccccaagaagagaagcaaccccggcagccagagaagaagacugauccccgcccugagccuggacaccagcagccccgugagaaagccccccaacagcaccggcgugagauggguggacggcccccugagaagcagccccagaggccugggcgagcccuucgagaucaagguguacgagaucgacgacguggagagacugcagagaagaagaggcggcgccagcaaggaggccaugugcuucaacgccaagcugaagauccuggagcacagacagcagagaaucgccgaggugagagccaaguacgaguggcugaugaaggagcuggaggccaccaagcaguaccugaugcuggaccccaacaaguggcugagcgaguucgaccuggagcaggugugggagcuggacagccuggaguaccuggaggcccuggagugcgugaccgagagacuggagagcagagugaacuucugcaaggcccaccugaugaugaucaccugcuucgacaucaccagcagaagaagauaa

SEQ ID NO: 18944 - RNA, 2235 nt, Artificial Sequence
  KIF2A__Homo_sapiens__NP_001091981
auggccaccgccaacuucggcaagauccagaucggcaucuacguggagaucaagagaagcgacggcagaauccaccaggccauggugaccagccugaacgaggacaacgagagcgugaccguggaguggaucgagaacggcgacaccaagggcaaggagaucgaccuggagagcaucuucagccugaaccccgaccuggugcccgacgaggagaucgagcccagccccgagaccccccccccccccgccagcagcgccaaggugaacaagaucgugaagaacagaagaaccguggccagcaucaagaacgacccccccagcagagacaacagaguggugggcagcgccagagccagacccagccaguuccccgagcagagcagcagcgcccagcagaacggcagcgugagcgacaucagccccgugcaggccgccaagaaggaguucggcccccccagcagaagaaagagcaacugcgugaaggagguggagaagcugcaggagaagagagagaagagaagacugcagcagcaggagcugagagagaagagagcccaggacguggacgccaccaaccccaacuacgagaucaugugcaugaucagagacuucagaggcagccuggacuacagaccccugaccaccgccgaccccaucgacgagcacagaaucugcgugugcgugagaaagagaccccugaacaagaaggagacccagaugaaggaccuggacgugaucaccauccccagcaaggacguggugauggugcacgagcccaagcagaagguggaccugaccagauaccuggagaaccagaccuucagauucgacuacgccuucgacgacagcgcccccaacgagaugguguacagauucaccgccagaccccugguggagaccaucuucgagagaggcauggccaccugcuucgccuacggccagaccggcagcggcaagacccacaccaugggcggcgacuucagcggcaagaaccaggacugcagcaagggcaucuacgcccuggccgccagagacguguuccugaugcugaagaagcccaacuacaagaagcuggagcugcagguguacgccaccuucuucgagaucuacagcggcaagguguucgaccugcugaacagaaagaccaagcugagagugcuggaggacggcaagcagcaggugcagguggugggccugcaggagagagaggugaagugcguggaggacgugcugaagcugaucgacaucggcaacagcugcagaaccagcggccagaccagcgccaacgcccacagcagcagaagccacgccguguuccagaucauccugagaagaaagggcaagcugcacggcaaguucagccugaucgaccuggccggcaacgagagaggcgccgacaccagcagcgccgacagacagaccagacuggagggcgccgagaucaacaagagccugcuggcccugaaggagugcaucagagcccugggcagaaacaagccccacacccccuucagagccagcaagcugacccaggugcugagagacagcuucaucggcgagaacagcagaaccugcaugaucgccaccaucagccccggcauggccagcugcgagaacacccugaacacccugagauacgccaacagagugaaggaguucggcaucagccccagcgacauccccuucagccagggcagcggcagcagacccgaccugagccccagcuacgaguacgacgacuucagccccagcgugaccagagugaaggagcugaccguggaccccaccgccgccggcgacgugagacccaucaugcaccacccccccaaccagaucgacgaccuggagacccaguggggcgugggcagcagcccccagagagacgaccugaagcugcugugcgagcagaacgaggaggaggugagcccccagcuguucaccuuccacgaggccgugagccagaugguggagauggaggagcaggugguggaggaccacagagccguguuccaggagagcaucagauggcuggaggacgagaaggcccugcuggagaugaccgaggagguggacuacgacguggacagcuacgccacccagcuggaggccauccuggagcagaagaucgacauccugaccgagcugagagacaaggugaagagcuucagagccgcccugcaggaggaggagcaggccagcaagcagaucaaccccaagagacccagagcccuguaa

SEQ ID NO: 18945 - RNA, 2022 nt, Artificial Sequence
  KIF2B__Homo_sapiens__NP_115948
auggccagccaguucugccugcccgagagccccugccugagcccccugaagccccugaagccccacuucggcgacauccaggagggcaucuacguggccauccagagaagcgacaagagaauccaccuggccguggugaccgagaucaacagagagaacuacugggugaccguggaguggguggagaaggccgugaagaagggcaagaagaucgaccuggagaccauccugcugcugaaccccgcccuggacagcgccgagcaccccaugcccccccccccccugagcccccuggcccuggcccccagcagcgccaucagagaccagagaaccgccaccaaguggguggccaugaucccccagaagaaccagaccgccagcggcgacagccuggacgugagagugcccagcaagcccugccugaugaagcagaagaagagccccugccugugggagauccagaagcugcaggagcagagagagaagagaagaagacugcagcaggagaucagagccagaagagcccuggacgugaacaccagaaaccccaacuacgagaucaugcacaugaucgaggaguacagaagacaccuggacagcagcaagaucagcgugcuggagcccccccaggagcacagaaucugcgugugcgugagaaagagaccccugaaccagagagagaccacccugaaggaccuggacaucaucaccgugcccagcgacaacguggugauggugcacgagagcaagcagaagguggaccugaccagauaccugcagaaccagaccuucugcuucgaccacgccuucgacgacaaggccagcaacgagcugguguaccaguucaccgcccagccccugguggagagcaucuucagaaagggcauggccaccugcuucgccuacggccagaccggcagcggcaagaccuacaccaugggcggcgacuucagcggcaccgcccaggacugcagcaagggcaucuacgcccugguggcccaggacguguuccugcugcugagaaacagcaccuacgagaagcuggaccugaagguguacggcaccuucuucgagaucuacggcggcaagguguacgaccugcugaacuggaagaagaagcugcaggugcuggaggacggcaaccagcagauccagguggugggccugcaggagaaggaggugugcugcguggaggaggugcugaaccugguggagaucggcaacagcugcagaaccagcagacagacccccgugaacgcccacagcagcagaagccacgccguguuccagaucauccugaagagcggcagaaucaugcacggcaaguucagccugguggaccuggccggcaacgagagaggcgccgacaccaccaaggccagcagaaagagacagcuggagggcgccgagaucaacaagagccugcuggcccugaaggagugcauccuggcccugggccagaacaagccccacacccccuucagagccagcaagcugacccuggugcugagagacagcuucaucggccagaacagcagcaccugcaugaucgccaccaucagccccggcaugaccagcugcgagaacacccugaacacccugagauacgccaacagagugaagaagcugaacguggacgugagacccuaccacagaggccacuaccccaucggccacgaggcccccagaaugcugaagagccacaucggcaacagcgagaugagccugcagagagacgaguucaucaagauccccuacgugcagagcgaggagcagaaggagaucgaggagguggagacccugcccacccugcugggcaaggacaccaccaucagcggcaagggcagcagccaguggcuggagaacauccaggagagagccggcggcgugcaccacgacaucgacuucugcaucgccagaagccugagcauccuggagcagaagaucgacgcccugaccgagauccagaagaagcugaagcugcugcuggccgaccugcacgugaagagcaagguggaguaa

SEQ ID NO: 18946 - RNA, 2055 nt, Artificial Sequence
  KIF2C__Homo_sapiens__NP_001284584
auggccauggacagcagccugcaggccagacuguuccccggccuggccaucaagauccagagaagcaacggccugauccacagcgccaacgugagaaccgugaaccuggagaagagcugcgugagcguggagugggccgagggcggcgccaccaagggcaaggagaucgacuucgacgacguggccgccaucaaccccgagcugcugcagcugcugccccugcaccccaaggacaaccugccccugcaggagaacgugaccauccagaagcagaagagaagaagcgugaacagcaagauccccgcccccaaggagagccugagaagcagaagcaccagaaugagcaccgugagcgagcugagaaucaccgcccaggagaacgacauggagguggagcugcccgccgccgccaacagcagaaagcaguucagcgugccccugagaagaaagagcugccuggugaaggagguggagaagaugaagaacaagagagaggagaagaaggcccagaacagcgagaugagaaugaagagagcccaggaguacgacagcagcuuccccaacugggaguucgccagaaugaucaaggaguucagagccacccuggagugccacccccugaccaugaccgaccccaucgaggagcacagaaucugcgugugcgugagaaagagaccccugaacaagcaggagcuggccaagaaggagaucgacgugaucagcauccccagcaagugccugcugcuggugcacgagcccaagcugaagguggaccugaccaaguaccuggagaaccaggccuucugcuucgacuucgccuucgacgagaccgccagcaacgaggugguguacagauucaccgccagaccccuggugcagaccaucuucgagggcggcaaggccaccugcuucgccuacggccagaccggcagcggcaagacccacaccaugggcggcgaccugagcggcaaggcccagaacgccagcaagggcaucuacgccauggccagcagagacguguuccugcugaagaaccagcccugcuacagaaagcugggccuggagguguacgugaccuucuucgagaucuacaacggcaagcuguucgaccugcugaacaagaaggccaagcugagagugcuggaggacggcaagcagcaggugcagguggugggccugcaggagcaccuggugaacagcgccgacgacgugaucaagaugaucgacaugggcagcgccugcagaaccagcggccagaccuucgccaacagcaacagcagcagaagccacgccugcuuccagaucauccugagagccaagggcagaaugcacggcaaguucagccugguggaccuggccggcaacgagagaggcgccgacaccagcagcgccgacagacagaccagaauggagggcgccgagaucaacaagagccugcuggcccugaaggagugcaucagagcccugggccagaacaaggcccacacccccuucagagagagcaagcugacccaggugcugagagacagcuucaucggcgagaacagcagaaccugcaugaucgccaccaucagccccggcaucagcagcugcgaguacacccugaacacccugagauacgccgacagagugaaggagcugagcccccacagcggccccagcggcgagcagcugauccagauggagaccgaggagauggaggccugcagcaacggcgcccugauccccggcaaccugagcaaggaggaggaggagcugagcagccagaugagcagcuucaacgaggccaugacccagaucagagagcuggaggagaaggccauggaggagcugaaggagaucauccagcagggccccgacuggcuggagcugagcgagaugaccgagcagcccgacuacgaccuggagaccuucgugaacaaggccgagagcgcccuggcccagcaggccaagcacuucagcgcccugagagacgugaucaaggcccugagacuggccaugcagcuggaggagcaggccagcagacagaucagcagcaagaagagaccccaguaa

SEQ ID NO: 18947 - RNA, 2181 nt, Artificial Sequence
  KIF3A__Homo_sapiens__NP_001287720
augcccaucaacaagagcgagaagcccgagagcugcgacaacgugaaggugguggugagaugcagaccccugaacgagagagagaagagcaugugcuacaagcaggccgugagcguggacgagaugagaggcaccaucaccgugcacaagaccgacagcagcaacgagccccccaagaccuucaccuucgacaccguguucggccccgagagcaagcagcuggacguguacaaccugaccgccagacccaucaucgacagcgugcuggagggcuacaacggcaccaucuucgccuacggccagaccggcaccggcaagaccuucaccauggagggcgugagagccauccccgagcugagaggcaucauccccaacagcuucgcccacaucuucggccacaucgccaaggccgagggcgacaccagauuccuggugagagugagcuaccuggagaucuacaacgaggaggugagagaccugcugggcaaggaccagacccagagacuggaggugaaggagagacccgacgugggcguguacaucaaggaccugagcgccuacguggugaacaacgccgacgacauggacagaaucaugacccugggccacaagaacagaagcgugggcgccaccaacaugaacgagcacagcagcagaagccacgccaucuucaccaucaccaucgagugcagcgagaagggcaucgacggcaacaugcacgugagaaugggcaagcugcaccugguggaccuggccggcagcgagagacaggccaagaccggcgccaccggccagagacugaaggaggccaccaagaucaaccugagccugagcacccugggcaacgugaucagcgcccugguggacggcaagagcacccacgugcccuacagaaacagcaagcugaccagacugcugcaggacagccugggcggcaacagcaagaccaugaugugcgccaacaucggccccgccgacuacaacuacgacgagaccaucagcacccugagauacgccaacagagccaagaacaucaagaacaaggccagaaucaacgaggaccccaaggacgcccugcugagacaguuccagaaggagaucgaggagcugaagaagaagcuggaggagggcgaggagaucagcggcagcgacaucagcggcagcgaggaggacgacgacgaggagggcgaggugggcgaggacggcgagaagagaaagaagagaagaggcagcagcagcagcagcagcagcgacagcaccugcagcgugaucgagaagccccuggacaaguuccugcccaaccaggccggcaagaagaaggugagccccgacaagaugaucgagaugcaggccaagaucgacgaggagagaaaggcccuggagaccaagcuggacauggaggaggaggagagaaacaaggccagagccgagcuggagaagagagagaaggaccugcugaaggcccagcaggagcaccagagccugcuggagaagcugagcgcccuggagaagaaggugaucgugggcggcguggaccugcuggccaaggccgaggagcaggagaagcugcuggaggagagcaacauggagcuggaggagagaagaaagagagccgagcagcugagaagagagcuggaggagaaggagcaggagagacuggacaucgaggagaaguacaccagccugcaggaggaggcccagggcaagaccaagaagcugaagaagguguggaccaugcugauggccgccaagagcgagauggccgaccugcagcaggagcaccagagagagaucgagggccugcuggagaacaucagacagcugagcagagagcugagacugcagaugcugaucaucgacaacuucauccccagagacuaccaggagaugaucgagaacuacgugcacuggaacgaggacaucggcgaguggcagcugaagugcguggccuacaccggcaacaacaugagaaagcagacccccgugcccgacaagaaggagaaggaccccuucgagguggaccugagccacguguaccuggccuacaccgaggagagccugagacagagccugaugaagcuggagagacccagaaccagcaagggcaaggccagacccaagaccggcagaagaaagagaagcgccaagcccgagaccgugaucgacagccugcugcaguaa

SEQ ID NO: 18948 - RNA, 2244 nt, Artificial Sequence
  KIF3B__Homo_sapiens__NP_004789
augagcaagcugaagagcagcgagagcgugagagugguggugagaugcagacccaugaacggcaaggagaaggccgccagcuacgacaaggugguggacguggacgugaagcugggccaggugagcgugaagaaccccaagggcaccgcccacgagaugcccaagaccuucaccuucgacgccguguacgacuggaacgccaagcaguucgagcuguacgacgagaccuucagaccccugguggacagcgugcugcagggcuucaacggcaccaucuucgccuacggccagaccggcaccggcaagaccuacaccauggagggcaucagaggcgaccccgagaagagaggcgugauccccaacagcuucgaccacaucuucacccacaucagcagaagccagaaccagcaguaccuggugagagccagcuaccuggagaucuaccaggaggagaucagagaccugcugagcaaggaccagaccaagagacuggagcugaaggagagacccgacaccggcguguacgugaaggaccugagcagcuucgugaccaagagcgugaaggagaucgagcacgugaugaacgugggcaaccagaacagaagcgugggcgccaccaacaugaacgagcacagcagcagaagccacgccaucuucgugaucaccaucgagugcagcgaggugggccuggacggcgagaaccacaucagagugggcaagcugaaccugguggaccuggccggcagcgagagacaggccaagaccggcgcccagggcgagagacugaaggaggccaccaagaucaaccugagccugagcgcccugggcaacgugaucagcgcccugguggacggcaagagcacccacauccccuacagagacagcaagcugaccagacugcugcaggacagccugggcggcaacgccaagaccgugaugguggccaacgugggccccgccagcuacaacguggaggagacccugaccacccugagauacgccaacagagccaagaacaucaagaacaagcccagagugaacgaggaccccaaggacgcccugcugagagaguuccaggaggagaucgccagacugaaggcccagcuggagaagagaagcaucggcagaagaaagagaagagagaagagaagagagggcggcggcagcggcggcggcggcgaggaggaggaggaggagggcgaggagggcgaggaggagggcgacgacaaggacgacuacuggagagagcagcaggagaagcuggagaucgagaagagagccaucguggaggaccacagccugguggccgaggagaagaugagacugcugaaggagaaggagaagaagauggaggaccugagaagagagaaggacgccgccgagaugcugggcgccaagaucaaggccauggagagcaagcugcuggugggcggcaagaacaucguggaccacaccaacgagcagcagaagauccuggagcagaagagacaggagaucgccgagcagaagagaagagagagagagauccagcagcagauggagagcagagacgaggagacccuggagcugaaggagaccuacagcagccugcagcaggagguggacaucaagaccaagaagcugaagaagcuguucagcaagcugcaggccgugaaggccgagauccacgaccugcaggaggagcacaucaaggagagacaggagcuggagcagacccagaacgagcugaccagagagcugaagcugaagcaccugaucaucgagaacuucaucccccuggaggagaagagcaagaucaugaacagagccuucuucgacgaggaggaggaccacuggaagcugcaccccaucaccagacuggagaaccagcagaugaugaagagacccgugagcgccgugggcuacaagagaccccugagccagcacgccagaaugagcaugaugaucagacccgaggccagauacagagccgagaacaucgugcugcuggagcuggacaugcccagcagaaccaccagagacuacgagggccccgccaucgcccccaaggugcaggccgcccuggacgccgcccugcaggacgaggacgagauccagguggacgccagcagcuucgagagcaccgccaacaagaagagcaaggccagacccaagagcggcagaaagagcggcagcagcagcagcagcagcggcacccccgccagccagcuguacccccagagcagaggccuggugcccaaguaa

SEQ ID NO: 18949 - RNA, 2382 nt, Artificial Sequence
  KIF3C__Homo_sapiens__NP_002245
auggccagcaagaccaaggccagcgaggcccugaaggugguggccagaugcagaccccugagcagaaaggaggaggccgccggccacgagcagauccugaccauggacgugaagcugggccaggugacccugagaaaccccagagccgcccccggcgagcugcccaagaccuucaccuucgacgccguguacgacgccagcagcaagcaggccgaccuguacgacgagaccgugagaccccugaucgacagcgugcugcagggcuucaacggcaccguguucgccuacggccagaccggcaccggcaagaccuacaccaugcagggcaccuggguggagcccgagcugagaggcgugauccccaacgccuucgagcacaucuucacccacaucagcagaagccagaaccagcaguaccuggugagagccagcuaccuggagaucuaccaggaggagaucagagaccugcugagcaaggagcccggcaagagacuggagcugaaggagaaccccgagaccggcguguacaucaaggaccugagcagcuucgugaccaagaacgugaaggagaucgagcacgugaugaaccugggcaaccagaccagagccgugggcagcacccacaugaacgaggugagcagcagaagccacgccaucuucaucaucaccguggagugcagcgagagaggcagcgacggccaggaccacaucagagugggcaagcugaaccugguggaccuggccggcagcgagagacagaacaaggccggccccaacaccgccggcggcgccgccacccccagcagcggcggcggcggcggcggcggcggcagcggcggcggcgccggcggcgagagacccaaggaggccagcaagaucaaccugagccugagcgcccugggcaacgugaucgccgcccuggccggcaacagaagcacccacauccccuacagagacagcaagcugaccagacugcugcaggacagccugggcggcaacgccaagaccaucaugguggccacccugggccccgccagccacagcuacgacgagagccugagcacccugagauucgccaacagagccaagaacaucaagaacaagcccagagugaacgaggaccccaaggacacccugcugagagaguuccaggaggagaucgccagacugaaggcccagcuggagaagagaggcaugcugggcaagagacccagaagaaagagcagcagaagaaagaaggccgugagcgccccccccggcuaccccgagggccccgugaucgaggccuggguggccgaggaggaggacgacaacaacaacaaccacagacccccccagcccauccuggagagcgcccuggagaagaacauggagaacuaccugcaggagcagaaggagagacuggaggaggagaaggccgccauccaggacgacagaagccuggugagcgaggagaagcagaagcugcuggaggagaaggagaagaugcuggaggaccugagaagagagcagcaggccaccgagcugcuggccgccaaguacaaggccauggagagcaagcugcugaucggcggcagaaacaucauggaccacaccaacgagcagcagaagaugcuggagcugaagagacaggagaucgccgagcagaagagaagagagagagagaugcagcaggagaugaugcugagagacgaggagaccauggagcugagaggcaccuacaccagccugcagcaggagguggaggugaagaccaagaagcugaagaagcuguacgccaagcugcaggccgugaaggccgagauccaggaccagcacgacgaguacaucagagugagacaggaccuggaggaggcccagaacgagcagaccagagagcugaagcugaaguaccugaucaucgagaacuucaucccccccgaggagaagaacaagaucaugaacagacuguuccuggacugcgaggaggagcaguggaaguuccagccccuggugcccgccggcgugagcagcagccagaugaagaagagacccaccagcgccgugggcuacaagagacccaucagccaguacgccagaguggccauggccaugggcagccaccccagauacagagccgagaacaucauguuccuggagcuggacgugagcccccccgccguguucgagauggaguucagccacgaccaggagcaggaccccagagcccugcacauggagagacugaugagacuggacagcuuccuggagagacccagcaccagcaaggugagaaagagcagaagcuggugccagagcccccagagacccccccccagcaccacccacgccagccuggccagcgccagccugagacccgccaccguggccgaccacgaguaa

SEQ ID NO: 18950 - RNA, 3699 nt, Artificial Sequence
  KIF4A__Homo_sapiens__XP_011529195
augaaggaggaggugaagggcauccccgugagaguggcccugagaugcagaccccuggugcccaaggagaucagcgagggcugccagaugugccugagcuucgugcccggcgagccccaggugguggugggcaccgacaagagcuucaccuacgacuucguguucgaccccagcaccgagcaggaggagguguucaacaccgccguggccccccugaucaagggcguguucaagggcuacaacgccaccgugcuggccuacggccagaccggcagcggcaagaccuacagcaugggcggcgccuacaccgccgagcaggagaacgagcccaccgugggcgugauccccagagugauccagcugcuguucaaggagaucgacaagaagagcgacuucgaguucacccugaaggugagcuaccuggagaucuacaacgaggagauccuggaccugcugugccccagcagagagaaggcccagaucaacaucagagaggaccccaaggagggcaucaagaucgugggccugaccgagaagaccgugcugguggcccuggacaccgugagcugccuggagcagggcaacaacagcagaaccguggccagcaccgccaugaacagccagagcagcagaagccacgccaucuucaccaucagccuggagcagagaaagaagagcgacaagaacagcagcuucagaagcaagcugcaccugguggaccuggccggcagcgagagacagaagaagaccaaggccgagggcgacagacugaaggagggcaucaacaucaacagaggccugcugugccugggcaacgugaucagcgcccugggcgacgacaagaagggcggcuucgugcccuacagagacagcaagcugaccagacugcugcaggacagccugggcggcaacagccacacccugaugaucgccugcgugagccccgccgacagcaaccuggaggagacccugaacacccugagauacgccgacagagccagaaagaucaagaacaagcccaucgugaacaucgacccccagaccgccgagcugaaccaccugaagcagcaggugcagcagcugcaggugcugcugcugcaggcccacggcggcacccugcccggcagcaucaccguggagcccagcgagaaccugcagagccugauggagaagaaccagagccugguggaggagaacgagaagcugagcagaggccugagcgaggccgccggccagaccgcccagaugcuggagagaaucauccugaccgagcaggccaacgagaagaugaacgccaagcuggaggagcugagacagcacgccgccugcaagcuggaccugcagaagcugguggagacccuggaggaccaggagcugaaggagaacguggagaucaucugcaaccugcagcagcugaucacccagcugagcgacgagaccguggccugcauggccgccgccaucgacaccgccguggagcaggaggcccagguggagaccagccccgagaccagcagaagcagcgacgccuucaccacccagcacgcccugagacaggcccagaugagcaaggagcugguggagcugaacaaggcccuggcccugaaggaggcccuggccagaaagaugacccagaacgacagccagcugcagcccauccaguaccaguaccaggacaacaucaaggagcuggagcuggaggugaucaaccugcagaaggagaaggaggagcuggugcuggagcugcagaccgccaagaaggacgccaaccaggccaagcugagcgagagaagaagaaagagacugcaggagcuggagggccagaucgccgaccugaagaagaagcugaacgagcagagcaagcugcugaagcugaaggagagcaccgagagaaccgugagcaagcugaaccaggagaucagaaugaugaagaaccagagagugcagcugaugagacagaugaaggaggacgccgagaaguucagacaguggaagcagaagaaggacaaggaggugauccagcugaaggagagagacagaaagagacaguacgagcugcugaagcuggagagaaacuuccagaagcagagcaacgugcugagaagaaagaccgaggaggccgccgccgccaacaagagacugaaggacgcccugcagaagcagagagagguggccgacaagagaaaggagacccagagcagaggcauggagggcaccgccgccagagugaagaacuggcugggcaacgagaucgaggugauggugagcaccgaggaggccaagagacaccugaacgaccugcuggaggacagaaagauccuggcccaggacguggcccagcugaaggagaagaaggagagcggcgagaaccccccccccaagcugagaagaagaaccuucagccugaccgaggugagaggccaggugagcgagagcgaggacagcaucaccaagcagaucgagagccuggagaccgagauggaguucagaagcgcccagaucgccgaccugcagcagaagcugcuggacgccgagagcgaggacagacccaagcagagaugggagaacaucgccaccauccuggaggccaagugcgcccugaaguaccugaucggcgagcuggugagcagcaagauccaggugagcaagcuggagagcagccugaagcagagcaagaccagcugcgccgacaugcagaagaugcuguucgaggagagaaaccacuucgccgagaucgagaccgagcugcaggccgagcuggugagaauggagcagcagcaccaggagaaggugcuguaccugcugagccagcugcagcagagccagauggccgagaagcagcuggaggagagcgugagcgagaaggagcagcagcugcugagcacccugaagugccaggacgaggagcuggagaagaugagagaggugugcgagcagaaccagcagcugcugagagagaacgagaucaucaagcagaagcugacccugcugcagguggccagcagacagaagcaccugcccaaggacacccugcugagccccgacagcagcuucgaguacgugccccccaagcccaagcccagcagagugaaggagaaguuccuggagcagagcauggacaucgaggaccugaaguacugcagcgagcacagcgugaacgagcacgaggacggcgacggcgacgacgacgagggcgacgacgaggaguggaagcccaccaagcuggugaaggugagcagaaagaacauccagggcugcagcugcaagggcuggugcggcaacaagcagugcggcugcagaaagcagaagagcgacugcggcguggacugcugcugcgaccccaccaagugcagaaacagacagcagggcaaggacagccugggcaccguggagagaacccaggacagcgagggcagcuucaagcuggaggaccccaccgaggugacccccggccugagcuucuucaaccccgugugcgccacccccaacagcaagauccugaaggagaugugcgacguggagcaggugcugagcaagaagaccccccccgcccccagccccuucgaccugcccgagcugaagcacguggccaccgaguaccaggagaacaaggcccccggcaagaagaagaagagagcccuggccagcaacaccagcuucuucagcggcugcagccccaucgaggaggaggcccacuaa

SEQ ID NO: 18951 - RNA, 3705 nt, Artificial Sequence
  KIF4B__Homo_sapiens__NP_001092763
augaaggaggaggugaagggcauccccgugagaguggcccugagaugcagaccccuggugcccaaggagaucagcgagggcugccagaugugccugagcuucgugcccggcgagacccaggugguggugggcaccgacaagagcuucaccuacgacuucguguucgaccccugcaccgagcaggaggagguguucaacaaggccguggccccccugaucaagggcaucuucaagggcuacaacgccaccgugcuggccuacggccagaccggcagcggcaagaccuacagcaugggcggcgccuacaccgccgagcaggagaacgagcccaccgugggcaucauccccagagugauccagcugcuguucaaggagaucgacaagaagagcgacuucgaguucacccugaaggugagcuaccuggagaucuacaacgaggagauccuggaccugcugugccccagcagagagaaggcccagaucaacaucagagaggaccccaaggagggcaucaagaucgugggccugaccgagaagaccgugcugguggcccuggacaccgugagcugccuggagcagggcaacaacagcagaaccguggccagcaccgccaugaacagccagagcagcagaagccacgccaucuucaccaucagcaucgagcagagaaagaagagcgacaagaacugcagcuucagaagcaagcugcaccugguggaccuggccggcagcgagagacagaagaagaccaaggccgagggcgacagacugaaggagggcaucaacaucaacagaggccugcugugccugggcaacgugaucagcgcccugggcgacgacaagaagggcagcuucgugcccuacagagacagcaagcugaccagacugcugcaggacagccugggcggcaacagccacacccugaugaucgccugcgugagccccgccgacagcaaccuggaggagacccugagcacccugagauacgccgacagagccagaaagaucaagaacaagcccaucgugaacaucgacccccacaccgccgagcugaaccaccugaagcagcaggugcagcagcugcaggugcugcugcugcaggcccacggcggcacccugcccggcagcaucaacgccgagcccagcgagaaccugcagagccugauggagaagaaccagagccugguggaggagaacgagaagcugagcagaugccugagcaaggccgccggccagaccgcccagaugcuggagagaaucauccugaccgagcaggugaacgagaagcugaacgccaagcuggaggagcugagacagcacguggccugcaagcuggaccugcagaagcugguggagacccuggaggaccaggagcugaaggagaacguggagaucaucugcaaccugcagcagcugaucacccagcugagcgacgagaccguggccugcaccgccgccgccaucgacaccgccguggaggaggaggcccagguggagaccagccccgagaccagcagaagcagcgacgccuucaccacccagcacgcccugcaccaggcccagaugagcaaggaggugguggagcugaacaacgcccuggcccugaaggaggcccuggugagaaagaugacccagaacgacaaccagcugcagcccauccaguuccaguaccaggacaacaucaagaaccuggagcuggaggugaucaaccugcagaaggagaaggaggagcuggugagagagcugcagaccgccaagaagaacgugaaccaggccaagcugagcgagcacagacacaagcugcugcaggagcuggagggccagaucgccgaccugaagaagaagcugaacgagcagagcaagcugcugaagcugaaggagagcaccgagagaaccgugagcaagcugaaccaggagaucuggaugaugaagaaccagagagugcagcugaugagacagaugaaggaggacgccgagaaguucagacaguggaagcagaagaaggacaaggaggugauccagcugaaggagagagacagaaagagacaguacgagcugcugaagcuggagagaaacuuccagaagcagagcagcgugcugagaagaaagaccgaggaggccgccgccgccaacaagagacugaaggacgcccugcagaagcagagagaggugaccgacaagagaaaggagacccagagccacggcaaggagggcaucgccgccagagugagaaacuggcugggcaacgagaucgaggugauggugagcaccgaggaggccaagagacaccugaacgaccugcuggaggacagaaagauccuggcccaggacguggugcagcugaaggagaagaaggagagcagagagaaccccccccccaagcugagaaagugcaccuucagccugagcgaggugcacggccaggugcuggagagcgaggacugcaucaccaagcagaucgagagccuggagaccgagauggagcugagaagcgcccagaucgccgaccugcagcagaagcugcuggacgccgagagcgaggacagacccaagcagugcugggagaacaucgccaccauccuggaggccaagugcgcccugaaguaccugaucggcgagcuggugagcagcaagauccacgugaccaagcuggagaacagccugagacagagcaaggccagcugcgccgacaugcagaagaugcuguucgaggagcagaaccacuucagcgagaucgagaccgagcugcaggccgagcuggugagaauggagcagcagcaccaggagaaggugcuguaccuggugagccagcugcaggagagccagauggccgagaagcagcuggagaagagcgccagcgagaaggagcagcagcuggugagcacccugcagugccaggacgaggagcuggagaagaugagagaggugugcgagcagaaccagcagcugcugcaggagaacgagaucaucaagcagaagcugauccugcugcagguggccagcagacagaagcaccugcccaacgacacccugcugagccccgacagcagcuucgaguacaucccccccaagcccaagcccagcagagugaaggagaaguuccuggagcagagcauggacaucgaggaccugaaguacugcagcgagcacagcgugaacgagcacgaggacggcgacggcgacggcgacagcgacgagggcgacgacgaggaguggaagcccaccaagcuggugaaggugagcagaaagaacauccagggcugcagcugcaagggcuggugcggcaacaagcagugcggcugcagaaagcagaagagcgacugcggcguggacugcagcugcgaccccaccaagugcagaaacagacagcagggcaaggacagccugggcaccguggagcagacccaggacagcgagggcagcuucaagcuggaggaccccaccgaggugacccccggccugagcuucuucaaccccgugugcgccacccccaacagcaagauccugaaggagaugugcgacauggagcaggugcugagcaagaagaccgcccccgcccccagccccuucgaccugcccgagagcaagcacggcgccaccgaguaccagcagaacaagccccccggcaagaagaagaagagagcccuggccagcaacaccagcuucuucagcggcugcagccccaucgaggaggaggcccacuaa

SEQ ID NO: 18952 - RNA, 3099 nt, Artificial Sequence
  KIF5A__Homo_sapiens__NP_004975
auggccgagaccaacaacgagugcagcaucaaggugcugugcagauucagaccccugaaccaggccgagauccugagaggcgacaaguucauccccaucuuccagggcgacgacagcguggugaucggcggcaagcccuacguguucgacagaguguucccccccaacaccacccaggagcagguguaccacgccugcgccaugcagaucgugaaggacgugcuggccggcuacaacggcaccaucuucgccuacggccagaccagcagcggcaagacccacaccauggagggcaagcugcacgacccccagcugaugggcaucauccccagaaucgccagagacaucuucaaccacaucuacagcauggacgagaaccuggaguuccacaucaaggugagcuacuucgagaucuaccuggacaagaucagagaccugcuggacgugaccaagaccaaccugagcgugcacgaggacaagaacagagugcccuucgugaagggcugcaccgagagauucgugagcagccccgaggagauccuggacgugaucgacgagggcaagagcaacagacacguggccgugaccaacaugaacgagcacagcagcagaagccacagcaucuuccugaucaacaucaagcaggagaacauggagaccgagcagaagcugagcggcaagcuguaccugguggaccuggccggcagcgagaaggugagcaagaccggcgccgagggcgccgugcuggacgaggccaagaacaucaacaagagccugagcgcccugggcaacgugaucagcgcccuggccgagggcaccaagagcuacgugcccuacagagacagcaagaugaccagaauccugcaggacagccugggcggcaacugcagaaccaccauguucaucugcugcagccccagcagcuacaacgacgccgagaccaagagcacccugauguucggccagagagccaagaccaucaagaacaccgccagcgugaaccuggagcugaccgccgagcaguggaagaagaaguacgagaaggagaaggagaagaccaaggcccagaaggagaccaucgccaagcuggaggccgagcugagcagauggagaaacggcgagaacgugcccgagaccgagagacuggccggcgaggaggccgcccugggcgccgagcugugcgaggagacccccgugaacgacaacagcagcaucguggugagaaucgcccccgaggagagacagaaguacgaggaggagaucagaagacuguacaagcagcuggacgacaaggacgacgagaucaaccagcagagccagcugaucgagaagcugaagcagcagaugcuggaccaggaggagcugcuggugagcaccagaggcgacaacgagaaggugcagagagagcugagccaccugcagagcgagaacgacgccgccaaggacgaggugaaggaggugcugcaggcccuggaggagcuggccgugaacuacgaccagaagagccaggagguggaggagaagagccagcagaaccagcugcugguggacgagcugagccagaagguggccaccaugcugagccuggagagcgagcugcagagacugcaggaggugagcggccaccagagaaagagaaucgccgaggugcugaacggccugaugaaggaccugagcgaguucagcgugaucgugggcaacggcgagaucaagcugcccguggagaucagcggcgccaucgaggaggaguucaccguggccagacuguacaucagcaagaucaagagcgaggugaagagcguggugaagagaugcagacagcuggagaaccugcagguggagugccacagaaagauggaggugaccggcagagagcugagcagcugccagcugcugaucagccagcacgaggccaagaucagaagccugaccgaguacaugcagagcguggagcugaagaagagacaccuggaggagagcuacgacagccugagcgacgagcuggccaagcugcaggcccaggagaccgugcacgagguggcccugaaggacaaggagcccgacacccaggacgccgacgaggugaagaaggcccuggagcugcagauggagagccacagagaggcccaccacagacagcuggccagacugagagacgagaucaacgagaagcagaagaccaucgacgagcugaaggaccugaaccagaagcugcagcuggagcuggagaagcugcaggccgacuacgagaagcugaagagcgaggagcacgagaagagcaccaagcugcaggagcugaccuuccuguacgagagacacgagcagagcaagcaggaccugaagggccuggaggagaccguggccagagagcugcagacccugcacaaccugagaaagcuguucgugcaggacgugaccaccagagugaagaagagcgccgagauggagcccgaggacagcggcggcauccacagccagaagcagaagaucagcuuccuggagaacaaccuggagcagcugaccaaggugcacaagcagcuggugagagacaacgccgaccugagaugcgagcugcccaagcuggagaagagacugagagccaccgccgagagagugaaggcccuggagggcgcccugaaggaggccaaggagggcgccaugaaggacaagagaagauaccagcaggagguggacagaaucaaggaggccgugagauacaagagcagcggcaagagaggccacagcgcccagaucgccaagcccgugagacccggccacuaccccgccagcagccccaccaaccccuacggcaccagaagccccgagugcaucagcuacaccaacagccuguuccagaacuaccagaaccuguaccugcaggccacccccagcagcaccagcgacauguacuucgccaacagcugcaccagcagcggcgccaccagcagcggcggcccccuggccagcuaccagaaggccaacauggacaacggcaacgccaccgacaucaacgacaacagaagcgaccugcccugcggcuacgaggccgaggaccaggccaagcuguucccccugcaccaggagaccgccgccagcuaa

SEQ ID NO: 18953 - RNA, 2892 nt, Artificial Sequence
  KIF5B__Homo_sapiens__NP_004512
auggccgaccuggccgagugcaacaucaaggugaugugcagauucagaccccugaacgagagcgaggugaacagaggcgacaaguacaucgccaaguuccagggcgaggacaccguggugaucgccagcaagcccuacgccuucgacagaguguuccagagcagcaccagccaggagcagguguacaacgacugcgccaagaagaucgugaaggacgugcuggagggcuacaacggcaccaucuucgccuacggccagaccagcagcggcaagacccacaccauggagggcaagcugcacgaccccgagggcaugggcaucauccccagaaucgugcaggacaucuucaacuacaucuacagcauggacgagaaccuggaguuccacaucaaggugagcuacuucgagaucuaccuggacaagaucagagaccugcuggacgugagcaagaccaaccugagcgugcacgaggacaagaacagagugcccuacgugaagggcugcaccgagagauucgugugcagccccgacgaggugauggacaccaucgacgagggcaagagcaacagacacguggccgugaccaacaugaacgagcacagcagcagaagccacagcaucuuccugaucaacgugaagcaggagaacacccagaccgagcagaagcugagcggcaagcuguaccugguggaccuggccggcagcgagaaggugagcaagaccggcgccgagggcgccgugcuggacgaggccaagaacaucaacaagagccugagcgcccugggcaacgugaucagcgcccuggccgagggcagcaccuacgugcccuacagagacagcaagaugaccagaauccugcaggacagccugggcggcaacugcagaaccaccaucgugaucugcugcagccccagcagcuacaacgagagcgagaccaagagcacccugcuguucggccagagagccaagaccaucaagaacaccgugugcgugaacguggagcugaccgccgagcaguggaagaagaaguacgagaaggagaaggagaagaacaagauccugagaaacaccauccaguggcuggagaacgagcugaacagauggagaaacggcgagaccgugcccaucgacgagcaguucgacaaggagaaggccaaccuggaggccuucaccguggacaaggacaucacccugaccaacgacaagcccgccaccgccaucggcgugaucggcaacuucaccgacgccgagagaagaaagugcgaggaggagaucgccaagcuguacaagcagcuggacgacaaggacgaggagaucaaccagcagagccagcugguggagaagcugaagacccagaugcuggaccaggaggagcugcuggccagcaccagaagagaccaggacaacaugcaggccgagcugaacagacugcaggccgagaacgacgccagcaaggaggaggugaaggaggugcugcaggcccuggaggagcuggccgugaacuacgaccagaagagccaggagguggaggacaagaccaaggaguacgagcugcugagcgacgagcugaaccagaagagcgccacccuggccagcaucgacgccgagcugcagaagcugaaggagaugaccaaccaccagaagaagagagccgccgagaugauggccagccugcugaaggaccuggccgagaucggcaucgccgugggcaacaacgacgugaagcagcccgagggcaccggcaugaucgacgaggaguucaccguggccagacuguacaucagcaagaugaagagcgaggugaagaccauggugaagagaugcaagcagcuggagagcacccagaccgagagcaacaagaagauggaggagaacgagaaggagcuggccgccugccagcugagaaucagccagcacgaggccaagaucaagagccugaccgaguaccugcagaacguggagcagaagaagagacagcuggaggagagcguggacgcccugagcgaggagcuggugcagcugagagcccaggagaaggugcacgagauggagaaggagcaccugaacaaggugcagaccgccaacgaggugaagcaggccguggagcagcagauccagagccacagagagacccaccagaagcagaucagcagccugagagacgagguggaggccaaggccaagcugaucaccgaccugcaggaccagaaccagaagaugaugcuggagcaggagagacugagaguggagcacgagaagcugaaggccaccgaccaggagaagagcagaaagcugcacgagcugaccgugaugcaggacagaagagagcaggccagacaggaccugaagggccuggaggagaccguggccaaggagcugcagacccugcacaaccugagaaagcuguucgugcaggaccuggccaccagagugaagaagagcgccgagaucgacagcgacgacaccggcggcagcgccgcccagaagcagaagaucagcuuccuggagaacaaccuggagcagcugaccaaggugcacaagcagcuggugagagacaacgccgaccugagaugcgagcugcccaagcuggagaagagacugagagccaccgccgagagagugaaggcccuggagagcgcccugaaggaggccaaggagaacgccagcagagacagaaagagauaccagcaggagguggacagaaucaaggaggccgugagaagcaagaacauggccagaagaggccacagcgcccagaucgccaagcccaucagacccggccagcaccccgccgccagccccacccaccccagcgccaucagaggcggcggcgccuucgugcagaacagccagcccguggccgugagaggcggcggcggcaagcagguguaa

SEQ ID NO: 18954 - RNA, 2874 nt, Artificial Sequence
  KIF5C__Homo_sapiens__NP_004513
auggccgaccccgccgagugcagcaucaaggugaugugcagauucagaccccugaacgaggccgagauccugagaggcgacaaguucauccccaaguucaagggcgacgagaccguggugaucggccagggcaagcccuacguguucgacagagugcugccccccaacaccacccaggagcagguguacaacgccugcgccaagcagaucgugaaggacgugcuggagggcuacaacggcaccaucuucgccuacggccagaccagcagcggcaagacccacaccauggagggcaagcugcacgacccccagcugaugggcaucauccccagaaucgcccacgacaucuucgaccacaucuacagcauggacgagaaccuggaguuccacaucaaggugagcuacuucgagaucuaccuggacaagaucagagaccugcuggacgugagcaagaccaaccuggccgugcacgaggacaagaacagagugcccuacgugaagggcugcaccgagagauucgugagcagccccgaggaggugauggacgugaucgacgagggcaaggccaacagacacguggccgugaccaacaugaacgagcacagcagcagaagccacagcaucuuccugaucaacaucaagcaggagaacguggagaccgagaagaagcugagcggcaagcuguaccugguggaccuggccggcagcgagaaggugagcaagaccggcgccgagggcgccgugcuggacgaggccaagaacaucaacaagagccugagcgcccugggcaacgugaucagcgcccuggccgagggcaccaagacccacgugcccuacagagacagcaagaugaccagaauccugcaggacagccugggcggcaacugcagaaccaccaucgugaucugcugcagccccagcguguucaacgaggccgagaccaagagcacccugauguucggccagagagccaagaccaucaagaacaccgugagcgugaaccuggagcugaccgccgaggaguggaagaagaaguacgagaaggagaaggagaagaacaagacccugaagaacgugauccagcaccuggagauggagcugaacagauggagaaacggcgaggccgugcccgaggacgagcagaucagcgccaaggaccagaagaaccuggagcccugcgacaacacccccaucaucgacaacaucgcccccgugguggccggcaucagcaccgaggagaaggagaaguacgacgaggagaucagcagccuguacagacagcuggacgacaaggacgacgagaucaaccagcagagccagcuggccgagaagcugaagcagcagaugcuggaccaggacgagcugcuggccagcaccagaagagacuacgagaagauccaggaggagcugaccagacugcagaucgagaacgaggccgccaaggacgaggugaaggaggugcugcaggcccuggaggagcuggccgugaacuacgaccagaagagccaggagguggaggacaagaccagagccaacgagcagcugaccgacgagcuggcccagaagaccaccacccugaccaccacccagagagagcugagccagcugcaggagcugagcaaccaccagaagaagagagccaccgagauccugaaccugcugcugaaggaccugggcgagaucggcggcaucaucggcaccaacgacgugaagacccuggccgacgugaacggcgugaucgaggaggaguucaccauggccagacuguacaucagcaagaugaagagcgaggugaagagccuggugaacagaagcaagcagcuggagagcgcccagauggacagcaacagaaagaugaacgccagcgagagagagcuggccgccugccagcugcugaucagccagcacgaggccaagaucaagagccugaccgacuacaugcagaacauggagcagaagagaagacagcuggaggagagccaggacagccugagcgaggagcuggccaagcugagagcccaggagaagaugcacgaggugagcuuccaggacaaggagaaggagcaccugaccagacugcaggacgccgaggagaugaagaaggcccuggagcagcagauggagagccacagagaggcccaccagaagcagcugagcagacugagagacgagaucgaggagaagcagaagaucaucgacgagaucagagaccugaaccagaagcugcagcuggagcaggagaagcugagcagcgacuacaacaagcugaagaucgaggaccaggagagagagaugaagcuggagaagcugcugcugcugaacgacaagagagagcaggccagagaggaccugaagggccuggaggagaccgugagcagagagcugcagacccugcacaaccugagaaagcuguucgugcaggaccugaccaccagagugaagaagagcguggagcuggacaacgacgacggcggcggcagcgccgcccagaagcagaagaucagcuuccuggagaacaaccuggagcagcugaccaaggugcacaagcagcuggugagagacaacgccgaccugagaugcgagcugcccaagcuggagaagagacugagagccaccgccgagagagugaaggcccuggagagcgcccugaaggaggccaaggagaacgccaugagagacagaaagagauaccagcaggagguggacagaaucaaggaggccgugagagccaagaacauggccagaagagcccacagcgcccagaucgccaagcccaucagacccggccacuaccccgccagcagccccaccgccgugcacgccaucagaggcggcggcggcagcagcagcaacagcacccacuaccagaaguaa

SEQ ID NO: 18955 - RNA, 2394 nt, Artificial Sequence
  KIF6__Homo_sapiens__NP_001275949
auggugaagcagaccauccagaucuucgccagagugaagccccccgugagaaagcaccagcagggcaucuacagcaucgacgaggacgagaagcugauccccagccuggagaucauccugcccagagaccuggccgacggcuucgugaacaacaagagagagagcuacaaguucaaguuccagagaaucuucgaccaggacgccaaccaggagaccguguucgagaacaucgccaagcccguggccggcagcgugcuggccggcuacaacggcaccaucuucgccuacggccagaccggcagcggcaagaccuucaccaucaccggcggcgccgagagauacagcgacagaggcaucauccccagaacccugagcuacaucuucgagcagcugcagaaggacagcagcaagaucuacaccacccacaucagcuaccuggagaucuacaacgagugcggcuacgaccugcuggaccccagacacgaggccagcagccuggaggaccugcccaaggugaccauccuggaggaccccgaccagaacauccaccugaagaaccugacccugcaccaggccaccaccgaggaggaggcccugaaccugcuguuccugggcgacaccaacagaaugaucgccgagacccccaugaaccaggccagcaccagaagccacugcaucuucaccauccaccugagcagcaaggagcccggcagcgccaccgugagacacgccaagcugcaccugguggaccuggccggcagcgagagaguggccaagaccggcgugggcggccaccugcugaccgaggccaaguacaucaaccugagccugcacuaccuggagcaggugaucaucgcccugagcgagaagcacagaagccacauccccuacagaaacagcaugaugaccagcgugcugagagacagccugggcggcaacugcaugaccaccaugaucgccacccugagccuggagaagagaaaccuggacgagagcaucagcaccugcagauucgcccagagaguggcccugaucaagaacgaggccgugcugaacgaggagaucaaccccagacuggugaucaagagacugcagaaggagauccaggagcugaaggacgagcuggccauggugaccggcgagcagagaaccgaggcccugaccgaggccgagcugcugcagcuggagaagcugaucaccagcuuccuggaggaccaggacagcgacagcagacuggaggugggcgccgacaugagaaaggugcaccacugcuuccaccaccugaagaagcugcugaacgacaagaagauccuggagaacaacaccgugagcagcgagagcaaggaccaggacugccaggagccccugaaggaggaggaguacagaaagcugagagacauccugaagcagagagacaacgagaucaacauccuggugaacaugcugaagaaggagaagaagaaggcccaggaggcccugcaccuggccggcauggacagaagagaguucagacagagccagagcccccccuucagacugggcaaccccgaggagggccagagaaugagacugagcagcgcccccagccaggcccaggacuucagcauccugggcaagagaagcagccugcugcacaagaagaucggcaugagagaggagaugagccugggcugccaggaggccuucgagaucuucaagagagaccacgccgacagcgugaccaucgacgacaacaagcagauccugaagcagagauucagcgaggccaaggcccugggcgagagcaucaacgaggccagaagcaagaucggcaucagcgagaacauggccgugccccugaugcccgaccagcaggaggagaagcugagaagccagcuggaggaggagaagagaagauacaagaccauguucaccagacugaaggcccugaagguggagaucgagcaccugcagcugcugauggacaaggccaaggugaagcugcagaaggaguucgagguguggugggccgaggaggccaccaaccugcaggugaacagccccgccgugaacagccuggaccacaccaagcccuuccugcagaccagcgacagccagcacgaguggagccagcugcugagcaacaagagcagcggcggcugggaggugcaggaccagggcaccggcagauucgacgugugcgacgugaacgccagaaagauccugcccagccccugccccagcccccacagccagaagcagagcagcaccagcaccccccuggaggacagcauccccaagagacccgugagcagcaucccccugaccggcgacagccagaccgacagcgacaucaucgccuucaucaaggccagacagagcauccugcagaagcagugccugggcagcaacuaa

SEQ ID NO: 18956 - RNA, 4032 nt, Artificial Sequence
  KIF7__Homo_sapiens__XP_005254959
augggccuggaggcccagagacugcccggcgccgaggaggcccccgugagaguggcccugagagugagaccccugcugcccaaggagcugcugcacggccaccagagcugccugcagguggagcccggccugggcagagugacccugggcagagacagacacuucggcuuccacguggugcuggccgaggacgccggccaggaggccguguaccaggccugcgugcagccccugcuggaggccuucuucgagggcuucaacgccaccguguucgccuacggccagaccggcagcggcaagaccuacaccaugggcgaggccagcguggccagccugcuggaggacgagcagggcaucgugcccagagccauggccgaggccuucaagcugaucgacgagaacgaccugcuggacugccuggugcacgugagcuaccuggagguguacaaggaggaguucagagaccugcuggaggugggcaccgccagcagagacauccagcugagagaggacgagagaggcaacguggugcugugcggcgugaaggagguggacguggagggccuggacgaggugcugagccugcuggagaugggcaacgccgccagacacaccggcgccacccaccugaaccaccugagcagcagaagccacaccguguucaccgugacccuggagcagagaggcagagcccccagcagacugcccagacccgcccccggccagcugcuggugagcaaguuccacuucguggaccuggccggcagcgagagagugcugaagaccggcagcaccggcgagagacugaaggagagcauccagaucaacagcagccugcuggcccugggcaacgugaucagcgcccugggcgacccccagagaagaggcagccacauccccuacagagacagcaagaucaccagaauccugaaggacagccugggcggcaacgccaagaccgugaugaucgccugcgugagccccagcagcagcgacuucgacgagacccugaacacccugaacuacgccagcagagcccagaacaucagaaacagagccaccgugaacuggagacccgaggccgagagaccccccgaggagaccgccagcggcgccagaggcccccccagacacagaagcgagaccagaaucauccacagaggcagaagagcccccggccccgccaccgccagcgccgccgccgccaugagacugggcgccgagugcgccagauacagagccugcaccgacgccgccuacagccugcugagagagcugcaggccgagcccggccugcccggcgccgccgccagaaaggugagagacuggcugugcgccguggagggcgagagaagcgcccugagcagcgccagcggccccgacagcggcaucgagagcgccagcguggaggaccaggccgcccagggcgccggcggcagaaaggaggacgagggcgcccagcagcugcugacccugcagaaccagguggccagacuggaggaggagaacagagacuuccuggccgcccuggaggacgccauggagcaguacaagcugcagagcgacagacugagagagcagcaggaggagaugguggagcugagacugagacuggagcuggugagacccggcuggggcggccccagacugcugaacggccugccccccggcagcuucgugcccagaccccacaccgccccccugggcggcgcccacgcccacgugcugggcauggugccccccgccugccugcccggcgacgaggugggcagcgagcagagaggcgagcaggugaccaacggcagagaggccggcgccgagcugcugaccgaggugaacagacugggcagcggcagcagcgccgccagcgaggaggaggaggaggaggaggagccccccagaagaacccugcaccugagaagaaacagaaucagcaacugcagccagagagccggcgccagacccggcagccugcccgagagaaagggccccgagcugugccuggaggagcuggacgccgccauccccggcagcagagccgugggcggcagcaaggccagagugcaggccagacaggugccccccgccaccgccagcgaguggagacuggcccaggcccagcagaagaucagagagcuggccaucaacaucagaaugaaggaggagcugaucggcgagcuggugagaaccggcaaggccgcccaggcccugaacagacagcacagccagagaaucagagagcuggagcaggaggccgagcaggugagagccgagcugagcgagggccagagacagcugagagagcuggagggcaaggagcugcaggacgccggcgagagaagcagacugcaggaguucagaagaagaguggccgccgcccagagccaggugcaggugcugaaggagaagaagcaggccaccgagagacuggugagccugagcgcccagagcgagaagagacugcaggagcuggagagaaacgugcagcugaugagacagcagcagggccagcugcagagaagacugagagaggagaccgagcagaagagaagacuggaggccgagaugagcaagagacagcacagagugaaggagcuggagcugaagcacgagcagcagcagaagauccugaagaucaagaccgaggagaucgccgccuuccagagaaagagaagaagcggcagcaacggcagcguggugagccuggagcagcagcagaagaucgaggagcagaagaaguggcuggaccaggagauggagaaggugcugcagcagagaagagcccuggaggagcugggcgaggagcugcacaagagagaggccauccuggccaagaaggaggcccugaugcaggagaagaccggccuggagagcaagagacugagaagcagccaggcccugaacgaggacaucgugagagugagcagcagacuggagcaccuggagaaggagcugagcgagaagagcggccagcugagacagggcagcgcccagagccagcagcagaucagaggcgagaucgacagccugagacaggagaaggacagccugcugaagcagagacuggagaucgacggcaagcugagacagggcagccugcugagccccgaggaggagagaacccuguuccagcuggacgaggccaucgaggcccuggacgccgccaucgaguacaagaacgaggccaucaccugcagacagagagugcugagagccagcgccagccugcugagccagugcgagaugaaccugauggccaagcugagcuaccugagcagcagcgagaccagagcccugcugugcaaguacuucgacaagguggugacccugagagaggagcagcaccagcagcagaucgccuucagcgagcuggagaugcagcuggaggagcagcagagacugguguacuggcuggagguggcccuggagagacagagacuggagauggacagacagcugacccugcagcagaaggagcacgagcagaacaugcagcugcugcugcagcagagcagagaccaccugggcgagggccuggccgacagcagaagacaguacgaggccagaauccaggcccuggagaaggagcugggcagauacauguggaucaaccaggagcugaagcagaagcugggcggcgugaacgccgugggccacagcagaggcggcgagaagagaagccugugcagcgagggcagacaggcccccggcaacgaggacgagcugcaccuggcccccgagcugcuguggcugagcccccugaccgagggcgcccccagaaccagagaggagaccagagaccuggugcacgccccccugccccugaccuggaagagaagcagccugugcggcgaggagcagggcagccccgaggagcugagacagagagaggccgccgagccccuggugggcagagugcugcccgugggcgaggccggccugcccuggaacuucggcccccugagcaagcccagaagagagcugagaagagccagccccggcaugaucgacgugagaaagaacccccuguaa

SEQ ID NO: 18957 - RNA, 2373 nt, Artificial Sequence
  KIF9__Homo_sapiens__NP_001128350
augggcaccagaaagaaggugcacgccuucgugagagugaagcccaccgacgacuucgcccacgagaugaucagauacggcgacgacaagagaagcaucgacauccaccugaagaaggacaucagaagaggcguggugaacaaccagcagaccgacuggagcuucaagcuggacggcgugcugcacgacgccagccaggaccugguguacgagaccguggccaaggacguggugagccaggcccuggacggcuacaacggcaccaucaugugcuacggccagaccggcgccggcaagaccuacaccaugaugggcgccaccgagaacuacaagcacagaggcauccugcccagagcccugcagcagguguucagaaugaucgaggagagacccacccacgccaucaccgugagagugagcuaccuggagaucuacaacgagagccuguucgaccugcugagcacccugcccuacgugggccccagcgugacccccaugaccaucguggagaacccccagggcguguucaucaagggccugagcgugcaccugaccagccaggaggaggacgccuucagccugcuguucgagggcgagaccaacagaaucaucgccagccacaccaugaacaagaacagcagcagaagccacugcaucuucaccaucuaccuggaggcccacagcagaacccugagcgaggagaaguacaucaccagcaagaucaaccugguggaccuggccggcagcgagagacugggcaagagcggcagcgagggccaggugcugaaggaggccaccuacaucaacaagagccugagcuuccuggagcaggccaucaucgcccugggcgaccagaagagagaccacauccccuucagacagugcaagcugacccacgcccugaaggacagccugggcggcaacugcaacauggugcuggugaccaacaucuacggcgaggccgcccagcuggaggagacccugagcagccugagauucgccagcagaaugaagcuggugaccaccgagcccgccaucaacgagaaguacgacgccgagagaauggugaagaaccuggagaaggagcuggcccugcugaagcaggagcuggccauccacgacagccugaccaacagaaccuucgugaccuacgaccccauggacgagauccagaucgccgagaucaacagccaggugagaagauaccuggagggcacccuggacgagaucgacaucaucagccugagacagaucaaggagguguucaaccaguucagaguggugcugagccagcaggagcaggagguggagagcacccugagaagaaaguacacccugaucgacagaaacgacuucgccgccaucagcgccauccagaaggccggccugguggacguggacggccaccuggugggcgagcccgagggccagaacuucggccugggcguggcccccuucagcaccaagcccggcaagaaggccaagagcaagaagaccuucaaggagccccugagcagccuggccagaaaggagggcgccagcagccccgugaacggcaaggaccuggacuacgugagcaccagcaagacccagcuggugcccagcagcaaggacggcgacgugaaggacaugcugagcagagacagagagaccagcagcaucgagccccugcccagcgacagccccaaggaggagcugagacccaucagacccgacaccccccccagcaagcccguggccuucgaggaguucaagaacgagcagggcagcgagaucaacagaaucuucaaggagaacaagagcauccugaacgagagaagaaagagagccagcgagaccacccagcacaucaacgccaucaagagagagaucgacgugaccaaggaggcccugaacuuccagaagagccugagagagaagcagggcaaguacgagaacaagggccugaugaucaucgacgaggaggaguuccugcugauccugaagcugaaggaccugaagaagcaguacagaagcgaguaccaggaccugagagaccugagagccgagauccaguacugccagcaccugguggaccagugcagacacagacugcugauggaguucgacaucugguacaacgagagcuucgugauccccgaggacaugcagauggcccugaagcccggcggcagcaucagacccggcauggugcccgugaacagaaucgugagccugggcgaggacgaccaggacaaguucagccagcugcagcagagagugcugcccgagggccccgacagcaucagcuucuacaacgccaaggugaagaucgagcagaagcacaacuaccugaagaccaugaugggccugcagcaggcccacagaaaguaa

SEQ ID NO: 18958 - RNA, 2145 nt, Artificial Sequence
  KIFAP3__Homo_sapiens__NP_001191443
augagcaucgcccugggcaacaccuacagaagaagccugagcgacagcgagaccgugagcgugcugcaggccagccugugcgaggagaagaaggagaagagcagcaagcccaaggaccccccccccuucgagggcauggagaucgacgagguggccaacaucaacgacauggacgaguacaucgagcugcuguacgaggacauccccgacaaggugagaggcagcgcccugauccugcagcuggccagaaaccccgacaaccuggaggagcugcugcugaacgagaccgcccugggcgcccuggccagagugcugagagaggacuggaagcagagcguggagcuggccaccaacaucaucuacaucuucuucugcuucagcagcuucagccaguuccacggccugaucacccacuacaagaucggcgcccugugcaugaacaucaucgaccacgagcugaagagacacgagcuguggcaggaggagcugagcaagaagaagaaggccguggacgaggaccccgagaaccagacccugagaaaggacuacgagaagaccuucaagaaguaccagggccugguggugaagcaggagcagcugcugagaguggcccuguaccugcugcugaaccuggccgaggacaccagaaccgagcugaagaugagaaacaagaacaucgugcacaugcuggugaaggcccuggacagagacaacuucgagcugcugauccugguggugagcuuccugaagaagcugagcaucuucauggagaacaagaacgacaugguggagauggacaucguggagaagcuggugaagaugauccccugcgagcacgaggaccugcugaacaucacccugagacugcugcugaaccugagcuucgacaccggccugagaaacaagauggugcaggugggccugcugcccaagcugaccgcccugcugggcaacgacaacuacaagcagaucgccaugugcgugcuguaccacaucagcauggacgacagauucaagagcauguucgccuacaccgacugcaucccccagcugaugaagaugcuguucgagugcagcgacgagagaaucgaccuggagcugaucagcuucugcaucaaccuggccgccaacaagagaaacgugcagcugaucugcgagggcaacggccugaagaugcugaugaagagagcccugaaguucaaggacccccugcugaugaagaugaucagaaacaucagccagcacgacggccccaccaagaaccuguucaucgacuacgugggcgaccuggccgcccagaucagcaacgacgaggaggaggaguucgugaucgagugccugggcacccuggccaaccugaccauccccgaccuggacugggagcuggugcugaaggaguacaagcuggugcccuaccugaaggacaagcugaagcccggcgccgccgaggacgaccuggugcuggagguggugaucaugaucggcaccgugagcauggacgacagcugcgccgcccugcuggccaagagcggcaucauccccgcccugaucgagcugcugaacgcccagcaggaggacgacgaguucgugugccagaucaucuacguguucuaccagaugguguuccaccaggccaccagagacgugaucaucaaggagacccaggcccccgccuaccugaucgaccugaugcacgacaagaacaacgagaucagaaaggugugcgacaacacccuggacaucaucgccgaguacgacgaggagugggccaagaagauccagagcgagaaguucagauggcacaacagccaguggcuggagaugguggagagcagacagauggacgagagcgagcaguaccuguacggcgacgacagaaucgagcccuacauccacgagggcgacauccuggagagacccgaccuguucuacaacagcgacggccugaucgccagcgagggcgccaucagccccgacuucuucaacgacuaccaccugcagaacggcgacguggugggccagcacagcuuccccggcagccugggcauggacggcuucggccagcccgugggcauccugggcagacccgccaccgccuacggcuucagacccgacgagcccuacuacuacggcuacggcagcuaa

SEQ ID NO: 18959 - RNA, 2022 nt, Artificial Sequence
  KIFC1__Homo_sapiens__NP_002254
auggacccccagagaagcccccugcuggaggugaagggcaacaucgagcugaagagaccccugaucaaggcccccagccagcugccccugagcggcagcagacugaagagaagacccgaccagauggaggacggccuggagcccgagaagaagagaaccagaggccugggcgccaccaccaagaucaccaccagccaccccagagugcccagccugaccaccgugccccagacccagggccagaccaccgcccagaaggugagcaagaagaccggccccagaugcagcaccgccaucgccaccggccugaagaaccagaagcccgugcccgccgugcccgugcagaagagcggcaccagcggcgugccccccauggccggcggcaagaagcccagcaagagacccgccugggaccugaagggccagcugugcgaccugaacgccgagcugaagagaugcagagagagaacccagacccuggaccaggagaaccagcagcugcaggaccagcugagagacgcccagcagcaggugaaggcccugggcaccgagagaaccacccuggagggccaccuggccaaggugcaggcccaggccgagcagggccagcaggagcugaagaaccugagagccugcgugcuggagcuggaggagagacugagcacccaggagggccuggugcaggagcugcagaagaagcagguggagcugcaggaggagagaagaggccugaugagccagcuggaggagaaggagagaagacugcagaccagcgaggccgcccugagcagcagccaggccgagguggccagccugagacaggagaccguggcccaggccgcccugcugaccgagagagaggagagacugcacggccuggagauggagagaagaagacugcacaaccagcugcaggagcugaagggcaacaucagaguguucugcagagugagacccgugcugcccggcgagcccacccccccccccggccugcugcuguuccccagcggccccggcggccccagcgacccccccaccagacugagccugagcagaagcgacgagagaagaggcacccugagcggcgcccccgccccccccaccagacacgacuucagcuucgacagaguguucccccccggcagcggccaggacgagguguucgaggagaucgccaugcuggugcagagcgcccuggacggcuaccccgugugcaucuucgccuacggccagaccggcagcggcaagaccuucaccauggagggcggccccggcggcgacccccagcuggagggccugauccccagagcccugagacaccuguucagcguggcccaggagcugagcggccagggcuggaccuacagcuucguggccagcuacguggagaucuacaacgagaccgugagagaccugcuggccaccggcaccagaaagggccagggcggcgagugcgagaucagaagagccggccccggcagcgaggagcugaccgugaccaacgccagauacgugcccgugagcugcgagaaggagguggacgcccugcugcaccuggccagacagaacagagccguggccagaaccgcccagaacgagagaagcagcagaagccacagcguguuccagcugcagaucagcggcgagcacagcagcagaggccugcagugcggcgccccccugagccugguggaccuggccggcagcgagagacuggaccccggccuggcccugggccccggcgagagagagagacugagagagacccaggccaucaacagcagccugagcacccugggccuggugaucauggcccugagcaacaaggagagccacgugcccuacagaaacagcaagcugaccuaccugcugcagaacagccugggcggcagcgccaagaugcugauguucgugaacaucagcccccuggaggagaacgugagcgagagccugaacagccugagauucgccagcaaggugaaccagugcgugaucggcaccgcccaggccaacagaaaguaa

SEQ ID NO: 18960 - RNA, 2481 nt, Artificial Sequence
  KIFC3__Homo_sapiens__NP_001123572
auggugcccagcagaagaaccuggaaccugggcgccacccccagccugagaggccuguggagagugggcagagcccccgagcccgagcccggcauggccagacccgcccccgcccccgccagccccgccgccagacccuucccccacaccggccccggcagacugagaaccggcagaggcaaggacacccccgugugcggcgacgaggacagcagcgccagaagcgccgccagacccgcccuggcccagugcagagcccugagcguggacugggccggccccggcagcccccacggccuguaccugacccugcagguggagcaccugaaggagaagcugaucagccaggcccaggaggugagcagacugagaagcgagcugggcggcaccgaccuggagaagcacagagaccugcugaugguggagaacgagagacugagacaggagaugagaagaugcgaggccgagcugcaggagcugagaaccaagcccgccggccccugccccggcugcgagcacagccaggagagcgcccagcugagagacaagcugagccagcugcagcuggagauggccgagagcaagggcaugcugagcgagcugaaccuggaggugcagcagaagaccgacagacuggccgagguggagcugagacugaaggacugccuggccgagaaggcccaggaggaggagagacugagcagaagacugagagacagccacgagaccaucgccagccugagagcccagagcccccccgugaaguacgugaucaagaccguggagguggagagcagcaagaccaagcaggcccugagcgagagccaggccagaaaccagcaccugcaggagcagguggccaugcagagacaggugcugaaggagauggagcagcagcugcagagcagccaccagcugaccgccagacugagagcccagaucgccauguacgagagcgagcuggagagagcccacggccagaugcuggaggagaugcagagccuggaggaggacaagaacagagccaucgaggaggccuucgccagagcccagguggagaugaaggccgugcacgagaaccuggccggcgugagaaccaaccugcugacccugcagcccgcccugagaacccugaccaacgacuacaacggccugaagagacaggugagaggcuucccccugcugcugcaggaggcccugagaagcgugaaggccgagaucggccaggccaucgaggaggugaacagcaacaaccaggagcugcugagaaaguacagaagagagcugcagcugagaaagaagugccacaacgagcuggugagacugaagggcaacaucagagugaucgccagagugagacccgugaccaaggaggacggcgagggccccgaggccaccaacgccgugaccuucgacgccgacgacgacagcaucauccaccugcugcacaagggcaagcccgugagcuucgagcuggacaagguguucagcccccaggccagccagcaggacguguuccaggaggugcaggcccuggugaccagcugcaucgacggcuucaacgugugcaucuucgccuacggccagaccggcgccggcaagaccuacaccauggagggcaccgccgagaaccccggcaucaaccagagagcccugcagcugcuguucagcgaggugcaggagaaggccagcgacugggaguacaccaucaccgugagcgccgccgagaucuacaacgaggugcugagagaccugcugggcaaggagccccaggagaagcuggagaucagacugugccccgacggcagcggccagcuguacgugcccggccugaccgaguuccaggugcagagcguggacgacaucaacaagguguucgaguucggccacaccaacagaaccaccgaguucaccaaccugaacgagcacagcagcagaagccacgcccugcugaucgugaccgugagaggcguggacugcagcaccggccugagaaccaccggcaagcugaaccugguggaccuggccggcagcgagagagugggcaagagcggcgccgagggcagcagacugagagaggcccagcacaucaacaagagccugagcgcccugggcgacgugaucgccgcccugagaagcagacagggccacgugcccuucagaaacagcaagcugaccuaccugcugcaggacagccugagcggcgacagcaagacccugaugguggugcaggugagccccguggagaagaacaccagcgagacccuguacagccugaaguucgccgagagagugagaagcguggagcugggccccggccugagaagagccgagcugggcagcuggagcagccaggagcaccuggagugggagcccgccugccagaccccccagcccagcgccagagcccacagcgcccccagcagcggcaccagcagcagacccggcagcaucagaagaaagcugcagcccagcgccuaa

SEQ ID NO: 18961 - RNA, 1182 nt, Artificial Sequence
  KIN__Homo_sapiens__NP_036443
augggcaagagcgacuuccugacccccaaggccaucgccaacagaaucaagagcaagggccugcagaagcugagaugguacugccagaugugccagaagcagugcagagacgagaacggcuucaagugccacugcaugagcgagagccaccagagacagcugcugcuggccagcgagaacccccagcaguucauggacuacuucagcgaggaguucagaaacgacuuccuggagcugcugagaagaagauucggcaccaagagagugcacaacaacaucguguacaacgaguacaucagccacagagagcacauccacaugaacgccacccagugggagacccugaccgacuucaccaaguggcugggcagagagggccugugcaagguggacgagacccccaagggcugguacauccaguacaucgacagagaccccgagaccaucagaagacagcuggagcuggagaagaagaagaagcaggaccuggacgacgaggagaagaccgccaaguucaucgaggagcaggugagaagaggccuggagggcaaggagcaggaggugcccaccuucaccgagcugagcagagagaacgacgaggagaaggugaccuucaaccugagcaagggcgccugcagcagcagcggcgccaccagcagcaagagcagcacccugggccccagcgcccugaagaccaucggcagcagcgccagcgugaagagaaaggagagcagccagagcagcacccagagcaaggagaagaagaagaagaagagcgcccuggacgagaucauggagaucgaggaggagaagaagagaaccgccagaaccgacuacuggcugcagcccgagaucaucgugaagaucaucaccaagaagcugggcgagaaguaccacaagaagaaggccaucgugaaggaggugaucgacaaguacaccgccguggugaagaugaucgacagcggcgacaagcugaagcuggaccagacccaccuggagaccgugauccccgcccccggcaagagaauccuggugcugaacggcggcuacagaggcaacgagggcacccuggagagcaucaacgagaagaccuucagcgccaccaucgugaucgagaccggcccccugaagggcagaagaguggagggcauccaguacgaggacaucagcaagcuggccuaa

SEQ ID NO: 18962 - RNA, 1047 nt, Artificial Sequence
  KIR2DL1__Homo_sapiens__NP_055033
augagccugcugguggugagcauggccugcgugggcuucuuccugcugcagggcgccuggccccacgagggcgugcacagaaagcccagccugcuggcccaccccggcagacuggugaagagcgaggagaccgugauccugcagugcuggagcgacgugauguucgagcacuuccugcugcacagagagggcauguucaacgacacccugagacugaucggcgagcaccacgacggcgugagcaaggccaacuucagcaucagcagaaugacccaggaccuggccggcaccuacagaugcuacggcagcgugacccacagccccuaccaggugagcgcccccagcgacccccuggacaucgugaucaucggccuguacgagaagcccagccugagcgcccagcugggccccaccgugcuggccggcgagaacgugacccugagcugcagcagcagaagcagcuacgacauguaccaccugagcagagagggcgaggcccacgagagaagacugcccgccggccccaaggugaacggcaccuuccaggccgacuucccccugggccccgccacccacggcggcaccuacagaugcuucggcagcuuccacgacagccccuacgaguggagcaagagcagcgacccccugcuggugagcgugaccggcaaccccagcaacagcuggcccagccccaccgagcccagcagcaagaccggcaaccccagacaccugcacauccugaucggcaccagcguggugaucauccuguucauccugcuguucuuccugcugcacagauggugcagcaacaagaagaacgccgccgugauggaccaggagagcgccggcaacagaaccgccaacagcgaggacagcgacgagcaggacccccaggaggugaccuacacccagcugaaccacugcguguucacccagagaaagaucaccagacccagccagagacccaagaccccccccaccgacaucaucguguacaccgagcugcccaacgccgagagcagaagcaagguggugagcugccccuaa

SEQ ID NO: 18963 - RNA, 1047 nt, Artificial Sequence
  KIR2DL2__Homo_sapiens__NP_055034
augagccugaugguggugagcauggccugcgugggcuucuuccugcugcagggcgccuggccccacgagggcgugcacagaaagcccagccugcuggcccaccccggcagacuggugaagagcgaggagaccgugauccugcagugcuggagcgacgugagauucgagcacuuccugcugcacagagagggcaaguucaaggacacccugcaccugaucggcgagcaccacgacggcgugagcaaggccaacuucagcaucggccccaugaugcaggaccuggccggcaccuacagaugcuacggcagcgugacccacagccccuaccagcugagcgcccccagcgacccccuggacaucgugaucaccggccuguacgagaagcccagccugagcgcccagcccggccccaccgugcuggccggcgagagcgugacccugagcugcagcagcagaagcagcuacgacauguaccaccugagcagagagggcgaggcccacgagugcagauucagcgccggccccaaggugaacggcaccuuccaggccgacuucccccugggccccgccacccacggcggcaccuacagaugcuucggcagcuucagagacagccccuacgaguggagcaacagcagcgacccccugcuggugagcgugaccggcaaccccagcaacagcuggcccagccccaccgagcccagcagcaagaccggcaaccccagacaccugcacauccugaucggcaccagcguggugaucauccuguucauccugcuguucuuccugcugcacagauggugcagcaacaagaagaacgccgccgugauggaccaggagagcgccggcaacagaaccgccaacagcgaggacagcgacgagcaggacccccaggaggugaccuacacccagcugaaccacugcguguucacccagagaaagaucaccagacccagccagagacccaagaccccccccaccgacaucaucguguacaccgagcugcccaacgccgagagcagaagcaagguggugagcugccccuaa

SEQ ID NO: 18964 - RNA, 1026 nt, Artificial Sequence
  KIR2DL3__Homo_sapiens__NP_056952
augagccugaugguggugagcauggugugcgugggcuucuuccugcugcagggcgccuggccccacgagggcgugcacagaaagcccagccugcuggcccaccccggcccccuggugaagagcgaggagaccgugauccugcagugcuggagcgacgugagauuccagcacuuccugcugcacagagagggcaaguucaaggacacccugcaccugaucggcgagcaccacgacggcgugagcaaggccaacuucagcaucggccccaugaugcaggaccuggccggcaccuacagaugcuacggcagcgugacccacagccccuaccagcugagcgcccccagcgacccccuggacaucgugaucaccggccuguacgagaagcccagccugagcgcccagcccggccccaccgugcuggccggcgagagcgugacccugagcugcagcagcagaagcagcuacgacauguaccaccugagcagagagggcgaggcccacgagagaagauucagcgccggccccaaggugaacggcaccuuccaggccgacuucccccugggccccgccacccacggcggcaccuacagaugcuucggcagcuucagagacagccccuacgaguggagcaacagcagcgacccccugcuggugagcgugaccggcaaccccagcaacagcuggcccagccccaccgagcccagcagcgagaccggcaaccccagacaccugcacgugcugaucggcaccagcguggugaucauccuguucauccugcugcuguucuuccugcugcacagauggugcugcaacaagaagaacgccguggugauggaccaggagcccgccggcaacagaaccgugaacagagaggacagcgacgagcaggacccccaggaggugaccuacgcccagcugaaccacugcguguucacccagagaaagaucaccagacccagccagagacccaagaccccccccaccgacaucaucguguacaccgagcugcccaacgccgagcccuaa

SEQ ID NO: 18965 - RNA, 1029 nt, Artificial Sequence
  KIR2DL4__Homo_sapiens__NP_001074239
augagcaugagccccaccgugaucauccuggccugccugggcuucuuccuggaccagagcgugugggcccacgugggcggccaggacaagcccuucugcagcgccuggcccagcgccguggugccccagggcggccacgugacccugagaugccacuacagaagaggcuucaacaucuucacccuguacaagaaggacggcgugcccgugcccgagcuguacaacagaaucuucuggaacagcuuccugaucagccccgugacccccgcccacgccggcaccuacagaugcagaggcuuccacccccacagccccaccgaguggagcgcccccagcaacccccuggugaucauggugaccggccuguacgagaagcccagccugaccgccagacccggccccaccgugagagccggcgagaacgugacccugagcugcagcagccagagcagcuucgacaucuaccaccugagcagagagggcgaggcccacgagcugagacugcccgccgugcccagcaucaacggcaccuuccaggccgacuucccccugggccccgccacccacggcgagaccuacagaugcuucggcagcuuccacggcagccccuacgaguggagcgaccccagcgacccccugcccgugagcgugaccggcaaccccagcagcagcuggcccagccccaccgagcccagcuucaagaccgacgccgccgugaugaaccaggagcccgccggccacagaaccgugaacagagaggacagcgacgagcaggacccccaggaggugaccuacgcccagcuggaccacugcaucuucacccagagaaagaucaccggccccagccagagaagcaagagacccagcaccgacaccagcgugugcaucgagcugcccaacgccgagcccagagcccugagccccgcccacgagcaccacagccaggcccugaugggcagcagcagagagaccaccgcccugagccagacccagcuggccagcagcaacgugcccgccgccggcaucuaa

SEQ ID NO: 18966 - RNA, 1128 nt, Artificial Sequence
  KIR2DL5A__Homo_sapiens__NP_065396
augagccugauggugaucagcauggccugcgugggcuucuuccugcugcagggcgccuggacccacgagggcggccaggacaagccccugcugagcgccuggcccagcgccguggugcccagaggcggccacgugacccugcugugcagaagcagacugggcuucaccaucuucagccuguacaaggaggacggcgugcccgugcccgagcuguacaacaagaucuucuggaagagcauccugaugggccccgugacccccgcccacgccggcaccuacagaugcagaggcagccaccccagaagccccaucgaguggagcgcccccagcaacccccuggugaucguggugaccggccuguucggcaagcccagccugagcgcccagcccggccccaccgugagaaccggcgagaacgugacccugagcugcagcagcagaagcagcuucgacauguaccaccugagcagagagggcagagcccacgagcccagacugcccgccgugcccagcgugaacggcaccuuccaggccgacuucccccugggccccgccacccacggcggcaccuacaccugcuucggcagccugcacgacagccccuacgaguggagcgaccccagcgacccccugcuggugagcgugaccggcaacagcagcagcagcagcagcagccccaccgagcccagcagcaagaccggcaucagaagacaccugcacauccugaucggcaccagcguggccaucauccuguucaucauccuguucuucuuccugcugcacugcugcugcagcaacaagaagaacgccgccgugauggaccaggagcccgccggcgacagaaccgugaacagagaggacagcgacgaccaggacccccaggaggugaccuacgcccagcuggaccacugcguguucacccagaccaagaucaccagccccagccagagacccaagaccccccccaccgacaccaccauguacauggagcugcccaacgccaagcccagaagccugagccccgcccacaagcaccacagccaggcccugagaggcagcagcagagagaccaccgcccugagccagaacagaguggccagcagccacgugcccgccgccggcaucuaa

SEQ ID NO: 18967 - RNA, 1128 nt, Artificial Sequence
  KIR2DL5B__Homo_sapiens__NP_001018091
augagccugauggugaucagcauggccugcgugggcuucuuccugcugcagggcgccuggacccacgagggcggccaggacaagccccugcugagcgccuggcccagcgccguggugcccagaggcggccacgugacccugcugugcagaagcagacugggcuucaccaucuucagccuguacaaggaggacggcgugcccgugcccgagcuguacaacaagaucuucuggaagagcauccugaugggccccgugacccccgcccacgccggcaccuacagaugcagaggcagccaccccagaagccccaucgaguggagcgcccccagcaacccccuggugaucguggugaccggccuguucggcaagcccagccugagcgcccagcccggccccaccgugagaaccggcgagaacguggcccugagcugcagcagcagaagcagcuucgacauguaccaccugagcagagagggcagagcccacgagcccagacugcccgccgugcccagcguggacggcaccuuccaggccgacuucccccugggccccgccacccacggcggcaccuacaccugcuucagcagccugcacgacagccccuacgaguggagcgaccccagcgacccccugcuggugagcgugaccggcaacagcagcagcagcagcagcagccccaccgagcccagcagcaagaccggcaucagaagacaccugcacauccugaucggcaccagcguggccaucauccuguucaucauccuguucuucuuccugcugcacugcugcugcagcaacaagaagaacgccgccgugauggaccagggccccgccggcgacagaaccgugaacagagaggacagcgacgaccaggacccccaggaggugaccuacgcccagcuggaccacugcguguucacccagaccaagaucaccagccccagccagagacccaaggccccccccaccgacaccaccauguacauggagcugcccaacgccaagcccagaagccugagccccgcccacaagcaccacagccaggcccugagaggcagcagcagagagaccaccgcccugagccagaacagaguggccagcagccacgugcccgccgccggcaucuaa

SEQ ID NO: 18968 - RNA, 915 nt, Artificial Sequence
  KIR2DS1__Homo_sapiens__NP_055327
augagccugaccguggugagcauggccugcgugggcuucuuccugcugcagggcgccuggccccacgagggcgugcacagaaagcccagccugcuggcccaccccggcagacuggugaagagcgaggagaccgugauccugcagugcuggagcgacgugauguucgagcacuuccugcugcacagagagggcauguucaacgacacccugagacugaucggcgagcaccacgacggcgugagcaaggccaacuucagcaucagcagaaugaagcaggaccuggccggcaccuacagaugcuacggcagcgugacccacagccccuaccagcugagcgcccccagcgacccccuggacaucgugaucaucggccuguacgagaagcccagccugagcgcccagcccggccccaccgugcuggccggcgagaacgugacccugagcugcagcagcagaagcagcuacgacauguaccaccugagcagagagggcgaggcccacgagagaagacugcccgccggcaccaaggugaacggcaccuuccaggccaacuucccccugggccccgccacccacggcggcaccuacagaugcuucggcagcuucagagacagccccuacgaguggagcaagagcagcgacccccugcuggugagcgugaccggcaaccccagcaacagcuggcccagccccaccgagcccagcagcgagaccggcaaccccagacaccugcacgugcugaucggcaccagcguggugaagauccccuucaccauccugcuguucuuccugcugcacagauggugcagcgacaagaagaacgccgccgugauggaccaggagcccgccggcaacagaaccgugaacagcgaggacagcgacgagcaggaccaccaggaggugagcuacgccuaa

SEQ ID NO: 18969 - RNA, 1017 nt, Artificial Sequence
  KIR2DS2__Homo_sapiens__NP_001278624
augagccugaugguggugagcauggccugcgugggcuucuuccugcugcagggcgccuggccccacgagggcgugcacagaaagcccagccugcuggcccaccccggcccccuggugaagagcgaggagaccgugauccugcagugcuggagcgacgugagauucgagcacuuccugcugcacagagagggcaaguacaaggacacccugcaccugaucggcgagcaccacgacggcgugagcaaggccaacuucagcaucggccccaugaugcaggaccuggccggcaccuacagaugcuacggcagcgugacccacagccccuaccagcugagcgcccccagcgacccccuggacaucgugaucaccggccuguacgagaagcccagccugagcgcccagcccggccccaccgugcuggccggcgagagcgugacccugagcugcagcagcagaagcagcuacgacauguaccaccugagcagagagggcgaggcccacgagagaagauucagcgccggccccaaggugaacggcaccuuccaggccgacuucccccugggccccgccacccacggcggcaccuacagaugcuucggcagcuucagagacagccccuacgaguggagcaacagcagcgacccccugcuggugagcgugaccggcaaccccagcaacagcuggcccagccccaccgagcccagcagcaagaccggcaaccccagacaccugcacgugcugaucggcaccagcguggugaagauccccuucaccauccugcuguucuuccugcugcacagauggugcagcaacaagaagaacgccgccgugauggaccaggagcccgccggcaacagaaccgugaacagcgagagagagaucaccagacccagcgagagacccaagaccccccccaccgacaccagcauguacaucgagcugcccaacgccgagcccagaagcaaggugguguucugccccagagccccccagagcggccuggagggcaucuucuaa

SEQ ID NO: 18970 - RNA, 915 nt, Artificial Sequence
  KIR2DS3__Homo_sapiens__NP_036445
augagccugauggugaucagcauggccugcgugggcuucuucuggcugcagggcgccuggccccacgagggcuucagaagaaagcccagccugcuggcccaccccggcagacuggugaagagcgaggagaccgugauccugcagugcuggagcgacgugauguucgagcacuuccugcugcacagagagggcaccuucaacgacacccugagacugaucggcgagcacaucgacggcgugagcaaggccaacuucagcaucggcagaaugagacaggaccuggccggcaccuacagaugcuacggcagcgugccccacagccccuaccaguucagcgcccccagcgacccccuggacaucgugaucaccggccuguacgagaagcccagccugagcgcccagcccggccccaccgugcuggccggcgagagcgugacccugagcugcagcagcuggagcagcuacgacauguaccaccugagcaccgagggcgaggcccacgagagaagauucagcgccggccccaaggugaacggcaccuuccaggccgacuucccccugggccccgccacccagggcggcaccuacagaugcuucggcagcuuccacgacagccccuacgaguggagcaagagcagcgacccccugcuggugagcgugaccggcaaccccagcaacagcuggcccagccccaccgagcccagcagcaagaccggcaaccccagacaccugcacgugcugaucggcaccagcguggugaagcugcccuucaccauccugcuguucuuccugcugcacagauggugcagcgacaagaagaacgccagcgugauggaccagggccccgccggcaacagaaccgugaacagagaggacagcgacgagcaggaccaccaggaggugagcuacgccuaa

SEQ ID NO: 18971 - RNA, 915 nt, Artificial Sequence
  KIR2DS4__Homo_sapiens__NP_036446
augagccugauggugaucaucauggccugcgugggcuucuuccugcugcagggcgccuggccccaggagggcgugcacagaaagcccagcuuccuggcccugcccggccaccuggugaagagcgaggagaccgugauccugcagugcuggagcgacgugauguucgagcacuuccugcugcacagagagggcaaguucaacaacacccugcaccugaucggcgagcaccacgacggcgugagcaaggccaacuucagcaucggccccaugaugcccgugcuggccggcaccuacagaugcuacggcagcgugccccacagccccuaccagcugagcgcccccagcgacccccuggacauggugaucaucggccuguacgagaagcccagccugagcgcccagcccggccccaccgugcaggccggcgagaacgugacccugagcugcagcagcagaagcagcuacgacauguaccaccugagcagagagggcgaggcccacgagagaagacugcccgccgugagaagcaucaacggcaccuuccaggccgacuucccccugggccccgccacccacggcggcaccuacagaugcuucggcagcuucagagacgcccccuacgaguggagcaacagcagcgacccccugcuggugagcgugaccggcaaccccagcaacagcuggcccagccccaccgagcccagcagcaagaccggcaaccccagacaccugcacgugcugaucggcaccagcguggugaagauccccuucaccauccugcuguucuuccugcugcacagauggugcagcgacaagaagaacgccgccgugauggaccaggagcccgccggcaacagaaccgugaacagcgaggacagcgacgagcaggaccaccaggaggugagcuacgccuaa

SEQ ID NO: 18972 - RNA, 1335 nt, Artificial Sequence
  KIR3DL1__Homo_sapiens__NP_037421
augagccugaugguggugagcauggccugcgugggccuguuccuggugcagagagccggcccccacaugggcggccaggacaagcccuuccugagcgccuggcccagcgccguggugcccagaggcggccacgugacccugagaugccacuacagacacagauucaacaacuucaugcuguacaaggaggacagaauccacauccccaucuuccacggcagaaucuuccaggagagcuucaacaugagccccgugaccaccgcccacgccggcaacuacaccugcagaggcagccacccccacagccccaccggcuggagcgcccccagcaaccccguggugaucauggugaccggcaaccacagaaagcccagccugcuggcccaccccggcccccuggugaagagcggcgagagagugauccugcagugcuggagcgacaucauguucgagcacuucuuccugcacaaggagggcaucagcaaggaccccagcagacuggugggccagauccacgacggcgugagcaaggccaacuucagcaucggccccaugaugcuggcccuggccggcaccuacagaugcuacggcagcgugacccacacccccuaccagcugagcgcccccagcgacccccuggacaucguggugaccggccccuacgagaagcccagccugagcgcccagcccggccccaaggugcaggccggcgagagcgugacccugagcugcagcagcagaagcagcuacgacauguaccaccugagcagagagggcggcgcccacgagagaagacugcccgccgugagaaaggugaacagaaccuuccaggccgacuucccccugggccccgccacccacggcggcaccuacagaugcuucggcagcuucagacacagccccuacgaguggagcgaccccagcgacccccugcuggugagcgugaccggcaaccccagcagcagcuggcccagccccaccgagcccagcagcaagagcggcaaccccagacaccugcacauccugaucggcaccagcguggugaucauccuguucauccugcugcuguucuuccugcugcaccuguggugcagcaacaagaagaacgccgccgugauggaccaggagcccgccggcaacagaaccgccaacagcgaggacagcgacgagcaggaccccgaggaggugaccuacgcccagcuggaccacugcguguucacccagagaaagaucaccagacccagccagagacccaagaccccccccaccgacaccauccuguacaccgagcugcccaacgccaagcccagaagcaagguggugagcugccccuaa

SEQ ID NO: 18973 - RNA, 1317 nt, Artificial Sequence
  KIR3DL2__Homo_sapiens__NP_001229796
augagccugaccguggugagcauggccugcgugggcuucuuccugcugcagggcgccuggccccugaugggcggccaggacaagcccuuccugagcgccagacccagcaccguggugcccagaggcggccacguggcccugcagugccacuacagaagaggcuucaacaacuucaugcuguacaaggaggacagaagccacgugcccaucuuccacggcagaaucuuccaggagagcuucaucaugggccccgugacccccgcccacgccggcaccuacagaugcagaggcagcagaccccacagccugaccggcuggagcgcccccagcaacccccuggugaucauggugaccggcaaccacagaaagcccagccugcuggcccaccccggcccccugcugaagagcggcgagaccgugauccugcagugcuggagcgacgugauguucgagcacuucuuccugcacagagagggcaucagcgaggaccccagcagacuggugggccagauccacgacggcgugagcaaggccaacuucagcaucggcccccugaugcccgugcuggccggcaccuacagaugcuacggcagcgugccccacagccccuaccagcugagcgcccccagcgacccccuggacaucgugaucaccggccuguacgagaagcccagccugagcgcccagcccggccccaccgugcaggccggcgagaacgugacccugagcugcagcagcuggagcagcuacgacaucuaccaccugagcagagagggcgaggcccacgagagaagacugagagccgugcccaaggugaacagaaccuuccaggccgacuucccccugggccccgccacccacggcggcaccuacagaugcuucggcagcuucagagcccugcccugcguguggagcaacagcagcgacccccugcuggugagcgugaccggcaucugcagacaccugcacgugcugaucggcaccagcguggugaucuuccuguucauccugcugcuguucuuccugcuguacagauggugcagcaacaagaagaacgccgccgugauggaccaggagcccgccggcgacagaaccgugaacagacaggacagcgacgagcaggacccccaggaggugaccuacgcccagcuggaccacugcguguucauccagagaaagaucagcagacccagccagagacccaagaccccccugaccgacaccagcguguacaccgagcugcccaacgccgagcccagaagcaagguggugagcugccccagagccccccagagcggccuggagggcguguucuaa

SEQ ID NO: 18974 - RNA, 1233 nt, Artificial Sequence
  KIR3DL3__Homo_sapiens__NP_703144
augagccugaugguggugagcauggccugcgugggcuucuuccugcuggagggccccuggccccacgugggcggccaggacaagcccuuccugagcgccuggcccggcaccguggugagcgagggccagcacgugacccugcagugcagaagcagacugggcuucaacgaguucagccugagcaaggaggacggcaugcccgugcccgagcuguacaacagaaucuucagaaacagcuuccugaugggccccgugacccccgcccacgccggcaccuacagaugcugcagcagccacccccacagccccaccggcuggagcgcccccagcaaccccguggugaucauggugaccggcgugcacagaaagcccagccugcuggcccaccccggcccccuggugaagagcggcgagaccgugauccugcagugcuggagcgacgugagauucgagagauuccugcugcacagagagggcaucaccgaggacccccugagacuggugggccagcugcacgacgccggcagccaggugaacuacagcaugggccccaugacccccgcccuggccggcaccuacagaugcuucggcagcgugacccaccugcccuacgagcugagcgcccccagcgacccccuggacaucgugguggugggccuguacggcaagcccagccugagcgcccagcccggccccaccgugcaggccggcgagaacgugacccugagcugcagcagcagaagccuguucgacaucuaccaccugagcagagaggccgaggccggcgagcugagacugaccgccgugcugagagugaacggcaccuuccaggccaacuucccccugggccccgugacccacggcggcaacuacagaugcuucggcagcuucagagcccugccccacgccuggagcgaccccagcgacccccugcccgugagcgugaccggcaacagcagaaaccugcacgugcugaucggcaccagcguggugaucauccccuucgccauccugcuguucuuccugcugcacagauggugcgccaacaagaagaacgccguggugauggaccaggagcccgccggcaacagaaccgugaacagagaggacagcgacgagcaggacccccaggaggugaccuacgcccagcugaaccacugcguguucacccagagaaagaucaccagacccagccagagacccaagaccccccccaccgacaccagcguguaa

SEQ ID NO: 18975 - RNA, 1902 nt, Artificial Sequence
  KIRREL2__Homo_sapiens__NP_115499
augcugagaaugagagugcccgcccugcuggugcugcuguucugcuucagaggcagagccggccccagcccccacuuccugcagcagcccgaggaccugguggugcugcugggcgaggaggccagacugcccugcgcccugggcgccuacuggggccuggugcaguggaccaagagcggccuggcccugggcggccagagagaccugcccggcuggagcagauacuggaucagcggcaacgccgccaacggccagcacgaccugcacaucagacccguggagcuggaggacgaggccagcuacgagugccaggccacccaggccggccugagaagcagacccgcccagcugcacgugcuggugccccccgaggccccccaggugcugggcggccccagcgugagccugguggccggcgugcccgccaaccugaccugcagaagcagaggcgacgccagacccacccccgagcugcugugguucagagacggcgugcugcuggacggcgccaccuuccaccagacccugcugaaggagggcacccccggcagcguggagagcacccugacccugacccccuucagccacgacgacggcgccaccuucgugugcagagccagaagccaggcccugcccaccggcagagacaccgccaucacccugagccugcaguacccccccgaggugacccugagcgccagcccccacaccgugcaggagggcgagaaggugaucuuccugugccaggccaccgcccagccccccgugaccggcuacagaugggccaagggcggcagccccgugcugggcgccagaggccccagacuggaggugguggccgacgccagcuuccugaccgagcccgugagcugcgaggugagcaacgccgugggcagcgccaacagaagcaccgcccuggacgugcuguucggccccauccugcaggccaagcccgagcccgugagcguggacgugggcgaggacgccagcuucagcugcgccuggagaggcaacccccugcccagagugaccuggaccagaagaggcggcgcccaggugcugggcagcggcgccacccugagacugcccagcgugggccccgaggacgccggcgacuacgugugcagagccgaggccggccugagcggccugagaggcggcgccgccgaggccagacugaccgugaacgccccccccguggugaccgcccugcacagcgcccccgccuuccugagaggccccgccagacugcagugccugguguucgccagccccgcccccgacgccgugguguggagcugggacgagggcuuccuggaggccggcagccagggcagauuccugguggagaccuuccccgcccccgagagcagaggcggccugggccccggccugaucagcgugcugcacaucagcggcacccaggagagcgacuucagcagaagcuucaacugcagcgccagaaacagacugggcgagggcggcgcccaggccagccugggcagaagagaccugcugcccaccgugagaaucguggccggcguggccgccgccaccaccacccugcugauggugaucaccggcguggcccugugcugcuggagacacagcaaggccagcgccagcuucagcgagcagaagaaccugaugagaauccccggcagcagcgacggcagcagcagcagaggccccgaggaggaggagaccggcagcagagaggacagaggccccaucgugcacaccgaccacagcgaccuggugcuggaggaggagggcacccuggagaccaaggaccccaccaacggcuacuacaaggugagaggcgugagcccccccgccagccccgacagcagagugaccagcuuccaguggaagagccccggcaucagcaaccugcccuaa

SEQ ID NO: 18976 - RNA, 1803 nt, Artificial Sequence
  KIRREL3__Homo_sapiens__NP_001155179
augaagcccuuccagcuggaccugcuguucgugugcuucuuccuguucagccaggagcugggccugcagaagagaggcugcugccuggugcugggcuacauggccaaggacaaguucagaagaaugaacgagggccagguguacagcuucagccagcagccccaggaccaggugguggugagcggccagcccgugacccugcugugcgccauccccgaguacgacggcuucgugcuguggaucaaggacggccuggcccugggcgugggcagagaccugagcagcuacccccaguaccugguggugggcaaccaccugagcggcgagcaccaccugaagauccugagagccgagcugcaggacgacgccguguacgagugccaggccauccaggccgccaucagaagcagacccgccagacugaccgugcuggugccccccgacgaccccgugauccugggcggccccgugaucagccugagagccggcgacccccugaaccugaccugccacgccgacaacgccaagcccgccgccagcaucaucuggcugagaaagggcgaggugaucaacggcgccaccuacagcaagacccugcugagagacggcaagagagagagcaucgugagcacccuguucaucagccccggcgacguggagaacggccagagcaucgugugcagagccaccaacaaggccauccccggcggcaaggagaccagcgugaccaucgacauccagcaccccccccuggugaaccugagcguggagccccagcccgugcuggaggacaacguggugaccuuccacugcagcgccaaggccaaccccgccgugacccaguacagaugggccaagagaggccagaucaucaaggaggccagcggcgagguguacagaaccaccguggacuacaccuacuucagcgagcccgugagcugcgaggugaccaacgcccugggcagcaccaaccugagcagaaccguggacguguacuucggccccagaaugaccaccgagccccagagccugcugguggaccugggcagcgacgccaucuucagcugcgccuggaccggcaaccccagccugaccaucguguggaugaagagaggcagcggcguggugcugagcaacgagaagacccugacccugaagagcgugagacaggaggacgccggcaaguacgugugcagagccguggugcccagagugggcgccggcgagagagaggugacccugaccgugaacggcccccccaucaucagcagcacccagacccagcacgcccugcacggcgagaagggccagaucaagugcuucaucagaagcacccccccccccgacagaaucgccuggagcuggaaggagaacgugcuggagagcggcaccagcggcagauacaccguggagaccaucagcaccgaggagggcgugaucagcacccugaccaucagcaacaucgugagagccgacuuccagaccaucuacaacugcaccgccuggaacagcuucggcagcgacaccgagaucaucagacugaaggagcagggcagcgagaugaagagcggcgccggccuggaggccgagagcgugcccauggccgugaucaucggcguggccgugggcgccggcguggccuuccuggugcugauggccaccaucguggccuucugcugcgccagaagccagagaagcaccggcggcagaagcggcaucagcggcagaggcaccgagaagaaggccagacugagacugcccagaagagccagcaagcaggagugcaacgagcagggcagcuaa

SEQ ID NO: 18977 - RNA, 1974 nt, Artificial Sequence
  KIRREL__Homo_sapiens__NP_001273278
augcugagccugcugguguggauccugacccugagcgacaccuucagccaggugccccccgaggacaccagaaucgacggcggccccgugauccugcugcaggccggcaccccccacaaccugaccugcagagccuucaacgccaagcccgccgccaccaucaucugguucagagacggcacccagcaggagggcgccguggccagcaccgagcugcugaaggacggcaagagagagaccaccgugagccagcugcugaucaaccccaccgaccuggacaucggcagaguguucaccugcagaagcaugaacgaggccauccccagcggcaaggagaccagcaucgagcuggacgugcaccacccccccaccgugacccugagcaucgagccccagaccgugcaggagggcgagagagugguguucaccugccaggccaccgccaaccccgagauccugggcuacagaugggccaagggcggcuuccugaucgaggacgcccacgagagcagauacgagaccaacguggacuacagcuucuucaccgagcccgugagcugcgaggugcacaacaaggugggcagcaccaacgugagcacccuggugaacgugcacuucgcccccagaaucgugguggaccccaagcccaccaccaccgacaucggcagcgacgugacccugaccugcgugugggugggcaaccccccccugacccugaccuggaccaagaaggacagcaacauggugcugagcaacagcaaccagcugcugcugaagagcgugacccaggccgacgccggcaccuacaccugcagagccaucgugcccagaaucggcguggccgagagagaggugccccuguacgugaacggcccccccaucaucagcagcgaggccgugcaguacgccgugagaggcgacggcggcaagguggagugcuucaucggcagcacccccccccccgacagaaucgccugggccuggaaggagaacuuccuggaggugggcacccuggagagauacaccguggagagaaccaacagcggcagcggcgugcugagcacccugaccaucaacaacgugauggaggccgacuuccagacccacuacaacugcaccgccuggaacagcuucggccccggcaccgccaucauccagcuggaggagagagaggugcugcccgugggcaucaucgccggcgccaccaucggcgccagcauccugcugaucuucuucuucaucgcccugguguucuuccuguacagaagaagaaagggcagcagaaaggacgugacccugagaaagcuggacaucaagguggagaccgugaacagagagccccugaccaugcacagcgacagagaggacgacaccgccagcgugagcaccgccaccagagugaugaaggccaucuacagcagcuucaaggacgacguggaccugaagcaggaccugagaugcgacaccaucgacaccagagaggaguacgagaugaaggaccccaccaacggcuacuacaacgugagagcccacgaggacagacccagcagcagagccgugcuguacgccgacuacagagcccccggccccgccagauucgacggcagacccagcagcagacugagccacagcagcggcuacgcccagcugaacaccuacagcagaggccccgccagcgacuacggccccgagcccaccccccccggccccgccgcccccgccggcaccgacaccaccagccagcugagcuacgagaacuacgagaaguucaacagccaccccuuccccggcgccgccggcuaccccaccuacagacugggcuacccccaggccccccccagcggccuggagagaacccccuacgaggccuacgaccccaucggcaaguacgccaccgccaccagauucagcuacaccagccagcacagcgacuacggccagagauuccagcagagaaugcagacccacguguaa

SEQ ID NO: 18978 - RNA, 417 nt, Artificial Sequence
  KISS1__Homo_sapiens__XP_011507827
augaacagccuggugagcuggcagcugcugcuguuccugugcgccacccacuucggcgagccccuggagaagguggccagcgugggcaacagcagacccaccggccagcagcuggagagccugggccugcuggcccccggcgagcagagccugcccugcaccgagagaaagcccgccgccaccgccagacugagcagaagaggcaccagccugagccccccccccgagagcagcggcagcccccagcagcccggccugagcgccccccacagcagacagauccccgccccccagggcgccgugcuggugcagagagagaaggaccugcccaacuacaacuggaacagcuucggccugagauucggcaagagagaggccgcccccggcaaccacggcagaagcgccggcagaggcuaa

SEQ ID NO: 18979 - RNA, 1197 nt, Artificial Sequence
  KISS1R__Homo_sapiens__NP_115940
augcacaccguggccaccagcggccccaacgccagcuggggcgcccccgccaacgccagcggcugccccggcugcggcgccaacgccagcgacggccccgugcccagccccagagccguggacgccuggcuggugccccuguucuucgccgcccugaugcugcugggccuggugggcaacagccuggugaucuacgugaucugcagacacaagcccaugagaaccgugaccaacuucuacaucgccaaccuggccgccaccgacgugaccuuccugcugugcugcgugcccuucaccgcccugcuguacccccugcccggcugggugcugggcgacuucaugugcaaguucgugaacuacauccagcaggugagcgugcaggccaccugcgccacccugaccgccaugagcguggacagaugguacgugaccguguucccccugagagcccugcacagaagaacccccagacuggcccuggccgugagccugagcaucugggugggcagcgccgccgugagcgcccccgugcuggcccugcacagacugagccccggccccagagccuacugcagcgaggccuuccccagcagagcccuggagagagccuucgcccuguacaaccugcuggcccuguaccugcugccccugcuggccaccugcgccugcuacgccgccaugcugagacaccugggcagaguggccgugagacccgcccccgccgacagcgcccugcagggccaggugcuggccgagagagccggcgccgugagagccaaggugagcagacugguggccgccguggugcugcuguucgccgccugcuggggccccauccagcuguuccuggugcugcaggcccugggccccgccggcagcuggcaccccagaagcuacgccgccuacgcccugaagaccugggcccacugcaugagcuacagcaacagcgcccugaacccccugcuguacgccuuccugggcagccacuucagacaggccuucagaagagugugccccugcgcccccagaagacccagaagacccagaagacccggccccagcgaccccgccgccccccacgccgagcugcugagacugggcagccaccccgcccccgccagagcccagaagcccggcagcagcggccuggccgccagaggccugugcgugcugggcgaggacaacgccccccuguaa

SEQ ID NO: 18980 - RNA, 2931 nt, Artificial Sequence
  KIT__Homo_sapiens__NP_000213
augagaggcgccagaggcgccugggacuuccugugcgugcugcugcugcugcugagagugcagaccggcagcagccagcccagcgugagccccggcgagcccagcccccccagcauccaccccggcaagagcgaccugaucgugagagugggcgacgagaucagacugcugugcaccgaccccggcuucgugaaguggaccuucgagauccuggacgagaccaacgagaacaagcagaacgaguggaucaccgagaaggccgaggccaccaacaccggcaaguacaccugcaccaacaagcacggccugagcaacagcaucuacguguucgugagagaccccgccaagcuguuccugguggacagaagccuguacggcaaggaggacaacgacacccuggugagaugcccccugaccgaccccgaggugaccaacuacagccugaagggcugccagggcaagccccugcccaaggaccugagauucauccccgaccccaaggccggcaucaugaucaagagcgugaagagagccuaccacagacugugccugcacugcagcguggaccaggagggcaagagcgugcugagcgagaaguucauccugaaggugagacccgccuucaaggccgugcccguggugagcgugagcaaggccagcuaccugcugagagagggcgaggaguucaccgugaccugcaccaucaaggacgugagcagcagcguguacagcaccuggaagagagagaacagccagaccaagcugcaggagaaguacaacagcuggcaccacggcgacuucaacuacgagagacaggccacccugaccaucagcagcgccagagugaacgacagcggcguguucaugugcuacgccaacaacaccuucggcagcgccaacgugaccaccacccuggaggugguggacaagggcuucaucaacaucuuccccaugaucaacaccaccguguucgugaacgacggcgagaacguggaccugaucguggaguacgaggccuuccccaagcccgagcaccagcaguggaucuacaugaacagaaccuucaccgacaagugggaggacuaccccaagagcgagaacgagagcaacaucagauacgugagcgagcugcaccugaccagacugaagggcaccgagggcggcaccuacaccuuccuggugagcaacagcgacgugaacgccgccaucgccuucaacguguacgugaacaccaagcccgagauccugaccuacgacagacuggugaacggcaugcugcagugcguggccgccggcuuccccgagcccaccaucgacugguacuucugccccggcaccgagcagagaugcagcgccagcgugcugcccguggacgugcagacccugaacagcagcggcccccccuucggcaagcugguggugcagagcagcaucgacagcagcgccuucaagcacaacggcaccguggagugcaaggccuacaacgacgugggcaagaccagcgccuacuucaacuucgccuucaagggcaacaacaaggagcagauccacccccacacccuguucaccccccugcugaucggcuucgugaucguggccggcaugaugugcaucaucgugaugauccugaccuacaaguaccugcagaagcccauguacgaggugcaguggaaggugguggaggagaucaacggcaacaacuacguguacaucgaccccacccagcugcccuacgaccacaagugggaguuccccagaaacagacugagcuucggcaagacccugggcgccggcgccuucggcaaggugguggaggccaccgccuacggccugaucaagagcgacgccgccaugaccguggccgugaagaugcugaagcccagcgcccaccugaccgagagagaggcccugaugagcgagcugaaggugcugagcuaccugggcaaccacaugaacaucgugaaccugcugggcgccugcaccaucggcggccccacccuggugaucaccgaguacugcugcuacggcgaccugcugaacuuccugagaagaaagagagacagcuucaucugcagcaagcaggaggaccacgccgaggccgcccuguacaagaaccugcugcacagcaaggagagcagcugcagcgacagcaccaacgaguacauggacaugaagcccggcgugagcuacguggugcccaccaaggccgacaagagaagaagcgugagaaucggcagcuacaucgagagagacgugacccccgccaucauggaggacgacgagcuggcccuggaccuggaggaccugcugagcuucagcuaccagguggccaagggcauggccuuccuggccagcaagaacugcauccacagagaccuggccgccagaaacauccugcugacccacggcagaaucaccaagaucugcgacuucggccuggccagagacaucaagaacgacagcaacuacguggugaagggcaacgccagacugcccgugaaguggauggcccccgagagcaucuucaacugcguguacaccuucgagagcgacguguggagcuacggcaucuuccugugggagcuguucagccugggcagcagccccuaccccggcaugcccguggacagcaaguucuacaagaugaucaaggagggcuucagaaugcugagccccgagcacgcccccgccgagauguacgacaucaugaagaccugcugggacgccgacccccugaagagacccaccuucaagcagaucgugcagcugaucgagaagcagaucagcgagagcaccaaccacaucuacagcaaccuggccaacugcagccccaacagacagaagcccgugguggaccacagcgugagaaucaacagcgugggcagcaccgccagcagcagccagccccugcuggugcacgacgacguguaa

SEQ ID NO: 18981 - RNA, 822 nt, Artificial Sequence
  KITLG__Homo_sapiens__NP_000890
augaagaagacccagaccuggauccugaccugcaucuaccugcagcugcugcuguucaacccccuggugaagaccgagggcaucugcagaaacagagugaccaacaacgugaaggacgugaccaagcugguggccaaccugcccaaggacuacaugaucacccugaaguacgugcccggcauggacgugcugcccagccacugcuggaucagcgagaugguggugcagcugagcgacagccugaccgaccugcuggacaaguucagcaacaucagcgagggccugagcaacuacagcaucaucgacaagcuggugaacaucguggacgaccugguggagugcgugaaggagaacagcagcaaggaccugaagaagagcuucaagagccccgagcccagacuguucacccccgaggaguucuucagaaucuucaacagaagcaucgacgccuucaaggacuucgugguggccagcgagaccagcgacugcguggugagcagcacccugagccccgagaaggacagcagagugagcgugaccaagcccuucaugcugccccccguggccgccagcagccugagaaacgacagcagcagcagcaacagaaaggccaagaacccccccggcgacagcagccugcacugggccgccauggcccugcccgcccuguucagccugaucaucggcuucgccuucggcgcccuguacuggaagaagagacagcccagccugaccagagccguggagaacauccagaucaacgaggaggacaacgagaucagcaugcugcaggagaaggagagagaguuccaggagguguaa

SEQ ID NO: 18982 - RNA, 3135 nt, Artificial Sequence
  KLB__Homo_sapiens__NP_783864
augaagcccggcugcgccgccggcagccccggcaacgaguggaucuucuucagcaccgacgagaucaccaccagauacagaaacaccaugagcaacggcggccugcagagaagcgugauccugagcgcccugauccugcugagagccgugaccggcuucagcggcgacggcagagccaucuggagcaagaaccccaacuucacccccgugaacgagagccagcuguuccuguacgacaccuuccccaagaacuucuucuggggcaucggcaccggcgcccugcagguggagggcagcuggaagaaggacggcaagggccccagcaucugggaccacuucauccacacccaccugaagaacgugagcagcaccaacggcagcagcgacagcuacaucuuccuggagaaggaccugagcgcccuggacuucaucggcgugagcuucuaccaguucagcaucagcuggcccagacuguuccccgacggcaucgugaccguggccaacgccaagggccugcaguacuacagcacccugcuggacgcccuggugcugagaaacaucgagcccaucgugacccuguaccacugggaccugccccuggcccugcaggagaaguacggcggcuggaagaacgacaccaucaucgacaucuucaacgacuacgccaccuacugcuuccagauguucggcgacagagugaaguacuggaucaccauccacaaccccuaccugguggccuggcacggcuacggcaccggcaugcacgcccccggcgagaagggcaaccuggccgccguguacaccgugggccacaaccugaucaaggcccacagcaagguguggcacaacuacaacacccacuucagaccccaccagaagggcuggcugagcaucacccugggcagccacuggaucgagcccaacagaagcgagaacaccauggacaucuucaagugccagcagagcauggugagcgugcugggcugguucgccaaccccauccacggcgacggcgacuaccccgagggcaugagaaagaagcuguucagcgugcugcccaucuucagcgaggccgagaagcacgagaugagaggcaccgccgacuucuucgccuucagcuucggccccaacaacuucaagccccugaacaccauggccaagaugggccagaacgugagccugaaccugagagaggcccugaacuggaucaagcuggaguacaacaaccccagaauccugaucgccgagaacggcugguucaccgacagcagagugaagaccgaggacaccaccgccaucuacaugaugaagaacuuccugagccaggugcugcaggccaucagacuggacgagaucagaguguucggcuacaccgccuggagccugcuggacggcuucgaguggcaggacgccuacaccaucagaagaggccuguucuacguggacuucaacagcaagcagaaggagagaaagcccaagagcagcgcccacuacuacaagcagaucaucagagagaacggcuucagccugaaggagagcacccccgacgugcagggccaguuccccugcgacuucagcuggggcgugaccgagagcgugcugaagcccgagagcguggccagcagcccccaguucagcgacccccaccuguacguguggaacgccaccggcaacagacugcugcacagaguggagggcgugagacugaagaccagacccgcccagugcaccgacuucgugaacaucaagaagcagcuggagaugcuggccagaaugaaggugacccacuacagauucgcccuggacugggccagcgugcugcccaccggcaaccugagcgccgugaacagacaggcccugagauacuacagaugcguggugagcgagggccugaagcugggcaucagcgccauggugacccuguacuaccccacccacgcccaccugggccugcccgagccccugcugcacgccgacggcuggcugaaccccagcaccgccgaggccuuccaggccuacgccggccugugcuuccaggagcugggcgaccuggugaagcuguggaucaccaucaacgagcccaacagacugagcgacaucuacaacagaagcggcaacgacaccuacggcgccgcccacaaccugcugguggcccacgcccuggccuggagacuguacgacagacaguucagacccagccagagaggcgccgugagccugagccugcacgccgacugggccgagcccgccaaccccuacgccgacagccacuggagagccgccgagagauuccugcaguucgagaucgccugguucgccgagccccuguucaagaccggcgacuaccccgccgccaugagagaguacaucgccagcaagcacagaagaggccugagcagcagcgcccugcccagacugaccgaggccgagagaagacugcugaagggcaccguggacuucugcgcccugaaccacuucaccaccagauucgugaugcacgagcagcuggccggcagcagauacgacagcgacagagacauccaguuccugcaggacaucaccagacugagcagccccaccagacuggccgugauccccuggggcgugagaaagcugcugagaugggugagaagaaacuacggcgacauggacaucuacaucaccgccagcggcaucgacgaccaggcccuggaggacgacagacugagaaaguacuaccugggcaaguaccugcaggaggugcugaaggccuaccugaucgacaaggugagaaucaagggcuacuacgccuucaagcuggccgaggagaagagcaagcccagauucggcuucuucaccagcgacuucaaggccaagagcagcauccaguucuacaacaaggugaucagcagcagaggcuuccccuucgagaacagcagcagcagaugcagccagacccaggagaacaccgagugcaccgugugccuguuccuggugcagaagaagccccugaucuuccugggcugcugcuucuucagcacccuggugcugcugcugagcaucgccaucuuccagagacagaagagaagaaaguucuggaaggccaagaaccugcagcacaucccccugaagaagggcaagagaguggugagcuaa

SEQ ID NO: 18983 - RNA, 1857 nt, Artificial Sequence
  KLC1__Homo_sapiens__NP_001123579
auguacgacaacaugagcaccaugguguacaucaaggaggacaagcuggagaagcugacccaggacgagaucaucagcaagaccaagcaggugauccagggccuggaggcccugaagaacgagcacaacagcauccugcagagccugcuggagacccugaagugccugaagaaggacgacgagagcaaccugguggaggagaagagcaacaugaucagaaagagccuggagaugcuggagcugggccugagcgaggcccaggugaugauggcccugagcaaccaccugaacgccguggagagcgagaagcagaagcugagagcccaggugagaagacugugccaggagaaccaguggcugagagacgagcuggccaacacccagcagaagcugcagaagagcgagcagagcguggcccagcuggaggaggagaagaagcaccuggaguucaugaaccagcugaagaaguacgacgacgacaucagccccagcgaggacaaggacaccgacagcaccaaggagccccuggacgaccuguuccccaacgacgaggacgaccccggccagggcauccagcagcagcacagcagcgccgccgccgccgcccagcagggcggcuacgagauccccgccagacugagaacccugcacaaccuggugauccaguacgccagccagggcagauacgagguggccgugccccugugcaagcaggcccuggaggaccuggagaagaccagcggccacgaccaccccgacguggccaccaugcugaacauccuggcccugguguacagagaccagaacaaguacaaggacgccgccaaccugcugaacgacgcccuggccaucagagagaagacccugggcaaggaccaccccgccguggccgccacccugaacaaccuggccgugcuguacggcaagagaggcaaguacaaggaggccgagccccugugcaagagagcccuggagaucagagagaaggugcugggcaaggaccaccccgacguggccaagcagcugaacaaccuggcccugcugugccagaaccagggcaaguacgaggagguggaguacuacuaccagagagcccuggagaucuaccagaccaagcugggccccgacgaccccaacguggccaagaccaagaacaaccuggccagcugcuaccugaagcagggcaaguucaagcaggccgagacccuguacaaggagauccugaccagagcccacgagagagaguucggcagcguggacgacgagaacaagcccaucuggaugcacgccgaggagagagaggagugcaagggcaagcagaaggacggcaccagcuucggcgaguacggcggcugguacaaggccugcaagguggacagccccaccgugaccaccacccugaagaaccugggcgcccuguacagaagacagggcaaguucgaggccgccgagacccuggaggaggccgccaugagaagcagaaagcagggccuggacaacgugcacaagcagagaguggccgaggugcugaacgaccccgagaacauggagaagagaagaagcagagagagccugaacguggacguggugaaguacgagagcggccccgacggcggcgaggaggugagcaugagcguggaguggaacggcgacggcaccggcagccugaagagaagcggcagcuucagcaagcugagagccagcaucagaagaagcagcgagaagcuggugagaaagcugaagggcggcagcagcagagagagcgagcccaagaaccccggcgccagccuggccgagccccuguucguggagaacgacagcagcagcagcggccuggaggacgccaccgccaacuaa

SEQ ID NO: 18984 - RNA, 1410 nt, Artificial Sequence
  KLF10__Homo_sapiens__NP_001027453
auggaggagagaauggagaugaucagcgagagacccaaggagagcauguacagcuggaacaagaccgccgagaagagcgacuucgaggccguggaggcccugaugagcaugagcugcagcuggaagagcgacuucaagaaguacguggagaacagacccgugacccccgugagcgaccugagcgaggaggagaaccugcugcccggcacccccgacuuccacaccauccccgccuucugccugaccccccccuacagccccagcgacuucgagcccagccaggugagcaaccugauggcccccgcccccagcaccgugcacuucaagagccugagcgacaccgccaagccccacaucgccgcccccuucaaggaggaggagaagagccccgugagcgcccccaagcugcccaaggcccaggccaccagcgugaucagacacaccgccgacgcccagcugugcaaccaccagaccugccccaugaaggccgccagcauccugaacuaccagaacaacagcuucagaagaagaacccaccugaacguggaggccgccagaaagaacauccccugcgccgccgugagccccaacagaagcaagugcgagagaaacaccguggccgacguggacgagaaggccagcgccgcccuguacgacuucagcgugcccagcagcgagaccgugaucugcagaagccagcccgcccccgugagcccccagcagaagagcgugcuggugagcccccccgccgugagcgccggcggcgugccccccaugcccgugaucugccagauggugccccugcccgccaacaaccccguggugaccaccguggugcccagcaccccccccagccagccccccgccgugugcccccccgugguguucaugggcacccaggugcccaagggcgccgugauguucguggugccccagcccguggugcagagcagcaagccccccguggugagccccaacggcaccagacugagccccaucgcccccgcccccggcuucagccccagcgccgccaaggugaccccccagaucgacagcagcagaaucagaagccacaucugcagccaccccggcugcggcaagaccuacuucaagagcagccaccugaaggcccacaccagaacccacaccggcgagaagcccuucagcugcagcuggaagggcugcgagagaagauucgccagaagcgacgagcugagcagacacagaagaacccacaccggcgagaagaaguucgccugccccaugugcgacagaagauucaugagaagcgaccaccugaccaagcacgccagaagacaccugagcgccaagaagcugcccaacuggcagauggaggugagcaagcugaacgacaucgcccugccccccacccccgcccccacccaguaa

SEQ ID NO: 18985 - RNA, 1539 nt, Artificial Sequence
  KLF11__Homo_sapiens__NP_003588
augcacacccccgacuucgccggccccgacgacgccagagccguggacaucauggacaucugcgagagcauccuggagagaaagagacacgacagcgagagaagcaccugcagcauccuggagcagaccgacauggaggccguggaggcccuggugugcaugagcagcuggggccagagaagccagaagggcgaccugcugagaaucagaccccugacccccgugagcgacagcggcgacgugaccaccaccgugcacauggacgccgccacccccgagcugcccaaggacuuccacagccugagcacccugugcaucacccccccccagagccccgaccugguggagcccagcaccagaacccccgugagcccccaggugaccgacagcaaggccugcaccgccaccgacgugcugcagagcagcgccgugguggccagagcccugagcggcggcgccgagagaggccugcugggccuggagcccgugcccagcagccccugcagagccaagggcaccagcgugaucagacacaccggcgagagccccgccgccugcuuccccaccauccagacccccgacugcagacugagcgacagcagagagggcgaggagcagcugcugggccacuucgagacccugcaggacacccaccugaccgacagccugcugagcaccaaccuggugagcugccagcccugccugcacaagagcggcggccugcugcugaccgacaagggccagcaggccggcuggcccggcgccgugcagaccugcagccccaagaacuacgagaacgaccugcccagaaagaccaccccccugaucagcgugagcgugcccgccccccccgugcugugccagaugauccccgugaccggccagagcagcaugcugcccgccuuccugaagccccccccccagcugagcgugggcaccgugagacccauccuggcccaggccgcccccgccccccagcccguguucgugggccccgccgugccccagggcgccgugaugcuggugcugccccagggcgcccugcccccccccgcccccugcgccgccaacgugauggccgccggcaacaccaagcugcugccccuggcccccgcccccguguucaucaccagcagccagaacugcgugccccagguggacuucagcagaagaagaaacuacgugugcagcuuccccggcugcagaaagaccuacuucaagagcagccaccugaaggcccaccugagaacccacaccggcgagaagcccuucaacugcagcugggacggcugcgacaagaaguucgccagaagcgacgagcugagcagacacagaagaacccacaccggcgagaagaaguucgugugccccgugugcgacagaagauucaugagaagcgaccaccugaccaagcacgccagaagacacaugaccaccaagaagauccccggcuggcaggccgaggugggcaagcugaacagaaucgccagcgccgagagccccggcagcccccuggugagcaugcccgccagcgccuaa

SEQ ID NO: 18986 - RNA, 1209 nt, Artificial Sequence
  KLF12__Homo_sapiens__XP_011533211
augaacauccacaugaagagaaagaccaucaagaacaucaacaccuucgagaacagaaugcugaugcuggacggcaugcccgccgugagagugaagaccgagcugcuggagagcgagcagggcagccccaacgugcacaacuaccccgacauggaggccgugccccugcugcugaacaacgugaagggcgagccccccgaggacagccugagcguggaccacuuccagacccagaccgagcccguggaccugagcaucaacaaggccagaaccagccccaccgccgugagcagcagccccgugagcaugaccgccagcgccagcagccccagcagcaccagcaccagcagcagcagcagcagcagacuggccagcagccccaccgugaucaccagcgugagcagcgccagcagcagcagcaccgugcugacccccggcccccugguggccagcgccagcggcgugggcggccagcaguuccugcacaucauccaccccgugccccccagcagccccaugaaccugcagagcaacaagcugagccacgugcacagaauccccgugguggugcagagcgugcccgugguguacaccgccgugagaagccccggcaacgugaacaacaccaucguggugccccugcuggaggacggcagaggccacggcaaggcccagauggaccccagaggccugagccccagacagagcaagagcgacagcgacgacgacgaccugcccaacgugacccuggacagcgugaacgagaccggcagcaccgcccugagcaucgccagagccgugcaggaggugcaccccagccccgugagcagagugagaggcaacagaaugaacaaccagaaguuccccugcagcaucagccccuucagcaucgagagcaccagaagacagagaagaagcgagagccccgacagcagaaagagaagaauccacagaugcgacuucgagggcugcaacaagguguacaccaagagcagccaccugaaggcccacagaagaacccacaccggcgagaagcccuacaagugcaccugggagggcugcaccuggaaguucgccagaagcgacgagcugaccagacacuacagaaagcacaccggcgugaagcccuucaagugcgccgacugcgacagaagcuucagcagaagcgaccaccuggcccugcacagaagaagacacaugcugguguaa

SEQ ID NO: 18987 - RNA, 867 nt, Artificial Sequence
  KLF13__Homo_sapiens__NP_057079
auggccgccgccgccuacguggaccacuucgccgccgagugccuggugagcaugagcagcagagccguggugcacggccccagagagggccccgagagcagacccgagggcgccgccguggccgccacccccacccugcccagaguggaggagagaagagacggcaaggacagcgccagccuguucgugguggccagaauccuggccgaccugaaccagcaggcccccgcccccgcccccgccgagagaagagagggcgccgccgccagaaaggccagaacccccugcagacugcccccccccgcccccgagcccaccagccccggcgccgagggcgccgccgccgccccccccagccccgccuggagcgagcccgagcccgaggccggccuggagcccgagagagagcccggccccgccggcagcggcgagcccggccugagacagagagugagaagaggcagaagcagagccgaccuggagagcccccagagaaagcacaagugccacuacgccggcugcgagaagguguacggcaagagcagccaccugaaggcccaccugagaacccacaccggcgagagacccuucgccugcagcuggcaggacugcaacaagaaguucgccagaagcgacgagcuggccagacacuacagaacccacaccggcgagaagaaguucagcugccccaucugcgagaagagauucaugagaagcgaccaccugaccaagcacgccagaagacacgccaacuuccaccccggcaugcugcagagaagaggcggcggcagcagaaccggcagccugagcgacuacagcagaagcgacgccagcagccccaccaucagccccgccagcagccccuaa

SEQ ID NO: 18988 - RNA, 972 nt, Artificial Sequence
  KLF14__Homo_sapiens__NP_619638
augagcgccgccguggccugccuggacuacuucgccgccgagugccuggugagcaugagcgccggcgccguggugcacagaagaccccccgaccccgagggcgccggcggcgccgccggcagcgaggugggcgccgccccccccgagagcgcccugcccggccccggcccccccggccccgccagcgugccccagcugccccaggugcccgcccccagccccggcgccggcggcgccgccccccaccugcuggccgccagcgugugggccgaccugagaggcagcagcggcgagggcagcugggagaacagcggcgaggcccccagagccagcagcggcuucagcgaccccauccccugcagcgugcagacccccugcagcgagcuggcccccgccagcggcgccgccgccgugugcgcccccgagagcagcagcgacgcccccgccgugcccagcgcccccgccgcccccggcgcccccgccgccagcggcggcuucagcggcggcgcccugggcgccggccccgcccccgccgccgaccaggcccccagaagaagaagcgugacccccgccgccaagagacaccagugccccuuccccggcugcaccaaggccuacuacaagagcagccaccugaagagccaccagagaacccacaccggcgagagacccuucagcugcgacuggcuggacugcgacaagaaguucaccagaagcgacgagcuggccagacacuacagaacccacaccggcgagaagagauucagcugcccccugugccccaagcaguucagcagaagcgaccaccugaccaagcacgccagaagacaccccaccuaccaccccgacaugaucgaguacagaggcagaagaagaacccccagaaucgaccccccccugaccagcgagguggagagcagcgccagcggcagcggccccggccccgcccccagcuucaccaccugccuguaa

SEQ ID NO: 18989 - RNA, 1251 nt, Artificial Sequence
  KLF15__Homo_sapiens__NP_054798
augguggaccaccugcugcccguggacgagaacuucagcagccccaagugccccgugggcuaccugggcgacagacuggugggcagaagagccuaccacaugcugcccagccccgugagcgaggacgacagcgacgccagcagccccugcagcugcagcagccccgacagccaggcccugugcagcugcuacggcggcggccugggcaccgagagccaggacagcauccuggacuuccugcugagccaggccacccugggcagcggcggcggcagcggcagcagcaucggcgccagcagcggccccguggccuggggccccuggagaagagccgccgcccccgugaagggcgagcacuucugccugcccgaguucccccugggcgaccccgacgacgugcccagacccuuccagcccacccuggaggagaucgaggaguuccuggaggagaacauggagcccggcgugaaggaggugcccgagggcaacagcaaggaccuggacgccugcagccagcugagcgccggcccccacaagagccaccugcaccccggcagcagcggcagagagagaugcagccccccccccggcggcgccagcgccggcggcgcccagggccccggcggcggccccacccccgacggccccauccccgugcugcugcagauccagcccgugcccgugaagcaggagagcggcaccggccccgccagccccggccaggcccccgagaacgugaagguggcccagcugcuggugaacauccagggccagaccuucgcccuggugccccagguggugcccagcagcaaccugaaccugcccagcaaguucgugagaaucgcccccgugcccaucgccgccaagcccgugggcagcggcccccugggccccggccccgccggccugcugaugggccagaaguuccccaagaaccccgccgccgagcugaucaagaugcacaagugcaccuuccccggcugcagcaagauguacaccaagagcagccaccugaaggcccaccugagaagacacaccggcgagaagcccuucgccugcaccuggcccggcugcggcuggagauucagcagaagcgacgagcugagcagacacagaagaagccacagcggcgugaagcccuaccagugccccgugugcgagaagaaguucgccagaagcgaccaccugagcaagcacaucaaggugcacagauuccccagaagcagcagaagcgugagaagcgugaacuaa

SEQ ID NO: 18990 - RNA, 759 nt, Artificial Sequence
  KLF16__Homo_sapiens__NP_114124
augagcgccgccguggccugcguggacuacuucgccgccgacgugcugauggccaucagcagcggcgccguggugcacagaggcagacccggccccgagggcgccggccccgccgccggccuggacgugagagccgccagaagagaggccgccagccccggcacccccggcccccccccccccccccccgccgccagcggccccggccccggcgccgccgccgccccccaccugcuggccgccagcauccuggccgaccugagaggcggccccggcgccgcccccggcggcgccagccccgccagcagcagcagcgccgccagcagccccagcagcggcagagcccccggcgccgcccccagcgccgccgccaagagccacagaugccccuuccccgacugcgccaaggccuacuacaagagcagccaccugaagagccaccugagaacccacaccggcgagagacccuucgccugcgacuggcagggcugcgacaagaaguucgccagaagcgacgagcuggccagacaccacagaacccacaccggcgagaagagauucagcugcccccugugcagcaagagauucaccagaagcgaccaccuggccaagcacgccagaagacaccccggcuuccaccccgaccugcugagaagacccggcgccagaagcaccagccccagcgacagccugcccugcagccuggccggcagccccgcccccagccccgcccccagccccgcccccgccggccuguaa

SEQ ID NO: 18991 - RNA, 1089 nt, Artificial Sequence
  KLF1__Homo_sapiens__NP_006554
auggccaccgccgagaccgcccugcccagcaucagcacccugaccgcccugggccccuuccccgacacccaggacgacuuccugaagugguggagaagcgaggaggcccaggacaugggccccggcccccccgaccccaccgagcccccccugcacgugaagagcgaggaccagcccggcgaggaggaggacgacgagagaggcgccgacgccaccugggaccuggaccugcugcugaccaacuucagcggccccgagcccggcggcgccccccagaccugcgcccuggcccccagcgaggccagcggcgcccaguacccccccccccccgagacccugggcgccuacgccggcggccccggccugguggccggccugcugggcagcgaggaccacagcggcugggugagacccgcccugagagccagagcccccgacgccuucgugggccccgcccuggcccccgcccccgcccccgagcccaaggcccuggcccugcagcccguguaccccggccccggcgccggcagcagcggcggcuacuuccccagaaccggccugagcgugcccgccgccagcggcgcccccuacggccugcugagcggcuaccccgccauguaccccgccccccaguaccagggccacuuccagcuguucagaggccugcagggccccgcccccggccccgccaccagccccagcuuccugagcugccugggccccggcaccgugggcaccggccugggcggcaccgccgaggaccccggcgugaucgccgagaccgcccccagcaagagaggcagaagaagcugggccagaaagagacaggccgcccacaccugcgcccaccccggcugcggcaagagcuacaccaagagcagccaccugaaggcccaccugagaacccacaccggcgagaagcccuacgccugcaccugggagggcugcggcuggagauucgccagaagcgacgagcugaccagacacuacagaaagcacaccggccagagacccuucagaugccagcugugccccagagccuucagcagaagcgaccaccuggcccugcacaugaagagacaccuguaa

SEQ ID NO: 18992 - RNA, 1068 nt, Artificial Sequence
  KLF2__Homo_sapiens__NP_057354
auggcccugagcgagcccauccugcccagcuucagcaccuucgccagccccugcagagagagaggccugcaggagagauggcccagagccgagcccgagagcggcggcaccgacgacgaccugaacagcgugcuggacuucauccugagcaugggccuggacggccugggcgccgaggccgcccccgagccccccccccccccccccccccccgccuucuacuaccccgagcccggcgcccccccccccuacagcgcccccgccggcggccuggugagcgagcugcugagacccgagcuggacgccccccugggccccgcccugcacggcagauuccugcuggccccccccggcagacuggugaaggccgagccccccgaggccgacggcggcggcggcuacggcugcgcccccggccugaccagaggccccagaggccugaagagagagggcgcccccggccccgccgccagcugcaugagaggccccggcggcagacccccccccccccccgacacccccccccugagccccgacggccccgccagacugcccgcccccggccccagagccagcuuccccccccccuucggcggccccggcuucggcgcccccggccccggccugcacuacgccccccccgccccccccgccuucggccuguucgacgacgccgccgccgccgccgccgcccugggccuggccccccccgccgccagaggccugcugaccccccccgccagcccccuggagcugcuggaggccaagcccaagagaggcagaagaagcuggcccagaaagagaaccgccacccacaccugcagcuacgccggcugcggcaagaccuacaccaagagcagccaccugaaggcccaccugagaacccacaccggcgagaagcccuaccacugcaacugggacggcugcggcuggaaguucgccagaagcgacgagcugaccagacacuacagaaagcacaccggccacagacccuuccagugccaccugugcgacagagccuucagcagaagcgaccaccuggcccugcacaugaagagacacauguaa

SEQ ID NO: 18993 - RNA, 1038 nt, Artificial Sequence
  KLF3__Homo_sapiens__NP_057615
augcugauguucgaccccgugcccgugaagcaggaggccauggaccccgugagcgugagcuaccccagcaacuacauggagagcaugaagcccaacaaguacggcgugaucuacagcaccccccugcccgagaaguucuuccagacccccgagggccugagccacggcauccagauggagcccguggaccugaccgugaacaagagaagcagcccccccagcgccggcaacagccccagcagccugaaguuccccagcagccacagaagagccagccccggccugagcaugcccagcagcagcccccccaucaagaaguacagcccccccagccccggcgugcagcccuucggcgugccccugagcaugccccccgugauggccgccgcccugagcagacacggcaucagaagccccggcauccugcccgugauccagcccgugguggugcagcccgugcccuucauguacaccagccaccugcagcagccccugauggugagccugagcgaggagauggagaacagcagcagcagcaugcaggugcccgugaucgagagcuacgagaagcccaucagccagaagaagaucaagaucgagcccggcaucgagccccagagaaccgacuacuaccccgaggagaugagccccccccugaugaacagcgugagccccccccaggcccugcugcaggagaaccaccccagcgugaucgugcagcccggcaagagaccccugcccguggagagccccgacacccagagaaagagaagaauccacagaugcgacuacgacggcugcaacaagguguacaccaagagcagccaccugaaggcccacagaagaacccacaccggcgagaagcccuacaagugcaccugggagggcugcaccuggaaguucgccagaagcgacgagcugaccagacacuucagaaagcacaccggcaucaagcccuuccagugccccgacugcgacagaagcuucagcagaagcgaccaccuggcccugcacagaaagagacacaugcugguguaa

SEQ ID NO: 18994 - RNA, 1440 nt, Artificial Sequence
  KLF4__Homo_sapiens__NP_004226
augagacagccccccggcgagagcgacauggccgugagcgacgcccugcugcccagcuucagcaccuucgccagcggccccgccggcagagagaagacccugagacaggccggcgcccccaacaacagauggagagaggagcugagccacaugaagagacugccccccgugcugcccggcagacccuacgaccuggccgccgccaccguggccaccgaccuggagagcggcggcgccggcgccgccugcggcggcagcaaccuggccccccugcccagaagagagaccgaggaguucaacgaccugcuggaccuggacuucauccugagcaacagccugacccacccccccgagagcguggccgccaccgugagcagcagcgccagcgccagcagcagcagcagccccagcagcagcggccccgccagcgcccccagcaccugcagcuucaccuaccccaucagagccggcaacgaccccggcguggcccccggcggcaccggcggcggccugcuguacggcagagagagcgcccccccccccaccgcccccuucaaccuggccgacaucaacgacgugagccccagcggcggcuucguggccgagcugcugagacccgagcuggaccccguguacauccccccccagcagccccagccccccggcggcggccugaugggcaaguucgugcugaaggccagccugagcgcccccggcagcgaguacggcagccccagcgugaucagcgugagcaagggcagccccgacggcagccaccccguggugguggcccccuacaacggcggcccccccagaaccugccccaagaucaagcaggaggccgugagcagcugcacccaccugggcgccggccccccccugagcaacggccacagacccgccgcccacgacuucccccugggcagacagcugcccagcagaaccacccccacccugggccuggaggaggugcugagcagcagagacugccaccccgcccugccccugccccccggcuuccacccccaccccggccccaacuaccccagcuuccugcccgaccagaugcagccccaggugcccccccugcacuaccaggagcugaugccccccggcagcugcaugcccgaggagcccaagcccaagagaggcagaagaagcuggcccagaaagagaaccgccacccacaccugcgacuacgccggcugcggcaagaccuacaccaagagcagccaccugaaggcccaccugagaacccacaccggcgagaagcccuaccacugcgacugggacggcugcggcuggaaguucgccagaagcgacgagcugaccagacacuacagaaagcacaccggccacagacccuuccagugccagaagugcgacagagccuucagcagaagcgaccaccuggcccugcacaugaagagacacuucuaa

SEQ ID NO: 18995 - RNA, 1101 nt, Artificial Sequence
  KLF5__Homo_sapiens__NP_001273747
auggagaaguaccugaccccccagcugccccccgugcccaucauccccgagcacaagaaguacagaagagacagcgccagcgugguggaccaguucuucaccgacaccgagggccugcccuacagcaucaacaugaacguguuccugcccgacaucacccaccugagaaccggccuguacaagagccagagacccugcgugacccacaucaagaccgagcccguggccaucuucagccaccagagcgagaccaccgcccccccccccgcccccacccaggcccugcccgaguucaccagcaucuucagcagccaccagaccgccgcccccgaggugaacaacaucuucaucaagcaggagcugcccacccccgaccugcaccugagcgugcccacccagcagggccaccuguaccagcugcugaacacccccgaccuggacaugcccagcagcaccaaccagaccgccgccauggacacccugaacgugagcaugagcgccgccauggccggccugaacacccacaccagcgccgugccccagaccgccgugaagcaguuccagggcaugccccccugcaccuacaccaugcccagccaguuccugccccagcaggccaccuacuucccccccagcccccccagcagcgagcccggcagccccgacagacaggccgagaugcugcagaaccugacccccccccccagcuacgccgccaccaucgccagcaagcuggccauccacaaccccaaccugcccaccacccugcccgugaacagccagaacauccagcccgugagauacaacagaagaagcaaccccgaccuggagaagagaagaauccacuacugcgacuaccccggcugcaccaagguguacaccaagagcagccaccugaaggcccaccugagaacccacaccggcgagaagcccuacaagugcaccugggagggcugcgacuggagauucgccagaagcgacgagcugaccagacacuacagaaagcacaccggcgccaagcccuuccagugcggcgugugcaacagaagcuucagcagaagcgaccaccuggcccugcacaugaagagacaccagaacuaa

SEQ ID NO: 18996 - RNA, 714 nt, Artificial Sequence
  KLF6__Homo_sapiens__NP_001153597
auggacgugcugcccaugugcagcaucuuccaggagcugcagaucgugcacgagaccggcuacuucagcgcccugcccagccuggaggaguacuggcagcagaccugccuggagcuggagagauaccugcagagcgagcccugcuacgugagcgccagcgagaucaaguucgacagccaggaggaccuguggaccaagaucauccuggccagagagaagaaggaggagagcgagcugaagaucagcagcagcccccccgaggacacccugaucagccccagcuucugcuacaaccuggagaccaacagccugaacagcgacgugagcagcgagagcagcgacagcagcgaggagcugagccccaccgccaaguucaccagcgaccccaucggcgaggugcuggugagcagcggcaagcugagcagcagcgugaccagcaccccccccagcagccccgagcugagcagagagcccagccagcuguggggcugcgugcccggcgagcugcccagccccggcaaggugagaagcggcaccagcggcaagcccggcgacaagggcaacggcgacgccagccccgacggcagaagaagagugcacagaugccacuucaacggcugcagaaagguguacaccaagagcagccaccugaaggcccaccagagaacccacaccggcguguuccccggccugaccaccuggcccugcaccuaa

SEQ ID NO: 18997 - RNA, 693 nt, Artificial Sequence
  KLF7__Homo_sapiens__NP_001257871
auggacgugcuggccagcuacagcaucuuccaggagcugcagcuggugcacgacaccggcuacuucagcgcccugcccagccuggaggagaccuggcagcagaccugccuggagcuggagagauaccugcagaccgagcccagaagaaucagcgagaccuucggcgaggaccuggacugcuuccugcacgccagccccccccccugcaucgaggagagcuucagaagacuggacccccugcugcugcccguggaggccgccaucugcgagaagagcagcgccguggacauccugcugagcagagacaagcugcugagcgagaccugccugagccugcagcccgccagcagcagccuggacagcuacaccgccgugaaccaggcccagcugaacgccgugaccagccugaccccccccagcagccccgagcugagcagacaccuggugaagaccagccagacccugagcgccguggacggcaccgugacccugaagcugguggccaagaaggccgcccugagcagcgugaaggugagaagccugaucagcgcccacggcagagacgugagcggcgugcugcacgaggccaugagcagcagaggcaccaccggcaacacccaggugcagagccccagcaacgccaccaccgccaccggcguguuccccggccugaccauccugcccagcaccuaa

SEQ ID NO: 18998 - RNA, 1080 nt, Artificial Sequence
  KLF8__Homo_sapiens__XP_005262036
augguggacauggacaagcugaucaacaaccuggaggugcagcugaacagcgagggcggcagcaugcagguguucaagcaggugaccgccagcgugagaaacagagacccccccgagaucgaguacagaagcaacaugaccagccccacccugcuggacgccaaccccauggagaaccccgcccuguucaacgacaucaagaucgagccccccgaggagcugcuggccagcgacuucagccugccccagguggagcccguggaccugagcuuccacaagcccaaggccccccugcagcccgccagcaugcugcaggcccccaucagaccccccaagccccagagcagcccccagacccugguggugagcaccagcaccagcgacaugagcaccagcgccaacauccccaccgugcugacccccggcagcgugcugaccagcagccagagcaccggcagccagcagauccugcacgugauccacaccauccccagcgugagccugcccaacaagaugggcggccugaagaccauccccgugguggugcagagccugcccaugguguacaccacccugcccgccgacggcggccccgccgccaucaccgugccccugaucggcggcgacggcaagaacgccggcagcgugaagguggaccccaccagcaugagcccccuggagauccccagcgacagcgaggagagcaccaucgagagcggcagcagcgcccugcagagccugcagggccugcagcaggagcccgccgccauggcccagaugcagggcgaggagagccuggaccugaagagaagaagaauccaccagugcgacuucgccggcugcagcaagguguacaccaagagcagccaccugaaggcccacagaagaauccacaccggcgagaagcccuacaagugcaccugggacggcugcagcuggaaguucgccagaagcgacgagcugaccagacacuucagaaagcacaccggcaucaagcccuucagaugcaccgacugcaacagaagcuucagcagaagcgaccaccugagccugcacagaagaagacacgacaccauguaa

SEQ ID NO: 18999 - RNA, 735 nt, Artificial Sequence
  KLF9__Homo_sapiens__NP_001197
augagcgccgccgccuacauggacuucguggccgcccagugccuggugagcaucagcaacagagccgccgugcccgagcacggcguggcccccgacgccgagagacugagacugcccgagagagaggugaccaaggagcacggcgaccccggcgacaccuggaaggacuacugcacccuggugaccaucgccaagagccugcuggaccugaacaaguacagacccauccagacccccagcgugugcagcgacagccuggagagccccgacgaggacaugggcagcgacagcgacgugaccaccgagagcggcagcagccccagccacagccccgaggagagacaggaccccggcagcgcccccagcccccugagccugcugcaccccggcguggccgccaagggcaagcacgccagcgagaagagacacaagugccccuacagcggcugcggcaagguguacggcaagagcagccaccugaaggcccacuacagagugcacaccggcgagagacccuuccccugcaccuggcccgacugccugaagaaguucagcagaagcgacgagcugaccagacacuacagaacccacaccggcgagaagcaguucagaugcccccugugcgagaagagauucaugagaagcgaccaccugaccaagcacgccagaagacacaccgaguuccaccccagcaugaucaagagaagcaagaaggcccuggccaacgcccuguaa

SEQ ID NO: 19000 - RNA, 1221 nt, Artificial Sequence
  KLHDC1__Homo_sapiens__NP_751943
auggccgacagccagcuguucugcguggccgaggagagaagcggccacugcgccgugguggacggcaacuuccuguacguguggggcggcuacgugagcaucgaggacaacgagguguaccugcccaacgacgagaucuggaccuacgacaucgacagcggccuguggagaaugcaccugauggagggcgagcugcccgccagcaugagcggcagcugcggcgccugcaucaacggcaagcuguacaucuucggcggcuacgacgacaagggcuacagcaacagacuguacuucgugaaccugagaaccagagacgagaccuacaucugggagaagaucaccgacuucgagggccagccccccacccccagagacaagcugagcugcuggguguacaaggacagacugaucuacuucggcggcuacggcugcagaagacacagcgagcugcaggacugcuucgacgugcacgacgccagcugggaggagcagaucuucuggggcuggcacaacgacgugcacaucuucgacaccaagacccagaccugguuccagcccgagaucaagggcggcgugcccccccagcccagagccgcccacaccugcgccgugcugggcaacaagggcuacaucuucggcggcagagugcugcagaccagaaugaacgaccugcacuaccugaaccuggacaccuggaccuggagcggcagaaucaccaucaacggcgagagccccaagcacagaagcuggcacacccugacccccaucgccgacgacaagcuguuccugugcggcggccugagcgccgacaacaucccccugagcgacggcuggauccacaacgugaccaccaacugcuggaagcagcugacccaccugcccaagaccagacccagacuguggcacaccgccugccugggcaaggagaacgagaucaugguguucggcggcagcaaggacgaccugcuggcccuggacaccggccacugcaacgaccugcugaucuuccagacccagcccuacagccugcugagaagcugccuggacugcaucggcaagaacagcaucaugcuggagagccagaucagccugcugccccccaagcugcugcagcaggugcugaagaagaucaccuucugggccgccgccaaccacagagaggagcagagagugcagaaggaggagaccgagaacaaguaccaguggaucagcagcaacuaa

SEQ ID NO: 19001 - RNA, 1221 nt, Artificial Sequence
  KLHDC2__Homo_sapiens__NP_055130
auggccgacggcaacgaggaccugagagccgacgaccugcccggccccgccuucgagagcuacgagagcauggagcuggccugccccgccgagagaagcggccacguggccgugagcgacggcagacacauguucguguggggcggcuacaagagcaaccaggugagaggccuguacgacuucuaccugcccagagaggagcuguggaucuacaacauggagaccggcagauggaagaagaucaacaccgagggcgacgugccccccagcaugagcggcagcugcgccgugugcguggacagagugcuguaccuguucggcggccaccacagcagaggcaacaccaacaaguucuacaugcuggacagcagaagcaccgacagagugcugcagugggagagaaucgacugccagggcaucccccccagcagcaaggacaagcugggcguguggguguacaagaacaagcugaucuucuucggcggcuacggcuaccugcccgaggacaaggugcugggcaccuucgaguucgacgagaccagcuucuggaacagcagccaccccagaggcuggaacgaccacgugcacauccuggacaccgagaccuucaccuggagccagcccaucaccaccggcaaggcccccagccccagagccgcccacgccugcgccaccgugggcaacagaggcuucguguucggcggcagauacagagacgccagaaugaacgaccugcacuaccugaaccuggacaccugggaguggaacgagcugaucccccagggcaucugccccgugggcagaagcuggcacagccugacccccgugagcagcgaccaccuguuccuguucggcggcuucaccaccgacaagcagccccugagcgacgccuggaccuacugcaucagcaagaacgaguggauccaguucaaccaccccuacaccgagaagcccagacuguggcacaccgccugcgccagcgacgagggcgaggugaucguguucggcggcugcgccaacaaccugcuggugcaccacagagccgcccacagcaacgagauccugaucuucagcgugcagcccaagagccuggugagacugagccuggaggccgugaucugcuucaaggagaugcuggccaacagcuggaacugccugcccaagcaccugcugcacagcgugaaccagagauucggcagcaacaacaccagcggcagcuaa

SEQ ID NO: 19002 - RNA, 1053 nt, Artificial Sequence
  KLHDC8A__Homo_sapiens__XP_006711492
auggaggugcccaacgugaaggacuuccaguggaagagacuggccccccugcccagcagaagaguguacugcagccugcuggagaccggcggccagguguacgccaucggcggcugcgacgacaacggcgugcccauggacugcuucgagguguacagccccgaggccgaccaguggaccgcccugcccagacugcccaccgccagagccggcguggccgugaccgcccugggcaagagaaucauggugaucggcggcgugggcaccaaccagcugccccugaaggugguggagauguacaacaucgacgagggcaaguggaagaagagaagcaugcugagagaggccgccaugggcaucagcgugaccgccaaggacuacagaguguacgccgccggcggcaugggccuggaccugagaccccacaaccaccugcagcacuacgacaugcugaaggacaugugggugagccuggcccccaugcccacccccagauacgccgccaccagcuuccugagaggcagcaagaucuacgugcugggcggcagacagagcaaguacgccgugaacgccuucgagguguucgacaucgagaccagaagcuggaccaaguuccccaacauccccuacaagagagccuucagcagcuucgugacccuggacaaccaccuguacagccugggcggccugagacagggcagacuguacagacagcccaaguuccugagaaccauggacguguucgacauggagcagggcggcuggcugaagauggagagaagcuucuuccugaagaagagaagagccgacuucguggccggcagccugagcggcagagugaucguggccggcggccugggcaaccagcccaccgugcuggagaccgccgaggccuuccaccccggcaagaacaagugggagauccugcccgccaugcccacccccagaugcgccugcagcagcaucguggugaagaacugccugcuggccgugggcggcgugaaccagggccugagcgacgccguggaggcccugugcgugagcgacagcuaa

SEQ ID NO: 19003 - RNA, 1065 nt, Artificial Sequence
  KLHDC8B__Homo_sapiens__NP_775817
augagcgccggcggcggcagagccuucgccuggcagguguucccccccaugcccaccugcagaguguacggcaccguggcccaccaggacggccaccugcuggugcugggcggcugcggcagagccggccugccccuggacaccgccgagacccuggacauggccagccacaccuggcuggcccuggccccccugcccaccgccagagccggcgccgccgccguggugcugggcaagcaggugcugguggugggcggcguggacgaggugcagagccccguggccgccguggaggccuuccugauggacgagggcagaugggagagaagagccacccugccccaggccgccaugggcguggccaccguggagagagacggcaugguguacgcccugggcggcaugggccccgacaccgccccccaggcccaggugagaguguacgagcccagaagagacugcuggcugagccugcccagcaugcccacccccugcuacggcgccagcaccuuccugcacggcaacaagaucuacgugcugggcggcagacagggcaagcugcccgugaccgccuucgaggccuucgaccuggaggccagaaccuggaccagacaccccagccugcccagcagaagagccuucgccggcugcgccauggccgagggcagcguguucagccugggcggccugcagcagcccggcccccacaacuucuacagcagaccccacuucgugaacaccguggagauguucgaccuggagcacggcagcuggaccaagcugcccagaagccugagaaugagagacaagagagccgacuucguggugggcagccugggcggccacaucguggccaucggcggccugggcaaccagcccugcccccugggcagcguggagagcuucagccuggccagaagaagaugggaggcccugcccgccaugcccaccgccagaugcagcugcagcagccugcaggccggccccagacuguucgugaucggcggcguggcccagggccccagccaggccguggaggcccugugccugagagacggcguguaa

SEQ ID NO: 19004 - RNA, 1827 nt, Artificial Sequence
  KLHL10__Homo_sapiens__NP_689680
auggagauggagagcgccgccgccagcaccagauuccaccagccccacauggagagaaagaugagcgccauggccugcgagaucuucaacgagcugagacuggagggcaagcugugcgacguggugaucaaggugaacggcuucgaguucagcgcccacaagaacauccugugcagcugcagcagcuacuucagagcccuguucaccagcggcuggaacaacaccgagaagaagguguacaacauccccggcaucagccccgacaugaugaagcugaucaucgaguacgccuacaccagaaccgugcccaucacccccgacaacguggagaagcugcuggccgccgccgaccaguucaacaucaugggcaucgugagaggcugcugcgaguuccugaagagcgagcugugccuggacaacugcaucggcaucugcaaguucaccgacuacuacuacugccccgagcugagacagaaggccuacauguucauccugcacaacuucgaggagauggugaaggugagcgccgaguuccuggagcugagcgugaccgagcugaaggacaucaucgagaaggacgagcugaacgugaagcaggaggacgccguguucgaggccauccugaaguggaucagccacgacccccagaacagaaagcagcacaucagcauccugcugcccaaggugagacuggcccugaugcacgccgaguacuucaugaacaacgugaagaugaacgacuacgugaaggacagcgaggagugcaagcccgugaucaucaacgcccugaaggccauguacgaccugaacaugaacggccccagcaacagcgacuucaccaacccccugaccagacccagacugcccuacgccauccuguucgccaucggcggcuggagcggcggcagccccaccaacgccaucgaggccuacgacgccagagccgacagaugggugaacgugaccugcgaggaggagagccccagagccuaccacggcgccgccuaccugaagggcuacguguacaucaucggcggcuucgacagcguggacuacuucaacagcgugaagagauucgaccccgugaagaagaccuggcaccagguggcccccaugcacagcagaagaugcuacgugagcgugaccgugcugggcaacuucaucuacgccaugggcggcuucgacggcuacgugagacugaacaccgccgagagauacgagcccgagaccaaccaguggacccugaucgcccccaugcacgagcagagaagcgacgccagcgccaccacccuguacggcaagguguacaucugcggcggcuucaacggcaacgagugccuguucaccgccgagguguacaacaccgagagcaaccaguggaccgugaucgcccccaugagaagcagaagaagcggcaucggcgugaucgccuacggcgagcacguguacgccgugggcggcuucgacggcgccaacagacugagaagcgccgaggccuacagccccguggccaacaccuggagaaccauccccaccauguucaaccccagaagcaacuucggcaucgaggugguggacgaccugcuguucguggugggcggcuucaacggcuucaccaccaccuucaacguggagugcuacgacgagaagaccgacgagugguacgacgcccacgacaugagcaucuacagaagcgcccugagcugcugcguggugcccggccuggccaacguggaggaguacgccgccagaagagacaacuuccccggccuggcccugagagacgaggugaaguacagcgccagcaccagcacccugcccguguaa

SEQ ID NO: 19005 - RNA, 1821 nt, Artificial Sequence
  KLHL12__Homo_sapiens__NP_001289980
auggacgugaacaaguucgaggccagcgugggcuuccuggacgugaagaaguuccugagcaccuggaagcugcagaaccccagaacccacuucgugcugagcccccacugcuucaugggcggcaucauggcccccaaggacaucaugaccaacacccacgccaagagcauccugaacagcaugaacagccugagaaagagcaacacccugugcgacgugacccugagaguggagcagaaggacuuccccgcccacagaaucgugcuggccgccugcagcgacuacuucugcgccauguucaccagcgagcugagcgagaagggcaagcccuacguggacauccagggccugaccgccagcaccauggagauccugcuggacuucguguacaccgagaccgugcacgugaccguggagaacgugcaggagcugcugcccgccgccugccugcugcagcugaagggcgugaagcaggccugcugcgaguuccuggagagccagcuggaccccagcaacugccugggcaucagagacuucgccgagacccacaacugcguggaccugaugcaggccgccgagguguucagccagaagcacuuccccgagguggugcagcacgaggaguucauccugcugagccagggcgagguggagaagcugaucaagugcgacgagauccagguggacagcgaggagcccguguucgaggccgugaucaacugggugaagcacgccaagaaggagagagaggagagccugcccaaccugcugcaguacgugagaaugccccugcugacccccagauacaucaccgacgugaucgacgccgagcccuucaucagaugcagccugcagugcagagaccugguggacgaggccaagaaguuccaccugagacccgagcugagaagccagaugcagggccccagaaccagagccagacugggcgccaacgaggugcugcugguggugggcggcuucggcagccagcagagccccaucgacgugguggagaaguacgaccccaagacccaggaguggagcuuccugcccagcaucaccagaaagagaagauacguggccagcgugagccugcacgacagaaucuacgugaucggcggcuacgacggcagaagcagacugagcagcguggagugccuggacuacaccgccgacgaggacggcgugugguacagcguggcccccaugaacgugagaagaggccuggccggcgccaccacccugggcgacaugaucuacgugagcggcggcuucgacggcagcagaagacacaccagcauggagagauacgaccccaacaucgaccaguggagcaugcugggcgacaugcagaccgccagagagggcgccggccuggugguggccagcggcgugaucuacugccugggcggcuacgacggccugaacauccugaacagcguggagaaguacgacccccacaccggccacuggaccaacgugacccccauggccaccaagagaagcggcgccggcguggcccugcugaacgaccacaucuacguggugggcggcuucgacggcaccgcccaccugagcagcguggaggccuacaacaucagaaccgacagcuggaccaccgugaccagcaugaccacccccagaugcuacgugggcgccaccgugcugagaggcagacuguacgccaucgccggcuacgacggcaacagccugcugagcagcaucgagugcuacgaccccaucaucgacagcugggagguggugaccagcaugggcacccagagaugcgacgccggcgugugcgugcugagagagaaguaa

SEQ ID NO: 19006 - RNA, 2064 nt, Artificial Sequence
  KLHL1__Homo_sapiens__NP_001273654
augagcggcagcggcagaaaggacuucgacgugaagcacauccugagacugagauggaagcuguucagccaccccagccccagcaccggcggccccgccggcggcggcugccugcagcaggacggcagcggcagcuucgagcacuggggccccagccagagcagacugcugaagagccaggagagaagcggcgugagcaccuucuggaagaagcccagcagcagcagcagcagcagcagcagccccagcagcagcagcagcagcuucaacccccugaacggcacccugcugcccguggccaccagacugcagcagggcgcccccggccagggcacccagcagcccgccagaacccuguucuacguggagagccuggaggaggagguggugcccggcauggacuuccccggcccccacgagaagggccuggugcugcaggagcugaagguggagcccgacaacagcagccaggccaccggcgagggcugcggccacagacuggugcugagcagcgugagcgacuacuucgccgccauguucaccagcgacgugugcgaggccaagcaggaggagaucaagauggagggcaucgaccccaacgcccugugggaccuggugcaguucgccuacaccggcugccuggagcugaaggaggacaccaucgagaaccugcuggccgccgccugccugcugcagcugccccaggugguggaggugugcugccacuuccugaugaagcugcugcaccccagcaacugccugggcaucagagccuucgccgacgcccagggcugcaucgagcugaugaagguggcccacagcuacaccauggagaacaucauggaggugaucagaaaccaggaguuccugcugcugcccgccgaggagcugcacaagcugcuggccagcgacgacgugaacgugcccgacgaggagaccaucuuccacgcccugaugaugugggugaaguacgacaugcagagcagaugcaacgaccugagcaugcugcuggccuucaucagacugccccugcugcccccccagauccuggccgaccuggagaaccacgcccuguucaagaacgaccuggagugccagaagcugauccuggaggccaugaaguaccaccugcugcccgagagaagaacccugaugcagagccccagaaccaagcccagaaagagcaccgugggcacccuguacgccgugggcggcauggacaacaacaagggcgccaccaccaucgagaaguacgaccugagaaccaaccuguggauccaggccggcaugaugaacggcagaagacugcaguucggcguggccgugaucgacgacaagcuguucgugaucggcggcagagacggccugaagacccugaacaccguggagugcuacaaccccaagaccaagaccuggaccgugcugccccccaugagcacccacagacacggccugggcgugaccgugcuggagggccccaucuacgccgugggcggccacgacggcuggagcuaccugaacaccguggagagaugggacccccagagccagcaguggaccuucguggccagcaugagcaucgccagaagcaccgugggcguggccgcccugaacggcaagcuguacagcgugggcggcagagacggcagcagcugccugagcagcauggaguacuacgacccccacaccaacaaguggaacaugugcgcccccaugugcaagagaagaggcggcgugggcguggccaccugcgacggcuuccuguacgccgugggcggccacgacgcccccgccagcaaccacugcagcagacugcuggacuacguggagagauacgaccccaagaccgacaccuggaccaugguggccccccugagcaugcccagagacgccgugggcgugugccugcugggcgacagacuguacgccgugggcggcuacgacggccagaccuaccugaacaccauggagagcuacgacccccagaccaacgaguggacccagauggccagccugaacaucggcagagccggcgccugcgugguggugaucaagcagcccuaa

SEQ ID NO: 19007 - RNA, 1830 nt, Artificial Sequence
  KLHL20__Homo_sapiens__NP_055273
auggagggcaagcccaugagaagaugcaccaacaucagacccggcgagaccggcauggacgugaccagcagaugcacccugggcgaccccaacaagcugcccgagggcgugccccagcccgccagaaugcccuacaucagcgacaagcaccccagacagacccuggaggugaucaaccugcugagaaagcacagagagcugugcgacguggugcugguggugggcgccaagaagaucuacgcccacagagugauccugagcgccugcagccccuacuucagagccauguucaccggcgagcuggccgagagcagacagaccgagguggugaucagagacaucgacgagagagccauggagcugcugaucgacuucgccuacaccagccagaucaccguggaggagggcaacgugcagacccugcugcccgccgccugccugcugcagcuggccgagauccaggaggccugcugcgaguuccugaagagacagcuggaccccagcaacugccugggcaucagagccuucgccgacacccacagcugcagagagcugcugagaaucgccgacaaguucacccagcacaacuuccaggaggugauggagagcgaggaguucaugcugcugcccgccaaccagcugaucgacaucaucagcagcgacgagcugaacgugagaagcgaggagcagguguucaacgccgugauggccugggugaaguacagcauccaggagagaagaccccagcugccccaggugcugcagcacgugagacugccccugcugagccccaaguuccuggugggcaccgugggcagcgacccccugaucaagagcgacgaggagugcagagaccugguggacgaggccaagaacuaccugcugcugccccaggagagaccccugaugcagggccccagaaccagacccagaaagcccaucagaugcggcgaggugcuguucgccgugggcggcuggugcagcggcgacgccaucagcagcguggagagauacgacccccagaccaacgaguggagaaugguggccagcaugagcaagagaagaugcggcgugggcgugagcgugcuggacgaccugcuguacgccgugggcggccacgacggcagcagcuaccugaacagcguggagagauacgaccccaagaccaaccaguggagcagcgacguggcccccaccagcaccugcagaaccagcgugggcguggccgugcugggcggcuuccuguacgccgugggcggccaggacggcgugagcugccugaacaucguggagagauacgaccccaaggagaacaaguggaccagaguggccagcaugagcaccagaagacugggcguggccguggccgugcugggcggcuuccuguacgccgugggcggcagcgacggcaccagcccccugaacaccguggagagauacaacccccaggagaacagauggcacaccaucgcccccaugggcaccagaagaaagcaccugggcugcgccguguaccaggacaugaucuacgccgugggcggcagagacgacaccaccgagcugagcagcgccgagagauacaaccccagaaccaaccaguggagccccgugguggccaugaccagcagaagaagcggcgugggccuggccguggugaacggccagcugauggccgugggcggcuucgacggcaccaccuaccugaagaccaucgagguguucgaccccgacgccaacaccuggagacuguacggcggcaugaacuacagaagacugggcggcggcgugggcgugaucaagaugacccacugcgagagccacaucugguaa

SEQ ID NO: 19008 - RNA, 1770 nt, Artificial Sequence
  KLHL25__Homo_sapiens__NP_071925
augagcgugagcgugcacgagaccagaaagagcagaagcagcaccggcagcaugaacgugacccuguuccacaaggccagccaccccgacugcgugcuggcccaccugaacacccugagaaagcacugcauguucaccgacgugacccugugggccggcgacagagccuuccccugccacagagccgugcuggccgccagcagcagauacuucgaggccauguucagccacggccugagagagagcagagacgacaccgugaacuuccaggacaaccugcaccccgaggugcuggagcugcugcuggacuucgccuacagcagcagaaucgccaucaacgaggagaacgccgagagccugcuggaggccggcgacaugcugcaguuccacgacgugagagacgccgccgccgaguuccuggagaagaaccuguuccccagcaacugccugggcaugaugcugcugagcgacgcccaccagugcagaagacuguacgaguucagcuggagaaugugccuggugcacuucgagaccgugagacagagcgaggacuucaacagccugagcaaggacacccugcuggaccugaucagcagcgacgagcuggagaccgaggacgagagagugguguucgaggccauccugcagugggugaagcacgaccuggagcccagaaaggugcaccugcccgagcugcugagaagcgugagacuggcccugcugcccagcgacugccugcaggaggccgugagcagcgaggcccugcugauggccgacgagagaaccaagcugaucauggacgaggcccugagaugcaagaccagaauccugcagaacgacggcguggugaccagccccugcgccagacccagaaaggccggccacacccugcugauccugggcggccagaccuucaugugcgacaagaucuaccagguggaccacaaggccaaggagaucauccccaaggccgaccugcccagccccagaaaggaguucagcgccagcgccaucggcugcaagguguacgugaccggcggcagaggcagcgagaacggcgugagcaaggacguguggguguacgacaccgugcacgaggaguggagcaaggccgcccccaugcugaucgccagauucggccacggcagcgccgagcuggagaacugccuguacguggugggcggccacaccagccuggccggcguguuccccgccagccccagcgugagccugaagcagguggagaaguacgaccccggcgccaacaaguggaugaugguggccccccugagagacggcgugagcaacgccgccguggugagcgccaagcugaagcuguucguguucggcggcaccagcauccacagagacauggugagcaaggugcagugcuacgaccccagcgagaacagauggaccaucaaggccgagugcccccagcccuggagauacaccgccgccgccgugcugggcagccagaucuucaucaugggcggcgacaccgaguucaccgccgccagcgccuacagauucgacugcgagaccaaccaguggaccagaaucggcgacaugaccgccaagagaaugagcugccacgcccuggccagcggcaacaagcuguacguggugggcggcuacuucggcacccagagaugcaagacccuggacugcuacgaccccaccagcgacaccuggaacugcaucaccaccgugcccuacagccugauccccaccgccuucgugagcaccuggaagcaccugcccgccuaa

SEQ ID NO: 19009 - RNA, 1848 nt, Artificial Sequence
  KLHL26__Homo_sapiens__NP_060786
auggccgagagcggcggcagcagcggcggcgccggcggcggcggcgccuucggcgccggccccggccccgagagacccaacagcaccgccgacaagaacggcgcccugaagugcaccuucagcgcccccagccacagcaccagccugcugcagggccuggccacccugagagcccagggccagcugcuggacguggugcugaccaucaacagagaggccuuccccgcccacaagguggugcuggccgccugcagcgacuacuucagagccauguucaccggcggcaugagagaggccagccaggacgugaucgagcugaagggcgugagcgccagaggccugagacacaucaucgacuucgccuacagcgccgaggugacccuggaccuggacugcgugcaggacgugcugggcgccgccguguuccugcagaugcugcccgugguggagcugugcgaggaguuccugaaggccgccaugagcguggagaccugccugaacaucggccagauggccaccaccuucagccuggccagccugagagagagcguggacgccuucaccuucagacacuuccugcagaucgccgaggaggaggacuuccugagacugccccuggagagacugguguucuuccugcagagcaacagacugcagagcugcgccgagaucgaccuguucagagccgccgugagauggcugcagcacgaccccgccagaagacccagagccagccacgugcugugccacaucagauucccccugaugcagagcagcgagcugguggacagcgugcagacccuggacaucaugguggaggacgugcugugcagacaguaccugcuggaggccuucaacuaccaggugcugcccuucagacagcacgagaugcagagccccagaaccgccgugagaagcgacgugcccagccuggugaccuucggcggcacccccuacaccgacagcgacagaagcgugagcagcaagguguaccagcugcccgagcccggcgccagacacuucagagagcugaccgagauggaggugggcugcagccacaccugcguggccgugcuggacaacuucguguacguggccggcggccagcaccugcaguacagaagcggcgagggcgccguggacgccugcuacagauacgacccccaccugaacagauggcugagacugcaggccaugcaggagagcagaauccaguuccagcugaacgugcugugcggcaugguguacgccaccggcggcagaaacagagccggcagccuggccagcguggagagauacugccccagaagaaacgaguggggcuacgccugcagccugaagagaagaaccuggggccacgccggcgccgccagcggcggcagacuguacaucagcggcggcuacggcaucagcguggaggacaagaaggcccugcacugcuacgaccccguggccgaccagugggaguucaaggcccccaugagcgagcccagagugcugcacgccauggugggcgccggcggcagaaucuacgcccugggcggcagaauggaccacguggacagaugcuucgacgugcuggccguggaguacuacgugcccgagaccgaccaguggaccagcgugagccccaugagagccggccagagcgaggccggcugcugccugcuggagagaaagaucuacaucgugggcggcuacaacuggagacugaacaacgugaccggcaucgugcagguguacaacaccgacaccgacgagugggagagagaccugcacuuccccgagagcuucgccggcaucgccugcgcccccgugcugcugcccagagccggcaccagaagauaa

SEQ ID NO: 19010 - RNA, 2628 nt, Artificial Sequence
  KLHL29__Homo_sapiens__NP_443152
augagcagacaccacagcagauucgagagagacuacagagugggcugggacagaagagaguggagcgugaacggcacccacggcaccaccagcaucugcagcgugaccagcggcgccggcggcggcaccgccagcagccugagcgugagacccggccugcugccccugcccguggugcccagcagacugcccacccccgccaccgcccccgcccccugcaccaccggcagcagcgaggccaucaccagccugguggccagcagcgccagcgccgugaccaccaaggcccccggcaucagcaagggcgacagccagagccagggccuggccaccagcaucagauggggccagacccccaucaaccagagcacccccugggacaccgacgagccccccagcaagcagaugagagagagcgacaaccccggcaccggccccugggugaccaccguggccgccggcaaccagcccacccugaucgcccacagcuacggcguggcccagccccccaccuucagccccgccgugaacgugcaggcccccgugaucggcgugacccccagccugcccccccacgugggcccccagcugccccugaugcccggccacuacagccugccccagccccccagccagccccugagcagcgugguggugaacaugcccgcccaggcccuguacgccagcccccagccccuggccgugagcacccugcccggcgugggccagguggccagacccggccccaccgccgugggcaacggccacauggccggcccccugcugcccccccccccccccgcccagcccagcgccacccugcccagcggcgcccccgccaccaacggcccccccaccaccgacagcgcccacggccugcagaugcugagaaccaucggcgugggcaaguacgaguucaccgaccccggccaccccagagagaugcugaaggagcugaaccagcagagaagagccaaggccuucaccgaccugaagaucgugguggagggcagagaguucgaggugcaccagaacgugcuggccagcugcagccuguacuucaaggaccugauccagagaagcgugcaggacagcggccagggcggcagagagaagcuggagcuggugcugagcaaccugcaggccgacgugcuggagcugcugcuggaguucguguacaccggcagccuggugaucgacagcgccaacgccaagacccugcuggaggccgccagcaaguuccaguuccacaccuucugcaaggugugcgugagcuuccuggagaagcagcugaccgccagcaacugccugggcgugcuggccauggccgaggccaugcagugcagcgagcuguaccacauggccaaggccuucgcccugcagaucuuccccgagguggccgcccaggaggagauccugagcaucagcaaggacgacuucaucgccuacgugagcaacgacagccugaacaccaaggccgaggagcugguguacgagaccgugaucaaguggaucaagaaggaccccgccaccagaacccaguacgccgccgagcugcuggccguggugagacugcccuucauccaccccagcuaccugcugaacgugguggacaacgaggagcugaucaagagcagcgaggccugcagagaccuggugaacgaggccaagagauaccacaugcugccccacgccagacaggagaugcagacccccagaaccagacccagacugagcgccggcguggccgaggugaucgugcuggugggcggcagacagauggugggcaugacccagagaagccugguggccgugaccugcuggaacccccagaacaacaagugguacccccuggccagccugcccuucuacgacagagaguucuucagcguggugagcgccggcgacaacaucuaccugagcggcggcauggagagcggcgugacccuggccgacguguggugcuacaugagccugcuggacaacuggaaccuggugagcagaaugaccgugcccagaugcagacacaacagccugguguacgacggcaagaucuacacccugggcggccugggcguggccggcaacguggaccacguggagagauacgacaccaucaccaaccagugggaggccguggccccccugcccaaggccgugcacagcgccgccgccaccgugugcggcggcaagaucuacguguucggcggcgugaacgaggccggcagagccgccggcgugcugcagagcuacgugccccagaccaacaccuggagcuucaucgagagccccaugaucgacaacaaguacgcccccgccgugacccugaacggcuucguguucauccugggcggcgccuacgccagagccaccaccaucuacgaccccgagaagggcaacaucaaggccggccccaacaugaaccacagcagacaguucugcagcgccguggugcuggacggcaagaucuacgccaccggcggcaucgugagcagcgagggccccgcccugggcaacauggaggccuacgagcccaccaccaacaccuggacccugcugccccacaugcccugccccguguucagacacggcugcguggugaucaagaaguacauccagagcggcuaa

SEQ ID NO: 19011 - RNA, 1794 nt, Artificial Sequence
  KLHL2__Homo_sapiens__NP_001154993
augguguggcuggaggccagaccccagauccuguucgugugcaccaagcagggccaccagaagccccuggacagcaaggacgacaacaccgagaagcacugccccgugaccgugaaccccuggcacaugaagaaggccuucaaggugaugaacgagcugagaagccagaaccugcugugcgacgugaccaucguggccgaggacauggagaucagcgcccacagaguggugcuggccgccugcagccccuacuuccacgccauguucaccggcgagaugagcgagagcagagccaagagagugagaaucaaggagguggacggcuggacccugagaaugcugaucgacuacguguacaccgccgagauccaggugaccgaggagaacgugcaggugcugcugcccgccgccggccugcugcagcugcaggacgugaagaagaccugcugcgaguuccuggagagccagcugcaccccgugaacugccugggcaucagagccuucgccgacaugcacgccugcaccgaccugcugaacaaggccaacaccuacgccgagcagcacuucgccgacguggugcugagcgaggaguuccugaaccugggcaucgagcaggugugcagccugaucagcagcgacaagcugaccaucagcagcgaggagaagguguucgaggccgugaucgccugggugaaccacgacaaggacgugagacaggaguucauggccagacugauggagcacgugagacugccccugcugcccagagaguaccuggugcagagaguggaggaggaggcccuggugaagaacagcagcgccugcaaggacuaccugaucgaggccaugaaguaccaccugcugcccaccgagcagagaauccugaugaagagcgugagaaccagacugagaacccccaugaaccugcccaagcugauggugguggugggcggccaggcccccaaggccaucagaagcguggagugcuacgacuucaaggaggagagauggcaccagguggccgagcugcccagcagaagaugcagagccggcaugguguacauggccggccugguguucgccgugggcggcuucaacggcagccugagagugagaaccguggacagcuacgaccccgugaaggaccaguggaccagcguggccaacaugagagacagaagaagcacccugggcgccgccgugcugaacggccugcuguacgccgugggcggcuucgacggcagcaccggccugagcagcguggaggccuacaacaucaagagcaacgagugguuccacguggcccccaugaacaccagaagaagcagcgugggcgugggcguggugggcggccugcuguacgccgugggcggcuacgacggcgccagcagacagugccugagcaccguggagugcuacaacgccaccaccaacgaguggaccuacaucgccgagaugagcaccagaagaagcggcgccggcgugggcgugcugaacaaccugcuguacgccgugggcggccacgacggcccccuggugagaaagagcguggagguguacgaccccaccaccaacgccuggagacagguggccgacaugaacaugugcagaagaaacgccggcgugugcgccgugaacggccugcuguacguggugggcggcgacgacggcagcugcaaccuggccagcguggaguacuacaaccccaccaccgacaaguggaccguggugagcagcugcaugagcaccggcagaagcuacgccggcgugaccgugaucgacaagccccuguaa

SEQ ID NO: 19012 - RNA, 1905 nt, Artificial Sequence
  KLHL31__Homo_sapiens__NP_001003760
auggcccccaagaagaagaucgugaagaagaacaagggcgacaucaacgagaugaccaucaucguggaggacagcccccugaacaagcugaacgcccugaacggccugcuggagggcggcaacggccugagcugcaucagcagcgagcugaccgacgccagcuacggccccaaccugcuggagggccugagcaagaugagacaggagaacuuccugugcgaccuggugaucggcaccaagaccaagagcuucgacgugcacaagagcgugauggccagcugcagcgaguacuucuacaacauccugaagaaggaccccagcauccagagaguggaccugaacgacaucagcccccugggccuggccaccgugaucgccuacgccuacaccggcaagcugacccugagccuguacaccaucggcagcaucaucagcgccgccguguaccugcagauccacacccuggugaagaugugcagcgacuuccugaucagagagaugagcguggagaacugcauguacguggugaacaucgccgagaccuacagccugaagaacgccaaggccgccgcccagaaguucaucagagacaacuuccuggaguucgccgagagcgaccaguucaugaagcugaccuucgagcagaucaacgagcugcugaucgacgacgaccugcagcugcccagcgagaucguggccuuccagaucgccaugaaguggcuggaguucgaccagaagagagugaaguacgccgccgaccugcugagcaacaucagauucggcaccaucagcgcccaggaccuggugaacuacgugcagagcgugcccagaaugaugcaggacgccgacugccacagacugcugguggacgccaugaacuaccaccugcugcccuaccaccagaacacccugcagagcagaagaaccagaaucagaggcggcugcagagugcuggugaccgugggcggcagacccggccugaccgagaagagccugagcagagacauccuguacagagaccccgagaacggcuggagcaagcugaccgagaugcccgccaagagcuucaaccagugcguggccgugauggacggcuuccuguacguggccggcggcgaggaccagaacgacgccagaaaccaggccaagcacgccgugagcaacuucugcagauacgaccccagauucaacaccuggauccaccuggccagcaugaaccagaagagaacccacuucagccugagcguguucaacggccugguguacgccgccggcggcagaaacgccgagggcagccuggccagccuggagugcuacgugcccagcaccaaccaguggcagcccaagaccccccuggagguggccagaugcugccacgccagcgccguggccgacggcagagugcuggugaccggcggcuacaucgccaacgccuacagcagaagcgugugcgccuacgaccccgccagcgacagcuggcaggagcugcccaaccugagcacccccagaggcuggcacugcgccgugacccugagcgacagaguguacgugaugggcggcagccagcugggccccagaggcgagagaguggacgugcugaccguggagugcuacagccccgccaccggccaguggagcuacgccgccccccugcaggugggcgugagcaccgccggcgugagcgcccugcacggcagagccuaccuggugggcggcuggaacgagggcgagaagaaguacaagaagugcauccagugcuucagccccgagcugaacgaguggaccgaggacgacgagcugcccgaggccaccgugggcgugagcugcugcacccugagcaugcccaacaacgugaccagagagagcagagccagcagcgugagcagcgugcccgugagcaucuaa

SEQ ID NO: 19013 - RNA, 1752 nt, Artificial Sequence
  KLHL35__Homo_sapiens__NP_001034637
augagacagggccacgcccccgaggagagcgagcccggcugcgaggcccccugcgccggccccugccacgcccagagagugcugcaggcccugaacgccuacagaagaagcggcacccugaccgacguggugcugagagccggcggcagagacuuccccugccacagagccgcccugagcgccggcagcgccuacuucagaagccuguucgccgccggcagacccgagagaggccccgccguggugcccguggugcccguggcccccgaggcccccggcaccagccccgccggcgccgccgccgcccuggccguggugcuggacuacguguacggcgccggcgugagacugagagccgaggacgaggccgccgccgugcuggcccuggccgagagacugggcguggccggccugagagaggccugcgugagauuccuggagggcagacugagagccgccaacagccuggcccugagaagaguggccgccgccuucagccuggccccccuggccgagagaugcggcagagugcugagacaggccuucgccgagguggccagacacgccgacuuccuggagcuggcccccgacgaggugguggcccugcuggccgaccccgcccugggcguggccagagaggaggccguguucgaggccgccaugagaugggugagacacgacgcccccgccagaagaggccagcugagaagacugcuggagcacgugagacugccccugcuggcccccgccuacuuccuggagaagguggaggccgacgagcugcugcaggccugcggcgagugcagaccccugcugcuggaggccagagccugcuucauccugggcagagaggccggcgcccugagaaccagacccagaagauucauggaccuggccgaggugaucguggugaucggcggcugcgacagaaagggccugcugaagcugcccuucgccgacgccuaccaccccgagagccagagauggaccccccugcccagccugcccggcuacaccagaagcgaguucgccgccugcgcccugagaaacgacguguacgugagcggcggccacaucaacagccacgacguguggauguucagcagccaccugcacaccuggaucaagguggccagccugcacaagggcagauggagacacaagauggccguggugcagggccagcuguucgccgugggcggcuucgacggccugagaagacugcacagcguggagagauacgaccccuucagcaacaccugggccgccgccgccccccugcccgaggccgugagcagcgccgccguggccagcugcgccggcaagcuguucgugaucggcggcgccagacagggcggcgugaacaccgacaaggugcagugcuucgaccccaaggaggacagauggagccugagaagccccgcccccuucagccagagaugccuggaggccgugagccuggaggacaccaucuacgugaugggcggccugaugagcaagaucuucaccuacgaccccggcaccgacguguggggcgaggccgccgugcugcccagccccguggagagcugcggcgugaccgugugcgacggcaaggugcacauccugggcggcagagacgacagaggcgagagcaccgacaagguguucaccuucgaccccagcagcggccagguggaggugcagcccagccugcagagaugcaccagcagccacggcugcgugaccaucauccagagccugggcagauaa

SEQ ID NO: 19014 - RNA, 1668 nt, Artificial Sequence
  KLHL3__Homo_sapiens__NP_001244123
augggcaaggccuucaaggugaugaacgagcugagaagcaagcagcugcugugcgacgugaugaucguggccgaggacguggagaucgaggcccacagaguggugcuggccgccugcagccccuacuucugcgccauguucaccggcgacaugagcgagagcaaggccaagaagaucgagaucaaggacguggacggccagacccugagcaagcugaucgacuacaucuacaccgccgagaucgaggugaccgaggagaacgugcaggugcugcugcccgccgccagccugcugcagcugauggacgugagacagaacugcugcgacuuccugcagagccagcugcaccccaccaacugccugggcaucagagccuucgccgacgugcacaccugcaccgaccugcugcagcaggccaacgccuacgccgagcagcacuuccccgaggugaugcugggcgaggaguuccugagccugagccuggaccaggugugcagccugaucagcagcgacaagcugaccgugagcagcgaggagaagguguucgaggccgugaucagcuggaucaacuacgagaaggagaccagacuggagcacauggccaagcugauggagcacgugagacugccccugcugcccagagacuaccuggugcagaccguggaggaggaggcccugaucaagaacaacaacaccugcaaggacuuccugaucgaggccaugaaguaccaccugcugccccuggaccagagacugcugaucaagaaccccagaaccaagcccagaacccccgugagccugcccaaggugaugaucguggugggcggccaggcccccaaggccaucagaagcguggagugcuacgacuucgaggaggacagaugggaccagaucgccgagcugcccagcagaagaugcagagccggcgugguguucauggccggccacguguacgccgugggcggcuucaacggcagccugagagugagaaccguggacguguacgacggcgugaaggaccaguggaccagcaucgccagcaugcaggagagaagaagcacccugggcgccgccgugcugaacgaccugcuguacgccgugggcggcuucgacggcagcaccggccuggccagcguggaggccuacagcuacaagaccaacgagugguucuucguggcccccaugaacaccagaagaagcagcgugggcgugggcgugguggagggcaagcuguacgccgugggcggcuacgacggcgccagcagacagugccugagcaccguggagcaguacaaccccgccaccaacgaguggaucuacguggccgacaugagcaccagaagaagcggcgccggcgugggcgugcugagcggccagcuguacgccaccggcggccacgacggcccccuggugagaaagagcguggagguguacgaccccggcaccaacaccuggaagcagguggccgacaugaacaugugcagaagaaacgccggcgugugcgccgugaacggccugcuguacguggugggcggcgacgacggcagcugcaaccuggccagcguggaguacuacaaccccgugaccgacaaguggacccugcugcccaccaacaugagcaccggcagaagcuacgccggcguggccgugauccacaagagccuguaa

SEQ ID NO: 19015 - RNA, 1866 nt, Artificial Sequence
  KLHL40__Homo_sapiens__NP_689606
auggcccugggccuggagcaggccgaggagcagagacuguaccagcagacccugcugcaggacggccugaaggacaugcuggaccacggcaaguuccuggacugcguggugagagccggcgagagagaguuccccugccacagacuggugcuggccgccugcagccccuacuucagagccagauuccuggccgagcccgagagagccggcgagcugcaccuggaggaggugagccccgacgugguggcccaggugcugcacuaccuguacaccagcgagaucgcccuggacgaggccagcgugcaggaccuguucgccgccgcccacagauuccagauccccagcaucuucaccaucugcgugagcuuccugcagaagagacugugccugagcaacugccuggccguguucagacugggccugcugcuggacugcgccagacuggccguggccgccagagacuucaucugcgcccacuucacccugguggccagagacgccgacuuccugggccugagcgccgacgagcugaucgccaucaucagcagcgacggccugaacguggagaaggaggaggccguguucgaggccgugaugagaugggccggcagcggcgacgccgaggcccaggccgagagacagagagcccugcccaccguguucgagagcgugagaugcagacugcugcccagagccuuccuggagagcagaguggagagacacccccuggugagagcccagcccgagcugcugagaaaggugcagauggugaaggacgcccacgagggcagaaucaccacccugagaaagaagaagaagggcaaggacggcgccggcgccaaggaggccgacaagggcaccagcaaggccaaggccgaggaggacgaggaggccgagagaauccugcccggcauccugaacgacacccugagauucggcauguuccugcaggaccugaucuucaugaucagcgaggagggcgccguggccuacgaccccgccgccaacgagugcuacugcgccagccugagcaaccaggugcccaagaaccacgugagccuggugaccaaggagaaccagguguucguggccggcggccuguucuacaacgaggacaacaaggaggaccccaugagcgccuacuuccugcaguucgaccaccuggacagcgaguggcugggcaugcccccccugcccagccccagaugccuguucggccugggcgaggcccugaacagcaucuacguggugggcggcagagagaucaaggacggcgagagaugccuggacagcgugaugugcuacgacagacugagcuucaaguggggcgagagcgacccccugcccuacgugguguacggccacaccgugcugagccacauggaccugguguacgugaucggcggcaagggcagcgacagaaagugccugaacaagaugugcguguacgaccccaagaaguucgaguggaaggagcuggcccccaugcagaccgccagaagccuguucggcgccaccgugcacgacggcagaaucaucguggccgccggcgugaccgacaccggccugaccagcagcgccgagguguacagcaucaccgacaacaagugggcccccuucgaggccuucccccaggagagaagcagccugagccuggugagccuggugggcacccuguacgccaucggcggcuucgccacccuggagaccgagagcggcgagcuggugcccaccgagcugaacgacaucuggagauacaacgaggaggagaagaagugggagggcgugcugagagagaucgccuacgccgccggcgccaccuuccugcccgugagacugaacgugcugugccugaccaagauguaa

SEQ ID NO: 19016 - RNA, 1821 nt, Artificial Sequence
  KLHL41__Homo_sapiens__NP_006054
auggacagccagagagagcuggccgaggagcugagacuguaccagagcacccugcugcaggacggccugaaggaccugcuggacgagaagaaguucaucgacugcacccugaaggccggcgacaagagccugcccugccacagacugauccugagcgccugcagccccuacuucagagaguacuuccugagcgagaucgacgaggccaagaagaaggagguggugcuggacaacguggaccccgccauccuggaccugaucaucaaguaccuguacagcgccagcaucgaccugaacgacggcaacgugcaggacaucuucgcccuggccagcagauuccagauccccagcguguucaccgugugcgugagcuaccugcagaagagacuggcccccggcaacugccuggccauccugagacugggccugcugcuggacugccccagacuggccaucagcgccagagaguucgugagcgacagauucgugcagaucugcaaggaggaggacuucaugcagcugagcccccaggagcugaucagcgugaucagcaacgacagccugaacguggagaaggaggaggccguguucgaggccgugaugaagugggugagaaccgacaaggagaacagagugaagaaccugagcgagguguucgacugcaucagauucagacugaugaccgagaaguacuucaaggaccacguggagaaggacgacaucaucaagagcaaccccgaccugcagaagaagaucaaggugcugaaggacgccuucgccggcaagcugcccgagcccagcaagaacgccgccaagaccggcgccggcgaggugaacggcgacgugggcgacgaggaccugcugcccggcuaccugaacgacauccccagacacggcauguucgugaaggaccugauccugcuggugaacgacaccgccgccguggccuacgaccccaccgagaacgagugcuaccugaccgcccuggccgagcagauccccagaaaccacagcagcaucgugacccagcagaaccagaucuacguggugggcggccuguacguggacgaggagaacaaggaccagccccugcagagcuacuucuuccagcuggacagcaucgccagcgagugggugggccugcccccccugcccagcgccagaugccuguucggccugggcgagguggacgacaagaucuacgugguggccggcaaggaccugcagaccgaggccagccuggacagcgugcugugcuacgaccccguggccgccaaguggaacgaggugaagaagcugcccaucaagguguacggccacaacgugaucagccacaagggcaugaucuacugccugggcggcaagaccgacgacaagaagugcaccaacagaguguucaucuucaaccccaagaagggcgacuggaaggaccuggcccccaugaagauccccagaagcauguucggcguggccgugcacaagggcaagaucgugaucgccggcggcgugaccgaggacggccugagcgccagcguggaggccuucgaccugaccaccaacaagugggacgugaugaccgaguucccccaggagagaagcagcaucagccuggugagccuggccggcagccuguacgccaucggcggcuucgccaugauccagcuggagagcaaggaguucgcccccaccgaggugaacgacaucuggaaguacgaggacgacaagaaggagugggccggcaugcugaaggagaucagauacgccagcggcgccagcugccuggccaccagacugaaccuguucaagcugagcaagcuguaa

SEQ ID NO: 19017 - RNA, 1518 nt, Artificial Sequence
  KLHL42__Homo_sapiens__NP_065833
augagcgccgaggagauggugcagaucagacuggaggacagaugcuaccccgugagcaagagaaagcugaucgagcagagcgacuacuucagagcccuguacagaagcggcaugagagaggcccugagccaggaggccggcggccccgaggugcagcagcugagaggccugagcgcccccggccugagacuggugcuggacuucaucaacgccggcggcgccagagagggcuggcugcugggccccagaggcgagaagggcggcggcguggacgaggacgaggagauggacgaggugagccugcugagcgagcugguggaggccgccagcuuccugcaggugaccagccugcugcagcugcugcugagccaggugagacugaacaacugccuggagauguacagacuggcccagguguacggccugcccgaccugcaggaggccugccugagauucaugguggugcacuuccacgaggugcugugcaagccccaguuccaccugcugggcagccccccccaggcccccggcgacgugagccugaagcagagacugagagaggccagaaugaccggcacccccgugcugguggcccugggcgacuuccugggcggcccccuggccccccaccccuaccagggcgagccccccagcaugcugagauacgaggagaugaccgagagaugguucccccuggccaacaaccugccccccgaccuggugaacgugagaggcuacggcagcgccauccuggacaacuaccuguucaucgugggcggcuacagaaucaccagccaggagaucagcgccgcccacagcuacaaccccagcaccaacgaguggcugcagguggccagcaugaaccagaagagaagcaacuucaagcugguggccgugaacagcaagcuguacgccaucggcggccaggccgugagcaacguggagugcuacaaccccgagcaggacgccuggaacuucguggccccccugcccaacccccuggccgaguucagcgccugcgagugcaagggcaagaucuacgugaucggcggcuacaccaccagagacagaaacaugaacauccugcaguacugccccagcagcgacauguggacccuguucgagaccugcgacgugcacaucagaaagcagcagauggugagcguggaggagaccaucuacaucgugggcggcugccugcacgagcugggccccaacagaagaagcagccagagcgaggacaugcugaccgugcagagcuacaacaccgugaccagacaguggcuguaccugaaggagaacaccagcaagagcggccugaaccugaccugcgcccugcacaacgacggcaucuacaucaugagcagagacgugacccugagcaccagccuggagcacagaguguuccugaaguacaacaucuucagcgacagcugggaggccuucagaagauuccccgccuucggccacaaccugcuggugagcagccuguaccugcccaacaaggccgagaccuaa

SEQ ID NO: 19018 - RNA, 2130 nt, Artificial Sequence
  KLHL5__Homo_sapiens__NP_001007076
augagcggcagcagaaaggaguucgacgugaagcagauccugaagaucagauggagaugguucggccaccaggccagcagccccaacagcaccguggacagccagcagggcgaguucuggaacagaggccagaccggcgccaacggcggcagaaaguuccuggaccccugcagccugcagcugccccuggccagcaucggcuacagaagaagcagccagcuggacuuccagaacagccccagcuggcccauggccagcaccagcgaggugcccgccuucgaguucaccgccgaggacugcggcggcgcccacuggcuggacagacccgagguggacgacggcaccagcgaggaggagaacgagagcgacagcagcagcugcagaaccagcaacagcagccagacccugagcagcugccacaccauggagcccugcaccagcgacgaguucuuccaggcccugaaccacgccgagcagaccuucaagaagauggagaacuaccugagacacaagcagcugugcgacgugauccugguggccggcgacagaagaauccccgcccacagacuggugcugagcagcgugagcgacuacuucgccgccauguucaccaacgacgugagagaggccagacaggaggagaucaagauggagggcguggagcccaacagccuguggagccugauccaguacgccuacaccggcagacuggagcugaaggaggacaacaucgagugccugcugagcaccgccugccugcugcagcugagccaggugguggaggccugcugcaaguuccugaugaagcagcugcaccccagcaacugccugggcaucagaagcuucgccgacgcccagggcugcaccgaccugcacaagguggcccacaacuacaccauggagcacuucauggaggugaucagaaaccaggaguucgugcugcugcccgccagcgagaucgccaagcugcuggccagcgacgacaugaacauccccaacgaggagaccauccugaacgcccugcugaccugggugagacacgaccuggagcagagaagaaaggaccugagcaagcugcuggccuacaucagacugccccugcuggccccccaguuccuggccgacauggagaacaacgugcuguucagagacgacaucgagugccagaagcugaucauggaggccaugaaguaccaccugcugcccgagagaagacccaugcugcagagccccagaaccaagcccagaaagagcaccgugggcacccuguucgccgugggcggcauggacagcaccaagggcgccaccagcaucgagaaguacgaccugagaaccaacauguggacccccguggccaacaugaacggcagaagacugcaguucggcguggccgugcuggacgacaagcuguacguggugggcggcagagacggccugaagacccugaacaccguggagugcuacaaccccaagaccaagaccuggagcgugaugccccccaugagcacccacagacacggccugggcguggccgugcuggagggccccauguacgccgugggcggccacgacggcuggagcuaccugaacaccguggagagaugggacccccaggccagacaguggaacuucguggccaccaugagcacccccagaagcaccgugggcguggccgugcugagcggcaagcuguacgccgugggcggcagagacggcagcagcugccugaagagcguggagugcuucgacccccacaccaacaaguggacccugugcgcccagaugagcaagagaagaggcggcgugggcgugaccaccuggaacggccugcuguacgccaucggcggccacgacgcccccgccagcaaccugaccagcagacugagcgacugcguggagagauacgaccccaagaccgacauguggaccgccguggccagcaugagcaucagcagagacgccgugggcgugugccugcugggcgacaagcuguacgccgugggcggcuacgacggccaggccuaccugaacaccguggaggccuacgacccccagaccaacgaguggacccagguggccccccugugccugggcagagccggcgccugcguggugaccgugaagcuguaa

SEQ ID NO: 19019 - RNA, 1866 nt, Artificial Sequence
  KLHL6__Homo_sapiens__NP_569713
augcugauggccggccagagaggcgccuggaccaugggcgacgugguggagaagagccuggagggcccccuggcccccagcaccgacgagcccagccagaagaccggcgaccugguggagauccugaacggcgagaaggugaaguucgacgacgccggccugagccugauccugcagaacggccuggagacccugagaauggagaacgcccugaccgacgugauccugugcguggacauccaggaguucagcugccacagaguggugcuggccgccgccagcaacuacuucagagccauguucugcaacgaccugaaggagaaguacgagaagagaaucaucaucaagggcguggacgccgagaccaugcacacccugcuggacuacaccuacaccagcaaggcccugaucaccaagcagaacgugcagagagugcuggaggccgccaaccuguuccaguuccugagaaugguggacgccugcgccagcuuccugaccgaggcccugaaccccgagaacugcgugggcauccugagacuggccgacacccacagccuggacagccugaagaagcaggugcagagcuacaucauccagaacuucgugcagauccugaacagcgaggaguuccuggaccugcccguggacacccugcaccacauccugaagagcgacgaccuguacgugaccgaggaggcccagguguucgagaccgugaugagcugggugagacacaagcccagcgagagacugugccugcugcccuacgugcuggagaacgugagacugccccugcuggaccccugguacuucguggagaccguggaggccgacccccugaucagacagugccccgagguguucccccugcugcaggaggccagaauguaccaccugagcggcaacgagaucaucagcgagagaaccaagcccagaaugcacgaguuccagagcgagguguucaugaucaucggcggcugcaccaaggacgagagauucguggccgaggugaccugccuggacccccugagaagaagcagacuggagguggccaagcugccccugaccgagcacgagcuggagagcgagaacaagaaguggguggaguucgccugcgugacccugaagaacgagguguacaucagcggcggcaaggagacccagcacgacguguggaaguacaacagcagcaucaacaaguggauccagaucgaguaccugaacaucggcagauggagacacaagaugguggugcugggcggcaagguguacgugaucggcggcuucgacggccugcagagaaucaacaacguggagaccuacgaccccuuccacaacugcuggagcgaggccgccccccugcuggugcacgugagcagcuucgccgccaccagccacaagaagaagcuguacgugaucggcggcggccccaacggcaagcuggccaccgacaagacccagugcuacgaccccagcaccaacaaguggagccugaaggccgccaugcccguggaggccaagugcaucaacgccgugagcuucagagacagaaucuacguggugggcggcgccaugagagcccuguacgccuacagcccccuggaggacagcuggugccuggugacccagcugagccacgagagagccagcugcggcaucgcccccugcaacaacagacuguacaucaccggcggcagagacgagaagaacgaggugaucgccaccgugcugugcugggaccccgaggcccagaagcugaccgaggagugcgugcugcccagaggcgugagccaccacggcagcgugaccaucagaaagagcuacacccacaucagaagaaucgugcccggcgccgugagcguguaa

SEQ ID NO: 19020 - RNA, 1761 nt, Artificial Sequence
  KLHL7__Homo_sapiens__NP_001026880
auggccgccagcggcguggagaagagcagcaagaagaagaccgagaagaagcuggccgccagagaggaggccaagcugcuggccggcuucaugggcgugaugaacaacaugagaaagcagaagacccugugcgacgugauccugauggugcaggagagaaagauccccgcccacagaguggugcuggccgccgccagccacuucuucaaccugauguucaccaccaacaugcuggagagcaagagcuucgagguggagcugaaggacgccgagcccgacaucaucgagcagcugguggaguucgccuacaccgccagaaucagcgugaacagcaacaacgugcagagccugcuggacgccgccaaccaguaccagaucgagcccgugaagaagaugugcguggacuuccugaaggagcagguggacgccagcaacugccugggcaucagcgugcuggccgagugccuggacugccccgagcugaaggccaccgccgacgacuucauccaccagcacuucaccgagguguacaagaccgacgaguuccugcagcuggacgugaagagagugacccaccugcugaaccaggacacccugaccgugagagccgaggaccagguguacgacgccgccgugagauggcugaaguacgacgagcccaacagacagcccuucaugguggacauccuggccaaggugagauucccccugaucagcaagaacuuccugagcaagaccgugcaggccgagccccugauccaggacaaccccgagugccugaagauggugaucagcggcaugagauaccaccugcugagccccgaggacagagaggagcugguggacggcaccagacccagaagaaagaagcacgacuacagaaucgcccuguucggcggcagccagccccagagcugcagauacuucaaccccaaggacuacagcuggaccgacaucagaugccccuucgagaagagaagagacgccgccugcguguucugggacaacgugguguacauccugggcggcagccagcuguuccccaucaagagaauggacugcuacaacguggugaaggacagcugguacagcaagcugggcccccccacccccagagacagccuggccgccugcgccgccgagggcaagaucuacaccagcggcggcagcgaggugggcaacagcgcccuguaccuguucgagugcuacgacaccagaaccgagagcuggcacaccaagcccagcaugcugacccagagaugcagccacggcaugguggaggccaacggccugaucuacgugugcggcggcagccugggcaacaacgugagcggcagagugcugaacagcugcgagguguacgaccccgccaccgagaccuggaccgagcugugccccaugaucgaggccagaaagaaccacggccugguguucgugaaggacaagaucuucgccgugggcggccagaacggccugggcggccuggacaacguggaguacuacgacaucaagcugaacgaguggaagauggugagccccaugcccuggaagggcgugaccgugaagugcgccgccgugggcagcaucguguacgugcuggccggcuuccagggcgugggcagacugggccacauccuggaguacaacaccgagaccgacaaguggguggccaacagcaaggugagagccuuccccgugaccagcugccugaucugcgugguggacaccugcggcgccaacgaggagacccuggagaccuaa

SEQ ID NO: 19021 - RNA, 1854 nt, Artificial Sequence
  KLHL9__Homo_sapiens__NP_061335
augaaggugagccugggcaacggcgagaugggcgugagcgcccaccugcagcccugcaaggccggcaccaccagauucuucaccagcaacacccacagcagcguggugcugcagggcuucgaccagcugagaaucgagggccugcugugcgacgugacccuggugcccggcgacggcgacgagaucuuccccgugcacagagccaugauggccagcgccagcgacuacuucaaggccauguucaccggcggcaugaaggagcaggaccugaugugcaucaagcugcacggcgugaacaaggugggccugaagaagaucaucgacuucaucuacaccgccaagcugagccugaacauggacaaccugcaggacacccuggaggccgccagcuuccugcagauccugcccgugcuggacuucugcaagguguuccugaucagcggcgugagccuggacaacugcguggaggugggcagaaucgccaacaccuacaaccugaucgagguggacaaguacgugaacaacuucauccugaagaacuuccccgcccugcugagcaccggcgaguuccugaagcugcccuucgagagacuggccuucgugcugagcagcaacagccugaagcacugcaccgagcuggagcuguucaaggccgccugcagauggcugagacuggaggaccccagaauggacuacgccgccaagcugaugaagaacaucagauucccccugaugaccccccaggaccugaucaacuacgugcagaccguggacuucaugagaaccgacaacaccugcgugaaccugcugcuggaggccagcaacuaccagaugaugcccuacaugcagcccgugaugcagagcgacagaaccgccaucagaagcgacagcacccaccuggugacccugggcggcgugcugagacagcagcugguggugagcaaggagcugagaauguacgacgagagagcccaggaguggagaagccuggcccccauggacgcccccagauaccagcacggcaucgccgugaucggcaacuuccuguacguggugggcggccagagcaacuacgacaccaagggcaagaccgccguggacaccguguucagauucgaccccagauacaacaaguggaugcagguggccagccugaacgagaagagaaccuucuuccaccugagcgcccugaagggccaccuguacgccgugggcggcagaagcgccgccggcgagcuggccaccguggagugcuacaaccccagaaugaacgaguggagcuacguggccaagaugagcgagccccacuacggccacgccggcaccguguacggcggccugauguacaucagcggcggcaucacccacgacaccuuccagaacgagcugaugugcuucgaccccgacaccgacaaguggaugcagaaggcccccaugaccaccgugagaggccugcacugcaugugcaccgugggcgacaagcuguacgugaucggcggcaaccacuucagaggcaccagcgacuacgacgacgugcugagcugcgaguacuacagccccacccuggaccaguggacccccaucgccgccaugcugagaggccagagcgacgugggcguggccguguucgagaacaagaucuacguggugggcggcuacagcuggaacaacagaugcaugguggagaucgugcagaaguacgaccccgagaaggacgaguggcacaagguguucgaccugcccgagagccugggcggcaucagagccugcacccugaccguguucccccccgaggagaaccccggcagccccagcagagagagcccccugagcgcccccagcgaccacagcuaa

SEQ ID NO: 19022 - RNA, 3039 nt, Artificial Sequence
  KL__Homo_sapiens__NP_004786
augcccgccagcgccccccccagaagacccagaccccccccccccagccugagccugcugcuggugcugcugggccugggcggcagaagacugagagccgagcccggcgacggcgcccagaccugggccagauucagcagaccccccgcccccgaggccgccggccuguuccagggcaccuuccccgacggcuuccugugggccgugggcagcgccgccuaccagaccgagggcggcuggcagcagcacggcaagggcgccagcaucugggacaccuucacccaccacccccuggccccccccggcgacagcagaaacgccagccugccccugggcgcccccagcccccugcagcccgccaccggcgacguggccagcgacagcuacaacaacguguucagagacaccgaggcccugagagagcugggcgugacccacuacagauucagcaucagcugggccagagugcugcccaacggcagcgccggcgugcccaacagagagggccugagauacuacagaagacugcuggagagacugagagagcugggcgugcagcccguggugacccuguaccacugggaccugccccagagacugcaggacgccuacggcggcugggccaacagagcccuggccgaccacuucagagacuacgccgagcugugcuucagacacuucggcggccaggugaaguacuggaucaccaucgacaaccccuacgugguggccuggcacggcuacgccaccggcagacuggcccccggcaucagaggcagccccagacugggcuaccugguggcccacaaccugcugcuggcccacgccaagguguggcaccuguacaacaccagcuucagacccacccagggcggccaggugagcaucgcccugagcagccacuggaucaaccccagaagaaugaccgaccacagcaucaaggagugccagaagagccuggacuucgugcugggcugguucgccaagcccguguucaucgacggcgacuaccccgagagcaugaagaacaaccugagcagcauccugcccgacuucaccgagagcgagaagaaguucaucaagggcaccgccgacuucuucgcccugugcuucggccccacccugagcuuccagcugcuggacccccacaugaaguucagacagcuggagagccccaaccugagacagcugcugagcuggaucgaccuggaguucaaccacccccagaucuucaucguggagaacggcugguucgugagcggcaccaccaagagagacgacgccaaguacauguacuaccugaagaaguucaucauggagacccugaaggccaucaagcuggacggcguggacgugaucggcuacaccgccuggagccugauggacggcuucgaguggcacagaggcuacagcaucagaagaggccuguucuacguggacuuccugagccaggacaagaugcugcugcccaagagcagcgcccuguucuaccagaagcugaucgagaagaacggcuuccccccccugcccgagaaccagccccuggagggcaccuuccccugcgacuucgccuggggcgugguggacaacuacauccagguggacaccacccugagccaguucaccgaccugaacguguaccugugggacgugcaccacagcaagagacugaucaagguggacggcguggugaccaagaagagaaagagcuacugcguggacuucgccgccauccagccccagaucgcccugcugcaggagaugcacgugacccacuucagauucagccuggacugggcccugauccugccccugggcaaccagagccaggugaaccacaccauccugcaguacuacagaugcauggccagcgagcuggugagagugaacaucacccccgugguggcccuguggcagcccauggcccccaaccagggccugcccagacugcuggccagacagggcgccugggagaaccccuacaccgcccuggccuucgccgaguacgccagacugugcuuccaggagcugggccaccacgugaagcuguggaucaccaugaacgagcccuacaccagaaacaugaccuacagcgccggccacaaccugcugaaggcccacgcccuggccuggcacguguacaacgagaaguucagacacgcccagaacggcaagaucagcaucgcccugcaggccgacuggaucgagcccgccugccccuucagccagaaggacaaggagguggccgagagagugcuggaguucgacaucggcuggcuggccgagcccaucuucggcagcggcgacuaccccugggugaugagagacuggcugaaccagagaaacaacuuccugcugcccuacuucaccgaggacgagaagaagcugauccagggcaccuucgacuuccuggcccugagccacuacaccaccauccugguggacagcgagaaggaggaccccaucaaguacaacgacuaccuggaggugcaggagaugaccgacaucaccuggcugaacagccccagccagguggccguggugcccuggggccugagaaaggugcugaacuggcugaaguucaaguacggcgaccugcccauguacaucaucagcaacggcaucgacgacggccugcacgccgaggacgaccagcugagaguguacuacaugcagaacuacaucaacgaggcccugaaggcccacauccuggacggcaucaaccugugcggcuacuucgccuacagcuucaacgacagaaccgcccccagauucggccuguacagauacgccgccgaccaguucgagcccaaggccagcaugaagcacuacagaaagaucaucgacagcaacggcuuccccggccccgagacccuggagagauucugccccgaggaguucaccgugugcaccgagugcagcuucuuccacaccagaaagagccugcuggccuucaucgccuuccuguucuucgccagcaucaucagccugagccugaucuucuacuacagcaagaagggcagaagaagcuacaaguaa

SEQ ID NO: 19023 - RNA, 831 nt, Artificial Sequence
  KLK10__Homo_sapiens__NP_002767
augagagccccccaccugcaccugagcgccgccagcggcgccagagcccuggccaagcugcugccccugcugauggcccagcugugggccgccgaggccgcccugcugccccagaacgacaccagacuggaccccgaggccuacggcagccccugcgccagaggcagccagcccuggcaggugagccuguucaacggccugagcuuccacugcgccggcgugcugguggaccagagcugggugcugaccgccgcccacugcggcaacaagccccugugggccagagugggcgacgaccaccugcugcugcugcagggcgagcagcugagaagaaccaccagaagcguggugcaccccaaguaccaccagggcagcggccccauccugcccagaagaaccgacgagcacgaccugaugcugcugaagcuggccagacccguggugcugggccccagagugagagcccugcagcugcccuacagaugcgcccagcccggcgaccagugccagguggccggcuggggcaccaccgccgccagaagagugaaguacaacaagggccugaccugcagcagcaucaccauccugagccccaaggagugcgagguguucuaccccggcguggugaccaacaacaugaucugcgccggccuggacagaggccaggaccccugccagagcgacagcggcggcccccuggugugcgacgagacccugcagggcauccugagcuggggcguguaccccugcggcagcgcccagcaccccgccguguacacccagaucugcaaguacaugagcuggaucaacaaggugaucagaagcaacuaa

SEQ ID NO: 19024 - RNA, 753 nt, Artificial Sequence
  KLK11__Homo_sapiens__NP_001129504
augagaauccugcagcugauccugcuggcccuggccaccggccuggugggcggcgagaccagaaucaucaagggcuucgagugcaagccccacagccagcccuggcaggccgcccuguucgagaagaccagacugcugugcggcgccacccugaucgcccccagauggcugcugaccgccgcccacugccugaagcccagauacaucgugcaccugggccagcacaaccugcagaaggaggagggcugcgagcagaccagaaccgccaccgagagcuucccccaccccggcuucaacaacagccugcccaacaaggaccacagaaacgacaucaugcuggugaagauggccagccccgugagcaucaccugggccgugagaccccugacccugagcagcagaugcgugaccgccggcaccagcugccugaucagcggcuggggcagcaccagcagcccccagcugagacugccccacacccugagaugcgccaacaucaccaucaucgagcaccagaagugcgagaacgccuaccccggcaacaucaccgacaccauggugugcgccagcgugcaggagggcggcaaggacagcugccagggcgacagcggcggcccccuggugugcaaccagagccugcagggcaucaucagcuggggccaggaccccugcgccaucaccagaaagcccggcguguacaccaaggugugcaaguacguggacuggauccaggagaccaugaagaacaacuaa

SEQ ID NO: 19025 - RNA, 765 nt, Artificial Sequence
  KLK12__Homo_sapiens__NP_062544
augggccugagcaucuuccugcugcugugcgugcugggccugagccaggccgccacccccaagaucuucaacggcaccgagugcggcagaaacagccagcccuggcaggugggccuguucgagggcaccagccugagaugcggcggcgugcugaucgaccacagaugggugcugaccgccgcccacugcagcggcagcagauacugggugagacugggcgagcacagccugagccagcuggacuggaccgagcagaucagacacagcggcuucagcgugacccaccccggcuaccugggcgccagcaccagccacgagcacgaccugagacugcugagacugagacugcccgugagagugaccagcagcgugcagccccugccccugcccaacgacugcgccaccgccggcaccgagugccacgugagcggcuggggcaucaccaaccaccccagaaaccccuuccccgaccugcugcagugccugaaccugagcaucgugagccacgccaccugccacggcguguaccccggcagaaucaccagcaacauggugugcgccggcggcgugcccggccaggacgccugccagggcgacagcggcggcccccuggugugcggcggcgugcugcagggccuggugagcuggggcagcgugggccccugcggccaggacggcauccccggcguguacaccuacaucugcaacagcacccuggugggccugggcaccagcuggaacuucaacagcugccagcccuucuaa

SEQ ID NO: 19026 - RNA, 834 nt, Artificial Sequence
  KLK13__Homo_sapiens__NP_056411
auguggccccuggcccuggugaucgccagccugacccuggcccugagcggcggcgugagccaggagagcagcaaggugcugaacaccaacggcaccagcggcuuccugcccggcggcuacaccugcuucccccacagccagcccuggcaggccgcccugcuggugcagggcagacugcugugcggcggcgugcuggugcaccccaagugggugcugaccgccgcccacugccugaaggagggccugaagguguaccugggcaagcacgcccugggcagaguggaggccggcgagcaggugagagagguggugcacagcaucccccaccccgaguacagaagaagccccacccaccugaaccacgaccacgacaucaugcugcuggagcugcagagccccgugcagcugaccggcuacauccagacccugccccugagccacaacaacagacugacccccggcaccaccugcagagugagcggcuggggcaccaccaccagcccccaggugaacuaccccaagacccugcagugcgccaacauccagcugagaagcgacgaggagugcagacagguguaccccggcaagaucaccgacaacaugcugugcgccggcaccaaggagggcggcaaggacagcugcgagggcgacagcggcggcccccuggugugcaacagaacccuguacggcaucgugagcuggggcgacuuccccugcggccagcccgacagacccggcguguacaccagagugagcagauacgugcuguggaucagagagaccaucagaaaguacgagacccagcagcagaaguggcugaagggcccccaguaa

SEQ ID NO: 19027 - RNA, 804 nt, Artificial Sequence
  KLK14__Homo_sapiens__NP_071329
augagccugagagugcugggcagcggcaccuggcccagcgcccccaagauguuccugcugcugaccgcccugcaggugcuggccaucgccaugacccagagccaggaggacgagaacaagaucaucggcggccacaccugcaccagaagcagccagcccuggcaggccgcccugcuggccggccccagaagaagauuccugugcggcggcgcccugcugagcggccagugggugaucaccgccgcccacugcggcagacccauccugcagguggcccugggcaagcacaaccugagaagaugggaggccacccagcaggugcugagaguggugagacaggugacccaccccaacuacaacagcagaacccacgacaacgaccugaugcugcugcagcugcagcagcccgccagaaucggcagagccgugagacccaucgaggugacccaggccugcgccagccccggcaccagcugcagagugagcggcuggggcaccaucagcagccccaucgccagauaccccgccagccugcagugcgugaacaucaacaucagccccgacgaggugugccagaaggccuaccccagaaccaucacccccggcauggugugcgccggcgugccccagggcggcaaggacagcugccagggcgacagcggcggcccccuggugugcagaggccagcugcagggccuggugagcuggggcauggagagaugcgcccugcccggcuaccccggcguguacaccaaccugugcaaguacagaagcuggaucgaggagaccaugagagacaaguaa

SEQ ID NO: 19028 - RNA, 768 nt, Artificial Sequence
  KLK15__Homo_sapiens__NP_001264010
auguggcugcugcugacccugagcuuccugcuggccagcaccgcccaggacggcgacaagcugcuggagggcgacgagugcgccccccacagccagcccuggcagguggcccuguacgagagaggcagauucaacugcggcgccagccugaucagcccccacugggugcugagcgccgcccacugccagagcagauucaugagagugagacugggcgagcacaaccugagaaagagagacggccccgagcagcugagaaccaccagcagagugaucccccaccccagauacgaggccagaagccacagaaacgacaucaugcugcugagacuggugcagcccgccagacugaacccccaggugagacccgccgugcugcccaccagaugcccccaccccggcgaggccugcguggugagcggcuggggccuggugagccacaacgagcccggcaccgccggcagccccagaagccaggugagccugcccgacacccugcacugcgccaacaucagcaucaucagcgacaccagcugcgacaagagcuaccccggcagacugaccaacaccauggugugcgccggcgccgagggcagaggcgccgagagcugcgagggcgacagcggcggcccccuggugugcggcggcauccugcagggcaucgugagcuggggcgacgugcccugcgacaacaccaccaagcccggcguguacaccaaggugugccacuaccuggaguggaucagagagaccaugaagagaaacuaa

SEQ ID NO: 19029 - RNA, 789 nt, Artificial Sequence
  KLK1__Homo_sapiens__NP_002248
augugguuccuggugcugugccuggcccugagccugggcggcaccggcgccgccccccccauccagagcagaaucgugggcggcugggagugcgagcagcacagccagcccuggcaggccgcccuguaccacuucagcaccuuccagugcggcggcauccuggugcacagacagugggugcugaccgccgcccacugcaucagcgacaacuaccagcuguggcugggcagacacaaccuguucgacgacgagaacaccgcccaguucgugcacgugagcgagagcuucccccaccccggcuucaacaugagccugcuggagaaccacaccagacaggccgacgaggacuacagccacgaccugaugcugcugagacugaccgagcccgccgacaccaucaccgacgccgugaaggugguggagcugcccaccgaggagcccgaggugggcagcaccugccuggccagcggcuggggcagcaucgagcccgagaacuucagcuuccccgacgaccugcagugcguggaccugaagauccugcccaacgacgagugcaagaaggcccacgugcagaaggugaccgacuucaugcugugcgugggccaccuggagggcggcaaggacaccugcgugggcgacagcggcggcccccugaugugcgacggcgugcugcagggcgugaccagcuggggcuacgugcccugcggcacccccaacaagcccagcguggccgugagagugcugagcuacgugaaguggaucgaggacaccaucgccgagaacagcuaa

SEQ ID NO: 19030 - RNA, 672 nt, Artificial Sequence
  KLK2__Homo_sapiens__NP_001002231
augugggaccuggugcugagcaucgcccugagcgugggcugcaccggcgccgugccccugauccagagcagaaucgugggcggcugggagugcgagaagcacagccagcccuggcagguggccguguacagccacggcugggcccacugcggcggcgugcuggugcacccccagugggugcugaccgccgcccacugccugaagaagaacagccagguguggcugggcagacacaaccuguucgagcccgaggacaccggccagagagugcccgugagccacagcuucccccacccccuguacaacaugagccugcugaagcaccagagccugagacccgacgaggacagcagccacgaccugaugcugcugagacugagcgagcccgccaagaucaccgacguggugaaggugcugggccugcccacccaggagcccgcccugggcaccaccugcuacgccagcggcuggggcagcaucgagcccgaggaguuccugagacccagaagccugcagugcgugagccugcaccugcugagcaacgacaugugcgccagagccuacagcgagaaggugaccgaguucaugcugugcgccggccuguggaccggcggcaaggacaccugcggcgugagccaccccuacagccagcaccuggagggcaagggcuaa

SEQ ID NO: 19031 - RNA, 717 nt, Artificial Sequence
  KLK3__Homo_sapiens__NP_001025218
augugggugcccgugguguuccugacccugagcgugaccuggaucggcgccgccccccugauccugagcagaaucgugggcggcugggagugcgagaagcacagccagcccuggcaggugcugguggccagcagaggcagagccgugugcggcggcgugcuggugcacccccagugggugcugaccgccgcccacugcaucagaaacaagagcgugauccugcugggcagacacagccuguuccaccccgaggacaccggccagguguuccaggugagccacagcuucccccacccccuguacgacaugagccugcugaagaacagauuccugagacccggcgacgacagcagccacgaccugaugcugcugagacugagcgagcccgccgagcugaccgacgccgugaaggugauggaccugcccacccaggagcccgcccugggcaccaccugcuacgccagcggcuggggcagcaucgagcccgaggaguuccugacccccaagaagcugcagugcguggaccugcacgugaucagcaacgacgugugcgcccaggugcacccccagaaggugaccaaguucaugcugugcgccggcagauggaccggcggcaagagcaccugcagcugggugauccugaucaccgagcugaccaugcccgcccugcccauggugcugcacggcagccuggugcccuggagaggcggcguguaa

SEQ ID NO: 19032 - RNA, 765 nt, Artificial Sequence
  KLK4__Homo_sapiens__NP_004908
auggccaccgccggcaaccccuggggcugguuccugggcuaccugauccugggcguggccggcagccuggugagcggcagcugcagccagaucaucaacggcgaggacugcagcccccacagccagcccuggcaggccgcccuggugauggagaacgagcuguucugcagcggcgugcuggugcacccccagugggugcugagcgccgcccacugcuuccagaacagcuacaccaucggccugggccugcacagccuggaggccgaccaggagcccggcagccagaugguggaggccagccugagcgugagacaccccgaguacaacagaccccugcuggccaacgaccugaugcugaucaagcuggacgagagcgugagcgagagcgacaccaucagaagcaucagcaucgccagccagugccccaccgccggcaacagcugccuggugagcggcuggggccugcuggccaacggcagaaugcccaccgugcugcagugcgugaacgugagcguggugagcgaggaggugugcagcaagcuguacgacccccuguaccaccccagcauguucugcgccggcggcggccaggaccagaaggacagcugcaacggcgacagcggcggcccccugaucugcaacggcuaccugcagggccuggugagcuucggcaaggcccccugcggccaggugggcgugcccggcguguacaccaaccugugcaaguucaccgaguggaucgagaagaccgugcaggccagcuaa

SEQ ID NO: 19033 - RNA, 882 nt, Artificial Sequence
  KLK5__Homo_sapiens__NP_036559
auggccaccgccagaccccccuggaugugggugcugugcgcccugaucaccgcccugcugcugggcgugaccgagcacgugcuggccaacaacgacgugagcugcgaccaccccagcaacaccgugcccagcggcagcaaccaggaccugggcgccggcgccggcgaggacgccagaagcgacgacagcagcagcagaaucaucaacggcagcgacugcgacaugcacacccagcccuggcaggccgcccugcugcugagacccaaccagcuguacugcggcgccgugcuggugcacccccaguggcugcugaccgccgcccacugcagaaagaagguguucagagugagacugggccacuacagccugagccccguguacgagagcggccagcagauguuccagggcgugaagagcaucccccaccccggcuacagccaccccggccacagcaacgaccugaugcugaucaagcugaacagaagaaucagacccaccaaggacgugagacccaucaacgugagcagccacugccccagcgccggcaccaagugccuggugagcggcuggggcaccaccaagagcccccaggugcacuuccccaaggugcugcagugccugaacaucagcgugcugagccagaagagaugcgaggacgccuaccccagacagaucgacgacaccauguucugcgccggcgacaaggccggcagagacagcugccagggcgacagcggcggccccguggugugcaacggcagccugcagggccuggugagcuggggcgacuaccccugcgccagacccaacagacccggcguguacaccaaccugugcaaguucaccaaguggauccaggagaccauccaggccaacagcuaa

SEQ ID NO: 19034 - RNA, 735 nt, Artificial Sequence
  KLK6__Homo_sapiens__NP_001012982
augaagaagcugaugguggugcugagccugaucgccgccgccugggccgaggagcagaacaagcuggugcacggcggccccugcgacaagaccagccaccccuaccaggccgcccuguacaccagcggccaccugcugugcggcggcgugcugauccacccccugugggugcugaccgccgcccacugcaagaagcccaaccugcagguguuccugggcaagcacaaccugagacagagagagagcagccaggagcagagcagcguggugagagccgugauccaccccgacuacgacgccgccagccacgaccaggacaucaugcugcugagacuggccagacccgccaagcugagcgagcugauccagccccugccccuggagagagacugcagcgccaacaccaccagcugccacauccugggcuggggcaagaccgccgacggcgacuuccccgacaccauccagugcgccuacauccaccuggugagcagagaggagugcgagcacgccuaccccggccagaucacccagaacaugcugugcgccggcgacgagaaguacggcaaggacagcugccagggcgacagcggcggcccccuggugugcggcgaccaccugagaggccuggugagcuggggcaacauccccugcggcagcaaggagaagcccggcguguacaccaacgugugcagauacaccaacuggauccagaagaccauccaggccaaguaa

SEQ ID NO: 19035 - RNA, 546 nt, Artificial Sequence
  KLK7__Homo_sapiens__NP_001193982
augaacgaguacaccgugcaccugggcagcgacacccugggcgacagaagagcccagagaaucaaggccagcaagagcuucagacaccccggcuacagcacccagacccacgugaacgaccugaugcuggugaagcugaacagccaggccagacugagcagcauggugaagaaggugagacugcccagcagaugcgagccccccggcaccaccugcaccgugagcggcuggggcaccaccaccagccccgacgugaccuuccccagcgaccugaugugcguggacgugaagcugaucagcccccaggacugcaccaagguguacaaggaccugcuggagaacagcaugcugugcgccggcauccccgacagcaagaagaacgccugcaacggcgacagcggcggcccccuggugugcagaggcacccugcagggccuggugagcuggggcaccuuccccugcggccagcccaacgaccccggcguguacacccaggugugcaaguucaccaaguggaucaacgacaccaugaagaagcacagauaa

SEQ ID NO: 19036 - RNA, 783 nt, Artificial Sequence
  KLK8__Homo_sapiens__NP_009127
augggcagacccagacccagagccgccaagaccuggauguuccugcugcugcugggcggcgccugggccggccacagcagagcccaggaggacaaggugcugggcggccacgagugccagccccacagccagcccuggcaggccgcccuguuccagggccagcagcugcugugcggcggcgugcuggugggcggcaacugggugcugaccgccgcccacugcaagaagcccaaguacaccgugagacugggcgaccacagccugcagaacaaggacggccccgagcaggagauccccguggugcagagcaucccccaccccugcuacaacagcagcgacguggaggaccacaaccacgaccugaugcugcugcagcugagagaccaggccagccugggcagcaaggugaagcccaucagccuggccgaccacugcacccagcccggccagaagugcaccgugagcggcuggggcaccgugaccagccccagagagaacuuccccgacacccugaacugcgccgaggugaagaucuucccccagaagaagugcgaggacgccuaccccggccagaucaccgacggcauggugugcgccggcagcagcaagggcgccgacaccugccagggcgacagcggcggcccccuggugugcgacggcgcccugcagggcaucaccagcuggggcagcgaccccugcggcagaagcgacaagcccggcguguacaccaacaucugcagauaccuggacuggaucaagaagaucaucggcagcaagggcuaa

SEQ ID NO: 19037 - RNA, 753 nt, Artificial Sequence
  KLK9__Homo_sapiens__NP_036447
augaagcugggccugcugugcgcccugcugagccugcuggccggccacggcugggccgacaccagagccaucggcgccgaggagugcagacccaacagccagcccuggcaggccggccuguuccaccugaccagacuguucugcggcgccacccugaucagcgacagauggcugcugaccgccgcccacugcagaaagcccuaccugugggugagacugggcgagcaccaccuguggaagugggagggccccgagcagcuguucagagugaccgacuucuucccccaccccggcuucaacaaggaccugagcgccaacgaccacaacgacgacaucaugcugaucagacugcccagacaggccagacugagccccgccgugcagccccugaaccugagccagaccugcgugagccccggcaugcagugccugaucagcggcuggggcgccgugagcagccccaaggcccuguuccccgugacccugcagugcgccaacaucagcauccuggagaacaagcugugccacugggccuaccccggccacaucagcgacagcaugcugugcgccggccugugggagggcggcagaggcagcugccagggcgacagcggcggcccccuggugugcaacggcacccuggccggcguggugagcggcggcgccgagcccugcagcagacccagaagacccgccguguacaccagcgugugccacuaccuggacuggauccaggagaucauggagaacuaa

SEQ ID NO: 19038 - RNA, 1917 nt, Artificial Sequence
  KLKB1__Homo_sapiens__NP_000883
augauccuguucaagcaggccaccuacuucaucagccuguucgccaccgugagcugcggcugccugacccagcuguacgagaacgccuucuucagaggcggcgacguggccagcauguacacccccaacgcccaguacugccagaugagaugcaccuuccaccccagaugccugcuguucagcuuccugcccgccagcagcaucaacgacauggagaagagauucggcugcuuccugaaggacagcgugaccggcacccugcccaaggugcacagaaccggcgccgugagcggccacagccugaagcagugcggccaccagaucagcgccugccacagagacaucuacaagggcguggacaugagaggcgugaacuucaacgugagcaaggugagcagcguggaggagugccagaagagaugcaccagcaacaucagaugccaguucuucagcuacgccacccagaccuuccacaaggccgaguacagaaacaacugccugcugaaguacagccccggcggcacccccaccgccaucaaggugcugagcaacguggagagcggcuucagccugaagcccugcgcccugagcgagaucggcugccacaugaacaucuuccagcaccuggccuucagcgacguggacguggccagagugcugacccccgacgccuucgugugcagaaccaucugcaccuaccaccccaacugccuguucuucaccuucuacaccaacguguggaagaucgagagccagagaaacgugugccugcugaagaccagcgagagcggcacccccagcagcagcaccccccaggagaacaccaucagcggcuacagccugcugaccugcaagagaacccugcccgagcccugccacagcaagaucuaccccggcguggacuucggcggcgaggagcugaacgugaccuucgugaagggcgugaacgugugccaggagaccugcaccaagaugaucagaugccaguucuucaccuacagccugcugcccgaggacugcaaggaggagaagugcaagugcuuccugagacugagcauggacggcagccccaccagaaucgccuacggcacccagggcagcagcggcuacagccugagacugugcaacaccggcgacaacagcgugugcaccaccaagaccagcaccagaaucgugggcggcaccaacagcagcuggggcgaguggcccuggcaggugagccugcaggugaagcugaccgcccagagacaccugugcggcggcagccugaucggccaccagugggugcugaccgccgcccacugcuucgacggccugccccugcaggacguguggagaaucuacagcggcauccugaaccugagcgacaucaccaaggacacccccuucagccagaucaaggagaucaucauccaccagaacuacaaggugagcgagggcaaccacgacaucgcccugaucaagcugcaggccccccugaacuacaccgaguuccagaagcccaucugccugcccagcaagggcgacaccagcaccaucuacaccaacugcugggugaccggcuggggcuucagcaaggagaagggcgagauccagaacauccugcagaaggugaacaucccccuggugaccaacgaggagugccagaagagauaccaggacuacaagaucacccagagaauggugugcgccggcuacaaggagggcggcaaggacgccugcaagggcgacagcggcggcccccuggugugcaagcacaacggcauguggagacuggugggcaucaccagcuggggcgagggcugcgccagaagagagcagcccggcguguacaccaagguggccgaguacauggacuggauccuggagaagacccagagcagcgacggcaaggcccagaugcagagccccgccuaa

SEQ ID NO: 19039 - RNA, 537 nt, Artificial Sequence
  KLLN__Homo_sapiens__NP_001119521
auggacagacccggccccggcagcgccagacccggcagaaccgugcacguguggggcuacagaguggaguggaaggugagaaacggcagaaagcugcagcccagcgagugggccggcagaggcgaccugggcggcuucaagagaagauggaaggacaccagagccaccgugggcaccaccuucagaagaagaagcagagugagccuggugggcgagcugagcaaguucccccugcccagcgacagcagcggcggcaagagcagcagcagcuucgccagaggcgcccuggccuggugcagacagagaaaccccaaccccagcugcgccgccgccgagaccggcgccagaaccagccugcccaaggagagaugcagaggcuggagacugggcaacuggcugcacaagcacccccaccccaacaccugccccagacugcccgccugcuggcugccccccauccugaccgagagaggcgagagagugcccaagcuggugccccugcuggccugcuaccccaagagcaagcccaaggacuaa

SEQ ID NO: 19040 - RNA, 678 nt, Artificial Sequence
  KLRB1__Homo_sapiens__NP_002249
auggaccagcaggccaucuacgccgagcugaaccugcccaccgacagcggccccgagagcagcagccccagcagccugcccagagacgugugccagggcagccccuggcaccaguucgcccugaagcugagcugcgccggcaucauccugcuggugcugguggugaccggccugagcgugagcgugaccagccugauccagaagagcagcaucgagaagugcagcguggacauccagcagagcagaaacaagaccaccgagagacccggccugcugaacugccccaucuacuggcagcagcugagagagaagugccugcuguucagccacaccgugaaccccuggaacaacagccuggccgacugcagcaccaaggagagcagccugcugcugaucagagacaaggacgagcugauccacacccagaaccugaucagagacaaggccauccuguucuggaucggccugaacuucagccugagcgagaagaacuggaaguggaucaacggcagcuuccugaacagcaacgaccuggagaucagaggcgacgccaaggagaacagcugcaucagcaucagccagaccagcguguacagcgaguacugcagcaccgagaucagauggaucugccagaaggagcugacccccgugagaaacaagguguaccccgacagcuaa

SEQ ID NO: 19041 - RNA, 648 nt, Artificial Sequence
  KLRC1__Homo_sapiens__NP_998822
auggacaaccagggcgugaucuacagcgaccugaaccugccccccaaccccaagagacagcagagaaagcccaagggcaacaagagcagcauccuggccaccgagcaggagaucaccuacgccgagcugaaccugcagaaggccagccaggacuuccagggcaacgacaagaccuaccacugcaaggaccugcccagcgcccccgagaagcugaucgugggcauccugggcaucaucugccugauccugauggccagcguggugaccaucguggugauccccagcagacacugcggccacugccccgaggaguggaucaccuacagcaacagcugcuacuacaucggcaaggagagaagaaccugggaggagagccugcuggccugcaccagcaagaacagcagccugcugagcaucgacaacgaggaggagaugaaguuccugagcaucaucagccccagcagcuggaucggcguguucagaaacagcagccaccaccccugggugaccaugaacggccuggccuucaagcacgagaucaaggacagcgacaacgccgagcugaacugcgccgugcugcaggugaacagacugaagagcgcccagugcggcagcagcaucaucuaccacugcaagcacaagcuguaa

SEQ ID NO: 19042 - RNA, 696 nt, Artificial Sequence
  KLRC2__Homo_sapiens__NP_002251
augaacaagcagagaggcaccuucagcgaggugagccuggcccaggaccccaagagacagcagagaaagcccaagggcaacaagagcagcaucagcggcaccgagcaggagaucuuccagguggagcugaaccugcagaaccccagccugaaccaccagggcaucgacaagaucuacgacugccagggccugcugcccccccccgagaagcugaccgccgaggugcugggcaucaucugcaucgugcugauggccaccgugcugaagaccaucgugcugauccccuuccuggagcagaacaacuucagccccaacaccagaacccagaaggccagacacugcggccacugccccgaggaguggaucaccuacagcaacagcugcuacuacaucggcaaggagagaagaaccugggaggagagccugcuggccugcaccagcaagaacagcagccugcugagcaucgacaacgaggaggagaugaaguuccuggccagcauccugcccagcagcuggaucggcguguucagaaacagcagccaccaccccugggugaccaucaacggccuggccuucaagcacaagaucaaggacagcgacaacgccgagcugaacugcgccgugcugcaggugaacagacugaagagcgcccagugcggcagcagcaugaucuaccacugcaagcacaagcuguaa

SEQ ID NO: 19043 - RNA, 477 nt, Artificial Sequence
  KLRC4__Homo_sapiens__NP_038459
augaacaagcagagaggcaccuacagcgaggugagccuggcccaggaccccaagagacagcagagaaagcugaagggcaacaagaucagcaucagcggcaccaagcaggagaucuuccagguggagcugaaccugcagaacgccagcagcgaccaccagggcaacgacaagaccuaccacugcaagggccugcugcccccccccgagaagcugaccgccgaggugcugggcaucaucugcaucgugcugauggccaccgugcugaagaccaucgugcugauccccugcaucggcgugcuggagcagaacaacuucagccugaacagaagaaugcagaaggccagacacugcggccacugccccgaggaguggaucaccuacagcaacagcugcuacuacaucggcaaggagagaagaaccugggaggagagagugugcuggcccgugcugagaagaacccugaucugcuuccuguaa

SEQ ID NO: 19044 - RNA, 651 nt, Artificial Sequence
  KLRC4-KLRK1__Homo_sapiens__NP_001186734
augggcuggaucagaggcagaagaagcagacacagcugggagaugagcgaguuccacaacuacaaccuggaccugaagaagagcgacuucagcaccagauggcagaagcagagaugccccguggugaagagcaagugcagagagaacgccagccccuucuucuucugcugcuucaucgccguggccaugggcaucagauucaucaucauggugaccaucuggagcgccguguuccugaacagccuguucaaccaggaggugcagaucccccugaccgagagcuacugcggccccugccccaagaacuggaucugcuacaagaacaacugcuaccaguucuucgacgagagcaagaacugguacgagagccaggccagcugcaugagccagaacgccagccugcugaagguguacagcaaggaggaccaggaccugcugaagcuggugaagagcuaccacuggaugggccuggugcacauccccaccaacggcagcuggcagugggaggacggcagcauccugagccccaaccugcugaccaucaucgagaugcagaagggcgacugcgcccuguacgccagcagcuucaagggcuacaucgagaacugcagcacccccaacaccuacaucugcaugcagagaaccguguaa

SEQ ID NO: 19045 - RNA, 540 nt, Artificial Sequence
  KLRD1__Homo_sapiens__NP_001107868
auggccguguucaagaccacccuguggagacugaucagcggcacccugggcaucaucugccugagccugauggccacccugggcauccugcugaagaacagcuucaccaagcugagcaucgagcccgccuucacccccggccccaacaucgagcugcagaaggacagcgacugcugcagcugccaggagaagugggugggcuacagaugcaacugcuacuucaucagcagcgagcagaagaccuggaacgagagcagacaccugugcgccagccagaagagcagccugcugcagcugcagaacaccgacgagcuggacuucaugagcagcagccagcaguucuacuggaucggccugagcuacagcgaggagcacaccgccuggcugugggagaacggcagcgcccugagccaguaccuguuccccagcuucgagaccuucaacaccaagaacugcaucgccuacaaccccaacggcaacgcccuggacgagagcugcgaggacaagaacagauacaucugcaagcagcagcugaucuaa

SEQ ID NO: 19046 - RNA, 570 nt, Artificial Sequence
  KLRG1__Homo_sapiens__NP_005801
augaccgacagcgugaucuacagcaugcuggagcugcccaccgccacccaggcccagaacgacuacggcccccagcagaagagcagcagcagcagacccagcugcagcugccugguggccaucgcccugggccugcugaccgccgugcugcugagcgugcugcuguaccaguggauccugugccagggcagcaacuacagcaccugcgccagcugccccagcugccccgacagauggaugaaguacggcaaccacugcuacuacuucagcguggaggagaaggacuggaacagcagccuggaguucugccuggccagagacagccaccugcuggugaucaccgacaaccaggagaugagccugcugcagguguuccugagcgaggccuucugcuggaucggccugagaaacaacagcggcuggagaugggaggacggcagcccccugaacuucagcagaaucagcagcaacagcuucgugcagaccugcggcgccaucaacaagaacggccugcaggccagcagcugcgaggugccccugcacugggugugcaagaaggugagacuguaa

SEQ ID NO: 19047 - RNA, 1230 nt, Artificial Sequence
  KLRG2__Homo_sapiens__NP_940910
auggaggagagcugggaggccgcccccggcggccaggccggcgccgagcugcccauggagcccgugggcagccuggugcccacccuggagcagccccaggugcccgccaaggugagacagcccgagggccccgagagcagccccagccccgccggcgccguggagaaggccgccggcgccggccuggagcccagcagcaagaagaagccccccagccccagacccggcagccccagagugcccccccugagccugggcuacggcgugugccccgagccccccagccccggccccgcccuggugaagcugcccagaaacggcgaggcccccggcgccgagcccgcccccagcgccugggcccccauggagcugcagguggacgugagagugaagcccgugggcgccgccggcggcagcagcacccccagccccagacccagcaccagauuccugaaggugcccgugcccgagagccccgccuucagcagacacgccgaccccgcccaccagcugcugcugagagcccccagccagggcggcaccuggggcagaagaagcccccuggccgccgccagaaccgagagcggcugcgacgccgagggcagagccagccccgccgagggcagcgccggcagccccggcagccccaccugcugcagaugcaaggagcugggccuggagaaggaggacgccgcccugcugcccagagccggccuggacggcgacgagaagcugcccagagccgugacccugaccggccugcccauguacgugaagagccuguacugggcccuggccuucauggccgugcugcuggccgugagcggcguggugaucguggugcuggccagcagagccggcgccagaugccagcagugcccccccggcugggugcugagcgaggagcacugcuacuacuucagcgccgaggcccaggccugggaggccagccaggccuucugcagcgccuaccacgccacccugccccugcugagccacacccaggacuuccugggcagauaccccgugagcagacacagcugggugggcgccuggagaggcccccagggcuggcacuggaucgacgaggccccccugcccccccagcugcugcccgaggacggcgaggacaaccuggacaucaacugcggcgcccuggaggagggcacccugguggccgccaacugcagcacccccagacccugggugugcgccaagggcacccaguaa

SEQ ID NO: 19048 - RNA, 1461 nt, Artificial Sequence
  KMO__Homo_sapiens__NP_003670
auggacagcagcgugauccagagaaagaagguggccgugaucggcggcggccuggugggcagccugcaggccugcuuccuggccaagagaaacuuccagaucgacguguacgaggccagagaggacaccagaguggccaccuucaccagaggcagaagcaucaaccuggcccugagccacagaggcagacaggcccugaaggccgugggccuggaggaccagaucgugagccagggcauccccaugagagccagaaugauccacagccugagcggcaagaagagcgccauccccuacggcaccaagagccaguacauccugagcgugagcagagagaaccugaacaaggaccugcugaccgccgccgagaaguaccccaacgugaagaugcacuucaaccacagacugcugaagugcaaccccgaggagggcaugaucaccgugcugggcagcgacaaggugcccaaggacgugaccugcgaccugaucgugggcugcgacggcgccuacagcaccgugagaagccaccugaugaagaagcccagauucgacuacagccagcaguacaucccccacggcuacauggagcugaccaucccccccaagaacggcgacuacgccauggagcccaacuaccugcacaucuggcccagaaacaccuucaugaugaucgcccugcccaacaugaacaagagcuucaccugcacccuguucaugcccuucgaggaguucgagaagcugcugaccagcaacgacgugguggacuucuuccagaaguacuuccccgacgccaucccccugaucggcgagaagcugcuggugcaggacuucuuccugcugcccgcccagcccaugaucagcgugaagugcagcagcuuccacuucaagagccacugcgugcugcugggcgacgccgcccacgccaucgugcccuucuucggccagggcaugaacgccggcuucgaggacugccugguguucgacgagcugauggacaaguucagcaacgaccugagccugugccugcccguguucagcagacugagaauccccgacgaccacgccaucagcgaccugagcauguacaacuacaucgagaugagagcccacgugaacagcagcugguucaucuuccagaagaacauggagagauuccugcacgccaucaugcccagcaccuucaucccccuguacaccauggugaccuucagcagaaucagauaccacgaggccgugcagagauggcacuggcagaagaaggugaucaacaagggccuguucuuccugggcagccugaucgccaucagcagcaccuaccugcugauccacuacaugagccccagaagcuuccugagacugagaagacccuggaacuggaucgcccacuucagaaacaccaccugcuuccccgccaaggccguggacagccuggagcagaucagcaaccugaucagcagauaa

SEQ ID NO: 19049 - RNA, 11919 nt, Artificial Sequence
  KMT2A__Homo_sapiens__NP_001184033
auggcccacagcugcagauggagauuccccgccagacccggcaccaccggcggcggcggcggcggcggcagaagaggccugggcggcgcccccagacagagagugcccgcccugcugcugccccccggcccccccgugggcggcggcggccccggcgccccccccagcccccccgccguggccgccgccgccgccgccgccggcagcagcggcgccggcgugcccggcggcgccgccgccgccagcgccgccagcagcagcagcgccagcagcagcagcagcagcagcagcagcgccagcagcggccccgcccugcugagagugggccccggcuucgacgccgcccugcaggugagcgccgccaucggcaccaaccugagaagauucagagccguguucggcgagagcggcggcggcggcggcagcggcgaggacgagcaguuccugggcuucggcagcgacgaggaggugagagugagaagccccaccagaagccccagcgugaagaccagccccagaaagcccagaggcagacccagaagcggcagcgacagaaacagcgccauccugagcgaccccagcguguucagcccccugaacaagagcgagaccaagagcggcgacaagaucaagaagaaggacagcaagagcaucgagaagaagagaggcagaccccccaccuuccccggcgugaagaucaagaucacccacggcaaggacaucagcgagcugcccaagggcaacaaggaggacagccugaagaagaucaagagaacccccagcgccaccuuccagcaggccaccaagaucaagaagcugagagccggcaagcugagcccccugaagagcaaguucaagaccggcaagcugcagaucggcagaaagggcgugcagaucgugagaagaagaggcagaccccccagcaccgagagaaucaagacccccagcggccugcugaucaacagcgagcuggagaagccccagaaggugagaaaggacaaggagggcacccccccccugaccaaggaggacaagaccguggugagacagagccccagaagaaucaagcccgugagaaucauccccagcagcaagagaaccgacgccaccaucgccaagcagcugcugcagagagccaagaagggcgcccagaagaagaucgagaaggaggccgcccagcugcagggcagaaaggugaagacccaggugaagaacaucagacaguucaucaugcccguggugagcgccaucagcagcagaaucaucaagacccccagaagauucaucgaggacgaggacuacgacccccccaucaagaucgccagacuggagagcacccccaacagcagauucagcgcccccagcugcggcagcagcgagaagagcagcgccgccagccagcacagcagccagaugagcagcgacagcagcagaagcagcagccccagcguggacaccagcaccgacagccaggccagcgaggagauccaggugcugcccgaggagagaagcgacacccccgaggugcaccccccccugcccaucagccagagccccgagaacgagagcaacgacagaagaagcagaagauacagcgugagcgagagaagcuucggcagcagaaccaccaagaagcugagcacccugcagagcgccccccagcagcagaccagcagcagccccccccccccccugcugacccccccccccccccugcagcccgccagcagcaucagcgaccacacccccuggcugaugccccccaccaucccccuggccagccccuuccugcccgccagcaccgcccccaugcagggcaagagaaagagcauccugagagagcccaccuucagauggaccagccugaagcacagcagaagcgagccccaguacuucagcagcgccaaguacgccaaggagggccugaucagaaagcccaucuucgacaacuucagaccccccccccugacccccgaggacgugggcuucgccagcggcuucagcgccagcggcaccgccgccagcgccagacuguucagcccccugcacagcggcaccagauucgacaugcacaagagaagcccccugcugagagcccccagauucacccccagcgaggcccacagcagaaucuucgagagcgugacccugcccagcaacagaaccagcgccggcaccagcagcagcggcgugagcaacagaaagagaaagagaaagguguucagccccaucagaagcgagcccagaagccccagccacagcaugagaaccagaagcggcagacugagcagcagcgagcugagcccccugaccccccccagcagcgugagcagcagccugagcaucagcgugagcccccuggccaccagcgcccugaaccccaccuucaccuuccccagccacagccugacccagagcggcgagagcgccgagaagaaccagagacccagaaagcagaccagcgcccccgccgagcccuucagcagcagcagccccaccccccuguuccccugguucacccccggcagccagaccgagagaggcagaaacaaggacaaggcccccgaggagcugagcaaggacagagacgccgacaagagcguggagaaggacaagagcagagagagagacagagagagagagaaggagaacaagagagagagcagaaaggagaagagaaagaagggcagcgagauccagagcagcagcgcccuguaccccgugggcagagugagcaaggagaagguggugggcgaggacguggccaccagcagcagcgccaagaaggccaccggcagaaagaagagcagcagccacgacagcggcaccgacaucaccagcgugacccugggcgacaccaccgccgugaagaccaagauccugaucaagaagggcagaggcaaccuggagaagaccaaccuggaccugggccccaccgcccccagccuggagaaggagaagacccugugccugagcacccccagcagcagcaccgugaagcacagcaccagcagcaucggcagcaugcuggcccaggccgacaagcugcccaugaccgacaagagaguggccagccugcugaagaaggccaaggcccagcugugcaagaucgagaagagcaagagccugaagcagaccgaccagcccaaggcccagggccaggagagcgacagcagcgagaccagcgugagaggccccagaaucaagcacgugugcagaagagccgccguggcccugggcagaaagagagccguguuccccgacgacaugcccacccugagcgcccugcccugggaggagagagagaagauccugagcagcaugggcaacgacgacaagagcagcaucgccggcagcgaggacgccgagccccuggccccccccaucaagcccaucaagcccgugaccagaaacaaggccccccaggagccccccgugaagaagggcagaagaagcagaagaugcggccagugccccggcugccaggugcccgaggacugcggcgugugcaccaacugccuggacaagcccaaguucggcggcagaaacaucaagaagcagugcugcaagaugagaaagugccagaaccugcaguggaugcccagcaaggccuaccugcagaagcaggccaaggccgugaagaagaaggagaagaagagcaagaccagcgagaagaaggacagcaaggagagcagcguggugaagaacgugguggacagcagccagaagcccacccccagcgccagagaggaccccgcccccaagaagagcagcagcgagcccccccccagaaagcccguggaggagaagagcgaggagggcaacgugagcgcccccggccccgagagcaagcaggccaccacccccgccagcagaaagagcagcaagcaggugagccagcccgcccuggugauccccccccagccccccaccaccggcccccccagaaaggaggugcccaagaccacccccagcgagcccaagaagaagcagccccccccccccgagagcggccccgagcagagcaagcagaagaagguggcccccagacccagcauccccgugaagcagaagcccaaggagaaggagaagcccccccccgugaacaagcaggagaacgccggcacccugaacauccugagcacccugagcaacggcaacagcagcaagcagaagauccccgccgacggcgugcacagaaucagaguggacuucaaggaggacugcgaggccgagaacgugugggagaugggcggccugggcauccugaccagcgugcccaucacccccagaguggugugcuuccugugcgccagcagcggccacguggaguucguguacugccaggugugcugcgagcccuuccacaaguucugccuggaggagaacgagagaccccuggaggaccagcuggagaacuggugcugcagaagaugcaaguucugccacgugugcggcagacagcaccaggccaccaagcagcugcuggagugcaacaagugcagaaacagcuaccaccccgagugccugggccccaacuaccccaccaagcccaccaagaagaagaagguguggaucugcaccaagugcgugagaugcaagagcugcggcagcaccacccccggcaagggcugggacgcccaguggagccacgacuucagccugugccacgacugcgccaagcuguucgccaagggcaacuucugcccccugugcgacaagugcuacgacgacgacgacuacgagagcaagaugaugcagugcggcaagugcgacagaugggugcacagcaagugcgagaaccugagcggcaccgaggacgagauguacgagauccugagcaaccugcccgagagcguggccuacaccugcgugaacugcaccgagagacaccccgccgaguggagacuggcccuggagaaggagcugcagaucagccugaagcaggugcugaccgcccugcugaacagcagaaccaccagccaccugcugagauacagacaggccgccaagccccccgaccugaaccccgagaccgaggagagcauccccagcagaagcagccccgagggccccgacccccccgugcugaccgaggugagcaagcaggacgaccagcagccccuggaccuggagggcgugaagagaaagauggaccagggcaacuacaccagcgugcuggaguucagcgacgacaucgugaagaucauccaggccgccaucaacagcgacggcggccagcccgagaucaagaaggccaacagcauggugaagagcuucuucaucagacagauggagagaguguuccccugguucagcgugaagaagagcagauucugggagcccaacaaggugagcagcaacagcggcaugcugcccaacgccgugcugccccccagccuggaccacaacuacgcccaguggcaggagagagaggagaacagccacaccgagcagcccccccugaugaagaagaucauccccgcccccaagcccaagggccccggcgagcccgacagccccaccccccugcacccccccaccccccccauccugagcaccgacagaagcagagaggacagccccgagcugaaccccccccccggcaucgaggacaacagacagugcgcccugugccugaccuacggcgacgacagcgccaacgacgccggcagacugcuguacaucggccagaacgaguggacccacgugaacugcgcccuguggagcgccgagguguucgaggacgacgacggcagccugaagaacgugcacauggccgugaucagaggcaagcagcugagaugcgaguucugccagaagcccggcgccaccgugggcugcugccugaccagcugcaccagcaacuaccacuucaugugcagcagagccaagaacugcguguuccuggacgacaagaagguguacugccagagacacagagaccugaucaagggcgagguggugcccgagaacggcuucgagguguucagaagaguguucguggacuucgagggcaucagccugagaagaaaguuccugaacggccuggagcccgagaacauccacaugaugaucggcagcaugaccaucgacugccugggcauccugaacgaccugagcgacugcgaggacaagcuguuccccaucggcuaccagugcagcagaguguacuggagcaccaccgacgccagaaagagaugcguguacaccugcaagaucguggagugcagaccccccgugguggagcccgacaucaacagcaccguggagcacgacgagaacagaaccaucgcccacagccccaccagcuucaccgagagcagcagcaaggagagccagaacaccgccgagaucaucagcccccccagccccgacagacccccccacagccagaccagcggcagcugcuacuaccacgugaucagcaaggugcccagaaucagaacccccagcuacagccccacccagagaagccccggcugcagaccccugcccagcgccggcagccccacccccaccacccacgagaucgugaccgugggcgacccccugcugagcagcggccugagaagcaucggcagcagaagacacagcaccagcagccugagcccccagagaagcaagcugagaaucaugagccccaugagaaccggcaacaccuacagcagaaacaacgugagcagcgugagcaccaccggcaccgccaccgaccuggagagcagcgccaaggugguggaccacgugcugggcccccugaacagcagcaccagccugggccagaacaccagcaccagcagcaaccugcagagaaccguggugaccgugggcaacaagaacagccaccuggacggcagcagcagcagcgagaugaagcagagcagcgccagcgaccuggugagcaagagcagcagccugaagggcgagaagaccaaggugcugagcagcaagagcagcgagggcagcgcccacaacguggccuaccccggcauccccaagcuggccccccaggugcacaacaccaccagcagagagcugaacgugagcaagaucggcagcuucgccgagcccagcagcgugagcuucagcagcaaggaggcccugagcuucccccaccugcaccugagaggccagagaaacgacagagaccagcacaccgacagcacccagagcgccaacagcagccccgacgaggacaccgaggugaagacccugaagcugagcggcaugagcaacagaagcagcaucaucaacgagcacaugggcagcagcagcagagacagaagacagaagggcaagaagagcugcaaggagaccuucaaggagaagcacagcagcaagagcuuccuggagcccggccaggugaccaccggcgaggagggcaaccugaagcccgaguucauggacgaggugcugacccccgaguacaugggccagagacccugcaacaacgugagcagcgacaagaucggcgacaagggccugagcaugcccggcgugcccaaggccccccccaugcagguggagggcagcgccaaggagcugcaggcccccagaaagagaaccgugaaggugacccugaccccccugaagauggagaacgagagccagagcaagaacgcccugaaggagagcagccccgccagcccccugcagaucgagagcaccagccccaccgagcccaucagcgccagcgagaaccccggcgacggccccguggcccagcccagccccaacaacaccagcugccaggacagccagagcaacaacuaccagaaccugcccgugcaggacagaaaccugaugcugcccgacggccccaagccccaggaggacggcagcuucaagagaagauaccccagaagaagcgccagagccagaagcaacauguucuucggccugaccccccuguacggcgugagaagcuacggcgaggaggacauccccuucuacagcagcagcaccggcaagaagagaggcaagagaagcgccgagggccagguggacggcgccgacgaccugagcaccagcgacgaggacgaccuguacuacuacaacuucaccagaaccgugaucagcagcggcggcgaggagagacuggccagccacaaccuguucagagaggaggagcagugcgaccugcccaagaucagccagcuggacggcguggacgacggcaccgagagcgacaccagcgugaccgccaccaccagaaagagcagccagauccccaagagaaacggcaaggagaacggcaccgagaaccugaagaucgacagacccgaggacgccggcgagaaggagcacgugaccaagagcagcgugggccacaagaacgagcccaagauggacaacugccacagcgugagcagagugaagacccagggccaggacagccuggaggcccagcugagcagccuggagagcagcagaagagugcacaccagcacccccagcgacaagaaccugcuggacaccuacaacaccgagcugcugaagagcgacagcgacaacaacaacagcgacgacugcggcaacauccugcccagcgacaucauggacuucgugcugaagaacacccccagcaugcaggcccugggcgagagccccgagagcagcagcagcgagcugcugaaccugggcgagggccugggccuggacagcaacagagagaaggacaugggccuguucgagguguucagccagcagcugcccaccaccgagcccguggacagcagcgugagcagcagcaucagcgccgaggagcaguucgagcugccccuggagcugcccagcgaccugagcgugcugaccaccagaagccccaccgugcccagccagaaccccagcagacuggccgugaucagcgacagcggcgagaagagagugaccaucaccgagaagagcguggccagcagcgagagcgaccccgcccugcugagccccggcguggaccccacccccgagggccacaugacccccgaccacuucauccagggccacauggacgccgaccacaucagcagcccccccugcggcagcguggagcagggccacggcaacaaccaggaccugaccagaaacagcagcacccccggccugcaggugcccgugagccccaccgugcccauccagaaccagaaguacgugcccaacagcaccgacagccccggccccagccagaucagcaacgccgccgugcagaccacccccccccaccugaagcccgccaccgagaagcugaucguggugaaccagaacaugcagccccuguacgugcugcagacccugcccaacggcgugacccagaagauccagcugaccagcagcgugagcagcacccccagcgugauggagaccaacaccagcgugcugggccccaugggcggcggccugacccugaccaccggccugaaccccagccugcccaccagccagagccuguuccccagcgccagcaagggccugcugcccaugagccaccaccagcaccugcacagcuuccccgccgccacccagagcagcuucccccccaacaucagcaacccccccagcggccugcugaucggcgugcagcccccccccgacccccagcugcuggugagcgagagcagccagagaaccgaccugagcaccaccguggccacccccagcagcggccugaagaagagacccaucagcagacugcagaccagaaagaacaagaagcuggcccccagcagcacccccagcaacaucgcccccagcgacguggugagcaacaugacccugaucaacuucacccccagccagcugcccaaccaccccagccugcuggaccugggcagccugaacaccagcagccacagaaccgugcccaacaucaucaagagaagcaagagcagcaucauguacuucgagcccgccccccugcugccccagagcgugggcggcaccgccgccaccgccgccggcaccagcaccaucagccaggacaccagccaccugaccagcggcagcgugagcggccuggccagcagcagcagcgugcugaacguggugagcaugcagaccaccaccacccccaccagcagcgccagcgugcccggccacgugacccugaccaaccccagacugcugggcacccccgacaucggcagcaucagcaaccugcugaucaaggccagccagcagagccugggcauccaggaccagcccguggcccugccccccagcagcggcauguucccccagcugggcaccagccagacccccagcaccgccgccaucaccgccgccagcagcaucugcgugcugcccagcacccagaccaccggcaucaccgccgccagccccagcggcgaggccgacgagcacuaccagcugcagcacgugaaccagcugcuggccagcaagaccggcauccacagcagccagagagaccuggacagcgccagcggcccccaggugagcaacuucacccagaccguggacgcccccaacagcaugggccuggagcagaacaaggcccugagcagcgccgugcaggccagccccaccagccccggcggcagccccagcagccccagcagcggccagagaagcgccagccccagcgugcccggccccaccaagcccaagcccaagaccaagagauuccagcugccccuggacaagggcaacggcaagaagcacaaggugagccaccugagaaccagcagcagcgaggcccacauccccgaccaggagaccaccagccugaccagcggcaccggcacccccggcgccgaggccgagcagcaggacaccgccagcguggagcagagcagccagaaggagugcggccagcccgccggccagguggccgugcugcccgaggugcaggugacccagaaccccgccaacgagcaggagagcgccgagcccaagaccguggaggaggaggagagcaacuucagcagcccccugaugcuguggcugcagcaggagcagaagagaaaggagagcaucaccgagaagaagcccaagaagggccugguguucgagaucagcagcgacgacggcuuccagaucugcgccgagagcaucgaggacgccuggaagagccugaccgacaaggugcaggaggccagaagcaacgccagacugaagcagcugagcuucgccggcgugaacggccugagaaugcugggcauccugcacgacgccgugguguuccugaucgagcagcugagcggcgccaagcacugcagaaacuacaaguucagauuccacaagcccgaggaggccaacgagcccccccugaacccccacggcagcgccagagccgaggugcaccugagaaagagcgccuucgacauguucaacuuccuggccagcaagcacagacagccccccgaguacaaccccaacgacgaggaggaggaggaggugcagcugaagagcgccagaagagccaccagcauggaccugcccaugcccaugagauucagacaccugaagaagaccagcaaggaggccgugggcguguacagaagccccauccacggcagaggccuguucugcaagagaaacaucgacgccggcgagauggugaucgaguacgccggcaacgugaucagaagcauccagaccgacaagagagagaaguacuacgacagcaagggcaucggcugcuacauguucagaaucgacgacagcgaggugguggacgccaccaugcacggcaacgccgccagauucaucaaccacagcugcgagcccaacugcuacagcagagugaucaacaucgacggccagaagcacaucgugaucuucgccaugagaaagaucuacagaggcgaggagcugaccuacgacuacaaguuccccaucgaggacgccagcaacaagcugcccugcaacugcggcgccaagaagugcagaaaguuccugaacuaa

SEQ ID NO: 19050 - RNA, 8148 nt, Artificial Sequence
  KMT2B__Homo_sapiens__NP_055542
auggccgccgccgccggcggcggcagcugccccggccccggcagcgccagaggcagauuccccggcagacccagaggcgccggcggcggcggcggcagaggcggcagaggcaacggcgccgagagagugagaguggcccugagaagaggcggcggcgccaccggccccggcggcgccgagcccggcgaggacaccgcccugcugagacugcugggccugagaagaggccugagaagacugagaagacugugggccggccccagagugcagagaggcagaggcagaggcagaggcagaggcuggggccccagcagaggcugcgugcccgaggaggagagcagcgacggcgagagcgacgaggaggaguuccagggcuuccacagcgacgaggacguggcccccagcagccugagaagcgcccugagaagccagagaggcagagcccccagaggcagaggcagaaagcacaagaccaccccccugcccccccccagacuggccgacguggcccccaccccccccaagacccccgccagaaagagaggcgaggagggcaccgagagaauggugcaggcccugaccgagcugcugagaagagcccaggccccccaggcccccagaagcagagccugcgagcccagcacccccagaagaagcagaggcagaccccccggcagacccgccggccccugcagaagaaagcagcaggccguggugguggccgaggccgccgugaccauccccaagcccgagccccccccccccguggugcccgugaagcaccagaccggcagcuggaagugcaaggagggccccggccccggccccggcacccccagaagaggcggccagagcagcagaggcggcagaggcggcagaggcagaggcagaggcggcggccugcccuucgugaucaaguucgugagcagagccaagaaggugaagaugggccagcugagccugggccuggagagcggccagggccagggccagcacgaggagagcuggcaggacgugccccagagaagagugggcagcggccagggcggcagccccugcuggaagaagcaggagcagaagcuggacgacgaggaggaggagaagaaggaggaggaggagaaggacaaggagggcgaggagaaggaggagagagccguggccgaggagaugaugcccgccgccgagaaggaggaggccaagcugcccccccccccccugaccccccccgcccccagccccccccccccccugcccccccccagcaccagccccccccccccccugugcccccccccccccccccccgugagcccccccccccugcccagccccccccccccccccgcccaggaggagcaggaggagagccccccccccguggugcccgccaccugcagcagaaagagaggcagacccccccugacccccagccagagagccgagagagaggccgccagagccggccccgagggcaccagcccccccacccccacccccagcaccgccaccggcggcccccccgaggacagccccaccguggcccccaagagcaccaccuuccugaagaacaucagacaguucaucaugcccguggugagcgccagaagcagcagagugaucaagacccccagaagauucauggacgaggacccccccaagccccccaagguggaggugagccccgugcugagaccccccaucaccaccagcccccccgugccccaggagcccgcccccgugcccagcccccccagagcccccaccccccccagcacccccgugccccugcccgagaagagaagaagcauccugagagagcccaccuucagauggaccagccugaccagagagcugcccccccccccccccgcccccccccccccccccgcccccagccccccccccgcccccgccaccagcagcagaagaccccugcugcugagagccccccaguucacccccagcgaggcccaccugaagaucuacgagagcgugcugaccccccccccccugggcgcccccgaggcccccgagcccgagcccccccccgccgacgacagccccgccgagcccgagcccagagccgugggcagaaccaaccaccugagccugcccagauucgcccccguggugaccacccccgugaaggccgaggugagcccccacggcgcccccgcccugagcaacggcccccagacccaggcccagcugcugcagccccugcaggcccugcagacccagcugcugccccaggcccugccccccccccagccccagcugcagcccccccccagcccccagcagaugcccccccuggagaaggccagaaucgccggcgugggcagccugccccugagcggcguggaggagaagauguucagccugcugaagagagccaaggugcagcuguucaagaucgaccagcagcagcagcagaagguggccgccagcaugccccugagccccggcggccagauggaggagguggccggcgccgugaagcagaucagcgacagaggccccgugagaagcgaggacgagagcguggaggccaagagagagagacccagcggccccgagagccccgugcagggccccagaaucaagcacgugugcagacacgccgccguggcccugggccaggccagagccauggugcccgaggacgugcccagacugagcgcccugccccugagagacagacaggaccuggccaccgaggacaccagcagcgccagcgagaccgagagcgugcccagcagaagcagaagaggcaagguggaggccgccggccccggcggcgagagcgagcccaccggcagcggcggcacccuggcccacacccccagaagaagccugcccagccaccacggcaagaagaugagaauggccagaugcggccacugcagaggcugccugagagugcaggacugcggcagcugcgugaacugccuggacaagcccaaguucggcggccccaacaccaagaagcagugcugcguguacagaaagugcgacaagaucgaggccagaaagauggagagacuggccaagaagggcagaaccaucgugaagacccugcugcccugggacagcgacgagagccccgaggccagccccggcccccccggccccagaagaggcgccggcgccggcggccccagagaggaggugguggcccaccccggccccgaggagcaggacagccugcugcagagaaagagcgccagaagaugcgugaagcagagacccagcuacgacaucuucgaggacagcgacgacagcgagcccggcggcccccccgcccccagaagaagaacccccagagagaacgagcugccccugcccgagcccgaggagcagagcagacccagaaagcccacccugcagcccgugcugcagcugaaggccagaagaagacuggacaaggacgcccuggcccccggccccuucgccagcuuccccaacggcuggaccggcaagcagaagagccccgacggcgugcacagagugagaguggacuucaaggaggacugcgaccuggagaacguguggcugaugggcggccugagcgugcugaccagcgugcccggcggcccccccauggugugccugcugugcgccagcaagggccugcacgagcugguguucugccaggugugcugcgaccccuuccaccccuucugccuggaggaggccgagagaccccugccccagcaccacgacaccuggugcugcagaagaugcaaguucugccacgugugcggcagaaagggcagaggcagcaagcaccugcuggagugcgagagaugcagacacgccuaccaccccgccugccugggccccagcuaccccaccagagccaccagaaagagaagacacuggaucugcagcgccugcgugagaugcaagagcugcggcgccacccccggcaagaacugggacguggaguggagcggcgacuacagccugugccccagaugcacccagcuguacgagaagggcaacuacugccccaucugcaccagaugcuacgaggacaacgacuacgagagcaagaugaugcagugcgcccagugcgaccacugggugcacgccaagugcgagggccugagcgacgaggacuacgagauccugagcggccugcccgacagcgugcuguacaccugcggccccugcgccggcgccgcccagcccagauggagagaggcccugagcggcgcccugcagggcggccugagacaggugcugcagggccugcugagcagcaagguggugggcccccugcugcugugcacccagugcggccccgacggcaagcagcugcaccccggccccugcggccugcaggccgugagccagagauucgaggacggccacuacaagagcgugcacagcuucauggaggacauggugggcauccugaugagacacagcgaggagggcgagacccccgacagaagagccggcggccagaugaagggccugcugcugaagcugcuggagagcgccuucggcugguucgacgcccacgaccccaaguacuggagaagaagcaccagacugcccaacggcgugcugcccaacgccgugcugccccccagccuggaccacguguacgcccaguggagacagcaggagcccgagacccccgagagcggccagccccccggcgaccccagcgccgccuuccagggcaaggaccccgccgccuucagccaccuggaggaccccagacagugcgcccugugccugaaguacggcgacgccgacagcaaggaggccggcagacugcuguacaucggccagaacgaguggacccacgugaacugcgccaucuggagcgccgagguguucgaggagaacgacggcagccugaagaacgugcacgccgccguggccagaggcagacagaugagaugcgagcugugccugaagcccggcgccaccgugggcugcugccugagcagcugccugagcaacuuccacuucaugugcgccagagccagcuacugcaucuuccaggacgacaagaagguguucugccagaagcacaccgaccugcuggacggcaaggagaucgugaaccccgacggcuucgacgugcugagaagaguguacguggacuucgagggcaucaacuucaagagaaaguuccugaccggccuggagcccgacgccaucaacgugcugaucggcagcaucagaaucgacagccugggcacccugagcgaccugagcgacugcgagggcagacuguuccccaucggcuaccagugcagcagacuguacuggagcaccguggacgccagaagaagaugcugguacagaugcagaauccuggaguacagacccuggggccccagagaggagcccgcccaccuggaggccgccgaggagaaccagaccaucgugcacagccccgcccccagcagcgagccccccggcggcgaggaccccccccuggacaccgacgugcuggugcccggcgcccccgagagacacagccccauccagaaccuggaccccccccugagacccgacagcggcagcgcccccccccccgcccccagaagcuucagcggcgccagaaucaaggugcccaacuacagccccagcagaagaccccugggcggcgugagcuucggcccccugcccagccccggcagccccagcagccugacccaccacauccccaccgugggcgaccccgacuuccccgccccccccagaagaagcagaagacccagcccccuggcccccagacccccccccagcagaugggccagccccccccugaagaccagcccccagcugagagugcccccccccaccagcguggugaccgcccugacccccaccagcggcgagcuggccccccccggccccgcccccagcccccccccccccgaggaccugggccccgacuucgaggacauggagguggugagcggccugagcgccgccgaccuggacuucgccgccagccugcugggcaccgagcccuuccaggaggagaucguggccgccggcgccaugggcagcagccacggcggccccggcgacagcagcgaggaggagagcagccccaccagcagauacauccacuuccccgugaccguggugagcgcccccggccuggcccccagcgccacccccggcgcccccagaaucgagcagcuggacggcguggacgacggcaccgacagcgaggccgaggccgugcagcagcccagaggccagggcaccccccccagcggccccggcguggugagagccggcgugcugggcgccgccggcgacagagccagaccccccgaggaccugcccagcgagaucguggacuucgugcugaagaaccugggcggccccggcgacggcggcgccggccccagagaggagagccugccccccgcccccccccuggccaacggcagccagcccagccagggccugaccgccagccccgccgaccccaccagaaccuucgccuggcugcccggcgcccccggcgugagagugcugagccugggccccgcccccgagccccccaagcccgccaccagcaagaucauccuggugaacaagcugggccagguguucgugaagauggccggcgagggcgagcccgugcccccccccgugaagcagcccccccugccccccaccaucagccccaccgcccccaccagcuggacccugccccccggcccccugcugggcgugcugcccguggugggcguggugagacccgccccccccccccccccccccccccugacccuggugcugagcagcggccccgccagcccccccagacaggccaucagagugaagagagugagcaccuucagcggcagaagcccccccgcccccccccccuacaaggcccccagacuggacgaggacggcgaggccagcgaggacaccccccaggugcccggccugggcagcggcggcuucagcagagugagaaugaagacccccaccgugagaggcgugcuggaccuggacagacccggcgagcccgccggcgaggagagccccggcccccugcaggagagaagcccccugcugccccugcccgaggacggccccccccaggugcccgacggcccccccgaccugcugcuggagagccaguggcaccacuacagcggcgaggccagcagcagcgaggaggagccccccagccccgacgacaaggagaaccaggcccccaagagaaccggcccccaccugagauucgagaucagcagcgaggacggcuucagcguggaggccgagagccuggagggcgccuggagaacccugaucgagaaggugcaggaggccagaggccacgccagacugagacaccugagcuucagcggcaugagcggcgccagacugcugggcauccaccacgacgccgugaucuuccuggccgagcagcugcccggcgcccagagaugccagcacuacaaguucagauaccaccagcagggcgagggccaggaggagcccccccugaacccccacggcgccgccagagccgagguguaccugagaaagugcaccuucgacauguucaacuuccuggccagccagcacagagugcugcccgagggcgccaccugcgacgaggaggaggacgaggugcagcugagaagcaccagaagagccaccagccuggagcugcccauggccaugagauucagacaccugaagaagaccagcaaggaggccgugggcguguacagaagcgccauccacggcagaggccuguucugcaagagaaacaucgacgccggcgagauggugaucgaguacagcggcaucgugaucagaagcgugcugaccgacaagagagagaaguucuacgacggcaagggcaucggcugcuacauguucagaauggacgacuucgacgugguggacgccaccaugcacggcaacgccgccagauucaucaaccacagcugcgagcccaacugcuucagcagagugauccacguggagggccagaagcacaucgugaucuucgcccugagaagaauccugagaggcgaggagcugaccuacgacuacaaguuccccaucgaggacgccagcaacaagcugcccugcaacugcggcgccaagagaugcagaagauuccugaacuaa

SEQ ID NO: 19051 - RNA, 14736 nt, Artificial Sequence
  KMT2C__Homo_sapiens__NP_733751
augagcagcgaggaggacaagagcguggagcagccccagccccccccccccccccccgaggagcccggcgcccccgcccccagccccgccgccgccgacaagagacccagaggcagacccagaaaggacggcgccagccccuuccagagagccagaaagaagcccagaagcagaggcaagaccgccguggaggacgaggacagcauggacggccuggagaccaccgagaccgagaccaucguggagaccgagaucaaggagcagagcgccgaggaggacgccgaggccgagguggacaacagcaagcagcugauccccacccugcagagaagcgugagcgaggagagcgccaacagccuggugagcgugggcguggaggccaagaucagcgagcagcugugcgccuucugcuacugcggcgagaagagcagccugggccagggcgaccugaagcaguucagaaucacccccggcuucauccugcccuggagaaaccagcccagcaacaagaaggacaucgacgacaacagcaacggcaccuacgagaagaugcagaacagcgcccccagaaagcagagaggccagagaaaggagagaagcccccagcagaacaucgugagcugcgugagcgugagcacccagaccgccagcgacgaccaggccggcaagcugugggacgagcugagccuggugggccugcccgacgccaucgacauccaggcccuguucgacagcaccggcaccugcugggcccaccacagaugcguggaguggagccugggcgugugccagauggaggagccccugcuggugaacguggacaaggccguggugagcggcagcaccgagagaugcgccuucugcaagcaccugggcgccaccaucaagugcugcgaggagaagugcacccagauguaccacuaccccugcgccgccggcgccggcaccuuccaggacuucagccacaucuuccugcugugccccgagcacaucgaccaggcccccgagagaagcaaggaggacgccaacugcgccgugugcgacagccccggcgaccugcuggaccaguucuucugcaccaccugcggccagcacuaccacggcaugugccuggacaucgccgugaccccccugaagagagccggcuggcagugccccgagugcaaggugugccagaacugcaagcagagcggcgaggacagcaagaugcuggugugcgacaccugcgacaagggcuaccacaccuucugccugcagcccgugaugaagagcgugcccaccaacggcuggaagugcaagaacugcagaaucugcaucgagugcggcaccagaagcagcagccaguggcaccacaacugccugaucugcgacaacugcuaccagcagcaggacaaccugugccccuucugcggcaagugcuaccaccccgagcugcagaaggacaugcugcacugcaacaugugcaagagaugggugcaccuggagugcgacaagcccaccgaccacgagcuggacacccagcugaaggaggaguacaucugcauguacugcaagcaccugggcgccgagauggacagacugcagcccggcgaggagguggagaucgccgagcugaccaccgacuacaacaacgagauggagguggagggccccgaggaccagaugguguucagcgagcaggccgccaacaaggacgugaacggccaggagagcacccccggcaucgugcccgacgccgugcaggugcacaccgaggagcagcagaagagccaccccagcgagagccuggacaccgacagccugcugaucgccgugagcagccagcacaccgugaacaccgagcuggagaagcagaucagcaacgagguggacagcgaggaccugaagaugagcagcgaggugaagcacaucugcggcgaggaccagaucgaggacaagauggaggugaccgagaacaucgagguggugacccaccagaucaccgugcagcaggagcagcugcagcugcuggaggagcccgagaccguggugagcagagaggagagcagaccccccaagcuggugauggagagcgugacccugccccuggagacccuggugagcccccacgaggagagcaucagccugugccccgaggagcagcuggugaucgagagacugcagggcgagaaggagcagaaggagaacagcgagcugagcaccggccugauggacagcgagaugacccccaccaucgagggcugcgugaaggacgugagcuaccagggcggcaagagcaucaagcugagcagcgagaccgagagcagcuucagcagcagcgccgacaucagcaaggccgacgugagcagcagccccacccccagcagcgaccugcccagccacgacaugcugcacaacuaccccagcgcccugagcagcagcgccggcaacaucaugcccaccaccuacaucagcgugacccccaagaucggcaugggcaagcccgccaucaccaagagaaaguucagccccggcagacccagaagcaagcagggcgccuggagcacccacaacaccgugagcccccccagcuggagccccgacaucagcgagggcagagagaucuucaagcccagacagcugcccggcagcgccaucuggagcaucaaggugggcagaggcagcggcuuccccggcaagagaagacccagaggcgccggccugagcggcagaggcggcagaggcagaagcaagcugaagagcggcaucggcgccguggugcugcccggcgugagcaccgccgacaucagcagcaacaaggacgacgaggagaacagcaugcacaacaccguggugcuguucagcagcagcgacaaguucacccugaaccaggacaugugcguggugugcggcagcuucggccagggcgccgagggcagacugcuggccugcagccagugcggccagugcuaccaccccuacugcgugagcaucaagaucaccaagguggugcugagcaagggcuggagaugccuggagugcaccgugugcgaggccugcggcaaggccaccgaccccggcagacugcugcugugcgacgacugcgacaucagcuaccacaccuacugccuggaccccccccugcagaccgugcccaagggcggcuggaagugcaaguggugcguguggugcagacacugcggcgccaccagcgccggccugagaugcgaguggcagaacaacuacacccagugcgcccccugcgccagccugagcagcugccccgugugcuacagaaacuacagagaggaggaccugauccugcagugcagacagugcgacagauggaugcacgccgugugccagaaccugaacaccgaggaggagguggagaacguggccgacaucggcuucgacugcagcaugugcagacccuacaugcccgccagcaacgugcccagcagcgacugcugcgagagcagccugguggcccagaucgugaccaaggugaaggagcuggacccccccaagaccuacacccaggacggcgugugccugaccgagagcggcaugacccagcugcagagccugaccgugaccgugcccagaagaaagagaagcaagcccaagcugaagcugaagaucaucaaccagaacagcguggccgugcugcagaccccccccgacauccagagcgagcacagcagagacggcgagauggacgacagcagagagggcgagcugauggacugcgacggcaagagcgagagcagccccgagagagaggccguggacgacgagaccaagggcguggagggcaccgacggcgugaagaagagaaagagaaagcccuacagacccggcaucggcggcuucauggugagacagagaagcagaaccggccagggcaagaccaagagaagcgugaucagaaaggacagcagcggcagcaucagcgagcagcugcccugcagagacgacggcuggagcgagcagcugcccgacacccugguggacgagagcgugagcgugaccgagagcaccgagaagaucaagaagagauacagaaagagaaagaacaagcuggaggagaccuuccccgccuaccugcaggaggccuucuucggcaaggaccugcuggacaccagcagacagagcaagaucagccuggacaaccugagcgaggacggcgcccagcugcuguacaagaccaacaugaacaccggcuuccuggaccccagccuggacccccugcugagcagcagcagcgcccccaccaagagcggcacccacggccccgccgacgacccccuggccgacaucagcgaggugcugaacaccgacgacgacauccugggcaucaucagcgacgaccuggccaagagcguggaccacagcgacaucggccccgugaccgacgaccccagcagccugccccagcccaacgugaaccagagcagcagaccccugagcgaggagcagcuggacggcauccugagccccgagcuggacaagauggugaccgacggcgccauccugggcaagcuguacaagauccccgagcugggcggcaaggacguggaggaccuguucaccgccgugcugagccccgccaacacccagcccaccccccugccccagccccccccccccacccagcugcugcccauccacaaccaggacgccuucagcagaaugccccugaugaacggccugaucggcagcagcccccaccugccccacaacagccugccccccggcagcggccugggcaccuucagcgccaucgcccagagcagcuaccccgacgccagagacaagaacagcgccuucaaccccauggccagcgaccccaacaacagcuggaccagcagcgcccccaccguggagggcgagaacgacaccaugagcaacgcccagagaagcacccugaagugggagaaggaggaggcccugggcgagauggccaccguggcccccgugcuguacaccaacaucaacuuccccaaccugaaggaggaguuccccgacuggaccaccagagugaagcagaucgccaagcuguggagaaaggccagcagccaggagagagcccccuacgugcagaaggccagagacaacagagccgcccugagaaucaacaaggugcagaugagcaacgacagcaugaagagacagcagcagcaggacagcaucgaccccagcagcagaaucgacagcgagcuguucaaggacccccugaagcagagagagagcgagcacgagcaggaguggaaguucagacagcagaugagacagaagagcaagcagcaggccaagaucgaggccacccagaagcuggagcaggugaagaacgagcagcagcagcagcagcagcagcaguucggcagccagcaccugcuggugcagagcggcagcgacacccccagcagcggcauccagagcccccugaccccccagcccggcaacggcaacaugagccccgcccagagcuuccacaaggagcuguucaccaagcagccccccagcacccccaccagcaccagcagcgacgacguguucgugaagccccaggcccccccccccccccccgcccccagcagaauccccauccaggacagccugagccaggcccagaccagccagccccccagcccccagguguucagccccggcagcagcaacagcagaccccccagccccauggaccccuacgccaagauggugggcacccccagacccccccccgugggccacagcuucagcagaagaaacagcgccgcccccguggagaacugcaccccccugagcagcgugagcagaccccugcagaugaacgagaccaccgccaacagacccagccccgugagagaccugugcagcagcagcaccaccaacaacgaccccuacgccaagccccccgacacccccagacccgugaugaccgaccaguuccccaagagccugggccugagcagaagccccguggugagcgagcagaccgccaagggccccaucgccgccggcaccagcgaccacuucaccaagcccagccccagagccgacguguuccagagacagagaauccccgacagcuacgccagaccccugcugacccccgccccccuggacagcggccccggccccuucaagacccccaugcagcccccccccagcagccaggaccccuacggcagcgugagccaggccagcagaagacugagcguggaccccuacgagagacccgcccugacccccagacccaucgacaacuucagccacaaccagagcaacgaccccuacagccagcccccccugaccccccaccccgccgugaacgagagcuucgcccaccccagcagagccuucagccagcccggcaccaucagcagacccaccagccaggaccccuacagccagccccccggcacccccagacccgugguggacagcuacagccagagcagcggcaccgccagaagcaacaccgaccccuacagccagccccccggcacccccagacccaccaccguggaccccuacagccagcagccccagacccccagacccagcacccagaccgaccuguucgugacccccgugaccaaccagagacacagcgaccccuacgcccacccccccggcacccccagacccggcaucagcgugcccuacagccagccccccgccacccccagacccagaaucagcgagggcuucaccagaagcagcaugaccagacccgugcugaugcccaaccaggaccccuuccugcaggccgcccagaacagaggccccgcccugcccggcccccuggugagaccccccgacaccugcagccagacccccagaccccccggccccggccugagcgacaccuucagcagagugagccccagcgccgccagagaccccuacgaccagagccccaugacccccagaagccagagcgacagcuucggcaccagccagaccgcccacgacguggccgaccagcccagacccggcagcgagggcagcuucugcgccagcagcaacagccccaugcacagccagggccagcaguucagcggcgugagccagcugcccggccccgugcccaccagcggcgugaccgacacccagaacaccgugaacauggcccaggccgacaccgagaagcugagacagagacagaagcugagagagaucauccugcagcagcagcagcagaagaagaucgccggcagacaggagaagggcagccaggacagccccgccgugccccaccccggcccccugcagcacuggcagcccgagaacgugaaccaggccuucaccagaccccccccccccuaccccggcaacaucagaagccccguggcccccccccugggccccagauacgccguguuccccaaggaccagagaggccccuacccccccgacguggccagcaugggcaugagaccccacggcuucagauucggcuuccccggcggcagccacggcaccaugcccagccaggagagauuccuggugcccccccagcagauccagggcagcggcgugagcccccagcugagaagaagcgugagcguggacaugcccagaccccugaacaacagccagaugaacaaccccgugggccugccccagcacuucagcccccagagccugcccgugcagcagcacaacauccugggccaggccuacaucgagcugagacacagagcccccgacggcagacagagacugcccuucagcgccccccccggcagcgugguggaggccagcagcaaccugagacacggcaacuucauccccagacccgacuuccccggccccagacacaccgaccccaugagaagacccccccagggccugcccaaccagcugcccgugcaccccgaccuggagcaggugccccccagccagcaggagcagggccacagcgugcacagcagcagcauggugaugagaacccugaaccacccccugggcggcgaguucagcgaggccccccugagcaccagcgugcccagcgagaccaccagcgacaaccugcagaucaccacccagcccagcgacggccuggaggagaagcuggacagcgacgaccccagcgugaaggagcuggacgugaaggaccuggagggcguggaggugaaggaccuggacgacgaggaccuggagaaccugaaccuggacaccgaggacggcaaggugguggagcuggacacccuggacaaccuggagaccaacgaccccaaccuggacgaccugcugagaagcggcgaguucgacaucaucgccuacaccgaccccgagcuggacaugggcgacaagaagagcauguucaacgaggagcuggaccugcccaucgacgacaagcuggacaaccagugcgugagcguggagcccaagaagaaggagcaggagaacaagacccuggugcugagcgacaagcacagcccccagaagaagagcaccgugaccaacgaggugaagaccgaggugcugagccccaacagcaagguggagagcaagugcgagaccgagaagaacgacgagaacaaggacaacguggacacccccugcagccaggccagcgcccacagcgaccugaacgacggcgagaagaccagccugcaccccugcgaccccgaccuguucgagaagagaaccaacagagagaccgccggccccagcgccaacgugauccaggccagcacccagcugcccgcccaggacgugaucaacagcugcggcaucaccggcagcacccccgugcugagcagccugcuggccaacgagaagagcgacaacagcgacaucagacccagcggcagcccccccccccccacccugcccgccagccccagcaaccacgugagcagccugccccccuucaucgccccccccggcagagugcuggacaacgccaugaacagcaacgugaccguggugagcagagugaaccacguguucagccagggcgugcaggugaaccccggccugauccccggccagagcaccgugaaccacagccugggcaccggcaagcccgccacccagaccggcccccagaccagccagagcggcaccagcagcaugagcggcccccagcagcugaugaucccccagacccuggcccagcagaacagagagagaccccugcugcuggaggagcagccccugcugcugcaggaccugcuggaccaggagagacaggagcagcagcagcagagacagaugcaggccaugaucagacagagaagcgagcccuucuuccccaacaucgacuucgacgccaucaccgaccccaucaugaaggccaagaugguggcccugaagggcaucaacaaggugauggcccagaacaaccugggcaugccccccauggugaugagcagauuccccuucaugggccagguggugaccggcacccagaacagcgagggccagaaccugggcccccaggccaucccccaggacggcagcaucacccaccagaucagcagacccaacccccccaacuucggccccggcuucgugaacgacagccagagaaagcaguacgaggaguggcugcaggagacccagcagcugcugcagaugcagcagaaguaccuggaggagcagaucggcgcccacagaaagagcaagaaggcccugagcgccaagcagagaaccgccaagaaggccggcagagaguuccccgaggaggacgccgagcagcugaagcacgugaccgagcagcagagcauggugcagaagcagcuggagcagaucagaaagcagcagaaggagcacgccgagcugaucgaggacuacagaaucaagcagcagcagcagugcgccauggccccccccaccaugaugcccagcgugcagccccagcccccccugauccccggcgccaccccccccaccaugagccagcccaccuuccccauggugccccagcagcugcagcaccagcagcacaccaccgugaucagcggccacaccagccccgugagaaugcccagccugcccggcuggcagcccaacagcgcccccgcccaccugccccugaacccccccagaauccagccccccaucgcccagcugcccaucaagaccugcacccccgcccccggcaccgugagcaacgccaacccccagagcggccccccccccagaguggaguucgacgacaacaaccccuucagcgagagcuuccaggagagagagagaaaggagagacugagagagcagcaggagagacagagaauccagcugaugcaggagguggacagacagagagcccugcagcagagaauggagauggagcagcacggcauggugggcagcgagaucagcagcagcagaaccagcgugagccagauccccuucuacagcagcgaccugcccugcgacuucaugcagccccugggcccccugcagcagagcccccagcaccagcagcagaugggccaggugcugcagcagcagaacauccagcagggcagcaucaacagccccagcacccagaccuucaugcagaccaacgagagaagacaggugggcccccccagcuucgugcccgacagccccagcauccccgugggcagccccaacuucagcagcgugaagcagggccacggcaaccugagcggcaccagcuuccagcagagccccgugagacccagcuucacccccgcccugcccgccgccccccccguggccaacagcagccugcccugcggccaggacagcaccaucacccacggccacagcuaccccggcagcacccagagccugauccagcuguacagcgacaucauccccgaggagaagggcaagaagaagagaaccagaaagaagaagagagacgacgacgccgagagcaccaaggcccccagcaccccccacagcgacaucaccgccccccccacccccggcaucagcgagaccaccagcacccccgccgugagcacccccagcgagcugccccagcaggccgaccaggagagcguggagcccgugggccccagcacccccaacauggccgccggccagcugugcaccgagcuggagaacaagcugcccaacagcgacuucagccaggccacccccaaccagcagaccuacgccaacagcgagguggacaagcugagcauggagacccccgccaagaccgaggagaucaagcuggagaaggccgagaccgagagcugccccggccaggaggagcccaagcuggaggagcagaacggcagcaagguggagggcaacgccguggccugccccgugagcagcgcccagagccccccccacagcgccggcgcccccgccgccaagggcgacagcggcaacgagcugcugaagcaccugcugaagaacaagaagagcagcagccugcugaaccagaagcccgagggcagcaucugcagcgaggacgacugcaccaaggacaacaagcugguggagaagcagaaccccgccgagggccugcagacccugggcgcccagaugcagggcggcuucggcugcggcaaccagcugcccaagaccgacggcggcagcgagaccaagaagcagagaagcaagagaacccagagaaccggcgagaaggccgcccccagaagcaagaagagaaagaaggacgaggaggagaagcaggccauguacagcagcaccgacaccuucacccaccugaagcagcagaacaaccugagcaacccccccaccccccccgccagccugccccccacccccccccccauggccugccagaagauggccaacggcuucgccaccaccgaggagcuggccggcaaggccggcgugcuggugagccacgaggugaccaagacccugggccccaagcccuuccagcugcccuucagaccccaggacgaccugcuggccagagcccuggcccagggccccaagaccguggacgugcccgccagccugcccacccccccccacaacaaccaggaggagcugagaauccaggaccacugcggcgacagagacacccccgacagcuucgugcccagcagcagccccgagagcguggugggcguggaggugagcagauaccccgaccugagccuggugaaggaggagccccccgagcccgugcccagccccaucauccccauccugcccagcaccgccggcaagagcagcgagagcagaagaaacgacaucaagaccgagcccggcacccuguacuucgccagccccuucggccccagccccaacggccccagaagcggccugaucagcguggccaucacccugcaccccaccgccgccgagaacaucagcagcgugguggccgccuucagcgaccugcugcacgugagaauccccaacagcuacgaggugagcagcgcccccgacgugcccagcaugggccuggugagcagccacagaaucaaccccggccuggaguacagacagcaccugcugcugagaggccccccccccggcagcgccaacccccccagacuggugagcagcuacagacugaagcagcccaacgugcccuucccccccaccagcaacggccugagcggcuacaaggacagcagccacggcaucgccgagagcgccgcccugagaccccaguggugcugccacugcaagguggugauccugggcagcggcgugagaaagagcuucaaggaccugacccugcugaacaaggacagcagagagagcaccaagagaguggagaaggacaucguguucugcagcaacaacugcuucauccuguacagcagcaccgcccaggccaagaacagcgagaacaaggagagcauccccagccugccccagagccccaugagagagacccccagcaaggccuuccaccaguacagcaacaacaucagcacccuggacgugcacugccugccccagcugcccgagaaggccagcccccccgccagcccccccaucgccuucccccccgccuucgaggccgcccagguggaggccaagcccgacgagcugaaggugaccgugaagcugaagcccagacugagagccgugcacggcggcuucgaggacugcagaccccugaacaagaaguggagaggcaugaaguggaagaaguggagcauccacaucgugauccccaagggcaccuucaagccccccugcgaggacgagaucgacgaguuccugaagaagcugggcaccagccugaagcccgaccccgugcccaaggacuacagaaagugcugcuucugccacgaggagggcgacggccugaccgacggccccgccagacugcugaaccuggaccuggaccugugggugcaccugaacugcgcccuguggagcaccgagguguacgagacccaggccggcgcccugaucaacguggagcuggcccugagaagaggccugcagaugaagugcguguucugccacaagaccggcgccaccagcggcugccacagauucagaugcaccaacaucuaccacuucaccugcgccaucaaggcccagugcauguucuucaaggacaagaccaugcugugccccaugcacaagcccaagggcauccacgagcaggagcugagcuacuucgccguguucagaagaguguacgugcagagagacgaggugagacagaucgccagcaucgugcagagaggcgagagagaccacaccuucagagugggcagccugaucuuccacaccaucggccagcugcugccccagcagaugcaggccuuccacagccccaaggcccuguuccccgugggcuacgaggccagcagacuguacuggagcaccagauacgccaacagaagaugcagauaccugugcagcaucgaggagaaggacggcagacccguguucgugaucagaaucguggagcagggccacgaggaccuggugcugagcgacaucagccccaagggcgugugggacaagauccuggagcccguggccugcgugagaaagaagagcgagaugcugcagcuguuccccgccuaccugaagggcgaggaccuguucggccugaccgugagcgccguggccagaaucgccgagagccugcccggcguggaggccugcgagaacuacaccuucagauacggcagaaacccccugauggagcugccccuggccgugaaccccaccggcugcgccagaagcgagcccaagaugagcgcccacgugaagagauucgugcugagaccccacacccugaacagcaccagcaccagcaagagcuuccagagcaccgugaccggcgagcugaacgcccccuacagcaagcaguucgugcacagcaagagcagccaguacagaaagaugaagaccgaguggaagagcaacguguaccuggccagaagcagaauccagggccugggccuguacgccgccagagacaucgagaagcacaccauggugaucgaguacaucggcaccaucaucagaaacgagguggccaacagaaaggagaagcuguacgagagccagaacagaggcguguacauguucagaauggacaacgaccacgugaucgacgccacccugaccggcggccccgccagauacaucaaccacagcugcgcccccaacugcguggccgagguggugaccuucgagagaggccacaagaucaucaucagcagcagcagaagaauccagaagggcgaggagcugugcuacgacuacaaguucgacuucgaggacgaccagcacaagauccccugccacugcggcgccgugaacugcagaaaguggaugaacuaa

SEQ ID NO: 19052 - RNA, 16614 nt, Artificial Sequence
  KMT2D__Homo_sapiens__XP_005269219
auggacagccagaagcuggccggcgaggacaaggacagcgagcccgccgccgacggccccgccgccagcgaggaccccagcgccaccgagagcgaccugcccaacccccacgugggcgaggugagcgugcugagcagcggcagccccagacugcaggagaccccccaggacugcagcggcggccccgugagaagaugcgcccugugcaacugcggcgagcccagccugcacggccagagagagcugagaagauucgagcugcccuucgacuggcccagaugccccguggugagccccggcggcagccccggccccaacgaggccgugcugcccagcgaggaccugagccagaucggcuuccccgagggccugacccccgcccaccugggcgagcccggcggcagcugcugggcccaccacuggugcgccgccuggagcgccggcguguggggccaggagggccccgagcugugcggcguggacaaggccaucuucagcggcaucagccagagaugcagccacugcaccagacugggcgccagcauccccugcagaagccccggcugccccagacuguaccacuuccccugcgccaccgccagcggcagcuuccugagcaugaagacccugcagcugcugugccccgagcacagcgagggcgccgccuaccuggaggaggccagaugcgccgugugcgagggccccggcgagcugugcgaccuguucuucugcaccagcugcggccaccacuaccacggcgccugccuggacaccgcccugaccgccagaaagagagccggcuggcagugccccgagugcaaggugugccaggccugcagaaagcccggcaacgacagcaagaugcuggugugcgagaccugcgacaagggcuaccacaccuucugccugaagccccccauggaggagcugcccgcccacagcuggaagugcaaggccugcagagugugcagagccugcggcgccggcagcgccgagcugaaccccaacagcgagugguucgagaacuacagccugugccacagaugccacaaggcccagggcggccagaccaucagaagcguggccgagcagcacacccccgugugcagcagauucagcccccccgagcccggcgacacccccaccgacgagcccgacgcccuguacguggccugccagggccagcccaagggcggccacgugaccagcaugcagcccaaggagcccggcccccugcagugcgaggccaagccccugggcaaggccggcgugcagcuggagccccagcuggaggccccccugaacgaggagaugccccugcugcccccccccgaggagagcccccugagccccccccccgaggagagccccaccagccccccccccgaggccagcagacugagccccccccccgaggagcugcccgccagcccccugcccgaggcccugcaccugagcagaccccuggaggagagcccccugagccccccccccgaggagagcccccugagccccccccccgagagcagccccuucagcccccuggaggagagcccccugagcccccccgaggagagcccccccagccccgcccuggagaccccccugagccccccccccgaggccagcccccugagcccccccuucgaggagagcccccugagccccccccccgaggagcugcccaccagccccccccccgaggccagcagacugagccccccccccgaggagagccccaugagccccccccccgaggagagccccaugagccccccccccgaggccagcagacuguucccccccuucgaggagagcccccugagccccccccccgaggagagcccccugagccccccccccgaggccagcagacugagccccccccccgaggacagccccaugagccccccccccgaggagagccccaugagccccccccccgaggugagcagacugagcccccugcccguggugagcagacugagccccccccccgaggagagcccccugagccccccccccgaggagagccccaccagccccccccccgaggccagcagacugagccccccccccgaggacagccccaccagccccccccccgaggacagccccgccagccccccccccgaggacagccugaugagccugccccuggaggagagcccccugcugccccugcccgaggagccccagcugugccccagaagcgagggcccccaccugagccccagacccgaggagccccaccugagccccagacccgaggagccccaccugagcccccaggccgaggagccccaccugagcccccagcccgaggagcccugccugugcgccgugcccgaggagccccaccugagcccccaggccgagggcccccaccugagcccccagcccgaggagcugcaccugagcccccagaccgaggagccccaccugagccccgugcccgaggagcccugccugagcccccagcccgaggagagccaccugagcccccagagcgaggagcccugccugagccccagacccgaggagagccaccugagccccgagcuggagaagcccccccugagccccagacccgagaagccccccgaggagcccggccagugccccgcccccgaggagcugccccuguuccccccccccggcgagcccagccugagcccccugcugggcgagcccgcccugagcgagcccggcgagcccccccugagcccccugcccgaggagcugccccugagccccagcggcgagcccagccugagcccccagcugaugccccccgacccccugccccccccccugagccccaucaucaccgccgccgccccccccgcccugagcccccugggcgagcuggaguaccccuucggcgccaagggcgacagcgaccccgagagcccccuggccgcccccauccuggagacccccaucagccccccccccgaggccaacugcaccgaccccgagcccgugccccccaugauccugccccccagccccggcagccccgugggccccgccagccccauccugauggagccccugcccccccagugcagcccccugcugcagcacagccuggugccccagaacagcccccccagccagugcagcccccccgcccugccccugagcgugcccagcccccugagccccaucggcaagguggugggcgugagcgacgaggccgagcugcacgagauggagaccgagaaggugagcgagcccgagugccccgcccuggagcccagcgccaccagcccccugcccagccccaugggcgaccugagcugccccgcccccagccccgcccccgcccuggacgacuucagcggccugggcgaggacaccgccccccuggacggcaucgacgcccccggcagccagcccgagcccggccagacccccggcagccuggccagcgagcugaagggcagccccgugcugcuggaccccgaggagcuggcccccgugacccccauggagguguaccccgagugcaagcagaccgccggccagggcagccccugcgaggagcaggaggagcccagagcccccguggcccccaccccccccacccugaucaagagcgacaucgugaacgagaucagcaaccugagccagggcgacgccagcgccagcuuccccggcagcgagccccugcugggcagccccgaccccgagggcggcggcagccugagcauggagcugggcgugagcaccgacgugagccccgccagagacgagggcagccugagacugugcaccgacagccugcccgagaccgacgacagccugcugugcgacgccggcaccgccaucagcggcggcaaggccgagggcgagaagggcagaagaagaagcagccccgccagaagcagaaucaagcagggcagaagcagcagcuuccccggcagaagaagacccagaggcggcgcccacggcggcagaggcagaggcagagccagacugaagagcaccgccagcagcaucgagacccuggugguggccgacaucgacagcagccccagcaaggaggaggaggaggaggacgacgacaccaugcagaacaccguggugcuguucagcaacaccgacaaguucgugcugaugcaggacaugugcguggugugcggcagcuucggcagaggcgccgagggccaccugcuggccugcagccagugcagccagugcuaccaccccuacugcgugaacagcaagaucaccaaggugaugcugcugaagggcuggagaugcguggagugcaucgugugcgaggugugcggccaggccagcgaccccagcagacugcugcugugcgacgacugcgacaucagcuaccacaccuacugccuggaccccccccugcugaccgugcccaagggcggcuggaagugcaaguggugcgugagcugcaugcagugcggcgccgccagccccggcuuccacugcgaguggcagaacagcuacacccacugcggccccugcgccagccuggugaccugccccaucugccacgcccccuacguggaggaggaccugcugauccagugcagacacugcgagagauggaugcacgccggcugcgagagccuguucaccgaggacgacguggagcaggccgccgacgagggcuucgacugcgugagcugccagcccuacguggugaagcccguggcccccguggccccccccgagcuggugcccaugaaggugaaggagcccgagccccaguacuucagauucgagggcguguggcugaccgagaccggcauggcccugcugagaaaccugaccaugagcccccugcacaagagaagacagagaagaggcagacugggccugcccggcgaggccggccuggagggcagcgagcccagcgacgcccugggccccgacgacaagaaggacggcgaccuggacaccgacgagcugcugaagggcgagggcggcguggagcacauggagugcgagaucaagcuggagggccccgugagccccgacguggagcccggcaaggaggagaccgaggagagcaagaagagaaagagaaagcccuacagacccggcaucggcggcuucauggugagacagagaaagagccacaccagaaccaagaagggccccgccgcccaggccgaggugcugagcggcgacggccagcccgacgaggugauccccgccgaccugcccgccgagggcgccguggagcagagccuggccgagggcgacgagaagaagaagcagcagagaagaggcagaaagaagagcaagcuggaggacauguuccccgccuaccugcaggaggccuucuucggcaaggagcugcuggaccugagcagaaaggcccuguucgccgugggcgugggcagacccagcuucggccugggcacccccaaggccaagggcgacggcggcagcgagagaaaggagcugcccaccagccagaagggcgacgacggccccgacaucgccgacgaggagagcagaggccuggagggcaaggccgacacccccggccccgaggacggcggcgugaaggccagccccgugcccagcgaccccgagaagcccggcacccccggcgagggcaugcugagcagcgaccuggacagaaucagcaccgaggagcugcccaagauggagagcaaggaccugcagcagcuguucaaggacgugcugggcagcgagagagagcagcaccugggcugcggcacccccggccuggagggcagcagaaccccccugcagagacccuuccugcagggcggccugccccugggcaaccugcccagcagcagccccauggacagcuaccccggccugugccagagccccuuccuggacagcagagagagaggcggcuucuucagccccgagcccggcgagcccgacagccccuggaccggcagcggcggcaccacccccagcacccccaccacccccaccaccgagggcgagggcgacggccugagcuacaaccagagaagccugcagagaugggagaaggacgaggagcugggccagcugagcaccaucagccccgugcuguacgccaacaucaacuuccccaaccugaagcaggacuaccccgacuggagcagcagaugcaagcagaucaugaagcuguggagaaaggugcccgccgccgacaaggcccccuaccugcagaaggccaaggacaacagagccgcccacagaaucaacaaggugcagaagcaggccgagagccagaucaacaagcagaccaaggugggcgacaucgccagaaagaccgacagacccgcccugcaccugagaauccccccccagcccggcgcccugggcagccccccccccgccgccgcccccaccaucuucaucggcagccccaccacccccgccggccugagcaccagcgccgacggcuuccugaagccccccgccggcagcgugcccggccccgacagccccggcgagcuguuccugaagcugcccccccaggugcccgcccaggugcccagccaggaccccuucggccuggcccccgccuacccccuggagcccagauuccccaccgccccccccaccuacccccccuaccccagccccaccggcgcccccgcccagccccccaugcugggcgccagcagcagacccggcgccggccagcccggcgaguuccacaccaccccccccggcacccccagacaccagcccagcacccccgaccccuuccugaagcccagaugccccagccuggacaaccuggccgugcccgagagccccggcgugggcggcggcaaggccagcgagccccugcugagccccccccccuucggcgagagcagaaaggcccuggaggugaagaaggaggagcugggcgccagcagccccagcuacggcccccccaaccugggcuucguggacagccccagcagcggcacccaccugggcggccuggagcugaagacccccgacguguucaaggccccccugacccccagagccagccagguggagccccagagccccggccugggccugagaccccaggagcccccccccgcccaggcccuggcccccagcccccccagccaccccgacaucuucagacccggcagcuacaccgaccccuacgcccagcccccccugacccccagaccccagccccccccccccgagagcugcugcgcccugccccccagaagccugcccagcgaccccuucagcagagugcccgccagcccccagagccagagcagcagccagagcccccugacccccagaccccugagcgccgaggccuucugccccagccccgugacccccagauuccagagccccgaccccuacagcagaccccccagcagaccccagagcagagaccccuucgccccccugcacaagccccccagaccccagccccccgagguggccuucaaggccggcagccuggcccacaccagccugggcgccggcggcuuccccgccgcccugcccgccggccccgccggcgagcugcacgccaaggugcccagcggccagccccccaacuucgugagaagccccggcaccggcgccuucgugggcacccccagccccaugagauucaccuucccccaggccgugggcgagcccagccugaagccccccgugccccagcccggccugccccccccccacggcaucaacagccacuucggccccggccccacccugggcaagccccagagcaccaacuacaccguggccaccggcaacuuccaccccagcggcagcccccugggccccagcagcggcagcaccggcgagagcuacggccugagcccccugagaccccccagcgugcugcccccccccgcccccgacggcagccugcccuaccugagccacggcgccagccagagaagcggcaucaccagccccguggagaagagagaggaccccggcaccggcaugggcagcagccuggccaccgccgagcugcccggcacccaggaccccggcaugagcggccugagccagaccgagcuggagaagcagagacagagacagagacugagagagcugcugaucagacagcagauccagagaaacacccugagacaggagaaggagaccgccgccgccgccgccggcgccgugggcccccccggcagcuggggcgccgagcccagcagccccgccuucgagcagcugagcagaggccagacccccuucgccggcacccaggacaagagcagccuggugggccugccccccagcaagcugagcggccccauccugggccccggcagcuuccccagcgacgacagacugagcagaccccccccccccgccacccccagcagcauggacgugaacagcagacagcuggugggcggcagccaggccuucuaccagagagcccccuaccccggcagccugccccugcagcagcagcagcagcagcuguggcagcagcagcaggccaccgccgccaccagcaugagauucgccaugagcgccagauuccccagcacccccggccccgagcugggcagacaggcccugggcagcccccuggccggcaucagcaccagacugcccggccccggcgagcccgugcccggccccgccggccccgcccaguucaucgagcugagacacaacgugcagaagggccugggccccggcggcacccccuuccccggccagggccccccccagagacccagauucuaccccgugagcgaggacccccacagacuggcccccgagggccugagaggccuggccgugagcggccugcccccccagaagcccagcgccccccccgcccccgagcugaacaacagccugcaccccaccccccacaccaagggccccacccugcccaccggccuggagcuggugaacagaccccccagcagcaccgagcugggcagacccaacccccuggcccuggaggccggcaagcugcccugcgaggaccccgagcuggacgacgacuucgacgcccacaaggcccuggaggacgacgaggagcuggcccaccugggccugggcguggacguggccaagggcgacgacgagcugggcacccuggagaaccuggagaccaacgacccccaccuggacgaccugcugaacggcgacgaguucgaccugcuggccuacaccgaccccgagcuggacaccggcgacaagaaggacaucuucaacgagcaccugagacugguggagagcgccaacgagaaggccgagagagaggcccugcugagaggcguggagcccggcccccugggccccgaggagagacccccccccgccgccgacgccagcgagcccagacuggccagcgugcugcccgaggugaagcccaagguggaggagggcggcagacaccccagccccugccaguucaccaucgccacccccaagguggagcccgcccccgccgccaacagccugggccugggccugaagcccggccagagcaugaugggcagcagagacaccagaaugggcaccggccccuucagcagcagcggccacaccgccgagaaggccagcuucggcgccaccggcggcccccccgcccaccugcugacccccagcccccugagcggccccggcggcagcagccugcuggagaaguucgagcuggagagcggcgcccugacccugcccggcggccccgccgccagcggcgacgagcuggacaagauggagagcagccugguggccagcgagcugccccugcugaucgaggaccugcuggagcacgagaagaaggagcugcagaagaagcagcagcugagcgcccagcugcagcccgcccagcagcagcagcagcagcagcagcagcacagccugcugagcgcccccggccccgcccaggccaugagccugccccacgagggcagcagccccagccuggccggcagccagcagcagcugagccugggccuggccggcgccagacagcccggccugccccagccccugaugcccacccagccccccgcccacgcccugcagcagagacuggcccccagcauggccauggugagcaaccagggccacaugcugagcggccagcacggcggccaggccggccuggugccccagcagagcagccagcccgugcugagccagaagcccaugggcaccaugccccccagcaugugcaugaagccccagcagcuggccaugcagcagcagcuggccaacagcuucuuccccgacaccgaccuggacaaguucgccgccgaggacaucaucgaccccaucgccaaggccaagaugguggcccugaagggcaucaagaaggugauggcccagggcagcaucggcguggcccccggcaugaacagacagcaggugagccugcuggcccagagacugagcggcggccccagcagcgaccugcagaaccacguggccgccggcagcggccaggagagaagcgccggcgaccccagccagcccagacccaacccccccaccuucgcccagggcgugaucaacgaggccgaccagagacaguacgaggaguggcuguuccacacccagcagcugcugcagaugcagcugaaggugcuggaggagcagaucggcgugcacagaaagagcagaaaggcccugugcgccaagcagagaaccgccaagaaggccggcagagaguuccccgaggccgacgccgagaagcugaagcuggugaccgagcagcagagcaagauccagaagcagcuggaccaggugagaaagcagcagaaggagcacaccaaccugauggccgaguacagaaacaagcagcagcagcagcagcagcagcagcagcagcagcagcagcagcacagcgccgugcuggcccugagccccagccagagccccagacugcugaccaagcugcccggccagcugcugcccggccacggccugcagcccccccagggcccccccggcggccaggccggcggccugagacugacccccggcggcauggcccugcccggccagcccggcggccccuuccugaacaccgcccuggcccagcagcagcagcagcagcacagcggcggcgccggcagccuggccggccccagcggcggcuucuuccccggcaaccuggcccugagaagccugggccccgacagcagacugcugcaggagagacagcugcagcugcagcagcagagaaugcagcuggcccagaagcugcagcagcagcagcagcagcagcagcagcagcagcaccugcugggccagguggccauccagcagcagcagcagcagggccccggcgugcagaccaaccaggcccugggccccaagccccagggccugaugccccccagcagccaccagggccugcuggugcagcagcugagcccccagcccccccagggcccccagggcaugcugggccccgcccagguggccgugcugcagcagcagcaccccggcgcccugggcccccagggcccccacagacaggugcugaugacccagagcagagugcugagcagcccccagcuggcccagcagggccagggccugaugggccacagacuggugaccgcccagcagcagcagcagcagcagcagcaccagcagcagggcagcauggccggccugagccaccugcagcagagccugaugagccacagcggccagcccaagcugagcgcccagcccaugggcagccugcagcagcugcagcagcagcagcagcugcagcagcagcagcagcugcagcagcagcagcagcagcagcugcagcagcagcagcagcugcagcagcagcagcugcagcagcagcagcagcagcagcagcugcagcagcagcagcagcagcagcugcagcagcagcagcagcagcugcagcagcagcagcagcagcagcagcagcaguuccagcagcagcagcagcagcagcagaugggccugcugaaccagagcagaacccugcugagcccccagcagcagcagcagcagcagguggcccugggccccggcaugcccgccaagccccugcagcacuucagcagccccggcgcccugggccccacccugcugcugaccggcaaggagcagaacaccguggaccccgccgugagcagcgaggccaccgagggccccagcacccaccagggcggcccccuggccaucggcaccacccccgagagcauggccaccgagcccggcgaggugaagcccagccugagcggcgacagccagcugcugcuggugcagccccagccccagccccagcccagcagccugcagcugcagcccccccugagacugcccggccagcagcagcagcaggugagccugcugcacaccgccggcggcggcagccacggccagcugggcagcggcagcagcagcgaggccagcagcgugccccaccugcuggcccagcccagcgugagccugggcgaccagcccggcagcaugacccagaaccugcugggcccccagcagcccaugcuggagagacccaugcagaacaacaccggcccccagccccccaagcccggccccgugcugcagagcggccagggccugcccggcgugggcaucaugcccaccgugggccagcugagagcccagcugcagggcgugcuggccaagaacccccagcugagacaccugagcccccagcagcagcagcagcugcaggcccugcugaugcagagacagcugcagcagagccaggccgugagacagaccccccccuaccaggagcccggcacccagaccagcccccugcagggccugcugggcugccagccccagcugggcggcuuccccggcccccagaccggcccccugcaggagcugggcgccggccccagaccccagggcccccccagacugcccgccccccccggcgcccugagcaccggccccgugcugggccccgugcaccccacccccccccccagcagcccccaggagcccaagagacccagccagcugcccagccccagcagccagcugcccaccgaggcccagcugccccccacccaccccggcacccccaagccccagggccccacccuggagcccccccccggcagagugagccccgccgccgcccagcuggccgacacccuguucagcaagggccugggccccugggacccccccgacaaccuggccgagacccagaagcccgagcagagcagccuggugcccggccaccuggaccaggugaacggccagguggugcccgaggccagccagcugagcaucaagcaggagcccagagaggagcccugcgcccugggcgcccagagcgugaagagagaggccaacggcgagcccaucggcgcccccggcaccagcaaccaccugcugcuggccggccccagaagcgaggccggccaccugcugcugcagaagcugcugagagccaagaacgugcagcugagcaccggcagaggcagcgagggccugagagccgagaucaacggccacaucgacagcaagcuggccggccuggagcagaagcugcagggcacccccagcaacaaggaggacgccgccgccagaaagccccugacccccaagcccaagagagugcagaaggccagcgacagacuggugagcagcagaaagaagcugagaaaggaggacggcgugagagccagcgaggcccugcugaagcagcugaagcaggagcugagccugcugccccugaccgagcccgccaucaccgccaacuucagccuguucgcccccuucggcagcggcugccccgugaacggccagagccagcugagaggcgccuucggcagcggcgcccugcccaccggccccgacuacuacagccagcugcugaccaagaacaaccugagcaacccccccaccccccccagcagccugccccccacccccccccccagcgugcagcagaagauggugaacggcgugacccccagcgaggagcugggcgagcaccccaaggacgccgccagcgccagagacagcgagagagcccugagagacaccagcgaggugaagagccuggaccugcuggccgcccugcccacccccccccacaaccagaccgaggacgugagaauggagagcgacgaggacagcgacagccccgacagcaucgugcccgccagcagccccgagagcauccugggcgaggaggcccccagauucccccaccugggcagcggcagaugggagcaggaggacagagcccugagccccgugaucccccugauccccagagccagcauccccguguuccccgacaccaagcccuacggcgcccugggccuggaggugcccggcaagcugcccgugaccaccugggagaagggcaagggcagcgaggugagcgugaugcugaccgugagcgccgccgccgccaagaaccugaacggcgugaugguggccguggccgagcugcugagcaugaagauccccaacagcuacgaggugcuguuccccgagagccccgccagagccggcaccgagcccaagaagggcgaggccgagggccccggcggcaaggagaagggccuggagggcaagagccccgacaccggccccgacuggcugaagcaguucgacgccgugcugcccggcuacacccugaagagccagcuggacauccugagccugcugaagcaggagagccccgcccccgagccccccacccagcacagcuacaccuacaacgugagcaaccuggacgugagacagcugagcgcccccccccccgaggagcccagccccccccccagcccccuggcccccagccccgccagcccccccaccgagccccugguggagcugcccaccgagccccuggccgagccccccgugcccagcccccugccccuggccagcagccccgagagcgccagacccaagcccagagccagaccccccgaggagggcgaggacagcagaccccccagacugaagaaguggaagggcgugagauggaagagacugagacugcugcugaccauccagaagggcagcggcagacaggaggacgagagagagguggccgaguucauggagcagcugggcaccgcccugagacccgacaaggugcccagagacaugagaagaugcugcuucugccacgaggagggcgacggcgccaccgacggccccgccagacugcugaaccuggaccuggaccugugggugcaccugaacugcgcccuguggagcaccgagguguacgagacccagggcggcgcccugaugaacguggagguggcccugcacagaggccugcugaccaagugcagccugugccagagaaccggcgccaccagcagcugcaacagaaugagaugccccaacguguaccacuucgccugcgccaucagagccaagugcauguucuucaaggacaagaccaugcugugccccaugcacaagaucaagggccccugcgagcaggagcugagcagcuucgccguguucagaagaguguacaucgagagagacgaggugaagcagaucgccagcaucauccagagaggcgagagacugcacauguucagagugggcggccugguguuccacgccaucggccagcugcugccccaccagauggccgacuuccacagcgccaccgcccuguaccccgugggcuacgaggccaccagaaucuacuggagccugagaaccaacaacagaagaugcugcuacagaugcagcaucggcgagaacaacggcagacccgaguucgugaucaaggugaucgagcagggccuggaggaccugguguucaccgacgccagcccccaggccguguggaacagaaucaucgagcccguggccgccaugagaaaggaggccgacaugcugagacuguuccccgaguaccugaagggcgaggagcuguucggccugaccgugcacgccgugcugagaaucgccgagagccugcccggcguggagagcugccagaacuaccuguucagauacggcagacacccccugauggagcugccccugaugaucaaccccaccggcugcgccagaagcgagcccaagauccugacccacuacaagagaccccacacccugaacagcaccagcaugagcaaggccuaccagagcaccuucaccggcgagaccaacacccccuacagcaagcaguucgugcacagcaagagcagccaguacagaagacugagaaccgaguggaagaacaacguguaccuggccagaagcagaauccagggccugggccuguacgccgccaaggaccuggagaagcacaccauggugaucgaguacaucggcaccaucaucagaaacgagguggccaacagaagagagaagaucuacgaggagcagaacagaggcaucuacauguucagaaucaacaacgagcacgugaucgacgccacccugaccggcggccccgccagauacaucaaccacagcugcgcccccaacugcguggccgagguggugaccuucgacaaggaggacaagaucaucaucaucagcagcagaagaauccccaagggcgaggagcugaccuacgacuaccaguucgacuucgaggacgaccagcacaagauccccugccacugcggcgccuggaacugcagaaaguggaugaacuaa

SEQ ID NO: 19053 - RNA, 5577 nt, Artificial Sequence
  KMT2E__Homo_sapiens__NP_061152
augagcaucgugaucccccugggcguggacaccgccgagaccagcuaccuggagauggccgccggcagcgagcccgagagcguggaggccagccccguggugguggagaagagcaacagcuacccccaccagcuguacaccagcagcagccaccacagccacagcuacaucggccugcccuacgccgaccacaacuacggcgccagacccccccccaccccccccgccagccccccccccagcgugcugaucagcaagaacgaggugggcaucuucaccacccccaacuucgacgagaccagcagcgccaccaccaucagcaccagcgaggacggcagcuacggcaccgacgugaccagaugcaucugcggcuucacccacgacgacggcuacaugaucugcugcgacaagugcagcguguggcagcacaucgacugcaugggcaucgacagacagcacauccccgacaccuaccugugcgagagaugccagcccagaaaccuggacaaggagagagccgugcugcugcagagaagaaagagagagaacaugagcgacggcgacaccagcgccaccgagagcggcgacgaggugcccguggagcuguacaccgccuuccagcacacccccaccagcaucacccugaccgccagcagagugagcaaggugaacgacaagagaagaaagaagagcggcgagaaggagcagcacaucagcaagugcaagaaggccuucagagagggcagcagaaagagcagcagagugaagggcagcgcccccgagaucgaccccagcagcgacggcagcaacuucggcugggagaccaagaucaaggccuggauggacagauacgaggaggccaacaacaaccaguacagcgagggcgugcagagagaggcccagagaaucgcccugagacugggcaacggcaacgacaagaaggagaugaacaagagcgaccugaacaccaacaaccugcuguucaagccccccguggagagccacauccagaagaacaagaagauccugaagagcgccaaggaccugccccccgacgcccugaucaucgaguacagaggcaaguucaugcugagagagcaguucgaggccaacggcuacuucuucaagagacccuaccccuucgugcuguucuacagcaaguuccacggccuggagaugugcguggacgccagaaccuucggcaacgaggccagauucaucagaagaagcugcacccccaacgccgaggugagacacgagauccaggacggcaccauccaccuguacaucuacagcauccacagcauccccaagggcaccgagaucaccaucgccuucgacuucgacuacggcaacugcaaguacaagguggacugcgccugccugaaggagaaccccgagugccccgugcugaagagaagcagcgagagcauggagaacaucaacagcggcuacgagaccagaagaaagaagggcaagaaggacaaggacaucagcaaggagaaggacacccagaaccagaacaucacccuggacugcgagggcaccaccaacaagaugaagagccccgagaccaagcagagaaagcugagcccccugagacugagcgugagcaacaaccaggagcccgacuucaucgacgacaucgaggagaagacccccaucagcaacgagguggagauggagagcgaggagcagaucgccgagagaaagagaaagaugaccagagaggagagaaagauggaggccauccugcaggccuucgccagacuggagaagagagagaagagaagagagcaggcccuggagagaaucagcaccgccaagaccgaggugaagaccgagugcaaggacacccagaucgugagcgacgccgaggugauccaggagcaggccaaggaggagaacgccagcaagcccacccccgccaaggugaacagaaccaagcagagaaagagcuucagcagaagcagaacccacaucggccagcagagaagaagacacagaaccgugagcaugugcagcgacauccagcccagcagccccgacaucgaggugaccagccagcagaacgacaucgagaacaccgugcugaccaucgagcccgagaccgagaccgcccuggccgagaucaucaccgagaccgaggugcccgcccugaacaagugccccaccaaguaccccaagaccaagaagcaccuggugaacgaguggcugagcgagaagaacgagaagaccggcaagcccagcgacggccugagcgagagaccccugagaaucaccaccgaccccgaggugcuggccacccagcugaacagccugcccggccugaccuacagcccccacguguacagcacccccaagcacuacaucagauucaccagccccuuccugagcgagaagagaagaagaaaggagcccaccgagaacaucagcggcagcugcaagaagagauggcugaagcaggcccuggaggaggagaacagcgccauccugcacagauucaacagccccugccaggagagaagcagaagccccgccgugaacggcgagaacaagagcccccugcugcugaacgacagcugcagccugcccgaccugaccaccccccugaagaagagaagauucuaccagcugcuggacagcguguacagcgagaccagcacccccacccccagccccuacgccacccccacccacaccgacaucacccccauggaccccagcuucgccaccccccccagaaucaagagcgacgacgagaccugcagaaacggcuacaagcccaucuacagccccgugacccccgugacccccggcacccccggcaacaccaugcacuucgagaacaucagcagccccgagagcagccccgagaucaagagaagaaccuacagccaggagggcuacgacagaagcagcaccaugcugacccugggccccuucagaaacagcaaccugaccgagcugggccugcaggagaucaagaccaucggcuacaccagccccagaagcagaaccgaggugaacagacagugccccggcgagaaggagcccgugagcgaccugcagcugggccuggacgccguggagcccaccgcccugcacaagacccuggagacccccgcccacgacagagccgagcccaacagccagcuggacagcacccacagcggcagaggcaccauguacagcagcugggugaagagccccgacagaaccggcgugaacuucagcgugaacagcaaccugagagaccugacccccagccaccagcuggaggugggcggcggcuucagaaucagcgagagcaagugccugaugcaggacgacaccagaggcauguucauggagaccaccguguucugcaccagcgaggacggccuggugagcggcuucggcagaaccgugaacgacaaccugaucgacggcaacugcaccccccagaaccccccccagaagaagaaggugagccugcuggaguacagaaagagacagagagaggccagaaagagcggcagcaagaccgagaacuucccccugaucagcgugagcccccacgccagcggcagccugagcaacaacggcgacggcugcgccagcagcaacgacaacggcgagcagguggaccacaccgccagccugccccugcccacccccgccaccguguacaacgccaccagcgaggagaccagcaacaacugccccgugaaggacgccaccgccagcgagaagaacgagcccgaggugcaguggaccgccagcaccagcguggagcaggugagagagagaagcuaccagagagcccugcugcugagcgaccacagaaaggacaaggacagcggcggcgagagccccugcgugagcugcagccccagccacgugcagagcagccccagcagccacagcaaccacaucccccagcugcaggccaagggccccgugcccagcuucagcgagcugauggaggaccccgaccccgagaaccccgagcccaccaccaccaacgagugccccagccccgacaccagccagaacaccugcaagagcccccccaagaugagcaagcccggcagccccggcagcgugauccccgcccaggcccacggcaagaucuucaccaagcccgacccccagugggacagcaccgugagcgccagcgaggccgagaacggcgugcaccugaagaccgagcugcagcagaagcagcugagcaacaacaaccaggcccugagcaagaaccaccccccccagacccacgugagaaacagcagcgagcagcugagccagaagcugcccagcgugcccaccaagcugcacugcccccccagcccccaccuggagaacccccccaagagcagcaccccccacacccccgugcagcacggcuaccugagccccaagccccccagccagcagcugggcagccccuacagaccccaccacagccagagcccccaggugggcaccccccagagagagccccagagaaacuucuaccccgccgcccagaaccugcccgccaacacccagcaggccaccagcggcacccuguucacccagacccccagcggccagagcagcgccaccuacagccaguucaaccagcagagccugaacagcaccgcccccccccccccccccccccccccccccagcagcagcuacuaccagaaccagcagcccagcgccaacuuccagaacuacaaccagcugaagggcagccugagccagcagaccguguucaccagcggccccaaccaggcccugcccggcaccaccagccagcagaccgugcccggccaccacgugacccccggccacuuccugcccagccagaaccccaccauccaccaccagaccgccgccgccguggugccccccccccccccccccccccccgcccccggcccccaccuggugcagcagcccaacagccaccagcagcacagcguggcccacguggugggccccgugcacgccgugacccccggcagccacauccacagccagaccgccggccaccaccugcccccccccccccccccccccggccccgccccccaccaccacccccccccccaccccagcaccggccugcagggccugcaggcccagcaccagcacguggugaacagcgcccccccccccccccccccccccccccccagcagcgugcuggccagcggccaccacaccaccagcgcccaggcccugcaccaccccccccaccagggccccccccuguuccccagcagcgcccaccccaccgugccccccuaccccagccaggccacccaccacaccacccugggccccggcccccagcaccagcccagcggcaccggcccccacugcccccugcccgugaccggcccccaccugcagccccagggccccaacagcauccccacccccaccgccagcggcuucugcccccaccccggcagcguggcccugccccacggcgugcagggcccccagcaggccagccccgugcccggccagauccccauccacagagcccaggugccccccaccuuccagaacaacuaccacggcagcggcuggcacuaa

SEQ ID NO: 19054 - RNA, 1284 nt, Artificial Sequence
  KNG1__Homo_sapiens__NP_000884
augaagcugaucaccauccuguuccugugcagcagacugcugcugagccugacccaggagagccagagcgaggagaucgacugcaacgacaaggaccuguucaaggccguggacgccgcccugaagaaguacaacagccagaaccagagcaacaaccaguucgugcuguacagaaucaccgaggccaccaagaccgugggcagcgacaccuucuacagcuucaaguacgagaucaaggagggcgacugccccgugcagagcggcaagaccuggcaggacugcgaguacaaggacgccgccaaggccgccaccggcgagugcaccgccaccgugggcaagagaagcagcaccaaguucagcguggccacccagaccugccagaucacccccgccgagggccccguggugaccgcccaguacgacugccugggcugcgugcaccccaucagcacccagagccccgaccuggagcccauccugagacacggcauccaguacuucaacaacaacacccagcacagcagccuguucaugcugaacgaggugaagagagcccagagacaggugguggccggccugaacuucagaaucaccuacagcaucgugcagaccaacugcagcaaggagaacuuccuguuccugacccccgacugcaagagccuguggaacggcgacaccggcgagugcaccgacaacgccuacaucgacauccagcugagaaucgccagcuucagccagaacugcgacaucuaccccggcaaggacuucgugcagccccccaccaagaucugcgugggcugccccagagacauccccaccaacagccccgagcuggaggagacccugacccacaccaucaccaagcugaacgccgagaacaacgccaccuucuacuucaagaucgacaacgugaagaaggccagagugcaggugguggccggcaagaaguacuucaucgacuucguggccagagagaccaccugcagcaaggagagcaacgaggagcugaccgagagcugcgagaccaagaagcugggccagagccuggacugcaacgccgagguguacguggugcccugggagaagaagaucuaccccaccgugaacugccagccccugggcaugaucagccugaugaagagaccccccggcuucagccccuucagaagcagcagaaucggcgagaucaaggaggagaccaccagccaccugagaagcugcgaguacaagggcagaccccccaaggccggcgccgagcccgccagcgagagagaggugagcuaa

SEQ ID NO: 19055 - RNA, 861 nt, Artificial Sequence
  KNSTRN__Homo_sapiens__NP_001136233
auggccgcccccgaggcccccccccuggacagaguguucagaaccaccuggcugagcaccgagugcgacagccacccccugccccccagcuacagaaaguuccuguucgagacccaggccgccgaccuggccggcggcaccaccguggccgccggcaaccugcugaacgagagcgagaaggacugcggccaggacagaagagcccccggcgugcagcccugcagacuggugaccaugaccagcguggugaagaccguguacagccugcagccccccagcgcccugagcggcggccagcccgccgacacccagaccagagccaccagcaagagccugcugcccgugagaagcaaggagguggacgugagcaagcagcugcacagcggcggccccgagaacgacgugaccaagaucaccaagcugagaagagagaacggccagaugaaggccaccgacaccgccaccagaagaaacgugagaaagggcuacaagccccugagcaagcagaagagcgaggaggagcugaaggacaagaaccagcugcuggaggccgugaacaagcagcugcaccagaagcugaccgagacccagggcgagcugaaggaccugacccagaagguggagcugcuggagaaguucagagacaacugccuggccauccuggagagcaagggccuggaccccgcccugggcagcgagacccuggccagcagacaggagagcaccaccgaccacauggacagcaugcugcugcuggagacccugcaggaggagcugaagcuguucaacgagaccgccaagaagcagauggaggagcugcagaucgccuggaugaaccacggcauccugcaccagauguaa

SEQ ID NO: 19056 - RNA, 6630 nt, Artificial Sequence
  KNTC1__Homo_sapiens__NP_055523
auguggaacgacaucgagcugcugaccaacgacgacaccggcagcggcuaccugagcgugggcagcagaaaggagcacggcaccgcccuguaccagguggaccugcuggugaagaucagcagcgagaaggccagccugaaccccaagauccaggccugcagccugagcgacggcuucaucaucguggccgaccagagcgugauccugcuggacagcaucugcagaagccugcagcugcaccugguguucgacaccgagguggacguggugggccugugccaggagggcaaguuccugcuggugggcgagagaagcggcaaccugcaccugauccacgugaccagcaagcagacccugcugaccaacgccuucgugcagaaggccaacgacgagaacagaagaaccuaccagaaccuggugaucgagaaggacggcagcaacgagggcaccuacuacaugcugcugcugaccuacagcggcuucuucugcaucaccaaccugcagcugcugaagauccagcaggccaucgagaacguggacuucagcaccgccaagaagcugcagggccagaucaagagcagcuucaucagcaccgagaacuaccacacccugggcugccugagccugguggccggcgaccuggccagcgaggugcccgugaucaucggcggcaccggcaacugcgccuucagcaagugggagcccgacagcagcaagaagggcaugaccgugaagaaccugaucgacgccgagaucaucaagggcgccaagaaguuccagcugaucgacaaccugcuguucgugcuggacaccgacaacgugcugagccugugggacaucuacacccugacccccguguggaacuggcccagccugcacguggaggaguuccugcugaccaccgaggccgacagccccagcagcgugaccuggcagggcaucaccaaccugaagcugaucgcccugaccgccagcgccaacaagaagaugaagaaccugaugguguacagccugcccaccauggagauccuguacagccuggaggugagcagcgugagcagccuggugcagaccggcaucagcaccgacaccaucuaccugcuggagggcgugugcaagaacgaccccaagcugagcgaggacagcgugagcgugcuggugcugagaugccugaccgaggcccugcccgagaacagacugagcagacugcugcacaagcacagauucgccgaggccgagagcuucgccauccaguucggccuggacguggagcugguguacaaggugaagagcaaccacauccuggagaagcuggcccugagcagcguggacgccagcgagcagaccgaguggcagcagcugguggacgacgccaaggagaaccugcacaagauccaggacgacgaguucguggugaacuacugccugaaggcccaguggaucaccuacgagaccacccaggagaugcugaacuacgccaagaccagacugcugaagaaggaggacaagaccgcccugaucuacagcgacggccugaaggaggugcugagagcccacgccaagcugaccaccuucuacggcgccuucggccccgagaaguucagcggcagcagcuggaucgaguuccugaacaacgaggacgaccugaaggacaucuuccugcagcugaaggagggcaaccuggugugcgcccaguaccuguggcugagacacagagccaacuucgagagcagauucgacgugaagaugcuggagagccugcugaacagcaugagcgccagcgugagccugcagaagcugugccccugguucaagaacgacgugauccccuucgugagaagaaccgugcccgagggccagaucauccuggccaaguggcuggagcaggccgccagaaaccuggagcugaccgacaaggccaacuggcccgagaacggccugcagcuggccgagaucuucuucaccgccgagaagaccgacgagcugggccuggccagcagcuggcacuggaucagccugaaggacuaccagaacaccgaggaggugugccagcugagaacccuggugaacaaccugagagagcugaucacccugcacagaaaguacaacugcaagcuggcccugagcgacuucgagaaggagaacaccaccaccaucguguucagaauguucgacaaggugcuggcccccgagcugauccccagcauccuggagaaguucaucagaguguacaugagagagcacgaccugcaggaggaggagcugcugcugcuguacaucgaggaccugcugaacagaugcagcagcaagagcaccagccuguucgagaccgccugggaggccaaggccauggccgugaucgccugccugagcgacaccgaccugaucuucgacgccgugcugaagaucauguacgccgccguggugcccuggagcgccgccguggagcagcuggugaagcagcaccuggagauggaccaccccaaggugaagcugcugcaggagagcuacaagcugauggagaugaagaagcugcugagaggcuacggcaucagagaggugaaccugcugaacaaggagaucaugagaguggugagauacauccugaagcaggacgugcccagcagccuggaggacgcccugaagguggcccaggccuucaugcugagcgacgacgagaucuacagccugagaaucaucgaccugaucgacagagagcagggcgaggacugccugcugcugcugaagagccugccccccgccgaggccgagaagaccgccgagagagugaucaucugggccagacuggcccugcaggaggagcccgaccacagcaaggagggcaaggccuggagaaugagcguggccaagaccagcguggacauccugaagauccugugcgacauccagaaggacaaccugcagaagaaggacgagugcgaggagaugcugaagcuguucaaggagguggccagccugcaggagaacuucgagguguuccugagcuucgaggacuacagcaacagcagccugguggccgaccugagagagcagcacaucaaggcccacgagguggcccaggccaagcacaagcccggcagcacccccgagcccaucgccgccgaggugagaagccccagcauggagagcaagcugcacagacaggcccuggcccugcagaugagcaagcaggagcuggaggccgagcugacccugagagcccugaaggacggcaacaucaagaccgcccugaagaagugcagcgaccuguucaaguaccacugcaacgccgacaccggcaagcugcuguuccugaccugccagaagcugugccagaugcuggccgacaacgugcccgugaccgugcccgugggccugaaccugcccagcaugauccacgaccuggccagccaggccgccaccaucugcagccccgacuuccugcuggacgcccuggagcugugcaagcacacccugauggccguggagcugagcagacagugccagauggacgacugcggcauccugaugaaggccagcuucggcacccacaaggaccccuacgaggaguggagcuacagcgacuucuucagcgaggacggcaucgugcuggagagccagauggugcugcccgugaucuacgagcugaucagcagccuggugccccuggccgagagcaagagauacccccuggagagcaccagccugcccuacugcagccugaacgagggcgacggccuggugcugcccgugaucaacagcaucagcgcccugcugcagaaccugcaggagagcagccagugggagcuggcccugagauucguggugggcagcuucggcaccugccugcagcacagcgugagcaacuucaugaacgccacccugagcgagaagcuguucggcgagaccacccuggugaagagcagacacguggugauggagcugaaggagaaggccgugaucuucaucagagagaacgccaccacccugcugcacaagguguucaacugcagacugguggaccuggaccuggcccugggcuacugcacccugcugccccagaaggacguguucgagaaccuguggaagcugaucgacaaggccuggcagaacuacgacaagauccuggccaucagccuggugggcagcgagcuggccagccuguaccaggagaucgagaugggccugaaguucagagagcugagcaccgacgcccaguggggcaucagacugggcaagcugggcaucagcuuccagcccguguucagacagcacuuccugaccaagaaggaccugaucaaggcccugguggagaacaucgacauggacaccagccugauccuggaguacugcagcaccuuccagcuggacugcgacgccgugcugcagcuguucaucgagacccugcugcacaacaccaacgccggccagggccagggcgacgccagcauggacagcgccaagagaagacaccccaagcugcuggccaaggcccuggagauggugccccugcugaccagcaccaaggaccuggugaucagccugagcggcauccugcacaagcuggaccccuacgacuacgagaugaucgagguggugcugaaggugaucgagagagccgacgagaagaucaccaacaucaacaucaaccaggcccugagcauccugaagcaccugaagagcuacagaagaaucagcccccccguggaccuggaguaccaguacaugcuggagcacgugaucacccugcccagcgccgcccagaccagacugcccuuccaccugaucuucuucggcaccgcccagaacuucuggaagauccugagcaccgagcugagcgaggagagcuuccccacccugcugcugaucagcaagcugaugaaguucagccuggacacccuguacgugagcaccgccaagcacguguucgagaagaagcugaagcccaagcugcugaagcugacccaggccaagagcagcacccugaucaacaaggagaucaccaagaucacccagaccaucgagagcugccugcugagcaucgugaaccccgagugggccguggccaucgccaucagccuggcccaggacauccccgagggcagcuucaagaucagcgcccugaaguucugccuguaccuggccgagagauggcugcagaacauccccagccaggacgagaagagagagaaggccgaggcccugcugaagaagcugcacauccaguacagaagaagcggcaccgaggccgugcugaucgcccacaagcugaacaccgaggaguaccugagagugaucggcaagcccgcccaccugaucgugagccuguacgagcaccccagcaucaaccagagaauccagaacagcagcggcaccgacuaccccgacauccacgccgccgccaaggagaucgccgaggugaacgagaucaaccuggagaaggugugggacaugcugcuggagaaguggcugugccccagcaccaagcccggcgagaagcccagcgagcuguucgagcugcaggaggacgaggcccugagaagagugcaguaccugcugcugagcagacccaucgacuacagcagcagaaugcuguucguguucgccaccagcaccaccaccacccugggcaugcaccagcugaccuucgcccacagaaccagagcccugcagugccuguucuaccuggccgacaaggagaccaucgagagccuguucaagaagcccaucgaggaggugaagagcuaccugagaugcaucaccuuccuggccagcuucgagacccugaacauccccaucaccuacgagcuguucugcagcagccccaaggagggcaugaucaagggccuguggaagaaccacagccacgagagcauggccgugagacuggugaccgagcugugccuggaguacaagaucuacgaccugcagcuguggaacggccugcugcagaagcugcugggcuucaacaugauccccuaccugagaaaggugcugaaggccaucagcagcauccacagccuguggcaggugcccuacuucagcaaggccuggcagagagugauccagaucccccugcugagcgccagcugcccccugagccccgaccagcugagcgacugcagcgagagccugaucgccgugcuggagugccccgugagcggcgaccuggaccugaucggcguggccagacaguacauccagcuggagcugcccgccuucgcccuggccugccugaugcugaugccccacagcgagaagagacaccagcagaucaagaacuuccugggcagcugcgacccccaggugauccugaagcagcuggaggagcacaugaacaccggccagcuggccggcuucagccaccagaucagaagccugauccugaacaacaucaucaacaagaaggaguucggcauccuggccaagaccaaguacuuccagaugcugaagaugcacgccaugaacaccaacaacaucaccgagcuggugaacuaccuggccaacgaccugagccuggacgaggccagcgugcugaucaccgaguacagcaagcacugcggcaagcccgugccccccgacaccgcccccugcgagauccugaagauguuccugagcggccugagcuaa

SEQ ID NO: 19057 - RNA, 1617 nt, Artificial Sequence
  KPNA1__Homo_sapiens__NP_002255
augaccacccccggcaaggagaacuucagacugaagagcuacaagaacaagagccugaaccccgacgagaugagaagaagaagagaggaggagggccugcagcugagaaagcagaagagagaggagcagcuguucaagagaagaaacguggccaccgccgaggaggagaccgaggaggaggugaugagcgacggcggcuuccacgaggcccagaucagcaacauggagauggcccccggcggcgugaucaccagcgacaugaucgagaugaucuucagcaagagccccgagcagcagcugagcgccacccagaaguucagaaagcugcugagcaaggagcccaacccccccaucgacgaggugaucagcacccccggcgugguggccagauucguggaguuccugaagagaaaggagaacugcacccugcaguucgagagcgccugggugcugaccaacaucgccagcggcaacagccugcagaccagaaucgugauccaggccggcgccgugcccaucuucaucgagcugcugagcagcgaguucgaggacgugcaggagcaggccgugugggcccugggcaacaucgccggcgacagcaccaugugcagagacuacgugcuggacugcaacauccugcccccccugcugcagcuguucagcaagcagaacagacugaccaugaccagaaacgccgugugggcccugagcaaccugugcagaggcaagagccccccccccgaguucgccaaggugagccccugccugaacgugcugagcuggcugcuguucgugagcgacaccgacgugcuggccgacgccugcugggcccugagcuaccugagcgacggccccaacgacaagauccaggccgugaucgacgccggcgugugcagaagacugguggagcugcugaugcacaacgacuacaagguggugagccccgcccugagagccgugggcaacaucgugaccggcgacgacauccagacccaggugauccugaacugcagcgcccugcagagccugcugcaccugcugagcagccccaaggagagcaucaagaaggaggccugcuggaccaucagcaacaucaccgccggcaacagagcccagauccagaccgugaucgacgccaacaucuuccccgcccugaucagcauccugcagaccgccgaguucagaaccagaaaggaggccgccugggccaucaccaacgccaccagcggcggcagcgccgagcagaucaaguaccugguggagcugggcugcaucaagccccugugcgaccugcugaccgugauggacagcaagaucgugcagguggcccugaacggccuggagaacauccugagacugggcgagcaggaggccaagagaaacggcaccggcaucaaccccuacugcgcccugaucgaggaggccuacggccuggacaagaucgaguuccugcagagccacgagaaccaggagaucuaccagaaggccuucgaccugaucgagcacuacuucggcaccgaggacgaggacagcagcaucgccccccagguggaccugaaccagcagcaguacaucuuccagcagugcgaggcccccauggagggcuuccagcuguaa

SEQ ID NO: 19058 - RNA, 1590 nt, Artificial Sequence
  KPNA2__Homo_sapiens__NP_001307540
augagcaccaacgagaacgccaacacccccgccgccagacugcacagauucaagaacaagggcaaggacagcaccgagaugagaagaagaagaaucgaggugaacguggagcugagaaaggccaagaaggacgaccagaugcugaagagaagaaacgugagcagcuuccccgacgacgccaccagcccccugcaggagaacagaaacaaccagggcaccgugaacuggagcguggacgacaucgugaagggcaucaacagcagcaacguggagaaccagcugcaggccacccaggccgccagaaagcugcugagcagagagaagcagccccccaucgacaacaucaucagagccggccugauccccaaguucgugagcuuccugggcagaaccgacugcagccccauccaguucgagagcgccugggcccugaccaacaucgccagcggcaccagcgagcagaccaaggccgugguggacggcggcgccauccccgccuucaucagccugcuggccagcccccacgcccacaucagcgagcaggccgugugggcccugggcaacaucgccggcgacggcagcguguucagagaccuggugaucaaguacggcgccguggacccccugcuggcccugcuggccgugcccgacaugagcagccuggccugcggcuaccugagaaaccugaccuggacccugagcaaccugugcagaaacaagaaccccgccccccccaucgacgccguggagcagauccugcccacccuggugagacugcugcaccacgacgaccccgaggugcuggccgacaccugcugggccaucagcuaccugaccgacggccccaacgagagaaucggcaugguggugaagaccggcguggugccccagcuggugaagcugcugggcgccagcgagcugcccaucgugacccccgcccugagagccaucggcaacaucgugaccggcaccgacgagcagacccagguggugaucgacgccggcgcccuggccguguuccccagccugcugaccaaccccaagaccaacauccagaaggaggccaccuggaccaugagcaacaucaccgccggcagacaggaccagauccagcagguggugaaccacggccuggugcccuuccuggugagcgugcugagcaaggccgacuucaagacccagaaggaggccgugugggccgugaccaacuacaccagcggcggcaccguggagcagaucguguaccuggugcacugcggcaucaucgagccccugaugaaccugcugaccgccaaggacaccaagaucauccuggugauccuggacgccaucagcaacaucuuccaggccgccgagaagcugggcgagaccgagaagcugagcaucaugaucgaggagugcggcggccuggacaagaucgaggcccugcagaaccacgagaacgagagcguguacaaggccagccugagccugaucgagaaguacuucagcguggaggaggaggaggaccagaacguggugcccgagaccaccagcgagggcuacaccuuccaggugcaggacggcgcccccggcaccuucaacuucuaa

SEQ ID NO: 19059 - RNA, 1566 nt, Artificial Sequence
  KPNA3__Homo_sapiens__NP_002258
auggccgagaaccccagccuggagaaccacagaaucaagagcuucaagaacaagggcagagacguggagaccaugagaagacacagaaacgaggugaccguggagcugagaaagaacaagagagacgagcaccugcugaagaagagaaacgugccccaggaggagagccuggaggacagcgacguggacgccgacuucaaggcccagaacgugacccuggaggccauccugcagaacgccaccagcgacaaccccguggugcagcugagcgccgugcaggccgccagaaagcugcugagcagcgacagaaacccccccaucgacgaccugaucaagagcggcauccugcccauccuggugaagugccuggagagagacgacaaccccagccugcaguucgaggccgccugggcccugaccaacaucgccagcggcaccagcgcccagacccaggccguggugcagagcaacgccgugccccuguuccugagacugcugagaagcccccaccagaacgugugcgagcaggccgugugggcccugggcaacaucaucggcgacggcccccagugcagagacuacgugaucagccugggcguggugaagccccugcugagcuucaucagccccagcauccccaucaccuuccugagaaacgugaccugggugaucgugaaccugugcagaaacaaggacccccccccccccauggagaccgugcaggagauccugcccgcccugugcgugcugaucuaccacaccgacaucaacauccugguggacaccgugugggcccugagcuaccugaccgacggcggcaacgagcagauccagauggugaucgacagcggcguggugcccuuccuggugccccugcugagccaccaggaggugaaggugcagaccgccgcccugagagccgugggcaacaucgugaccggcaccgacgagcagacccagguggugcugaacugcgacgugcugagccacuuccccaaccugcugagccaccccaaggagaagaucaacaaggaggccgugugguuccugagcaacaucaccgccggcaaccagcagcaggugcaggccgugaucgacgccggccugauccccaugaucauccaccagcuggccaagggcgacuucggcacccagaaggaggccgccugggccaucagcaaccugaccaucagcggcagaaaggaccagguggaguaccuggugcagcagaacgugaucccccccuucugcaaccugcugagcgugaaggacagccagguggugcagguggugcuggacggccugaagaacauccugaucauggccggcgacgaggccagcaccaucgccgagaucaucgaggagugcggcggccuggagaagaucgaggugcugcagcagcacgagaacgaggacaucuacaagcuggccuucgagaucaucgaccaguacuucagcggcgacgacaucgacgaggaccccugccugauccccgaggccacccagggcggcaccuacaacuucgaccccaccgccaaccugcagaccaaggaguucaacuucuaa

SEQ ID NO: 19060 - RNA, 1566 nt, Artificial Sequence
  KPNA4__Homo_sapiens__NP_002259
auggccgacaacgagaagcuggacaaccagagacugaagaacuucaagaacaagggcagagaccuggagaccaugagaagacagagaaacgagguggugguggagcugagaaagaacaagagagacgagcaccugcugaagagaagaaacgugccccacgaggacaucugcgaggacagcgacaucgacggcgacuacagagugcagaacaccagccuggaggccaucgugcagaacgccagcagcgacaaccagggcauccagcugagcgccgugcaggccgccagaaagcugcugagcagcgacagaaacccccccaucgacgaccugaucaagagcggcauccugcccauccuggugcacugccuggagagagacgacaaccccagccugcaguucgaggccgccugggcccugaccaacaucgccagcggcaccagcgagcagacccaggccguggugcagagcaacgccgugccccuguuccugagacugcugcacagcccccaccagaacgugugcgagcaggccgugugggcccugggcaacaucaucggcgacggcccccagugcagagacuacgugaucagccugggcguggugaagccccugcugagcuucaucagccccagcauccccaucaccuuccugagaaacgugaccugggugauggugaaccugugcagacacaaggacccccccccccccauggagaccauccaggagauccugcccgcccugugcgugcugauccaccacaccgacgugaacauccugguggacaccgugugggcccugagcuaccugaccgacgccggcaacgagcagauccagauggugaucgacagcggcaucgugccccaccuggugccccugcugagccaccaggaggugaaggugcagaccgccgcccugagagccgugggcaacaucgugaccggcaccgacgagcagacccagguggugcugaacugcgacgcccugagccacuuccccgcccugcugacccaccccaaggagaagaucaacaaggaggccgugugguuccugagcaacaucaccgccggcaaccagcagcaggugcaggccgugaucgacgccaaccuggugcccaugaucauccaccugcuggacaagggcgacuucggcacccagaaggaggccgccugggccaucagcaaccugaccaucagcggcagaaaggaccagguggccuaccugauccagcagaacgugaucccccccuucugcaaccugcugaccgugaaggacgcccagguggugcagguggugcuggacggccugagcaacauccugaagauggccgaggacgaggccgagaccaucggcaaccugaucgaggagugcggcggccuggagaagaucgagcagcugcagaaccacgagaacgaggacaucuacaagcuggccuacgagaucaucgaccaguucuucagcagcgacgacaucgacgaggaccccagccuggugcccgaggccauccagggcggcaccuucggcuucaacagcagcgccaacgugcccaccgagggcuuccaguucuaa

SEQ ID NO: 19061 - RNA, 1608 nt, Artificial Sequence
  KPNA6__Homo_sapiens__XP_011539462
augaccauggccagccccggcaaggacaacuacagaaugaagagcuacaagaacaacgcccugaaccccgaggagaugagaagaagaagagaggaggagggcauccagcugagaaagcagaagagagagcagcagcuguucaagagaagaaacguggagcugaucaacgaggaggccgccauguucgacagccugcugauggacagcuacgugagcagcaccaccggcgagagcgugaucaccagagagaugguggagaugcuguucagcgacgacagcgaccugcagcuggccaccacccagaaguucagaaagcugcugagcaaggagcccagcccccccaucgacgaggugaucaacacccccagagugguggacagauucguggaguuccugaagagaaacgagaacugcacccugcaguucgaggccgccugggcccugaccaacaucgccagcggcaccagccagcagaccaagaucgugaucgaggccggcgccgugcccaucuucaucgagcugcugaacagcgacuucgaggacgugcaggagcaggccgugugggcccugggcaacaucgccggcgacagcagcgugugcagagacuacgugcugaacugcagcauccugaacccccugcugacccugcugaccaagagcaccagacugaccaugaccagaaacgccgugugggcccugagcaaccugugcagaggcaagaaccccccccccgaguucgccaaggugagccccugccugcccgugcugagcagacugcuguucagcagcgacagcgaccugcuggccgacgccugcugggcccugagcuaccugagcgacggccccaacgagaagauccaggccgugaucgacagcggcgugugcagaagacugguggagcugcugaugcacaacgacuacaagguggccagccccgcccugagagccgugggcaacaucgugaccggcgacgacauccagacccaggugauccugaacugcagcgcccugcccugccugcugcaccugcugagcagccccaaggagagcaucagaaaggaggccugcuggaccaucagcaacaucaccgccggcaacagagcccagauccaggccgugaucgacgccaacaucuuccccgugcugaucgagauccugcagaaggccgaguucagaaccagaaaggaggccgccugggccaucaccaacgccaccagcggcggcacccccgagcagaucagauaccuggugagccugggcugcaucaagccccugugcgaccugcugaccgugauggacagcaagaucgugcagguggcccugaacggccuggagaacauccugagacugggcgagcaggagggcaagagaagcggcagcggcgugaaccccuacugcggccugaucgaggaggccuacggccuggacaagaucgaguuccugcagagccacgagaaccaggagaucuaccagaaggccuucgaccugaucgagcacuacuucggcguggaggacgacgacagcagccuggccccccagguggacgagacccagcagcaguucaucuuccagcagcccgaggcccccauggagggcuuccagcuguaa

SEQ ID NO: 19062 - RNA, 1551 nt, Artificial Sequence
  KPNA7__Homo_sapiens__NP_001139187
augcccacccuggacgcccccgaggagagaagaagaaaguucaaguacagaggcaaggacgugagccugagaagacagcagagaauggccgugagccuggagcugagaaaggccaagaaggacgagcagacccugaagagaagaaacaucaccagcuucugccccgacacccccagcgagaagaccgccaagggcguggccgugagccugacccugggcgagaucaucaagggcgugaacagcagcgaccccgugcugugcuuccaggccacccagaccgccagaaagaugcugagccaggagaagaaccccccccugaagcuggugaucgaggccggccugauccccagaaugguggaguuccugaagagcagccuguaccccugccugcaguucgaggccgccugggcccugaccaacaucgccagcggcaccagcgagcagaccagagccgugguggagggcggcgccauccagccccugaucgagcugcugagcagcagcaacguggccgugugcgagcaggccgugugggcccugggcaacaucgccggcgacggccccgaguucagagacaacgugaucaccagcaacgccaucccccaccugcuggcccugaucagccccacccugcccaucaccuuccugagaaacaucaccuggacccugagcaaccugugcagaaacaagaaccccuaccccugcgacaccgccgugaagcagauccugcccgcccugcugcaccugcugcagcaccaggacagcgaggugcugagcgacgccugcugggcccugagcuaccugaccgacggcagcaacaagagaaucggccagguggugaacaccggcgugcugcccagacugguggugcugaugaccagcagcgagcugaacgugcugacccccagccugagaaccgugggcaacaucgugaccggcaccgacgagcagacccagauggccaucgacgccggcaugcugaacgugcugccccagcugcugcagcacaacaagcccagcauccagaaggaggccgccugggcccugagcaacguggccgccggccccugccaccacauccagcagcugcuggccuacgacgugcugcccccccugguggcccugcugaagaacggcgaguucaaggugcagaaggaggccguguggaugguggccaacuucgccaccggcgccaccauggaccagcugauccagcuggugcacagcggcgugcuggagccccuggugaaccugcugaccgcccccgacgugaagaucgugcugaucauccuggacgugaucagcugcauccugcaggccgccgagaagagaagcgagaaggagaaccugugccugcugaucgaggagcugggcggcaucgacagaaucgaggcccugcagcugcacgagaacagacagaucggccagagcgcccugaacaucaucgagaagcacuucggcgaggaggaggacgagagccagacccugcugagccaggugaucgaccaggacuacgaguucaucgacuacgagugccuggccaagaaguaa

SEQ ID NO: 19063 - RNA, 2196 nt, Artificial Sequence
  KPNB1__Homo_sapiens__NP_001263382
augaaggagagcacccuggaggccaucggcuacaucugccaggacaucgaccccgagcagcugcaggacaagagcaacgagauccugaccgccaucauccagggcaugagaaaggaggagcccagcaacaacgugaagcuggccgccaccaacgcccugcugaacagccuggaguucaccaaggccaacuucgacaaggagagcgagagacacuucaucaugcagguggugugcgaggccacccagugccccgacaccagagugagaguggccgcccugcagaaccuggugaagaucaugagccuguacuaccaguacauggagaccuacaugggccccgcccuguucgccaucaccaucgaggccaugaagagcgacaucgacgagguggcccugcagggcaucgaguucuggagcaacgugugcgacgaggagauggaccuggccaucgaggccagcgaggccgccgagcagggcagaccccccgagcacaccagcaaguucuacgccaagggcgcccugcaguaccuggugcccauccugacccagacccugaccaagcaggacgagaacgacgacgacgacgacuggaaccccugcaaggccgccggcgugugccugaugcugcuggccaccugcugcgaggacgacaucgugccccacgugcugcccuucaucaaggagcacaucaagaaccccgacuggagauacagagacgccgccgugauggccuucggcugcauccuggagggccccgagcccagccagcugaagccccuggugauccaggccaugcccacccugaucgagcugaugaaggaccccagcgugguggugagagacaccgccgccuggaccgugggcagaaucugcgagcugcugcccgaggccgccaucaacgacguguaccuggccccccugcugcagugccugaucgagggccugagcgccgagcccagaguggccagcaacgugugcugggccuucagcagccuggccgaggccgccuacgaggccgccgacguggccgacgaccaggaggagcccgccaccuacugccugagcagcagcuucgagcugaucgugcagaagcugcuggagaccaccgacagacccgacggccaccagaacaaccugagaagcagcgccuacgagagccugauggagaucgugaagaacagcgccaaggacugcuaccccgccgugcagaagaccacccuggugaucauggagagacugcagcaggugcugcagauggagagccacauccagagcaccagcgacagaauccaguucaacgaccugcagagccugcugugcgccacccugcagaacgugcugagaaaggugcagcaccaggacgcccugcagaucagcgacguggugauggccagccugcugagaauguuccagagcaccgccggcagcggcggcgugcaggaggacgcccugauggccgugagcacccugguggaggugcugggcggcgaguuccugaaguacauggaggccuucaagcccuuccugggcaucggccugaagaacuacgccgaguaccaggugugccuggccgccgugggccuggugggcgaccugugcagagcccugcagagcaacaucauccccuucugcgacgaggugaugcagcugcugcuggagaaccugggcaacgagaacgugcacagaagcgugaagccccagauccugagcguguucggcgacaucgcccuggccaucggcggcgaguucaagaaguaccuggagguggugcugaacacccugcagcaggccagccaggcccagguggacaagagcgacuacgacaugguggacuaccugaacgagcugagagagagcugccuggaggccuacaccggcaucgugcagggccugaagggcgaccaggagaacgugcaccccgacgugaugcuggugcagcccagaguggaguucauccugagcuucaucgaccacaucgccggcgacgaggaccacaccgacggcgugguggccugcgccgccggccugaucggcgaccugugcaccgccuucggcaaggacgugcugaagcugguggaggccagacccaugauccacgagcugcugaccgagggcagaagaagcaagaccaacaaggccaagacccuggccaccugggccaccaaggagcugagaaagcugaagaaccaggccuaa

SEQ ID NO: 19064 - RNA, 1740 nt, Artificial Sequence
  KPRP__Homo_sapiens__NP_001020402
augugcgaccagcagcagauccagugcagacugccccugcagcagugcugcgugaagggccccagcuucugcagcagccagagccccuucgcccagagccaggugguggugcaggcccccugcgagaugcagaucguggacugccccgccagcugccccgugcaggugugccaggugagcgaccaggcccccugccagagccagaccacccaggugaagugccagagcaagaccaagcaggugaagggccaggcccagugccagagcaagaccacccaggugaagggccaggccgccagccagagccagaccagcagcgugcagagccaggcccccugccagagcgaggugagcuacgugcagugcgaggccagccagcccgugcagaccugcuucguggagugcgcccccgugugcuacaccgagaccugcuacguggagugccccgugcagaacuacgugcccugccccgccccccagcccgugcagauguacagaggcagacccgccgugugccagccccagggcagauucagcacccagugccaguaccagggcagcuacagcagcugcggcccccaguuccagagcagagccaccugcaacaacuacaccccccaguuccagcugagacccagcuacagcagcugcuucccccaguacagaagcagaaccagcuucagccccugcgugccccagugccagacccagggcagcuacggcagcuucaccgagcagcacagaagcagaagcaccagcagaugccugcccccccccagaagacugcagcuguuccccagaagcugcagcccccccagaagauucgagcccugcagcagcagcuaccugccccugagacccagcgagggcuuccccaacuacugcaccccccccagaagaagcgagcccaucuacaacagcagaugccccagaagacccaucagcagcugcagccagagaagaggccccaagugcagaaucgagaucagcagccccugcugccccagacaggugcccccccagagaugccccguggagaucccccccaucagaagaagaagccagagcugcggcccccagcccagcuggggcgccagcugccccgagcugagaccccacguggagcccagaccccugcccagcuucugcccccccagaagacuggaccagugccccgagagcccccugcagagaugccccccccccgcccccagacccagacugagacccgagcccugcaucagccuggagcccagacccagaccccugcccagacagcugagcgagcccugccuguaccccgagccccugcccgcccugagacccacccccagacccgugccccugcccagacccggccagugcgagauccccgagcccagacccugccugcagcccugcgagcaccccgagcccugccccagacccgagcccaucccccugcccgcccccugccccagccccgagcccugcagagagaccuggagaagccccagccccugcuggggccccaaccccgugcccuaccccggcgaccugggcugccacgagagcagcccccacagacuggacaccgaggcccccuacugcggccccagcagcuacaaccagggccaggagagcggcgccggcugcggccccggcgacguguuccccgagagaagaggccaggacggccacggcgaccagggcaacgccuucgccggcgugaagggcgaggccaagagcgccuacuucuaa

SEQ ID NO: 19065 - RNA, 1143 nt, Artificial Sequence
  KPTN__Homo_sapiens__NP_001278225
augaugggcgaggccgccguggccgccggccccugcccccugagagaggacagcuucaccagauucagcagccagagcaacguguacggccuggccggcggcgccggcggcagaggcgagcugcuggccgccacccugaagggcaaggugcugggcuucagauaccaggaccugagacagaagaucagacccguggccaaggagcugcaguucaacuacauccccgagagcugccugaaccuggagcugcaguucacccccuuccagcugugccacgccgaggugcaggugggcgaccagcuggagaccguguuccugcugagcggcaacgaccccgccauccaccuguacaaggagaacgagggccugcaccaguucgaggagcagcccguggagaaccuguuccccgagcugaccaaccugaccagcagcgugcuguggcuggacgugcacaacuuccccggcaccagcagaagacugagcgcccugggcugccagagcggcuacgugagaguggcccacguggaccagagaagcagagaggugcugcagauguggagcgugcugcaggacggccccaucagcagagugaucguguucagccugagcgccgccaaggagaccaaggacagaccccugcaggacgaguacagcgugcugguggccagcaugcuggagcccgccgugguguacagagaccugcugaacagaggccuggaggaccagcugcugcugcccggcagcgaccaguucgacagcgugcugugcagccuggugaccgacguggaccuggacggcagacccgaggugcugguggccaccuacggccaggagcugcugugcuacaaguacagaggccccgagagcggccugcccgaggcccagcacggcuuccaccugcuguggcagagaagcuucagcagcccccugcuggccauggcccacguggaccugaccggcgacggccugcaggagcuggccguggugagccugaagggcgugcacauccugcagcacagccugauccaggccagcgagcuggugcugaccagacugagacaccagguggagcagagaagaagaagacugcagggccuggaggacggcgccggcgccggccccgccgagaacgccgccagcuaa

SEQ ID NO: 19066 - RNA, 567 nt, Artificial Sequence
  KRAS__Homo_sapiens__NP_004976
augaccgaguacaagcuggugguggugggcgccggcggcgugggcaagagcgcccugaccauccagcugauccagaaccacuucguggacgaguacgaccccaccaucgaggacagcuacagaaagcagguggugaucgacggcgagaccugccugcuggacauccuggacaccgccggccaggaggaguacagcgccaugagagaccaguacaugagaaccggcgagggcuuccugugcguguucgccaucaacaacaccaagagcuucgaggacauccaccacuacagagagcagaucaagagagugaaggacagcgaggacgugcccauggugcuggugggcaacaagugcgaccugcccagcagaaccguggacaccaagcaggcccaggaccuggccagaagcuacggcauccccuucaucgagaccagcgccaagaccagacagggcguggacgacgccuucuacacccuggugagagagaucagaaagcacaaggagaagaugagcaaggacggcaagaagaagaagaagaagagcaagaccaagugcgugaucauguaa

SEQ ID NO: 19067 - RNA, 516 nt, Artificial Sequence
  KRBOX4__Homo_sapiens__NP_001123370
auggccaugagccaggagagccugaccuucaaggacguguucguggacuucacccuggaggaguggcagcagcuggacagcgcccagaagaaccuguacagagacgugaugcuggagaacuacagccaccuggugagcgugggcuaccugguggccaagcccgacgugaucuucagacugggccccggcgaggagagcuggauggccgacggcggcacccccgugagaaccugcgccggcgaggacagacccgagguguggcagguggacgagcagaucgaccacuacaaggagagccaggacaagcugcccuggcaggccgccuucaucggcaaggagacccugaaggacgagagcggccaggagagcagaaccugcagaaagagcaucuaccugagcaccgaguucgacagcgugagacagagacugcccaaguacuacagcugggagaaggccuucaagaccagcuucaagcugagcuggagcaaguggaagcugugcaagaaggagagauaa

SEQ ID NO: 19068 - RNA, 1377 nt, Artificial Sequence
  KREMEN1__Homo_sapiens__NP_001034659
auggccccccccgccgccagacuggcccugcugagcgccgccgcccugacccuggccgccagacccgcccccagccccggccugggccccggccccgagugcuucaccgccaacggcgccgacuacagaggcacccagaacuggaccgcccugcagggcggcaagcccugccuguucuggaacgagaccuuccagcaccccuacaacacccugaaguaccccaacggcgagggcggccugggcgagcacaacuacugcagaaaccccgacggcgacgugagccccuggugcuacguggccgagcacgaggacggcguguacuggaaguacugcgagauccccgccugccagaugcccggcaaccugggcugcuacaaggaccacggcaacccccccccccugaccggcaccagcaagaccagcaacaagcugaccauccagaccugcaucagcuucugcagaagccagagauucaaguucgccggcauggagagcggcuacgccugcuucugcggcaacaaccccgacuacuggaaguacggcgaggccgccagcaccgagugcaacagcgugugcuucggcgaccacacccagcccugcggcggcgacggcagaaucauccuguucgacacccuggugggcgccugcggcggcaacuacagcgccaugagcagcgugguguacagccccgacuuccccgacaccuacgccaccggcagagugugcuacuggaccaucagagugcccggcgccagccacauccacuucagcuucccccuguucgacaucagagacagcgccgacaugguggagcugcuggacggcuacacccacagagugcuggccagauuccacggcagaagcagacccccccugagcuucaacgugagccuggacuucgugauccuguacuucuucagcgacagaaucaaccaggcccagggcuucgccgugcuguaccaggccgugaaggaggagcugccccaggagagacccgccgugaaccagaccguggccgaggugaucaccgagcaggccaaccugagcgugagcgccgccagaagcagcaaggugcuguacgugaucaccaccagccccagccaccccccccagaccgugcccggcuggaccguguacggccuggccacccugcugauccugaccgugaccgccaucguggccaagauccugcugcacgugaccuucaagagccacagagugcccgccagcggcgaccugagagacugccaccagcccggcaccagcggcgagaucuggagcaucuucuacaagcccagcaccagcaucagcaucuucaagaagaagcugaagggccagagccagcaggacgacagaaacccccuggugagcgacuaa

SEQ ID NO: 19069 - RNA, 2067 nt, Artificial Sequence
  KRIT1__Homo_sapiens__NP_001013424
augggcaaccccgagaacaucgaggacgccuacguggccgugaucagacccaagaacaccgccagccugaacagcagagaguacagagccaagagcuacgagauccugcugcacgaggugcccaucgagggccagaagaagaagagaaagaaggugcugcuggagaccaagcugcagggcaacagcgagaucacccagggcauccuggacuacgugguggagaccaccaagcccaucagccccgccaaccagggcaucagaggcaagagaguggugcugaugaagaaguucccccuggacggcgagaagaugggcagagaggccagccuguucaucgugcccagcguggugaaggacaacaccaaguacaccuacacccccggcugccccaucuucuacugccugcaggacaucaugagagugugcagcgagagcagcacccacuucgccacccugaccgccagaaugcugaucgcccuggacaaguggcuggacgagagacacgcccagagccacuucauccccgcccuguucagacccagcccccuggagagaaucaagaccaacgugaucaaccccgccuacgccaccgagagcggccagaccgagaacagccugcacaugggcuacagcgcccuggagaucaagagcaagaugcuggcccuggagaaggccgacaccugcaucuacaacccccuguucggcagcgaccugcaguacaccaacagaguggacaagguggugaucaaccccuacuucggccugggcgcccccgacuacagcaagauccagauccccaagcaggagaaguggcagagaagcaugagcagcgugaccgaggacaaguacggcaagguggaggccaccagaauccugcuggagaagggcaagugcaaccccaaccugcugaacggccagcugagcagcccccugcacuucgccgccggcggcggccacgccgagaucgugcagauccugcugaaccaccccgagaccgacagacacaucaccgaccagcagggcagaagcccccugaacaucugcgaggagaacaagcagaacaacugggaggaggccgccaagcugcugaaggaggccaucaacaagcccuacgagaaggugagaaucuacagaauggacggcagcuacagaagcguggagcugaagcacggcaacaacaccaccgugcagcagaucauggagggcaugagacugagccaggagacccagcaguacuucaccaucuggaucugcagcgagaaccugagccugcagcugaagcccuaccacaagccccugcagcacgugagagacuggcccgagauccuggccgagcugaccaaccuggacccccagagagagaccccccagcuguuccugagaagagacgugagacugccccuggagguggagaagcagaucgaggacccccuggccauccugauccuguucgacgaggccagauacaaccugcugaagggcuucuacaccgcccccgacgccaagcugaucacccuggccagccugcugcugcagaucguguacggcaacuacgagagcaagaagcacaagcagggcuuccugaacgaggagaaccugaagagcaucgugcccgugaccaagcugaagagcaaggccccccacuggaccaacagaauccugcacgaguacaagaaccugagcaccagcgagggcgugagcaaggagaugcaccaccugcagagaauguuccugcagaacugcugggagauccccaccuacggcgccgccuucuucaccggccagaucuucaccaaggccagccccagcaaccacaaggugauccccguguacgugggcgugaacaucaagggccugcaccugcugaacauggagaccaaggcccugcugaucagccugaaguacggcugcuucauguggcagcugggcgacaccgacaccugcuuccagauccacagcauggagaacaagaugagcuucaucgugcacaccaagcaggccggccugguggugaagcugcugaugaagcugaacggccagcugaugcccaccgagagaaacagcuaa

SEQ ID NO: 19070 - RNA, 1755 nt, Artificial Sequence
  KRT10__Homo_sapiens__NP_000412
augagcgugagauacagcagcagcaagcacuacagcagcagcagaagcggcggcggcggcggcggcggcggcugcggcggcggcggcggcgugagcagccugagaaucagcagcagcaagggcagccugggcggcggcuucagcagcggcggcuucagcggcggcagcuucagcagaggcagcagcggcggcggcugcuucggcggcagcagcggcggcuacggcggccugggcggcuucggcggcggcagcuucagaggcagcuacggcagcagcagcuucggcggcagcuacggcggcagcuucggcggcggcagcuucggcggcggcagcuucggcggcggcagcuucggcggcggcggcuucggcggcggcggcuucggcggcggcuucggcggcggcuucggcggcgacggcggccugcugagcggcaacgagaaggugaccaugcagaaccugaacgacagacuggccagcuaccuggacaaggugagagcccuggaggagagcaacuacgagcuggagggcaagaucaaggagugguacgagaagcacggcaacagccaccagggcgagcccagagacuacagcaaguacuacaagaccaucgacgaccugaagaaccagauccugaaccugaccaccgacaacgccaacauccugcugcagaucgacaacgccagacuggccgccgacgacuucagacugaaguacgagaacgagguggcccugagacagagcguggaggccgacaucaacggccugagaagagugcuggacgagcugacccugaccaaggccgaccuggagaugcagaucgagagccugaccgaggagcuggccuaccugaagaagaaccacgaggaggagaugaaggaccugagaaacgugagcaccggcgacgugaacguggagaugaacgccgcccccggcguggaccugacccagcugcugaacaacaugagaagccaguacgagcagcuggccgagcagaacagaaaggacgccgaggccugguucaacgagaagagcaaggagcugaccaccgagaucgacaacaacaucgagcagaucagcagcuacaagagcgagaucaccgagcugagaagaaacgugcaggcccuggagaucgagcugcagagccagcuggcccugaagcagagccuggaggccagccuggccgagaccgagggcagauacugcgugcagcugagccagauccaggcccagaucagcgcccuggaggagcagcugcagcagaucagagccgagaccgagugccagaacaccgaguaccagcagcugcuggacaucaagaucagacuggagaacgagauccagaccuacagaagccugcuggagggcgagggcagcagcggcggcggcggcagaggcggcggcagcuucggcggcggcuacggcggcggcagcagcggcggcggcagcagcggcggcggccacggcggcggccacggcggcagcagcggcggcggcuacggcggcggcagcagcggcggcggcagcagcggcggcggcuacggcggcggcagcagcagcggcggccacggcggcagcagcagcggcggcuacggcggcggcagcagcggcggcggcggcggcggcuacggcggcggcagcagcggcggcggcagcagcagcggcggcggcuacggcggcggcagcagcagcggcggccacaagagcagcagcagcggcagcgugggcgagagcagcagcaagggccccagauacuaa

SEQ ID NO: 19071 - RNA, 1485 nt, Artificial Sequence
  KRT12__Homo_sapiens__NP_000214
auggaccugagcaacaacaccaugagccugagcgugagaacccccggccugagcagaagacugagcagccagagcgugaucggcagacccagaggcaugagcgccagcagcgugggcagcggcuacggcggcagcgccuucggcuucggcgccagcugcggcggcggcuucagcgccgccagcauguucggcagcagcagcggcuucggcggcggcagcggcagcagcauggccggcggccugggcgccggcuacggcagagcccugggcggcggcagcuucggcggccugggcaugggcuucggcggcagccccggcggcggcagccugggcauccugagcggcaacgacggcggccugcugagcggcagcgagaaggagaccaugcagaaccugaacgacagacuggccagcuaccuggacaaggugagagcccuggaggaggccaacaccgagcuggagaacaagaucagagagugguacgagaccagaggcaccggcaccgccgacgccagccagagcgacuacagcaaguacuacccccugaucgaggaccugagaaacaagaucaucagcgccagcaucggcaacgcccagcugcugcugcagaucgacaacgccagacuggccgccgaggacuucagaaugaaguacgagaacgagcuggcccugagacagggcguggaggccgacaucaacggccugagaagagugcuggacgagcugacccugaccagaaccgaccuggagaugcagaucgagagccugaacgaggagcuggccuacaugaagaagaaccacgaggacgagcugcagagcuucagagugggcggccccggcgaggugagcguggagauggacgccgcccccggcguggaccugaccagacugcugaacgacaugagagcccaguacgagaccaucgccgagcagaacagaaaggacgccgaggccugguucaucgagaagagcggcgagcugagaaaggagaucagcaccaacaccgagcagcugcagagcagcaagagcgaggugaccgaccugagaagagccuuccagaaccuggagaucgagcugcagagccagcuggccaugaagaagagccuggaggacagccuggccgaggccgagggcgacuacugcgcccagcugagccaggugcagcagcugaucagcaaccuggaggcccagcugcugcaggugagagccgacgccgagagacagaacguggaccaccagagacugcugaacgugaaggccagacuggagcuggagaucgagaccuacagaagacugcuggacggcgaggcccagggcgacggccuggaggagagccuguucgugaccgacagcaagagccaggcccagagcaccgacagcagcaaggaccccaccaagaccagaaagaucaagaccguggugcaggagauggugaacggcgagguggugagcagccaggugcaggagaucgaggagcugauguaa

SEQ ID NO: 19072 - RNA, 1263 nt, Artificial Sequence
  KRT13__Homo_sapiens__NP_002265
augagccugagacugcagagcagcagcgccagcuacggcggcggcuucggcggcggcagcugccagcugggcggcggcagaggcgugagcaccugcagcaccagauucgugagcggcggcagcgccggcggcuacggcggcggcgugagcugcggcuucggcggcggcgccggcagcggcuucggcggcggcuacggcggcggccugggcggcggcuacggcggcggccugggcggcggcuucggcggcggcuucgccggcggcuucguggacuucggcgccugcgacggcggccugcugaccggcaacgagaagaucaccaugcagaaccugaacgacagacuggccagcuaccuggagaaggugagagcccuggaggaggccaacgccgaccuggaggugaagaucagagacuggcaccugaagcagagccccgccagccccgagagagacuacagccccuacuacaagaccaucgaggagcugagagacaagauccugaccgccaccaucgagaacaacagagugauccuggagaucgacaacgccagacuggccgccgacgacuucagacugaaguacgagaacgagcuggcccugagacagagcguggaggccgacaucaacggccugagaagagugcuggacgagcugacccugagcaagaccgaccuggagaugcagaucgagagccugaacgaggagcuggccuacaugaagaagaaccacgaggaggagaugaaggaguucagcaaccagguggugggccaggugaacguggagauggacgccacccccggcaucgaccugaccagagugcuggccgagaugagagagcaguacgaggccauggccgagagaaacagaagagacgccgaggagugguuccacgccaagagcgccgagcugaacaaggaggugagcaccaacaccgccaugauccagaccagcaagaccgagaucaccgagcugagaagaacccugcagggccuggagaucgagcugcagagccagcugagcaugaaggccggccuggagaacaccguggccgagaccgagugcagauacgcccugcagcugcagcagauccagggccugaucagcagcaucgaggcccagcugagcgagcugagaagcgagauggagugccagaaccaggaguacaagaugcugcuggacaucaagaccagacuggagcaggagaucgccaccuacagaagccugcuggagggccaggacgccaagaagagacagccccccuaa

SEQ ID NO: 19073 - RNA, 1419 nt, Artificial Sequence
  KRT14__Homo_sapiens__NP_000517
augaccaccugcagcagacaguucaccagcagcagcagcaugaagggcagcugcggcaucggcggcggcaucggcggcggcagcagcagaaucagcagcgugcuggccggcggcagcugcagagcccccagcaccuacggcggcggccugagcgugagcagcagcagauucagcagcggcggcgccuacggccugggcggcggcuacggcggcggcuucagcagcagcagcagcagcuucggcagcggcuucggcggcggcuacggcggcggccugggcgccggccugggcggcggcuucggcggcggcuucgccggcggcgacggccugcuggugggcagcgagaaggugaccaugcagaaccugaacgacagacuggccagcuaccuggacaaggugagagcccuggaggaggccaacgccgaccuggaggugaagaucagagacugguaccagagacagagacccgccgagaucaaggacuacagccccuacuucaagaccaucgaggaccugagaaacaagauccugaccgccaccguggacaacgccaacgugcugcugcagaucgacaacgccagacuggccgccgacgacuucagaaccaaguacgagaccgagcugaaccugagaaugagcguggaggccgacaucaacggccugagaagagugcuggacgagcugacccuggccagagccgaccuggagaugcagaucgagagccugaaggaggagcuggccuaccugaagaagaaccacgaggaggagaugaacgcccugagaggccaggugggcggcgacgugaacguggagauggacgccgcccccggcguggaccugagcagaauccugaacgagaugagagaccaguacgagaagauggccgagaagaacagaaaggacgccgaggagugguucuucaccaagaccgaggagcugaacagagagguggccaccaacagcgagcuggugcagagcggcaagagcgagaucagcgagcugagaagaaccaugcagaaccuggagaucgagcugcagagccagcugagcaugaaggccagccuggagaacagccuggaggagaccaagggcagauacugcaugcagcuggcccagauccaggagaugaucggcagcguggaggagcagcuggcccagcugagaugcgagauggagcagcagaaccaggaguacaagauccugcuggacgugaagaccagacuggagcaggagaucgccaccuacagaagacugcuggagggcgaggacgcccaccugagcagcagccaguucagcagcggcagccagagcagcagagacgugaccagcagcagcagacagaucagaaccaaggugauggacgugcacgacggcaagguggugagcacccacgagcaggugcugagaaccaagaacuaa

SEQ ID NO: 19074 - RNA, 1371 nt, Artificial Sequence
  KRT15__Homo_sapiens__NP_002266
augaccaccaccuuccugcagaccagcagcagcaccuucggcggcggcagcaccagaggcggcagccugcuggccggcggcggcggcuucggcggcggcagccugagcggcggcggcggcagcagaagcaucagcgccagcagcgccagauucgugagcagcggcagcggcggcggcuacggcggcggcaugagagugugcggcuucggcggcggcgccggcagcguguucggcggcggcuucggcggcggcgugggcggcggcuucggcggcggcuucggcggcggcgacggcggccugcugagcggcaacgagaagaucaccaugcagaaccugaacgacagacuggccagcuaccuggacaaggugagagcccuggaggaggccaacgccgaccuggaggugaagauccacgacugguaccagaagcagacccccaccagccccgagugcgacuacagccaguacuucaagaccaucgaggagcugagagacaagaucauggccaccaccaucgacaacagcagagugauccuggagaucgacaacgccagacuggccgccgacgacuucagacugaaguacgagaacgagcuggcccugagacagggcguggaggccgacaucaacggccugagaagagugcuggacgagcugacccuggccagaaccgaccuggagaugcagaucgagggccugaacgaggagcuggccuaccugaagaagaaccacgaggaggagaugaaggaguucagcagccagcuggccggccaggugaacguggagauggacgccgcccccggcguggaccugaccagagugcuggccgagaugagagagcaguacgaggccauggccgagaagaacagaagagacguggaggccugguucuucagcaagaccgaggagcugaacaaggagguggccagcaacaccgagaugauccagaccagcaagaccgagaucaccgaccugagaagaaccaugcaggagcuggagaucgagcugcagagccagcugagcaugaaggccggccuggagaacagccuggccgagaccgagugcagauacgccacccagcugcagcagauccagggccugaucggcggccuggaggcccagcugagcgagcugagaugcgagauggaggcccagaaccaggaguacaagaugcugcuggacaucaagaccagacuggagcaggagaucgccaccuacagaagccugcuggagggccaggacgccaagauggccggcaucggcaucagagaggccagcagcggcggcggcggcagcagcagcaacuuccacaucaacguggaggagagcguggacggccagguggugagcagccacaagagagagaucuaa

SEQ ID NO: 19075 - RNA, 1422 nt, Artificial Sequence
  KRT16__Homo_sapiens__NP_005548
augaccaccugcagcagacaguucaccagcagcagcagcaugaagggcagcugcggcaucggcggcggcaucggcggcggcagcagcagaaucagcagcgugcuggccggcggcagcugcagagcccccagcaccuacggcggcggccugagcgugagcagcagauucagcagcggcggcgccugcggccugggcggcggcuacggcggcggcuucagcagcagcagcagcuucggcagcggcuucggcggcggcuacggcggcggccugggcgccggcuucggcggcggccugggcgccggcuucggcggcggcuucgccggcggcgacggccugcuggugggcagcgagaaggugaccaugcagaaccugaacgacagacuggccagcuaccuggacaaggugagagcccuggaggaggccaacgccgaccuggaggugaagaucagagacugguaccagagacagagacccagcgagaucaaggacuacagccccuacuucaagaccaucgaggaccugagaaacaagaucaucgccgccaccaucgagaacgcccagcccauccugcagaucgacaacgccagacuggccgccgacgacuucagaaccaaguacgagcacgagcuggcccugagacagaccguggaggccgacgugaacggccugagaagagugcuggacgagcugacccuggccagaaccgaccuggagaugcagaucgagggccugaaggaggagcuggccuaccugagaaagaaccacgaggaggagaugcuggcccugagaggccagaccggcggcgacgugaacguggagauggacgccgcccccggcguggaccugagcagaauccugaacgagaugagagaccaguacgagcagauggccgagaagaacagaagagacgccgagaccugguuccugagcaagaccgaggagcugaacaaggagguggccagcaacagcgagcuggugcagagcagcagaagcgaggugaccgagcugagaagagugcugcagggccuggagaucgagcugcagagccagcugagcaugaaggccagccuggagaacagccuggaggagaccaagggcagauacugcaugcagcugagccagauccagggccugaucggcagcguggaggagcagcuggcccagcugagaugcgagauggagcagcagagccaggaguaccagauccugcuggacgugaagaccagacuggagcaggagaucgccaccuacagaagacugcuggagggcgaggacgcccaccugagcagccagcaggccagcggccagagcuacagcagcagagagguguucaccagcagcagcagcagcagcagcagacagaccagacccauccugaaggagcagagcagcagcagcuucagccagggccagagcagcuaa

SEQ ID NO: 19076 - RNA, 1299 nt, Artificial Sequence
  KRT17__Homo_sapiens__NP_000413
augaccaccagcaucagacaguucaccagcagcagcagcaucaagggcagcagcggccugggcggcggcagcagcagaaccagcugcagacugagcggcggccugggcgccggcagcugcagacugggcagcgccggcggccugggcagcacccugggcggcagcagcuacagcagcugcuacagcuucggcagcggcggcggcuacggcagcagcuucggcggcguggacggccugcuggccggcggcgagaaggccaccaugcagaaccugaacgacagacuggccagcuaccuggacaaggugagagcccuggaggaggccaacaccgagcuggaggugaagaucagagacugguaccagagacaggcccccggccccgccagagacuacagccaguacuacagaaccaucgaggagcugcagaacaagauccugaccgccaccguggacaacgccaacauccugcugcagaucgacaacgccagacuggccgccgacgacuucagaaccaaguucgagaccgagcaggcccugagacugagcguggaggccgacaucaacggccugagaagagugcuggacgagcugacccuggccagagccgaccuggagaugcagaucgagaaccugaaggaggagcuggccuaccugaagaagaaccacgaggaggagaugaacgcccugagaggccaggugggcggcgagaucaacguggagauggacgccgcccccggcguggaccugagcagaauccugaacgagaugagagaccaguacgagaagauggccgagaagaacagaaaggacgccgaggacugguucuucagcaagaccgaggagcugaacagagagguggccaccaacagcgagcuggugcagagcggcaagagcgagaucagcgagcugagaagaaccaugcaggcccuggagaucgagcugcagagccagcugagcaugaaggccagccuggagggcaaccuggccgagaccgagaacagauacugcgugcagcugagccagauccagggccugaucggcagcguggaggagcagcuggcccagcugagaugcgagauggagcagcagaaccaggaguacaagauccugcuggacgugaagaccagacuggagcaggagaucgccaccuacagaagacugcuggagggcgaggacgcccaccugacccaguacaagaaggagcccgugaccaccagacaggugagaaccaucguggaggaggugcaggacggcaaggugaucagcagcagagagcaggugcaccagaccaccagauaa

SEQ ID NO: 19077 - RNA, 1293 nt, Artificial Sequence
  KRT18__Homo_sapiens__NP_000215
augagcuucaccaccagaagcaccuucagcaccaacuacagaagccugggcagcgugcaggcccccagcuacggcgccagacccgugagcagcgccgccagcguguacgccggcgccggcggcagcggcagcagaaucagcgugagcagaagcaccagcuucagaggcggcaugggcagcggcggccuggccaccggcaucgccggcggccuggccggcaugggcggcauccagaacgagaaggagaccaugcagagccugaacgacagacuggccagcuaccuggacagagugagaagccuggagaccgagaacagaagacuggagagcaagaucagagagcaccuggagaagaagggcccccaggugagagacuggagccacuacuucaagaucaucgaggaccugagagcccagaucuucgccaacaccguggacaacgccagaaucgugcugcagaucgacaacgccagacuggccgccgacgacuucagagugaaguacgagaccgagcuggccaugagacagagcguggagaacgacauccacggccugagaaaggugaucgacgacaccaacaucaccagacugcagcuggagaccgagaucgaggcccugaaggaggagcugcuguucaugaagaagaaccacgaggaggaggugaagggccugcaggcccagaucgccagcagcggccugaccguggagguggacgcccccaagagccaggaccuggccaagaucauggccgacaucagagcccaguacgacgagcuggccagaaagaacagagaggagcuggacaaguacuggagccagcagaucgaggagagcaccaccguggugaccacccagagcgccgaggugggcgccgccgagaccacccugaccgagcugagaagaaccgugcagagccuggagaucgaccuggacagcaugagaaaccugaaggccagccuggagaacagccugagagagguggaggccagauacgcccugcagauggagcagcugaacggcauccugcugcaccuggagagcgagcuggcccagaccagagccgagggccagagacaggcccaggaguacgaggcccugcugaacaucaaggugaagcuggaggccgagaucgccaccuacagaagacugcuggaggacggcgaggacuucaaccugggcgacgcccuggacagcagcaacagcaugcagaccauccagaagaccaccaccagaagaaucguggacggcaagguggugagcgagaccaacgacaccaaggugcugagacacuaa

SEQ ID NO: 19078 - RNA, 1203 nt, Artificial Sequence
  KRT19__Homo_sapiens__NP_002267
augaccagcuacagcuacagacagagcagcgccaccagcagcuucggcggccugggcggcggcagcgugagauucggccccggcguggccuucagagcccccagcauccacggcggcagcggcggcagaggcgugagcgugagcagcgccagauucgugagcagcagcagcagcggcgccuacggcggcggcuacggcggcgugcugaccgccagcgacggccugcuggccggcaacgagaagcugaccaugcagaaccugaacgacagacuggccagcuaccuggacaaggugagagcccuggaggccgccaacggcgagcuggaggugaagaucagagacugguaccagaagcagggccccggccccagcagagacuacagccacuacuacaccaccauccaggaccugagagacaagauccugggcgccaccaucgagaacagcagaaucgugcugcagaucgacaacgccagacuggccgccgacgacuucagaaccaaguucgagaccgagcaggcccugagaaugagcguggaggccgacaucaacggccugagaagagugcuggacgagcugacccuggccagaaccgaccuggagaugcagaucgagggccugaaggaggagcuggccuaccugaagaagaaccacgaggaggagaucagcacccugagaggccaggugggcggccaggugagcguggagguggacagcgcccccggcaccgaccuggccaagauccugagcgacaugagaagccaguacgaggugauggccgagcagaacagaaaggacgccgaggccugguucaccagcagaaccgaggagcugaacagagagguggccggccacaccgagcagcugcagaugagcagaagcgaggugaccgaccugagaagaacccugcagggccuggagaucgagcugcagagccagcugagcaugaaggccgcccuggaggacacccuggccgagaccgaggccagauucggcgcccagcuggcccacauccaggcccugaucagcggcaucgaggcccagcugggcgacgugagagccgacagcgagagacagaaccaggaguaccagagacugauggacaucaagagcagacuggagcaggagaucgccaccuacagaagccugcuggagggccaggaggaccacuacaacaaccugagcgccagcaaggugcuguaa

SEQ ID NO: 19079 - RNA, 1935 nt, Artificial Sequence
  KRT1__Homo_sapiens__NP_006112
augagcagacaguucagcagcagaagcggcuacagaagcggcggcggcuucagcagcggcagcgccggcaucaucaacuaccagagaagaaccaccagcagcagcaccagaagaagcggcggcggcggcggcagauucagcagcugcggcggcggcggcggcagcuucggcgccggcggcggcuucggcagcagaagccuggugaaccugggcggcagcaagagcaucagcaucagcguggccagaggcggcggcagaggcagcggcuucggcggcggcuacggcggcggcggcuucggcggcggcggcuucggcggcggcggcuucggcggcggcggcaucggcggcggcggcuucggcggcuucggcagcggcggcggcggcuucggcggcggcggcuucggcggcggcggcuacggcggcggcuacggccccgugugcccccccggcggcauccaggaggugaccaucaaccagagccugcugcagccccugaacguggagaucgaccccgagauccagaaggugaagagcagagagagagagcagaucaagagccugaacaaccaguucgccagcuucaucgacaaggugagauuccuggagcagcagaaccaggugcugcagaccaagugggagcugcugcagcagguggacaccagcaccagaacccacaaccuggagcccuacuucgagagcuucaucaacaaccugagaagaagaguggaccagcugaagagcgaccagagcagacuggacagcgagcugaagaacaugcaggacaugguggaggacuacagaaacaaguacgaggacgagaucaacaagagaaccaacgccgagaacgaguucgugaccaucaagaaggacguggacggcgccuacaugaccaagguggaccugcaggccaagcuggacaaccugcagcaggagaucgacuuccugaccgcccuguaccaggccgagcugagccagaugcagacccagaucagcgagaccaacgugauccugagcauggacaacaacagaagccuggaccuggacagcaucaucgccgaggugaaggcccaguacgaggacaucgcccagaagagcaaggccgaggccgagagccuguaccagagcaaguacgaggagcugcagaucaccgccggcagacacggcgacagcgugagaaacagcaagaucgagaucagcgagcugaacagagugauccagagacugagaagcgagaucgacaacgugaagaagcagaucagcaaccugcagcagagcaucagcgacgccgagcagagaggcgagaacgcccugaaggacgccaagaacaagcugaacgaccuggaggacgcccugcagcaggccaaggaggaccuggccagacugcugagagacuaccaggagcugaugaacaccaagcuggcccuggaccuggagaucgccaccuacagaacccugcuggagggcgaggagagcagaaugagcggcgagugcgcccccaacgugagcgugagcgugagcaccagccacaccaccaucagcggcggcggcagcagaggcggcggcggcggcggcuacggcagcggcggcagcagcuacggcagcggcggcggcagcuacggcagcggcggcggcggcggcggcggcagaggcagcuacggcagcggcggcagcagcuacggcagcggcggcggcagcuacggcagcggcggcggcggcggcggccacggcagcuacggcagcggcagcagcagcggcggcuacagaggcggcagcggcggcggcggcggcggcagcagcggcggcagaggcagcggcggcggcagcagcggcggcagcaucggcggcagaggcagcagcagcggcggcgugaagagcagcggcggcagcagcagcgugaaguucgugagcaccaccuacagcggcgugaccagauaa

SEQ ID NO: 19080 - RNA, 1275 nt, Artificial Sequence
  KRT20__Homo_sapiens__NP_061883
auggacuucagcagaagaagcuuccacagaagccugagcagcagccugcaggcccccguggugagcaccgugggcaugcagagacugggcaccacccccagcguguacggcggcgccggcggcagaggcaucagaaucagcaacagcagacacaccgugaacuacggcagcgaccugaccggcggcggcgaccuguucgugggcaacgagaagauggccaugcagaaccugaacgacagacuggccagcuaccuggagaaggugagaacccuggagcagagcaacagcaagcuggaggugcagaucaagcagugguacgagaccaacgcccccagagccggcagagacuacagcgccuacuacagacagaucgaggagcugagaagccagaucaaggacgcccagcugcagaacgccagaugcgugcugcagaucgacaacgccaagcuggccgccgaggacuucagacugaaguacgagaccgagagaggcaucagacugaccguggaggccgaccugcagggccugaacaagguguucgacgaccugacccugcacaagaccgaccuggagauccagaucgaggagcugaacaaggaccuggcccugcugaagaaggagcaccaggaggagguggacggccugcacaagcaccugggcaacaccgugaacguggagguggacgccgcccccggccugaaccugggcgugaucaugaacgagaugagacagaaguacgaggugauggcccagaagaaccugcaggaggccaaggagcaguucgagagacagaccgccgugcugcagcagcaggugaccgugaacaccgaggagcugaagggcaccgaggugcagcugaccgagcugagaagaaccagccagagccuggagaucgagcugcagagccaccugagcaugaaggagagccuggagcacacccuggaggagaccaaggccagauacagcagccagcuggccaaccugcagagccugcugagcagccuggaggcccagcugaugcagaucagaagcaacauggagagacagaacaacgaguaccacauccugcuggacaucaagaccagacuggagcaggagaucgccaccuacagaagacugcuggagggcgaggacgugaagaccaccgaguaccagcugagcacccuggaggagagagacaucaagaagaccagaaagaucaagaccguggugcaggaggugguggacggcaagguggugagcagcgaggugaaggagguggaggagaacaucuaa

SEQ ID NO: 19081 - RNA, 1269 nt, Artificial Sequence
  KRT23__Homo_sapiens__NP_056330
augaacagcggccacagcuucagccagacccccagcgccagcuuccacggcgccggcggcggcuggggcagacccagaagcuuccccagagcccccaccgugcacggcggcgccggcggcgccagaaucagccugagcuucaccaccagaagcugccccccccccggcggcagcuggggcagcggcagaagcagcccccugcugggcggcaacggcaaggccaccaugcagaaccugaacgacagacuggccagcuaccuggagaaggugagagcccuggaggaggccaacaugaagcuggagagcagaauccugaaguggcaccagcagagagaccccggcagcaagaaggacuacagccaguacgaggagaacaucacccaccugcaggagcagaucguggacggcaagaugaccaacgcccagaucauccugcugaucgacaacgccagaauggccguggacgacuucaaccugaaguacgagaacgagcacagcuucaagaaggaccuggagaucgagguggagggccugagaagaacccuggacaaccugaccaucgugaccaccgaccuggagcaggagguggagggcaugagaaaggagcugauccugaugaagaagcaccacgagcaggagauggagaagcaccacgugcccagcgacuucaacgugaacgugaagguggacaccggccccagagaggaccugaucaaggugcuggaggacaugagacaggaguacgagcugaucaucaagaagaagcacagagaccuggacaccugguacaaggagcagagcgccgccaugagccaggaggccgccagccccgccaccgugcagagcagacagggcgacauccacgagcugaagagaaccuuccaggcccuggagaucgaccugcagacccaguacagcaccaagagcgcccuggagaacaugcugagcgagacccagagcagauacagcugcaagcugcaggacaugcaggagaucaucagccacuacgaggaggagcugacccagcugagacacgagcuggagagacagaacaacgaguaccaggugcugcugggcaucaagacccaccuggagaaggagaucaccaccuacagaagacugcuggagggcgagagcgagggcaccagagaggagagcaagagcagcaugaaggugagcgccacccccaagaucaaggccaucacccaggagaccaucaacggcagacuggugcugugccaggugaacgagauccagaagcacgccuaa

SEQ ID NO: 19082 - RNA, 1920 nt, Artificial Sequence
  KRT2__Homo_sapiens__NP_000414
augagcugccagaucagcugcaagagcagaggcagaggcggcggcggcggcggcuucagaggcuucagcagcggcagcgccguggugagcggcggcagcagaagaagcaccagcagcuucagcugccugagcagacacggcggcggcggcggcggcuucggcggcggcggcuucggcagcagaagccuggugggccugggcggcaccaagagcaucagcaucagcguggccggcggcggcggcggcuucggcgccgccggcggcuucggcggcagaggcggcggcuucggcggcggcagcagcuucggcggcggcagcggcuucagcggcggcggcuucggcggcggcggcuucggcggcggcagauucggcggcuucggcggccccggcggcgugggcggccugggcggccccggcggcuucggccccggcggcuaccccggcggcauccacgaggugagcgugaaccagagccugcugcagccccugaacgugaagguggaccccgagauccagaacgugaaggcccaggagagagagcagaucaagacccugaacaacaaguucgccagcuucaucgacaaggugagauuccuggagcagcagaaccaggugcugcagaccaagugggagcugcugcagcagaugaacgugggcaccagacccaucaaccuggagcccaucuuccagggcuacaucgacagccugaagagauaccuggacggccugaccgccgagagaaccagccagaacagcgagcugaacaacaugcaggaccugguggaggacuacaagaagaaguacgaggacgagaucaacaagagaaccgccgccgagaacgacuucgugacccugaagaaggacguggacaacgccuacaugaucaagguggagcugcagagcaagguggaccugcugaaccaggagaucgaguuccugaaggugcuguacgacgccgagaucagccagauccaccagagcgugaccgacaccaacgugauccugagcauggacaacagcagaaaccuggaccuggacagcaucaucgccgaggugaaggcccaguacgaggagaucgcccagagaagcaaggaggaggccgaggcccuguaccacagcaaguacgaggagcugcaggugaccgugggcagacacggcgacagccugaaggagaucaagaucgagaucagcgagcugaacagagugauccagagacugcagggcgagaucgcccacgugaagaagcagugcaagaacgugcaggacgccaucgccgacgccgagcagagaggcgagcacgcccugaaggacgccagaaacaagcugaacgaccuggaggaggcccugcagcaggccaaggaggaccuggccagacugcugagagacuaccaggagcugaugaacgugaagcuggcccuggacguggagaucgccaccuacagaaagcugcuggagggcgaggagugcagaaugagcggcgaccugagcagcaacgugaccgugagcgugaccagcagcaccaucagcagcaacguggccagcaaggccgccuucggcggcagcggcggcagaggcagcagcagcggcggcggcuacagcagcggcagcagcagcuacggcagcggcggcagacagagcggcagcagaggcggcagcggcggcggcggcagcaucagcggcggcggcuacggcagcggcggcggcagcggcggcagauacggcagcggcggcggcagcaagggcggcagcaucagcggcggcggcuacggcagcggcggcggcaagcacagcagcggcggcggcagcagaggcggcagcagcagcggcggcggcuacggcagcggcggcggcggcagcagcagcgugaagggcagcagcggcgaggccuucggcagcagcgugaccuucagcuucagauaa

SEQ ID NO: 19083 - RNA, 1251 nt, Artificial Sequence
  KRT31__Homo_sapiens__NP_002268
augcccuacaacuucugccugcccagccugagcugcagaaccagcugcagcagcagacccugcgugccccccagcugccacagcugcacccugcccggcgccugcaacauccccgccaacgugagcaacugcaacugguucugcgagggcagcuucaacggcagcgagaaggagaccaugcaguuccugaacgacagacuggccagcuaccuggagaaggugagacagcuggagagagacaacgccgagcuggagaaccugaucagagagagaagccagcagcaggagccccugcugugccccagcuaccagagcuacuucaagaccaucgaggagcugcagcagaagauccugugcaccaagagcgagaacgccagacugguggugcagaucgacaacgccaagcuggccgccgacgacuucagaaccaaguaccagaccgagcugagccugagacagcugguggagagcgacaucaacggccugagaagaauccuggacgagcugacccugugcaagagcgaccuggaggcccagguggagagccugaaggaggagcugcugugccugaagagcaaccacgagcaggaggugaacacccugagaugccagcugggcgacagacugaacguggagguggacgccgcccccaccguggaccugaacagagugcugaacgagaccagaagccaguacgaggcccugguggagaccaacagaagagagguggagcagugguucaccacccagaccgaggagcugaacaagcagguggugagcagcagcgagcagcugcagagcuaccaggccgagaucaucgagcugagaagaaccgugaacgcccuggagaucgagcugcaggcccagcacaaccugagagacagccuggagaacacccugaccgagagcgaggccagauacagcagccagcugagccaggugcagagccugaucaccaacguggagagccagcuggccgagaucagaagcgaccuggagagacagaaccaggaguaccaggugcugcuggacgugagagccagacuggagugcgagaucaacaccuacagaagccugcuggagagcgaggacugcaaccugcccagcaaccccugcgccaccaccaacgccugcagcaagcccaucggccccugccugagcaaccccugcaccagcugcgugccccccgcccccugcacccccugcgcccccagacccagaugcggccccugcaacagcuucgugagauaa

SEQ ID NO: 19084 - RNA, 1347 nt, Artificial Sequence
  KRT32__Homo_sapiens__NP_002269
augaccagcagcugcugcgugaccaacaaccugcaggccagccugaagagcugccccagacccgccagcgugugcagcagcggcgugaacugcagacccgagcugugccugggcuacgugugccagcccauggccugccugcccagcgugugccugcccaccaccuucagacccgccagcugccugagcaagaccuaccugagcagcagcugccaggccgccagcggcaucagcggcagcaugggccccggcagcugguacagcgagggcgccuucaacggcaacgagaaggagaccaugcaguuccugaacgacagacuggccagcuaccugaccagagugagacagcuggagcaggagaacgccgagcuggagagcagaauccaggaggccagccacagccaggugcugaccaugacccccgacuaccagagccacuucagaaccaucgaggagcugcagcagaagauccugugcaccaaggccgagaacgccagaaugguggugaacaucgacaacgccaagcuggccgccgacgacuucagagccaaguacgaggccgagcuggccaugagacagcugguggaggccgacaucaacggccugagaagaauccuggacgaccugacccugugcaaggccgaccuggaggcccagguggagagccugaaggaggagcugaugugccugaagaagaaccacgaggaggaggugggcagccugagaugccagcugggcgacagacugaacaucgagguggacgccgccccccccguggaccugaccagagugcuggaggagaugagaugccaguacgaggccaugguggaggccaacagaagagacguggaggagugguucaacaugcagauggaggagcugaaccagcagguggccaccagcagcgagcagcugcagaacuaccagagcgacaucaucgaccugagaagaaccgugaacacccuggagaucgagcugcaggcccagcacagccugagagacagccuggagaacacccugaccgagagcgaggccagauacagcagccagcuggcccagaugcagugcaugaucaccaacguggaggcccagcuggccgagaucagagccgaccuggagagacagaaccaggaguaccaggugcugcuggacgugagagccagacuggagggcgagaucaacaccuacagaagccugcuggagaacgaggacugcaagcugcccugcaaccccugcagcacccccagcugcaccaccugcgugcccagccccugcgugcccagaaccgugugcgugcccagaaccgugggcaugcccugcagccccugcccccagggcagauacuaa

SEQ ID NO: 19085 - RNA, 1311 nt, Artificial Sequence
  KRT34__Homo_sapiens__NP_066293
augcuguacgccaagcccccccccaccaucaacggcaucaagggccugcagagaaaggagagacugaagcccgcccacauccaccugcagcagcugaccugcuucagcaucaccugcagcagcaccaugagcuacagcugcugccugcccagccugggcugcagaaccagcugcagcagcagacccugcgugccccccagcugccacggcuacacccugcccggcgccugcaacauccccgccaacgugagcaacugcaacugguucugcgagggcagcuucaacggcagcgagaaggagaccaugcaguuccugaacgacagacuggccagcuaccuggagaaggugagacagcuggagagagacaacgccgagcuggagaagcugauccaggagagaagccagcagcaggagccccugcugugccccagcuaccagagcuacuucaagaccaucgaggagcugcagcagaagauccugugcgccaaggccgagaacgccagacugguggugaacaucgacaacgccaagcuggccagcgacgacuucagaagcaaguaccagaccgagcagagccugagacugcugguggagagcgacaucaacagcaucagaagaauccuggacgagcugacccugugcaagagcgaccuggagagccagguggagagccugagagaggagcugaucugccugaagaagaaccacgaggaggaggugaacacccugagaagccagcugggcgacagacugaacguggagguggacaccgcccccaccguggaccugaaccaggugcugaacgagaccagaagccaguacgaggcccugguggagaucaacagaagagagguggagcagugguucgccacccagaccgaggagcugaacaagcagguggugagcagcagcgagcagcugcagagcugccaggccgagaucaucgagcugagaagaaccgugaacgcccuggagaucgagcugcaggcccagcacaaccugagagacagccuggagaacacccugaccgagagcgaggcccacuacagcagccagcugagccaggugcagagccugaucaccaacguggagagccagcuggccgagaucagaugcgaccuggagagacagaaccaggaguaccaggugcugcuggacgugagagccagacuggagugcgagaucaacaccuacagaagccugcuggagagcgaggacugcaagcugcccugcaaccccugcgccaccaccaacgccagcggcaacagcugcggccccugcggcaccagccagaagggcugcugcaacuaa

SEQ ID NO: 19086 - RNA, 1368 nt, Artificial Sequence
  KRT35__Homo_sapiens__NP_002271
auggccagcaagugccugaaggccggcuucagcagcggcagccugaagagccccggcggcgccagcggcggcagcaccagagugagcgccauguacagcagcagcagcugcaagcugcccagccugagccccguggccagaagcuucagcgccugcagcgugggccugggcagaagcagcuacagagccaccagcugccugcccgcccugugccugcccgccggcggcuucgccaccagcuacagcggcggcggcggcugguucggcgagggcauccugaccggcaacgagaaggagaccaugcagagccugaacgacagacuggccggcuaccuggagaaggugagacagcuggagcaggagaacgccagccuggagagcagaaucagagaguggugcgagcagcaggugcccuacaugugccccgacuaccagagcuacuucagaaccaucgaggagcugcagaagaagacccugugcagcaaggccgagaacgccagacuggugguggagaucgacaacgccaagcuggccgccgacgacuucagaaccaaguacgagaccgaggugagccugagacagcugguggagagcgacaucaacggccugagaagaauccuggacgaccugacccugugcaagagcgaccuggaggcccagguggagagccugaaggaggagcugcugugccugaagaagaaccacgaggaggaggugaacagccugagaugccagcugggcgacagacugaacguggagguggacgccgccccccccguggaccugaacagagugcuggaggagaugagaugccaguacgagacccugguggagaacaacagaagagacgccgaggacuggcuggacacccagagcgaggagcugaaccagcagguggugagcagcagcgagcagcugcagagcugccaggccgagaucaucgagcugagaagaaccgugaacgcccuggagaucgagcugcaggcccagcacagcaugagagacgcccuggagagcacccuggccgagaccgaggccagauacagcagccagcuggcccagaugcagugcaugaucaccaacguggaggcccagcuggccgagaucagagccgaccuggagagacagaaccaggaguaccaggugcugcuggacgugagagccagacuggagugcgagaucaacaccuacagaggccugcuggagagcgaggacagcaagcugcccugcaaccccugcgcccccgacuacagccccagcaagagcugccugcccugccugcccgccgccagcugcggccccagcgccgccagaaccaacugcagccccagacccaucugcgugcccugccccggcggcagauucuaa

SEQ ID NO: 19087 - RNA, 1887 nt, Artificial Sequence
  KRT3__Homo_sapiens__NP_476429
augagcagacaggccagcaagaccagcggcggcggcagccagggcuucagcggcagaagcgccguggugagcggcagcagcagaaugagcugcguggcccacagcggcggcgccggcggcggcgccuacggcuucagaagcggcgccggcggcuucggcagcagaagccuguacaaccugggcggcaacaagagcaucagcaucagcguggccgccggcggcagcagagccggcggcuucggcggcggcagaagcagcugcgccuucgccggcggcuacggcggcggcuucggcagcggcuacggcggcggcuucggcggcggcuucggcggcggcagaggcaugggcggcggcuucggcggcgccggcggcuucggcggcgccggcggcuucggcggcgccggcggcuucggcggccccggcggcuucggcggcagcggcggcuucggcggccccggcagccugggcagccccggcggcuucggccccggcggcuuccccggcggcauccaggaggugaccaucaaccagagccugcugcagccccugaacguggagaucgacccccagaucggccaggugaaggcccaggagagagagcagaucaagacccugaacaacaaguucgccagcuucaucgacaaggugagauuccuggagcagcagaacaaggugcuggagaccaaguggaaccugcugcagcagcagggcaccagcagcaucagcggcaccaacaaccuggagccccuguucgagaaccacaucaacuaccugagaagcuaccuggacaacauccugggcgagagaggcagacuggacagcgagcugaagaacauggaggaccugguggaggacuucaagaagaaguacgaggacgagaucaacaagagaaccgccgccgagaacgaguucgugacccugaagaaggacguggacagcgccuacaugaacaagguggagcugcaggccaagguggacgcccugaucgacgagaucgacuuccugagaacccuguacgacgccgagcugagccagaugcagagccacaucagcgacaccagcguggugcugagcauggacaacaacagaagccuggaccuggacagcaucaucgccgaggugagagcccaguacgaggacaucgcccagagaagcaaggccgaggccgaggcccuguaccagaccaagcugggcgagcugcagaccaccgccggcagacacggcgacgaccugagaaacaccaagagcgagaucaucgagcugaacagaaugauccagagacugagagccgagaucgagggcgugaagaagcagaacgccaaccugcagaccgccaucgccgaggccgagcagcacggcgagauggcccugaaggacgccaacgccaagcugcaggagcugcaggccgcccugcagcaggccaaggacgaccuggccagacugcugagagacuaccaggagcugaugaacgugaagcuggcccuggacguggagaucgccaccuacagaaagcugcuggagggcgaggaguacagaaugagcggcgagugccccagcgccgugagcaucagcguggugagcagcagcaccaccagcgccagcgccggcggcuacggcggcggcuacggcggcggcaugggcggcggccugggcggcggcuucagcgccggcggcggcagcggcagcggcuucggcagaggcggcggcggcggcaucggcggcggcuucggcggcggcagcagcggcuucagcggcggcagcggcuucggcagcaucagcggcgccagauacggcgugagcggcggcggcuucagcagcgccagcaacagaggcggcagcaucaaguucagccagagcagccagagcagccagagauacagcagauaa

SEQ ID NO: 19088 - RNA, 1563 nt, Artificial Sequence
  KRT4__Homo_sapiens__NP_002263
augaucgccagacagcagugcgugagaggcggccccagaggcuucagcugcggcagcgccaucgugggcggcggcaagagaggcgccuucagcagcgugagcaugagcggcggcgccggcagaugcagcagcggcggcuucggcagcagaagccuguacaaccugagaggcaacaagagcaucagcaugagcguggccggcagcagacagggcgccugcuucggcggcgccggcggcuucggcaccggcggcuucggcggcggcuucggcggcagcuucagcggcaagggcggccccggcuuccccgugugccccgccggcggcauccaggaggugaccaucaaccagagccugcugaccccccugcacguggagaucgaccccgagauccagaaggugagaaccgaggagagagagcagaucaagcugcugaacaacaaguucgccagcuucaucgacaaggugcaguuccuggagcagcagaacaaggugcuggagaccaaguggaaccugcugcagcagcagaccaccaccaccagcagcaagaaccuggagccccuguucgagaccuaccugagcgugcugagaaagcagcuggacacccugggcaacgacaagggcagacugcagagcgagcugaagaccaugcaggacagcguggaggacuucaagaccaaguacgaggaggagaucaacaagagaaccgccgccgagaacgacuucguggugcugaagaaggacguggacgccgccuaccugaacaagguggagcuggaggccaagguggacagccugaacgacgagaucaacuuccugaaggugcuguacgacgccgagcugagccagaugcagacccacgugagcgacaccagcguggugcugagcauggacaacaacagaaaccuggaccuggacagcaucaucgccgaggugagagcccaguacgaggagaucgcccagagaagcaaggccgaggccgaggcccuguaccagaccaaggugcagcagcugcagaucagcguggaccagcacggcgacaaccugaagaacaccaagagcgagaucgccgagcugaacagaaugauccagagacugagagccgagaucgagaacaucaagaagcagugccagacccugcaggugagcguggccgacgccgagcagagaggcgagaacgcccugaaggacgcccacagcaagagaguggagcuggaggccgcccugcagcaggccaaggaggagcuggccagaaugcugagagaguaccaggagcugaugagcgugaagcuggcccuggacaucgagaucgccaccuacagaaagcugcuggagggcgaggaguacagaaugagcggcgagugccagagcgccgugagcaucagcguggugagcggcagcaccagcaccggcggcaucagcggcggccugggcagcggcagcggcuucggccugagcagcggcuucggcagcggcagcggcagcggcuucggcuucggcggcagcgugagcggcagcagcagcagcaagaucaucagcaccaccacccugaacaagagaagauaa

SEQ ID NO: 19089 - RNA, 1773 nt, Artificial Sequence
  KRT5__Homo_sapiens__NP_000415
augagcagacagagcagcgugagcuucagaagcggcggcagcagaagcuucagcaccgccagcgccaucacccccagcgugagcagaaccagcuucaccagcgugagcagaagcggcggcggcggcggcggcggcuucggcagagugagccuggccggcgccugcggcgugggcggcuacggcagcagaagccuguacaaccugggcggcagcaagagaaucagcaucagcaccagcggcggcagcuucagaaacagauucggcgccggcgccggcggcggcuacggcuucggcggcggcgccggcagcggcuucggcuucggcggcggcgccggcggcggcuucggccugggcggcggcgccggcuucggcggcggcuucggcggccccggcuuccccgugugcccccccggcggcauccaggaggugaccgugaaccagagccugcugaccccccugaaccugcagaucgaccccagcauccagagagugagaaccgaggagagagagcagaucaagacccugaacaacaaguucgccagcuucaucgacaaggugagauuccuggagcagcagaacaaggugcuggacaccaaguggacccugcugcaggagcagggcaccaagaccgugagacagaaccuggagccccuguucgagcaguacaucaacaaccugagaagacagcuggacagcaucgugggcgagagaggcagacuggacagcgagcugagaaacaugcaggaccugguggaggacuucaagaacaaguacgaggacgagaucaacaagagaaccaccgccgagaacgaguucgugaugcugaagaaggacguggacgccgccuacaugaacaagguggagcuggaggccaagguggacgcccugauggacgagaucaacuucaugaagauguucuucgacgccgagcugagccagaugcagacccacgugagcgacaccagcguggugcugagcauggacaacaacagaaaccuggaccuggacagcaucaucgccgaggugaaggcccaguacgaggagaucgccaacagaagcagaaccgaggccgagagcugguaccagaccaaguacgaggagcugcagcagaccgccggcagacacggcgacgaccugagaaacaccaagcacgagaucagcgagaugaacagaaugauccagagacugagagccgagaucgacaacgugaagaagcagugcgccaaccugcagaacgccaucgccgacgccgagcagagaggcgagcuggcccugaaggacgccagaaacaagcuggccgagcuggaggaggcccugcagaaggccaagcaggacauggccagacugcugagagaguaccaggagcugaugaacaccaagcuggcccuggacguggagaucgccaccuacagaaagcugcuggagggcgaggagugcagacugagcggcgagggcgugggccccgugaacaucagcguggugaccagcagcgugagcagcggcuacggcagcggcagcggcuacggcggcggccugggcggcggccugggcggcggccugggcggcggccuggccggcggcagcagcggcagcuacuacagcagcagcagcggcggcgugggccugggcggcggccugagcgugggcggcagcggcuucagcgccagcagcggcagaggccugggcgugggcuucggcagcggcggcggcagcagcagcagcgugaaguucgugagcaccaccagcagcagcagaaagagcuucaagagcuaa

SEQ ID NO: 19090 - RNA, 1695 nt, Artificial Sequence
  KRT6A__Homo_sapiens__NP_005545
auggccagcaccagcaccaccaucagaagccacagcagcagcagaagaggcuucagcgccaacagcgccagacugcccggcgugagcagaagcggcuucagcagcgugagcgugagcagaagcagaggcagcggcggccugggcggcgccugcggcggcgccggcuucggcagcagaagccuguacggccugggcggcagcaagagaaucagcaucggcggcggcagcugcgccaucagcggcggcuacggcagcagagccggcggcagcuacggcuucggcggcgccggcagcggcuucggcuucggcggcggcgccggcaucggcuucggccugggcggcggcgccggccuggccggcggcuucggcggccccggcuuccccgugugcccccccggcggcauccaggaggugaccgugaaccagagccugcugaccccccugaaccugcagaucgaccccaccauccagagagugagagccgaggagagagagcagaucaagacccugaacaacaaguucgccagcuucaucgacaaggugagauuccuggagcagcagaacaaggugcuggagaccaaguggacccugcugcaggagcagggcaccaagaccgugagacagaaccuggagccccuguucgagcaguacaucaacaaccugagaagacagcuggacagcaucgugggcgagagaggcagacuggacagcgagcugagaggcaugcaggaccugguggaggacuucaagaacaaguacgaggacgagaucaacaagagaaccgccgccgagaacgaguucgugacccugaagaaggacguggacgccgccuacaugaacaagguggagcugcaggccaaggccgacacccugaccgacgagaucaacuuccugagagcccuguacgacgccgagcugagccagaugcagacccacaucagcgacaccagcguggugcugagcauggacaacaacagaaaccuggaccuggacagcaucaucgccgaggugaaggcccaguacgaggagaucgcccagagaagcagagccgaggccgagagcugguaccagaccaaguacgaggagcugcaggugaccgccggcagacacggcgacgaccugagaaacaccaagcaggagaucgccgagaucaacagaaugauccagagacugagaagcgagaucgaccacgugaagaagcagugcgccaaccugcaggccgccaucgccgacgccgagcagagaggcgagauggcccugaaggacgccaagaacaagcuggagggccuggaggacgcccugcagaaggccaagcaggaccuggccagacugcugaaggaguaccaggagcugaugaacgugaagcuggcccuggacguggagaucgccaccuacagaaagcugcuggagggcgaggagugcagacugaacggcgagggcgugggccaggugaacaucagcguggugcagagcaccgugagcagcggcuacggcggcgccagcggcgugggcagcggccugggccugggcggcggcagcagcuacagcuacggcagcggccugggcgugggcggcggcuucagcagcagcagcggcagagccaucggcggcggccugagcagcgugggcggcggcagcagcaccaucaaguacaccaccaccagcagcagcagcagaaagagcuacaagcacuaa

SEQ ID NO: 19091 - RNA, 1695 nt, Artificial Sequence
  KRT6B__Homo_sapiens__NP_005546
auggccagcaccagcaccaccaucagaagccacagcagcagcagaagaggcuucagcgccaacagcgccagacugcccggcgugagcagaagcggcuucagcagcaucagcgugagcagaagcagaggcagcggcggccugggcggcgccugcggcggcgccggcuucggcagcagaagccuguacggccugggcggcagcaagagaaucagcaucggcggcggcagcugcgccaucagcggcggcuacggcagcagagccggcggcagcuacggcuucggcggcgccggcagcggcuucggcuucggcggcggcgccggcaucggcuucggccugggcggcggcgccggccuggccggcggcuucggcggccccggcuuccccgugugcccccccggcggcauccaggaggugaccgugaaccagagccugcugaccccccugaaccugcagaucgaccccgccauccagagagugagagccgaggagagagagcagaucaagacccugaacaacaaguucgccagcuucaucgacaaggugagauuccuggagcagcagaacaaggugcuggacaccaaguggacccugcugcaggagcagggcaccaagaccgugagacagaaccuggagccccuguucgagcaguacaucaacaaccugagaagacagcuggacaacaucgugggcgagagaggcagacuggacagcgagcugagaaacaugcaggaccugguggaggaccugaagaacaaguacgaggacgagaucaacaagagaaccgccgccgagaacgaguucgugacccugaagaaggacguggacgccgccuacaugaacaagguggagcugcaggccaaggccgacacccugaccgacgagaucaacuuccugagagcccuguacgacgccgagcugagccagaugcagacccacaucagcgacaccagcguggugcugagcauggacaacaacagaaaccuggaccuggacagcaucaucgccgaggugaaggcccaguacgaggagaucgcccagagaagcagagccgaggccgagagcugguaccagaccaaguacgaggagcugcagaucaccgccggcagacacggcgacgaccugagaaacaccaagcaggagaucgccgagaucaacagaaugauccagagacugagaagcgagaucgaccacgugaagaagcagugcgccaaccugcaggccgccaucgccgacgccgagcagagaggcgagauggcccugaaggacgccaagaacaagcuggagggccuggaggacgcccugcagaaggccaagcaggaccuggccagacugcugaaggaguaccaggagcugaugaacgugaagcuggcccuggacguggagaucgccaccuacagaaagcugcuggagggcgaggagugcagacugaacggcgagggcgugggccaggugaacaucagcguggugcagagcaccgugagcagcggcuacggcggcgccagcggcgugggcagcggccugggccugggcggcggcagcagcuacagcuacggcagcggccugggcgugggcggcggcuucagcagcagcagcggcagagccaccggcggcggccugagcagcgugggcggcggcagcagcaccaucaaguacaccaccaccagcagcagcagcagaaagagcuacaagcacuaa

SEQ ID NO: 19092 - RNA, 1695 nt, Artificial Sequence
  KRT6C__Homo_sapiens__NP_775109
auggccagcaccagcaccaccaucagaagccacagcagcagcagaagaggcuucagcgccaacagcgccagacugcccggcgugagcagaagcggcuucagcagcaucagcgugagcagaagcagaggcagcggcggccugggcggcgccugcggcggcgccggcuucggcagcagaagccuguacggccugggcggcagcaagagaaucagcaucggcggcggcagcugcgccaucagcggcggcuacggcagcagagccggcggcagcuacggcuucggcggcgccggcagcggcuucggcuucggcggcggcgccggcaucggcuucggccugggcggcggcgccggccuggccggcggcuucggcggccccggcuuccccgugugcccccccggcggcauccaggaggugaccgugaaccagagccugcugaccccccugaaccugcagaucgaccccgccauccagagagugagagccgaggagagagagcagaucaagacccugaacaacaaguucgccagcuucaucgacaaggugagauuccuggagcagcagaacaaggugcuggacaccaaguggacccugcugcaggagcagggcaccaagaccgugagacagaaccuggagccccuguucgagcaguacaucaacaaccugagaagacagcuggacagcaucgugggcgagagaggcagacuggacagcgagcugagaaacaugcaggaccugguggaggaccugaagaacaaguacgaggacgagaucaacaagagaaccgccgccgagaacgaguucgugacccugaagaaggacguggacgccgccuacaugaacaagguggagcugcaggccaaggccgacacccugaccgacgagaucaacuuccugagagcccuguacgacgccgagcugagccagaugcagacccacaucagcgacaccagcguggugcugagcauggacaacaacagaaaccuggaccuggacagcaucaucgccgaggugaaggcccaguacgaggagaucgcccagagaagcagagccgaggccgagagcugguaccagaccaaguacgaggagcugcaggugaccgccggcagacacggcgacgaccugagaaacaccaagcaggagaucgccgagaucaacagaaugauccagagacugagaagcgagaucgaccacgugaagaagcagugcgccagccugcaggccgccaucgccgacgccgagcagagaggcgagauggcccugaaggacgccaagaacaagcuggagggccuggaggacgcccugcagaaggccaagcaggaccuggccagacugcugaaggaguaccaggagcugaugaacgugaagcuggcccuggacguggagaucgccaccuacagaaagcugcuggagggcgaggagugcagacugaacggcgagggcgugggccaggugaacgugagcguggugcagagcaccaucagcagcggcuacggcggcgccagcggcgugggcagcggccugggccugggcggcggcagcagcuacagcuacggcagcggccugggcaucggcggcggcuucagcagcagcagcggcagagccaucggcggcggccugagcagcgugggcggcggcagcagcaccaucaaguacaccaccaccagcagcagcagcagaaagagcuacaagcacuaa

SEQ ID NO: 19093 - RNA, 1572 nt, Artificial Sequence
  KRT71__Homo_sapiens__NP_258259
augagcagacaguucaccugcaagagcggcgccgccgccaagggcggcuucagcggcugcagcgccgugcugagcggcggcagcagcagcagcuucagagccggcagcaagggccugagcggcggcuucggcagcagaagccuguacagccugggcggcgugagaagccugaacguggccagcggcagcggcaagagcggcggcuacggcuucggcagaggcagagccagcggcuucgccggcagcauguucggcagcguggcccugggccccgugugccccaccgugugcccccccggcggcauccaccaggugaccgugaacgagagccugcuggccccccugaacguggagcuggaccccgagauccagaaggugagagcccaggagagagagcagaucaaggcccugaacaacaaguucgccagcuucaucgacaaggugagauuccuggagcagcagaaccaggugcuggagaccaagugggagcugcugcagcagcuggaccugaacaacugcaagaacaaccuggagcccauccuggagggcuacaucagcaaccugagaaagcagcuggagacccugagcggcgacagagugagacuggacagcgagcugagaaacgugagagacgugguggaggacuacaagaagagauacgaggaggagaucaacaagagaaccgccgccgagaacgaguucgugcugcugaagaaggacguggacgccgccuacgccaacaagguggagcugcaggccaagguggagagcauggaccaggagaucaaguucuucagaugccuguucgaggccgagaucacccagauccagagccacaucagcgacaugagcgugauccugagcauggacaacaacagaaaccuggaccuggacagcaucaucgacgaggugagaacccaguacgaggagaucgcccugaagagcaaggccgaggccgaggcccuguaccagaccaaguuccaggagcugcagcuggccgccggcagacacggcgacgaccugaagaacaccaagaacgagaucagcgagcugaccagacugauccagagaaucagaagcgagaucgagaacgugaagaagcaggccagcaaccuggagaccgccaucgccgacgccgagcagagaggcgacaacgcccugaaggacgccagagccaagcuggacgagcuggagggcgcccugcaccaggccaaggaggagcuggccagaaugcugagagaguaccaggagcugaugagccugaagcuggcccuggacauggagaucgccaccuacagaaagcugcuggagagcgaggagugcagaaugagcggcgaguuccccagccccgugagcaucagcaucaucagcagcaccagcggcggcagcguguacggcuucagacccagcauggugagcggcggcuacguggccaacagcagcaacugcaucagcggcgugugcagcgugagaggcggcgagggcagaagcagaggcagcgccaacgacuacaaggacacccugggcaagggcagcagccugagcgcccccagcaagaagaccagcagauaa

SEQ ID NO: 19094 - RNA, 1410 nt, Artificial Sequence
  KRT72__Homo_sapiens__NP_001139698
augagcagacagcugacccacuuccccagaggcgagagacugggcuucagcggcugcagcgccgugcugagcggcggcaucggcagcagcagcgccagcuucagagccagagugaagggcagcgccagcuucggcagcaagagccugagcugccugggcggcagcagaagccuggcccugagcgccgccgccagaagaggcggcggcagacugggcggcuucgugggcaccgccuucggcagcgccggccugggccccaagugccccagcgugugcccccccggcggcaucccccaggugaccgugaacaagagccugcuggccccccugaacguggagauggaccccgagauccagagagugagagcccaggagagagagcagaucaaggcccugaacaacaaguucgccagcuucaucgacaaggugagauuccuggagcagcagaaccaggugcuggagaccaaguggaaccugcugcagcagcuggaccugaacaacugcagaaagaaccuggagcccaucuacgagggcuacaucagcaaccugcagaagcagcuggagaugcugagcggcgacggcgugagacuggacagcgagcugagaaacaugcaggaccugguggaggacuacaagaagagauacgagguggagaucaacagaagaaccgccgccgagaacgaguucguggugcugaagaaggacguggacgccgccuacaugaacaagguggagcugcaggccaagguggacagccugaccgacgagaucaaguucuucaagugccuguacgagggcgagaucacccagauccagagccacaucagcgacaccagcaucgugcugagcauggacaacaacagagaccuggaccuggacagcaucaucgccgaggugagagcccaguacgaggagaucgcccugaagagcaaggccgaggccgagacccuguaccagaccaagugcgccgaccuggagaccgccaucgccgacgccgagcagagaggcgacugcgcccugaaggacgccagagccaagcuggacgagcuggagggcgcccugcaccaggccaaggaggagcuggccagaaugcugagagaguaccaggagcuggugagccugaagcuggcccuggacauggagaucgccaccuacagaaagcugcuggagagcgaggagugcagaaugagcggcgaguaccccaacagcgugagcaucagcgugaucagcagcaccaacgccggcgccggcggcgccggcuucagcaugggcuucggcgccagcagcagcuacagcuacaagaccgccgccgccgacgugaagaccaagggcagcugcggcagcgagcugaaggacccccuggccaagaccagcggcagcagcugcgccaccaagaaggccagcagauaa

SEQ ID NO: 19095 - RNA, 1590 nt, Artificial Sequence
  KRT74__Homo_sapiens__XP_011536204
augagcagacagcugaacaucaagagcagcggcgacaagggcaacuucagcgugcacagcgccguggugcccagaaaggccgugggcagccuggccagcuacugcgccgccggcagaggcgccggcgccggcuucggcagcagaagccuguacagccugggcggcaacagaagaaucagcuucaacguggccggcggcggcgugagagccggcggcuacggcuucagacccggcagcggcuacggcggcggcagagccagcggcuucgccggcagcauguucggcagcguggcccugggccccgccugccugagcgugugcccccccggcggcauccaccaggugaccgugaacaagagccugcuggccccccugaacguggagcuggaccccgagauccagaaggugagagcccaggagagagagcagaucaaggugcugaacgacaaguucgccagcuucaucgacaaggugagauuccuggagcagcagaaccaggugcuggagaccaagugggagcugcugcagcagcuggaccugaacaacugcaagaagaaccuggagcccauccuggagggcuacaucagcaaccugagaaagcagcuggagacccugagcggcgacagagugagacuggacagcgagcugagaagcaugagagaccugguggaggacuacaagaagagauacgagguggagaucaacagaagaaccaccgccgagaacgaguucguggugcugaagaaggacgccgacgccgccuacgccgugaagguggagcugcaggccaagguggacagccuggacaaggagaucaaguuccugaagugccuguacgacgccgagaucgcccagauccagacccacgccagcgagaccagcgugauccugagcauggacaacaacagagaccuggaccuggacagcaucaucgccgaggugagaaugcacuacgaggagaucgcccugaagagcaaggccgaggccgaggcccuguaccagaccaagauccaggagcugcagcuggccgccagcagacacggcgacgaccugaagcacaccagaagcgagaugguggagcugaacagacugauccagagaaucagaugcgagaucggcaacgugaagaagcagagagccagccuggagaccgccaucgccgacgccgagcagagaggcgacaacgcccugaaggacgcccaggccaagcuggacgagcuggagggcgcccugcaccaggccaaggaggagcuggccagaaugcugagagaguaccaggagcugaugagccugaagcuggcccuggacauggagaucgccaccuacagaaagcugcuggagggcgaggagugcagaaugagcggcgagaaccccagcagcgugagcaucagcgugaucagcagcagcagcuacagcuaccaccaccccagcagcgccggcguggaccugggcgccagcgccguggccggcagcagcggcagcacccagagcggccagaccaagaccaccgaggccagaggcggcgaccugaaggacacccagggcaagagcacccccgccagcauccccgccagaaaggccaccagauaa

SEQ ID NO: 19096 - RNA, 1656 nt, Artificial Sequence
  KRT75__Homo_sapiens__NP_004684
augagcagacagagcagcaucaccuuccagagcggcagcagaagaggcuucagcaccaccagcgccaucacccccgccgccggcagaagcagauucagcagcgugagcguggccagaagcgccgccggcagcggcggccugggcagaaucagcagcgccggcgccagcuucggcagcagaagccuguacaaccugggcggcgccaagagagugagcaucaacggcugcggcagcagcugcagaagcggcuucggcggcagagccagcaacagauucggcgugaacagcggcuucggcuacggcggcggcgugggcggcggcuucagcggccccagcuuccccgugugcccccccggcggcauccaggaggugaccgugaaccagagccugcugaccccccugcaccugcagaucgaccccaccauccagagagugagagccgaggagagagagcagaucaagacccugaacaacaaguucgccagcuucaucgacaaggugagauuccuggagcagcagaacaaggugcuggagaccaagugggcccugcugcaggagcagggcagcagaaccgugagacagaaccuggagccccuguucgacagcuacaccagcgagcugagaagacagcuggagagcaucaccaccgagagaggcagacuggaggccgagcugagaaacaugcaggacgugguggaggacuucaaggugagauacgaggacgagaucaacaagagaaccgccgccgagaacgaguucguggcccugaagaaggacguggacgccgccuacaugaacaagguggagcuggaggccaaggugaagagccugcccgaggagaucaacuucauccacagcguguucgacgccgagcugagccagcugcagacccaggugggcgacaccagcguggugcugagcauggacaacaacagaaaccuggaccuggacagcaucaucgccgaggugaaggcccaguacgaggacaucgccaacagaagcagagccgaggccgagagcugguaccagaccaaguacgaggagcugcaggugaccgccggcagacacggcgacgaccugagaaacaccaagcaggagaucagcgagaugaacagaaugauccagagacugagagccgagaucgacagcgugaagaagcagugcagcagccugcagaccgccaucgccgacgccgagcagagaggcgagcuggcccugaaggacgccagagccaagcugguggaccuggaggaggcccugcagaaggccaagcaggacauggccagacugcugagagaguaccaggagcugaugaacaucaagcuggcccuggacguggagaucgccaccuacagaaagcugcuggagggcgaggagugcagacugagcggcgagggcgugagccccgugaacaucagcguggugaccagcacccugagcagcggcuacggcagcggcagcagcaucggcggcggcaaccugggccugggcggcggcagcggcuacagcuucaccaccagcggcggccacagccugggcgccggccugggcggcagcggcuucagcgccaccagcaacagaggccugggcggcagcggcagcagcgugaaguucgugagcaccaccagcagcagccagaagagcuacacccacuaa

SEQ ID NO: 19097 - RNA, 1917 nt, Artificial Sequence
  KRT76__Homo_sapiens__NP_056932
augaacagacaggugugcaagaagagcuucagcggcagaagccagggcuucagcggcagaagcgccguggugagcggcagcagcagaaugagcugcguggccagaagcggcggcgccggcggcggcgccugcggcuucagaagcggcgccggcagcuucggcagcagaagccuguacaaccugggcagcaacaagagcaucagcaucagcguggccgccggcagcagcagagccggcggcuucggcggcggcagaagcagcugcggcuucgccggcggcuacggcggcggcuucggcggcagcuacggcggcggcuucggcggcggcagaggcgugggcagcggcuucggcggcgccggcggcuucggcggcgccggcggcuucggcggccccggcguguucggcggccccggcagcuucggcggccccggcggcuucggccccggcggcuuccccggcggcauccaggaggugaucgugaaccagagccugcugcagccccugaacguggagaucgacccccagaucggccaggugaaggcccaggagagagagcagaucaagacccugaacaacaaguucgccagcuucaucgacaaggugagauuccuggagcagcagaacaaggugcuggagaccaagugggagcugcugcagcagcagaccaccggcagcggccccagcagccuggagcccugcuucgagagcuacaucagcuuccugugcaagcagcuggacagccugcugggcgagagaggcaaccuggagggcgagcugaagagcaugcaggaccugguggaggacuucaagaagaaguacgaggacgagaucaacaagagaaccgccgccgagaacgaguucgugggccugaagaaggacguggacgccgccuucaugaacaagguggagcugcaggccaagguggacagccugaccgacgaggugagcuuccugagaacccuguacgagauggagcugagccagaugcagagccacgccagcgacaccagcguggugcugagcauggacaacaacagaugccuggaccugggcagcaucaucgccgaggugagagcccaguacgaggagaucgcccagagaagcaagagcgaggccgaggcccuguaccagaccaagcugggcgagcugcagaccaccgccggcagacacggcgacgaccugagaaacaccaagagcgagaucauggagcugaacagaaugauccagagacugagagccgagaucgagaacgugaagaagcagaacgccaaccugcagaccgccaucgccgaggccgagcagagaggcgagauggcccugaaggacgccaacgccaagcugcaggaccugcagaccgcccugcagaaggccaaggacgaccuggccagacugcugagagacuaccaggagcugaugaacgugaagcuggcccuggacguggagaucgccaccuacagaaagcugcuggagggcgaggagugcagaaugagcggcgagugccagagcgccgugugcaucagcguggugagcaacgugaccagcaccagcggcagcagcggcagcagcagaggcguguucggcggcgugagcggcagcggcagcggcggcuacaagggcggcagcagcagcagcagcagcagcggcuacggcgugagcggcggcagcggcagcggcuacggcggcgugagcagcggcagcaccggcggcagaggcagcagcggcagcuaccagagcagcagcagcggcagcagacugggcggcgccggcagcaucagcgugagccacagcggcaugggcagcagcagcggcagcauccagaccagcggcggcagcggcuacaagagcggcggcggcggcagcaccagcaucagauucagccagaccaccagcagcagccagcacagcagcaccaaguaa

SEQ ID NO: 19098 - RNA, 1233 nt, Artificial Sequence
  KRT78__Homo_sapiens__NP_001287743
auggagggccacgaggccagccccgcccaggugggccagggcgacagaggcaaggugagauuccuggagcagcagaacaaggugcuggagaccaaguggcaccugcugcagcagcagggccugagcggcagccagcagggccuggagcccguguucgaggccugccuggaccagcugagaaagcagcuggagcagcugcagggcgagagaggcgcccuggacgccgagcugaaggccugcagagaccaggaggaggaguacaagagcaaguacgaggaggaggcccacagaagagccacccuggagaacgacuucguggugcugaagaaggacguggacggcguguuccugagcaagauggagcuggagggcaagcuggaggcccugagagaguaccuguacuuccugaagcaccugaacgaggaggagcugggccagcugcagacccaggccagcgacaccagcguggugcugagcauggacaacaacagauaccuggacuucagcagcaucaucaccgaggugagagccagauacgaggagaucgccagaagcagcaaggccgaggccgaggcccuguaccagaccaaguaccaggagcugcaggugagcgcccagcugcacggcgacagaaugcaggagaccaaggugcagaucagccagcugcaccaggagauccagagacugcagagccagaccgagaaccugaagaagcagaacgccagccugcaggccgccaucaccgacgccgagcagagaggcgagcuggcccugaaggacgcccaggccaagguggacgagcuggaggccgcccugagaauggccaagcagaaccuggccagacugcugugcgaguaccaggagcugaccagcaccaagcugagccuggacguggagaucgccaccuacagaagacugcuggagggcgaggagugcagaaugagcggcgagugcaccagccaggugaccaucagcagcgugggcggcagcgccgugaugagcggcggcgugggcggcggccugggcagcaccugcggccugggcagcggcaagggcagccccggcagcugcugcaccagcaucgugaccggcggcagcaacaucauccugggcagcggcaaggaccccgugcuggacagcugcagcgugagcggcagcagcgccggcagcagcugccacaccauccugaagaagaccguggagagcagccugaagaccagcaucaccuacuaa

SEQ ID NO: 19099 - RNA, 1410 nt, Artificial Sequence
  KRT7__Homo_sapiens__NP_005547
augagcauccacuucagcagccccguguucaccagcagaagcgccgccuucagcggcagaggcgcccaggugagacugagcagcgccagacccggcggccugggcagcagcagccuguacggccugggcgccagcagacccagaguggccgugagaagcgccuacggcggccccgugggcgccggcaucagagaggugaccaucaaccagagccugcuggccccccugagacuggacgccgaccccagccugcagagagugagacaggaggagagcgagcagaucaagacccugaacaacaaguucgccagcuucaucgacaaggugagauuccuggagcagcagaacaagcugcuggagaccaaguggacccugcugcaggagcagaagagcgccaagagcagcagacugcccgacaucuucgaggcccagaucgccggccugagaggccagcuggaggcccugcagguggacggcggcagacuggaggccgagcugagaagcaugcaggacgugguggaggacuucaagaacaaguacgaggacgagaucaaccacagaaccgccgccgagaacgaguucguggugcugaagaaggacguggacgccgccuacaugagcaagguggagcuggaggccaagguggacgcccugaacgacgagaucaacuuccugagaacccugaacgagaccgagcugaccgagcugcagagccagaucagcgacaccagcguggugcugagcauggacaacagcagaagccuggaccuggacggcaucaucgccgaggugaaggcccaguacgaggagauggccaagugcagcagagccgaggccgaggccugguaccagaccaaguucgagacccugcaggcccaggccggcaagcacggcgacgaccugagaaacaccagaaacgagaucagcgagaugaacagagccauccagagacugcaggccgagaucgacaacaucaagaaccagagagccaagcuggaggccgccaucgccgaggccgaggagagaggcgagcuggcccugaaggacgccagagccaagcaggaggagcuggaggccgcccugcagagaggcaagcaggacauggccagacagcugagagaguaccaggagcugaugagcgugaagcuggcccuggacaucgagaucgccaccuacagaaagcugcuggagggcgaggagagcagacuggccggcgacggcgugggcgccgugaacaucagcgugaugaacagcaccggcggcagcagcagcggcggcggcaucggccugacccugggcggcaccaugggcagcaacgcccugagcuucagcagcagcgccggccccggccugcugaaggccuacagcaucagaaccgccagcgccagcagaagaagcgccagagacuaa

SEQ ID NO: 19100 - RNA, 1269 nt, Artificial Sequence
  KRT80__Homo_sapiens__NP_001074961
auggccugcagaagcugcguggugggcuucagcagccugagcagcugcgaggugacccccgugggcagccccagacccggcaccagcggcugggacagcugcagagcccccggccccggcuucagcagcagaagccugaccggcugcuggagcgccggcaccaucagcaaggugaccgugaaccccggccugcuggugccccuggacgugaagcuggaccccgccgugcagcagcugaagaaccaggagaaggaggagaugaaggcccugaacgacaaguucgccagccugaucggcaaggugcaggcccuggagcagagaaaccagcugcuggagaccagauggagcuuccugcagggccaggacagcgccaucuucgaccugggccaccuguacgaggaguaccagggcagacugcaggaggagcugagaaaggugagccaggagagaggccagcuggaggccaaccugcugcaggugcuggagaagguggaggaguucagaaucagauacgaggacgagaucagcaagagaaccgacauggaguucaccuucgugcagcugaagaaggaccuggacgccgagugccugcacagaaccgagcuggagaccaagcugaagagccuggagagcuucguggagcugaugaagaccaucuacgagcaggagcugaaggaccuggccgcccaggugaaggacgugagcgugaccgugggcauggacagcagaugccacaucgaccugagcggcaucguggaggaggugaaggcccaguacgacgccguggccgccagaagccuggaggaggccgaggccuacagcagaagccagcuggaggagcaggccgccagaagcgccgaguacggcagcagccugcagagcagcagaagcgagaucgccgaccugaacgugagaauccagaagcugagaagccagauccugagcgugaagagccacugccugaagcuggaggagaacaucaagaccgccgaggagcagggcgagcuggccuuccaggacgccaagaccaagcuggcccagcuggaggccgcccugcagcaggccaagcaggacauggccagacagcugagaaaguaccaggagcugaugaacgugaagcuggcccuggacaucgagaucgccaccuacagaaagcugguggagggcgaggagggcagaauggacagccccagcgccaccguggugagcgccgugcagagcagaugcaagaccgcccccagccugcccuacccccugugcagccuguaa

SEQ ID NO: 19101 - RNA, 1518 nt, Artificial Sequence
  KRT81__Homo_sapiens__XP_011536636
augaccugcggcagcggcuucggcggcagagccuucagcugcaucagcgccugcggccccagacccggcagaugcugcaucaccgccgcccccuacagaggcaucagcugcuacagaggccugaccggcggcuucggcagccacagcgugugcggcggcuucagagccggcagcugcggcagaagcuucggcuacagaagcggcggcgugugcggccccagcccccccugcaucaccaccgugagcgugaacgagagccugcugaccccccugaaccuggagaucgaccccaacgcccagugcgugaagcaggaggagaaggagcagaucaagagccugaacagcagauucgccgccuucaucgacaaggugagauuccuggagcagcagaacaagcugcuggagaccaagcugcaguucuaccagaacagagagugcugccagagcaaccuggagccccuguucgagggcuacaucgagacccugagaagagaggccgagugcguggaggccgacagcggcagacuggccagcgagcugaaccacgugcaggaggugcuggagggcuacaagaagaaguacgaggaggaggugagccugagagccaccgccgagaacgaguucguggcccugaagaaggacguggacugcgccuaccugagaaagagcgaccuggaggccaacguggaggcccugauccaggagaucgacuuccugagaagacuguacgaggaggagauccugauccugcagagccacaucagcgacaccagcgugguggugaagcuggacaacagcagagaccugaacauggacugcaucaucgccgagaucaaggcccaguacgacgacaucgugaccagaagcagagccgaggccgagagcugguacagaagcaagugcgaggagaugaaggccaccgugaucagacacggcgagacccugagaagaaccaaggaggagaucaacgagcugaacagaaugauccagagacugaccgccgagguggagaacgccaagugccagaacagcaagcuggaggccgccguggcccagagcgagcagcagggcgaggccgcccugagcgacgccagaugcaagcuggccgagcuggagggcgcccugcagaaggccaagcaggacauggccugccugaucagagaguaccaggaggugaugaacagcaagcugggccuggacaucgagaucgccaccuacagaagacugcuggagggcgaggagcagagacugugcgagggcaucggcgccgugaacgugugcgugagcagcagcagaggcggcguggugugcggcgaccugugcgugagcggcagcagacccgugaccggcagcgugugcagcgcccccugcaacggcaacguggccgugagcaccggccugugcgcccccugcggccagcugaacaccaccugcggcggcggcagcugcggcgugggcagcugcggcaucagcagccugggcgugggcagcugcggcagcagcugcagaaagugcuaa

SEQ ID NO: 19102 - RNA, 1542 nt, Artificial Sequence
  KRT82__Homo_sapiens__NP_149022
augagcuaccacagcuuccagcccggcagcagaugcggcagccagagcuucagcagcuacagcgccgugaugcccagaauggugacccacuacgccgugagcaagggccccugcagacccggcggcggcagaggccugagagcccugggcugccugggcagcagaagccugugcaacgugggcuucggcagacccagaguggccagcagaugcggcggcacccugcccggcuucggcuacagacugggcgccaccugcggccccagcgccugcaucacccccgugaccaucaacgagagccugcuggugccccuggcccuggagaucgaccccaccgugcagagagugaagagagacgagaaggagcagaucaagugccugaacaacagauucgccagcuucaucaacaaggugagauuccuggagcagaagaacaagcugcuggagaccaaguggaacuucaugcagcagcagagaugcugccagaccaacaucgagcccaucuucgagggcuacaucagcgcccugagaagacagcuggacugcgugagcggcgacagagugagacuggagagcgagcugugcagccugcaggccgcccuggagggcuacaagaagaaguacgaggaggagcugagccugagacccugcguggagaacgaguucguggcccugaagaaggacguggacaccgccuuccugaugaaggccgaccuggagaccaacgccgaggcccuggugcaggagaucgacuuccugaagagccuguacgaggaggagaucugccugcugcagagccagaucagcgagaccagcgugaucgugaagauggacaacagcagagagcuggacguggacggcaucaucgccgagaucaaggcccaguacgacgacaucgccagcagaagcaaggccgaggccgaggccugguaccagugcagauacgaggagcugagagugaccgccggcaaccacugcgacaaccugagaaacagaaagaacgagauccuggagaugaacaagcugauccagagacugcagcaggagaccgagaacgugaaggcccagagaugcaagcuggagggcgccaucgccgaggccgagcagcagggcgaggccgcccugaacgacgccaagugcaagcuggccggccuggaggaggcccugcagaaggccaagcaggacauggccugccugcugaaggaguaccaggaggugaugaacagcaagcugggccuggacaucgagaucgccaccuacagaagacugcuggagggcgaggagcacagacugugcgagggcaucggccccgugaacaucagcgugagcagcagcaagggcgccuuccuguacgagcccugcggcgugagcacccccgugcugagcaccggcgugcugagaagcaacggcggcugcagcaucgugggcaccggcgagcuguacgugcccugcgagccccagggccugcugagcugcggcagcggcagaaagagcagcaugacccugggcgccggcggcagcagccccagccacaagcacuaa

SEQ ID NO: 19103 - RNA, 1482 nt, Artificial Sequence
  KRT83__Homo_sapiens__NP_002273
augaccugcggcuucaacagcaucggcugcggcuucagacccggcaacuucagcugcgugagcgccugcggccccagacccagcagaugcugcaucaccgccgcccccuacagaggcaucagcugcuacagaggccugaccggcggcuucggcagccacagcgugugcggcggcuucagagccggcagcugcggcagaagcuucggcuacagaagcggcggcgugugcggccccagcccccccugcaucaccaccgugagcgugaacgagagccugcugaccccccugaaccuggagaucgaccccaacgcccagugcgugaagcaggaggagaaggagcagaucaagagccugaacagcagauucgccgccuucaucgacaaggugagauuccuggagcagcagaacaagcugcuggagaccaagcugcaguucuaccagaacagagagugcugccagagcaaccuggagccccuguucgccggcuacaucgagacccugagaagagaggccgagugcguggaggccgacagcggcagacuggccagcgagcugaaccacgugcaggaggugcuggagggcuacaagaagaaguacgaggaggagguggcccugagagccaccgccgagaacgaguucguggcccugaagaaggacguggacugcgccuaccugagaaagagcgaccuggaggccaacguggaggcccugauccaggagaucgacuuccugagaagacuguacgaggaggagaucagaauccugcagagccacaucagcgacaccagcgugguggugaagcuggacaacagcagagaccugaacauggacugcaucguggccgagaucaaggcccaguacgacgacaucgccaccagaagcagagccgaggccgagagcugguacagaagcaagugcgaggagaugaaggccaccgugaucagacacggcgagacccugagaagaaccaaggaggagaucaacgagcugaacagaaugauccagagacugaccgccgagguggagaacgccaagugccagaacagcaagcuggaggccgccguggcccagagcgagcagcagggcgaggccgcccugagcgacgccagaugcaagcuggccgagcuggagggcgcccugcagaaggccaagcaggacauggccugccugaucagagaguaccaggaggugaugaacagcaagcugggccuggacaucgagaucgccaccuacagaagacugcuggagggcgaggagcagagacugugcgagggcguggaggccgugaacgugugcgugagcagcagcagaggcggcguggugugcggcgaccugugcgugagcggcagcagacccgugaccggcagcgugugcagcgcccccugcaacggcaaccugguggugagcaccggccugugcaagcccugcggccagcugaacaccaccugcggcggcggcagcugcggccagggcagacacuaa

SEQ ID NO: 19104 - RNA, 888 nt, Artificial Sequence
  KRT85__Homo_sapiens__NP_001287739
augguguucaaggugcaguuccugagcagcagacccagccugagccacacccaggacguggacugcgccuaccugagaaagagcgaccuggaggccaacguggaggcccugguggaggagagcagcuuccugagaagacuguacgaggaggagaucagagugcugcaggcccacaucagcgacaccagcgugaucgugaagauggacaacagcagagaccugaacauggacugcaucaucgccgagaucaaggcccaguacgacgacguggccagcagaagcagagccgaggccgagagcugguacagaagcaagugcgaggagaugaaggccaccgugaucagacacggcgagacccugagaagaaccaaggaggagaucaacgagcugaacagaaugauccagagacugaccgccgagaucgagaacgccaagugccagagagccaagcuggaggccgccguggccgaggccgagcagcagggcgaggccgcccugagcgacgccagaugcaagcuggccgagcuggagggcgcccugcagaaggccaagcaggacauggccugccugcugaaggaguaccaggaggugaugaacagcaagcugggccuggacaucgagaucgccaccuacagaagacugcuggagggcgaggagcacagacugugcgagggcgugggcagcgugaacgugugcgugagcagcagcagaggcggcgugagcugcggcggccugagcuacagcaccacccccggcagacagaucaccagcggccccagcgccaucggcggcagcaucaccgugguggcccccgacagcugcgcccccugccagcccagaagcagcagcuucagcugcggcagcagcagaagcgugagauucgccuaa

SEQ ID NO: 19105 - RNA, 1692 nt, Artificial Sequence
  KRT86__Homo_sapiens__XP_005268923
augugcgaggagcugaaggccaccgugcagaagcacacccagagccugaagcccagcaaggaggaccugaacagacugaaccaggccauccaguggcugaccguggaggugggcagcgccgagagccaggccuacagaggcgccagcagcgagagacugacccccagaccccugugcagccccuucggcagacugcacccccagaaccugcugagcagccccaagagcaccaugaccugcggcagcuacugcggcggcagagccuucagcugcaucagcgccugcggccccagacccggcagaugcugcaucaccgccgcccccuacagaggcaucagcugcuacagaggccugaccggcggcuucggcagccacagcgugugcggcggcuucagagccggcagcugcggcagaagcuucggcuacagaagcggcggcgugugcggccccagcccccccugcaucaccaccgugagcgugaacgagagccugcugaccccccugaaccuggagaucgaccccaacgcccagugcgugaagcaggaggagaaggagcagaucaagagccugaacagcagauucgccgccuucaucgacaaggugagauuccuggagcagcagaacaagcugcuggagaccaagcugcaguucuaccagaacagagagugcugccagagcaaccuggagccccuguucgagggcuacaucgagacccugagaagagaggccgagugcguggaggccgacagcggcagacuggccagcgagcugaaccacgugcaggaggugcuggagggcuacaagaagaaguacgaggaggaggugagccugagagccaccgccgagaacgaguucguggcccugaagaaggacguggacugcgccuaccugagaaagagcgaccuggaggccaacguggaggcccugauccaggagaucgacuuccugagaagacuguacgaggaggagaucagagugcugcagagccacaucagcgacaccagcgugguggugaagcuggacaacagcagagaccugaacauggacugcaucaucgccgagaucaaggcccaguacgacgacaucgugaccagaagcagagccgaggccgagagcugguacagaagcaagugcgaggagaugaaggccaccgugaucagacacggcgagacccugagaagaaccaaggaggagaucaacgagcugaacagaaugauccagagacugaccgccgagguggagaacgccaagugccagaacagcaagcuggaggccgccguggcccagagcgagcagcagggcgaggccgcccugagcgacgccagaugcaagcuggccgagcuggagggcgcccugcagaaggccaagcaggacauggccugccugaucagagaguaccaggaggugaugaacagcaagcugggccuggacaucgagaucgccaccuacagaagacugcuggagggcgaggagcagagacugugcgagggcgugggcagcgugaacgugugcgugagcagcagcagaggcggcguggugugcggcgaccugugcgccagcaccaccgcccccguggugagcaccagagugagcagcgugcccagcaacagcaacgugguggugggcaccaccaacgccugcgcccccagcgccagagugggcgugugcggcggcagcugcaagagaugcuaa

SEQ ID NO: 19106 - RNA, 1536 nt, Artificial Sequence
  KRT8__Homo_sapiens__NP_001243211
augaacggcgugagcuggagccaggaccugcaggagggcaucagcgccugguucggcccccccgccagcacccccgccagcaccaugagcaucagagugacccagaagagcuacaaggugagcaccagcggccccagagccuucagcagcagaagcuacaccagcggccccggcagcagaaucagcagcagcagcuucagcagagugggcagcagcaacuucagaggcggccugggcggcggcuacggcggcgccagcggcaugggcggcaucaccgccgugaccgugaaccagagccugcugagcccccuggugcuggagguggaccccaacauccaggccgugagaacccaggagaaggagcagaucaagacccugaacaacaaguucgccagcuucaucgacaaggugagauuccuggagcagcagaacaagaugcuggagaccaaguggagccugcugcagcagcagaagaccgccagaagcaacauggacaacauguucgagagcuacaucaacaaccugagaagacagcuggagacccugggccaggagaagcugaagcuggaggccgagcugggcaacaugcagggccugguggaggacuucaagaacaaguacgaggacgagaucaacaagagaaccgagauggagaacgaguucgugcugaucaagaaggacguggacgaggccuacaugaacaagguggagcuggagagcagacuggagggccugaccgacgagaucaacuuccugagacagcuguacgaggaggagaucagagagcugcagagccagaucagcgacaccagcguggugcugagcauggacaacagcagaagccuggacauggacagcaucaucgccgaggugaaggcccaguacgaggacaucgccaacagaagcagagccgaggccgagagcauguaccagaucaaguacgaggagcugcagagccuggccggcaagcacggcgacgaccugagaagaaccaagaccgagaucagcgagaugaacagaaacaucagcagacugcaggccgagaucgagggccugaagggccagagagccagccuggaggccgccaucgccgacgccgagcagagaggcgagcuggccaucaaggacgccaacgccaagcugagcgagcuggaggccgcccugcagagagccaagcaggacauggccagacagcugagagaguaccaggagcugaugaacgugaagcuggcccuggacaucgagaucgccaccuacagaaagcugcuggagggcgaggagagcagacuggagagcggcaugcagaacaugagcauccacaccaagaccaccagcggcuacgccggcggccugagcagcgccuacggcggccugaccagccccggccugagcuacagccugggcagcagcuucggcagcggcgccggcagcagcagcuucagcagaaccagcagcagcagagccgugguggugaagaagaucgagaccagagacggcaagcuggugagcgagagcagcgacgugcugcccaaguaa

SEQ ID NO: 19107 - RNA, 1872 nt, Artificial Sequence
  KRT9__Homo_sapiens__NP_000217
augagcugcagacaguucagcagcagcuaccugagcagaagcggcggcggcggcggcggcggccugggcagcggcggcagcaucagaagcagcuacagcagauucagcagcagcggcggcggcggcggcggcggcagauucagcagcagcagcggcuacggcggcggcagcagcagagugugcggcagaggcggcggcggcagcuucggcuacagcuacggcggcggcagcggcggcggcuucagcgccagcagccugggcggcggcuucggcggcggcagcagaggcuucggcggcgccagcggcggcggcuacagcagcagcggcggcuucggcggcggcuucggcggcggcagcggcggcggcuucggcggcggcuacggcagcggcuucggcggcuucggcggcuucggcggcggcgccggcggcggcgacggcggcauccugaccgccaacgagaagagcaccaugcaggagcugaacagcagacuggccagcuaccuggacaaggugcaggcccuggaggaggccaacaacgaccuggagaacaagauccaggacugguacgacaagaagggccccgccgccauccagaagaacuacagccccuacuacaacaccaucgacgaccugaaggaccagaucguggaccugaccgugggcaacaacaagacccugcuggacaucgacaacaccagaaugacccuggacgacuucagaaucaaguucgagauggagcagaaccugagacagggcguggacgccgacaucaacggccugagacaggugcuggacaaccugaccauggagaagagcgaccuggagaugcaguacgagacccugcaggaggagcugauggcccugaagaagaaccacaaggaggagaugagccagcugaccggccagaacagcggcgacgugaacguggagaucaacguggcccccggcaaggaccugaccaagacccugaacgacaugagacaggaguacgagcagcugaucgccaagaacagaaaggacaucgagaaccaguacgagacccagaucacccagaucgagcacgaggugagcagcagcggccaggaggugcagagcagcgccaaggaggugacccagcugagacacggcgugcaggagcuggagaucgagcugcagagccagcugagcaagaaggccgcccuggagaagagccuggaggacaccaagaacagauacugcggccagcugcagaugauccaggagcagaucagcaaccuggaggcccagaucaccgacgugagacaggagaucgagugccagaaccaggaguacagccugcugcugagcaucaagaugagacuggagaaggagaucgagaccuaccacaaccugcuggagggcggccaggaggacuucgagagcagcggcgccggcaagaucggccugggcggcagaggcggcagcggcggcagcuacggcagaggcagcagaggcggcagcggcggcagcuacggcggcggcggcagcggcggcggcuacggcggcggcagcggcagcagaggcggcagcggcggcagcuacggcggcggcagcggcagcggcggcggcagcggcggcggcuacggcggcggcagcggcggcggccacagcggcggcagcggcggcggccacagcggcggcagcggcggcaacuacggcggcggcagcggcagcggcggcggcagcggcggcggcuacggcggcggcagcggcagcagaggcggcagcggcggcagccacggcggcggcagcggcuucggcggcgagagcggcggcagcuacggcggcggcgaggaggccagcggcagcggcggcggcuacggcggcggcagcggcaagagcagccacagcuaa

SEQ ID NO: 19108 - RNA, 492 nt, Artificial Sequence
  KRTAP11-1__Homo_sapiens__NP_787054
augagcuucaacugcagcaccagaaacugcagcagcagacccaucggcggcagaugcaucgugcccguggcccaggugaccaccaccagcaccaccgacgccgacugccugggcggcaucugccugcccagcagcuuccagaccggcagcuggcugcuggaccacugccaggagaccugcugcgagcccaccgccugccagcccaccugcuacagaagaaccagcugcgugagcaaccccugccaggugaccugcagcagacagaccaccugcaucagcaaccccugcagcaccaccuacagcagaccccugaccuucgugagcagcggcugccagccccugggcggcaucagcagcgugugccagcccgugggcggcaucagcaccgugugccagcccgugggcggcgugagcaccgugugccagcccgccugcggcgugagcagaaccuaccagcagagcugcgugagcagcugcagaagaaccugcuaa

SEQ ID NO: 19109 - RNA, 837 nt, Artificial Sequence
  KRTAP5-1__Homo_sapiens__NP_001005922
augggcugcugcggcugcagcggcggcugcggcagcagcugcggcggcugcggcagcggcugcggcggcugcggcagcggcugcggcggcugcggcagcggcugcggcggcagcggcagcagcugcugcgugcccgugugcugcugcaagcccgugugcugcagagugcccaccugcagcugcagcagcugcggcaagggcggcugcggcagcagcggcggcagcaagggcggcugcggcagcugcggcggcugcaagggcggcugcggcagcugcggcggcagcaagggcggcugcggcagcugcggcggcagcaagggcggcugcggcagcugcggcggcagcaagggcggcugcggcagcggcugcggcggcugcggcagcagcugcugcgugcccgugugcugcugcaagcccaugugcugcugcgugcccgccugcagcugcagcagcugcggcaagggcggcugcggcagcugcggcugcagcaagggcgccugcggcagcugcggcggcagcaagggcggcugcggcagcugcggcggcugcaagggcggcugcggcagcugcggcggcagcaagggcggcugcggcagcggcugcggcggcugcggcagcggcugcggcgugcccgugugcugcugcagcugcagcagcugcggcagcugcgccggcagcaagggcggcugcggcagcagcugcagccagugcagcugcugcaagcccugcugcugcagcagcggcugcggcagcagcugcugccagagcagcugcugcaagcccugcugcagccagagcagcugcugcgugcccgugugcugccagugcaagaucuaa

SEQ ID NO: 19110 - RNA, 510 nt, Artificial Sequence
  KRTAP5-9__Homo_sapiens__NP_005544
augggcugcugcggcugcagcggcggcugcggcagcagcugcggcggcugcgacagcagcugcggcagcugcggcagcggcugcagaggcugcggccccagcugcugcgcccccguguacugcugcaagcccgugugcugcugcgugcccgccugcagcugcagcagcugcggcaagagaggcugcggcagcugcggcggcagcaagggcggcugcggcagcugcggcugcagccagugcagcugcugcaagcccugcugcugcagcagcggcugcggcagcagcugcugccagugcagcugcugcaagcccuacugcagccagugcagcugcugcaagcccugcugcagcagcagcggcagaggcagcagcugcugccagagcagcugcugcaagcccugcugcagcagcagcggcugcggcagcagcugcugccagagcagcugcugcaagcccugcugcagccagagcagaugcugcgugcccgugugcuaccagugcaagaucuaa

SEQ ID NO: 19111 - RNA, 2787 nt, Artificial Sequence
  KSR1__Homo_sapiens__XP_006722214
auggacagagccgcccugagagccgccgccaugggcgagaagaaggagggcggcggcggcggcgacgccgccgccgccgagggcggcgccggcgccgccgccagcagagcccugcagcagugcggccagcugcagaagcugaucgacaucagcaucggcagccugagaggccugagaaccaagugcgccgugagcaacgaccugacccagcaggagaucagaacccuggaggccaagcuggugagauacaucugcaagcagagacagugcaagcugagcguggcccccggcgagagaacccccgagcugaacagcuaccccagauucagcgacuggcuguacaccuucaacgugagacccgagguggugcaggagauccccagagaccugacccuggacgcccugcuggagaugaacgaggccaaggugaaggagacccugagaagaugcggcgccagcggcgacgagugcggcagacugcaguacgcccugaccugccugagaaaggugaccggccugggcggcgagcacaaggaggacagcagcuggagcagccuggacgccagaagagagagcggcagcggccccagcaccgacacccugagcgccgccagccugcccuggccccccggcagcagccagcugggcagagccggcaacagcgcccagggccccagaagcaucagcgugagcgcccugcccgccagcgacagccccacccccagcuucagcgagggccugagcgacaccugcaucccccugcacgccagcggcagacugacccccagagcccugcacagcuucaucaccccccccaccaccccccagcugagaagacacaccaagcugaagccccccagaaccccccccccccccagcagaaagguguuccagcugcugcccagcuuccccacccugaccagaagcaagagccacgagagccagcugggcaacagaaucgacgacgugagcagcaugagauucgaccugagccacggcagcccccagauggugagaagagacaucggccugagcgugacccacagauucagcaccaagagcuggcugagccaggugugccacgugugccagaagagcaugaucuucggcgugaagugcaagcacugcagacugaagugccacaacaagugcaccaaggaggcccccgccugcagaaucagcuuccugccccugaccagacugagaagaaccgagagcgugcccagcgacaucaacaaccccguggacagagccgccgagccccacuucggcacccugcccaaggcccugaccaagaaggagcacccccccgccaugaaccaccuggacagcagcagcaaccccagcagcaccaccagcagcacccccagcagccccgcccccuuccccaccagcagcaaccccagcagcgccaccaccccccccaaccccagccccggccagagagacagcagauucaacuuccccgccgccuacuucauccaccacagacagcaguucaucuuccccgacaucagcgccuucgcccacgccgccccccugcccgaggccgccgacggcaccagacuggacgaccagcccaaggccgacgugcuggaggcccacgaggccgaggccgaggagcccgaggccggcaagagcgaggccgaggacgacgaggacgagguggacgaccugcccagcagcagaagacccuggagaggccccaucagcagaaaggccagccagaccagcguguaccugcaggagugggacauccccuucgagcagguggagcugggcgagcccaucggccagggcagauggggcagagugcacagaggcagauggcacggcgagguggccaucagacugcuggagauggacggccacaaccaggaccaccugaagcuguucaagaaggaggugaugaacuacagacagaccagacacgagaacguggugcuguucaugggcgccugcaugaaccccccccaccuggccaucaucaccagcuucugcaagggcagaacccugcacagcuucgugagagaccccaagaccagccuggacaucaacaagaccagacagaucgcccaggagaucaucaagggcaugggcuaccugcacgccaagggcaucgugcacaaggaccugaagagcaagaacguguucuacgacaacggcaagguggugaucaccgacuucggccuguucggcaucagcggcguggugagagagggcagaagagagaaccagcugaagcugagccacgacuggcugugcuaccuggcccccgagaucgugagagagaugacccccggcaaggacgaggaccagcugcccuucagcaaggccgccgacguguacgccuucggcaccgugugguacgagcugcaggccagagacuggccccugaagaaccaggccgccgaggccagcaucuggcagaucggcagcggcgagggcaugaagagagugcugaccagcgugagccugggcaaggaggugagcgagauccugagcgccugcugggccuucgaccugcaggagagacccagcuucagccugcugauggacaugcuggagaagcugcccaagcugaacagaagacugagccaccccggccacuucuggaagagcgccgacagauggagaagcagauacuacggcaagggcagauacggccaccccgacuucaagagcagcugccccauccuggaggaguacaucaacagcagcaagguggugcccagauucgagagauucggccugggcgugcuggagagcagcaaccccaagauguaa

SEQ ID NO: 19112 - RNA, 2766 nt, Artificial Sequence
  KSR2__Homo_sapiens__NP_775869
augaucgaccugagcaucagcaaccuggagggccugagaaccaagugcgccaccagcaacgaccugacccagaaggagaucagaacccuggagagcaagcuggugaaguacuucagcagacagcugagcugcaagaagaagguggcccugcaggagagaaacgccgagcuggacggcuucccccagcugagacacugguucagaaucguggacgugagaaaggaggugcuggaggagaucagccccggccagcugagccuggaggaccugcuggagaugaccgacgagcaggugugcgagaccguggagaaguacggcgccaacagagaggagugcgccagacugaacgccagccugagcugccugagaaacgugcacaugagcggcggcaaccugagcaagcaggacuggaccauccaguggcccaccaccgagaccggcaaggagaacaaccccgugugcccccccgagcccacccccuggaucagaacccaccugagccagagccccagagugcccagcaagugcgugcagcacuacugccacaccagccccacccccggcgcccccguguacacccacguggacagacugaccguggacgccuaccccggccugugccccccccccccccuggagagcggccacagaagccugccccccagccccagacagagacacgccgugagaaccccccccagaacccccaacaucgugaccaccgugaccccccccggcaccccccccaugagaaagaagaacaagcugaagccccccggcacccccccccccagcagcagaaagcugauccaccugauccccggcuucaccgcccugcacagaagcaagagccacgaguuccagcugggccacagaguggacgaggcccacacccccaaggccaagaagaagagcaagccccugaaccugaagauccacagcagcgugggcagcugcgagaacauccccagccagcagagaagcccccugcugagcgagagaagccugagaagcuucuucgugggccacgcccccuuccugcccagcaccccccccgugcacaccgaggccaacuucagcgccaacacccugagcgugcccagauggagcccccagauccccagaagagaccugggcaacagcaucaagcacagauucagcaccaaguacuggaugagccagaccugcaccgugugcggcaagggcaugcuguucggccugaagugcaagaacugcaagcugaagugccacaacaagugcaccaaggaggccccccccugccaccugcugaucauccacagaggcgaccccgccagacuggugagaaccgagagcgugcccugcgacaucaacaacccccugagaaagccccccagauacagcgaccugcacaucagccagacccugcccaagaccaacaagaucaacaaggaccacauccccgugcccuaccagcccgacagcagcagcaaccccagcagcaccaccagcagcacccccagcagccccgcccccccccugccccccagcgccaccccccccagcccccugcaccccagcccccagugcaccagacagcagaagaacuucaaccugcccgccagccacuacuacaaguacaagcagcaguucaucuuccccgacguggugcccgugcccgagacccccaccagagccccccaggugauccugcaccccgugaccagcaaccccauccuggagggcaacccccugcugcagaucgagguggagcccaccagcgagaacgaggaggugcacgacgaggccgaggagagcgaggacgacuucgaggagaugaaccugagccugcugagcgccagaagcuuccccagaaaggccagccagaccagcaucuuccugcaggagugggacauccccuucgagcagcuggagaucggcgagcugaucggcaagggcagauucggccagguguaccacggcagauggcacggcgagguggccaucagacugaucgacaucgagagagacaacgaggaccagcugaaggccuucaagagagaggugauggccuacagacagaccagacacgagaacguggugcuguucaugggcgccugcaugagccccccccaccuggccaucaucaccagccugugcaagggcagaacccuguacagcguggugagagacgccaagaucgugcuggacgugaacaagaccagacagaucgcccaggagaucgugaagggcaugggcuaccugcacgccaagggcauccugcacaaggaccugaagagcaagaacguguucuacgacaacggcaagguggugaucaccgacuucggccuguucagcaucagcggcgugcugcaggccggcagaagagaggacaagcugagaauccagaacggcuggcugugccaccuggcccccgagaucaucagacagcugagccccgacaccgaggaggacaagcugcccuucagcaagcacagcgacguguucgcccugggcaccaucugguacgagcugcacgccagagaguggcccuucaagacccagcccgccgaggccaucaucuggcagaugggcaccggcaugaagcccaaccugagccagaucggcaugggcaaggagaucagcgacauccugcuguucugcugggccuucgagcaggaggagagacccaccuucaccaagcugauggacaugcuggagaagcugcccaagagaaacagaagacugagccaccccggccacuucuggaagagcgccgagcuguaa

SEQ ID NO: 19113 - RNA, 4074 nt, Artificial Sequence
  KTN1__Homo_sapiens__NP_001072989
auggaguucuacgagagcgccuacuucaucgugcugauccccagcaucgugaucaccgugaucuuccuguucuucuggcuguucaugaaggagacccuguacgacgaggugcuggccaagcagaagagagagcagaagcugauccccaccaagaccgacaagaagaaggccgagaagaagaagaacaagaagaaggagauccagaacggcaaccugcacgagagcgacagcgagagcgugcccagagacuucaagcugagcgacgcccuggccguggaggacgaccagguggcccccgugccccugaacgugguggagaccagcagcagcgugagagagagaaagaagaaggagaagaagcagaagcccgugcuggaggagcaggugaucaaggagagcgacgccagcaagauccccggcaagaagguggagcccgugcccgugaccaagcagcccaccccccccagcgaggccgccgccagcaagaagaagcccggccagaagaagagcaagaacggcagcgacgaccaggacaagaagguggagacccugauggugcccagcaagagacaggaggcccugccccugcaccaggagaccaagcaggagagcggcagcggcaagaagaaggccagcagcaagaagcagaagaccgagaacguguucguggacgagccccugauccacgccaccaccuacaucccccugauggacaacgccgacagcagccccgugguggacaagagagaggugaucgaccugcugaagcccgaccagguggagggcauccagaagagcggcaccaagaagcugaagaccgagaccgacaaggagaacgccgaggugaaguucaaggacuuccugcugagccugaagaccaugauguucagcgaggacgaggcccugugcgugguggaccugcugaaggagaagagcggcgugauccaggacgcccugaagaagagcagcaagggcgagcugaccacccugauccaccagcugcaggagaaggacaagcugcuggccgccgugaaggaggacgccgccgccaccaaggacagaugcaagcagcugacccaggagaugaugaccgagaaggagagaagcaacguggugaucaccagaaugaaggacagaaucggcacccuggagaaggagcacaacguguuccagaacaagauccacgugagcuaccaggagacccagcagaugcagaugaaguuccagcaggugagagagcagauggaggccgagaucgcccaccugaagcaggagaacggcauccugagagacgccgugagcaacaccaccaaccagcuggagagcaagcagagcgccgagcugaacaagcugagacaggacuacgccagacuggugaacgagcugaccgagaagaccggcaagcugcagcaggaggaggugcagaagaagaacgccgagcaggccgccacccagcugaaggugcagcugcaggaggccgagagaagaugggaggaggugcagagcuacaucagaaagagaaccgccgagcacgaggccgcccagcaggaccugcagagcaaguucguggccaaggagaacgaggugcagagccugcacagcaagcugaccgacacccuggugagcaagcagcagcuggagcagagacugaugcagcugauggagagcgagcagaagagagugaacaaggaggagagccugcagaugcaggugcaggacauccuggagcagaacgaggcccugaaggcccagauccagcaguuccacagccagaucgccgcccagaccagcgccagcgugcuggccgaggagcugcacaaggugaucgccgagaaggacaagcagaucaagcagaccgaggacagccuggccagcgagagagacagacugaccagcaaggaggaggagcugaaggacauccagaacaugaacuuccugcugaaggccgaggugcagaagcugcaggcccuggccaacgagcaggccgccgccgcccacgagcuggagaagaugcagcagagcguguacgugaaggacgacaagaucagacugcuggaggagcagcugcagcacgagaucagcaacaagauggaggaguucaagauccugaacgaccagaacaaggcccugaagagcgaggugcagaagcugcagacccuggugagcgagcagcccaacaaggacgugguggagcagauggagaagugcauccaggagaaggacgagaagcugaagaccguggaggagcugcuggagaccggccugauccagguggccaccaaggaggaggagcugaacgccaucagaaccgagaacagcagccugaccaaggaggugcaggaccugaaggccaagcagaacgaccaggugagcuucgccagccugguggaggagcugaagaaggugauccacgagaaggacggcaagaucaagagcguggaggagcugcuggaggccgagcugcugaagguggccaacaaggagaagaccgugcaggaccugaagcaggagaucaaggcccugaaggaggagaucggcaacgugcagcuggagaaggcccagcagcugagcaucaccagcaaggugcaggagcugcagaaccugcugaagggcaaggaggagcagaugaacaccaugaaggccgugcuggaggagaaggagaaggaccuggccaacaccggcaaguggcugcaggaccugcaggaggagaacgagagccugaaggcccacgugcaggagguggcccagcacaaccugaaggaggccagcagcgccagccaguucgaggagcuggagaucgugcugaaggagaaggagaacgagcugaagagacuggaggccaugcugaaggagagagagagcgaccugagcagcaagacccagcugcugcaggacgugcaggacgagaacaagcuguucaagagccagaucgagcagcugaagcagcagaacuaccagcaggccagcagcuuccccccccacgaggagcugcugaaggugaucagcgagagagagaaggagaucagcggccuguggaacgagcuggacagccugaaggacgccguggagcaccagagaaagaagaacaacgaccugagagagaagaacugggaggccauggaggcccuggccagcaccgagaagaugcugcaggacaaggugaacaagaccagcaaggagagacagcagcagguggaggccguggagcuggaggccaaggaggugcugaagaagcuguuccccaaggugagcgugcccagcaaccugagcuacggcgaguggcugcacggcuucgagaagaaggccaaggagugcauggccggcaccagcggcagcgaggaggugaaggugcuggagcacaagcugaaggaggccgacgagaugcacacccugcugcagcuggagugcgagaaguacaagagcgugcuggccgagaccgagggcauccugcagaagcugcagagaagcguggagcaggaggagaacaaguggaaggugaagguggacgagagccacaagaccaucaagcagaugcagagcagcuucaccagcagcgagcaggagcuggagagacugagaagcgagaacaaggacaucgagaaccugagaagagagagagagcaccuggagauggagcuggagaaggccgagauggagagaagcaccuacgugaccgaggugagagagcugaaggaccugcugaccgagcugcagaagaagcuggacgacagcuacagcgaggccgugagacagaacgaggagcugaaccugcugaaggcccagcugaacgagacccugaccaagcugagaaccgagcagaacgagagacagaagguggccggcgaccugcacaaggcccagcagagccuggagcugauccagagcaagaucgugaaggccgccggcgacaccaccgugaucgagaacagcgacgugagccccgagaccgagagcagcgagaaggagaccaugagcgugagccugaaccagaccgugacccagcugcagcagcugcugcaggccgugaaccagcagcugaccaaggagaaggagcacuaccaggugcuggaguaa

SEQ ID NO: 19114 - RNA, 924 nt, Artificial Sequence
  KYNU__Homo_sapiens__NP_001028170
auggagcccagcagccuggagcugcccgccgacaccgugcagagaaucgccgccgagcugaagugccaccccaccgacgagagaguggcccugcaccuggacgaggaggacaagcugagacacuucagagagugcuucuacauccccaagauccaggaccugccccccguggaccugagccuggugaacaaggacgagaacgccaucuacuuccugggcaacagccugggccugcagcccaagauggugaagaccuaccuggaggaggagcuggacaagugggccaagaucgccgccuacggccacgaggugggcaagagacccuggaucaccggcgacgagagcaucgugggccugaugaaggacaucgugggcgccaacgagaaggagaucgcccugaugaacgcccugaccgugaaccugcaccugcugaugcugagcuucuucaagcccacccccaagagauacaagauccugcuggaggccaaggccuuccccagcgaccacuacgccaucgagagccagcugcagcugcacggccugaacaucgaggagagcaugagaaugaucaagcccagagagggcgaggagacccugagaaucgaggacauccuggaggugaucgagaaggagggcgacagcaucgccgugauccuguucagcggcgugcacuucuacaccggccagcacuucaacauccccgccaucaccaaggccggccaggccaagggcugcuacgugggcuucgaccuggcccacgccgugggcaacguggagcuguaccugcacgacuggggcguggacuucgccugcuggugcagcuacaaguaccugaacgccggcgccggcggcaucgccggcgccuucauccacgagaagcacgcccacaccaucaagcccgccagaagcgaguucuucaacuaa

SEQ ID NO: 19115 - RNA, 3774 nt, Artificial Sequence
  L1CAM__Homo_sapiens__NP_000416
auggugguggcccugagauacguguggccccugcugcugugcagccccugccugcugauccagauccccgaggaguacgagggccaccacgugauggagccccccgugaucaccgagcagagccccagaagacuggugguguuccccaccgacgacaucagccugaagugcgaggccagcggcaagcccgaggugcaguucagauggaccagagacggcgugcacuucaagcccaaggaggagcugggcgugaccguguaccagagcccccacagcggcagcuucaccaucaccggcaacaacagcaacuucgcccagagauuccagggcaucuacagaugcuucgccagcaacaagcugggcaccgccaugagccacgagaucagacugauggccgagggcgcccccaaguggcccaaggagaccgugaagcccguggagguggaggagggcgagagcguggugcugcccugcaaccccccccccagcgccgagccccugagaaucuacuggaugaacagcaagauccugcacaucaagcaggacgagagagugaccaugggccagaacggcaaccuguacuucgccaacgugcugaccagcgacaaccacagcgacuacaucugccacgcccacuuccccggcaccagaaccaucauccagaaggagcccaucgaccugagagugaaggccaccaacagcaugaucgacagaaagcccagacugcuguuccccaccaacagcagcagccaccugguggcccugcagggccagccccuggugcuggagugcaucgccgagggcuuccccacccccaccaucaaguggcugagacccagcggccccaugcccgccgacagagugaccuaccagaaccacaacaagacccugcagcugcugaaggugggcgaggaggacgacggcgaguacagaugccuggccgagaacagccugggcagcgccagacacgccuacuacgugaccguggaggccgcccccuacuggcugcacaagccccagagccaccuguacggccccggcgagaccgccagacuggacugccaggugcagggcagaccccagcccgaggugaccuggagaaucaacggcauccccguggaggagcuggccaaggaccagaaguacagaauccagagaggcgcccugauccugagcaacgugcagcccagcgacaccauggugacccagugcgaggccagaaacagacacggccugcugcuggccaacgccuacaucuacguggugcagcugcccgccaagauccugaccgccgacaaccagaccuacauggccgugcagggcagcaccgccuaccugcugugcaaggccuucggcgcccccgugcccagcgugcaguggcuggacgaggacggcaccaccgugcugcaggacgagagauucuuccccuacgccaacggcacccugggcaucagagaccugcaggccaacgacaccggcagauacuucugccuggccgccaacgaccagaacaacgugaccaucauggccaaccugaaggugaaggacgccacccagaucacccagggccccagaagcaccaucgagaagaagggcagcagagugaccuucaccugccaggccagcuucgaccccagccugcagcccagcaucaccuggagaggcgacggcagagaccugcaggagcugggcgacagcgacaaguacuucaucgaggacggcagacuggugauccacagccuggacuacagcgaccagggcaacuacagcugcguggccagcaccgagcuggacgugguggagagcagagcccagcugcugguggugggcagccccggccccgugcccagacuggugcugagcgaccugcaccugcugacccagagccaggugagagugagcuggagccccgccgaggaccacaacgcccccaucgagaaguacgacaucgaguucgaggacaaggagauggcccccgagaagugguacagccugggcaaggugcccggcaaccagaccagcaccacccugaagcugagccccuacgugcacuacaccuucagagugaccgccaucaacaaguacggccccggcgagcccagccccgugagcgagaccguggugacccccgaggccgcccccgagaagaaccccguggacgugaagggcgagggcaacgagaccaccaacauggugaucaccuggaagccccugagauggauggacuggaacgccccccaggugcaguacagagugcaguggagaccccagggcaccagaggccccuggcaggagcagaucgugagcgaccccuuccugguggugagcaacaccagcaccuucgugcccuacgagaucaaggugcaggccgugaacagccagggcaagggccccgagccccaggugaccaucggcuacagcggcgaggacuacccccaggccauccccgagcuggagggcaucgagauccugaacagcagcgccgugcuggugaaguggagacccguggaccuggcccaggugaagggccaccugagaggcuacaacgugaccuacuggagagagggcagccagagaaagcacagcaagagacacauccacaaggaccacgugguggugcccgccaacaccaccagcgugauccugagcggccugagacccuacagcagcuaccaccuggaggugcaggccuucaacggcagaggcagcggccccgccagcgaguucaccuucagcacccccgagggcgugcccggccaccccgaggcccugcaccuggagugccagagcaacaccagccugcugcugagauggcagcccccccugagccacaacggcgugcugaccggcuacgugcugagcuaccacccccuggacgagggcggcaagggccagcugagcuucaaccugagagaccccgagcugagaacccacaaccugaccgaccugagcccccaccugagauacagauuccagcugcaggccaccaccaaggagggccccggcgaggccaucgugagagagggcggcaccauggcccugagcggcaucagcgacuucggcaacaucagcgccaccgccggcgagaacuacagcguggugagcugggugcccaaggagggccagugcaacuucagauuccacauccuguucaaggcccugggcgaggagaagggcggcgccagccugagcccccaguacgugagcuacaaccagagcagcuacacccagugggaccugcagcccgacaccgacuacgagauccaccuguucaaggagagaauguucagacaccagauggccgugaagaccaacggcaccggcagagugagacugccccccgccggcuucgccaccgagggcugguucaucggcuucgugagcgccaucauccugcugcugcuggugcugcugauccugugcuucaucaagagaagcaagggcggcaaguacagcgugaaggacaaggaggacacccagguggacagcgaggccagacccaugaaggacgagaccuucggcgaguacagaagccuggagagcgacaacgaggagaaggccuucggcagcagccagcccagccugaacggcgacaucaagccccugggcagcgacgacagccuggccgacuacggcggcagcguggacgugcaguucaacgaggacggcagcuucaucggccaguacagcggcaagaaggagaaggaggccgccggcggcaacgacagcagcggcgccaccagccccaucaaccccgccguggcccuggaguaa

SEQ ID NO: 19116 - RNA, 1392 nt, Artificial Sequence
  L2HGDH__Homo_sapiens__XP_005268132
auggugcccgcccugagauaccuggugggcgccugcggcagagccagaggccuguucgccggcggcagccccggcgccugcggcuucgccagcggcagacccagaccccugugcggcggcagcagaagcgccagcaccagcagcuucgacaucgugaucgugggcggcggcaucgugggccuggccagcgccagagcccugauccugagacaccccagccugagcaucggcgugcuggagaaggagaaggaccuggccgugcaccagaccggccacaacagcggcgugauccacagcggcaucuacuacaagcccgagagccugaaggccaagcugugcgugcagggcgccgcccugcuguacgaguacugccagcagaagggcaucagcuacaagcagugcggcaagcugaucguggccguggagcaggaggagauccccagacugcaggcccuguacgagaagggccugcagaacggcgugcccggccugagacugauccagcaggaggacaucaagaagaaggagcccuacugcagaggccugauggccaucgacugcccccacaccggcaucguggacuacagacagguggcccugagcuucgcccaggacuuccaggaggccggcggcagcgugcugaccaacuucgaggugaagggcaucgagauggccaaggagagccccagcagaagcaucgacggcaugcaguaccccaucgugaucaagaacaccaagggcgaggagaucagaugccaguacguggugaccugcgccggccuguacagcgacagaaucagcgagcugagcggcugcacccccgaccccagaaucgugcccuucagaggcgacuaccugcugcugaagcccgagaagugcuaccuggugaagggcaacaucuaccccgugcccgacagcagauuccccuuccugggcgugcacuucacccccagaauggacggcagcaucuggcugggccccaacgccgugcuggccuucaagagagagggcuacagacccuucgacuucagcgccaccgacgugauggacaucaucaucaacagcggccugaucaagcuggccagccagaacuucagcuacggcgugaccgagauguacaaggccugcuuccugggcgccaccgugaaguaccugcagaaguucauccccgagaucaccaucagcgacauccugagaggccccgccggcgugagagcccaggcccuggacagagacggcaaccugguggaggacuucguguucgacgccggcgugggcgacaucggcaacagaauccugcacgugagaaacgcccccagccccgccgccaccagcagcaucgccaucagcggcaugaucgccgacgaggugcagcagagauucgagcuguaa

SEQ ID NO: 19117 - RNA, 2319 nt, Artificial Sequence
  L3MBTL1__Homo_sapiens__NP_056293
augagaagaagagagggccacggcaccgacagcgagaugggccagggccccgugagagagagccagagcagcgacccccccgcccugcaguucagaaucagcgaguacaagccccugaacauggccggcguggagcagccccccagccccgagcugagacaggagggcgugaccgaguacgaggacggcggcgcccccgccggcgacggcgaggccggcccccagcaggccgaggaccacccccagaacccccccgaggaccccaaccaggacccccccgaggacgacagcaccugccagugccaggccugcggcccccaccaggccgccggccccgaccugggcagcagcaacgacggcugcccccagcuguuccaggagagaagcgugaucguggagaacagcagcggcagcaccagcgccagcgagcugcugaagcccaugaagaagagaaagagaagagaguaccagagccccagcgaggaggagagcgagcccgaggccauggagaagcaggaggagggcaaggaccccgagggccagcccaccgccagcacccccgagagcgaggaguggagcagcagccagcccgccaccggcgagaagaaggagugcuggagcugggagagcuaccuggaggagcagaaggccaucaccgcccccgugagccuguuccaggacagccaggccgugacccacaacaagaacggcuucaagcugggcaugaagcuggagggcaucgacccccagcaccccagcauguacuucauccugaccguggccgaggugugcggcuacagacugagacugcacuucgacggcuacagcgagugccacgacuucugggugaacgccaacagccccgacauccaccccgccggcugguucgagaagaccggccacaagcugcagccccccaagggcuacaaggaggaggaguucagcuggagccaguaccugagaagcaccagagcccaggccgcccccaagcaccuguucgugagccagagccacagcccccccccccugggcuuccaggugggcaugaagcuggaggccguggacagaaugaaccccagccuggugugcguggccagcgugaccgacgugguggacagcagauuccuggugcacuucgacaacugggacgacaccuacgacuacuggugcgaccccagcagccccuacauccaccccgugggcuggugccagaagcagggcaagccccugacccccccccaggacuaccccgaccccgacaacuucugcugggagaaguaccuggaggagaccggcgccagcgccgugcccaccugggccuucaaggugagacccccccacagcuuccuggugaacaugaagcuggaggccguggacagaagaaaccccgcccugaucagaguggccagcguggaggacguggaggaccacagaaucaagauccacuucgacggcuggagccacggcuacgacuucuggaucgacgccgaccaccccgacauccaccccgccggcuggugcagcaagaccggccacccccugcagcccccccugggccccagagagcccagcagcgccagccccggcggcugccccccccugagcuacagaagccugccccacaccagaaccagcaaguacagcuuccaccacagaaagugccccacccccggcugcgacggcagcggccacgugaccggcaaguucaccgcccaccacugccugagcggcugcccccuggccgagagaaaccagagcagacugaaggccgagcugagcgacagcgaggccagcgccagaaagaagaaccugagcggcuucagccccagaaagaagcccagacaccacggcagaaucggcagaccccccaaguacagaaagaucccccaggaggacuuccagacccugacccccgacguggugcaccagagccuguucaugagcgcccugagcgcccaccccgacagaagccugagcgugugcugggagcagcacugcaagcugcugcccggcguggccggcaucagcgccagcaccguggccaaguggaccaucgacgagguguucggcuucgugcagacccugaccggcugcgaggaccaggccagacuguucaaggacgaggccagaaucgugagagugacccacgugagcggcaagacccugguguggaccguggcccagcugggcgaccuggugugcagcgaccaccugcaggagggcaagggcauccuggagaccggcgugcacagccugcugugcagccugcccacccaccugcuggccaagcugagcuucgccagcgacagccaguacuaa

SEQ ID NO: 19118 - RNA, 2118 nt, Artificial Sequence
  L3MBTL2__Homo_sapiens__NP_113676
auggagaagcccagaagcaucgaggagacccccagcagcgagcccauggaggaggaggaggacgacgaccuggagcuguucggcggcuacgacagcuucagaagcuacaacagcagcgugggcagcgagagcagcagcuaccuggaggagagcagcgaggccgagaacgaggacagagaggccggcgagcugcccaccagcccccugcaccugcugagccccggcacccccagaagccuggacggcagcggcagcgagcccgccgugugcgagaugugcggcaucgugggcaccagagaggccuucuucagcaagaccaagagauucugcagcgugagcugcagcagaagcuacagcagcaacagcaagaaggccagcauccuggccagacugcagggcaagccccccaccaagaaggccaaggugcugcacaaggccgccuggagcgccaagaucggcgccuuccugcacagccagggcaccggccagcuggccgacggcacccccaccggccaggacgcccuggugcugggcuucgacuggggcaaguuccugaaggaccacagcuacaaggccgcccccgugagcugcuucaagcacgugccccuguacgaccagugggaggacgugaugaagggcaugaagguggaggugcugaacagcgacgccgugcugcccagcagaguguacuggaucgccagcgugauccagaccgccggcuacagagugcugcugagauacgagggcuucgagaacgacgccagccacgacuucuggugcaaccugggcaccguggacgugcaccccaucggcuggugcgccaucaacagcaagauccuggugccccccagaaccauccacgccaaguucaccgacuggaagggcuaccugaugaagagacuggugggcagcagaacccugcccguggacuuccacaucaagaugguggagagcaugaaguaccccuucagacagggcaugagacuggaggugguggacaagagccaggugagcagaaccagaauggccgugguggacaccgugaucggcggcagacugagacugcuguacgaggacggcgacagcgacgacgacuucuggugccacauguggagcccccugauccaccccgugggcuggagcagaagagugggccacggcaucaagaugagcgagagaagaagcgacauggcccaccaccccaccuucagaaagaucuacugcgacgccgugcccuaccuguucaagaaggugagagccguguacaccgagggcggcugguucgaggagggcaugaagcuggaggccaucgacccccugaaccugggcaacaucugcguggccaccgugugcaaggugcugcuggacggcuaccugaugaucugcguggacggcggccccagcaccgacggccuggacugguucugcuaccacgccagcagccacgccaucuuccccgccaccuucugccagaagaacgacaucgagcugaccccccccaagggcuacgaggcccagaccuucaacugggagaacuaccuggagaagaccaagagcaaggccgcccccagcagacuguucaacauggacugccccaaccacggcuucaaggugggcaugaagcuggaggccguggaccugauggagcccagacugaucugcguggccaccgugaagagaguggugcacagacugcugagcauccacuucgacggcugggacagcgaguacgaccaguggguggacugcgagagccccgacaucuaccccgugggcuggugcgagcugaccggcuaccagcugcagccccccguggccgccgagcccgccaccccccugaaggccaaggaggccaccaagaagaagaagaagcaguucggcaagaagagaaagagaaucccccccaccaagaccagaccccugagacagggcagcaagaagccccugcuggaggacgacccccagggcgccagaaagaucagcagcgagcccgugcccggcgagaucaucgccgugagagugaaggaggagcaccuggacguggccagccccgacaaggccagcagccccgagcugcccgugagcguggagaacaucaagcaggagaccgacgacuaa

SEQ ID NO: 19119 - RNA, 2268 nt, Artificial Sequence
  L3MBTL3__Homo_sapiens__NP_001007103
augaccgagagcgccagcagcaccagcggccaggaguucgacguguucagcgugauggacuggaaggacggcgugggcacccugcccggcagcgaccugaaguucagagugaacgaguucggcgcccuggaggugaucaccgacgagaacgagauggagaacgugaagaaggccaccgccaccaccaccuggauggugcccaccgcccaggagguguucagcgagaagaccggcaugcccuucagacugaaggaccccgugaagguggagggccugcaguucugcgagaacugcugccaguacggcaacguggacgagugccugagcggcggcaacuacugcagccagaacugcgccagacacaucaaggacaaggaccagaaggaggagagagacguggaggaggacaacgaggaggaggaccccaagugcagcagaaagaagaagcccaagcugagccugaaggccgacaccaaggaggacggcgaggagagagacgacgagauggagaacaagcaggacgugagaauccugagaggcagccagagagccagaagaaagagaagaggcgacagcgccgugcugaagcagggccugccccccaagggcaagaaggccuggugcugggccagcuaccuggaggaggagaaggccguggccgugcccgccaagcuguucaaggagcaccagagcuuccccuacaacaagaacggcuucaaggugggcaugaagcuggagggcguggaccccgagcaccagagcguguacugcgugcugaccguggccgaggugugcggcuacagaaucaagcugcacuucgacggcuacagcgacugcuacgacuucugggugaacgccgacgcccuggacauccaccccgugggcuggugcgagaagaccggccacaagcugcacccccccaagggcuacaaggaggaggaguucaacuggcagaccuaccugaagaccugcaaggcccaggccgcccccaagagccuguucgagaaccagaacaucaccgugauccccagcggcuucagagugggcaugaagcuggaggccguggacaagaagaaccccagcuucaucugcguggccaccgugaccgacaugguggacaacagauuccuggugcacuucgacaacugggacgagagcuacgacuacuggugcgaggccagcagcccccacauccaccccgugggcuggugcaaggagcacagaagaacccugaucaccccccccggcuaccccaacgugaagcacuucagcugggacaaguaccuggaggagaccaacagccugcccgcccccgccagagccuucaaggugaagcccccccacggcuuccagaagaagaugaagcuggaggugguggacaagagaaaccccauguucaucagaguggccaccguggccgacaccgacgaccacagagugaaggugcacuucgacggcuggaacaacugcuacgacuacuggaucgacgccgacagccccgacauccaccccgugggcuggugcagcaagaccggccacccccugcagcccccccugagcccccuggagcugauggaggccagcgagcacggcggcugcagcacccccggcugcaagggcaucggccacuucaagagagccagacaccugggcccccacagcgccgccaacugccccuacagcgagaucaaccugaacaaggacagaaucuuccccgacagacugagcggcgagaugccccccgccagccccagcuuccccagaaacaagagaaccgacgccaacgagagcagcagcagccccgagaucagagaccagcacgccgacgacgugaaggaggacuucgaggagagaaccgagagcgagaugagaaccagccacgaggccagaggcgccagagaggagcccaccgugcagcaggcccagagaagaagcgccguguuccugagcuucaagagccccauccccugccugccccugagaugggagcagcagagcaagcugcugcccaccguggccggcauccccgccagcaaggugagcaaguggagcaccgacgaggugagcgaguucauccagagccugcccggcugcgaggagcacggcaagguguucaaggacgagcagaucgacggcgaggccuuccugcugaugacccagaccgacaucgugaagaucaugagcaucaagcugggccccgcccugaagaucuucaacagcauccugauguucaaggccgccgagaagaacagccacaacgagcuguaa

SEQ ID NO: 19120 - RNA, 1872 nt, Artificial Sequence
  L3MBTL4__Homo_sapiens__NP_775735
augaagcagcccaacagaaagagaaagcugaacauggacagcaaggagagacuggaccaggacggcagacuggagcaggccgaggaggagaagaagcccaaggacagcaccaccccccugagccacgugcccagcgccgccgcccagggcgccuggagcugggagugguaccugaaggagcagaaggccguggccgcccccguggagcuguucagcaaggaccagagcuuccccgagcacgagaacggcuuccagaucggcaugagacuggagggcaucgaccccagacaccccagcguguucugcgugcugagcguggccgaggugugcggcuacagacugagacugcacuucgacggcuaccugagcugcuacgacuucuggaccaacgccggcagccccgacauccaccccgugggcuggugcgagaagaccaagcacgagcugcacauccccaagggcuacagaaaggacaaguucguguggauggacuaccugaaggccugcaagcugcagaacgcccccaagaagcuguucagaaacagaagccccaacggccccaugagcaaggaguuccaggugggcaugaagcuggaggccguggacagaaagaaccccagccuggugugcguggccaccaucgccgacaucguggaggacagacugcuggugcacuucgacaacugggacgacagcuacgacuacuggugcgacgugaacagccccuacgugcagcccgugggcuggugccaggagaacggcagaacccugaucgccccccagggcuaccccaaccccgagaacuucagcuggaccgaguaccuggaggccacccagaccaacgccgugcccgccaagguguucaagaugagacugccccacggcuuccugcccaacaugaagcuggaggugguggacaagagaaaccccagacugaucagaguggccaccaucguggacguggacgaccagagagugaaggugcacuucgacggcugggaccacaaguacgacuacuggguggaggccgacagccccgacauccaccccaucggcuggugcgacgugaccggccacccccuggaggugccccagagaaccaacgaccugaagauccugcccggccaggccgugugccccacccccggcugcagaggcaucggccacaucagaggccccagauacagcggccaccacagcgccuucggcugccccuacagcgacaugaaccugaagaaggaggccacccugcacgacagacugagagagcagacccaggccaaccuggagagcgacagcagccacagcaagagcaagagccugugcagccugaacuucaacggcaagcacgagaaggugaacagccagcccagacuggugcagcaggccaagugccugaagaucaagggcaaggaggacaucgaccuggacaaccuguucagagugcuggugcugcaccccagaggccuggaguacagcguggagcaggcccagcaggugcugcaccagagcgugagcaugagcaccgugagcgcccaccccuucagagaccugccccugggcagagagcagcacugcaagcugcugcccggcguggccgacaucagagccagccagguggccagauggaccguggacgagguggccgaguucgugcagagccugcugggcugcgaggagcacgccaagugcuucaagaaggagcagaucgacggcaaggccuuccugcugcugacccagaccgacaucgugaaggugaugaagaucaagcugggccccgcccugaagaucuacaacagcauccugauguucagacacagccaggagcugcccgaggaggacaucgccagcggccaggaggugagaggcuaa

SEQ ID NO: 19121 - RNA, 1293 nt, Artificial Sequence
  LACC1__Homo_sapiens__XP_006719829
auggccgaggccgugcugaucgaccuguucggccugaagcugaacagccagaagaacugccaccagacccugcugaagacccugaacgccgugcaguaccaccacgccgccaaggccaaguuccugugcaucaugugcugcagcaacaucagcuacgagagagacggcgagcaggacaacugcgagaucgagaccagcaacggccugagcgcccugcuggaggaguucgagaucgugagcugccccagcauggccgccacccuguacaccaucaagcagaagaucgacgagaagaaccugagcagcaucaaggugaucgugcccagacacagaaagacccugaugaaggccuucaucgaccagcuguucaccgacguguacaacuucgaguucgaggaccugcaggugaccuucagaggcggccuguucaagcagagcaucgagaucaacgugaucaccgcccaggagcugagaggcauccagaacgagaucgagaccuuccugagaagccugcccgcccugagaggcaagcugaccaucaucaccagcagccugauccccgacaucuucauccacggcuucaccaccagaaccggcggcaucagcuacauccccacccugagcagcuucaaccuguucagcagcagcaagagaagagaccccaaggugguggugcaggagaaccugagaagacuggccaacgccgccggcuucaacguggagaaguucuacagaaucaagacccaccacagcaacgacaucuggaucaugggcagaaaggagcccgacagcuacgacggcaucaccaccaaccagagaggcgugaccaucgccgcccugggcgccgacugcauccccaucguguucgccgaccccgugaagaaggccugcggcguggcccacgccggcuggaagggcacccugcugggcguggccauggccaccgugaacgccaugaucgccgaguacggcugcagccuggaggacaucgugguggugcugggccccagcgugggccccugcugcuucacccugcccagagagagcgccgaggccuuccacaaccugcaccccgccugcgugcagcuguucgacagccccaaccccugcaucgacaucagaaaggccaccagaauccugcuggagcagggcggcauccugccccagaacauccaggaccagaaccaggaccugaaccugugcaccagcugccaccccgacaaguucuucagccacgugagagacggccugaacuucggcacccagaucggcuucaucagcaucaaggaguaa

SEQ ID NO: 19122 - RNA, 1446 nt, Artificial Sequence
  LACE1__Homo_sapiens__NP_660358
auggccgccagcuggagccugcuggugacccugagaccccuggcccagagcccccugagaggcagaugcgugggcugcggcgccugggccgccgcccuggccccccuggccaccgcccccggcaagcccuucuggaaggccuacaccgugcagaccagcgagagcaugacccccaccgccaccagcgagaccuaccugaaggcccuggccgugugccacggcccccuggaccacuacgacuuccugaucaaggcccacgagcugaaggacgacgagcaccagagaagagugauccagugccugcagaagcugcacgaggaccugaagggcuacaacaucgaggccgagggccuguucagcaagcuguucagcagaagcaagccccccagaggccuguacguguacggcgacgugggcaccggcaagaccauggugauggacauguucuacgccuacguggagaugaagagaaagaagagagugcacuuccacggcuucaugcuggacgugcacaagagaauccacagacugaagcagagccugcccaagagaaagcccggcuucauggccaagagcuacgaccccaucgcccccaucgccgaggagaucagcgaggaggccugccugcugugcuucgacgaguuccaggugaccgacaucgccgacgccaugauccugaagcagcuguucgagaaccuguucaagaacggcgugguggugguggccaccagcaacagaccccccgaggaccuguacaagaacggccugcagagagccaacuucgugcccuucaucgccgugcugaaggaguacugcaacaccgugcagcuggacagcggcaucgacuacagaaagagagagcugcccgccgccggcaagcuguacuaccugaccagcgaggccgacguggaggccgugauggacaagcuguucgacgagcuggcccagaagcagaacgaccugaccagacccagaauccugaaggugcagggcagagagcugagacugaacaaggccugcggcaccguggccgacugcaccuucgaggagcugugcgagagaccccugggcgccagcgacuaccuggagcugagcaagaacuucgacaccaucuuccugagaaacaucccccaguucacccuggccaacagaacccagggcagaagauucaucacccugaucgacaacuucuacgaccugaaggugagaaucaucugcagcgccagcacccccaucagcagccuguuccugcaccagcaccacgacagcgagcuggagcagagcagaauccugauggacgaccugggccugagccaggacagcgccgagggccugagcauguucaccggcgaggaggagaucuucgccuuccagagaaccaucagcagacugaccgagaugcagaccgagcaguacuggaacgagggcgacagaaccaagaaguaa

SEQ ID NO: 19123 - RNA, 417 nt, Artificial Sequence
  LACRT__Homo_sapiens__NP_150593
augaaguucaccacccugcuguuccuggccgccguggccggcgcccugguguacgccgaggacgccagcagcgacagcaccggcgccgaccccgcccaggaggccggcaccagcaagcccaacgaggagaucagcggccccgccgagcccgccagcccccccgagaccaccaccaccgcccaggagaccagcgccgccgccgugcagggcaccgccaaggugaccagcagcagacaggagcugaacccccugaagagcaucguggagaagagcauccugcugaccgagcaggcccuggccaaggccggcaagggcaugcacggcggcgugcccggcggcaagcaguucaucgagaacggcagcgaguucgcccagaagcugcugaagaaguucagccugcugaagcccugggccuaa

SEQ ID NO: 19124 - RNA, 1644 nt, Artificial Sequence
  LACTB__Homo_sapiens__NP_116246
auguacagacugaugagcgccgugaccgccagagccgccgcccccggcggccuggccagcagcugcggcagaagaggcgugcaccagagagccggccugcccccccugggccacggcugggugggcggccugggccugggccugggccuggcccugggcgugaagcuggccggcggccugagaggcgccgcccccgcccagagccccgccgcccccgaccccgaggccagcccccuggccgagcccccccaggagcagagccuggcccccuggagcccccagacccccgccccccccugcagcagaugcuucgccagagccaucgagagcagcagagaccugcugcacagaaucaaggacgaggugggcgcccccggcaucguggugggcgugagcguggacggcaaggagguguggagcgagggccugggcuacgccgacguggagaacagagugcccugcaagcccgagaccgugaugagaaucgccagcaucagcaagagccugaccaugguggcccuggccaagcugugggaggccggcaagcuggaccuggacauccccgugcagcacuacgugcccgaguuccccgagaaggaguacgagggcgagaaggugagcgugaccaccagacugcugaucagccaccugagcggcaucagacacuacgagaaggacaucaagaaggugaaggaggagaaggccuacaaggcccugaagaugaugaaggagaacguggccuucgagcaggagaaggagggcaagagcaacgagaagaacgacuucaccaaguucaagaccgagcaggagaacgaggccaagugcagaaacagcaagcccggcaagaagaagaacgacuucgagcagggcgagcuguaccugagagagaaguucgagaacagcaucgagagccugagacuguucaagaacgacccccuguucuucaagcccggcagccaguuccuguacagcaccuucggcuacacccugcuggccgccaucguggagagagccagcggcugcaaguaccuggacuacaugcagaagaucuuccacgaccuggacaugcugaccaccgugcaggaggagaacgagcccgugaucuacaacagagccagauucuacguguacaacaagaagaagagacuggugaacacccccuacguggacaacagcuacaagugggccggcggcggcuuccugagcaccgugggcgaccugcugaaguucggcaacgccaugcuguacggcuaccaggugggccuguucaagaacagcaacgagaaccugcugcccggcuaccugaagcccgagaccauggugaugauguggacccccgugcccaacaccgagaugagcugggacaaggagggcaaguacgccauggccuggggcgugguggagagaaagcagaccuacggcagcugcagaaagcagagacacuacgccagccacaccggcggcgccgugggcgccagcagcgugcugcuggugcugcccgaggagcuggacaccgagaccaucaacaacaaggugccccccagaggcaucaucgugagcaucaucugcaacaugcagagcgugggccugaacagcaccgcccugaagaucgcccuggaguucgacaaggacagaagcgacuaa

SEQ ID NO: 19125 - RNA, 1554 nt, Artificial Sequence
  LAD1__Homo_sapiens__NP_005549
auggccgugagcagaaaggacuggagcgcccugagcagccuggccagacagagaacccuggaggacgaggaggagcaggagagagagagaagaagaagacacagaaaccugagcagcaccaccgacgacgaggcccccagacugagccagaacggcgacagacaggccagcgccagcgagagacugcccagcguggaggaggccgaggugcccaagccccugccccccgccagcaaggacgaggacgaggacauccagagcauccugagaaccagacaggagagaagacagagaagacaggugguggaggccgcccaggcccccauccaggagagacuggaggccgaggagggcagaaacagccugagccccgugcaggccacccagaagccccuggugagcaagaaggagcuggagaucccccccagaagaagacugagcagagagcagagaggccccugggcccuggaggaggagagccuggugggcagagagcccgaggagagaaagaagggcgugcccgagaagagccccgugcuggagaagagcagcaugcccaagaagaccgcccccgagaagagccuggugagcgacaagaccagcaucagcgagaaggugcuggccagcgagaagaccagccugagcgagaagaucgccgugagcgagaagagaaacagcagcgagaagaagagcgugcuggagaagaccagcgugagcgagaagagccuggcccccggcauggcccugggcagcggcagaagacuggugagcgagaaggccagcaucuucgagaaggcccuggccagcgagaagagccccaccgccgacgccaagcccgcccccaagagagccaccgccagcgagcagccccuggcccaggagccccccgccagcggcggcagccccgccaccaccaaggagcagagaggcagagcccugcccggcaagaaccugcccagccuggccaagcagggcgccagcgacccccccaccguggccagcagacugccccccgugacccugcaggugaagauccccagcaaggaggaggaggccgacaugagcagccccacccagagaaccuacagcagcagccugaagagaagcagccccagaaccaucagcuucagaaugaagcccaagaaggagaacagcgagaccacccugaccagaagcgccagcaugaagcugcccgacaacaccgugaagcugggcgagaagcuggagagauaccacaccgccaucagaagaagcgagagcgugaagagcagaggccugcccugcaccgagcuguucguggcccccgugggcguggccagcaagagacaccuguucgagaaggagcuggccggccagagcagagccgagcccgccagcagcagaaaggagaaccugagacugagcggcguggugaccagcagacugaaccuguggaucagcagaacccaggagagcggcgaccaggacccccaggaggcccagaaggccagcagcgccaccgagagaacccaguggggccagaagagcgacagcagccuggacgccgagguguaa

SEQ ID NO: 19126 - RNA, 1578 nt, Artificial Sequence
  LAG3__Homo_sapiens__NP_002277
augugggaggcccaguuccugggccugcuguuccugcagccccuguggguggcccccgugaagccccugcagcccggcgccgaggugcccguggugugggcccaggagggcgcccccgcccagcugcccugcagccccaccaucccccugcaggaccugagccugcugagaagagccggcgugaccuggcagcaccagcccgacagcggcccccccgccgccgcccccggccacccccuggcccccggcccccaccccgccgcccccagcagcuggggccccagacccagaagauacaccgugcugagcgugggccccggcggccugagaagcggcagacugccccugcagcccagagugcagcuggacgagagaggcagacagagaggcgacuucagccuguggcugagacccgccagaagagccgacgccggcgaguacagagccgccgugcaccugagagacagagcccugagcugcagacugagacugagacugggccaggccagcaugaccgccagcccccccggcagccugagagccagcgacugggugauccugaacugcagcuucagcagacccgacagacccgccagcgugcacugguucagaaacagaggccagggcagagugcccgugagagagagcccccaccaccaccuggccgagagcuuccuguuccugccccaggugagccccauggacagcggccccuggggcugcauccugaccuacagagacggcuucaacgugagcaucauguacaaccugaccgugcugggccuggagccccccaccccccugaccguguacgccggcgccggcagcagagugggccugcccugcagacugcccgccggcgugggcaccagaagcuuccugaccgccaaguggaccccccccggcggcggccccgaccugcuggugaccggcgacaacggcgacuucacccugagacuggaggacgugagccaggcccaggccggcaccuacaccugccacauccaccugcaggagcagcagcugaacgccaccgugacccuggccaucaucaccgugacccccaagagcuucggcagccccggcagccugggcaagcugcugugcgaggugacccccgugagcggccaggagagauucguguggagcagccuggacacccccagccagagaagcuucagcggccccuggcuggaggcccaggaggcccagcugcugagccagcccuggcagugccagcuguaccagggcgagagacugcugggcgccgccguguacuucaccgagcugagcagccccggcgcccagagaagcggcagagcccccggcgcccugcccgccggccaccugcugcuguuccugauccugggcgugcugagccugcugcugcuggugaccggcgccuucggcuuccaccuguggagaagacaguggagacccagaagauucagcgcccuggagcagggcauccaccccccccaggcccagagcaagaucgaggagcuggagcaggagcccgagcccgagcccgagcccgagcccgagcccgagcccgagcccgagcccgagcagcuguaa

SEQ ID NO: 19127 - RNA, 843 nt, Artificial Sequence
  LAIR1__Homo_sapiens__NP_001275955
auggagagagagauggugcugugccuggcccagaccauccacacccaggaggaccugcccagacccagcaucagcgccgagcccggcaccgugaucccccugggcagccacgugaccuucgugugcagaggccccgugggcgugcagaccuucagacuggagagagacagcagaagcaccuacaacgacaccgaggacgugagccaggccagccccagcgagagcgaggccagauucagaaucgacagcgugagagagggcaacgccggccuguacagaugcaucuacuacaagccccccaaguggagcgagcagagcgacuaccuggagcugcuggugaaggagagcagcggcggccccgacagccccgacaccgagcccggcagcagcgccggccccacccagagacccagcgacaacagccacaacgagcacgcccccgccagccagggccugaaggccgagcaccuguacauccugaucggcgugagcgugguguuccuguucugccugcugcugcuggugcuguucugccugcacagacagaaccagaucaagcagggcccccccagaagcaaggacgaggagcagaagccccagcagagacccgaccuggccguggacgugcuggagagaaccgccgacaaggccaccgugaacggccugcccgagaaggacagagagaccgacaccagcgcccuggccgccggcagcagccaggaggugaccuacgcccagcuggaccacugggcccugacccagagaaccgccagagccgugagcccccagagcaccaagcccauggccgagagcaucaccuacgccgccguggccagacacuaa

SEQ ID NO: 19128 - RNA, 459 nt, Artificial Sequence
  LAIR2__Homo_sapiens__NP_002279
augagcccccaccugaccgcccugcugggccuggugcugugccuggcccagaccauccacacccaggagggcgcccugcccagacccagcaucagcgccgagcccggcaccgugaucagccccggcagccacgugaccuucaugugcagaggccccgugggcgugcagaccuucagacuggagagagaggacagagccaaguacaaggacagcuacaacguguucagacugggccccagcgagagcgaggccagauuccacaucgacagcgugagcgagggcaacgccggccuguacagaugccuguacuacaagccccccggcuggagcgagcacagcgacuuccuggagcugcuggugaaggagagcagcggcggccccgacagccccgacaccgagcccggcagcagcgccggcaccgugcccggcaccgaggccagcggcuucgacgcccccuaa

SEQ ID NO: 19129 - RNA, 462 nt, Artificial Sequence
  LALBA__Homo_sapiens__XP_011536644
auggaggaccugcaguuccugggcguggccaagaugagauucuucgugccccuguuccuggugggcauccuguuccccgccauccuggccaagcaguucaccaagugcgagcugagccagcugcugaaggacaucgacggcuacggcggcaucgcccugcccgagcugaucugcaccauguuccacaccagcggcuacgacacccaggccaucguggagaacaacgagagcaccgaguacggccuguuccagaucagcaacaagcuguggugcaagagcagccaggugccccagagcagaaacaucugcgacaucagcugcgacaaguuccuggacgacgacaucaccgacgacaucaugugcgccaagaagauccuggacaucaagggcaucgacuacuggcuggcccacaaggcccugugcaccgagaagcuggagcaguggcugugcgagaagcuguaa

SEQ ID NO: 19130 - RNA, 9228 nt, Artificial Sequence
  LAMA1__Homo_sapiens__NP_005550
augagaggcggcgugcugcuggugcugcugcugugcguggccgcccagugcagacagagaggccuguuccccgccauccugaaccuggccagcaacgcccacaucagcaccaacgccaccugcggcgagaagggccccgagauguucugcaagcugguggagcacgugcccggcagacccgugagaaacccccagugcagaaucugcgacggcaacagcgccaaccccagagagagacaccccaucagccacgccaucgacggcaccaacaacugguggcagagccccagcauccagaacggcagagaguaccacugggugaccaucacccuggaccugagacagguguuccagguggccuacgugaucaucaaggccgccaacgcccccagacccggcaacuggauccuggagagaagccuggacggcaccaccuucagccccuggcaguacuacgccgugagcgacagcgagugccugagcagauacaacaucacccccagaagaggcccccccaccuacagagccgacgacgaggugaucugcaccagcuacuacagcagacuggugccccuggagcacggcgagauccacaccagccugaucaacggcagacccagcgccgacgaccugagccccaagcugcuggaguucaccagcgccagauacaucagacugagacugcagagaaucagaacccugaacgccgaccugaugacccugagccacagagagcccaaggagcuggaccccaucgugaccagaagauacuacuacagcaucaaggacaucagcgugggcggcaugugcaucugcuacggccacgccagcagcugccccugggacgagaccaccaagaagcugcagugccagugcgagcacaacaccugcggcgagagcugcaacagaugcugccccggcuaccaccagcagcccuggagacccggcaccgugagcagcggcaacaccugcgaggccugcaacugccacaacaaggccaaggacugcuacuacgacgagagcguggccaagcagaagaagagccugaacaccgccggccaguucagaggcggcggcgugugcaucaacugccugcagaacaccaugggcaucaacugcgagaccugcaucgacggcuacuacagaccccacaaggugagccccuacgaggacgagcccugcagacccugcaacugcgaccccgugggcagccugagcagcgugugcaucaaggacgaccugcacagcgaccugcacaacggcaagcagcccggccagugccccugcaaggagggcuacaccggcgagaagugcgacagaugccagcugggcuacaaggacuaccccaccugcgugagcugcggcugcaaccccgugggcagcgccagcgacgagcccugcaccggccccugcgugugcaaggagaacguggagggcaaggccugcgacagaugcaagcccggcuucuacaaccugaaggagaagaaccccagaggcugcagcgagugcuucugcuucggcgugagcgacgugugcagcagccugagcuggcccgugggccaggugaacagcaugagcggcuggcuggugaccgaccugaucagccccagaaagauccccagccagcaggacgcccugggcggcagacaccaggugagcaucaacaacaccgccgugaugcagagacuggcccccaaguacuacugggccgcccccgaggccuaccugggcaacaagcugaccgccuucggcggcuuccugaaguacaccgugagcuacgacauccccguggagaccguggacagcaaccugaugagccacgccgacgugaucaucaagggcaacggccugacccugagcacccaggccgagggccugagccugcagcccuacgaggaguaccugaacguggugagacuggugcccgagaacuuccaggacuuccacagcaagagacagaucgacagagaccagcugaugaccgugcuggccaacgugacccaccugcugaucagagccaacuacaacagcgccaagauggcccuguacagacuggagagcgugagccuggacaucgccagcagcaacgccaucgaccuggugguggccgccgacguggagcacugcgagugcccccagggcuacaccggcaccagcugcgagagcugccugagcggcuacuacagaguggacggcauccuguucggcggcaucugccagcccugcgagugccacggccacgccgccgagugcaacgugcacggcgugugcaucgccugcgcccacaacaccaccggcgugcacugcgagcagugccugcccggcuucuacggcgagcccagcagaggcacccccggcgacugccagcccugcgccugcccccugaccaucgccagcaacaacuucagccccaccugccaccugaacgacggcgacgagguggugugcgacuggugcgcccccggcuacagcggcgccuggugcgagagaugcgccgacggcuacuacggcaaccccaccgugcccggcgagagcugcgugcccugcgacugcagcggcaacguggaccccagcgaggccggccacugcgacagcgugaccggcgagugccugaagugccugggcaacaccgacggcgcccacugcgagagaugcgccgacggcuucuacggcgacgccgugaccgccaagaacugcagagccugcgagugccacgugaagggcagccacagcgccgugugccaccuggagaccggccugugcgacugcaagcccaacgugaccggccagcagugcgaccagugccugcacggcuacuacggccuggacagcggccacggcugcagacccugcaacugcagcguggccggcagcgugagcgacggcugcaccgacgagggccagugccacugcgugcccggcguggccggcaagagaugcgacagaugcgcccacggcuucuacgccuaccaggacggcagcugcacccccugcgacugcccccacacccagaacaccugcgaccccgagaccggcgagugcgugugccccccccacacccagggcgugaagugcgaggagugcgaggacggccacuggggcuacgacgccgaggugggcugccaggccugcaacugcagccuggugggcagcacccaccacagaugcgacguggugaccggccacugccagugcaagagcaaguucggcggcagagccugcgaccagugcagccugggcuacagagacuuccccgacugcgugcccugcgacugcgaccugagaggcaccagcggcgacgccugcaaccuggagcagggccugugcggcugcguggaggagaccggcgccugccccugcaaggagaacguguucggcccccagugcaacgagugcagagagggcaccuucgcccugagagccgacaacccccugggcugcagccccugcuucugcagcggccugagccaccugugcagcgagcuggaggacuacgugagaacccccgugacccugggcagcgaccagccccugcugagaguggugagccagagcaaccugagaggcaccaccgagggcguguacuaccaggcccccgacuuccugcuggacgccgccaccgugagacagcacaucagagccgagcccuucuacuggagacugccccagcaguuccagggcgaccagcugauggccuacggcggcaagcugaaguacagcguggccuucuacagccuggacggcgugggcaccagcaacuucgagccccaggugcugaucaagggcggcagaaucagaaagcaggugaucuacauggacgcccccgcccccgagaacggcgugagacaggagcaggagguggccaugagagagaacuucuggaaguacuucaacagcgugagcgagaagcccgugaccagagaggacuucaugagcgugcugagcgacaucgaguacauccugaucaaggccagcuacggccagggccugcagcagagcagaaucagcgacaucagcauggaggugggcagaaaggccgagaagcugcaccccgaggaggagguggccagccugcuggagaacugcgugugcccccccggcaccgugggcuucagcugccaggacugcgcccccggcuaccacagaggcaagcugcccgccggcagcgacagaggccccagaccccugguggcccccugcgugcccugcagcugcaacaaccacagcgacaccugcgaccccaacaccggcaagugccugaacugcggcgacaacaccgccggcgaccacugcgacgugugcaccagcggcuacuacggcaaggugaccggcagcgccagcgacugcgcccugugcgccugcccccacagcccccccgccagcuucagccccaccugcgugcuggagggcgaccacgacuucagaugcgacgccugccugcugggcuacgagggcaagcacugcgagagaugcagcagcagcuacuacggcaacccccagacccccggcggcagcugccagaagugcgacugcaacccccacggcagcgugcacggcgacugcgacagaaccagcggccagugcgugugcagacugggcgccagcggccugagaugcgacgagugcgagcccagacacauccugauggagaccgacugcgugagcugcgacgacgagugcgugggcgugcugcugaacgaccuggacgagaucggcgacgccgugcugagccugaaccugaccggcaucauccccgugcccuacggcauccugagcaaccuggagaacaccaccaaguaccugcaggagagccugcugaaggagaacaugcagaaggaccugggcaagaucaagcuggagggcguggccgaggagaccgacaaccugcagaagaagcugaccagaaugcuggccagcacccagaaggugaacagagccaccgagagaaucuucaaggagagccaggaccuggccaucgccaucgagagacugcagaugagcaucaccgagaucauggagaagaccacccugaaccagacccuggacgaggacuuccugcugcccaacagcacccugcagaacaugcagcagaacggcaccagccugcuggagaucaugcagaucagagacuucacccagcugcaccagaacgccacccuggagcugaaggccgccgaggaccugcugagccagauccaggagaacuaccagaagccccuggaggagcuggaggugcugaaggaggccgccagccacgugcugagcaagcacaacaacgagcugaaggccgccgaggcccuggugagagaggccgaggccaagaugcaggagagcaaccaccugcugcugauggugaacgccaaccugagagaguucagcgacaagaagcugcacgugcaggaggagcagaaccugaccagcgagcugaucgugcagggcagaggccugaucgacgccgccgccgcccagaccgacgccgugcaggacgcccuggagcaccuggaggaccaccaggacaagcugcugcuguggagcgccaagaucagacaccacaucgacgaccuggugaugcacaugagccagagaaacgccguggaccugguguacagagccgaggaccacgccgccgaguuccagagacuggccgacgugcuguacagcggccuggagaacaucagaaacgugagccugaacgccaccagcgccgccuacgugcacuacaacauccagagccugaucgaggagagcgaggagcuggccagagacgcccacagaaccgugaccgagaccagccugcugagcgagagccuggugagcaacggcaaggccgccgugcagagaagcagcagauuccugaaggagggcaacaaccugagcagaaagcugcccggcaucgcccuggagcugagcgagcugagaaacaagaccaacagauuccaggagaacgccguggagaucaccagacagaccaacgagagccugcugauccugagagccauccccaagggcaucagagacaagggcgccaagaccaaggagcuggccaccagcgccagccagagcgccgugagcacccugagagacguggccggccugagccaggagcugcugaacaccagcgccagccugagcagagugaacaccacccugagagagacccaccagcugcugcaggacagcaccauggccacccugcuggccggcagaaaggugaaggacguggagauccaggccaaccugcuguucgacagacugaagccccugaagaugcuggaggagaaccugagcagaaaccugagcgagaucaagcugcugaucagccaggccagaaagcaggccgccagcaucaagguggccgugagcgccgacagagacugcaucagagccuaccagccccagaucagcagcaccaacuacaacacccugacccugaacgugaagacccaggagcccgacaaccugcuguucuaccugggcagcagcaccgccagcgacuuccuggccguggagaugagaagaggcagaguggccuuccugugggaccugggcagcggcagcaccagacuggaguuccccgacuuccccaucgacgacaacagauggcacagcauccacguggccagauucggcaacaucggcagccugagcgugaaggagaugagcagcaaccagaagagccccaccaagaccagcaagagccccggcaccgccaacgugcuggacgugaacaacagcacccugauguucgugggcggccugggcggccagaucaagaagagccccgccgugaaggugacccacuucaagggcugccugggcgaggccuuccugaacggcaagagcaucggccuguggaacuacaucgagagagagggcaagugcagaggcugcuucggcagcagccagaacgaggaccccagcuuccacuucgacggcagcggcuacagcgugguggagaagagccugcccgccaccgugacccagaucaucaugcuguucaacaccuucagccccaacggccugcugcuguaccugggcagcuacggcaccaaggacuuccugagcaucgagcuguucagaggcagagugaaggugaugaccgaccugggcagcggccccaucacccugcugaccgacagaagauacaacaacggcaccugguacaagaucgccuuccagagaaacagaaagcagggcgugcuggccgugaucgacgccuacaacaccagcaacaaggagaccaagcagggcgagacccccggcgccagcagcgaccugaacagacuggacaaggaccccaucuacgugggcggccugcccagaagcagaguggugagaagaggcgugaccaccaagagcuucgugggcugcaucaagaaccuggagaucagcagaagcaccuucgaccugcugagaaacagcuacggcgugagaaagggcugccugcuggagcccaucagaagcgugagcuuccugaagggcggcuacaucgagcugccccccaagagccugagccccgagagcgaguggcuggugaccuucgccaccaccaacagcagcggcaucauccuggccgcccugggcggcgacguggagaagagaggcgacagagaggaggcccacgugcccuucuucagcgugaugcugaucggcggcaacaucgaggugcacgugaaccccggcgacggcaccggccugagaaaggcccugcugcacgcccccaccggcaccugcagcgacggccaggcccacagcaucagccuggugagaaacagaagaaucaucaccgugcagcuggacgagaacaaccccguggagaugaagcugggcacccugguggagagcagaaccaucaacgugagcaaccuguacgugggcggcauccccgagggcgagggcaccagccugcugaccaugagaagaagcuuccacggcugcaucaagaaccugaucuucaaccuggagcugcuggacuucaacagcgccgugggccacgagcagguggaccuggacaccugcuggcugagcgagagacccaagcuggcccccgacgccgaggacagcaagcugcugcccgagcccagagccuuccccgagcagugcgugguggacgccgcccuggaguacgugcccggcgcccaccaguucggccugacccagaacagccacuucauccugcccuucaaccagagcgccgugagaaagaagcugagcguggagcugagcaucagaaccuucgccagcagcggccugaucuacuacauggcccaccagaaccaggccgacuacgccgugcugcagcugcacggcggcagacugcacuucauguucgaccugggcaagggcagaaccaaggugagccaccccgcccugcugagcgacggcaaguggcacaccgugaagaccgacuacgugaagagaaagggcuucaucaccguggacggcagagagagccccauggugaccguggugggcgacggcaccaugcuggacguggagggccuguucuaccugggcggccugcccagccaguaccaggccagaaagaucggcaacaucacccacagcauccccgccugcaucggcgacgugaccgugaacagcaagcagcuggacaaggacagccccgugagcgccuucaccgugaacagaugcuacgccguggcccaggagggcaccuacuucgacggcagcggcuacgccgcccuggugaaggagggcuacaaggugcagagcgacgugaacaucacccuggaguucagaaccagcagccagaacggcgugcugcugggcaucagcaccgccaagguggacgccaucggccuggagcugguggacggcaaggugcuguuccacgugaacaacggcgccggcagaaucaccgccgccuacgagcccaagaccgccaccgugcugugcgacggcaaguggcacacccugcaggccaacaagagcaagcacagaaucacccugaucguggacggcaacgccgugggcgccgagagcccccacacccagagcaccagcguggacaccaacaaccccaucuacgugggcggcuaccccgccggcgugaagcagaagugccugagaagccagaccagcuucagaggcugccugagaaagcuggcccugaucaagagcccccaggugcagagcuucgacuucagcagagccuucgagcugcacggcguguuccugcacagcugccccggcaccgagagcuaa

SEQ ID NO: 19131 - RNA, 9369 nt, Artificial Sequence
  LAMA2__Homo_sapiens__NP_000417
augcccggcgccgccggcgugcugcugcugcugcugcugagcggcggccugggcggcgugcaggcccagagaccccagcagcagagacagagccaggcccaccagcagagaggccuguuccccgccgugcugaaccuggccagcaacgcccugaucaccaccaacgccaccugcggcgagaagggccccgagauguacugcaagcugguggagcacgugcccggccagcccgugagaaacccccagugcagaaucugcaaccagaacagcagcaaccccaaccagagacaccccaucaccaacgccaucgacggcaagaacaccugguggcagagccccagcaucaagaacggcaucgaguaccacuacgugaccaucacccuggaccugcagcagguguuccagaucgccuacgugaucgugaaggccgccaacagccccagacccggcaacuggauccuggagagaagccuggacgacguggaguacaagcccuggcaguaccacgccgugaccgacaccgagugccugacccuguacaacaucuaccccagaaccggcccccccagcuacgccaaggacgacgaggugaucugcaccagcuucuacagcaagauccacccccuggagaacggcgagauccacaucagccugaucaacggcagacccagcgccgacgaccccagccccgagcugcuggaguucaccagcgccagauacaucagacugagauuccagagaaucagaacccugaacgccgaccugaugauguucgcccacaaggaccccagagagaucgaccccaucgugaccagaagauacuacuacagcgugaaggacaucagcgugggcggcaugugcaucugcuacggccacgccagagccugcccccuggaccccgccaccaacaagagcagaugcgagugcgagcacaacaccugcggcgacagcugcgaccagugcugccccggcuuccaccagaagcccuggagagccggcaccuuccugaccaagaccgagugcgaggccugcaacugccacggcaaggccgaggagugcuacuacgacgagaacguggccagaagaaaccugagccugaacaucagaggcaaguacaucggcggcggcgugugcaucaacugcacccagaacaccgccggcaucaacugcgagaccugcaccgacggcuucuucagacccaagggcgugagccccaacuaccccagacccugccagcccugccacugcgaccccaucggcagccugaacgaggugugcgugaaggacgagaagcacgccagaagaggccuggcccccggcagcugccacugcaagaccggcuucggcggcgugagcugcgacagaugcgccagaggcuacaccggcuaccccgacugcaaggccugcaacugcagcggccugggcagcaagaacgaggaccccugcuucggccccugcaucugcaaggagaacguggagggcggcgacugcagcagaugcaagagcggcuucuucaaccugcaggaggacaacuggaagggcugcgacgagugcuucugcagcggcgugagcaacagaugccagagcagcuacuggaccuacggcaagauccaggacaugagcggcugguaccugaccgaccugcccggcagaaucagaguggccccccagcaggacgaccuggacagcccccagcagaucagcaucagcaacgccgaggccagacaggcccugccccacagcuacuacuggagcgcccccgcccccuaccugggcaacaagcugcccgccgugggcggccagcugaccuucaccaucagcuacgaccuggaggaggaggaggaggacaccgagagagugcugcagcugaugaucauccuggagggcaacgaccugagcaucagcaccgcccaggacgagguguaccugcaccccagcgaggagcacaccaacgugcugcugcugaaggaggagagcuucaccauccacggcacccacuuccccgugagaagaaaggaguucaugaccgugcuggccaaccugaagagagugcugcugcagaucaccuacagcuucggcauggacgccaucuucagacugagcagcgugaaccuggagagcgccgugagcuaccccaccgacggcagcaucgccgccgccguggaggugugccagugcccccccggcuacaccggcagcagcugcgagagcugcuggcccagacacagaagagugaacggcaccaucuucggcggcaucugcgagcccugccagugcuucggccacgccgagagcugcgacgacgugaccggcgagugccugaacugcaaggaccacaccggcggccccuacugcgacaagugccugcccggcuucuacggcgagcccaccaagggcaccagcgaggacugccagcccugcgccugcccccugaacauccccagcaacaacuucagccccaccugccaccuggacagaagccugggccugaucugcgacggcugccccgugggcuacaccggccccagaugcgagagaugcgccgagggcuacuucggccagcccagcgugcccggcggcagcugccagcccugccagugcaacgacaaccuggacuucagcauccccggcagcugcgacagccugagcggcagcugccugaucugcaagcccggcaccaccggcagauacugcgagcugugcgccgacggcuacuucggcgacgccguggacgccaagaacugccagcccugcagaugcaacgccggcggcagcuucagcgaggugugccacagccagaccggccagugcgagugcagagccaacgugcagggccagagaugcgacaagugcaaggccggcaccuucggccugcagagcgccagaggcugcgugcccugcaacugcaacagcuucggcagcaagagcuucgacugcgaggagagcggccagugcuggugccagcccggcgugaccggcaagaagugcgacagaugcgcccacggcuacuucaacuuccaggagggcggcugcaccgccugcgagugcagccaccugggcaacaacugcgaccccaagaccggcagaugcaucugcccccccaacaccaucggcgagaagugcagcaagugcgcccccaacaccuggggccacagcaucaccaccggcugcaaggccugcaacugcagcaccgugggcagccuggacuuccagugcaacgugaacaccggccagugcaacugccaccccaaguucagcggcgccaagugcaccgagugcagcagaggccacuggaacuaccccagaugcaaccugugcgacugcuuccugcccggcaccgacgccaccaccugcgacagcgagaccaagaagugcagcugcagcgaccagaccggccagugcaccugcaaggugaacguggagggcauccacugcgacagaugcagacccggcaaguucggccuggacgccaagaacccccugggcugcagcagcugcuacugcuucggcaccaccacccagugcagcgaggccaagggccugaucagaaccugggugacccugaaggccgagcagaccauccugccccugguggacgaggcccugcagcacaccaccaccaagggcaucguguuccagcaccccgagaucguggcccacauggaccugaugagagaggaccugcaccuggagcccuucuacuggaagcugcccgagcaguucgagggcaagaagcugauggccuacggcggcaagcugaaguacgccaucuacuucgaggccagagaggagaccggcuucagcaccuacaacccccaggugaucaucagaggcggcacccccacccacgccagaaucaucgugagacacauggccgccccccugaucggccagcugaccagacacgagaucgagaugaccgagaaggaguggaaguacuacggcgacgaccccagagugcacagaaccgugaccagagaggacuuccuggacauccuguacgacauccacuacauccugaucaaggccaccuacggcaacuucaugagacagagcagaaucagcgagaucagcauggagguggccgagcagggcagaggcaccaccaugaccccccccgccgaccugaucgagaagugcgacugcccccugggcuacagcggccugagcugcgaggccugccugcccggcuucuacagacugagaagccagcccggcggcagaacccccggccccacccugggcaccugcgugcccugccagugcaacggccacagcagccugugcgaccccgagaccagcaucugccagaacugccagcaccacaccgccggcgacuucugcgagagaugcgcccugggcuacuacggcaucgugaagggccugcccaacgacugccagcagugcgccugcccccugaucagcagcagcaacaacuucagccccagcugcguggccgagggccuggacgacuacagaugcaccgccugccccagaggcuacgagggccaguacugcgagagaugcgcccccggcuacaccggcagccccggcaaccccggcggcagcugccaggagugcgagugcgaccccuacggcagccugcccgugcccugcgaccccgugaccggcuucugcaccugcagacccggcgccaccggcagaaagugcgacggcugcaagcacuggcacgccagagagggcugggagugcguguucugcggcgacgagugcaccggccugcugcugggcgaccuggccagacuggagcagauggugaugagcaucaaccugaccggcccccugcccgcccccuacaagaugcuguacggccuggagaacaugacccaggagcugaagcaccugcugagcccccagagagcccccgagagacugauccagcuggccgagggcaaccugaacacccuggugaccgagaugaacgagcugcugaccagagccaccaaggugaccgccgacggcgagcagaccggccaggacgccgagagaaccaacaccagagccaagagccugggcgaguucaucaaggagcuggccagagacgccgaggccgugaacgagaaggccaucaagcugaacgagacccugggcaccagagacgaggccuucgagagaaaccuggagggccugcagaaggagaucgaccagaugaucaaggagcugagaagaaagaaccuggagacccagaaggagaucgccgaggacgagcugguggccgccgaggcccugcugaagaaggugaagaagcuguucggcgagagcagaggcgagaacgaggagauggagaaggaccugagagagaagcuggccgacuacaagaacaagguggacgacgccugggaccugcugagagaggccaccgacaagaucagagaggccaacagacuguucgccgugaaccagaagaacaugaccgcccuggagaagaagaaggaggccguggagagcggcaagagacagaucgagaacacccugaaggagggcaacgacauccuggacgaggccaacagacuggccgacgagaucaacagcaucaucgacuacguggaggacauccagaccaagcugccccccaugagcgaggagcugaacgacaagaucgacgaccugagccaggagaucaaggacagaaagcuggccgagaaggugagccaggccgagagccacgccgcccagcugaacgacagcagcgccgugcuggacggcauccuggacgaggccaagaacaucagcuucaacgccaccgccgccuucaaggccuacagcaacaucaaggacuacaucgacgaggccgagaagguggccaaggaggccaaggaccuggcccacgaggccaccaagcuggccaccggccccagaggccugcugaaggaggacgccaagggcugccugcagaagagcuucagaauccugaacgaggccaagaagcuggccaacgacgugaaggagaacgaggaccaccugaacggccugaagaccagaaucgagaacgccgacgccagaaacggcgaccugcugagaacccugaacgacacccugggcaagcugagcgccauccccaacgacaccgccgccaagcugcaggccgugaaggacaaggccagacaggccaacgacaccgccaaggacgugcuggcccagaucaccgagcugcaccagaaccuggacggccugaagaagaacuacaacaagcuggccgacagcguggccaagaccaacgccguggugaaggaccccagcaagaacaagaucaucgccgacgccgacgccaccgugaagaaccuggagcaggaggccgacagacugaucgacaagcugaagcccaucaaggagcuggaggacaaccugaagaagaacaucagcgagaucaaggagcugaucaaccaggccagaaagcaggccaacagcaucaaggugagcgugagcagcggcggcgacugcaucagaaccuacaagcccgagaucaagaagggcagcuacaacaacaucguggugaacgugaagaccgccguggccgacaaccugcuguucuaccugggcagcgccaaguucaucgacuuccuggccaucgagaugagaaagggcaaggugagcuuccugugggacgugggcagcggcgugggcagaguggaguaccccgaccugaccaucgacgacagcuacugguacagaaucguggccagcagaaccggcagaaacggcaccaucagcgugagagcccuggacggccccaaggccagcaucgugcccagcacccaccacagcaccagcccccccggcuacaccauccuggacguggacgccaacgccaugcuguucgugggcggccugaccggcaagcugaagaaggccgacgccgugagagugaucaccuucaccggcugcaugggcgagaccuacuucgacaacaagcccaucggccuguggaacuucagagagaaggagggcgacugcaagggcugcaccgugagcccccagguggaggacagcgagggcaccauccaguucgacggcgagggcuacgcccuggugagcagacccaucagaugguaccccaacaucagcaccgugauguucaaguucagaaccuucagcagcagcgcccugcugauguaccuggccaccagagaccugagagacuucaugagcguggagcugaccgacggccacaucaaggugagcuacgaccugggcagcggcauggccagcguggugagcaaccagaaccacaacgacggcaaguggaagagcuucacccugagcagaauccagaagcaggccaacaucagcaucguggacaucgacaccaaccaggaggagaacaucgccaccagcagcagcggcaacaacuucggccuggaccugaaggccgacgacaagaucuacuucggcggccugcccacccugagaaaccugagcaugaaggccagacccgaggugaaccugaagaaguacagcggcugccugaaggacaucgagaucagcagaacccccuacaacauccugagcagccccgacuacgugggcgugaccaagggcugcagccuggagaacguguacaccgugagcuuccccaagcccggcuucguggagcugagccccgugcccaucgacgugggcaccgagaucaaccugagcuucagcaccaagaacgagagcggcaucauccugcugggcagcggcggcacccccgccccccccagaagaaagagaagacagaccggccaggccuacuacgugauccugcugaacagaggcagacuggaggugcaccugagcaccggcgccagaaccaugagaaagaucgugaucagacccgagcccaaccuguuccacgacggcagagagcacagcgugcacguggagagaaccagaggcaucuucaccgugcagguggacgagaacagaagauacaugcagaaccugaccguggagcagcccaucgaggugaagaagcuguucgugggcggcgccccccccgaguuccagcccagcccccugagaaacaucccccccuucgagggcugcaucuggaaccuggugaucaacagcgugcccauggacuucgccagacccgugagcuucaagaacgccgacaucggcagaugcgcccaccagaagcugagagaggacgaggacggcgccgcccccgccgagaucgugauccagcccgagcccgugcccacccccgccuuccccacccccacccccgugcugacccacggccccugcgccgccgagagcgagcccgcccugcugaucggcagcaagcaguucggccugagcagaaacagccacaucgccaucgccuucgacgacaccaaggugaagaacagacugaccaucgagcuggaggugagaaccgaggccgagagcggccugcuguucuacauggccagaaucaaccacgccgacuucgccaccgugcagcugagaaacggccugcccuacuucagcuacgaccugggcagcggcgacacccacaccaugauccccaccaagaucaacgacggccaguggcacaagaucaagaucaugagaagcaagcaggagggcauccuguacguggacggcgccagcaacagaaccaucagccccaagaaggccgacauccuggacguggugggcaugcuguacgugggcggccugcccaucaacuacaccaccagaagaaucggccccgugaccuacagcaucgacggcugcgugagaaaccugcacauggccgaggcccccgccgaccuggagcagcccaccagcagcuuccacgugggcaccugcuucgccaacgcccagagaggcaccuacuucgacggcaccggcuucgccaaggccgugggcggcuucaaggugggccuggaccugcugguggaguucgaguucagaaccaccaccaccaccggcgugcugcugggcaucagcagccagaagauggacggcaugggcaucgagaugaucgacgagaagcugauguuccacguggacaacggcgccggcagauucaccgccguguacgacgccggcgugcccggccaccugugcgacggccaguggcacaaggugaccgccaacaagaucaagcacagaaucgagcugaccguggacggcaaccagguggaggcccagagccccaaccccgccagcaccagcgccgacaccaacgaccccguguucgugggcggcuuccccgacgaccugaagcaguucggccugaccaccagcauccccuucagaggcugcaucagaagccugaagcugaccaagggcaccggcaagccccuggaggugaacuucgccaaggcccuggagcugagaggcgugcagcccgugagcugccccgccaacuaa

SEQ ID NO: 19132 - RNA, 5175 nt, Artificial Sequence
  LAMA3__Homo_sapiens__NP_000218
augccccccgccgugagaagaagcgccugcagcaugggcuggcuguggaucuucggcgccgcccugggccagugccugggcuacagcagccagcagcagagagugcccuuccugcagccccccggccagagccagcugcaggccagcuacguggaguucagacccagccagggcugcagccccggcuacuacagagaccacaagggccuguacaccggcagaugcgugcccugcaacugcaacggccacagcaaccagugccaggacggcagcggcaucugcgugaacugccagcacaacaccgccggcgagcacugcgagagaugccaggagggcuacuacggcaacgccgugcacggcagcugcagagccugccccugcccccacaccaacagcuucgccaccggcugcguggugaacggcggcgacgugagaugcagcugcaaggccggcuacaccggcacccagugcgagagaugcgcccccggcuacuucggcaacccccagaaguucggcggcagcugccagcccugcagcugcaacagcaacggccagcugggcagcugccacccccugaccggcgacugcaucaaccaggagcccaaggacagcagccccgccgaggagugcgacgacugcgacagcugcgugaugacccugcugaacgaccuggccaccaugggcgagcagcugagacuggugaagagccagcugcagggccugagcgccagcgccggccugcuggagcagaugagacacauggagacccaggccaaggaccugagaaaccagcugcugaacuacagaagcgccaucagcaaccacggcagcaagaucgagggccuggagagagagcugaccgaccugaaccaggaguucgagacccugcaggagaaggcccaggugaacagcagaaaggcccagacccugaacaacaacgugaacagagccacccagagcgccaaggagcuggacgugaagaucaagaacgugaucagaaacgugcacauccugcugaagcagaucagcggcaccgacggcgagggcaacaacgugcccagcggcgacuucagcagagagugggccgaggcccagagaaugaugagagagcugagaaacagaaacuucggcaagcaccugagagaggccgaggccgacaagagagagagccagcugcugcugaacagaaucagaaccuggcagaagacccaccagggcgagaacaacggccuggccaacagcaucagagacagccugaacgaguacgaggccaagcugagcgaccugagagccagacugcaggaggccgccgcccaggccaagcaggccaacggccugaaccaggagaacgagagagcccugggcgccauccagagacaggugaaggagaucaacagccugcagagcgacuucaccaaguaccugaccaccgccgacagcagccugcugcagaccaacaucgcccugcagcugauggagaagagccagaaggaguacgagaagcuggccgccagccugaacgaggccagacaggagcugagcgacaaggugagagagcugagcagaagcgccggcaagaccagccugguggaggaggccgagaagcacgccagaagccugcaggagcuggccaagcagcuggaggagaucaagagaaacgccagcggcgacgagcuggugagaugcgccguggacgccgccaccgccuacgagaacauccugaacgccaucaaggccgccgaggacgccgccaacagagccgccagcgccagcgagagcgcccugcagaccgugaucaaggaggaccugcccagaaaggccaagacccugagcagcaacagcgacaagcugcugaacgaggccaagaugacccagaagaagcugaagcaggaggugagccccgcccugaacaaccugcagcagacccugaacaucgugaccgugcagaaggaggugaucgacaccaaccugaccacccugagagacggccugcacggcauccagagaggcgacaucgacgccaugaucagcagcgccaagagcauggugagaaaggccaacgacaucaccgacgaggugcuggacggccugaaccccauccagaccgacguggagagaaucaaggacaccuacggcagaacccagaacgaggacuucaagaaggcccugaccgacgccgacaacagcgugaacaagcugaccaacaagcugcccgaccuguggagaaagaucgagagcaucaaccagcagcugcugccccugggcaacaucagcgacaacauggacagaaucagagagcugauccagcaggccagagacgccgccagcaagguggccgugcccaugagauucaacggcaagagcggcguggaggugagacugcccaacgaccuggaggaccugaagggcuacaccagccugagccuguuccugcagagacccaacagcagagagaacggcggcaccgagaacauguucgugauguaccugggcaacaaggacgccagcagagacuacaucggcauggccgugguggacggccagcugaccugcguguacaaccugggcgacagagaggccgagcugcagguggaccagauccugaccaagagcgagaccaaggaggccgugauggacagagugaaguuccagagaaucuaccaguucgccagacugaacuacaccaagggcgccaccagcagcaagcccgagacccccggcguguacgacauggacggcagaaacagcaacacccugcugaaccuggaccccgagaacgugguguucuacgugggcggcuacccccccgacuucaagcugcccagcagacugagcuucccccccuacaagggcugcaucgagcuggacgaccugaacgagaacgugcugagccuguacaacuucaagaagaccuucaaccugaacaccaccgagguggagcccugcagaagaagaaaggaggagagcgacaagaacuacuucgagggcaccggcuacgccagagugcccacccagccccacgcccccauccccaccuucggccagaccauccagaccaccguggacagaggccugcuguucuucgccgagaacggcgacagauucaucagccugaacaucgaggacggcaagcugauggugagauacaagcugaacagcgagcugcccaaggagagaggcgugggcgacgccaucaacaacggcagagaccacagcauccagaucaagaucggcaagcugcagaagagaauguggaucaacguggacgugcagaacaccaucaucgacggcgagguguucgacuucagcaccuacuaccugggcggcauccccaucgccaucagagagagauucaacaucagcacccccgccuucagaggcugcaugaagaaccugaagaagaccagcggcguggugagacugaacgacaccgugggcgugaccaagaagugcagcgaggacuggaagcuggugagaagcgccagcuucagcagaggcggccagcugagcuucaccgaccugggccugccccccaccgaccaccugcaggccagcuucggcuuccagaccuuccagcccagcggcauccugcuggaccaccagaccuggaccagaaaccugcaggugacccuggaggacggcuacaucgagcugagcaccagcgacagcggcggccccaucuucaagagcccccagaccuacauggacggccugcugcacuacgugagcgugaucagcgacaacagcggccugagacugcugaucgacgaccagcugcugagaaacagcaagagacugaagcacaucagcagcagcagacagagccugagacugggcggcagcaacuucgagggcugcaucagcaacguguucgugcagagacugagccugagccccgaggugcuggaccugaccagcaacagccugaagagagacgugagccugggcggcugcagccugaacaagccccccuuccugaugcugcugaagggcagcaccagauucaacaagaccaagaccuucagaaucaaccagcugcugcaggacacccccguggccagccccagaagcgugaagguguggcaggacgccugcagcccccugcccaagacccaggccaaccacggcgcccugcaguucggcgacauccccaccagccaccugcuguucaagcugccccaggagcugcugaagcccagaagccaguucgccguggacaugcagaccaccagcagcagaggccugguguuccacaccggcaccaagaacagcuucauggcccuguaccugagcaagggcagacugguguucgcccugggcaccgacggcaagaagcugagaaucaagagcaaggagaagugcaacgacggcaaguggcacaccgugguguucggccacgacggcgagaagggcagacuggugguggacggccugagagccagagagggcagccugcccggcaacagcaccaucagcaucagagcccccguguaccugggcagcccccccagcggcaagcccaagagccugcccaccaacagcuucgugggcugccugaagaacuuccagcuggacagcaagccccuguacacccccagcagcagcuucggcgugagcagcugccugggcggcccccuggagaagggcaucuacuucagcgaggagggcggccacguggugcuggcccacagcgugcugcugggccccgaguucaagcugguguucagcaucagacccagaagccugaccggcauccugauccacaucggcagccagcccggcaagcaccugugcguguaccuggaggccggcaaggugaccgccagcauggacagcggcgccggcggcaccagcaccagcgugacccccaagcagagccugugcgacggccaguggcacagcguggccgugaccaucaagcagcacauccugcaccuggagcuggacaccgacagcagcuacaccgccggccagauccccuucccccccgccagcacccaggagccccugcaccugggcggcgcccccgccaaccugaccacccugagaauccccguguggaagagcuucuucggcugccugagaaacauccacgugaaccacauccccgugcccgugaccgaggcccuggaggugcagggccccgugagccugaacggcugccccgaccaguaa

SEQ ID NO: 19133 - RNA, 5472 nt, Artificial Sequence
  LAMA4__Homo_sapiens__NP_001098676
auggcccugagcagcgccuggagaagcgugcugccccuguggcugcuguggagcgccgccugcagcagagccgccagcggcgacgacaacgccuuccccuucgacaucgagggcagcagcgccgugggcagacaggacccccccgagaccagcgagcccagaguggcccugggcagacugccccccgccgccgagaagugcaacgccggcuucuuccacacccugagcggcgagugcgugcccugcgacugcaacggcaacagcaacgagugccuggacggcagcggcuacugcgugcacugccagagaaacaccaccggcgagcacugcgagaagugccuggacggcuacaucggcgacagcaucagaggcgccccccaguucugccagcccugccccugcccccugccccaccuggccaacuucgccgagagcugcuacagaaagaacggcgccgugagaugcaucugcaacgagaacuacgccggccccaacugcgagagaugcgcccccggcuacuacggcaacccccugcugaucggcagcaccugcaagaagugcgacugcagcggcaacagcgaccccaaccugaucuucgaggacugcgacgaggugaccggccagugcagaaacugccugagaaacaccaccggcuucaagugcgagagaugcgcccccggcuacuacggcgacgccagaaucgccaagaacugcgccgugugcaacugcggcggcggccccugcgacagcgugaccggcgagugccuggaggagggcuucgagccccccaccggcauggacugccccaccaucagcugcgacaagugcgugugggaccugaccgacgaccugagacuggccgcccugagcaucgaggagggcaagagcggcgugcugagcgugagcagcggcgccgccgcccacagacacgugaacgagaucaacgccaccaucuaccugcugaagaccaagcugagcgagagagagaaccaguacgcccugagaaagauccagaucaacaacgccgagaacaccaugaagagccugcugagcgacguggaggagcugguggagaaggagaaccaggccagcagaaagggccagcuggugcagaaggagagcauggacaccaucaaccacgccagccagcugguggagcaggcccacgacaugagagacaagauccaggagaucaacaacaagaugcuguacuacggcgaggagcacgagcugagccccaaggagaucagcgagaagcuggugcuggcccagaagaugcuggaggagaucagaagcagacagcccuucuucacccagagagagcugguggacgaggaggccgacgaggccuacgagcugcugagccaggccgagagcuggcagagacugcacaacgagaccagaacccuguuccccguggugcuggagcagcuggacgacuacaacgccaagcugagcgaccugcaggaggcccuggaccaggcccugaacuacgugagagacgccgaggacaugaacagagccaccgccgccagacagagagaccacgagaagcagcaggagagagugagagagcagauggagguggugaacaugagccugagcaccagcgccgacagccugaccacccccagacugacccugagcgagcuggacgacaucaucaagaacgccagcggcaucuacgccgagaucgacggcgccaagagcgagcugcaggugaagcugagcaaccugagcaaccugagccacgaccuggugcaggaggccaucgaccacgcccaggaccugcagcaggaggccaacgagcugagcagaaagcugcacagcagcgacaugaacggccuggugcagaaggcccuggacgccagcaacguguacgagaacaucgugaacuacgugagcgaggccaacgagaccgccgaguucgcccugaacaccaccgacagaaucuacgacgccgugagcggcaucgacacccagaucaucuaccacaaggacgagagcgagaaccugcugaaccaggccagagagcugcaggccaaggccgagagcagcagcgacgaggccguggccgacaccagcagaagagugggcggcgcccuggccagaaagagcgcccugaagaccagacugagcgacgccgugaagcagcugcaggccgccgagagaggcgacgcccagcagagacugggccagagcagacugaucaccgaggaggccaacagaaccaccauggaggugcagcaggccaccgcccccauggccaacaaccugaccaacuggagccagaaccugcagcacuucgacagcagcgccuacaacaccgccgugaacagcgccagagacgccgugagaaaccugaccgagguggugccccagcugcuggaccagcugagaaccguggagcagaagagacccgccagcaacgugagcgccagcauccagagaaucagagagcugaucgcccagaccagaagcguggccagcaagauccaggugagcaugauguucgacggccagagcgccguggaggugcacagcagaaccagcauggacgaccugaaggccuucaccagccugagccuguacaugaagccccccgugaagagacccgagcugaccgagaccgccgaccaguucauccuguaccugggcagcaagaacgccaagaaggaguacaugggccuggccaucaagaacgacaaccugguguacguguacaaccugggcaccaaggacguggagaucccccuggacagcaagcccgugagcagcuggcccgccuacuucagcaucgugaagaucgagagagugggcaagcacggcaagguguuccugaccgugcccagccugagcagcaccgccgaggagaaguucaucaagaagggcgaguucagcggcgacgacagccugcuggaccuggaccccgaggacaccguguucuacgugggcggcgugcccagcaacuucaagcugcccaccagccugaaccugcccggcuucgugggcugccuggagcuggccacccugaacaacgacgugaucagccuguacaacuucaagcacaucuacaacauggaccccagcaccagcgugcccugcgccagagacaagcuggccuucacccagagcagagccgccagcuacuucuucgacggcagcggcuacgccguggugagagacaucaccagaagaggcaaguucggccaggugaccagauucgacaucgaggugagaacccccgccgacaacggccugauccugcugauggugaacggcagcauguucuucagacuggagaugagaaacggcuaccugcacguguucuacgacuucggcuucagcggcggccccgugcaccuggaggacacccugaagaaggcccagaucaacgacgccaaguaccacgagaucagcaucaucuaccacaacgacaagaagaugauccuggugguggacagaagacacgugaagagcauggacaacgagaagaugaagauccccuucaccgacaucuacaucggcggcgccccccccgagauccugcagagcagagcccugagagcccaccugccccuggacaucaacuucagaggcugcaugaagggcuuccaguuccagaagaaggacuucaaccugcuggagcagaccgagacccugggcgugggcuacggcugccccgaggacagccugaucagcagaagagccuacuucaacggccagagcuucaucgccagcauccagaagaucagcuucuucgacggcuucgagggcggcuucaacuucagaacccugcagcccaacggccugcuguucuacuacgccagcggcagcgacguguucagcaucagccuggacaacggcaccgugaucauggacgugaagggcaucaaggugcagagcguggacaagcaguacaacgacggccugagccacuucgugaucagcagcgugagccccaccagauacgagcugaucguggacaagagcagagugggcagcaagaaccccaccaagggcaagaucgagcagacccaggccagcgagaagaaguucuacuucggcggcagccccaucagcgcccaguacgccaacuucaccggcugcaucagcaacgccuacuucaccagaguggacagagacguggagguggaggacuuccagagauacaccgagaaggugcacaccagccuguacgagugccccaucgagagcagcccccuguuccugcugcacaagaagggcaagaaccugagcaagcccaaggccagccagaacaagaagggcggcaagagcaaggacgcccccagcugggaccccguggcccugaagcugcccgagagaaacacccccagaaacagccacugccaccugagcaacagccccagagccaucgagcacgccuaccaguacggcggcaccgccaacagcagacaggaguucgagcaccugaagggcgacuucggcgccaagagccaguucagcaucagacugagaaccagaagcagccacggcaugaucuucuacgugagcgaccaggaggagaacgacuucaugacccuguuccuggcccacggcagacugguguacauguucaacgugggccacaagaagcugaagaucagaagccaggagaaguacaacgacggccuguggcacgacgugaucuucaucagagagagaagcagcggcagacuggugaucgacggccugagagugcuggaggagagccugccccccaccgaggccaccuggaagaucaagggccccaucuaccugggcggcguggcccccggcaaggccgugaagaacgugcagaucaacagcaucuacagcuucagcggcugccugagcaaccugcagcugaacggcgccagcaucaccagcgccagccagaccuucagcgugacccccugcuucgagggccccauggagaccggcaccuacuucagcaccgagggcggcuacguggugcuggacgagagcuucaacaucggccugaaguucgagaucgccuucgaggugagacccagaagcagcagcggcacccuggugcacggccacagcgugaacggcgaguaccugaacgugcacaugaagaacggccaggugaucgugaaggugaacaacggcaucagagacuucagcaccagcgugacccccaagcagagccugugcgacggcagauggcacagaaucaccgugaucagagacagcaacguggugcagcuggacguggacagcgaggugaaccacguggugggcccccugaaccccaagcccaucgaccacagagagcccguguucgugggcggcgugcccgagagccugcugacccccagacuggcccccagcaagcccuucaccggcugcaucagacacuucgugaucgacggccaccccgugagcuucagcaaggccgcccuggugagcggcgccgugagcaucaacagcugccccgccgccuaa

SEQ ID NO: 19134 - RNA, 11088 nt, Artificial Sequence
  LAMA5__Homo_sapiens__NP_005551
auggccaagagacugugcgccggcagcgcccugugcgugagaggccccagaggccccgccccccugcugcuggugggccuggcccugcugggcgccgccagagccagagaggaggccggcggcggcuucagccugcacccccccuacuucaaccuggccgagggcgccagaaucgccgccagcgccaccugcggcgaggaggcccccgccagaggcagccccagacccaccgaggaccuguacugcaagcuggugggcggccccguggccggcggcgaccccaaccagaccaucagaggccaguacugcgacaucugcaccgccgccaacagcaacaaggcccaccccgccagcaacgccaucgacggcaccgagagaugguggcagagccccccccugagcagaggccuggaguacaacgaggugaacgugacccuggaccugggccagguguuccacguggccuacgugcugaucaaguucgccaacagccccagacccgaccugugggugcuggagagaagcauggacuucggcagaaccuaccagcccuggcaguucuucgccagcagcaagagagacugccuggagagauucggcccccagacccuggagagaaucaccagagacgacgccgccaucugcaccaccgaguacagcagaaucgugccccuggagaacggcgagaucguggugagccuggugaacggcagacccggcgccaugaacuucagcuacagcccccugcugagagaguucaccaaggccaccaacgugagacugagauuccugagaaccaacacccugcugggccaccugaugggcaaggcccugagagaccccaccgugaccagaagauacuacuacagcaucaaggacaucagcaucggcggcagaugcgugugccacggccacgccgacgccugcgacgccaaggaccccaccgaccccuucagacugcagugcaccugccagcacaacaccugcggcggcaccugcgacagaugcugccccggcuucaaccagcagcccuggaagcccgccaccgccaacagcgccaacgagugccagagcugcaacugcuacggccacgccaccgacugcuacuacgaccccgagguggacagaagaagagccagccagagccuggacggcaccuaccagggcggcggcgugugcaucgacugccagcaccacaccaccggcgugaacugcgagagaugccugcccggcuucuacagaagccccaaccacccccuggacagcccccacgugugcagaagaugcaacugcgagagcgacuucaccgacggcaccugcgaggaccugaccggcagaugcuacugcagacccaacuucagcggcgagagaugcgacgugugcgccgagggcuucaccggcuuccccagcugcuaccccacccccagcagcagcaacgacaccagagagcaggugcugcccgccggccagaucgugaacugcgacugcagcgccgccggcacccagggcaacgccugcagaaaggaccccagagugggcagaugccugugcaagcccaacuuccagggcacccacugcgagcugugcgcccccggcuucuacggccccggcugccagcccugccagugcagcagccccggcguggccgacgacagaugcgaccccgacaccggccagugcagaugcagagugggcuucgagggcgccaccugcgacagaugcgcccccggcuacuuccacuucccccugugccagcugugcggcugcagccccgccggcacccugcccgagggcugcgacgaggccggcagaugccugugccagcccgaguucgccggcccccacugcgacagaugcagacccggcuaccacggcuuccccaacugccaggccugcaccugcgaccccagaggcgcccuggaccagcugugcggcgccggcggccugugcagaugcagacccggcuacaccggcaccgccugccaggagugcagccccggcuuccacggcuuccccagcugcgugcccugccacugcagcgccgagggcagccugcacgccgccugcgaccccagaagcggccagugcagcugcagacccagagugaccggccugagaugcgacaccugcgugcccggcgccuacaacuuccccuacugcgaggccggcagcugccaccccgccggccuggcccccguggaccccgcccugcccgaggcccaggugcccugcaugugcagagcccacguggagggccccagcugcgacagaugcaagcccggcuucuggggccugagccccagcaaccccgagggcugcaccagaugcagcugcgaccugagaggcacccugggcggcguggccgagugccagcccggcaccggccagugcuucugcaagccccacgugugcggccaggccugcgccagcugcaaggacggcuucuucggccuggaccaggccgacuacuucggcugcagaagcugcagaugcgacaucggcggcgcccugggccagagcugcgagcccagaaccggcgugugcagaugcagacccaacacccagggccccaccugcagcgagcccgccagagaccacuaccugcccgaccugcaccaccugagacuggagcuggaggaggccgccacccccgagggccacgccgugagauucggcuucaacccccuggaguucgagaacuucagcuggagaggcuacgcccagauggcccccgugcagcccagaaucguggccagacugaaccugaccagccccgaccuguucuggcugguguucagauacgugaacagaggcgccaugagcgugagcggcagagugagcgugagagaggagggcagaagcgccaccugcgccaacugcaccgcccagagccagcccguggccuucccccccagcaccgagcccgccuucaucaccgugccccagagaggcuucggcgagcccuucgugcugaaccccggcaccugggcccugagaguggaggccgagggcgugcugcuggacuacguggugcugcugcccagcgccuacuacgaggccgcccugcugcagcugagagugaccgaggccugcaccuacagacccagcgcccagcagagcggcgacaacugccugcuguacacccaccugccccuggacggcuuccccagcgccgccggccuggaggcccugugcagacaggacaacagccugcccagacccugccccaccgagcagcugagccccagccaccccccccugaucaccugcaccggcagcgacguggacgugcagcugcagguggccgugccccagcccggcagauacgcccuggugguggaguacgccaacgaggacgccagacaggaggugggcguggccgugcacaccccccagagagccccccagcagggccugcugagccugcaccccugccuguacagcacccugugcagaggcaccgccagagacacccaggaccaccuggccguguuccaccuggacagcgaggccagcgugagacugaccgccgagcaggccagauucuuccugcacggcgugacccuggugcccaucgaggaguucagccccgaguucguggagcccagagugagcugcaucagcagccacggcgccuucggccccaacagcgccgccugccugcccagcagauuccccaagcccccccagcccaucauccugagagacugccaggugaucccccugccccccggccugccccugacccacgcccaggaccugacccccgccaugagccccgccggccccagacccagaccccccaccgccguggaccccgacgccgagcccacccugcugagagagccccaggccaccgugguguucaccacccacgugcccacccugggcagauacgccuuccugcugcacggcuaccagcccgcccaccccaccuuccccguggaggugcugaucaacgccggcagaguguggcagggccacgccaacgccagcuucugcccccacggcuacggcugcagaacccugguggugugcgagggccaggcccugcuggacgugacccacagcgagcugaccgugaccgugagagugcccaagggcagauggcuguggcuggacuacgugcugguggugcccgagaacguguacagcuucggcuaccugagagaggagccccuggacaagagcuacgacuucaucagccacugcgccgcccagggcuaccacaucagccccagcagcagcagccuguucugcagaaacgccgccgccagccugagccuguucuacaacaacggcgccagacccugcggcugccacgaggugggcgccaccggccccaccugcgagcccuucggcggccagugccccugccacgcccacgugaucggcagagacugcagcagaugcgccaccggcuacuggggcuuccccaacugcagacccugcgacugcggcgccagacugugcgacgagcugaccggccagugcaucugcccccccagaaccaucccccccgacugccugcugugccagccccagaccuucggcugccacccccuggugggcugcgaggagugcaacugcagcggccccggcauccaggagcugaccgaccccaccugcgacaccgacagcggccagugcaagugcagacccaacgugaccggcagaagaugcgacaccugcagccccggcuuccacggcuaccccagaugcagacccugcgacugccacgaggccggcaccgcccccggcgugugcgacccccugaccggccagugcuacugcaaggagaacgugcagggccccaagugcgaccagugcagccugggcaccuucagccuggacgccgccaaccccaagggcugcaccagaugcuucugcuucggcgccaccgagagaugcagaagcagcagcuacaccagacaggaguucguggacauggagggcugggugcugcugagcaccgacagacagguggugccccacgagagacagcccggcaccgagaugcugagagccgaccugagacacgugcccgaggccgugcccgaggccuuccccgagcuguacuggcaggccccccccagcuaccugggcgacagagugagcagcuacggcggcacccugagauacgagcugcacagcgagacccagagaggcgacguguucgugcccauggagagcagacccgacguggugcugcagggcaaccagaugagcaucaccuuccuggagcccgccuaccccacccccggccacgugcacagaggccagcugcagcugguggagggcaacuucagacacaccgagaccagaaacaccgugagcagagaggagcugaugauggugcuggccagccuggagcagcugcagaucagagcccuguucagccagaucagcagcgccguguuccugagaagaguggcccuggagguggccagccccgccggccagggcgcccuggccagcaacguggagcugugccugugccccgccagcuacagaggcgacagcugccaggagugcgcccccggcuucuacagagacgugaagggccuguuccugggcagaugcgugcccugccagugccacggccacagcgacagaugccugcccggcagcggcgugugcguggacugccagcacaacaccgagggcgcccacugcgagagaugccaggccggcuucgugagcagcagagacgaccccagcgcccccugcgugagcugccccugcccccugagcgugcccagcaacaacuucgccgagggcugcgugcugagaggcggcagaacccagugccugugcaagcccggcuacgccggcgccagcugcgagagaugcgcccccggcuucuucggcaacccccuggugcugggcagcagcugccagcccugcgacugcagcggcaacggcgaccccaaccugcuguucagcgacugcgacccccugaccggcgccugcagaggcugccugagacacaccaccggccccagaugcgagaucugcgcccccggcuucuacggcaacgcccugcugcccggcaacugcaccagaugcgacugcacccccugcggcaccgaggccugcgacccccacagcggccacugccugugcaaggccggcgugaccggcagaagaugcgacagaugccaggagggccacuucggcuucgacggcugcggcggcugcagacccugcgccugcggccccgccgccgagggcagcgagugccacccccagagcggccagugccacugcagacccggcaccaugggcccccagugcagagagugcgcccccggcuacuggggccugcccgagcagggcugcagaagaugccagugccccggcggcagaugcgacccccacaccggcagaugcaacugcccccccggccugagcggcgagagaugcgacaccugcagccagcagcaccaggugcccgugcccggcggccccgugggccacagcauccacugcgaggugugcgaccacugcguggugcugcugcuggacgaccuggagagagccggcgcccugcugcccgccauccacgagcagcugagaggcaucaacgccagcagcauggccugggccagacugcacagacugaacgccagcaucgccgaccugcagagccagcugagaagcccccugggccccagacacgagaccgcccagcagcuggaggugcuggagcagcagagcaccagccugggccaggacgccagaagacugggcggccaggccgugggcaccagagaccaggccagccagcugcuggccggcaccgaggccacccugggccacgccaagacccugcuggccgccaucagagccguggacagaacccugagcgagcugaugagccagaccggccaccugggccuggccaacgccagcgcccccagcggcgagcagcugcugagaacccuggccgagguggagagacugcugugggagaugagagccagagaccugggcgccccccaggccgccgccgaggccgagcuggccgccgcccagagacugcuggccagagugcaggagcagcugagcagccugugggaggagaaccaggcccuggccacccagaccagagacagacuggcccagcacgaggccggccugauggaccugagagaggcccugaacagagccguggacgccaccagagaggcccaggagcugaacagcagaaaccaggagagacuggaggaggcccugcagagaaagcaggagcugagcagagacaacgccacccugcaggccacccugcacgccgccagagacacccuggccagcguguucagacugcugcacagccuggaccaggccaaggaggagcuggagagacuggccgccagccuggacggcgccagaaccccccugcugcagagaaugcagaccuucagccccgccggcagcaagcugagacugguggaggccgccgaggcccacgcccagcagcugggccagcuggcccugaaccugagcagcaucauccuggacgugaaccaggacagacugacccagagagccaucgaggccagcaacgccuacagcagaauccugcaggccgugcaggccgccgaggacgccgccggccaggcccugcagcaggccgaccacaccugggccaccguggugagacagggccugguggacagagcccagcagcugcuggccaacagcaccgcccuggaggaggccaugcugcaggagcagcagagacugggccuggugugggccgcccugcagggcgccagaacccagcugagagacgugagagccaagaaggaccagcuggaggcccacauccaggccgcccaggccaugcuggccauggacaccgacgagaccagcaagaagaucgcccacgccaaggccguggccgccgaggcccaggacaccgccaccagagugcagagccagcugcaggccaugcaggagaacguggagagauggcagggccaguacgagggccugagaggccaggaccugggccaggccgugcuggacgccggccacagcgugagcacccuggagaagacccugccccagcugcuggccaagcugagcauccuggagaacagaggcgugcacaacgccagccuggcccugagcgccagcaucggcagagugagagagcugaucgcccaggccagaggcgccgccagcaaggugaaggugcccaugaaguucaacggcagaagcggcgugcagcugagaacccccagagaccuggccgaccuggccgccuacaccgcccugaaguucuaccugcagggccccgagcccgagcccggccagggcaccgaggacagauucgugauguacaugggcagcagacaggccaccggcgacuacaugggcgugagccugagagacaagaaggugcacuggguguaccagcugggcgaggccggccccgccgugcugagcaucgacgaggacaucggcgagcaguucgccgccgugagccuggacagaacccugcaguucggccacaugagcgugaccguggagagacagaugauccaggagaccaagggcgacaccguggcccccggcgccgagggccugcugaaccugagacccgacgacuucguguucuacgugggcggcuaccccagcaccuucaccccccccccccugcugagauuccccggcuacagaggcugcaucgagauggacacccugaacgaggagguggugagccuguacaacuucgagagaaccuuccagcuggacaccgccguggacagacccugcgccagaagcaagagcaccggcgaccccuggcugaccgacggcagcuaccuggacggcaccggcuucgccagaaucagcuucgacagccagaucagcaccaccaagagauucgagcaggagcugagacuggugagcuacagcggcgugcuguucuuccugaagcagcagagccaguuccugugccuggccgugcaggagggcagccuggugcugcuguacgacuucggcgccggccugaagaaggccgugccccugcagcccccccccccccugaccagcgccagcaaggccauccagguguuccugcugggcggcagcagaaagagagugcuggugagaguggagagagccaccguguacagcguggagcaggacaacgaccuggagcuggccgacgccuacuaccugggcggcgugccccccgaccagcugccccccagccugagaagacuguuccccaccggcggcagcgugagaggcugcgugaagggcaucaaggcccugggcaaguacguggaccugaagagacugaacaccaccggcgugagcgccggcugcaccgccgaccugcuggugggcagagccaugaccuuccacggccacggcuuccugagacuggcccugagcaacguggccccccugaccggcaacguguacagcggcuucggcuuccacagcgcccaggacagcgcccugcuguacuacagagccagccccgacggccugugccaggugagccugcagcagggcagagugagccugcagcugcugagaaccgaggugaagacccaggccggcuucgccgacggcgccccccacuacguggccuucuacagcaacgccaccggcguguggcuguacguggacgaccagcugcagcagaugaagccccacagaggccccccccccgagcugcagccccagcccgagggcccccccagacugcugcugggcggccugcccgagagcggcaccaucuacaacuucagcggcugcaucagcaacguguucgugcagagacugcugggcccccagagaguguucgaccugcagcagaaccugggcagcgugaacgugagcaccggcugcgcccccgcccugcaggcccagacccccggccugggccccagaggccugcaggccaccgccagaaaggccagcagaagaagcagacagcccgccagacaccccgccugcaugcugcccccccaccugagaaccaccagagacagcuaccaguucggcggcagccugagcagccaccuggaguucgugggcauccuggccagacacagaaacuggcccagccugagcaugcacgugcugcccagaagcagcagaggccugcugcuguucaccgccagacugagacccggcagccccagccuggcccuguuccugagcaacggccacuucguggcccagauggagggccugggcaccagacugagagcccagagcagacagagaagcagacccggcagauggcacaaggugagcgugagaugggagaagaacagaauccugcuggugaccgacggcgccagagccuggagccaggagggcccccacagacagcaccagggcgccgagcacccccagccccacacccuguucgugggcggccugcccgccagcagccacagcagcaagcugcccgugaccgugggcuucagcggcugcgugaagagacugagacugcacggcagaccccugggcgcccccaccagaauggccggcgugacccccugcauccugggcccccuggaggccggccuguucuuccccggcagcggcggcgugaucacccuggaccugcccggcgccacccugcccgacgugggccuggagcuggaggugagaccccuggccgugaccggccugaucuuccaccugggccaggccagaaccccccccuaccugcagcugcaggugaccgagaagcaggugcugcugagagccgacgacggcgccggcgaguucagcaccagcgugaccagacccagcgugcugugcgacggccaguggcacagacuggccgugaugaagagcggcaacgugcugagacuggagguggacgcccagagcaaccacaccgugggcccccugcuggccgccgccgccggcgcccccgccccccuguaccugggcggccugcccgagcccauggccgugcagcccuggccccccgccuacugcggcugcaugagaagacuggccgugaacagaagccccguggccaugaccagaagcguggaggugcacggcgccgugggcgccagcggcugccccgccgccuaa

SEQ ID NO: 19135 - RNA, 5361 nt, Artificial Sequence
  LAMB1__Homo_sapiens__NP_002282
augggccugcugcagcugcuggccuucagcuuccuggcccugugcagagccagagugagagcccaggagcccgaguucagcuacggcugcgccgagggcagcugcuaccccgccaccggcgaccugcugaucggcagagcccagaagcugagcgugaccagcaccugcggccugcacaagcccgagcccuacugcaucgugagccaccugcaggaggacaagaagugcuucaucugcaacagccaggaccccuaccacgagacccugaaccccgacagccaccugaucgagaacguggugaccaccuucgcccccaacagacugaagaucugguggcagagcgagaacggcguggagaacgugaccauccagcuggaccuggaggccgaguuccacuucacccaccugaucaugaccuucaagaccuucagacccgccgccaugcugaucgagagaagcagcgacuucggcaagaccuggggcguguacagauacuucgccuacgacugcgaggccagcuuccccggcaucagcaccggccccaugaagaagguggacgacaucaucugcgacagcagauacagcgacaucgagcccagcaccgagggcgaggugaucuucagagcccuggaccccgccuucaagaucgaggaccccuacagccccagaauccagaaccugcugaagaucaccaaccugagaaucaaguucgugaagcugcacacccugggcgacaaccugcuggacagcagaauggagaucagagagaaguacuacuacgccguguacgacaugguggugagaggcaacugcuucugcuacggccacgccagcgagugcgcccccguggacggcuucaacgaggagguggagggcauggugcacggccacugcaugugcagacacaacaccaagggccugaacugcgagcugugcauggacuucuaccacgaccugcccuggagacccgccgagggcagaaacagcaacgccugcaagaagugcaacugcaacgagcacagcaucagcugccacuucgacauggccguguaccuggccaccggcaacgugagcggcggcgugugcgacgacugccagcacaacaccaugggcagaaacugcgagcagugcaagcccuucuacuaccagcaccccgagagagacaucagagaccccaacuucugcgagagaugcaccugcgaccccgccggcagccagaacgagggcaucugcgacagcuacaccgacuucagcaccggccugaucgccggccagugcagaugcaagcugaacguggagggcgagcacugcgacgugugcaaggagggcuucuacgaccugagcagcgaggaccccuucggcugcaagagcugcgccugcaacccccugggcaccauccccggcggcaaccccugcgacagcgagaccggccacugcuacugcaagagacuggugaccggccagcacugcgaccagugccugcccgagcacuggggccugagcaacgaccuggacggcugcagacccugcgacugcgaccugggcggcgcccugaacaacagcugcuucgccgagagcggccagugcagcugcagaccccacaugaucggcagacagugcaacgagguggagcccggcuacuacuucgccacccuggaccacuaccuguacgaggccgaggaggccaaccugggccccggcgugagcaucguggagagacaguacauccaggacagaauccccagcuggaccggcgccggcuucgugagagugcccgagggcgccuaccuggaguucuucaucgacaacauccccuacagcauggaguacgacauccugaucagauacgagccccagcugcccgaccacugggagaaggccgugaucaccgugcagagacccggcagaauccccaccagcagcagaugcggcaacaccauccccgacgacgacaaccagguggugagccugagccccggcagcagauacguggugcugcccagacccgugugcuucgagaagggcaccaacuacaccgugagacuggagcugccccaguacaccagcagcgacagcgacguggagagccccuacacccugaucgacagccuggugcugaugcccuacugcaagagccuggacaucuucaccgugggcggcagcggcgacggcguggugaccaacagcgccugggagaccuuccagagauacagaugccuggagaacagcagaagcguggugaagacccccaugaccgacgugugcagaaacaucaucuucagcaucagcgcccugcugcaccagaccggccuggccugcgagugcgacccccagggcagccugagcagcgugugcgaccccaacggcggccagugccagugcagacccaacguggugggcagaaccugcaacagaugcgcccccggcaccuucggcuucggccccagcggcugcaagcccugcgagugccaccugcagggcagcgugaacgccuucugcaaccccgugaccggccagugccacugcuuccagggcguguacgccagacagugcgacagaugccugcccggccacuggggcuuccccagcugccagcccugccagugcaacggccacgccgacgacugcgaccccgugaccggcgagugccugaacugccaggacuacaccaugggccacaacugcgagagaugccuggccggcuacuacggcgaccccaucaucggcagcggcgaccacugcagacccugccccugccccgacggccccgacagcggcagacaguucgccagaagcugcuaccaggaccccgugacccugcagcuggccugcgugugcgaccccggcuacaucggcagcagaugcgacgacugcgccagcggcuacuucggcaaccccagcgaggugggcggcagcugccagcccugccagugccacaacaacaucgacaccaccgaccccgaggccugcgacaaggagaccggcagaugccugaagugccuguaccacaccgagggcgagcacugccaguucugcagauucggcuacuacggcgacgcccugcagcaggacugcagaaagugcgugugcaacuaccugggcaccgugcaggagcacugcaacggcagcgacugccagugcgacaaggccaccggccagugccugugccugcccaacgugaucggccagaacugcgacagaugcgcccccaacaccuggcagcuggccagcggcaccggcugcgaccccugcaacugcaacgccgcccacagcuucggccccagcugcaacgaguucaccggccagugccagugcaugcccggcuucggcggcagaaccugcagcgagugccaggagcuguucuggggcgaccccgacguggagugcagagccugcgacugcgaccccagaggcaucgagaccccccagugcgaccagagcaccggccagugcgugugcguggagggcguggagggccccagaugcgacaagugcaccagaggcuacagcggcguguuccccgacugcacccccugccaccagugcuucgcccugugggacgugaucaucgccgagcugaccaacagaacccacagauuccuggagaaggccaaggcccugaagaucagcggcgugaucggccccuacagagagaccguggacagcguggagagaaaggugagcgagaucaaggacauccuggcccagagccccgccgccgagccccugaagaacaucggcaaccuguucgaggaggccgagaagcugaucaaggacgugaccgagaugauggcccagguggaggugaagcugagcgacaccaccagccagagcaacagcaccgccaaggagcuggacagccugcagaccgaggccgagagccuggacaacaccgugaaggagcuggccgagcagcuggaguucaucaagaacagcgacaucagaggcgcccuggacagcaucaccaaguacuuccagaugagccuggaggccgaggagagagugaacgccagcaccaccgagcccaacagcaccguggagcagagcgcccugaugagagacagaguggaggacgugaugauggagagagagagccaguucaaggagaagcaggaggagcaggccagacugcuggacgagcuggccggcaagcugcagagccuggaccugagcgccgccgccgagaugaccugcggcaccccccccggcgccagcugcagcgagaccgagugcggcggccccaacugcagaaccgacgagggcgagagaaagugcggcggccccggcugcggcggccuggugaccguggcccacaacgccuggcagaaggccauggaccuggaccaggacgugcugagcgcccuggccgagguggagcagcugagcaagauggugagcgaggccaagcugagagccgacgaggccaagcagagcgccgaggacauccugcugaagaccaacgccaccaaggagaagauggacaagagcaacgaggagcugagaaaccugaucaagcagaucagaaacuuccugacccaggacagcgccgaccuggacagcaucgaggccguggccaacgaggugcugaagauggagaugcccagcaccccccagcagcugcagaaccugaccgaggacaucagagagagaguggagagccugagccagguggaggugauccugcagcacagcgccgccgacaucgccagagccgagaugcugcuggaggaggccaagagagccagcaagagcgccaccgacgugaaggugaccgccgacauggugaaggaggcccuggaggaggccgagaaggcccagguggccgccgagaaggccaucaagcaggccgacgaggacauccagggcacccagaaccugcugaccagcaucgagagcgagaccgccgccagcgaggagacccuguucaacgccagccagagaaucagcgagcuggagagaaacguggaggagcugaagagaaaggccgcccagaacagcggcgaggccgaguacaucgagaaggugguguacaccgugaagcagagcgccgaggacgugaagaagacccuggacggcgagcuggacgagaaguacaagaagguggagaaccugaucgccaagaagaccgaggagagcgccgacgccagaagaaaggccgagaugcugcagaacgaggccaagacccugcuggcccaggccaacagcaagcugcagcugcugaaggaccuggagagaaaguacgaggacaaccagagauaccuggaggacaaggcccaggagcuggccagacuggagggcgaggugagaagccugcugaaggacaucagccagaagguggccguguacagcaccugccuguaa

SEQ ID NO: 19136 - RNA, 5397 nt, Artificial Sequence
  LAMB2__Homo_sapiens__NP_002283
auggagcugaccagcagagagagaggcagaggccagccccugcccugggagcugagacugggccugcugcugagcgugcuggccgccacccuggcccaggcccccgcccccgacgugcccggcugcagcagaggcagcugcuaccccgccaccggcgaccugcuggugggcagagccgacagacugaccgccagcagcaccugcggccugaacggcccccagcccuacugcaucgugagccaccugcaggacgagaagaagugcuuccugugcgacagcagaagacccuucagcgccagagacaacccccacagccacagaauccagaacguggugaccagcuucgccccccagagaagagccgccugguggcagagcgagaacggcauccccgccgugaccauccagcuggaccuggaggccgaguuccacuucacccaccugaucaugaccuucaagaccuucagacccgccgccaugcugguggagagaagcgccgacuucggcagaaccuggcacguguacagauacuucagcuacgacugcggcgccgacuuccccggcgugccccuggccccccccagacacugggacgacguggugugcgagagcagauacagcgagaucgagcccagcaccgagggcgaggugaucuacagagugcuggaccccgccauccccauccccgaccccuacagcagcagaauccagaaccugcugaagaucaccaaccugagagugaaccugaccagacugcacacccugggcgacaaccugcuggaccccagaagagagaucagagagaaguacuacuacgcccuguacgagcugguggugagaggcaacugcuucugcuacggccacgccagcgagugcgcccccgcccccggcgcccccgcccacgccgagggcauggugcacggcgccugcaucugcaagcacaacaccagaggccugaacugcgagcagugccaggacuucuacagagaccugcccuggagacccgccgaggacggccacagccacgccugcagaaagugcgagugccacggccacacccacagcugccacuucgacauggccguguaccuggccagcggcaacgugagcggcggcgugugcgacggcugccagcacaacaccgccggcagacacugcgagcugugcagacccuucuucuacagagaccccaccaaggaccugagagaccccgccgugugcagaagcugcgacugcgaccccaugggcagccaggacggcggcagaugcgacagccacgacgaccccgcccugggccuggugagcggccagugcagaugcaaggagcacguggugggcaccagaugccagcagugcagagacggcuucuucggccugagcaucagcgacagacugggcugcagaagaugccagugcaacgccagaggcaccgugcccggcagcacccccugcgaccccaacagcggcagcugcuacugcaagagacuggugaccggcagaggcugcgacagaugccugcccggccacuggggccugagccacgaccugcugggcugcagacccugcgacugcgacgugggcggcgcccuggacccccagugcgacgagggcaccggccagugccacugcagacagcacauggugggcagaagaugcgagcaggugcagcccggcuacuucagacccuuccuggaccaccugaucugggaggccgaggacaccagaggccaggugcuggacgugguggagagacuggugacccccggcgagacccccagcuggaccggcagcggcuucgugagacugcaggagggccagacccuggaguuccugguggccagcgugcccaaggccauggacuacgaccugcugcugagacuggagccccaggugcccgagcagugggccgagcuggagcugaucgugcagagacccggccccgugcccgcccacagccugugcggccaccuggugcccaaggacgacagaauccagggcacccugcagccccacgccagauaccugaucuuccccaaccccgugugccuggagcccggcaucagcuacaagcugcaccugaagcuggugagaaccggcggcagcgcccagcccgagacccccuacagcggccccggccugcugaucgacagccuggugcugcugcccagagugcuggugcuggagauguucagcggcggcgacgccgccgcccuggagagacaggccaccuucgagagauaccagugccacgaggagggccuggugcccagcaagaccagccccagcgaggccugcgccccccugcugaucagccugagcacccugaucuacaacggcgcccugcccugccagugcaacccccagggcagccugagcagcgagugcaacccccacggcggccagugccugugcaagcccggcguggugggcagaagaugcgaccugugcgcccccggcuacuacggcuucggccccaccggcugccaggccugccagugcagccacgagggcgcccugagcagccugugcgagaagaccagcggccagugccugugcagaaccggcgccuucggccugagaugcgacagaugccagagaggccaguggggcuuccccagcugcagacccugcgugugcaacggccacgccgacgagugcaacacccacaccggcgccugccugggcugcagagaccacaccggcggcgagcacugcgagagaugcaucgccggcuuccacggcgaccccagacugcccuacggcggccagugcagacccugccccugccccgagggccccggcagccagagacacuucgccaccagcugccaccaggacgaguacagccagcagaucgugugccacugcagagccggcuacaccggccugagaugcgaggccugcgcccccggccacuucggcgaccccagcagacccggcggcagaugccagcugugcgagugcagcggcaacaucgaccccauggaccccgacgccugcgacccccacaccggccagugccugagaugccugcaccacaccgagggcccccacugcgcccacugcaagcccggcuuccacggccaggccgccagacagagcugccacagaugcaccugcaaccugcugggcaccaacccccagcagugccccagccccgaccagugccacugcgaccccagcagcggccagugccccugccugcccaacgugcagggccccagcugcgacagaugcgcccccaacuucuggaaccugaccagcggccacggcugccagcccugcgccugccaccccagcagagccagaggccccaccugcaacgaguucaccggccagugccacugcagagccggcuucggcggcagaaccugcagcgagugccaggagcugcacuggggcgaccccggccugcagugccacgccugcgacugcgacagcagaggcaucgacaccccccagugccacagauucaccggccacugcagcugcagacccggcgugagcggcgugagaugcgaccagugcgccagaggcuucagcggcaucuuccccgccugccaccccugccacgccugcuucggcgacugggacagaguggugcaggaccuggccgccagaacccagagacuggagcagagagcccaggagcugcagcagaccggcgugcugggcgccuucgagagcagcuucuggcacaugcaggagaagcugggcaucgugcagggcaucgugggcgccagaaacaccagcgccgccagcaccgcccagcugguggaggccaccgaggagcugagaagagagaucggcgaggccaccgagcaccugacccagcuggaggccgaccugaccgacgugcaggacgagaacuucaacgccaaccacgcccugagcggccuggagagagacagacuggcccugaaccugacccugagacagcuggaccagcaccuggaccugcugaagcacagcaacuuccugggcgccuacgacagcaucagacacgcccacagccagagcgccgaggccgagagaagagccaacaccagcgcccuggccgugcccagccccgugagcaacagcgccagcgccagacacagaaccgaggcccugauggacgcccagaaggaggacuucaacagcaagcacauggccaaccagagagcccugggcaagcugagcgcccacacccacacccugagccugaccgacaucaacgagcuggugugcggcgcccccggcgacgcccccugcgccaccagccccugcggcggcgccggcugcagagacgaggacggccagcccagaugcggcggccugagcugcaacggcgccgccgccaccgccgaccuggcccugggcagagccagacacacccaggccgagcugcagagagcccuggccgagggcggcagcauccugagcagaguggccgagaccagaagacaggccagcgaggcccagcagagagcccaggccgcccuggacaaggccaacgccagcagaggccagguggagcaggccaaccaggagcugcaggagcugauccagagcgugaaggacuuccugaaccaggagggcgccgaccccgacagcaucgagaugguggccaccagagugcuggagcugagcauccccgccagcgccgagcagauccagcaccuggccggcgccaucgccgagagagugagaagccuggccgacguggacgccauccuggccagaaccgugggcgacgugagaagagccgagcagcugcugcaggacgccagaagagccagaagcugggccgaggacgagaagcagaaggccgagaccgugcaggccgcccuggaggaggcccagagagcccagggcaucgcccagggcgccaucagaggcgccguggccgacaccagagacaccgagcagacccuguaccaggugcaggagagaauggccggcgccgagagagcccugagcagcgccggcgagagagccagacagcuggacgcccugcuggaggcccugaagcugaagagagccggcaacagccuggccgccagcaccgccgaggagaccgccggcagcgcccagggcagagcccaggaggccgagcagcugcugagaggcccccugggcgaccaguaccagaccgugaaggcccuggccgagagaaaggcccagggcgugcuggccgcccaggccagagccgagcagcugagagacgaggccagagaccugcugcaggccgcccaggacaagcugcagagacugcaggagcuggagggcaccuacgaggagaacgagagagcccuggagagcaaggccgcccagcuggacggccuggaggccagaaugagaagcgugcugcaggccaucaaccugcaggugcagaucuacaacaccugccaguaa

SEQ ID NO: 19137 - RNA, 3519 nt, Artificial Sequence
  LAMB3__Homo_sapiens__NP_001121113
augagacccuucuuccugcugugcuucgcccugcccggccugcugcacgcccagcaggccugcagcagaggcgccugcuacccccccgugggcgaccugcuggugggcagaaccagauuccugagagccagcagcaccugcggccugaccaagcccgagaccuacugcacccaguacggcgaguggcagaugaagugcugcaagugcgacagcagacagccccacaacuacuacagccacagaguggagaacguggccagcagcagcggccccaugagaugguggcagagccagaacgacgugaaccccgugagccugcagcuggaccuggacagaagauuccagcugcaggaggugaugauggaguuccagggccccaugcccgccggcaugcugaucgagagaagcagcgacuucggcaagaccuggagaguguaccaguaccuggccgccgacugcaccagcaccuuccccagagugagacagggcagaccccagagcuggcaggacgugagaugccagagccugccccagagacccaacgccagacugaacggcggcaaggugcagcugaaccugauggaccuggugagcggcauccccgccacccagagccagaagauccaggaggugggcgagaucaccaaccugagagugaacuucaccagacuggcccccgugccccagagaggcuaccacccccccagcgccuacuacgccgugagccagcugagacugcagggcagcugcuucugccacggccacgccgacagaugcgcccccaagcccggcgccagcgccggccccagcaccgccgugcaggugcacgacgugugcgugugccagcacaacaccgccggccccaacugcgagagaugcgcccccuucuacaacaacagacccuggagacccgccgagggccaggacgcccacgagugccagagaugcgacugcaacggccacagcgagaccugccacuucgaccccgccguguucgccgccagccagggcgccuacggcggcgugugcgacaacugcagagaccacaccgagggcaagaacugcgagagaugccagcugcacuacuucagaaacagaagacccggcgccagcauccaggagaccugcaucagcugcgagugcgaccccgacggcgccgugcccggcgcccccugcgaccccgugaccggccagugcgugugcaaggagcacgugcagggcgagagaugcgaccugugcaagcccggcuucaccggccugaccuacgccaacccccagggcugccacagaugcgacugcaacauccugggcagcagaagagacaugcccugcgacgaggagagcggcagaugccugugccugcccaacguggugggccccaagugcgaccagugcgcccccuaccacuggaagcuggccagcggccagggcugcgagcccugcgccugcgacccccacaacagccugagcccccagugcaaccaguucaccggccagugccccugcagagagggcuucggcggccugaugugcagcgccgccgccaucagacagugccccgacagaaccuacggcgacguggccaccggcugcagagccugcgacugcgacuucagaggcaccgagggccccggcugcgacaaggccagcggcagaugccugugcagacccggccugaccggccccagaugcgaccagugccagagaggcuacugcaacagauaccccgugugcguggccugccaccccugcuuccagaccuacgacgccgaccugagagagcaggcccugagauucggcagacugagaaacgccaccgccagccuguggagcggccccggccuggaggacagaggccuggccagcagaauccuggacgccaagagcaagaucgagcagaucagagccgugcugagcagccccgccgugaccgagcaggagguggcccagguggccagcgccauccugagccugagaagaacccugcagggccugcagcuggaccugccccuggaggaggagacccugagccugcccagagaccuggagagccuggacagaagcuucaacggccugcugaccauguaccagagaaagagagagcaguucgagaagaucagcagcgccgaccccagcggcgccuucagaaugcugagcaccgccuacgagcagagcgcccaggccgcccagcaggugagcgacagcagcagacugcuggaccagcugagagacagcagaagagaggccgagagacuggugagacaggccggcggcggcggcggcaccggcagccccaagcugguggcccugagacuggagaugagcagccugcccgaccugacccccaccuucaacaagcugugcggcaacagcagacagauggccugcacccccaucagcugccccggcgagcugugcccccaggacaacggcaccgccugcggcagcagaugcagaggcgugcugcccagagccggcggcgccuuccugauggccggccagguggccgagcagcugagaggcuucaacgcccagcugcagagaaccagacagaugaucagagccgccgaggagagcgccagccagauccagagcagcgcccagagacuggagacccaggugagcgccagcagaagccagauggaggaggacgugagaagaaccagacugcugauccagcaggugagagacuuccugaccgaccccgacaccgacgccgccaccauccaggaggugagcgaggccgugcuggcccuguggcugcccaccgacagcgccaccgugcugcagaagaugaacgagauccaggccaucgccgccagacugcccaacguggaccuggugcugagccagaccaagcaggacaucgccagagccagaagacugcaggccgaggccgaggaggccagaagcagagcccacgccguggagggccagguggaggacguggugggcaaccugagacagggcaccguggcccugcaggaggcccaggacaccaugcagggcaccagcagaagccugagacugauccaggacagaguggccgaggugcagcaggugcugagacccgccgagaagcuggugaccagcaugaccaagcagcugggcgacuucuggaccagaauggaggagcugagacaccaggccagacagcagggcgccgaggccgugcaggcccagcagcuggccgagggcgccagcgagcaggcccugagcgcccaggagggcuucgagagaaucaagcagaaguacgccgagcugaaggacagacugggccagagcagcaugcugggcgagcagggcgccagaauccagagcgugaagaccgaggccgaggagcuguucggcgagaccauggagaugauggacagaaugaaggacauggagcuggagcugcugagaggcagccaggccaucaugcugagaagcgccgaccugaccggccuggagaagagaguggagcagaucagagaccacaucaacggcagagugcuguacuacgccaccugcaaguaa

SEQ ID NO: 19138 - RNA, 5286 nt, Artificial Sequence
  LAMB4__Homo_sapiens__NP_031382
augcaguuccagcugacccuguuccugcaccugggcuggcugagcuacagcaaggcccaggacgacugcaacagaggcgccugccaccccaccaccggcgaccugcuggugggcagaaacacccagcugauggccagcagcaccugcggccugagcagagcccagaaguacugcauccugagcuaccuggagggcgagcagaagugcuucaucugcgacagcagauuccccuacgaccccuacgaccagcccaacagccacaccaucgagaacgugaucgugagcuucgagcccgacagagagaagaagugguggcagagcgagaacggccuggaccacgugagcaucagacuggaccuggaggcccuguucagauucagccaccugauccugaccuucaagaccuucagacccgccgccaugcugguggagagaagcaccgacuacggccacaacuggaagguguucaaguacuucgccaaggacugcgccaccagcuuccccaacaucaccagcggccaggcccagggcgugggcgacaucgugugcgacagcaaguacagcgacaucgagcccagcaccggcggcgagguggugcugaaggugcuggaccccagcuucgagaucgagaaccccuacagccccuacauccaggaccuggugacccugaccaaccugagaaucaacuucaccaagcugcacacccugggcgacgcccugcugggcagaagacagaacgacagccuggacaaguacuacuacgcccuguacgagaugaucgugagaggcagcugcuucugcaacggccacgccagcgagugcagacccaugcagaagaugagaggcgacguguucagcccccccggcauggugcacggccagugcgugugccagcacaacaccgacggccccaacugcgagagaugcaaggacuucuuccaggacgcccccuggagacccgccgccgaccugcaggacaacgccugcagaagcugcagcugcaacagccacagcagcagaugccacuucgacaugaccaccuaccuggccagcggcggccugagcggcggcgugugcgaggacugccagcacaacaccgagggccagcacugcgacagaugcagaccccuguucuacagagacccccugaagaccaucagcgaccccuacgccugcauccccugcgagugcgaccccgacggcaccaucagcggcggcaucugcgugagccacagcgaccccgcccugggcagcguggccggccagugccugugcaaggagaacguggagggcgccaagugcgaccagugcaagcccaaccacuacggccugagcgccaccgacccccugggcugccagcccugcgacugcaacccccugggcagccugcccuuccugaccugcgacguggacaccggccagugccugugccugagcuacgugaccggcgcccacugcgaggagugcaccgugggcuacuggggccugggcaaccaccugcacggcugcagccccugcgacugcgacaucggcggcgccuacagcaacgugugcagccccaagaacggccagugcgagugcagaccccacgugaccggcagaagcugcagcgagcccgcccccggcuacuucuucgccccccugaacuucuaccuguacgaggccgaggaggccaccacccugcagggccuggccccccugggcagcgagaccuucggccagagccccgccgugcacguggugcugggcgagcccgugcccggcaaccccgugaccuggaccggccccggcuucgccagagugcugcccggcgccggccugagauucgccgugaacaacauccccuuccccguggacuucaccaucgccauccacuacgagacccagagcgccgccgacuggaccgugcagaucguggugaacccccccggcggcagcgagcacugcauccccaagacccugcagagcaagccccagagcuucgcccugcccgccgccaccagaaucaugcugcugcccacccccaucugccuggagcccgacgugcaguacagcaucgacguguacuucagccagccccugcagggcgagagccacgcccacagccacgugcugguggacagccugggccugaucccccagaucaacagccuggagaacuucugcagcaagcaggaccuggacgaguaccagcugcacaacugcguggagaucgccagcgccaugggcccccaggugcugcccggcgccugcgagagacugaucaucagcaugagcgccaagcugcacgacggcgccguggccugcaagugccacccccagggcagcgugggcagcagcugcagcagacugggcggccagugccagugcaagccccugguggugggcagaugcugcgacagaugcagcaccggcagcuacgaccugggccaccacggcugccaccccugccacugccacccccagggcagcaaggacaccgugugcgaccaggugaccggccagugccccugccacggcgaggugagcggcagaagaugcgacagaugccuggccggcuacuucggcuuccccagcugccaccccugccccugcaacagauucgccgagcugugcgaccccgagaccggcagcugcuucaacugcggcggcuucaccaccggcagaaacugcgagagaugcaucgacggcuacuacggcaaccccagcagcggccagcccugcagacccugccugugccccgacgaccccagcagcaaccaguacuucgcccacagcugcuaccagaaccuguggagcagcgacgugaucugcaacugccugcagggcuacaccggcacccagugcggcgagugcagcaccggcuucuacggcaaccccagaaucagcggcgcccccugccagcccugcgccugcaacaacaacaucgacgugaccgaccccgagagcugcagcagagugaccggcgagugccugagaugccugcacaacacccagggcgccaacugccagcugugcaagcccggccacuacggcagcgcccugaaccagaccugcagaagaugcagcugccacgccagcggcgugagccccauggagugcccccccggcggcggcgccugccugugcgaccccgugaccggcgccugccccugccugcccaacgugaccggccuggccugcgacagaugcgccgacggcuacuggaaccuggugcccggcagaggcugccagagcugcgacugcgaccccagaaccagccagagcagccacugcgaccagcugaccggccagugccccugcaagcugggcuacggcggcaagagaugcagcgagugccaggagaacuacuacggcgacccccccggcagaugcauccccugcgacugcaacagagccggcacccagaagcccaucugcgaccccgacaccggcaugugcagaugcagagagggcgugagcggccagagaugcgacagaugcgccagaggccacagccaggaguuccccaccugccugcagugccaccugugcuucgaccagugggaccacaccaucagcagccugagcaaggccgugcagggccugaugagacuggccgccaacauggaggacaagagagagacccugcccgugugcgaggccgacuucaaggaccugagaggcaacgugagcgagaucgagagaauccugaagcaccccguguuccccagcggcaaguuccugaaggugaaggacuaccacgacagcgugagaagacagaucaugcagcugaacgagcagcugaaggccguguacgaguuccaggaccugaaggacaccaucgagagagccaagaacgaggccgaccugcugcuggaggaccugcaggaggagaucgaccugcagagcagcgugcugaacgccagcaucgccgacagcagcgagaacaucaagaaguacuaccacaucagcagcagcgccgagaagaagaucaacgagaccagcagcaccaucaacaccagcgccaacaccagaaacgaccugcugaccauccuggacacccugaccagcaagggcaaccugagccuggagagacugaagcagaucaagauccccgacauccagauccugaacgagaaggugugcggcgaccccggcaacgugcccugcgugccccugcccugcggcggcgcccugugcaccggcagaaagggccacagaaagugcagaggccccggcugccacggcagccugacccugagcaccaacgcccugcagaaggcccaggaggccaagagcaucaucagaaaccuggacaagcaggugagaggccugaagaaccagaucgagagcaucagcgagcaggccgaggugagcaagaacaacgcccugcagcugagagagaagcugggcaacaucagaaaccagagcgacagcgaggaggagaacaucaaccuguucaucaagaaggugaagaacuuccugcuggaggagaacgugccccccgaggacaucgagaagguggccaacggcgugcuggacauccaccugcccauccccagccagaaccugaccgacgagcuggugaagauccagaagcacaugcagcugugcgaggacuacagaaccgacgagaacagacugaacgaggaggccgacggcgcccagaagcugcuggugaaggccaaggccgccgagaaggccgccaacauccugcugaaccuggacaagacccugaaccagcugcagcaggcccagaucacccagggcagagccaacagcaccaucacccagcugaccgccaacaucaccaagaucaagaagaacgugcugcaggccgagaaccagaccagagagaugaagagcgagcuggagcuggccaagcagagaagcggccuggaggacggccugagccugcugcagaccaagcugcagagacaccaggaccacgccgugaacgccaaggugcaggccgagagcgcccagcaccaggccggcagccuggagaaggaguucguggagcugaagaagcaguacgccauccugcagagaaagaccagcaccaccggccugaccaaggagacccugggcaaggugaagcagcugaaggacgccgccgagaagcuggccggcgacaccgaggccaagaucagaagaaucaccgaccuggagagaaagauccaggaccugaaccugagcagacaggccaaggccgaccagcugagaauccuggaggaccaggugguggccaucaagaacgagaucguggagcaggagaagaaguacgccagaugcuacagcuaa

SEQ ID NO: 19139 - RNA, 4830 nt, Artificial Sequence
  LAMC1__Homo_sapiens__NP_002284
augagaggcagccacagagccgcccccgcccugagacccagaggcagacuguggcccgugcuggccgugcuggccgccgccgccgccgccggcugcgcccaggccgccauggacgagugcaccgacgagggcggcagaccccagagaugcaugcccgaguucgugaacgccgccuucaacgugaccgugguggccaccaacaccugcggcaccccccccgaggaguacugcgugcagaccggcgugaccggcgugaccaagagcugccaccugugcgacgccggccagccccaccugcagcacggcgccgccuuccugaccgacuacaacaaccaggccgacaccaccugguggcagagccagaccaugcuggccggcgugcaguaccccagcagcaucaaccugacccugcaccugggcaaggccuucgacaucaccuacgugagacugaaguuccacaccagcagacccgagagcuucgccaucuacaagagaaccagagaggacggccccuggauccccuaccaguacuacagcggcagcugcgagaacaccuacagcaaggccaacagaggcuucaucagaaccggcggcgacgagcagcaggcccugugcaccgacgaguucagcgacaucagcccccugaccggcggcaacguggccuucagcacccuggagggcagacccagcgccuacaacuucgacaacagccccgugcugcaggagugggugaccgccaccgacaucagagugacccugaacagacugaacaccuucggcgacgagguguucaacgaccccaaggugcugaagagcuacuacuacgccaucagcgacuucgccgugggcggcagaugcaagugcaacggccacgccagcgagugcaugaagaacgaguucgacaagcuggugugcaacugcaagcacaacaccuacggcguggacugcgagaagugccugcccuucuucaacgacagacccuggagaagagccaccgccgagagcgccagcgagugccugcccugcgacugcaacggcagaagccaggagugcuacuucgaccccgagcuguacagaagcaccggccacggcggccacugcaccaacugccaggacaacaccgacggcgcccacugcgagagaugcagagagaacuucuucagacugggcaacaacgaggccugcagcagcugccacugcagccccgugggcagccugagcacccagugcgacagcuacggcagaugcagcugcaagcccggcgugaugggcgacaagugcgacagaugccagcccggcuuccacagccugaccgaggccggcugcagacccugcagcugcgaccccagcggcagcaucgacgagugcaacaucgagaccggcagaugcgugugcaaggacaacguggagggcuucaacugcgagagaugcaagcccggcuucuucaaccuggagagcagcaaccccagaggcugcacccccugcuucugcuucggccacagcagcgugugcaccaacgccgugggcuacagcguguacagcaucagcagcaccuuccagaucgacgaggacggcuggagagccgagcagagagacggcagcgaggccagccuggaguggagcagcgagagacaggacaucgccgugaucagcgacagcuacuuccccagauacuucaucgcccccgccaaguuccugggcaagcaggugcugagcuacggccagaaccugagcuucagcuucagaguggacagaagagacaccagacugagcgccgaggaccuggugcuggagggcgccggccugagagugagcgugccccugaucgcccagggcaacagcuaccccagcgagaccaccgugaaguacguguucagacugcacgaggccaccgacuaccccuggagacccgcccugacccccuucgaguuccagaagcugcugaacaaccugaccagcaucaagaucagaggcaccuacagcgagagaagcgccggcuaccuggacgacgugacccuggccagcgccagacccggccccggcgugcccgccaccuggguggagagcugcaccugccccgugggcuacggcggccaguucugcgagaugugccugagcggcuacagaagagagacccccaaccugggccccuacagccccugcgugcugugcgccugcaacggccacagcgagaccugcgaccccgagaccggcgugugcaacugcagagacaacaccgccggcccccacugcgagaagugcagcgacggcuacuacggcgacagcaccgccggcaccagcagcgacugccagcccugccccugccccggcggcagcagcugcgccguggugcccaagaccaaggagguggugugcaccaacugccccaccggcaccaccggcaagagaugcgagcugugcgacgacggcuacuucggcgacccccugggcagaaacggccccgugagacugugcagacugugccagugcagcgacaacaucgaccccaacgccgugggcaacugcaacagacugaccggcgagugccugaagugcaucuacaacaccgccggcuucuacugcgacagaugcaaggacggcuucuucggcaacccccuggcccccaaccccgccgacaagugcaaggccugcaacugcaaccuguacggcaccaugaagcagcagagcagcugcaaccccgugaccggccagugcgagugccugccccacgugaccggccaggacugcggcgccugcgaccccggcuucuacaaccugcagagcggccagggcugcgagagaugcgacugccacgcccugggcagcaccaacggccagugcgacaucagaaccggccagugcgagugccagcccggcaucaccggccagcacugcgagagaugcgaggugaaccacuucggcuucggccccgagggcugcaagcccugcgacugccaccccgagggcagccugagccugcagugcaaggacgacggcagaugcgagugcagagagggcuucgugggcaacagaugcgaccagugcgaggagaacuacuucuacaacagaagcuggcccggcugccaggagugccccgccugcuacagacuggugaaggacaagguggccgaccacagagugaagcugcaggagcuggagagccugaucgccaaccugggcaccggcgacgagauggugaccgaccaggccuucgaggacagacugaaggaggccgagagagaggugauggaccugcugagagaggcccaggacgugaaggacguggaccagaaccugauggacagacugcagagagugaacaacacccugagcagccagaucagcagacugcagaacaucagaaacaccaucgaggagaccggcaaccuggccgagcaggccagagcccacguggagaacaccgagagacugaucgagaucgccagcagagagcuggagaaggccaagguggccgccgccaacgugagcgugacccagcccgagagcaccggcgaccccaacaacaugacccugcuggccgaggaggccagaaagcuggccgagagacacaagcaggaggccgacgacaucgugagaguggccaagaccgccaacgacaccagcaccgaggccuacaaccugcugcugagaacccuggccggcgagaaccagaccgccuucgagaucgaggagcugaacagaaaguacgagcaggccaagaacaucagccaggaccuggagaagcaggccgccagagugcacgaggaggccaagagagccggcgacaaggccguggagaucuacgccagcguggcccagcugagcccccuggacagcgagacccuggagaacgaggccaacaacaucaagauggaggccgagaaccuggagcagcugaucgaccagaagcugaaggacuacgaggaccugagagaggacaugagaggcaaggagcuggaggugaagaaccugcuggagaagggcaagaccgagcagcagaccgccgaccagcugcuggccagagccgacgccgccaaggcccuggccgaggaggccgccaagaagggcagagacacccugcaggaggccaacgacauccugaacaaccugaaggacuucgacagaagagugaacgacaacaagaccgccgccgaggaggcccugagaaagauccccgccaucaaccagaccaucaccgaggccaacgagaagaccagagaggcccagcaggcccugggcagcgccgccgccgacgccaccgaggccaagaacaaggcccacgaggccgagagaaucgccagcgccgugcagaagaacgccaccagcaccaaggccgaggccgagagaaccuucgccgaggugaccgaccuggacaacgaggugaacaacaugcugaagcagcugcaggaggccgagaaggagcugaagagaaagcaggacgacgccgaccaggacaugaugauggccggcauggccagccaggccgcccaggaggccgagaucaacgccagaaaggccaagaacagcgugaccagccugcugagcaucaucaacgaccugcuggagcagcugggccagcuggacaccguggaccugaacaagcugaacgagaucgagggcacccugaacaaggccaaggacgagaugaaggugagcgaccuggacagaaaggugagcgaccuggagaacgaggccaagaagcaggaggccgccaucauggacuacaacagagacaucgaggagaucaugaaggacaucagaaaccuggaggacaucagaaagacccugcccagcggcugcuucaacacccccagcaucgagaagcccuaa

SEQ ID NO: 19140 - RNA, 3582 nt, Artificial Sequence
  LAMC2__Homo_sapiens__NP_005553
augcccgcccuguggcugggcugcugccugugcuucagccugcugcugcccgccgccagagccaccagcagaagagaggugugcgacugcaacggcaagagcagacagugcaucuucgacagagagcugcacagacagaccggcaacggcuucagaugccugaacugcaacgacaacaccgacggcauccacugcgagaagugcaagaacggcuucuacagacacagagagagagacagaugccugcccugcaacugcaacagcaagggcagccugagcgccagaugcgacaacagcggcagaugcagcugcaagcccggcgugaccggcgccagaugcgacagaugccugcccggcuuccacaugcugaccgacgccggcugcacccaggaccagagacugcuggacagcaagugcgacugcgaccccgccggcaucgccggccccugcgacgccggcagaugcgugugcaagcccgccgugaccggcgagagaugcgacagaugcagaagcggcuacuacaaccuggacggcggcaaccccgagggcugcacccagugcuucugcuacggccacagcgccagcugcagaagcagcgccgaguacagcgugcacaagaucaccagcaccuuccaccaggacguggacggcuggaaggccgugcagagaaacggcagccccgccaagcugcaguggagccagagacaccaggacguguucagcagcgcccagagacuggaccccguguacuucguggcccccgccaaguuccugggcaaccagcaggugagcuacggccagagccugagcuucgacuacagaguggacagaggcggcagacaccccagcgcccacgacgugauccuggagggcgccggccugagaaucaccgccccccugaugccccugggcaagacccugcccugcggccugaccaagaccuacaccuucagacugaacgagcaccccagcaacaacuggagcccccagcugagcuacuucgaguacagaagacugcugagaaaccugaccgcccugagaaucagagccaccuacggcgaguacagcaccggcuacaucgacaacgugacccugaucagcgccagacccgugagcggcgcccccgcccccuggguggagcagugcaucugccccgugggcuacaagggccaguucugccaggacugcgccagcggcuacaagagagacagcgccagacugggccccuucggcaccugcauccccugcaacugccagggcggcggcgccugcgaccccgacaccggcgacugcuacagcggcgacgagaaccccgacaucgagugcgccgacugccccaucggcuucuacaacgacccccacgaccccagaagcugcaagcccugccccugccacaacggcuucagcugcagcgugaugcccgagaccgaggagguggugugcaacaacugcccccccggcgugaccggcgccagaugcgagcugugcgccgacggcuacuucggcgaccccuucggcgagcacggccccgugagacccugccagcccugccagugcaacaacaacguggaccccagcgccagcggcaacugcgacagacugaccggcagaugccugaagugcauccacaacaccgccggcaucuacugcgaccagugcaaggccggcuacuucggcgacccccuggcccccaaccccgccgacaagugcagagccugcaacugcaaccccaugggcagcgagcccgugggcugcagaagcgacggcaccugcgugugcaagcccggcuucggcggccccaacugcgagcacggcgccuucagcugccccgccugcuacaaccaggugaagauccagauggaccaguucaugcagcagcugcagagaauggaggcccugaucagcaaggcccagggcggcgacggcguggugcccgacaccgagcuggagggcagaaugcagcaggccgagcaggcccugcaggacauccugagagacgcccagaucagcgagggcgccagcagaagccugggccugcagcuggccaaggugagaagccaggagaacagcuaccagagcagacuggacgaccugaagaugaccguggagagagugagagcccugggcagccaguaccagaacagagugagagacacccacagacugaucacccagaugcagcugagccuggccgagagcgaggccagccugggcaacaccaacauccccgccagcgaccacuacgugggccccaacggcuucaagagccuggcccaggaggccaccagacuggccgagagccacguggagagcgccagcaacauggagcagcugaccagagagaccgaggacuacagcaagcaggcccugagccuggugagaaaggcccugcacgagggcgugggcagcggcagcggcagccccgacggcgccguggugcagggccugguggagaagcuggagaagaccaagagccuggcccagcagcugaccagagaggccacccaggccgagaucgaggccgacagaagcuaccagcacagccugagacugcuggacagcgugagcagacugcagggcgugagcgaccagagcuuccagguggaggaggccaagagaaucaagcagaaggccgacagccugagcagccuggugaccagacacauggacgaguucaagagaacccagaagaaccugggcaacuggaaggaggaggcccagcagcugcugcagaacggcaagagcggcagagagaagagcgaccagcugcugagcagagccaaccuggccaagagcagagcccaggaggcccugagcaugggcaacgccaccuucuacgagguggagagcauccugaagaaccugagagaguucgaccugcagguggacaacagaaaggccgaggccgaggaggccaugaagagacugagcuacaucagccagaaggugagcgacgccagcgacaagacccagcaggccgagagagcccugggcagcgccgccgccgacgcccagagagccaagaacggcgccggcgaggcccuggagaucagcagcgagaucgagcaggagaucggcagccugaaccuggaggccaacgugaccgccgacggcgcccuggccauggagaagggccuggccagccugaagagcgagaugagagagguggagggcgagcuggagagaaaggagcuggaguucgacaccaacauggacgccgugcagauggugaucaccgaggcccagaagguggacaccagagccaagaacgccggcgugaccauccaggacacccugaacacccuggacggccugcugcaccugauggaccagccccugagcguggacgaggagggccuggugcugcuggagcagaagcugagcagagccaagacccagaucaacagccagcugagacccaugaugagcgagcuggaggagagagccagacagcagagaggccaccugcaccugcuggagaccagcaucgacggcauccuggccgacgugaagaaccuggagaacaucagagacaaccugccccccggcugcuacaacacccaggcccuggagcagcaguaa

SEQ ID NO: 19141 - RNA, 4728 nt, Artificial Sequence
  LAMC3__Homo_sapiens__NP_006050
auggccgccgccgcccugcugcugggccuggcccugcuggcccccagagccgccggcgccggcaugggcgccugcuacgacggcgccggcagaccccagagaugccugcccguguucgagaacgccgccuucggcagacuggcccaggccagccacaccugcggcagcccccccgaggacuucugcccccacgugggcgccgccggcgccggcgcccacugccagagaugcgacgccgccgacccccagagacaccacaacgccagcuaccugaccgacuuccacagccaggacgagagcaccugguggcagagccccagcauggccuucggcgugcaguaccccaccagcgugaacaucacccugagacugggcaaggccuacgagaucaccuacgugagacugaaguuccacaccagcagacccgagagcuucgccaucuacaagagaagcagagccgacggccccugggagcccuaccaguucuacagcgccagcugccagaagaccuacggcagacccgagggccaguaccugagacccggcgaggacgagagaguggccuucugcaccagcgaguucagcgacaucagcccccugagcggcggcaacguggccuucagcacccuggagggcagacccagcgccuacaacuucgaggagagccccggccugcaggagugggugaccagcaccgagcugcugaucagccuggacagacugaacaccuucggcgacgacaucuucaaggaccccaaggugcugcagagcuacuacuacgccgugagcgacuucagcgugggcggcagaugcaagugcaacggccacgccagcgagugcggccccgacguggccggccagcuggccugcagaugccagcacaacaccaccggcaccgacugcgagagaugccugcccuucuuccaggacagacccugggccagaggcaccgccgaggccgcccacgagugccugcccugcaacugcagcggcagaagcgaggagugcaccuucgacagagagcuguucagaagcaccggccacggcggcagaugccaccacugcagagaccacaccgccggcccccacugcgagagaugccaggagaacuucuaccacugggaccccagaaugcccugccagcccugcgacugccagagcgccggcagccugcaccugcagugcgacgacaccggcaccugcgccugcaagcccaccgugaccggcuggaagugcgacagaugccugcccggcuuccacagccugagcgagggcggcugcagacccugcaccugcaaccccgccggcagccuggacaccugcgaccccagaagcggcagaugccccugcaaggagaacguggagggcaaccugugcgacagaugcagacccggcaccuucaaccugcagccccacaaccccgccggcugcagcagcugcuucugcuacggccacagcaaggugugcgccagcaccgcccaguuccaggugcaccacauccugagcgacuuccaccagggcgccgagggcuggugggccagaagcgugggcggcagcgagcaccccccccaguggagccccaacggcgugcugcugagccccgaggacgaggaggagcugaccgcccccgagaaguuccugggcgaccagagauucagcuacggccagccccugauccugaccuucagagugccccccggcgacagcccccugcccgugcagcugagacuggagggcaccggccuggcccugagccugagacacagcagccugagcggcccccaggacgccggccaccccagagagguggagcugagauuccaccugcaggagaccagcgaggacguggcccccccccugccccccuuccacuuccagagacugcuggccaaccugaccagccugagacugagagugagccccggccccagccccgccggccccguguuccugaccgaggugagacugaccagcgccagacccggccugagcccccccgccagcuggguggagaucugcagcugccccaccggcuacaccggccaguucugcgagagcugcgcccccggcuacaagagagagaugccccagggcggccccuacgccagcugcgugcccugcaccugcaaccagcacggcaccugcgaccccaacaccggcaucugcgugugcagccaccacaccgagggccccagcugcgagagaugccugcccggcuucuacggcaaccccuucgccggccaggccgacgacugccagcccugccccugccccggccagagcgccugcaccaccauccccgagagcagagagguggugugcacccacugcccccccggccagagaggcagaagaugcgaggugugcgacgacggcuucuucggcgacccccugggccuguucggccacccccagcccugccaccagugccagugcagcggcaacguggaccccaacgccgugggcaacugcgacccccugagcggccacugccugagaugccugcacaacaccaccggcgaccacugcgagcacugccaggagggcuucuacggcagcgcccuggcccccagacccgccgacaagugcaugcccugcagcugccacccccagggcagcgugagcgagcagaugcccugcgaccccgugaccggccagugcagcugccugccccacgugaccgccagagacugcagcagaugcuaccccggcuucuucgaccugcagcccggcagaggcugcagaagcugcaagugccacccccugggcagccaggaggaccagugccaccccaagaccggccagugcaccugcagacccggcgugaccggccaggccugcgacagaugccagcugggcuucuucggcuucagcaucaagggcugcagagccugcagaugcagcccccugggcgccgccagcgcccagugccacgagaacggcaccugcgugugcagacccggcuucgagggcuacaagugcgacagaugccacgacaacuucuuccugaccgccgacggcacccacugccagcagugccccagcugcuacgcccuggugaaggaggaggccgccaagcugaaggccagacugacccugaccgagggcuggcugcagggcagcgacugcggcagccccuggggcccccuggacauccugcugggcgaggcccccagaggcgacguguaccagggccaccaccugcugcccggcgccagagaggccuuccuggagcagaugaugagccuggagggcgccgugaaggccgccagagagcagcugcagagacugaacaagggcgccagaugcgcccaggccggcagccagaagaccugcacccagcuggccgaccuggaggccgugcuggagagcagcgaggaggagauccugcacgccgccgccauccuggccagccuggagaucccccaggagggccccagccagcccaccaaguggagccaccuggccaccgaggccagagcccuggccagaagccacagagacaccgccaccaagaucgccgccaccgccuggagagcccugcuggccagcaacaccagcuacgcccugcuguggaaccugcuggagggcagaguggcccuggagacccagagagaccuggaggacagauaccaggaggugcaggccgcccagaaggcccugagaaccgccguggccgaggugcugcccgaggccgagagcgugcuggccaccgugcagcaggugggcgccgacaccgcccccuaccuggcccugcuggccagccccggcgcccugccccagaagagcagagccgaggaccugggccugaaggccaaggcccuggagaagaccguggccagcuggcagcacauggccaccgaggccgccagaacccugcagaccgccgcccaggccacccugagacagaccgagccccugaccaagcugcaccaggaggccagagccgcccugacccaggccagcagcagcgugcaggccgccaccgugaccgugaugggcgccagaacccugcuggccgaccuggagggcaugaagcugcaguuccccagacccaaggaccaggccgcccugcagagaaaggccgacagcgugagcgacagacugcuggccgacaccagaaagaagaccaagcaggccgagagaaugcugggcaacgccgccccccugagcagcagcgccaagaagaagggcagagaggccgaggugcuggccaaggacagcgccaagcuggccaaggcccugcugagagagagaaagcaggcccacagaagagccagcagacugaccagccagacccaggccacccugcagcaggccagccagcaggugcuggccagcgaggccagaagacaggagcuggaggaggccgagagagugggcgccggccugagcgagauggagcagcagaucagagagagcagaaucagccuggagaaggacaucgagacccugagcgagcugcuggccagacugggcagccuggacacccaccaggcccccgcccaggcccugaacgagacccagugggcccuggagagacugagacugcagcugggcagccccggcagccugcagagaaagcugagccugcuggagcaggagagccagcagcaggagcugcagauccagggcuucgagagcgaccuggccgagaucagagccgacaagcagaaccuggaggccauccugcacagccugcccgagaacugcgccagcuggcaguaa

SEQ ID NO: 19142 - RNA, 1254 nt, Artificial Sequence
  LAMP1__Homo_sapiens__NP_005552
auggccgcccccggcagcgccagaagaccccugcugcugcugcugcugcugcugcugcugggccugaugcacugcgccagcgccgccauguucauggugaagaacggcaacggcaccgccugcaucauggccaacuucagcgccgccuucagcgugaacuacgacaccaagagcggccccaagaacaugaccuucgaccugcccagcgacgccaccguggugcugaacagaagcagcugcggcaaggagaacaccagcgaccccagccuggugaucgccuucggcagaggccacacccugacccugaacuucaccagaaacgccaccagauacagcgugcagcugaugagcuucguguacaaccugagcgacacccaccuguuccccaacgccagcagcaaggagaucaagaccguggagagcaucaccgacaucagagccgacaucgacaagaaguacagaugcgugagcggcacccaggugcacaugaacaacgugaccgugacccugcacgacgccaccauccaggccuaccugagcaacagcagcuucagcagaggcgagaccagaugcgagcaggacagacccagccccaccaccgccccccccgccccccccagccccagccccagccccgugcccaagagccccagcguggacaaguacaacgugagcggcaccaacggcaccugccugcuggccagcaugggccugcagcugaaccugaccuacgagagaaaggacaacaccaccgugaccagacugcugaacaucaaccccaacaagaccagcgccagcggcagcugcggcgcccaccuggugacccuggagcugcacagcgagggcaccaccgugcugcuguuccaguucggcaugaacgccagcagcagcagauucuuccugcagggcauccagcugaacaccauccugcccgacgccagagaccccgccuucaaggccgccaacggcagccugagagcccugcaggccaccgugggcaacagcuacaagugcaacgccgaggagcacgugagagugaccaaggccuucagcgugaacaucuucaaggugugggugcaggccuucaagguggagggcggccaguucggcagcguggaggagugccugcuggacgagaacagcaugcugauccccaucgccgugggcggcgcccuggccggccuggugcugaucgugcugaucgccuaccuggugggcagaaagagaagccacgccggcuaccagaccaucuaa

SEQ ID NO: 19143 - RNA, 1236 nt, Artificial Sequence
  LAMP2__Homo_sapiens__NP_001116078
auggugugcuucagacuguuccccgugcccggcagcggccuggugcuggugugccuggugcugggcgccgugagaagcuacgcccuggagcugaaccugaccgacagcgagaacgccaccugccuguacgccaaguggcagaugaacuucaccgugagauacgagaccaccaacaagaccuacaagaccgugaccaucagcgaccacggcaccgugaccuacaacggcagcaucugcggcgacgaccagaacggccccaagaucgccgugcaguucggccccggcuucagcuggaucgccaacuucaccaaggccgccagcaccuacagcaucgacagcgugagcuucagcuacaacaccggcgacaacaccaccuuccccgacgccgaggacaagggcauccugaccguggacgagcugcuggccaucagaaucccccugaacgaccuguucagaugcaacagccugagcacccuggagaagaacgacguggugcagcacuacugggacgugcuggugcaggccuucgugcagaacggcaccgugagcaccaacgaguuccugugcgacaaggacaagaccagcaccguggcccccaccauccacaccaccgugcccagccccaccaccacccccacccccaaggagaagcccgaggccggcaccuacagcgugaacaacggcaacgacaccugccugcuggccaccaugggccugcagcugaacaucacccaggacaagguggccagcgugaucaacaucaaccccaacaccacccacagcaccggcagcugcagaagccacaccgcccugcugagacugaacagcagcaccaucaaguaccuggacuucguguucgccgugaagaacgagaacagauucuaccugaaggaggugaacaucagcauguaccuggugaacggcagcguguucagcaucgccaacaacaaccugagcuacugggacgccccccugggcagcagcuacaugugcaacaaggagcagaccgugagcgugagcggcgccuuccagaucaacaccuucgaccugagagugcagcccuucaacgugacccagggcaaguacagcaccgccgaggagugcagcgccgacagcgaccugaacuuccugauccccguggccgugggcguggcccugggcuuccugaucaucgugguguucaucagcuacaugaucggcagaagaaagagcagaaccggcuaccagagcguguaa

SEQ ID NO: 19144 - RNA, 1251 nt, Artificial Sequence
  LAMP3__Homo_sapiens__NP_055213
augcccagacagcugagcgccgccgccgcccuguucgccagccuggccgugauccugcacgacggcagccagaugagagccaaggccuuccccgagaccagagacuacagccagcccaccgccgccgccaccgugcaggacaucaagaagcccgugcagcagcccgccaagcaggccccccaccagacccuggccgccagauucauggacggccacaucaccuuccagaccgccgccaccgugaagauccccaccaccacccccgccaccaccaagaacaccgccaccaccagccccaucaccuacacccuggugaccacccaggccacccccaacaacagccacaccgccccccccgugaccgaggugaccgugggccccagccuggcccccuacagccugccccccaccaucaccccccccgcccacaccaccggcaccagcagcagcaccgugagccacaccaccggcaacaccacccagcccagcaaccagaccacccugcccgccacccugagcaucgcccugcacaagagcaccaccggccagaagcccgugcagcccacccacgcccccggcaccaccgccgccgcccacaacaccaccagaaccgccgcccccgccagcaccgugcccggccccacccuggccccccagcccagcagcgugaagaccggcaucuaccaggugcugaacggcagcagacugugcaucaaggccgagaugggcauccagcugaucgugcaggacaaggagagcguguucagccccagaagauacuucaacaucgaccccaacgccacccaggccagcggcaacugcggcaccagaaagagcaaccugcugcugaacuuccagggcggcuucgugaaccugaccuucaccaaggacgaggagagcuacuacaucagcgaggugggcgccuaccugaccgugagcgaccccgagaccaucuaccagggcaucaagcacgccguggugauguuccagaccgccgugggccacagcuucaagugcgugagcgagcagagccugcagcugagcgcccaccugcaggugaagaccaccgacgugcagcugcaggccuucgacuucgaggacgaccacuucggcaacguggacgagugcagcagcgacuacaccaucgugcugcccgugaucggcgccaucguggugggccugugccugaugggcaugggcguguacaagaucagacugagaugccagagcagcggcuaccagagaaucuaa

SEQ ID NO: 19145 - RNA, 486 nt, Artificial Sequence
  LAMTOR1__Homo_sapiens__NP_060377
augggcugcugcuacagcagcgagaacgaggacagcgaccaggacagagaggagagaaagcugcugcuggaccccagcagcccccccaccaaggcccugaacggcgccgagcccaacuaccacagccugcccagcgccagaaccgacgagcaggcccugcugagcagcauccuggccaagaccgccagcaacaucaucgacgugagcgccgccgacagccagggcauggagcagcacgaguacauggacagagccagacaguacagcaccagacuggccgugcugagcagcagccugacccacuggaagaagcugcccccccugcccagccugaccagccagccccaccaggugcuggccagcgagcccauccccuucagcgaccugcagcaggugagcagaaucgccgccuacgccuacagcgcccugagccagaucagaguggacgccaaggaggagcugguggugcaguucggcauccccuaa

SEQ ID NO: 19146 - RNA, 288 nt, Artificial Sequence
  LAMTOR2__Homo_sapiens__NP_001138736
augcugagacccaaggcccugacccaggugcugagccaggccaacaccggcggcgugcagagcacccugcugcugaacaacgagggcagccugcuggccuacagcggcuacggcgacaccgacgccagagugaccgccgccaucgccagcaacaucugggccgccuacgacagaaacggcaaccaggccuucaacgaggacaaccugaaguucauccugauggacugcauggcccaggcccuggugcaguaccuggaggagccccugacccagguggccgccagcuaa

SEQ ID NO: 19147 - RNA, 375 nt, Artificial Sequence
  LAMTOR3__Homo_sapiens__NP_068805
auggccgacgaccugaagagauuccuguacaagaagcugcccagcguggagggccugcacgccaucguggugagcgacagagacggcgugcccgugaucaagguggccaacgacaacgcccccgagcacgcccugagacccggcuuccugagcaccuucgcccuggccaccgaccagggcagcaagcugggccugagcaagaacaagagcaucaucugcuacuacaacaccuaccagguggugcaguucaacagacugccccugguggugagcuucaucgccagcagcagcgccaacaccggccugaucgugagccuggagaaggagcuggccccccuguucgaggagcugagacaggugguggaggugagcuaa

SEQ ID NO: 19148 - RNA, 1200 nt, Artificial Sequence
  LANCL1__Homo_sapiens__NP_001130047
auggcccagagagccuuccccaaccccuacgccgacuacaacaagagccuggccgagggcuacuucgacgccgccggcagacugacccccgaguucagccagagacugaccaacaagaucagagagcugcugcagcagauggagagaggccugaagagcgccgaccccagagacggcaccggcuacaccggcugggccggcaucgccgugcuguaccugcaccuguacgacguguucggcgaccccgccuaccugcagcuggcccacggcuacgugaagcagagccugaacugccugaccaagagaagcaucaccuuccugugcggcgacgccggcccccuggccguggccgccgugcuguaccacaagaugaacaacgagaagcaggccgaggacugcaucaccagacugauccaccugaacaagaucgacccccacgcccccaacgagaugcuguacggcagaaucggcuacaucuacgcccugcuguucgugaacaagaacuucggcguggagaagaucccccagagccacauccagcagaucugcgagaccauccugaccagcggcgagaaccuggccagaaagagaaacuucaccgccaagagcccccugauguacgagugguaccaggaguacuacgugggcgccgcccacggccuggccggcaucuacuacuaccugaugcagcccagccugcaggugagccagggcaagcugcacagccuggugaagcccagcguggacuacgugugccagcugaaguuccccagcggcaacuacccccccugcaucggcgacaacagagaccugcuggugcacuggugccacggcgcccccggcgugaucuacaugcugauccaggccuacaagguguucagagaggagaaguaccugugcgacgccuaccagugcgccgacgugaucuggcaguacggccugcugaagaagggcuacggccugugccacggcagcgccggcaacgccuacgccuuccugacccuguacaaccugacccaggacaugaaguaccuguacagagccugcaaguucgccgaguggugccuggaguacggcgagcacggcugcagaacccccgacacccccuucagccuguucgagggcauggccggcaccaucuacuuccuggccgaccugcuggugcccaccaaggccagauuccccgccuucgagcuguaa

SEQ ID NO: 19149 - RNA, 1353 nt, Artificial Sequence
  LANCL2__Homo_sapiens__NP_061167
augggcgagaccaugagcaagagacugaagcugcaccugggcggcgaggccgagauggaggagagagccuucgugaaccccuuccccgacuacgaggccgccgccggcgcccugcuggccagcggcgccgccgaggagaccggcugcgugagaccccccgccaccaccgacgagcccggccugcccuuccaccaggacggcaagaucauccacaacuucaucagaagaauccagaccaagaucaaggaccugcugcagcagauggaggagggccugaagaccgccgacccccacgacugcagcgccuacaccggcuggaccggcaucgcccugcuguaccugcagcuguacagagugaccugcgaccagaccuaccugcugagaagccuggacuacgugaagagaacccugagaaaccugaacggcagaagagugaccuuccugugcggcgacgccggcccccuggccgugggcgccgugaucuaccacaagcugagaagcgacugcgagagccaggagugcgugaccaagcugcugcagcugcagagaagcguggugugccaggagagcgaccugcccgacgagcugcuguacggcagagccggcuaccuguacgcccugcuguaccugaacaccgagaucggccccggcaccgugugcgagagcgccaucaaggagguggugaacgccaucaucgagagcggcaagacccugagcagagaggagagaaagaccgagagaugcccccugcuguaccaguggcacagaaagcaguacgugggcgccgcccacggcauggccggcaucuacuacaugcugaugcagcccgccgccaagguggaccaggagacccugaccgagauggugaagcccagcaucgacuacgugagacacaagaaguucagaagcggcaacuaccccagcagccugagcaacgagaccgacagacuggugcacuggugccacggcgcccccggcgugauccacaugcugaugcaggccuacaagguguucaaggaggagaaguaccugaaggaggccauggagugcagcgacgugaucuggcagagaggccugcugagaaagggcuacggcaucugccacggcaccgccggcaacggcuacagcuuccugagccuguacagacugacccaggacaagaaguaccuguacagagccugcaaguucgccgaguggugccuggacuacggcgcccacggcugcagaauccccgacagacccuacagccuguucgagggcauggccggcgccauccacuuccugagcgacgugcugggccccgagaccagcagauuccccgccuucgagcuggacagcagcaagagagacuaa

SEQ ID NO: 19150 - RNA, 1560 nt, Artificial Sequence
  LAP3__Homo_sapiens__NP_056991
auguuccugcugccccugcccgccgccggcagagugguggugagaagacuggccgugagaagauucggcagcagaagccugagcaccgccgacaugaccaagggccuggugcugggcaucuacagcaaggagaaggaggacgacgugccccaguucaccagcgccggcgagaacuucgacaagcugcuggccggcaagcugagagagacccugaacaucagcggccccccccugaaggccggcaagaccagaaccuucuacggccugcaccaggacuuccccagcguggugcuggugggccugggcaagaaggccgccggcaucgacgagcaggagaacuggcacgagggcaaggagaacaucagagccgccguggccgccggcugcagacagauccaggaccuggagcugagcagcguggagguggaccccugcggcgacgcccaggccgccgccgagggcgccgugcugggccuguacgaguacgacgaccugaagcagaagaagaagauggccgugagcgccaagcuguacggcagcggcgaccaggaggccuggcagaagggcgugcuguucgccagcggccagaaccuggccagacagcugauggagacccccgccaacgagaugacccccaccagauucgccgagaucaucgagaagaaccugaagagcgccagcagcaagaccgaggugcacaucagacccaagagcuggaucgaggagcaggccaugggcagcuuccugagcguggccaagggcagcgacgagccccccguguuccuggagauccacuacaagggcagccccaacgccaacgagcccccccugguguucgugggcaagggcaucaccuucgacagcggcggcaucagcaucaaggccagcgccaacauggaccugaugagagccgacaugggcggcgccgccaccaucugcagcgccaucgugagcgccgccaagcugaaccugcccaucaacaucaucggccuggccccccugugcgagaacaugcccagcggcaaggccaacaagcccggcgacguggugagagccaagaacggcaagaccauccagguggacaacaccgacgccgagggcagacugauccuggccgacgcccugugcuacgcccacaccuucaaccccaaggugauccugaacgccgccacccugaccggcgccauggacguggcccugggcagcggcgccaccggcguguucaccaacagcagcuggcuguggaacaagcuguucgaggccagcaucgagaccggcgacagaguguggagaaugccccuguucgagcacuacaccagacaggugguggacugccagcuggccgacgugaacaacaucggcaaguacagaagcgccggcgccugcaccgccgccgccuuccugaaggaguucgugacccaccccaagugggcccaccuggacaucgccggcgugaugaccaacaaggacgaggugcccuaccugagaaagggcaugaccggcagacccaccagaacccugaucgaguuccugcugagauucagccaggacaacgccuaa

SEQ ID NO: 19151 - RNA, 954 nt, Artificial Sequence
  LAPTM4B__Homo_sapiens__NP_060877
augaccagcagaaccagagugaccuggcccagcccccccagaccccugcccgugcccgccgccgccgccguggccuucggcgccaagggcaccgaccccgccgaggccagaagcagcagaggcaucgaggaggccggccccagagcccacggcagagccggcagagagcccgagagaagaagaagcagacagcagagaagaggcggccugcaggccagaagaagcacccugcugaagaccugcgccagagccagagccaccgcccccggcgccaugaagaugguggcccccuggaccagauucuacagcaacagcugcugccugugcugccacgugagaaccggcaccauccugcugggcgugugguaccugaucaucaacgccguggugcugcugauccugcugagcgcccuggccgaccccgaccaguacaacuucagcagcagcgagcugggcggcgacuucgaguucauggacgacgccaacaugugcaucgccaucgccaucagccugcugaugauccugaucugcgccauggccaccuacggcgccuacaagcagagagccgccuggaucauccccuucuucugcuaccagaucuucgacuucgcccugaacaugcugguggccaucaccgugcugaucuaccccaacagcauccaggaguacaucagacagcugccccccaacuuccccuacagagacgacgugaugagcgugaaccccaccugccuggugcugaucauccugcuguucaucagcaucauccugaccuucaagggcuaccugaucagcugcguguggaacugcuacagauacaucaacggcagaaacagcagcgacgugcugguguacgugaccagcaacgacaccaccgugcugcugccccccuacgacgacgccaccgugaacggcgccgccaaggagccccccccccccuacgugagcgccuaa

SEQ ID NO: 19152 - RNA, 2271 nt, Artificial Sequence
  LARGE__Homo_sapiens__XP_005261889
augcugggcaucugcagaggcagaagaaaguuccuggccgccagccugagccugcugugcauccccgccaucaccuggaucuaccuguucagcggcagcuucgaggacggcaagcccgugagccugagcccccuggagagccaggcccacagccccagauacaccgccagcagccagagagagagagagagccuggaggugagaaugagagagguggaggaggagaacagagcccugagaagacagcugagccuggcccagggcagagcccccagccacagaagaggcaaccacagcaagaccuacagcauggaggagggcaccggcgacagcgagaaccugagagccggcaucguggccggcaacagcagcgagugcggccagcagcccgugguggagaagugcgagaccauccacguggccaucgugugcgccggcuacaacgccagcagagacguggugacccuggugaagagcgugcuguuccacagaagaaacccccugcacuuccaccugaucgccgacagcaucgccgagcagauccuggccacccuguuccagaccuggauggugcccgccgugagaguggacuucuacaacgccgacgagcugaagagcgaggugagcuggauccccaacaagcacuacagcggcaucuacggccugaugaagcuggugcugaccaagacccugcccgccaaccuggagagagugaucgugcuggacaccgacaucaccuucgccaccgacaucgccgagcugugggccguguuccacaaguucaagggccagcaggugcugggccugguggagaaccagagcgacugguaccugggcaaccuguggaagaaccacagacccuggcccgcccugggcagaggcuacaacaccggcgugauccugcugcugcuggacaagcugagaaagaugaagugggagcagauguggagacugaccgccgagagagagcugaugggcaugcugagcaccagccuggccgaccaggacaucuucaacgccgugaucaagcagaaccccuuccugguguaccagcugcccugcuucuggaacgugcagcugagcgaccacaccagaagcgagcagugcuacagagacgugagcgaccugaaggugauccacuggaacagccccaagaagcugagagugaagaacaagcacguggaguucuucagaaaccuguaccugaccuuccuggaguacgacggcaaccugcugagaagagagcuguucggcugccccagcgaggccgacgugaacagcgagaaccugcagaagcagcugagcgagcuggacgaggacgaccugugcuacgaguucagaagagagagauucaccgugcacagaacccaccuguacuuccugcacuacgaguacgagcccgccgccgacagcaccgacgugacccugguggcccagcugagcauggacagacugcagaugcuggaggccaucugcaagcacugggagggccccaucagccuggcccuguaccugagcgacgccgaggcccagcaguuccugagauacgcccagggcagcgaggugcugaugagcagacacaacgugggcuaccacaucguguacaaggagggccaguucuaccccgugaaccugcugagaaacguggccaugaagcacaucagcacccccuacauguuccugagcgacaucgacuuccugcccauguacggccuguacgaguaccugagaaagagcgugauccagcuggaccuggccaacaccaagaaggccaugaucgugcccgccuucgagacccugagauacagacugagcuuccccaagagcaaggccgagcugcugagcaugcuggacaugggcacccuguucaccuucagauaccacguguggaccaagggccacgcccccaccaacuucgccaaguggagaaccgccaccacccccuacagaguggagugggaggccgacuucgagcccuacgugguggugagaagagacugccccgaguacgacagaagauucgugggcuucggcuggaacaagguggcccacaucauggagcuggacgugcaggaguacgaguucaucgugcugcccaacgccuacaugauccacaugccccacgcccccagcuucgacaucaccaaguucagaagcaacaagcaguacagaaucugccugaagacccugaaggaggaguuccagcaggacaugagcagaagauacggcuucgccgcccugaaguaccugaccgccgagaacaacagcuaa

SEQ ID NO: 19153 - RNA, 3060 nt, Artificial Sequence
  LARP1__Homo_sapiens__NP_056130
augcuguggagagugcugcugagcaagagaccccccuucccccaccccgagcuggacuuccaggaggcccccauccccagcugccccggcagacugcccggcagaaagaacagcguggcccuggccgccgcccccagaaaggagcccaccggcgacagagagaagccccugcccuuccccgugcuggcccccuucagcaaccccgagcacagcgcccccgccaagguggugagagccgccgugcccaagcagagaaagggcagcaaggugggcgacuucggcgacgccaucaacuggcccacccccggcgagaucgcccacaagagcgugcagccccagagccacaagccccagcccaccagaaagcugccccccaagaaggacaugaaggagcaggagaagggcgagggcagcgacagcaaggagagccccaagaccaagagcgacgagagcggcgaggagaagaacggcgacgaggacugccagagaggcggccagaagaagaagggcaacaagcacaagugggugccccugcagaucgacaugaagcccgaggugcccagagagaagcuggccagcagacccaccagaccccccgagcccagacacauccccgccaacagaggcgagaucaagggcagcgagagcgccaccuacgugcccguggccccccccacccccgccuggcagcccgagaucaagcccgagcccgccuggcacgaccaggacgagaccagcagcgugaagagcgacggcgccggcggcgccagagccagcuucagaggcagaggcagaggcagaggcagaggcagaggcagaggcagaggcggcaccagaacccacuucgacuaccaguucggcuacagaaaguucgacggcguggagggccccagaacccccaaguacaugaacaacaucaccuacuacuucgacaacgugagcagcaccgagcuguacagcguggaccaggagcugcugaaggacuacaucaagagacagaucgaguacuacuucagcguggacaaccuggagagagacuucuuccugagaagaaagauggacgccgacggcuuccugcccaucacccugaucgccagcuuccacagagugcaggcccugaccaccgacaucagccugaucuucgccgcccugaaggacagcaaggugguggagaucguggacgagaaggugagaagaagagaggagcccgagaaguggccccugccccccaucguggacuacagccagaccgacuucagccagcugcugaacugccccgaguucgugcccagacagcacuaccagaaggagaccgagagcgcccccggcagccccagagccgugacccccgugcccaccaagaccgaggaggugagcaaccugaagacccugcccaagggccugagcgccagccugcccgaccuggacagcgagaacuggaucgaggugaagaagagacccagacccagccccgccagacccaagaagagcgaggagagcagauucagccaccugaccagccugccccagcagcugcccagccagcagcugaugagcaaggaccaggacgagcaggaggagcuggacuuccuguucgacgaggagauggagcagauggacggcagaaagaacaccuucaccgccuggagcgacgaggagagcgacuacgagaucgacgacagagacgugaacaagauccugaucgugacccagaccccccacuacaugagaagacaccccggcggcgacagaaccggcaaccacaccagcagagccaagaugagcgccgagcuggccaaggugaucaacgacggccuguucuacuacgagcaggaccugugggccgagaaguucgagcccgaguacagccagaucaagcaggagguggagaacuucaagaaggugaacaugaucagcagagagcaguucgacacccugacccccgagccccccguggaccccaaccaggaggugccccccggcccccccagauuccagcaggugcccaccgacgcccuggccaacaagcuguucggcgcccccgagcccagcaccaucgccagaagccugcccaccaccgugcccgagagccccaacuacagaaacaccagaacccccagaacccccagaaccccccagcugaaggacagcagccagaccagcagauucuaccccguggugaaggagggcagaacccuggacgccaagaugcccagaaagagaaagaccagacacagcagcaaccccccccuggagagccacgugggcugggugauggacagcagagagcacagacccagaaccgccagcaucagcagcagccccagcgagggcacccccaccgugggcagcuacggcugcaccccccagagccugcccaaguuccagcaccccagccacgagcugcugaaggagaacggcuucacccagcacguguaccacaaguacagaagaagaugccugaacgagagaaagagacugggcaucggccagagccaggagaugaacacccuguucagauucuggagcuucuuccugagagaccacuucaacaagaagauguacgaggaguucaagcagcuggcccuggaggacgccaaggagggcuacagauacggccuggagugccuguucagauacuacagcuacggccuggagaagaaguucagacuggacaucuucaaggacuuccaggaggagaccgugaaggacuacgaggccggccagcuguacggccuggagaaguucugggccuuccugaaguacagcaaggccaagaaccuggacaucgaccccaagcugcaggaguaccugggcaaguucagaagacuggaggacuucagaguggacccccccaugggcgaggagggcaaccacaagagacacagcgugguggccggcggcggcggcggcgagggcagaaagagaugccccagccagagcagcagcagacccgccgccaugaucagccagccccccaccccccccaccggccagcccgugagagaggacgccaaguggaccagccagcacagcaacacccagacccugggcaaguaa

SEQ ID NO: 19154 - RNA, 1749 nt, Artificial Sequence
  LARP4__Homo_sapiens__NP_001164274
augcugcuguucguggagcagguggccagcaagggcaccggccugaaccccaacgccaagguguggcaggagaucgcccccggcaacaccgacgccacccccgugacccacggcaccgagagcagcuggcacgagaucgccgccaccagcggcgcccaccccgagggcaacgccgagcugagcgaggacaucugcaaggaguacgaggugauguacagcagcagcugcgagaccaccagaaacaccaccggcaucgaggagagcaccgacggcaugauccugggccccgaggaccugagcuaccagaucuacgacgugagcggcgagagcaacagcgccgugagcaccgaggaccugaaggagugccugaagaagcagcuggaguucugcuucagcagagagaaccugagcaaggaccuguaccugaucagccagauggacagcgaccaguucauccccaucuggaccguggccaacauggaggagaucaagaagcugaccaccgaccccgaccugauccuggaggugcugagaagcagccccauggugcagguggacgagaagggcgagaaggugagacccagccacaagagaugcaucgugauccugagagagauccccgagaccacccccaucgaggaggugaagggccuguucaagagcgagaacugccccaaggugaucagcugcgaguucgcccacaacagcaacugguacaucaccuuccagagcgacaccgacgcccagcaggccuucaaguaccugagagaggaggugaagaccuuccagggcaagcccaucauggcccccuuccccaacggcagcuucgugaacggcuucaacagccccggcagcuacaagaccaacgccgccgccaugaacaugggcagacccuuccagaagaacagaagaacccuguucagaggcagaagaagaagagaggacgacagaaucagcagaccccaccccagcaccgccgagagcaaggcccccacccccaaguucgaccugcuggccagcaacuuccccccccugcccggcagcagcagcagaaugcccggcgagcuggugcuggagaacagaaugagcgacguggugaagggcguguacaaggagaaggacaacgaggagcugaccaucagcugccccgugcccgccgacgagcagaccgagugcaccagcgcccagcagcugaacaugagcaccagcagccccugcgccgccgagcugaccgcccugagcaccacccagcaggagaaggaccugaucgaggacagcagcgugcagaaggacggccugaaccagaccaccauccccgugagcccccccagcaccaccaagcccagcagagccagcaccgccagccccugcaacaacaacaucaacgccgccaccgccguggcccugcaggagcccagaaagcugagcuacgccgaggugugccagaagccccccaaggagcccagcagcgugcuggugcagccccugagagagcugagaagcaacguggugagccccaccaagaacgaggacaacggcgcccccgagaacagcguggagaagccccacgagaagcccgaggccagagccagcaaggacuacagcggcuucagaggcaacaucauccccagaggcgccgccggcaagaucagagagcagagaagacaguucagccacagagccaucccccagggcgugaccagaagaaacggcaaggagcaguacgugccccccagaagccccaaguaa

SEQ ID NO: 19155 - RNA, 1476 nt, Artificial Sequence
  LARP6__Homo_sapiens__NP_060827
auggcccagagcggcggcgaggccagacccggccccaagaccgccgugcagaucagaguggccauccaggaggccgaggacguggacgagcuggaggacgaggaggagggcgccgagaccagaggcgccggcgaccccgccagauaccugagccccggcuggggcagcgccagcgaggaggagcccagcagaggccacagcggcaccaccgccagcggcggcgagaacgagagagaggaccuggagcaggaguggaagccccccgacgaggagcugaucaagaagcugguggaccagaucgaguucuacuucagcgacgagaaccuggagaaggacgccuuccugcugaagcacgugagaagaaacaagcugggcuacgugagcgugaagcugcugaccagcuucaagaaggugaagcaccugaccagagacuggagaaccaccgcccacgcccugaaguacagcguggugcuggagcugaacgaggaccacagaaaggugagaagaaccacccccgugccccuguuccccaacgagaaccugcccagcaagaugcugcugguguacgaccuguaccugagccccaagcugugggcccuggccaccccccagaagaacggcagagugcaggagaaggugauggagcaccugcugaagcuguucggcaccuucggcgugaucagcagcgugagaauccugaagcccggcagagagcugccccccgacaucagaagaaucagcagcagauacagccaggugggcacccaggagugcgccaucguggaguucgaggagguggaggccgccaucaaggcccacgaguucaugaucaccgagagccagggcaaggagaacaugaaggccgugcugaucggcaugaagccccccaagaagaagcccgccaaggacaagaaccacgacgaggagcccaccgccagcauccaccugaacaagagccugaacaagagaguggaggagcugcaguacaugggcgacgagagcagcgccaacagcagcagcgaccccgagagcaaccccaccagccccauggccggcagaagacacgccgccaccaacaagcugagccccagcggccaccagaaccuguuccugagccccaacgccagccccugcaccagccccuggagcagcccccuggcccagagaaagggcgugagcagaaagagcccccuggccgaggagggcagacugaacugcagcaccagccccgagaucuucagaaagugcauggacuacagcagcgacagcagcgugacccccagcggcagccccugggugagaagaagaagacaggccgagaugggcacccaggagaagagccccggcaccagcccccugcugagcagaaagaugcagaccgccgacggccugcccgugggcgugcugagacugcccagaggccccgacaacaccagaggcuuccacggccacgagagaagcagagccugcguguaa

SEQ ID NO: 19156 - RNA, 1770 nt, Artificial Sequence
  LARP7__Homo_sapiens__NP_001253968
augauccccaacaucgagggcauggagaccgagagcggcaaccaggagaaggugauggaggaggagagcaccgagaagaagaaggagguggagaagaagaagagaagcagagugaagcaggugcuggccgacaucgccaagcagguggacuucugguucggcgacgccaaccugcacaaggacagauuccugagagagcagaucgagaagagcagagacggcuacguggacaucagccugcuggugagcuucaacaagaugaagaagcugaccaccgacggcaagcugaucgccagagcccugagaagcagcgccgugguggagcuggaccuggagggcaccagaaucagaagaaagaagccccugggcgagagacccaaggacgaggacgagagaaccguguacguggagcugcugcccaagaacgugaaccacagcuggaucgagagaguguucggcaagugcggcaacgugguguacaucagcaucccccacuacaagagcaccggcgaccccaagggcuucgccuucguggaguucgagaccaaggagcaggccgccaaggccaucgaguuccugaacaacccccccgaggaggcccccagaaagcccggcaucuuccccaagaccgugaagaacaagcccauccccgcccugagagugguggaggagaagaagaagaagaagaagaagaagggcagaaugaagaaggaggacaacauccaggccaaggaggagaacauggacaccagcaacaccagcaucagcaagaugaagagaagcagacccaccagcgagggcagcgacaucgagagcaccgagccccagaagcagugcagcaagaagaagaagaagagagacagaguggaggccagcagccugcccgaggugagaaccggcaagagaaagagaagcagcagcgaggacgccgagagccuggcccccagaagcaaggugaagaagaucauccagaaggacaucaucaaggaggccagcgaggccagcaaggagaacagagacaucgagaucagcaccgaggaggagaaggacaccggcgaccugaaggacagcagccugcugaagaccaagagaaagcacaagaagaagcacaaggagagacacaagaugggcgaggaggugaucccccugagagugcugagcaagagcgaguggauggaccugaagaaggaguaccuggcccugcagaaggccagcauggccagccugaagaagaccaucagccagaucaagagcgagagcgagauggagaccgacagcggcgugccccagaacaccggcaugaagaacgagaagaccgccaacagagaggagugcagaacccaggagaaggugaacgccaccggcccccaguucgugagcggcgugaucgugaagaucaucagcaccgagccccugcccggcagaaagcaggugagagacacccuggccgccaucagcgaggugcuguacguggaccugcuggagggcgacaccgagugccacgccagauucaagacccccgaggacgcccaggccgugaucaacgccuacaccgagaucaacaagaagcacugcuggaagcuggagauccugagcggcgaccacgagcagagauacuggcagaagauccugguggacagacaggccaagcugaaccagcccagagagaagaagagaggcaccgagaagcugaucaccaaggccgagaagaucagacuggccaagacccagcaggccagcaagcacaucagauucagcgaguacgacuaa

SEQ ID NO: 19157 - RNA, 2712 nt, Artificial Sequence
  LARS2__Homo_sapiens__NP_056155
auggccagcguguggcagagacugggcuucuacgccagccugcugaagagacagcugaacggcggccccgacgugaucaagugggagagaagagugauccccggcugcaccagaagcaucuacagcgccaccggcaaguggaccaaggaguacacccugcagaccagaaaggacguggagaagugguggcaccagagaaucaaggagcaggccagcaagaucagcgaggccgacaagagcaagcccaaguucuacgugcugagcauguuccccuaccccagcggcaagcugcacaugggccacgugagaguguacaccaucagcgacaccaucgccagauuccagaagaugagaggcaugcaggugaucaaccccaugggcugggacgccuucggccugcccgccgagaacgccgccguggagagaaaccugcacccccagagcuggacccagagcaacaucaagcacaugagaaagcagcuggacagacugggccugugcuucagcugggacagagagaucaccaccugccugcccgacuacuacaaguggacccaguaccuguucaucaagcuguacgaggccggccuggccuaccagaaggaggcccuggugaacugggaccccguggaccagaccgugcuggccaacgagcagguggacgagcacggcugcagcuggagaagcggcgccaagguggagcagaaguaccugagacagugguucaucaagaccaccgccuacgccaaggccaugcaggacgcccuggccgaccugcccgagugguacggcaucaagggcaugcaggcccacuggaucggcgacugcgugggcugccaccuggacuucacccugaaggugcacggccaggccaccggcgagaagcugaccgccuacaccgccacccccgaggccaucuacggcaccagccacguggccaucagccccagccacagacugcugcacggccacagcagccugaaggaggcccugagaauggcccuggugcccggcaaggacugccugacccccgugauggccgugaacaugcugacccagcaggaggugcccguggugauccuggccaaggccgaccuggagggcagccuggacagcaagaucggcauccccagcaccagcagcgaggacaccauccuggcccagacccugggccuggccuacagcgaggugaucgagacccugcccgacggcaccgagagacugagcagcagcgccgaguucaccggcaugaccagacaggacgccuuccuggcccugacccagaaggccagaggcaagagagugggcggcgacgugaccagcgacaagcugaaggacuggcugaucagcagacagagauacuggggcacccccauccccaucgugcacugccccgugugcggccccacccccgugccccuggaggaccugcccgugacccugcccaacaucgccagcuucaccggcaagggcggccccccccuggccauggccagcgagugggugaacugcagcugccccagaugcaagggcgccgccaagagagagaccgacaccauggacaccuucguggacagcgccugguacuacuucagauacaccgacccccacaacccccacagccccuucaacaccgccguggccgacuacuggaugcccguggaccuguacaucggcggcaaggagcacgccgugaugcaccuguucuacgccagauucuucagccacuucugccacgaccagaagauggugaagcacagagagcccuuccacaagcugcuggcccagggccugaucaagggccagaccuucagacugcccagcggccaguaccugcagagagaggagguggaccugaccggcagcgugcccgugcacgccaagaccaaggagaagcuggaggugaccugggagaagaugagcaagagcaagcacaacggcguggaccccgaggaggugguggagcaguacggcaucgacaccaucagacuguacauccuguucgccgccccccccgagaaggacauccugugggacgugaagaccgacgcccugcccggcgugcugagauggcagcagagacuguggacccugaccaccagauucaucgaggccagagccagcggcaagagcccccagccccagcugcugagcaacaaggagaaggccgaggccagaaagcugugggaguacaagaacagcgugaucagccaggugaccacccacuucaccgaggacuucagccugaacagcgccaucagccagcugaugggccugagcaacgcccugagccaggccagccagagcgugauccugcacagccccgaguucgaggacgcccugugcgcccugauggugauggccgccccccuggccccccacgugaccagcgagaucugggccggccuggcccuggugcccagaaagcugugcgcccacuacaccugggacgccagcgugcugcugcaggccuggcccgccguggaccccgaguuccugcagcagcccgagguggugcagauggccgugcugaucaacaacaaggccugcggcaagauccccgugccccagcagguggccagagaccaggacaaggugcacgaguucgugcugcagagcgagcugggcgugagacugcugcagggcagaagcaucaagaagagcuuccugagccccagaaccgcccugaucaacuuccuggugcaggacuaa

SEQ ID NO: 19158 - RNA, 3531 nt, Artificial Sequence
  LARS__Homo_sapiens__NP_064502
auggccgagagaaagggcaccgccaagguggacuuccugaagaagaucgagaaggagauccagcagaagugggacaccgagagaguguucgaggugaacgccagcaaccuggagaagcagaccagcaagggcaaguacuucgugaccuuccccuaccccuacaugaacggcagacugcaccugggccacaccuucagccugagcaagugcgaguucgccgugggcuaccagagacugaagggcaagugcugccuguuccccuucggccugcacugcaccggcaugcccaucaaggccugcgccgacaagcugaagagagagaucgagcuguacggcugcccccccgacuuccccgacgaggaggaggaggaggaggagaccagcgugaagaccgaggacaucaucaucaaggacaaggccaagggcaagaagagcaaggccgccgccaaggccggcagcagcaaguaccaguggggcaucaugaagagccugggccugagcgacgaggagaucgugaaguucagcgaggccgagcacuggcuggacuacuuccccccccuggccauccaggaccugaagagaaugggccugaagguggacuggagaagaagcuucaucaccaccgacgugaaccccuacuacgacagcuucgugagauggcaguuccugacccugagagagagaaacaagaucaaguucggcaagagauacaccaucuacagccccaaggacggccagcccugcauggaccacgacagacagaccggcgagggcgugggcccccaggaguacacccugcugaagcugaaggugcuggagcccuaccccagcaagcugagcggccugaagggcaagaacaucuuccugguggccgccacccugagacccgagaccauguucggccagaccaacugcugggugagacccgacaugaaguacaucggcuucgagaccgugaacggcgacaucuucaucugcacccagaaggccgccagaaacaugagcuaccagggcuucaccaaggacaacggcguggugcccguggugaaggagcugaugggcgaggagauccugggcgccagccugagcgccccccugaccagcuacaaggugaucuacgugcugcccaugcugaccaucaaggaggacaagggcaccggcguggugaccagcgugcccagcgacagccccgacgacaucgccgcccugagagaccugaagaagaagcaggcccugagagccaaguacggcaucagagacgacauggugcugcccuucgagcccgugcccgugaucgagauccccggcuucggcaaccugagcgccgugaccaucugcgacgagcugaagauccagagccagaacgacagagagaagcuggccgaggccaaggagaagaucuaccugaagggcuucuacgagggcaucaugcugguggacggcuucaagggccagaaggugcaggacgugaagaagaccauccagaagaagaugaucgacgccggcgacgcccugaucuacauggagcccgagaagcaggugaugagcagaagcagcgacgagugcgugguggcccugugcgaccagugguaccuggacuacggcgaggagaacuggaagaagcagaccagccagugccugaagaaccuggagaccuucugcgaggagaccagaagaaacuucgaggccacccugggcuggcugcaggagcacgccugcagcagaaccuacggccugggcacccaccugcccugggacgagcaguggcugaucgagagccugagcgacagcaccaucuacauggccuucuacaccguggcccaccugcugcagggcggcaaccugcacggccaggccgagagcccccugggcaucagaccccagcagaugaccaaggaggugugggacuacguguucuucaaggaggcccccuuccccaagacccagaucgccaaggagaagcuggaccagcugaagcaggaguucgaguucugguaccccguggaccugagagugagcggcaaggaccuggugcccaaccaccugagcuacuaccuguacaaccacguggccauguggcccgagcagagcgacaaguggcccaccgccgugagagccaacggccaccugcugcugaacagcgagaagaugagcaagagcaccggcaacuuccugacccugacccaggccaucgacaaguucagcgccgacggcaugagacuggcccuggccgacgccggcgacaccguggaggacgccaacuucguggaggccauggccgacgccggcauccugagacuguacaccuggguggagugggugaaggagaugguggccaacugggacagccugagaagcggccccgccagcaccuucaacgacagaguguucgccagcgagcugaacgccggcaucaucaagaccgaccagaacuacgagaagaugauguucaaggaggcccugaagaccggcuucuucgaguuccaggccgccaaggacaaguacagagagcuggccguggagggcaugcacagagagcugguguucagauucaucgaggugcagacccugcugcuggcccccuucugcccccaccugugcgagcacaucuggacccugcugggcaagcccgacagcaucaugaacgccagcuggcccguggccggccccgugaacgaggugcugauccacagcagccaguaccugauggaggugacccacgaccugagacugagacugaagaacuacaugaugcccgccaagggcaagaagaccgacaagcagccccugcagaagcccagccacugcaccaucuacguggccaagaacuacccccccuggcagcacaccacccugagcgugcugagaaagcacuucgaggccaacaacggcaagcugcccgacaacaaggugaucgccagcgagcugggcagcaugcccgagcugaagaaguacaugaagaaggugaugcccuucguggccaugaucaaggagaaccuggagaagaugggccccagaauccuggaccugcagcuggaguucgacgagaaggccgugcugauggagaacaucguguaccugaccaacagccuggagcuggagcacaucgaggugaaguucgccagcgaggccgaggacaagaucagagaggacugcugccccggcaagccccugaacguguucagaaucgagcccggcgugagcgugagccuggugaacccccagcccagcaacggccacuucagcaccaagaucgagaucagacagggcgacaacugcgacagcaucaucagaagacugaugaagaugaacagaggcaucaaggaccugagcaaggugaagcugaugagauucgacgacccccugcugggccccagaagagugcccgugcugggcaaggaguacaccgagaagacccccaucagcgagcacgccguguucaacguggaccugaugagcaagaagauccaccugaccgagaacggcaucagaguggacaucggcgacaccaucaucuaccuggugcacuaa

SEQ ID NO: 19159 - RNA, 2154 nt, Artificial Sequence
  LAS1L__Homo_sapiens__NP_001164120
augagcugggagagcggcgccggccccggccugggcagccagggcauggaccugguguggagcgccugguacggcaagugcgugaagggcaagggcagccugccccugagcgcccacggcaucgugguggccuggcugagcagagccgagugggaccaggugaccguguaccuguucugcgacgaccacaagcugcagagauacgcccugaacagaaucaccguguggagaagcagaagcggcaacgagcugccccuggccguggccagcaccgccgaccugaucagaugcaagcugcuggacgugaccggcggccugggcaccgacgagcugagacugcuguacggcauggcccuggugagauucgugaaccugaucagcgagagaaagaccaaguucgccaaggugccccugaagugccuggcccaggaggugaacauccccgacuggaucguggaccugagacacgagcugacccacaagaagaugccccacaucaacgacugcagaagaggcugcuacuucgugcuggacuggcugcagaagaccuacuggugcagacagcuggagaacagccugagagagaccugggagcuggaggaguucagagagggcaucgaggaggaggaccaggaggaggacaagaacaucgugguggacgacaucaccgagcagaagcccgagccccaggacgacggcaagagcaccgagagcgacgugaaggccgacggcgacagcaagggcagcgaggagguggacagccacugcaagaaggcccugagccacaaggagcuguacgagagagccagagagcugcuggugagcuacgaggaggagcaguucaccgugcuggagaaguucagauaccugcccaaggccaucaaggccuggaacaaccccagccccagaguggagugcgugcuggccgagcugaagggcgugaccugcgagaacagagaggccgugcuggacgccuuccuggacgacggcuuccuggugcccaccuucgagcagcuggccgcccugcagaucgaguacgaggagaacguggaccugaacgacgugcuggugcccaagcccuucagccaguucuggcagccccugcugagaggccugcacagccagaacuucacccaggcccugcuggagagaaugcugagcgagcugcccgcccugggcaucagcggcaucagacccaccuacauccugagauggaccguggagcugaucguggccaacaccaagaccggcagaaacgccagaagauucagcgccggccagugggaggccagaagaggcuggagacuguucaacugcagcgccagccuggacuggcccagaaugguggagagcugccugggcagccccugcugggccagcccccagcugcugagaaucaucuucaaggccaugggccagggccugcccgacgaggagcaggagaagcugcugagaaucugcagcaucuacacccagagcggcgagaacagccuggugcaggagggcagcgaggccagccccaucggcaagagccccuacacccuggacagccuguacuggagcgugaagcccgccagcagcagcuucggcagcgaggccaaggcccagcagcaggaggagcagggcagcgugaacgacgugaaggaggaggagaaggaggagaaggaggugcugcccgaccagguggaggaggaggaggagaacgacgaccaggaggaggaggaggaggacgaggacgacgaggacgacgaggaggaggacagaauggaggugggccccuucagcaccggccaggagagccccaccgccgagaacgccagacugcuggcccagaagagaggcgcccugcagggcagcgccuggcaggugagcagcgaggacgugagaugggacaccuucccccugggcagaaugcccggccagaccgaggaccccgccgagcugaugcuggagaacuacgacaccauguaccugcuggaccagcccgugcuggagcagagacuggagcccagcaccugcaagaccgacacccugggccugagcugcggcgugggcagcggcaacugcagcaacagcagcagcagcaacuucgagggccugcuguggagccagggccagcugcacggccugaagaccggccugcagcuguucuaa

SEQ ID NO: 19160 - RNA, 618 nt, Artificial Sequence
  LASP1__Homo_sapiens__NP_001258537
augcugccccugagagaccugcaggacgacaccgagcacgaggagcugcagggccugagagaggaggcccugcugcagagagugagauacaaggaggaguucgagaagaacaagggcaagggcuucagcgugguggccgacacccccgagcugcagagaaucaagaagacccaggaccagaucagcaacaucaaguaccacgaggaguucgagaagagcagaaugggccccagcggcggcgagggcauggagcccgagagaagagacagccaggacggcagcagcuacagaagaccccuggagcagcagcagccccaccacauccccaccagcgcccccguguaccagcagccccagcagcagcccguggcccagagcuacggcggcuacaaggagcccgccgcccccgugagcauccagagaagcgcccccggcggcggcggcaagagauacagagccguguacgacuacagcgccgccgacgaggacgaggugagcuuccaggacggcgacaccaucgugaacgugcagcagaucgacgacggcuggauguacggcaccguggagagaaccggcgacaccggcaugcugcccgccaacuacguggaggccaucuaa

SEQ ID NO: 19161 - RNA, 732 nt, Artificial Sequence
  LAT2__Homo_sapiens__NP_115852
augagcagcggcaccgagcugcuguggcccggcgccgcccugcuggugcugcugggcguggccgccagccugugcgugagaugcagcagacccggcgccaagagaagcgagaagaucuaccagcagagaagccugagagaggaccagcagagcuucaccggcagcagaaccuacagccuggugggccaggccuggcccggcccccuggccgacauggcccccaccagaaaggacaagcugcugcaguucuaccccagccuggaggaccccgccagcagcagauaccagaacuucagcaagggcagcagacacggcagcgaggaggccuacaucgaccccaucgccauggaguacuacaacuggggcagauucagcaagccccccgaggacgacgacgccaacagcuacgagaacgugcugaucugcaagcagaagaccaccgagaccggcgcccagcaggagggcaucggcggccugugcagaggcgaccugagccugagccuggcccugaagaccggccccaccagcggccugugccccagcgccagccccgaggaggacgaggagagcgaggacuaccagaacagcgccagcauccaccaguggagagagagcagaaaggugaugggccagcugcagagagaggccagccccggccccgugggcagccccgacgaggaggacggcgagcccgacuacgugaacggcgagguggccgccaccgaggccuaa

SEQ ID NO: 19162 - RNA, 702 nt, Artificial Sequence
  LAT__Homo_sapiens__NP_001014987
auggaggaggccauccuggugcccugcgugcugggccugcugcugcugcccauccuggccaugcugauggcccugugcgugcacugccacagacugcccggcagcuacgacagcaccagcagcgacagccuguaccccagaggcauccaguucaagagaccccacaccguggcccccuggccccccgccuacccccccgugaccagcuaccccccccugagccagcccgaccugcugcccauccccagaagcccccagccccugggcggcagccacagaacccccagcagcagaagagacagcgacggcgccaacagcguggccagcuacgagaacgaggagcccgccugcgaggacgccgacgaggacgaggacgacuaccacaaccccggcuaccugguggugcugcccgacagcacccccgccaccagcaccgccgcccccagcgcccccgcccugagcacccccggcaucagagacagcgccuucagcauggagagcaucgacgacuacgugaacgugcccgagagcggcgagagcgccgaggccagccuggacggcagcagagaguacgugaacgugagccaggagcugcaccccggcgccgccaagaccgagcccgccgcccugagcagccaggaggccgaggagguggaggaggagggcgcccccgacuacgagaaccugcaggagcugaacuaa

SEQ ID NO: 19163 - RNA, 2073 nt, Artificial Sequence
  LATS1__Homo_sapiens__NP_001257448
augaagagaagcgagaagcccgagggcuacagacagaugagacccaagaccuuccccgccagcaacuacaccgugagcagcagacagaugcugcaggagaucagagagagccugagaaaccugagcaagcccagcgacgccgccaaggccgagcacaacaugagcaagaugagcaccgaggaccccagacaggugagaaacccccccaaguucggcacccaccacaaggcccugcaggagaucagaaacagccugcugcccuucgccaacgagaccaacagcagcagaagcaccagcgaggugaacccccagaugcugcaggaccugcaggccgccggcuucgacgaggacauggugauccaggcccugcagaagaccaacaacagaagcaucgaggccgccaucgaguucaucagcaagaugagcuaccaggaccccagaagagagcagauggccgccgccgccgccagacccaucaacgccagcaugaagcccggcaacgugcagcagagcgugaacagaaagcagagcuggaagggcagcaaggagagccuggugccccagagacacggccccccccugggcgagagcguggccuaccacagcgagagccccaacagccagaccgacgugggcagaccccugagcggcagcggcaucagcgccuucgugcaggcccaccccagcaacggccagagagugaacccccccccccccccccaggugagaagcgugacccccccccccccccccagaggccagacccccccccccagaggcaccaccccccccccccccagcugggagcccaacagccagaccaagagauacagcggcaacauggaguacgugaucagcagaaucagccccgugccccccggcgccuggcaggagggcuaccccccccccccccugaacaccagccccaugaacccccccaaccagggccagagaggcaucagcagcgugcccgugggcagacagcccaucaucaugcagagcagcagcaaguucaacuuccccagcggcagacccggcaugcagaacggcaccggccagaccgacuucaugauccaccagaacguggugcccgccggcaccgugaacagacagccccccccccccuacccccugaccgccgccaacggccagagccccagcgcccugcagaccggcggcagcgccgcccccagcagcuacaccaacggcagcaucccccagagcaugauggugcccaacagaaacagccacaacauggagcuguacaacaucagcgugcccggccugcagaccaacuggccccagagcagcagcgcccccgcccagagcagccccagcagcggccacgagauccccaccuggcagcccaacauccccgugagaagcaacagcuucaacaacccccugggcaacagagccagccacagcgccaacagccagcccagcgccaccaccgugaccgccaucacccccgcccccauccagcagcccgugaagagcaugagagugcugaagcccgagcugcagaccgcccuggcccccacccaccccagcuggaucccccagcccauccagaccgugcagcccagccccuuccccgagggcaccgccagcaacgugaccgugaugccccccguggccgaggcccccaacuaccagggcccccccccccccuaccccaagcaccugcugcaccagaaccccagcgugccccccuacgagagcaucagcaagcccagcaaggaggaccagcccagccugcccaaggaggacgagagcgagaagagcuacgagaacguggacagcggcgacaaggagaagaagcagaucaccaccagccccaucaccgugagaaagaacaagaaggacgaggagagaagagagagcagaauccagagcuacagcccccaggccuucaaguucuucauggagcagcacguggagaacgugcugaagagccaccagcagagacugcacagaaagaagcagcuggagaacgagaugaugagagugaagcccuucaagaugagcaucuucauccugaaccaccuguucgccuggugccuguucuaa

SEQ ID NO: 19164 - RNA, 3267 nt, Artificial Sequence
  LATS2__Homo_sapiens__XP_005266399
augagacccaagaccuuccccgccaccaccuacagcggcaacagcagacagagacugcaggagaucagagagggccugaagcagcccagcaagagcagcgugcagggccugcccgccggccccaacagcgacaccagccuggacgccaaggugcugggcagcaaggacgccaccagacagcagcagcagaugagagccacccccaaguucggccccuaccagaaggcccugagagagaucagauacagccugcugcccuucgccaacgagagcggcaccagcgccgccgccgaggugaacagacagaugcugcaggagcuggugaacgccggcugcgaccaggagauggccggcagagcccugaagcagaccggcagcagaagcaucgaggccgcccuggaguacaucagcaagaugggcuaccuggaccccagaaacgagcagaucgugagagugaucaagcagaccagccccggcaagggccugaugcccacccccgugaccagaagacccagcuucgagggcaccggcgacagcuucgccagcuaccaccagcugagcggcacccccuacgagggccccagcuucggcgccgacggccccaccgcccuggaggagaugcccagacccuacguggacuaccuguuccccggcgugggcccccacggccccggccaccagcaccagcacccccccaagggcuacggcgccagcguggaggccgccggcgcccacuucccccugcagggcgcccacuacggcagaccccaccugcuggugcccggcgagccccugggcuacggcgugcagagaagccccagcuuccagagcaagaccccccccgagaccggcggcuacgccagccugcccaccaagggccagggcggcccccccggcgccggccuggccuuccccccccccgccgccggccuguacgugccccacccccaccacaagcaggccggccccgccgcccaccagcugcacgugcugggcagcagaagccagguguucgccagcgacagccccccccagagccugcugacccccagcagaaacagccugaacguggaccuguacgagcugggcagcaccagcgugcagcaguggcccgccgccacccuggccagaagagacagccugcagaagcccggccuggaggccccccccagagcccacguggccuucagacccgacugccccgugcccagcagaaccaacagcuucaacagccaccagcccagacccggcccccccggcaaggccgagcccagccugcccgcccccaacaccgugaccgccgugaccgccgcccacauccugcaccccgugaagagcgugagagugcugagacccgagccccagaccgccgugggccccagccaccccgccugggugcccgcccccgcccccgcccccgcccccgcccccgcccccgccgccgagggccuggacgccaaggaggagcacgcccuggcccugggcggcgccggcgccuucccccuggacguggaguacggcggccccgacagaagaugcccccccccccccuaccccaagcaccugcugcugagaagcaagagcgagcaguacgaccuggacagccugugcgccggcauggagcagagccugagagccggccccaacgagcccgagggcggcgacaagagcagaaagagcgccaagggcgacaagggcggcaaggacaagaagcagauccagaccagccccgugcccgugagaaagaacagcagagacgaggagaagagagagagcagaaucaagagcuacagccccuacgccuucaaguucuucauggagcagcacguggagaacgugaucaagaccuaccagcagaaggugaacagaagacugcagcuggagcaggagauggccaaggccggccugugcgaggccgagcaggagcagaugagaaagauccuguaccagaaggagagcaacuacaacagacugaagagagccaagauggacaagagcauguucgugaagaucaagacccugggcaucggcgccuucggcgaggugugccuggccugcaagguggacacccacgcccuguacgccaugaagacccugagaaagaaggacgugcugaacagaaaccagguggcccacgugaaggccgagagagacauccuggccgaggccgacaacgaguggguggugaagcuguacuacagcuuccaggacaaggacagccuguacuucgugauggacuacauccccggcggcgacaugaugagccugcugaucagaauggagguguuccccgagcaccuggccagauucuacaucgccgagcugacccuggccaucgagagcgugcacaagaugggcuucauccacagagacaucaagcccgacaacauccugaucgaccuggacggccacaucaagcugaccgacuucggccugugcaccggcuucagauggacccacaacagcaaguacuaccagaagggcagccacgugagacaggacagcauggagcccagcgaccugugggacgacgugagcaacugcagaugcggcgacagacugaagacccuggagcagagagccagaaagcagcaccagagaugccuggcccacagccuggugggcacccccaacuacaucgcccccgaggugcugcugagaaagggcuacacccagcugugcgacugguggagcgugggcgugauccuguucgagaugcuggugggccagccccccuuccuggcccccacccccaccgagacccagcugaaggugaucaacugggagaacacccugcacauccccgcccaggugaagcugagccccgaggccagagaccugaucaccaagcugugcugcagcgccgaccacagacugggcagaaacggcgccgacgaccugaaggcccaccccuucuucagcgccaucgacuucagcagcgacaucagaaagcagcccgcccccuacgugcccaccaucagccaccccauggacaccagcaacuucgaccccguggacgaggagagccccuggaacgacgccagcgagggcagcaccaaggccugggacacccugaccagccccaacaacaagcaccccgagcacgccuucuacgaguucaccuucagaagauucuucgacgacaacggcuaccccuucagaugccccaagcccagcggcgccgaggccagccaggccgagagcagcgaccuggagagcagcgaccugguggaccagaccgagggcugccagcccguguacguguaa

SEQ ID NO: 19165 - RNA, 1149 nt, Artificial Sequence
  LAX1__Homo_sapiens__NP_001129662
augagaagccacuuccugcagugggcccuggccaccagcagaaacaaggaccagaucaccaacaucuucagcggcuucgccggccugcuggccauccugcuggugguggccguguucugcauccuguggaacuggaacaagagaaagaagagacaggugcccuaccugagagugaccgugaugccccugcugacccugccccagaccagacagagagccaagaacaucuacgacauccugcccuggagacaggaggaccugggcagacacgagagcagaagcaugagaaucuucagcaccgagagccugcugagcagaaacagcgagagccccgagcacgugcccagccaggccggcaacgccuuccaggagcacaccgcccacauccacgccaccgaguacgccgugggcaucuacgacaacgccauggugccccagaugugcggcaaccugacccccagcgcccacugcaucaacgugagagccagcagagacugcgccagcaucagcagcgaggacagccacgacuacgugaacgugcccaccgccgaggagaucgccgagacccuggccagcaccaagagccccagcagaaaccuguucgugcugcccagcacccagaagcuggaguucaccgaggagagagacgagggcugcggcgacgccggcgacugcaccagccuguacagccccggcgccgaggacagcgacagccugagcaacggcgagggcagcagccagaucagcaacgacuacgugaacaugaccggccuggaccugagcgccauccaggagagacagcuguggguggccuuccagugcugcagagacuacgagaacgugcccgccgccgaccccagcggcagccagcagcaggccgagaaggacgugcccagcagcaacaucggccacguggaggacaagaccgacgaccccggcacccacgugcagugcgugaagagaaccuuccuggccagcggcgacuacgccgacuuccagcccuucacccagagcgaggacagccagaugaagcacagagaggagaugagcaacgaggacagcagcgacuacgagaacgugcugaccgccaagcugggcggcagagacagcgagcagggccccggcacccagcugcugcccgacgaguaa

SEQ ID NO: 19166 - RNA, 1149 nt, Artificial Sequence
  LAYN__Homo_sapiens__NP_001245319
augagacccggcaccgcccugcaggccgugcugcuggccgugcugcuggugggccugagagccgccaccggcagacugcugagcgccagcgaccuggaccugagaggcggccagcccgugugcagaggcggcacccagagacccugcuacaaggugaucuacuuccacgacaccagcagaagacugaacuucgaggaggccaaggaggccugcagaagagacggcggccagcuggugagcaucgagagcgaggacgagcagaagcugaucgagaaguucaucgagaaccugcugcccagcgacggcgacuucuggaucggccugagaagaagagaggagaagcagagcaacagcaccgccugccaggaccuguacgccuggaccgacggcagcaucagccaguucagaaacugguacguggacgagcccagcugcggcagcgaggugugcguggugauguaccaccagcccagcgcccccgccggcaucggcggccccuacauguuccaguggaacgacgacagaugcaacaugaagaacaacuucaucugcaaguacagcgacgagaagcccgccgugcccagcagagaggccgagggcgaggagaccgagcugaccacccccgugcugcccgaggagacccaggaggaggacgccaagaagaccuucaaggagagcagagaggccgcccugaaccuggccuacauccugauccccagcaucccccugcugcugcugcugguggugaccaccguggugugcuggguguggaucugcagaaagagaaagagagagcagcccgaccccagcaccaagaagcagcacaccaucuggcccagcccccaccagggcaacagccccgaccuggagguguacaacgugaucagaaagcagagcgaggccgaccuggccgagaccagacccgaccugaagaacaucagcuucagagugugcagcggcgaggccacccccgacgacaugagcugcgacuacgacaacauggccgugaaccccagcgagagcggcuucgugacccuggugagcguggagagcggcuucgugaccaacgacaucuacgaguucagccccgaccagaugggcagaagcaaggagagcggcuggguggagaacgagaucuacggcuacuaa

SEQ ID NO: 19167 - RNA, 318 nt, Artificial Sequence
  LBH__Homo_sapiens__NP_112177
augagcaucuacuuccccauccacugccccgacuaccugagaagcgccaagaugaccgaggugaugaugaacacccagcccauggaggagaucggccugagccccagaaaggacggccugagcuaccagaucuuccccgaccccagcgacuucgacagaugcugcaagcugaaggacagacugcccagcaucgugguggagcccaccgagggcgagguggagagcggcgagcugagauggccccccgaggaguuccuggugcaggaggacgagcaggacaacugcgaggagaccgccaaggagaacaaggagcaguaa

SEQ ID NO: 19168 - RNA, 1446 nt, Artificial Sequence
  LBP__Homo_sapiens__NP_004130
augggcgcccuggccagagcccugcccagcauccugcuggcccugcugcugaccagcacccccgaggcccugggcgccaaccccggccugguggccagaaucaccgacaagggccugcaguacgccgcccaggagggccugcuggcccugcagagcgagcugcugagaaucacccugcccgacuucaccggcgaccugagaaucccccacgugggcagaggcagauacgaguuccacagccugaacauccacagcugcgagcugcugcacagcgcccugagacccgugcccggccagggccugagccugagcaucagcgacagcagcaucagagugcagggcagauggaaggugagaaagagcuucuucaagcugcagggcagcuucgacgugagcgugaagggcaucagcaucagcgugaaccugcugcugggcagcgagagcagcggcagacccaccgugaccgccagcagcugcagcagcgacaucgccgacguggagguggacaugagcggcgaccugggcuggcugcugaaccuguuccacaaccagaucgagagcaaguuccagaaggugcuggagagcagaaucugcgagaugauccagaagagcgugagcagcgaccugcagcccuaccugcagacccugcccgugaccaccgagaucgacagcuucgccgacaucgacuacagccugguggaggcccccagagccaccgcccagaugcuggaggugauguucaagggcgagaucuuccacagaaaccacagaagccccgugacccugcuggccgccgugaugagccugcccgaggagcacaacaagaugguguacuucgccaucagcgacuacguguucaacaccgccagccugguguaccacgaggagggcuaccugaacuucagcaucaccgacgacaugaucccccccgacagcaacaucagacugaccaccaagagcuucagacccuucgugcccagacuggccagacuguaccccaacaugaaccuggagcugcagggcagcgugcccagcgccccccugcugaacuucagccccggcaaccugagcguggaccccuacauggagaucgacgccuucgugcugcugcccagcagcagcaaggagcccguguucagacugagcguggccaccaacgugagcgccacccugaccuucaacaccagcaagaucaccggcuuccugaagcccggcaaggugaagguggagcugaaggagagcaaggugggccuguucaacgccgagcugcuggaggcccugcugaacuacuacauccugaacaccuucuaccccaaguucaacgacaagcuggccgagggcuucccccugccccugcugaagagagugcagcuguacgaccugggccugcagauccacaaggacuuccuguuccugggcgccaacgugcaguacaugagaguguaa

SEQ ID NO: 19169 - RNA, 1722 nt, Artificial Sequence
  LBR__Homo_sapiens__XP_005273182
augcccagcagaaaguucgccgacggcgagguggugagaggcagauggcccggcagcagccuguacuacgagguggagauccugagccacgacagcaccagccagcuguacaccgugaaguacaaggacggcaccgagcuggagcugaaggagaacgacaucaagccccugaccagcuucagacagagaaagggcggcagcaccagcagcagccccagcagaagaagaggcagcagaagcagaagcagaagcagaagccccggcagaccccccaagagcgccagaagaagcgccagcgccagccaccaggccgacaucaaggaggccagaagagagguggaggugaagcugaccccccugauccugaagcccuucggcaacagcaucagcagauacaacggcgagcccgagcacaucgagagaaacgacgccccccacaagaacacccaggagaaguucagccugagccaggagagcagcuacaucgccacccaguacagccugagacccagaagagaggaggugaagcugaaggagaucgacagcaaggaggagaaguacguggccaaggagcuggccgugagaaccuucgaggugacccccaucagagccaaggaccuggaguucggcggcgugcccggcguguuccugaucauguucggccugcccguguuccuguuccugcugcugcugaugugcaagcagaaggaccccagccugcugaacuucccccccccccugcccgcccuguacgagcugugggagaccagaguguucggcguguaccugcugugguuccugauccaggugcuguucuaccugcugcccaucggcaaggugguggagggcaccccccugaucgacggcagaagacugaaguacagacugaacggcuucuacgccuucauccugaccagcgccgugaucggcaccagccuguuccagggcguggaguuccacuacguguacagccacuuccugcaguucgcccuggccgccaccguguucugcguggugcugagcguguaccuguacaugagaagccugaaggcccccagaaacgaccugagccccgccagcagcggcaacgccguguacgacuucuucaucggcagagagcugaaccccagaaucggcaccuucgaccugaaguacuucugcgagcugagacccggccugaucggcugggaggcccugcugaccaccauggacaucauccacgacggcuucggcuucaugcuggccuucggcgaccuggugugggugcccuucaucuacagcuuccaggccuucuaccuggugagccaccccaacgaggugagcuggcccauggccagccugaucaucgugcugaagcugugcggcuacgugaucuucagaggcgccaacagccagaagaacgccuucagaaagaaccccagcgaccccaagcuggcccaccugaagaccauccacaccagcaccggcaagaaccugcuggugagcggcugguggggcuucgugagacaccccaacuaccugggcgaccugaucauggcccuggccuggagccugcccugcggcuucaaccacauccugcccuacuucuacaucaucuacuucaccaugcugcuggugcacagagaggccagagacgaguaccacugcaagaagaaguacggcguggccugggagaaguacugccagagagugcccuacagaaucuuccccuacaucuacuaa

SEQ ID NO: 19170 - RNA, 846 nt, Artificial Sequence
  LBX1__Homo_sapiens__XP_005269500
augaccagcaaggaggacggcaaggccgcccccggcgaggagagaagaagaagcccccuggaccaccugcccccccccgccaacagcaacaagccccugacccccuucagcaucgaggacauccugaacaagcccagcgugagaagaagcuacagccugugcggcgccgcccaccugcuggccgccgccgacaagcacgcccagggcggccugccccuggccggcagagcccugcugagccagaccagcccccugugcgcccuggaggagcuggccagcaagaccuucaagggccuggaggugagcgugcugcaggccgccgagggcagagacggcaugaccaucuucggccagagacagacccccaagaagagaagaaagagcagaaccgccuucaccaaccaccagaucuacgagcuggagaagagauuccuguaccagaaguaccugagccccgccgacagagaccagaucgcccagcagcugggccugaccaacgcccaggugaucaccugguuccagaacagaagagccaagcugaagagagaccuggaggagaugaaggccgacguggagagcgccaagaagcugggccccagcggccagauggacaucguggcccuggccgagcuggagcagaacagcgaggccaccgccggcggcggcggcggcugcggcagagccaagagcagacccggcagccccgugcugccccccggcgcccccaaggcccccggcgccggcgcccugcagcugagccccgccagcccccugaccgaccagcccgccagcagccaggacugcagcgaggacgaggaggacgaggagaucgacguggacgacuaa

SEQ ID NO: 19171 - RNA, 585 nt, Artificial Sequence
  LBX2__Homo_sapiens__NP_001009812
augggcaagagaaccagccuggaggugagccugggcgagcugggcggcgagaagugcagaggcggcagaagaagcuuccccccccuggccgccagcagacccgccagacccggcggcuggagaugggccagaagagaccugugcaagaccgccagcagagccgagaacaacagccaggccugcagaccccagagaagagccggccccgacgcccugggccccggccccuucggcagaaagagaagaaagagcagaaccgccuucaccgcccagcaggugcuggagcuggagagaagauucguguuccagaaguaccuggcccccagcgagagagacggccuggccaccagacugggccuggccaacgcccagguggugaccugguuccagaacagaagagccaagcugaagagagacguggaggagaugagagccgacguggccagccugagagcccugagccccgaggugcugugcagccuggcccugcccgagggcgcccccgaccccggccugugccugggccccgccggccccgacagcagaccccaccugagcgacgaggagauccagguggacgacuaa

SEQ ID NO: 19172 - RNA, 2094 nt, Artificial Sequence
  LCA5__Homo_sapiens__NP_001116241
augggcgagagagccggcagccccggcaccgaccaggagagaaaggccggcaagcaccacuacagcuaccugagcgacuucgagaccccccagagcagcggcagaagcagccuggugagcagcagccccgccagcgugagaagaaagaaccccaagagacagaccagcgacggccaggugcaccaccaggcccccagaaagcccagccccaagggccugcccaacagaaagggcgugagagugggcuucagaagccagagccugaacagagagccccugagaaaggacaccgaccuggugaccaagagaauccugagcgccagacugcugaagaucaacgagcugcagaacgaggugagcgagcugcaggugaagcuggccgagcugcugaaggagaacaagagccugaagagacugcaguacagacaggagaaggcccugaacaaguucgaggacgccgagaacgagaucagccagcugaucuucagacacaacaacgagaucaccgcccugaaggagagacugagaaagagccaggagaaggagagagccaccgagaagagagugaaggacaccgagagcgagcuguucagaaccaaguucagccugcagaagcugaaggagaucagcgaggccagacaccugcccgagagagacgaccuggccaagaagcuggugagcgccgagcugaagcuggacgacaccgagagaagaaucaaggagcugagcaagaaccuggagcugagcaccaacagcuuccagagacagcugcuggccgagagaaagagagccuacgaggcccacgacgagaacaaggugcugcagaaggaggugcagagacuguaccacaagcugaaggagaaggagagagagcuggacaucaagaacaucuacagcaacagacugcccaagagcagccccaacaaggagaaggagcuggcccugagaaagaacgccgccugccagagcgacuucgccgaccugugcaccaagggcgugcagaccauggaggacuucaagcccgaggaguacccccugacccccgagaccaucaugugcuacgagaacaagugggaggagcccggccaccugacccuggaccugcagagccagaagcaggacagacacggcgaggccggcauccugaaccccaucauggagagagaggagaaguucgugaccgacgaggagcugcacguggugaagcaggagguggagaagcuggaggacgagugggagagagaggagcuggacaagaagcagaaggagaaggccagccugcuggagagagaggagaagcccgagugggagaccggcagauaccagcugggcauguaccccauccagaacauggacaagcugcagggcgaggaggaggagagacugaagagagagaugcugcuggccaagcugaacgagaucgacagagagcugcaggacagcagaaaccugaaguaccccgugcugccccugcugcccgacuucgagagcaagcugcacagccccgagagaagccccaagaccuacagauucagcgagagcagcgagagacuguucaacggccaccaccugcaggacaucagcuucagcacccccaagggcgagggccagaacagcggcaacgugagaagccccgccagccccaacgaguucgccuucggcagcuacgugcccagcuucgccaagaccagcgagagaagcaaccccuucagccagaagagcagcuuccuggacuuccagagaaacagcauggagaagcugagcaaggacggcguggaccugaucaccagaaaggagaagaaggccaaccugauggagcagcuguucggcgccagcggcagcagcaccaucagcagcaagagcagcgaccccaacagcguggccagcagcaagggcgacaucgacccccugaacuuccugcccggcaacaagggcagcagagaccaggagcacgacgaggacgagggcuucuuccugagcgagggcagaagcuucaaccccaacagacacagacugaagcacgccgacgacaagcccgccgugaaggccgccgacagcguggaggacgagaucgaggagguggcccugagauaa

SEQ ID NO: 19173 - RNA, 1323 nt, Artificial Sequence
  LCAT__Homo_sapiens__NP_000220
augggcccccccggcagccccuggcagugggugacccugcugcugggccugcugcugccccccgccgcccccuucuggcugcugaacgugcuguuccccccccacaccacccccaaggccgagcugagcaaccacaccagacccgugauccuggugcccggcugccugggcaaccagcuggaggccaagcuggacaagcccgacguggugaacuggaugugcuacagaaagaccgaggacuucuucaccaucuggcuggaccugaacauguuccugccccugggcguggacugcuggaucgacaacaccagagugguguacaacagaagcagcggccuggugagcaacgcccccggcgugcagaucagagugcccggcuucggcaagaccuacagcguggaguaccuggacagcagcaagcuggccggcuaccugcacacccuggugcagaaccuggugaacaacggcuacgugagagacgagaccgugagagccgcccccuacgacuggagacuggagcccggccagcaggaggaguacuacagaaagcuggccggccugguggaggagaugcacgccgccuacggcaagcccguguuccugaucggccacagccugggcugccugcaccugcuguacuuccugcugagacagccccaggccuggaaggacagauucaucgacggcuucaucagccugggcgcccccuggggcggcagcaucaagcccaugcuggugcuggccagcggcgacaaccagggcauccccaucaugagcagcaucaagcugaaggaggagcagagaaucaccaccaccagccccuggauguuccccagcagaauggccuggcccgaggaccacguguucaucagcacccccagcuucaacuacaccggcagagacuuccagagauucuucgccgaccugcacuucgaggagggcugguacauguggcugcagagcagagaccugcuggccggccugcccgcccccggcguggagguguacugccuguacggcgugggccugcccacccccagaaccuacaucuacgaccacggcuuccccuacaccgaccccgugggcgugcuguacgaggacggcgacgacaccguggccaccagaagcaccgagcugugcggccuguggcagggcagacagccccagcccgugcaccugcugccccugcacggcauccagcaccugaacaugguguucagcaaccugacccuggagcacaucaacgccauccugcugggcgccuacagacagggcccccccgccagccccaccgccagccccgagccccccccccccgaguaa

SEQ ID NO: 19174 - RNA, 267 nt, Artificial Sequence
  LCE1C__Homo_sapiens__NP_001263260
augagcugccagcagagccagcagcagugccagcccccccccaacgugagcagcggcggcugcugcggcagcagcagcggcggcagcugcggcagcagcagcggcggcugcugcagcagcggcggcggcggcugcugccugagccaccacagaagaagaagaagccacugccacagaccccagagcagcggcugcugcagccagcccagcggcggcagcagcugcugcggcggcggcagcggccagcacagcggcggcugcugcuaa

SEQ ID NO: 19175 - RNA, 270 nt, Artificial Sequence
  LCE3A__Homo_sapiens__NP_848518
augagcugccagcagaaccagcagcagugccagcccccccccaagugccccgccaagagccccgcccagugccugccccccgccagcagcagcugcgcccccagcagcggcggcugcggccccagcagcgagagaagcugcugccugagccaccacagaugcagaagaagccacagaugcagaugccagagcagcaacagcugcgacagaggcagcggccagcagggcggcagcagcagcugcggccacagcagcgccggcugcugcuaa

SEQ ID NO: 19176 - RNA, 288 nt, Artificial Sequence
  LCE3B__Homo_sapiens__NP_848520
augagcugccagcagaaccagcagcagugccagccccugcccaagugccccagccccaagugcccccccaagagcagcgcccagugccugccccccgccagcagcugcugcgcccccagacccggcugcugcggcggccccagcagcgagggcggcugcugccugagccaccacagaugcugcagaagccacagaugcagaagacagagcagcaacagcugcgacagaggcagcggccagcaggacggcgccagcgacugcggcuacggcagcggcggcugcugcuaa

SEQ ID NO: 19177 - RNA, 285 nt, Artificial Sequence
  LCE3C__Homo_sapiens__NP_848521
augagcugccagcagaaccagcagcagugccagcccccccccagcugccccagccccaagugcccccccaagagccccgcccagugccugcccccccccagcagcgacugcgcccugagcagcggcggcugcggccccagcagcgagagcggcugcugccugagccaccacagacacuucagaagccaccagugcagaagacagagaagcaacagcugcgacagaggcagcggccagcagggcggcggcagcugcagaggccacggcagcggcggcugcugcuaa

SEQ ID NO: 19178 - RNA, 279 nt, Artificial Sequence
  LCE3D__Homo_sapiens__NP_115952
augagcugccagcagaaccagcagcagugccagcccccccccaagugccccagccccaagugcccccccaagagccccgugcagugccugccccccgccagcagcggcugcgcccccagcagcggcggcugcggccccagcagcgagggcggcugcuuccugaaccaccacagaagacaccacagaugcagaagacagagacccaacagcugcgacagaggcagcggccagcagggcggcggcagcggcugcggccacggcagcggcggcugcugcuaa

SEQ ID NO: 19179 - RNA, 279 nt, Artificial Sequence
  LCE3E__Homo_sapiens__NP_848522
augagcugccagcagaaccagaagcagugccagcccccccccaagugccccagccccaagugcccccccaagaaccccgugcagugccugccccccgccagcagcggcugcgcccccagcagcggcggcugcggccccagcagcgagggcggcugcuuccugaaccaccacagaagacaccacagaugcagaagacagagaagcaacagcugcgacagaggcagcggccagcagggcggcggcagcggcugcugccacggcagcggcggcugcugcuaa

SEQ ID NO: 19180 - RNA, 357 nt, Artificial Sequence
  LCE5A__Homo_sapiens__NP_848525
augagcugccagcagagccagcagcagugccagcccccccccaagugcacccccaagugcccccccaagugcacccccaagugcccccccaagugcccccccaagugccccccccagugcagcgcccccugccccccccccgugagcagcugcugcggcagcagcagcggcggcugcugcagcagcgagggcggcggcugcugccugagccaccacagacccagacagagccugagaagaagaccccagagcagcagcugcugcggcagcggcagcggccagcagagcggcggcagcagcugcugccacagcagcggcggcagcggcugcugccacagcagcggcggcugcugcuaa

SEQ ID NO: 19181 - RNA, 1551 nt, Artificial Sequence
  LCK__Homo_sapiens__XP_011539756
augggcugcggcugcagcagccaccccgaggacgacuggauggagaacaucgacgugugcgagaacugccacuaccccaucgugccccuggacggcaagggcacccugcugaucagaaacggcagcgaggugagagacccccuggugaccuacgagggcagcaacccccccgccagcccccugcagggcgaccccagacagcagggccugaaggacaaggccugcggcagccuggccgugggcuuccaccugagccccaccuacuuccugcccggccuggccuuccuggugccccaccccgugacccccggcuuccugcccauccccgccagauucagccugaugccccugguguucaccgacaaccuggugaucgcccugcacagcuacgagcccagccacgacggcgaccugggcuucgagaagggcgagcagcugagaauccuggagcagagcggcgagugguggaaggcccagagccugaccaccggccaggagggcuucauccccuucaacuucguggccaaggccaacagccuggagcccgagcccugguucuucaagaaccugagcagaaaggacgccgagagacagcugcuggcccccggcaacacccacggcagcuuccugaucagagagagcgagagcaccgccggcagcuucagccugagcgugagagacuucgaccagaaccagggcgagguggugaagcacuacaagaucagaaaccuggacaacggcggcuucuacaucagccccagaaucaccuuccccggccugcacgagcuggugagacacuacaccagauacuacaacggccacaccaagguggccgugaagagccugaagcagggcagcaugagccccgacgccuuccuggccgaggccaaccugaugaagcagcugcagcaccagagacuggugagacuguacgccguggugacccaggagcccaucuacaucaucaccgaguacauggagaacggcagccugguggacuuccugaagacccccagcggcaucaagcugaccaucaacaagcugcuggacauggccgcccagaucgccgagggcauggccuucaucgaggagagaaacuacauccacagagaccugagagccgccaacauccuggugagcgacacccugagcugcaagaucgccgacuucggccuggccagacugaucgaggacaacgaguacaccgccagagagggcgccaaguuccccaucaaguggaccgcccccgaggccaucaacuacggcaccuucaccaucaagagcgacguguggagcuucggcauccugcugaccgagaucgugacccacggcagaauccccuaccccggcaugaccaaccccgaggugauccagaaccuggagagaggcuacagaauggugagacccgacaacugccccgaggagcuguaccagcugaugagacugugcuggaaggagagacccgaggacagacccaccuucgacuaccugagaagcgugcuggaggacuucuucaccgccaccgagggccaguaccagccccagcccuaa

SEQ ID NO: 19182 - RNA, 1131 nt, Artificial Sequence
  LCLAT1__Homo_sapiens__NP_001291374
auggugagcuggaagggcaucuacuucauccugacccuguucuggggcagcuucuucggcagcaucuucaugcugagccccuuccugccccugauguucgugaaccccagcugguacagauggaucaacaacagacugguggccaccuggcugacccugcccguggcccugcuggagaccauguucggcgugaaggugaucaucaccggcgacgccuucgugcccggcgagagaagcgugaucaucaugaaccacagaaccagaauggacuggauguuccuguggaacugccugaugagauacagcuaccugagacuggagaagaucugccugaaggccagccugaagggcgugcccggcuucggcugggccaugcaggccgccgccuacaucuucauccacagaaaguggaaggacgacaagagccacuucgaggacaugaucgacuacuucugcgacauccacgagccccugcagcugcugaucuuccccgagggcaccgaccugaccgagaacagcaagagcagaagcaacgccuucgccgagaagaacggccugcagaaguacgaguacgugcugcaccccagaaccaccggcuucaccuucgugguggacagacugagagagggcaagaaccuggacgccgugcacgacaucaccguggccuacccccacaacaucccccagagcgagaagcaccugcugcagggcgacuuccccagagagauccacuuccacgugcacagauaccccaucgacacccugcccaccagcaaggaggaccugcagcuguggugccacaagagaugggaggagaaggaggagagacugagaagcuucuaccagggcgagaagaacuucuacuucaccggccagagcgugaucccccccugcaagagcgagcugagagugcugguggugaagcugcugagcauccuguacuggacccuguucagccccgccaugugccugcugaucuaccuguacagccuggugaagugguacuucaucaucaccaucgugaucuucgugcugcaggagagaaucuucggcggccuggagaucaucgagcuggccugcuacagacugcugcacaagcagccccaccugaacagcaagaagaacgaguaa

SEQ ID NO: 19183 - RNA, 840 nt, Artificial Sequence
  LCMT1__Homo_sapiens__NP_001027563
auggccaccagacagagagagagcagcaucaccagcugcugcagcaccagcagcugcgacgccgacgacgagggcgugagaggcaccugcgaggacgccagccugugcaagagauucgccgugagcaucggcuacuggcacgaccccuacauccagcacuucgugagacugagcaaggagagaaaggcccccgagaucaacagaggcuacuucgccagagugcacggcgugagccagcugaucaaggccuuccugagaaagaccgagugccacugccagaucgugaaccugggcgccggcauggacaccaccuucuggagacugaaggacgaggaccugcugcccagcaaguacuucgagguggacuuccccaugaucgugaccagaaagcugcacagcaucaagcugcccacccugcugaucgccgagugcgugcugguguacaugacccccgagcagagcgccaaccugcugaagugggccgccaacagcuucgagagagccauguucaucaacuacgagcaggugaacaugggcgacagauucggccagaucaugaucgagaaccugagaagaagacagugcgaccuggccggcguggagaccugcaagagccuggagagccagaaggagagacugcugagcaacggcugggagaccgccagcgccguggacaugauggagcuguacaacagacugcccagagccgaggugagcagaaucgagagccuggaguuccuggacgagauggagcugcuggagcagcugaugagacacuacugccugugcugggccaccaagggcggcaacgagcugggccugaaggagaucaccuacuaa

SEQ ID NO: 19184 - RNA, 531 nt, Artificial Sequence
  LCN1__Homo_sapiens__NP_001239546
augaagccccugcugcuggccgugagccugggccugaucgccgcccugcaggcccaccaccugcuggccagcgacgaggagauccaggacgugagcggcaccugguaccugaaggccaugaccguggacagagaguuccccgagaugaaccuggagagcgugacccccaugacccugaccacccuggagggcggcaaccuggaggccaaggugaccaugcugaucagcggcagaugccaggaggugaaggccgugcuggagaagaccgacgagcccggcaaguacaccgccgacggcggcaagcacguggccuacaucaucagaagccacgugaaggaccacuacaucuucuacugcgagggcgagcugcacggcaagcccgugagaggcgugaagcuggugggcagagaccccaagaacaaccuggaggcccuggaggacuucgagaaggccgccggcgccagaggccugagcaccgagagcauccugauccccagacagagcgagaccugcagccccggcagcgacuaa

SEQ ID NO: 19185 - RNA, 597 nt, Artificial Sequence
  LCN2__Homo_sapiens__NP_005555
augccccugggccugcuguggcugggccuggcccugcugggcgcccugcacgcccaggcccaggacagcaccagcgaccugauccccgcccccccccugagcaaggugccccugcagcagaacuuccaggacaaccaguuccagggcaagugguacguggugggccuggccggcaacgccauccugagagaggacaaggacccccagaagauguacgccaccaucuacgagcugaaggaggacaagagcuacaacgugaccagcgugcuguucagaaagaagaagugcgacuacuggaucagaaccuucgugcccggcugccagcccggcgaguucacccugggcaacaucaagagcuaccccggccugaccagcuaccuggugagaguggugagcaccaacuacaaccagcacgccaugguguucuucaagaaggugagccagaacagagaguacuucaagaucacccuguacggcagaaccaaggagcugaccagcgagcugaaggagaacuucaucagauucagcaagagccugggccugcccgagaaccacaucguguuccccgugcccaucgaccagugcaucgacggcuaa

SEQ ID NO: 19186 - RNA, 1221 nt, Artificial Sequence
  LCOR__Homo_sapiens__NP_001164237
augcagagaaugauccagcaguucgccgccgaguacaccagcaagaacagcagcacccaggaccccagccagcccaacagcaccaagaaccagagccugcccaaggccagccccgugaccaccagccccaccgccgccaccacccagaaccccgugcugagcaagcugcugauggccgaccaggacagcccccuggaccugaccgugagaaagagccagagcgagcccagcgagcaggacggcgugcuggaccugagcaccaagaagagccccugcgccggcagcaccagccugagccacagccccggcugcagcagcacccagggcaacggcagacccggcagacccagccaguacagacccgacggccugagaagcggcgacggcgugccccccagaagccugcaggacggcaccagagagggcuucggccacagcaccagccugaaggugccccuggccagaagccugcagaucagcgaggagcugcugagcagaaaccagcugagcaccgccgccagccugggccccagcggccugcagaaccacggccagcaccugauccugagcagagaggccagcugggccaagccccacuacgaguucaaccugagcagaaugaaguucagaggcaacggcgcccugagcaacaucagcgaccugcccuuccuggccgagaacagcgccuuccccaagauggcccugcaggccaagcaggacggcaagaaggacgugagccacagcagccccguggaccugaagaucccccaggugagaggcauggaccugagcugggagagcagaaccggcgaccaguacagcuacagcagccuggugaugggcagccagaccgagagcgcccugagcaagaagcugagagccauccugcccaagcagagcagaaagagcaugcuggacgccggccccgacagcuggggcagcgacgccgagcagagcaccagcggccagcccuaccccaccagcgaccaggagggcgaccccggcagcaagcagcccagaaagaagagaggcagauacagacaguacaacagcgagauccuggaggaggccaucagcguggugaugagcggcaagaugagcgugagcaaggcccagagcaucuacggcaucccccacagcacccuggaguacaaggugaaggagagacugggcacccugaagaacccccccaagaagaagaugaagcugaugagcggcuaa

SEQ ID NO: 19187 - RNA, 1884 nt, Artificial Sequence
  LCP1__Homo_sapiens__XP_005266431
auggccagaggcagcgugagcgacgaggagaugauggagcugagagaggccuucgccaagguggacaccgacggcaacggcuacaucagcuucaacgagcugaacgaccuguucaaggccgccugccugccccugcccggcuacagagugagagagaucaccgagaaccugauggccaccggcgaccuggaccaggacggcagaaucagcuucgacgaguucaucaagaucuuccacggccugaagagcaccgacguggccaagaccuucagaaaggccaucaacaagaaggagggcaucugcgccaucggcggcaccagcgagcagagcagcgugggcacccagcacagcuacagcgaggaggagaaguacgccuucgugaacuggaucaacaaggcccuggagaacgaccccgacugcagacacgugauccccaugaaccccaacaccaacgaccuguucaacgccgugggcgacggcaucgugcugugcaagaugaucaaccugagcgugcccgacaccaucgacgagagaaccaucaacaagaagaagcugacccccuucaccauccaggagaaccugaaccuggcccugaacagcgccagcgccaucggcugccacguggugaacaucggcgccgaggaccugaaggagggcaagcccuaccuggugcugggccugcuguggcaggugaucaagaucggccuguucgccgacaucgagcugagcagaaacgaggcccugaucgcccugcugagagagggcgagagccuggaggaccugaugaagcugagccccgaggagcugcugcugagaugggccaacuaccaccuggagaacgccggcugcaacaagaucggcaacuucagcaccgacaucaaggacagcaaggccuacuaccaccugcuggagcagguggcccccaagggcgacgaggagggcgugcccgccguggugaucgacaugagcggccugagagagaaggacgacauccagagagccgagugcaugcugcagcaggccgagagacugggcugcagacaguucgugaccgccaccgacguggugagaggcaaccccaagcugaaccuggccuucaucgccaaccuguucaacagauaccccgcccugcacaagcccgagaaccaggacaucgacuggggcgcccuggagggcgagaccagagaggagagaaccuucagaaacuggaugaacagccugggcgugaaccccagagugaaccaccuguacagcgaccugagcgacgcccuggugaucuuccagcuguacgagaagaucaaggugcccguggacuggaacagagugaacaagccccccuaccccaagcugggcggcaacaugaagaagcuggagaacugcaacuacgccguggagcugggcaagaaccaggccaaguucagccuggugggcaucggcggccaggaccugaacgagggcaacagaacccugacccuggcccugaucuggcagcugaugagaagauacacccugaacauccuggaggagaucggcggcggccagaaggugaacgacgacaucaucgugaacugggugaacgagacccugagagaggccaagaagagcagcagcaucagcagcuucaaggaccccaagaucagcaccagccugcccgugcuggaccugaucgacgccauccagcccggcagcaucaacuacgaccugcugaagaccgagaaccugaacgacgacgagaagcugaacaacgccaaguacgccaucagcauggccagaaagaucggcgccagaguguacgcccugcccgaggaccugguggaggugaaccccaagauggugaugaccguguucgccugccugaugggcaagggcaugaagagaguguaa

SEQ ID NO: 19188 - RNA, 1602 nt, Artificial Sequence
  LCP2__Homo_sapiens__NP_005556
auggcccugagaaacgugcccuucagaagcgaggugcugggcugggaccccgacagccuggccgacuacuucaagaagcugaacuacaaggacugcgagaaggccgugaagaaguaccacaucgacggcgccagauuccugaaccugaccgagaacgacauccagaaguuccccaagcugagagugcccauccugagcaagcugagccaggagaucaacaagaacgaggagagaagaagcaucuucaccagaaagccccaggugcccagauuccccgaggagaccgagagccacgaggaggacaacggcggcuggagcagcuucgaggaggacgacuacgagagccccaacgacgaccaggacggcgaggacgacggcgacuacgagagccccaacgaggaggaggaggcccccguggaggacgacgccgacuacgagcccccccccagcaacgacgaggaggcccugcagaacagcauccugcccgccaagcccuuccccaacagcaacagcauguacaucgacagaccccccagcggcaagaccccccagcagccccccgugcccccccagagacccauggccgcccugccccccccccccgccggcagaaaccacagcccccugccccccccccagaccaaccacgaggagcccagcagaagcagaaaccacaagaccgccaagcugcccgcccccagcaucgacagaagcaccaagcccccccuggacagaagccuggcccccuucgacagagagcccuucacccugggcaagaagccccccuucagcgacaagcccagcauccccgccggcagaagccugggcgagcaccugcccaagauccagaagcccccccugccccccaccaccgagagacacgagagaagcagcccccugcccggcaagaagccccccgugcccaagcacggcuggggccccgacagaagagagaacgacgaggacgacgugcaccagagaccccugccccagcccgcccugcugcccaugagcagcaacaccuuccccagcagaagcaccaagcccagccccaugaacccccugcccagcagccacaugcccggcgccuucagcgagagcaacagcagcuucccccagagcgccagccugccccccuacuucagccagggccccagcaacagaccccccaucagagccgagggcagaaacuucccccugccccugcccaacaagcccagaccccccagccccgccgaggaggagaacagccugaacgaggagugguacgugagcuacaucaccagacccgaggccgaggccgcccugagaaagaucaaccaggacggcaccuuccuggugagagacagcagcaagaagaccaccaccaaccccuacgugcugauggugcuguacaaggacaagguguacaacauccagaucagauaccagaaggagagccagguguaccugcugggcaccggccugagaggcaaggaggacuuccugagcgugagcgacaucaucgacuacuucagaaagaugccccugcugcugaucgacggcaagaacagaggcagcagauaccagugcacccugacccacgccgccggcuaccccuaa

SEQ ID NO: 19189 - RNA, 5784 nt, Artificial Sequence
  LCT__Homo_sapiens__NP_002290
auggagcugagcuggcacgugguguucaucgcccugcugagcuucagcugcuggggcagcgacugggagagcgacagaaacuucaucagcaccgccggcccccugaccaacgaccugcugcacaaccugagcggccugcugggcgaccagagcagcaacuucguggccggcgacaaggacauguacgugugccaccagccccugcccaccuuccugcccgaguacuucagcagccugcacgccagccagaucacccacuacaagguguuccugagcugggcccagcugcugcccgccggcagcacccagaaccccgacgagaagaccgugcagugcuacagaagacugcugaaggcccugaagaccgccagacugcagcccauggugauccugcaccaccagacccugcccgccagcacccugagaagaaccgaggccuucgccgaccuguucgccgacuacgccaccuucgccuuccacagcuucggcgaccuggugggcaucugguucaccuucagcgaccuggaggaggugaucaaggagcugccccaccaggagagcagagccagccagcugcagacccugagcgacgcccacagaaaggccuacgagaucuaccacgagagcuacgccuuccagggcggcaagcugagcguggugcugagagccgaggacauccccgagcugcugcuggagccccccaucagcgcccuggcccaggacaccguggacuuccugagccuggaccugagcuacgagugccagaacgaggccagccugagacagaagcugagcaagcugcagaccaucgagcccaaggugaagguguucaucuucaaccugaagcugcccgacugccccagcaccaugaagaaccccgccagccugcuguucagccuguucgaggccaucaacaaggaccaggugcugaccaucggcuucgacaucaacgaguuccugagcugcagcagcagcagcaagaagagcaugagcugcagccugaccggcagccuggcccugcagcccgaccagcagcaggaccacgagaccaccgacagcagccccgccagcgccuaccagagaaucugggaggccuucgccaaccagagcagagccgagagagacgccuuccugcaggacaccuuccccgagggcuuccuguggggcgccagcaccggcgccuucaacguggagggcggcugggccgagggcggcagaggcgugagcaucugggaccccagaagaccccugaacaccaccgagggccaggccacccuggagguggccagcgacagcuaccacaagguggccagcgacguggcccugcugugcggccugagagcccagguguacaaguucagcaucagcuggagcagaaucuuccccaugggccacggcagcagccccagccugcccggcguggccuacuacaacaagcugaucgacagacugcaggacgccggcaucgagcccauggccacccuguuccacugggaccugccccaggcccugcaggaccacggcggcuggcagaacgagagcgugguggacgccuuccuggacuacgccgccuucugcuucagcaccuucggcgacagagugaagcugugggugaccuuccacgagcccugggugaugagcuacgccggcuacggcaccggccagcacccccccggcaucagcgaccccggcguggccagcuucaagguggcccaccuggugcugaaggcccacgccagaaccuggcaccacuacaacagccaccacagaccccagcagcagggccacgugggcaucgugcugaacagcgacugggccgagccccugagccccgagagacccgaggaccugagagccagcgagagauuccugcacuucaugcugggcugguucgcccaccccguguucguggacggcgacuaccccgccacccugagaacccagauccagcagaugaacagacagugcagccaccccguggcccagcugcccgaguucaccgaggccgagaagcagcugcugaagggcagcgccgacuuccugggccugagccacuacaccagcagacugaucagcaacgccccccagaacaccugcauccccagcuacgacaccaucggcggcuucagccagcacgugaaccacguguggccccagaccagcagcagcuggaucagaguggugcccuggggcaucagaagacugcugcaguucgugagccuggaguacaccagaggcaaggugcccaucuaccuggccggcaacggcaugcccaucggcgagagcgagaaccuguucgacgacagccugagaguggacuacuucaaccaguacaucaacgaggugcugaaggccaucaaggaggacagcguggacgugagaagcuacaucgccagaagccugaucgacggcuucgagggccccagcggcuacagccagagauucggccugcaccacgugaacuucagcgacagcagcaagagcagaacccccagaaagagcgccuacuucuucaccagcaucaucgagaagaacggcuuccugaccaagggcgccaagagacugcugccccccaacaccgugaaccugcccagcaaggugagagccuucaccuuccccagcgaggugcccagcaaggccaagguggugugggagaaguucagcagccagcccaaguucgagagagaccuguucuaccacggcaccuucagagacgacuuccuguggggcgugagcagcagcgccuaccagaucgagggcgccugggacgccgacggcaagggccccagcaucugggacaacuucacccacacccccggcagcaacgugaaggacaacgccaccggcgacaucgccugcgacagcuaccaccagcuggacgccgaccugaacaugcugagagcccugaaggugaaggccuacagauucagcaucagcuggagcagaaucuuccccaccggcagaaacagcagcaucaacagccacggcguggacuacuacaacagacugaucaacggccugguggccagcaacaucuuccccauggugacccuguuccacugggaccugccccaggcccugcaggacaucggcggcugggagaaccccgcccugaucgaccuguucgacagcuacgccgacuucugcuuccagaccuucggcgacagagugaaguucuggaugaccuucaacgagcccauguaccuggccuggcugggcuacggcagcggcgaguucccccccggcgugaaggaccccggcugggcccccuacagaaucgcccacgccgugaucaaggcccacgccagaguguaccacaccuacgacgagaaguacagacaggagcagaagggcgugaucagccugagccugagcacccacugggccgagcccaagagccccggcgugcccagagacguggaggccgccgacagaaugcugcaguucagccugggcugguucgcccaccccaucuucagaaacggcgacuaccccgacaccaugaaguggaaggugggcaacagaagcgagcugcagcaccuggccaccagcagacugcccagcuucaccgaggaggagaagagauucaucagagccaccgccgacguguucugccugaacaccuacuacagcagaaucgugcagcacaagacccccagacugaacccccccagcuacgaggacgaccaggagauggccgaggaggaggaccccagcuggcccagcaccgccaugaacagagccgcccccuggggcaccagaagacugcugaacuggaucaaggaggaguacggcgacauccccaucuacaucaccgagaacggcgugggccugaccaaccccaacaccgaggacaccgacagaaucuucuaccacaagaccuacaucaacgaggcccugaaggccuacagacuggacggcaucgaccugagaggcuacguggccuggagccugauggacaacuucgaguggcugaacggcuacaccgugaaguucggccuguaccacguggacuucaacaacaccaacagacccagaaccgccagagccagcgccagauacuacaccgaggugaucaccaacaacggcaugccccuggccagagaggacgaguuccuguacggcagauuccccgagggcuucaucuggagcgccgccagcgccgccuaccagaucgagggcgccuggagagccgacggcaagggccugagcaucugggacaccuucagccacaccccccugagaguggagaacgacgccaucggcgacguggccugcgacagcuaccacaagaucgccgaggaccuggugacccugcagaaccugggcgugagccacuacagauucagcaucagcuggagcagaauccugcccgacggcaccaccagauacaucaacgaggccggccugaacuacuacgugagacugaucgacacccugcuggccgccagcauccagccccaggugaccaucuaccacugggaccugccccagacccugcaggacgugggcggcugggagaacgagaccaucgugcagagauucaaggaguacgccgacgugcuguuccagagacugggcgacaaggugaaguucuggaucacccugaacgagcccuucgugaucgccuaccagggcuacggcuacggcaccgccgcccccggcgugagcaacagacccggcaccgcccccuacaucgugggccacaaccugaucaaggcccacgccgaggccuggcaccuguacaacgacguguacagagccagccagggcggcgugaucagcaucaccaucagcagcgacugggccgagcccagagaccccagcaaccaggaggacguggaggccgccagaagauacgugcaguucaugggcggcugguucgcccaccccaucuucaagaacggcgacuacaacgaggugaugaagaccagaaucagagacagaagccuggccgccggccugaacaagagcagacugcccgaguucaccgagagcgagaagagaagaaucaacggcaccuacgacuucuucggcuucaaccacuacaccaccgugcuggccuacaaccugaacuacgccaccgccaucagcagcuucgacgccgacagaggcguggccagcaucgccgacagaagcuggcccgacagcggcagcuucuggcugaagaugacccccuucggcuucagaagaauccugaacuggcugaaggaggaguacaacgacccccccaucuacgugaccgagaacggcgugagccagagagaggagaccgaccugaacgacaccgccagaaucuacuaccugagaaccuacaucaacgaggcccugaaggccgugcaggacaagguggaccugagaggcuacaccguguggagcgccauggacaacuucgagugggccaccggcuucagcgagagauucggccugcacuucgugaacuacagcgaccccagccugcccagaauccccaaggccagcgccaaguucuacgccagcguggugagaugcaacggcuuccccgaccccgccaccggcccccacgccugccugcaccagcccgacgccggccccaccaucagccccgugagacaggaggaggugcaguuccugggccugaugcugggcaccaccgaggcccagaccgcccuguacgugcuguucagccuggugcugcugggcgugugcggccuggccuuccugagcuacaaguacugcaagagaagcaagcagggcaagacccagagaagccagcaggagcugagccccgugagcagcuucuaa

SEQ ID NO: 19190 - RNA, 1236 nt, Artificial Sequence
  LDB1__Homo_sapiens__NP_001106878
augagcgugggcugcgccugccccggcugcagcagcaagagcuucaagcuguacagccccaaggagccccccaacggcaacgccuucccccccuuccaccccggcaccaugcuggacagagacgugggccccacccccauguacccccccaccuaccuggagcccggcaucggcagacacacccccuacggcaaccagaccgacuacagaaucuucgagcugaacaagagacugcagaacuggaccgaggagugcgacaaccuguggugggacgccuucaccaccgaguucuucgaggacgacgccaugcugaccaucaccuucugccuggaggacggccccaagagauacaccaucggcagaacccugauccccagauacuucagaagcaucuucgagggcggcgccaccgagcuguacuacgugcugaagcaccccaaggaggccuuccacagcaacuucgugagccuggacugcgaccagggcagcauggugacccagcacggcaagcccauguucacccaggugugcguggagggcagacuguaccuggaguucauguucgacgacaugaugagaaucaagaccuggcacuucagcaucagacagcacagagagcugauccccagaagcauccuggccaugcacgcccaggacccccagaugcuggaccagcugagcaagaacaucaccagaugcggccugagcaacagcacccugaacuaccugagacugugcgugauccuggagcccaugcaggagcugaugagcagacacaagaccuacagccugagccccagagacugccugaagaccugccuguuccagaaguggcagagaaugguggccccccccgccgagcccaccagacagcagcccagcaagagaagaaagagaaagaugagcggcggcagcaccaugagcagcggcggcggcaacaccaacaacagcaacagcaagaagaagagccccgccagcaccuucgcccugagcagccaggugcccgacgugaugguggugggcgagcccacccugaugggcggcgaguucggcgacgaggacgagagacugaucaccagacuggagaacacccaguucgacgccgccaacggcaucgacgacgaggacagcuucaacaacagccccgcccugggcgccaacagccccuggaacagcaagccccccagcagccaggagagcaagagcgagaaccccaccagccaggccagccaguaa

SEQ ID NO: 19191 - RNA, 996 nt, Artificial Sequence
  LDB2__Homo_sapiens__NP_001124306
augagcagcaccccccacgaccccuucuacagcagccccuucggccccuucuacagaagacacacccccuacauggugcagcccgaguacagaaucuacgagaugaacaagagacugcagagcagaaccgaggacagcgacaaccuguggugggacgccuucgccaccgaguucuucgaggacgacgccacccugacccugagcuucugccuggaggacggccccaagagauacaccaucggcagaacccugauccccagauacuucagcaccguguucgagggcggcgugaccgaccuguacuacauccugaagcacagcaaggagagcuaccacaacagcagcaucaccguggacugcgaccagugcaccauggugacccagcacggcaagcccauguucaccaaggugugcaccgagggcagacugauccuggaguucaccuucgacgaccugaugagaaucaagaccuggcacuucaccaucagacaguacagagagcuggugcccagaagcauccuggccaugcacgcccaggacccccaggugcuggaccagcugagcaagaacaucaccagaaugggccugaccaacuucacccugaacuaccugagacugugcgugauccuggagcccaugcaggagcugaugagcagacacaagaccuacaaccugagccccagagacugccugaagaccugccuguuccagaaguggcagagaaugguggccccccccgccgagcccaccagacagcccaccaccaagagaagaaagagaaagaacagcaccagcagcaccagcaacagcagcgccggcaacaacgccaacagcaccggcagcaagaagaagaccaccgccgccaaccugagccugagcagccaggugcccggccugggcgccauccccaacugcagccugaaccccggcagagacggcgaccugugccacagcaccgccgugacccccagcggccaguucaaggagaagcacuaa

SEQ ID NO: 19192 - RNA, 1854 nt, Artificial Sequence
  LDB3__Homo_sapiens__NP_001073583
augagcuacagcgugacccugaccggccccggccccuggggcuucagacugcagggcggcaaggacuucaacaugccccugaccaucagcagaaucacccccggcagcaaggccgcccagagccagcugagccagggcgaccuggugguggccaucgacggcgugaacaccgacaccaugacccaccuggaggcccagaacaagaucaagagcgccagcuacaaccugagccugacccugcagaagagcaagagacccauccccaucagcaccaccgccccccccgugcagaccccccugcccgugaucccccaccagaaggugguggugaacagccccgccaacgccgacuaccaggagagauucaaccccagcgcccugaaggacagcgcccugagcacccacaagcccaucgaggugaagggccugggcggcaaggccaccaucauccacgcccaguacaacacccccaucagcauguacagccaggacgccaucauggacgccaucgccggccaggcccaggcccagggcagcgacuucagcggcagccugcccaucaaggaccuggccguggacagcgccagccccguguaccaggccgugaucaagagccagaacaagcccgaggacgaggccgacgagugggccagaagaagcagcaaccugcagagcagaagcuucagaauccuggcccagaugaccggcaccgaguucaugcaggaccccgacgaggaggcccugagaagaagcagaccccaggccagcagcuacagccccgccguggccgccagcagcgcccccgccacccacaccagcuacagcgagggccccgccgcccccgcccccaagcccagaguggugaccaccgccagcaucagacccagcguguaccagcccgugcccgccagcaccuacagccccagccccggcgccaacuacagccccacccccuacacccccagccccgcccccgccuacacccccagccccgcccccgccuacacccccagccccgugcccaccuacacccccagccccgcccccgccuacacccccagccccgcccccaacuacaaccccgcccccagcguggccuacagcggcggccccgccgagcccgccagcagaccccccugggugaccgacgacagcuucagccagaaguucgcccccggcaagagcaccaccagcaucagcaagcagacccugcccagaggcggccccgccuacacccccgccggcccccaggugcccccccuggccagaggcaccgugcagagagccgagagauuccccgccagcagcagaaccccccugugcggccacugcaacaacgugaucagaggccccuuccugguggccaugggcagaagcuggcaccccgaggaguucaccugcgccuacugcaagaccagccuggccgacgugugcuucguggaggagcagaacaacguguacugcgagagaugcuacgagcaguucuucgccccccugugcgccaagugcaacaccaagaucaugggcgaggugaugcacgcccugagacagaccuggcacaccaccugcuucgugugcgccgccugcaagaagcccuucggcaacagccuguuccacauggaggacggcgagcccuacugcgagaaggacuacaucaaccuguucagcaccaagugccacggcugcgacuuccccguggaggccggcgacaaguucaucgaggcccugggccacaccuggcacgacaccugcuucaucugcgccgugugccacgugaaccuggagggccagcccuucuacagcaagaaggacagaccccugugcaagaagcacgcccacaccaucaaccuguaa

SEQ ID NO: 19193 - RNA, 825 nt, Artificial Sequence
  LDHA__Homo_sapiens__NP_001128711
auggccacccugaaggaccagcugaucuacaaccugcugaaggaggagcagaccccccagaacaagaucaccguggugggcgugggcgccgugggcauggccugcgccaucagcauccugaugaaggaccuggccgacgagcuggcccugguggacgugaucgaggacaagcugaagggcgagaugauggaccugcagcacggcagccuguuccugagaacccccaagaucgugagcggcaagguggacauccugaccuacguggccuggaagaucagcggcuuccccaagaacagagugaucggcagcggcugcaaccuggacagcgccagauucagauaccugaugggcgagagacugggcgugcacccccugagcugccacggcugggugcugggcgagcacggcgacagcagcgugcccguguggagcggcaugaacguggccggcgugagccugaagacccugcaccccgaccugggcaccgacaaggacaaggagcaguggaaggaggugcacaagcaggugguggagagcgccuacgaggugaucaagcugaagggcuacaccagcugggccaucggccugagcguggccgaccuggccgagagcaucaugaagaaccugagaagagugcaccccgugagcaccaugaucaagggccuguacggcaucaaggacgacguguuccugagcgugcccugcauccugggccagaacggcaucagcgaccuggugaaggugacccugaccagcgaggaggaggccagacugaagaagagcgccgacacccuguggggcauccagaaggagcugcaguucuaa

SEQ ID NO: 19194 - RNA, 1146 nt, Artificial Sequence
  LDHAL6B__Homo_sapiens__NP_149972
augagcuggaccgugcccguggugagagccagccagagagugagcagcgugggcgccaacuuccugugccugggcauggcccugugccccagacaggccaccagaaucccccugaacggcaccuggcuguucacccccgugagcaagauggccaccgugaagagcgagcugaucgagagauucaccagcgagaagcccgugcaccacagcaaggugagcaucaucggcaccggcagcgugggcauggccugcgccaucagcauccugcugaagggccugagcgacgagcuggcccugguggaccuggacgaggacaagcugaagggcgagaccauggaccugcagcacggcagccccuucaccaagaugcccaacaucgugugcagcaaggacuacuucgugaccgccaacagcaaccuggugaucaucaccgccggcgccagacaggagaagggcgagaccagacugaaccuggugcagagaaacguggccaucuucaagcugaugaucagcagcaucgugcaguacagcccccacugcaagcugaucaucgugagcaaccccguggacauccugaccuacguggccuggaagcugagcgccuuccccaagaacagaaucaucggcagcggcugcaaccuggacaccgccagauucagauuccugaucggccagaagcugggcauccacagcgagagcugccacggcuggauccugggcgagcacggcgacagcagcgugcccguguggagcggcgugaacaucgccggcgugccccugaaggaccugaacagcgacaucggcaccgacaaggaccccgagcaguggaagaacgugcacaaggaggugaccgccaccgccuacgagaucaucaagaugaagggcuacaccagcugggccaucggccugagcguggccgaccugaccgagagcauccugaagaaccugagaagaauccaccccgugagcaccaucaucaagggccuguacggcaucgacgaggagguguuccugagcauccccugcauccugggcgagaacggcaucaccaaccugaucaagaucaagcugacccccgaggaggaggcccaccugaagaagagcgccaagacccugugggagauccagaacaagcugaagcuguaa

SEQ ID NO: 19195 - RNA, 1005 nt, Artificial Sequence
  LDHB__Homo_sapiens__NP_002291
auggccacccugaaggagaagcugaucgcccccguggccgaggaggaggccaccgugcccaacaacaagaucaccguggugggcgugggccaggugggcauggccugcgccaucagcauccugggcaagagccuggccgacgagcuggcccugguggacgugcuggaggacaagcugaagggcgagaugauggaccugcagcacggcagccuguuccugcagacccccaagaucguggccgacaaggacuacagcgugaccgccaacagcaagaucgugguggugaccgccggcgugagacagcaggagggcgagagcagacugaaccuggugcagagaaacgugaacguguucaaguucaucaucccccagaucgugaaguacagccccgacugcaucaucaucguggugagcaaccccguggacauccugaccuacgugaccuggaagcugagcggccugcccaagcacagagugaucggcagcggcugcaaccuggacagcgccagauucagauaccugauggccgagaagcugggcauccaccccagcagcugccacggcuggauccugggcgagcacggcgacagcagcguggccguguggagcggcgugaacguggccggcgugagccugcaggagcugaaccccgagaugggcaccgacaacgacagcgagaacuggaaggaggugcacaagauggugguggagagcgccuacgaggugaucaagcugaagggcuacaccaacugggccaucggccugagcguggccgaccugaucgagagcaugcugaagaaccugagcagaauccaccccgugagcaccauggugaagggcauguacggcaucgagaacgagguguuccugagccugcccugcauccugaacgccagaggccugaccagcgugaucaaccagaagcugaaggacgacgagguggcccagcugaagaagagcgccgacacccugugggacauccagaaggaccugaaggaccuguaa

SEQ ID NO: 19196 - RNA, 999 nt, Artificial Sequence
  LDHC__Homo_sapiens__NP_059144
augagcaccgugaaggagcagcugaucgagaagcugaucgaggacgacgagaacagccagugcaagaucaccaucgugggcaccggcgccgugggcauggccugcgccaucagcauccugcugaaggaccuggccgacgagcuggcccugguggacguggcccuggacaagcugaagggcgagaugauggaccugcagcacggcagccuguucuucagcaccagcaagaucaccagcggcaaggacuacagcgugagcgccaacagcagaaucgugaucgugaccgccggcgccagacagcaggagggcgagaccagacuggcccuggugcagagaaacguggccaucaugaagagcaucauccccgccaucgugcacuacagccccgacugcaagauccugguggugagcaaccccguggacauccugaccuacaucguguggaagaucagcggccugcccgugaccagagugaucggcagcggcugcaaccuggacagcgccagauucagauaccugaucggcgagaagcugggcgugcaccccaccagcugccacggcuggaucaucggcgagcacggcgacagcagcgugccccuguggagcggcgugaacguggccggcguggcccugaagacccuggaccccaagcugggcaccgacagcgacaaggagcacuggaagaacauccacaagcaggugauccagagcgccuacgagaucaucaagcugaagggcuacaccagcugggccaucggccugagcgugauggaccuggugggcagcauccugaagaaccugagaagagugcaccccgugagcaccauggugaagggccuguacggcaucaaggaggagcuguuccugagcauccccugcgugcugggcagaaacggcgugagcgacguggugaagaucaaccugaacagcgaggaggaggcccuguucaagaagagcgccgagacccuguggaacauccagaaggaccugaucuucuaa

SEQ ID NO: 19197 - RNA, 1524 nt, Artificial Sequence
  LDHD__Homo_sapiens__NP_705690
auggccagacugcugagaagcgccaccugggagcuguuccccuggagaggcuacugcagccagaaggccaagggcgagcugugcagagacuucguggaggcccugaaggccguggugggcggcagccacgugagcaccgccgccguggugagagagcagcacggcagagacgagagcgugcacagaugcgagccccccgacgccgugguguggccccagaacguggagcaggugagcagacuggccgcccugugcuacagacagggcgugcccaucauccccuucggcaccggcaccggccuggagggcggcgugugcgccgugcagggcggcgugugcgugaaccugacccacauggacagaauccuggagcugaaccaggaggacuucagcguggugguggagcccggcgugaccagaaaggcccugaacgcccaccugagagacagcggccugugguuccccguggaccccggcgccgacgccagccugugcggcauggccgccaccggcgccagcggcaccaacgccgugagauacggcaccaugagagacaacgugcugaaccuggagguggugcugcccgacggcagacugcugcacaccgccggcagaggcagacacuucagauucggcuucuggcccgagaucccccaccacaccgccugguacagccccugcgugagccugggcagaagaaagagcgccgccggcuacaaccugaccggccuguucgugggcagcgagggcacccugggccugaucaccgccaccacccugagacugcaccccgcccccgaggccaccguggccgccaccugcgccuuccccagcgugcaggccgccguggacagcaccgugcacauccugcaggccgccgugcccguggccagaaucgaguuccuggacgaggugaugauggacgccugcaacagauacagcaagcugaacugccugguggcccccacccuguuccuggaguuccacggcagccagcaggcccuggaggagcagcugcagagaaccgaggagaucgugcagcagaacggcgccagcgacuucagcugggccaaggaggccgaggagagaagcagacuguggaccgccagacacaacgccugguacgccgcccuggccaccagacccggcugcaagggcuacagcaccgacgugugcgugcccaucagcagacugcccgagaucguggugcagaccaaggaggaccugaacgccagcggccugaccggcagcaucgugggccacgugggcgacggcaacuuccacugcauccugcuggugaaccccgacgacgccgaggagcugggcagagugaaggccuucgccgagcagcugggcagaagagcccuggcccugcacggcaccugcaccggcgagcacggcaucggcaugggcaagagacagcugcugcaggaggaggugggcgccgugggcguggagaccaugagacagcugaaggccgugcuggacccccagggccugaugaaccccggcaaggugcuguaa

SEQ ID NO: 19198 - RNA, 1038 nt, Artificial Sequence
  LDLRAD3__Homo_sapiens__NP_777562
auguggcugcugggcccccugugccugcugcugagcagcgccgccgagagccagcugcugcccggcaacaacuucaccaacgagugcaacauccccggcaacuucaugugcagcaacggcagaugcauccccggcgccuggcagugcgacggccugcccgacugcuucgacaagagcgacgagaaggagugccccaaggccaagagcaagugcggccccaccuucuuccccugcgccagcggcauccacugcaucaucggcagauucagaugcaacggcuucgaggacugccccgacggcagcgacgaggagaacugcaccgccaacccccugcugugcagcaccgccagauaccacugcaagaacggccugugcaucgacaagagcuucaucugcgacggccagaacaacugccaggacaacagcgacgaggagagcugcgagagcagccaggagcccggcagcggccagguguucgugaccagcgagaaccagcugguguacuaccccagcaucaccuacgccaucaucggcagcagcgugaucuucgugcuggugguggcccugcuggcccuggugcugcaccaccagagaaagagaaacaaccugaugacccugcccgugcacagacugcagcaccccgugcugcugagcagacugguggugcuggaccacccccaccacugcaacgugaccuacaacgugaacaacggcauccaguacguggccagccaggccgagcagaacgccagcgaggugggcagcccccccagcuacagcgaggcccugcuggaccagagacccgccugguacgaccugccccccccccccuacagcagcgacaccgagagccugaaccaggccgaccugccccccuacagaagcagaagcggcagcgccaacagcgccagcagccaggccgccagcagccugcugagcguggaggacaccagccacagccccggccagcccggcccccaggagggcaccgccgagcccagagacagcgagcccagccagggcaccgaggagguguaa

SEQ ID NO: 19199 - RNA, 810 nt, Artificial Sequence
  LDLRAD4__Homo_sapiens__NP_001003674
augagcagcgaccaccugaacaacagcacccugaaggaggcccaguucaaggaccuguuccugaagaaggccgagcuggaguucgcccagaucaucaucaucguggugguggugaccgugauggugguggugaucgugugccugcugaaccacuacaaggugagcaccagaagcuucaucaacagacccaaccagagcagaagaagagaggacggccugccccaggagggcugccuguggcccagcgacagcgccgcccccagacugggcgccagcgagaucaugcacgcccccagaagcagagacagauucaccgcccccagcuucauccagagagacagauucagcagauuccagcccaccuaccccuacgugcagcacgagaucgaccugccccccaccaucagccugagcgacggcgaggagcccccccccuaccagggccccugcacccugcagcugagagaccccgagcagcagauggagcugaacagagagagcgugagagccccccccaacagaaccaucuucgacagcgaccugaucgacaucgccauguacagcggcggccccugcccccccagcagcaacagcggcaucagcgccagcaccugcagcagcaacggcagaauggagggccccccccccaccuacagcgaggugaugggccaccaccccggcgccagcuuccugcaccaccagagaagcaacgcccacagaggcagcagacugcaguuccagcagaacaacgccgagagcaccaucgugcccaucaagggcaaggacagaaagcccggcaaccugguguaa

SEQ ID NO: 19200 - RNA, 2583 nt, Artificial Sequence
  LDLR__Homo_sapiens__NP_000518
augggccccuggggcuggaagcugagauggaccguggcccugcugcuggccgccgccggcaccgccgugggcgacagaugcgagagaaacgaguuccagugccaggacggcaagugcaucagcuacaagugggugugcgacggcagcgccgagugccaggacggcagcgacgagagccaggagaccugccugagcgugaccugcaagagcggcgacuucagcugcggcggcagagugaacagaugcaucccccaguucuggagaugcgacggccagguggacugcgacaacggcagcgacgagcagggcugcccccccaagaccugcagccaggacgaguucagaugccacgacggcaagugcaucagcagacaguucgugugcgacagcgacagagacugccuggacggcagcgacgaggccagcugccccgugcugaccugcggccccgccagcuuccagugcaacagcagcaccugcaucccccagcugugggccugcgacaacgaccccgacugcgaggacggcagcgacgaguggccccagagaugcagaggccuguacguguuccagggcgacagcagccccugcagcgccuucgaguuccacugccugagcggcgagugcauccacagcagcuggagaugcgacggcggccccgacugcaaggacaagagcgacgaggagaacugcgccguggccaccugcagacccgacgaguuccagugcagcgacggcaacugcauccacggcagcagacagugcgacagagaguacgacugcaaggacaugagcgacgaggugggcugcgugaacgugacccugugcgagggccccaacaaguucaagugccacagcggcgagugcaucacccuggacaaggugugcaacauggccagagacugcagagacuggagcgacgagcccaucaaggagugcggcaccaacgagugccuggacaacaacggcggcugcagccacgugugcaacgaccugaagaucggcuacgagugccugugccccgacggcuuccagcugguggcccagagaagaugcgaggacaucgacgagugccaggaccccgacaccugcagccagcugugcgugaaccuggagggcggcuacaagugccagugcgaggagggcuuccagcuggacccccacaccaaggccugcaaggccgugggcagcaucgccuaccuguucuucaccaacagacacgaggugagaaagaugacccuggacagaagcgaguacaccagccugauccccaaccugagaaacgugguggcccuggacaccgagguggccagcaacagaaucuacuggagcgaccugagccagagaaugaucugcagcacccagcuggacagagcccacggcgugagcagcuacgacaccgugaucagcagagacauccaggcccccgacggccuggccguggacuggauccacagcaacaucuacuggaccgacagcgugcugggcaccgugagcguggccgacaccaagggcgugaagagaaagacccuguucagagagaacggcagcaagcccagagccaucgugguggaccccgugcacggcuucauguacuggaccgacuggggcacccccgccaagaucaagaagggcggccugaacggcguggacaucuacagccuggugaccgagaacauccaguggcccaacggcaucacccuggaccugcugagcggcagacuguacuggguggacagcaagcugcacagcaucagcagcaucgacgugaacggcggcaacagaaagaccauccuggaggacgagaagagacuggcccaccccuucagccuggccguguucgaggacaagguguucuggaccgacaucaucaacgaggccaucuucagcgccaacagacugaccggcagcgacgugaaccugcuggccgagaaccugcugagccccgaggacauggugcuguuccacaaccugacccagcccagaggcgugaacuggugcgagagaaccacccugagcaacggcggcugccaguaccugugccugcccgccccccagaucaacccccacagccccaaguucaccugcgccugccccgacggcaugcugcuggccagagacaugagaagcugccugaccgaggccgaggccgccguggccacccaggagaccagcaccgugagacugaaggugagcagcaccgccgugagaacccagcacaccaccaccagacccgugcccgacaccagcagacugcccggcgccacccccggccugaccaccguggagaucgugaccaugagccaccaggcccugggcgacguggccggcagaggcaacgagaagaagcccagcagcgugagagcccugagcaucgugcugcccaucgugcugcugguguuccugugccugggcguguuccugcuguggaagaacuggagacugaagaacaucaacagcaucaacuucgacaaccccguguaccagaagaccaccgaggacgaggugcacaucugccacaaccaggacggcuacagcuaccccagcagacagauggugagccuggaggacgacguggccuaa

SEQ ID NO: 19201 - RNA, 441 nt, Artificial Sequence
  LDOC1__Homo_sapiens__NP_036449
augguggacgagcuggugcugcugcugcacgcccugcugaugagacacagagcccugagcaucgagaacagccagcugauggagcagcugagacugcuggugugcgagagagccagccugcugagacaggugagaccccccagcugccccgugcccuuccccgagaccuucaacggcgagagcagcagacugcccgaguucaucgugcagaccgccagcuacaugcuggugaacgagaacagauucugcaacgacgccaugaagguggccuuccugaucagccugcugaccggcgaggccgaggaguggguggugcccuacaucgagauggacagccccauccugggcgacuacagagccuuccuggacgagaugaagcagugcuucggcugggacgacgacgaggacgacgacgacgaggaggaggaggacgacuacuaa

SEQ ID NO: 19202 - RNA, 720 nt, Artificial Sequence
  LDOC1L__Homo_sapiens__NP_115663
auggugcagccccagaccagcaaggccgagagccccgcccuggccgccagccccaacgcccagauggacgacgugaucgacacccugaccagccugagacugaccaacagcgcccugagaagagaggccagcacccugagagccgagaaggccaaccugaccaacaugcuggagagcgugauggccgagcugacccugcugagaaccagagccagaauccccggcgcccugcagaucaccccccccaucagcagcaucaccagcaacggcaccagacccaugaccaccccccccaccagccugcccgagcccuucagcggcgaccccggcagacuggccggcuuccugaugcagauggacagauucaugaucuuccaggccagcagauuccccggcgaggccgagagaguggccuuccuggugagcagacugaccggcgaggccgagaagugggccaucccccacaugcagcccgacagcccccugagaaacaacuaccagggcuuccuggccgagcugagaagaaccuacaagagcccccugagacacgccagaagagcccagaucagaaagaccagcgccagcaacagagccgugagagagagacagaugcugugcagacagcuggccagcgccggcaccggccccugccccgugcaccccgccagcaacggcaccagccccgcccccgcccugcccgccagagccagaaaccuguaa

SEQ ID NO: 19203 - RNA, 234 nt, Artificial Sequence
  LEAP2__Homo_sapiens__NP_443203
auguggcaccugaagcugugcgccgugcugaugaucuuccugcugcugcugggccagaucgacggcagccccauccccgaggugagcagcgccaagagaagacccagaagaaugacccccuucuggagaggcgugagccugagacccaucggcgccagcugcagagacgacagcgagugcaucaccagacugugcagaaagagaagaugcagccugagcguggcccaggaguaa

SEQ ID NO: 19204 - RNA, 1002 nt, Artificial Sequence
  LECT1__Homo_sapiens__NP_001011705
augaccgagaacagcgacaaggugcccaucgcccuggugggccccgacgacguggaguucugcagcccccccgccuacgccacccugaccgugaagcccagcagccccgccagacugcugaaggugggcgccguggugcugaucagcggcgccgugcugcugcuguucggcgccaucggcgccuucuacuucuggaagggcagcgacagccacaucuacaacgugcacuacaccaugagcaucaacggcaagcugcaggacggcagcauggagaucgacgccggcaacaaccuggagaccuucaagaugggcagcggcgccgaggaggccaucgccgugaacgacuuccagaacggcaucaccggcaucagauucgccggcggcgagaagugcuacaucaaggcccaggugaaggccagaauccccgaggugggcgccgugaccaagcagagcaucagcagcaagcuggagggcaagaucaugcccgugaaguacgaggagaacagccugaucuggguggccguggaccagcccgugaaggacaacagcuuccugagcagcaaggugcuggagcugugcggcgaccugcccaucuucuggcugaagcccaccuaccccaaggagauccagagagagagaagagagguggugagaaagaucgugcccaccaccaccaagagaccccacagcggccccagaagcaaccccggcgccggcagacugaacaacgagaccagacccagcgugcaggaggacagccaggccuucaaccccgacaaccccuaccaccaggagggcgagagcaugaccuucgaccccagacuggaccacgagggcaucugcugcaucgagugcagaagaagcuacacccacugccagaagaucugcgagccccugggcggcuacuaccccuggcccuacaacuaccagggcugcagaagcgccugcagagugaucaugcccugcagcugguggguggccagaauccugggcaugguguaa

SEQ ID NO: 19205 - RNA, 456 nt, Artificial Sequence
  LECT2__Homo_sapiens__NP_002293
auguucagcaccaaggcccugcugcuggccggccugaucagcaccgcccuggccggccccugggccaacaucugcgccggcaagagcagcaacgagaucagaaccugcgacagacacggcugcggccaguacagcgcccagagaagccagagaccccaccagggcguggacauccugugcagcgccggcagcaccguguacgcccccuucaccggcaugaucgugggccaggagaagcccuaccagaacaagaacgccaucaacaacggcgugagaaucagcggcagaggcuucugcgugaagauguucuacaucaagcccaucaaguacaagggccccaucaagaagggcgagaagcugggcacccugcugccccugcagaagguguaccccggcauccagagccacgugcacaucgagaacugcgacagcagcgaccccaccgccuaccuguaa

SEQ ID NO: 19206 - RNA, 1116 nt, Artificial Sequence
  LEF1__Homo_sapiens__NP_001124185
augccccagcugagcggcggcggcggcggcggcggcggcgaccccgagcugugcgccaccgacgagaugauccccuucaaggacgagggcgacccccagaaggagaagaucuucgccgagaucagccaccccgaggaggagggcgaccuggccgacaucaagagcagccuggugaacgagagcgagaucauccccgccagcaacggccacgagguggccagacaggcccagaccagccaggagcccuaccacgacaaggccagagagcaccccgacgacggcaagcaccccgacggcggccuguacaacaagggccccagcuacagcagcuacagcggcuacaucaugaugcccaacaugaacaacgaccccuacaugagcaacggcagccugagcccccccauccccagaaccagcaacaaggugcccguggugcagcccagccacgccgugcacccccugaccccccugaucaccuacagcgacgagcacuucagccccggcagccaccccagccacauccccagcgacgugaacagcaagcagggcaugagcagacacccccccgcccccgacauccccaccuucuacccccugagccccggcggcgugggccagaucacccccccccugggcugguucagccaccacaugauccccggcccccccggcccccacaccaccggcaucccccaccccgccaucgugaccccccaggugaagcaggagcacccccacaccgacagcgaccugaugcacgugaagccccagcacgagcagagaaaggagcaggagcccaagagaccccacaucaagaagccccugaacgccuucaugcuguacaugaaggagaugagagccaacgugguggccgagugcacccugaaggagagcgccgccaucaaccagauccugggcagaagauggcacgcccugagcagagaggagcaggccaaguacuacgagcuggccagaaaggagagacagcugcacaugcagcuguaccccggcuggagcgccagagacaacuacggcaagaagaagaagagaaagagagagaagcugcaggagagcgccagcggcaccggccccagaaugaccgccgccuacaucuaa

SEQ ID NO: 19207 - RNA, 1101 nt, Artificial Sequence
  LEFTY1__Homo_sapiens__NP_066277
augcagccccuguggcugugcugggcccugugggugcugccccuggccagccccggcgccgcccugaccggcgagcagcugcugggcagccugcugagacagcugcagcugaaggaggugcccacccuggacagagccgacauggaggagcuggugauccccacccacgugagagcccaguacguggcccugcugcagagaagccacggcgacagaagcagaggcaagagauucagccagagcuucagagagguggccggcagauuccuggcccuggaggccagcacccaccugcugguguucggcauggagcagagacugccccccaacagcgagcuggugcaggccgugcugagacuguuccaggagcccgugcccaaggccgcccugcacagacacggcagacugagccccagaagcgccagagccagagugaccguggaguggcugagagugagagacgacggcagcaacagaaccagccugaucgacagcagacuggugagcgugcacgagagcggcuggaaggccuucgacgugaccgaggccgugaacuucuggcagcagcugagcagacccagacagccccugcugcugcaggugagcgugcagagagagcaccugggcccccuggccagcggcgcccacaagcuggugagauucgccagccagggcgcccccgccggccugggcgagccccagcuggagcugcacacccuggaccugggcgacuacggcgcccagggcgacugcgaccccgaggcccccaugaccgagggcaccagaugcugcagacaggagauguacaucgaccugcagggcaugaagugggccgagaacugggugcuggagccccccggcuuccuggccuacgagugcgugggcaccugcagacagccccccgaggcccuggccuucaaguggcccuuccugggccccagacagugcaucgccagcgagaccgacagccugcccaugaucgugagcaucaaggagggcggcagaaccagaccccagguggugagccugcccaacaugagagugcagaagugcagcugcgccagcgacggcgcccuggugcccagaagacugcagcccuaa

SEQ ID NO: 19208 - RNA, 999 nt, Artificial Sequence
  LEFTY2__Homo_sapiens__NP_001165896
auguggccccuguggcugugcugggcccugugggugcugccccuggccggccccggcgccgcccugaccgaggagcagcugcugggcagccugcugagacagcugcagcugagcgaggugcccgugcuggacagagccgacauggagaagcuggugauccccgcccacgugagagcccaguacguggugcugcugagaagaagccacggcgacagaagcagaggcaagagauucagccagagcuucagagagguggccggcagauuccuggccagcgaggccgcccugcacagacacggcagacugagccccagaagcgcccaggccagagugaccguggaguggcugagagugagagacgacggcagcaacagaaccagccugaucgacagcagacuggugagcgugcacgagagcggcuggaaggccuucgacgugaccgaggccgugaacuucuggcagcagcugagcagacccagacagccccugcugcugcaggugagcgugcagagagagcaccugggcccccuggccagcggcgcccacaagcuggugagauucgccagccagggcgcccccgccggccugggcgagccccagcuggagcugcacacccuggaccugagagacuacggcgcccagggcgacugcgaccccgaggcccccaugaccgagggcaccagaugcugcagacaggagauguacaucgaccugcagggcaugaagugggccaagaacugggugcuggagccccccggcuuccuggccuacgagugcgugggcaccugccagcagccccccgaggcccuggccuucaacuggcccuuccugggccccagacagugcaucgccagcgagaccgccagccugcccaugaucgugagcaucaaggagggcggcagaaccagaccccagguggugagccugcccaacaugagagugcagaagugcagcugcgccagcgacggcgcccuggugcccagaagacugcagcccuaa

SEQ ID NO: 19209 - RNA, 2079 nt, Artificial Sequence
  LEKR1__Homo_sapiens__NP_001004316
auggaccaccacauccccaugcacgcccugcccgaggagauccagaagaugcugcccgaggagaaggugugcaaguacugcggcgugagcuaccugauccugcacgaguucaaggccauggaggagaaggugaaggccauggagaaggagaugaaguucuaccagggcagcguggacagagagaagagacugcaggagaagcugcacagccugagccaggagcuggagcaguacaagaucgacaacaagagcaagaccgagagaaucuacgacgugggcaugcagcugaagagccagcagaacgaguuccagaaggugaagaagcagcugagccaccugcaggacgagcugaagaucaaguacagacagagcuacaucuucagccagagacugagcgaguacaaguacuucuggaacaagacccugagccugcugaccuucaccaagagagagcugaccagcaucaagaacgagguguacgacaacuaccagaacuggaccagccugaagggcgccguguuccugcagaucaagagcaucagcgagaccgcccugaccgagaucgacauccugaacaagagccugaccgugagccagagaaacaaggugugccuggagaaggagaugaagaaccugaagcugcugagcgacgccgccauccugagaagccagcagaucagaaccagcagacagcaggaggugaaccugcagaccagaugcuacgaccugcagaaggaggugcuggaccugcagugccugguggaggcccugggccugaagcugcagaaggccgugaccgagauggacaacuacaaggagaugcugaugaacaagagcaacgaggccgacgacugccagagagagcugaagaagcugaaguucgagagcaucaucagcgagagccagcacaccaugcugcugaaggagaaggaggacagccugaugaccugccagcagaucuacaaggcccugcaggaggagcugaccgugaaggagaagcaggaggaggacaucaagagaagaaucaaccuggccgagaacgagcuggagaucaccaagacccugcugaaccagaccagagaggaggugcugacccugaagaacgagagagagcugaugcugaucagccaccagaagagcaucgagcagcugcaggagacccugagacagaagcugcugagcgacgacaacuggaaggagaagaucgaggccgagcuggccaaggagagagcccagcaccugguggaguucgaggagcaggcccugcuguucaaggaggagaccaagcugcagcuggacaucgagaaggagaagcaccaggacgugauccagaaguacaagaaggagcaggaggagcugcagaugaagaucagcgaccugaucaccggcgccaccagagaccugagacaggaggugaccacccugaaggagaagcugcacaagagccacaucagauacaccgaggagagcaacagcaaggagaaggagaucgagaaccugaagaaccugguggccgaguucgagagcagacugaagaaggagaucgacagcaacgacagcgugagcgagaaccugagaaaggagauggagcagaagagcgacgagcugaagagagugaugcuggcccagacccagcugaucgagcaguucaaccagagccaggaggagaacaccuuccugcaggagaccgugagaagagagugcgaggagagauucgagcugaccgaggcccugagccaggccagagagcagcugcuggagcugagcaagcugagaggcagccugcccuucagccccugcagccugagcaagggcagccugaccagccccgccgccgccgugagcaaccacggcgagagaagccuggccagacugaacagcgagaagggcauccagauccccaaccugagaggcgugagcaagcccaccaccuuccccaccagcgacaagcccaagagagugagaagcggcgugcccauccugccccagccccacccccccagaggcggcgccagcagcgccaacgagaccagacagagacuggccgccauccugagaagaagaagaagccagcaguaa

SEQ ID NO: 19210 - RNA, 606 nt, Artificial Sequence
  LEMD2__Homo_sapiens__NP_001137416
auggaggcccaggaguacaucgccaacgugaccagcagcagcagcgccaaguucgaggccgcccugaccuggauccugagcagcaacaaggacgugggcaucuggcugaagggcgaggaccagagcgagcuggugaccaccguggacaagguggugugccuggagagcgcccaccccagaaugggcgugggcugcagacugagcagagcccugcugaccgccgugaccaacgugcugaucuucuucuggugccuggccuuccuguggggccugcugauccugcugaaguacagauggagaaagcuggaggaggaggagcaggccauguacgagauggugaagaagaucaucgacguggugcaggaccacuacguggacugggagcaggacauggagagauaccccuacgugggcauccugcacgugagagacagccugauccccccccagagcagaagaagaaugaagagagugugggacagagccguggaguuccuggccagcaacgagagcagaauccagaccgagagccacagaguggccggcgaggacaugcugguguggagauggaccaagcccagcagcuucagcgacagcgagagauaa

SEQ ID NO: 19211 - RNA, 2736 nt, Artificial Sequence
  LEMD3__Homo_sapiens__NP_055134
auggccgccgccgccgccagcgccccccagcagcugagcgacgaggagcuguucagccagcugagaagauacggccugagccccggccccgugaccgagagcaccagacccguguaccugaagaagcugaagaagcugagagaggaggagcagcagcagcacagaagcggcggcagaggcaacaagaccagaaacagcaacaacaacaacaccgccgccgccaccguggccgccgccggccccgccgccgccgccgccgccggcaugggcgugagacccgugagcggcgaccugagcuaccugagaacccccggcggccugugcagaaucagcgccagcggccccgagagccugcugggcggccccggcggcgccagcgccgcccccgccgccggcagcaaggugcugcugggcuucagcagcgacgagagcgacguggaggccagccccagagaccaggccggcggcggcggcagaaaggacagagccagccugcaguacagaggccugaaggccccccccgccccccuggccgccagcgaggugaccaacagcaacagcgccgagagaagaaagccccacagcugguggggcgccagaagacccgccggccccgagcugcagaccccccccggcaaggacggcgccguggaggacgaggagggcgagggcgaggacggcgaggagagagaccccgagaccgaggagccccugugggccagcagaaccgugaacggcagcagacuggugcccuacagcugcagagagaacuacagcgacagcgaggaggaggacgacgacgacguggccagcagcagacaggugcugaaggacgacagccugagcagacacagacccagaagaacccacagcaagccccugcccccccugaccgccaagagcgccggcggcagacuggagaccagcgugcagggcggcggcggccuggccaugaacgacagagccgccgccgccggcagccuggacagaagcagaaaccuggaggaggccgccgccgccgagcagggcggcggcugcgaccagguggacagcagccccgugcccagauacagagugaacgccaagaagcugaccccccugcugccccccccccugaccgacauggacagcacccuggacagcagcaccggcagccugcugaagaccaacaaccacaucggcggcggcgccuucagcguggacagccccagaaucuacagcaacagccugccccccagcgccgccguggccgccagcagcagccugagaaucaaccacgccaaccacaccggcagcaaccacaccuaccugaagaacaccuacaacaagcccaagcugagcgagcccgaggaggagcugcugcagcaguucaagagagaggaggugagccccaccggcagcuucagcgcccacuaccugagcauguuccugcugaccgccgccugccuguucuuccugauccugggccugaccuaccugggcaugagaggcaccggcgugagcgaggacggcgagcugagcaucgagaaccccuucggcgagaccuucggcaagauccaggagagcgagaagacccugaugaugaacacccuguacaagcugcacgacagacuggcccagcuggccggcgaccacgagugcggcagcagcagccagagaacccugagcgugcaggaggccgccgccuaccugaaggaccugggccccgaguacgagggcaucuucaacaccagccugcaguggauccuggagaacggcaaggacgugggcaucagaugcgugggcuucggccccgaggaggagcugaccaacaucaccgacgugcaguuccugcagagcaccagaccccugaugagcuucuggugcagauucagaagagccuucgugaccgugacccacagacugcugcugcugugccugggcguggugauggugugcguggugcugagauacaugaaguacagauggaccaaggaggaggaggagaccagacagauguacgacaugguggugaagaucaucgacgugcugagaagccacaacgaggccugccaggagaacaaggaccugcagcccuacaugcccaucccccacgugagagacagccugauccagccccacgacagaaagaagaugaagaaggugugggacagagccguggacuuccuggccgccaacgagagcagagugagaaccgagaccagaagaaucggcggcgccgacuuccugguguggagauggauccagcccagcgccagcugcgacaagauccuggugauccccagcaagguguggcagggccaggccuuccaccuggacagaagaaacagcccccccaacagccugacccccugccugaagaucagaaacauguucgaccccgugauggagaucggcgaccaguggcaccuggccauccaggaggccauccuggagaagugcagcgacaacgacggcaucgugcacaucgccguggacaagaacagcagagagggcugcguguacgugaagugccugagccccgaguacgccggcaaggccuucaaggcccugcacggcagcugguucgacggcaagcuggugaccgugaaguaccugagacuggacagauaccaccacagauucccccaggcccugaccagcaacaccccccugaagcccagcaacaagcacaugaacagcaugagccaccugagacugagaaccggccugaccaacagccagggcagcagcuaa

SEQ ID NO: 19212 - RNA, 1821 nt, Artificial Sequence
  LEO1__Homo_sapiens__NP_001273359
auggccgacauggaggaccuguucggcagcgacgccgacagcgaggccgagagaaaggacagcgacagcggcagcgacagcgacagcgaccaggagaacgccgccagcggcagcaacgccagcggcagcgagagcgaccaggacgagagaggcgacagcggccagcccagcaacaaggagcuguucggcgacgacagcgaggacgagggcgccagccaccacagcggcagcgacaaccacagcgagagaagcgacaacagaagcgaggccagcgagagaagcgaccacgaggacaacgaccccagcgacguggaccagcacagcggcagcgaggcccccaacgacgacgaggacgagggccacagaagcgacggcggcagccaccacagcgaggccgagggcagcgagaaggcccacagcgacgacgagaaguggggcagagaggacaagagcgaccagagcgacgacgagaagauccagaacagcgacgacgaggagagagcccagggcagcgacgaggacaagcugcagaacagcgacgacgacgagaagaugcagaacaccgacgacgaggagagaccccagcugagcgacgacgagagacagcagcugagcgaggaggagaaggccaacagcgacgacgagagacccguggccagcgacaacgacgacgagaagcagaacagcgacgacgaggagcagccccagcugagcgacgaggagaagaugcagaacagcgacgacgagagaccccaggccagcgacgaggagcacagacacagcgacgacgaggaggagcaggaccacaagagcgagagcgccagaggcagcgacagcgaggacgaggugcugagaaugaagagaaagaacgccaucgccagcgacagcgaggccgacagcgacaccgaggugcccaaggacaacagcggcaccauggaccuguucggcggcgccgacgacaucagcagcggcagcgacggcgaggacaagccccccacccccggccagcccguggacgagaacggccugccccaggaccagcaggaggaggagcccauccccgagaccagaaucgagguggagauccccaaggugaacaccgaccugggcaacgaccuguacuucgugaagcugcccaacuuccugagcguggagcccagcaugagccugcaccugggcaacgagguguucgacguguacaaggccccccugcagggcgaccacaaccaccuguucaucagacagggcaccggccugcagggccaggccguguucaagaccaagcugaccuucagaccccacagcaccgacagcgccacccacagaaagaugacccugagccuggccgacagaugcagcaagacccagaagaucagaauccugcccauggccggcagagaccccgagugccagagaaccgagaugaucaagaaggaggaggagagacugagagccagcaucagaagagagagccagcagagaagaaugagagagaagcagcaccagagaggccugagcgccagcuaccuggagcccgacagauacgacgaggaggaggagggcgaggagagcaucagccuggccgccaucaagaacagauacaagggcggcaucagagaggagagagccagaaucuacagcagcgacagcgacgagggcagcgaggaggacaaggcccagagacugcugaaggccaagaagcugaccagcgacgaggagggcgagcccagcggcaagagaaaggccgaggacgacgacaaggccaacaagaagcacaagaaguacgugaucagcgacgaggaggaggaggacgacgacuaa

SEQ ID NO: 19213 - RNA, 504 nt, Artificial Sequence
  LEP__Homo_sapiens__NP_000221
augcacuggggcacccugugcggcuuccuguggcuguggcccuaccuguucuacgugcaggccgugcccauccagaaggugcaggacgacaccaagacccugaucaagaccaucgugaccagaaucaacgacaucagccacacccagagcgugagcagcaagcagaaggugaccggccuggacuucauccccggccugcaccccauccugacccugagcaagauggaccagacccuggccguguaccagcagauccugaccagcaugcccagcagaaacgugauccagaucagcaacgaccuggagaaccugagagaccugcugcacgugcuggccuucagcaagagcugccaccugcccugggccagcggccuggagacccuggacagccugggcggcgugcuggaggccagcggcuacagcaccgaggugguggcccugagcagacugcagggcagccugcaggacaugcuguggcagcuggaccugagccccggcugcuaa

SEQ ID NO: 19214 - RNA, 510 nt, Artificial Sequence
  LEPROTL1__Homo_sapiens__NP_001121680
auggccggcaucaaggcccugaucagccugagcuucggcggcgccaucggccugauguuccugaugcugggcugcgcccugcccaucuacaacaaguacuggccccuguucgugcuguucuucuacauccugagccccauccccuacugcaucgccagaagacugguggacgacaccgacgccaugagcaacgccugcaaggagcuggccaucuuccugaccaccggcaucguggugagcgccuucggccugcccaucguguucgccagagcccaccugaugggcagacugcccuucuucagcaagaugggcaccgccgagagcgagggcagagagacccugacccagcagcugccccugcccgccgccgccaugagaagacugcugcccgccagcagagugagcacccagcccgugcugagacuggccgacagcgccgagagccugcugggcagacccgcccugugggcccugggcuuccugcugugcccccccagccaggcccaguaa

SEQ ID NO: 19215 - RNA, 2220 nt, Artificial Sequence
  LETM1__Homo_sapiens__NP_036450
auggccagcauccugcugagaagcugcagaggcagagcccccgccagacugccccccccccccagauacaccgugcccagaggcagccccggcgaccccgcccaccugagcugcgccagcacccugggccugagaaacugccugaacgugcccuucggcugcugcacccccauccaccccguguacaccagcagcagaggcgaccaccugggcugcugggcccugagacccgagugccugagaaucgugagcagagcccccuggaccagcaccagcgugggcuucguggccgugggcccccagugccugcccgugagaggcuggcacagcagcagacccgugagagacgacagcgugguggagaagagccugaagagccugaaggacaagaacaagaagcuggaggagggcggccccguguacagcccccccgccgaggugguggugaagaagagccugggccagagagugcuggacgagcugaagcacuacuaccacggcuucagacugcuguggaucgacaccaagaucgccgccagaaugcuguggagaauccugaacggccacagccugaccagaagagagagaagacaguuccugagaaucugcgccgaccuguucagacuggugcccuuccugguguucgugguggugcccuucauggaguuccugcugcccguggccgugaagcuguuccccaacaugcugcccagcaccuucgagacccagagccugaaggaggagagacugaagaaggagcugagagugaagcuggagcuggccaaguuccugcaggacaccaucgaggagauggcccugaagaacaaggccgccaagggcagcgccaccaaggacuucagcguguucuuccagaagaucagagagaccggcgagagacccagcaacgaggagaucaugagauucagcaagcuguucgaggacgagcugacccuggacaaccugaccagaccccagcugguggcccugugcaagcugcuggagcugcagagcaucggcaccaacaacuuccugagauuccagcugaccaugagacugagaagcaucaaggccgacgacaagcugaucgccgaggagggcguggacagccugaacgugaaggagcugcaggccgccugcagagccagaggcaugagagcccugggcgugaccgaggacagacugagaggccagcugaagcaguggcuggaccugcaccugcaccaggagauccccaccagccugcugauccugagcagagccauguaccugcccgacacccugagccccgccgaccagcugaagagcacccugcagacccugcccgagaucguggccaaggaggcccaggugaagguggccgagguggagggcgagcagguggacaacaaggccaagcuggaggccacccugcaggaggaggccgccauccagcaggagcacagagagaaggagcugcagaagagaagcgagguggccaaggacuucgagcccgagagagugguggccgccccccagagacccggcaccgagccccagcccgagaugcccgacaccgugcugcagagcgagacccugaaggacaccgcccccgugcuggagggccugaaggaggaggagaucaccaaggaggagaucgacauccugagcgacgccugcagcaagcugcaggagcagaagaagagccugaccaaggagaaggaggagcuggagcugcugaaggaggacgugcaggacuacagcgaggaccugcaggagaucaagaaggagcugagcaagaccggcgaggagaaguacguggaggagagcaaggccagcaagagacugaccaagagagugcagcagaugaucggccagaucgacggccugaucagccagcuggagauggaccagcaggccggcaagcuggcccccgccaacggcaugcccaccggcgagaacgugaucagcguggccgagcugaucaacgccaugaagcaggugaagcacauccccgagagcaagcugaccagccuggccgccgcccuggacgagaacaaggacggcaaggugaacaucgacgaccuggugaaggugaucgagcugguggacaaggaggacgugcacaucagcaccagccagguggccgagaucguggccacccuggagaaggaggagaagguggaggagaaggagaaggccaaggagaaggccgagaaggagguggccgaggugaagagcuaa

SEQ ID NO: 19216 - RNA, 1122 nt, Artificial Sequence
  LETMD1__Homo_sapiens__NP_001230618
auggcccugagcagagugugcugggccagaagcgccguguggggcagcgccgugacccccggccacuucgugaccagaagacugcagcugggcagaagcggccuggccuggggcgcccccagaagcagcaagcugcaccugagccccaaggccgacgugaagaaccugaugagcuacguggugaccaagaccaaggccaucaacggcaaguaccacagauuccugggcagacacuuccccagauucuacgugcuguacaccaucuucaugaagggccugcagaugcugugggccgacgccaagaaggccagaagaaucaagaccaacauguggaagcacaacaucaaguuccaccagcugcccuacagagagauggagcaccugagacaggugugggccagaggcagauaccccgaggugcacggcgaguucagacaggacgugaccaagugccuguuccugggcaucaucagcaucccccccuucgccaacuaccugguguuccugcugauguaccuguuccccagacagcugcugaucagacacuucuggacccccaagcagcagaccgacuuccuggacaucuaccacgccuucagaaagcagagccaccccgagaucaucagcuaccuggagaaggugaucccccugaucagcgacgccggccugagauggagacugaccgaccugugcaccaagauccagagaggcacccaccccgccauccacgacauccuggcccugagagagugcuucagcaaccacccccugggcaugaaccagcugcaggcccugcacgugaaggcccugagcagagccaugcugcugaccagcuaccugccccccccccugcugagacacagacugaagacccacaccaccgugauccaccagcuggacaaggcccuggccaagcugggcaucggccagcugaccgcccaggaggugaagagcgccugcuaccugagaggccugaacagcacccacaucggcgaggacagaugcagaaccuggcugggcgaguggcugcagaucagcugcagccugaaggaggccgagcugagccugcugcugcacaacguggugcugcugagcaccaacuaccugggcaccagaagauaa

SEQ ID NO: 19217 - RNA, 507 nt, Artificial Sequence
  LEUTX__Homo_sapiens__NP_001137304
augcaccccagccuggccaccaugggcaagcuggccagcaagcugcagcuggaccugagcguggugaagaucugguucaagaaccagagagccaaguggaagagacagcagagacagcagaugcagaccagacccagccugggccccgccaaccagaccaccagcgugaagaaggaggagacccccagcgccaucaccaccgccaacaucagacccgugagccccggcaucagcgacgccaacgaccacgaccugagagagcccagcggcaucaagaaccccggcggcgccagcgccagcgccagagugagcagcugggacagccagagcuacgacaucgagcagaucugccugggcgccagcaacccccccugggccagcacccuguucgagaucgacgaguucgugaagaucuacgaccugcccggcgaggacgacaccagcagccugaaccaguaccuguuccccgugugccuggaguacgaccagcugcagagcagcguguaa

SEQ ID NO: 19218 - RNA, 1140 nt, Artificial Sequence
  LFNG__Homo_sapiens__NP_001035257
augcugaagagaugcggcagaagacugcugcuggcccuggccggcgcccugcuggccugccugcuggugcugaccgccgacccccccccccccccccugcccgccgagagaggcagaagagcccugagaagccuggccggccccgccggcgccgcccccgcccccggccugggcgccgccgccgccgcccccggcgcccuggugagagacgugcacagccugagcgaguacuucagccugcugaccagagccagaagagacgccggccccccccccggcgccgcccccagacccgccgacggccaccccagaccccuggccgagccccuggcccccagagacguguucaucgccgugaagaccaccaagaaguuccacagagccagacuggaccugcugcuggagaccuggaucagcagacacaaggagaugaccuucaucuucaccgacggcgaggacgaggcccuggccagacacaccggcaacguggugaucaccaacugcagcgccgcccacagcagacaggcccugagcugcaagauggccguggaguacgacagauucaucgagagcggcagaaagugguucugccacguggacgacgacaacuacgugaaccugagagcccugcugagacugcuggccagcuacccccacaccagagacguguacgugggcaagcccagccuggacagacccauccaggccauggagagagugagcgagaacaaggugagacccgugcacuucugguucgccaccggcggcgccggcuucugcaucagcagaggccuggcccugaagaugagccccugggccagcggcggccacuucaugaacaccgccgagagaaucagacugcccgacgacugcaccaucggcuacaucguggaggcccugcugggcgugccccugaucagaagcggccuguuccacagccaccuggagaaccugcagcaggugcccaccagcgagcugcacgagcaggugacccugagcuacggcauguucgagaacaagagaaacgccgugcacgugaagggccccuucagcguggaggccgaccccagcagauucagaagcauccacugccaccuguaccccgacacccccuggugccccagaaccgccaucuucuaa

SEQ ID NO: 19219 - RNA, 1014 nt, Artificial Sequence
  LGALS12__Homo_sapiens__NP_001136007
augagccagcccagcggcggcagagcccccggcaccagaaucuacagcuggagcugccccaccgugaugagccccggcgagaagcuggaccccauccccgacagcuucauccugcagccccccguguuccaccccguggugcccuacgugaccaccaucuucggcggccugcacgccggcaagauggugaugcugcagggcguggugccccuggacgcccacagcagauuccagguggacuuccagugcggcugcagccugugccccagacccgacaucgccuuccacuucaaccccagauuccacaccaccaagccccacgugaucugcaacacccugcacggcggcagauggcagagagaggccagauggccccaccuggcccugagaagaggcagcagcuuccugauccuguuccuguucggcaacgaggaggugaaggugagcgugaacggccagcacuuccugcacuucagauacagacugccccugagccacguggacacccugggcaucuucggcgacauccugguggaggccgugggcuuccugaacaucaaccccuucguggagggcagcagagaguaccccgccggccaccccuuccugcugaugagccccagacuggaggugcccugcagccacgcccugccccagggccugagccccggccaggugaucaucgugagaggccuggugcugcaggagcccaagcacuucaccgugagccugagagaccaggccgcccacgcccccgugacccugagagccagcuucgccgacagaacccuggccuggaucagcagauggggccagaagaagcugaucagcgcccccuuccuguucuacccccagagauucuucgaggugcugcugcuguuccaggagggcggccugaagcuggcccugaacggccagggccugggcgccaccagcaugaaccagcaggcccuggagcagcugagagagcugagaaucagcggcagcgugcagcuguacugcgugcacagcuaa

SEQ ID NO: 19220 - RNA, 420 nt, Artificial Sequence
  LGALS13__Homo_sapiens__NP_037400
augagcagccugcccgugcccuacaagcugcccgugagccugagcgugggcagcugcgugaucaucaagggcacccccauccacagcuucaucaacgacccccagcugcagguggacuucuacaccgacauggacgaggacagcgacaucgccuucagauucagagugcacuucggcaaccacguggugaugaacagaagagaguucggcaucuggaugcuggaggagaccaccgacuacgugcccuucgaggacggcaagcaguucgagcugugcaucuacgugcacuacaacgaguacgagaucaaggugaacggcaucagaaucuacggcuucgugcacagaaucccccccagcuucgugaagauggugcaggugagcagagacaucagccugaccagcgugugcgugugcaacuaa

SEQ ID NO: 19221 - RNA, 420 nt, Artificial Sequence
  LGALS14__Homo_sapiens__NP_064514
augagcagccugcccgugcccuacacccugcccgugagccugcccgugggcagcugcgugaucaucaccggcacccccauccugaccuucgugaaggacccccagcuggaggugaacuucuacaccggcauggacgaggacagcgacaucgccuuccaguucagacugcacuucggccaccccgccaucaugaacagcugcguguucggcaucuggagauacgaggagaagugcuacuaccugcccuucgaggacggcaagcccuucgagcugugcaucuacgugagacacaaggaguacaaggugauggugaacggccagagaaucuacaacuucgcccacagauucccccccgccagcgugaagaugcugcagguguucagagacaucagccugaccagagugcugaucagcgacuaa

SEQ ID NO: 19222 - RNA, 429 nt, Artificial Sequence
  LGALS16__Homo_sapiens__NP_001177370
augagcuuccugaccgugcccuacaagcugcccgugagccugagcgugggcagcugcgugaucaucaagggcacccugaucgacagcagcaucaacgagccccagcugcagguggacuucuacaccgagaugaacgaggacagcgagaucgccuuccaccugagagugcaccugggcagaagaguggugaugaacagcagagaguucggcaucuggaugcuggaggagaaccugcacuacgugcccuucgaggacggcaagcccuucgaccugagaaucuacgugugccacaacgaguacgaggugaaggugaacggcgaguacaucuacgccuucgugcacagaaucccccccagcuacgugaagaugauccagguguggagagacgugagccuggacagcgugcuggugaacaacggcagaagauaa

SEQ ID NO: 19223 - RNA, 408 nt, Artificial Sequence
  LGALS1__Homo_sapiens__NP_002296
auggccugcggccugguggccagcaaccugaaccugaagcccggcgagugccugagagugagaggcgagguggcccccgacgccaagagcuucgugcugaaccugggcaaggacagcaacaaccugugccugcacuucaaccccagauucaacgcccacggcgacgccaacaccaucgugugcaacagcaaggacggcggcgccuggggcaccgagcagagagaggccguguuccccuuccagcccggcagcguggccgaggugugcaucaccuucgaccaggccaaccugaccgugaagcugcccgacggcuacgaguucaaguuccccaacagacugaaccuggaggccaucaacuacauggccgccgacggcgacuucaagaucaagugcguggccuucgacuaa

SEQ ID NO: 19224 - RNA, 399 nt, Artificial Sequence
  LGALS2__Homo_sapiens__NP_006489
augaccggcgagcuggaggugaagaacauggacaugaagcccggcagcacccugaagaucaccggcagcaucgccgacggcaccgacggcuucgugaucaaccugggccagggcaccgacaagcugaaccugcacuucaaccccagauucagcgagagcaccaucgugugcaacagccuggacggcagcaacuggggccaggagcagagagaggaccaccugugcuucagccccggcagcgaggugaaguucaccgugaccuucgagagcgacaaguucaaggugaagcugcccgacggccacgagcugaccuuccccaacagacugggccacagccaccugagcuaccugagcgugagaggcggcuucaacaugagcagcuucaagcugaaggaguaa

SEQ ID NO: 19225 - RNA, 1758 nt, Artificial Sequence
  LGALS3BP__Homo_sapiens__NP_005558
augaccccccccagacuguucuggguguggcugcugguggccggcacccagggcgugaacgacggcgacaugagacuggccgacggcggcgccaccaaccagggcagaguggagaucuucuacagaggccaguggggcaccgugugcgacaaccugugggaccugaccgacgccagcguggugugcagagcccugggcuucgagaacgccacccaggcccugggcagagccgccuucggccagggcagcggccccaucaugcuggacgaggugcagugcaccggcaccgaggccagccuggccgacugcaagagccugggcuggcugaagagcaacugcagacacgagagagacgccggcguggugugcaccaacgagaccagaagcacccacacccuggaccugagcagagagcugagcgaggcccugggccagaucuucgacagccagagaggcugcgaccugagcaucagcgugaacgugcagggcgaggacgcccugggcuucugcggccacaccgugauccugaccgccaaccuggaggcccaggcccuguggaaggagcccggcagcaacgugaccaugagcguggacgccgagugcgugcccauggugagagaccugcugagauacuucuacagcagaagaaucgacaucacccugagcagcgugaagugcuuccacaagcuggccagcgccuacggcgccagacagcugcagggcuacugcgccagccuguucgccauccugcugccccaggaccccagcuuccagaugccccuggaccuguacgccuacgccguggccaccggcgacgcccugcuggagaagcugugccugcaguuccuggccuggaacuucgaggcccugacccaggccgaggccuggcccagcgugcccaccgaccugcugcagcugcugcugcccagaagcgaccuggccgugcccagcgagcuggcccugcugaaggccguggacaccuggagcuggggcgagagagccagccacgaggagguggagggccugguggagaagaucagauuccccaugaugcugcccgaggagcuguucgagcugcaguucaaccugagccuguacuggagccacgaggcccuguuccagaagaagacccugcaggcccuggaguuccacaccgugcccuuccagcugcuggccagauacaagggccugaaccugaccgaggacaccuacaagcccagaaucuacaccagccccaccuggagcgccuucgugaccgacagcagcuggagcgccagaaagagccagcugguguaccagagcagaagaggcccccuggugaaguacagcagcgacuacuuccaggcccccagcgacuacagauacuaccccuaccagagcuuccagaccccccagcaccccagcuuccuguuccaggacaagagagugagcuggagccugguguaccugcccaccauccagagcugcuggaacuacggcuucagcugcagcagcgacgagcugcccgugcugggccugaccaagagcggcggcagcgacagaaccaucgccuacgagaacaaggcccugaugcugugcgagggccuguucguggccgacgugaccgacuucgagggcuggaaggccgccauccccagcgcccuggacaccaacagcagcaagagcaccagcagcuuccccugccccgccggccacuucaacggcuucagaaccgugaucagacccuucuaccugaccaacagcagcggcguggacuaa

SEQ ID NO: 19226 - RNA, 603 nt, Artificial Sequence
  LGALS3__Homo_sapiens__NP_001170859
auggccgacaacuucagccugcacgacgcccugagcggcagcggcaaccccaacccccagggcuggcccggcgccuggggcaaccagcccgccggcgccggcggcuaccccggcgccagcuaccccggcgccuaccccggccaggccccccccggcgccuaccccggccaggccccccccggcgccuaccccggcgcccccggcgccuaccccggcgcccccgcccccggcguguaccccggcccccccagcggccccggcgccuaccccagcagcggccagcccagcgccaccggcgccuaccccgccaccggccccuacggcgcccccgccggcccccugaucgugcccuacaaccugccccugcccggcggcguggugcccagaaugcugaucaccauccugggcaccgugaagcccaacgccaacagaaucgcccuggacuuccagagaggcaacgacguggccuuccacuucaaccccagauucaacgagaacaacagaagagugaucgugugcaccuacaugugcaagggcuucauguucaccgugagcgagaacuucuacauccaccaguaccccagcugcaagagcagcaccuaa

SEQ ID NO: 19227 - RNA, 972 nt, Artificial Sequence
  LGALS4__Homo_sapiens__NP_006140
auggccuacgugcccgcccccggcuaccagcccaccuacaaccccacccugcccuacuaccagcccauccccggcggccugaacgugggcaugagcguguacauccagggcguggccagcgagcacaugaagagauucuucgugaacuucguggugggccaggaccccggcagcgacguggccuuccacuucaaccccagauucgacggcugggacaaggugguguucaacacccugcagggcggcaaguggggcagcgaggagagaaagagaagcaugcccuucaagaagggcgccgccuucgagcugguguucaucgugcuggccgagcacuacaaggugguggugaacggcaaccccuucuacgaguacggccacagacugccccugcagauggugacccaccugcagguggacggcgaccugcagcugcagagcaucaacuucaucggcggccagccccugagaccccagggcccccccaugaugccccccuaccccggccccggccacugccaccagcagcugaacagccugcccaccauggagggcccccccaccuucaacccccccgugcccuacuucggcagacugcagggcggccugaccgccagaagaaccaucaucaucaagggcuacgugccccccaccggcaagagcuucgccaucaacuucaaggugggcagcagcggcgacaucgcccugcacaucaaccccagaaugggcaacggcaccguggugagaaacagccugcugaacggcagcuggggcagcgaggagaagaagaucacccacaaccccuucggccccggccaguucuucgaccugagcaucagaugcggccuggacagauucaagguguacgccaacggccagcaccuguucgacuucgcccacagacugagcgccuuccagagaguggacacccuggagauccagggcgacgugacccugagcuacgugcagaucuaa

SEQ ID NO: 19228 - RNA, 411 nt, Artificial Sequence
  LGALS7B__Homo_sapiens__NP_001035972
augagcaacgugccccacaagagcagccugcccgagggcaucagacccggcaccgugcugagaaucagaggccuggugccccccaacgccagcagauuccacgugaaccugcugugcggcgaggagcagggcagcgacgccgcccugcacuucaaccccagacuggacaccagcgaggugguguucaacagcaaggagcagggcagcuggggcagagaggagagaggccccggcgugcccuuccagagaggccagcccuucgaggugcugaucaucgccagcgacgacggcuucaaggccguggugggcgacgcccaguaccaccacuucagacacagacugccccuggccagagugagacugguggaggugggcggcgacgugcagcuggacagcgugagaaucuucuaa

SEQ ID NO: 19229 - RNA, 1080 nt, Artificial Sequence
  LGALS8__Homo_sapiens__NP_006490
augaugcugagccugaacaaccugcagaacaucaucuacaaccccgugauccccuucgugggcaccauccccgaccagcuggaccccggcacccugaucgugaucagaggccacgugcccagcgacgccgacagauuccagguggaccugcagaacggcagcagcaugaagcccagagccgacguggccuuccacuucaaccccagauucaagagagccggcugcaucgugugcaacacccugaucaacgagaaguggggcagagaggagaucaccuacgacacccccuucaagagagagaagagcuucgagaucgugaucauggugcugaaggacaaguuccagguggccgugaacggcaagcacacccugcuguacggccacagaaucggccccgagaagaucgacacccugggcaucuacggcaaggugaacauccacagcaucggcuucagcuucagcagcgaccugcagagcacccaggccagcagccuggagcugaccgagaucagcagagagaacgugcccaagagcggcaccccccagcugcccagcaacagaggcggcgacaucagcaagaucgcccccagaaccguguacaccaagagcaaggacagcaccgugaaccacacccugaccugcaccaagaucccccccaugaacuacgugagcaagagacugcccuucgccgccagacugaacacccccaugggccccggcagaaccgugguggugaagggcgaggugaacgccaacgccaagagcuucaacguggaccugcuggccggcaagagcaaggacaucgcccugcaccugaaccccagacugaacaucaaggccuucgugagaaacagcuuccugcaggagagcuggggcgaggaggagagaaacaucaccagcuuccccuucagccccggcauguacuucgagaugaucaucuacugcgacgugagagaguucaagguggccgugaacggcgugcacagccuggaguacaagcacagauucaaggagcugagcagcaucgacacccuggagaucaacggcgacauccaccugcuggaggugagaagcugguaa

SEQ ID NO: 19230 - RNA, 972 nt, Artificial Sequence
  LGALS9__Homo_sapiens__NP_002299
auggccuucagcggcagccaggcccccuaccugagccccgccgugcccuucagcggcaccauccagggcggccugcaggacggccugcagaucaccgugaacggcaccgugcugagcagcagcggcaccagauucgccgugaacuuccagaccggcuucagcggcaacgacaucgccuuccacuucaaccccagauucgaggacggcggcuacguggugugcaacaccagacagaacggcagcuggggccccgaggagagaaagacccacaugcccuuccagaagggcaugcccuucgaccugugcuuccuggugcagagcagcgacuucaaggugauggugaacggcauccuguucgugcaguacuuccacagagugcccuuccacagaguggacaccaucagcgugaacggcagcgugcagcugagcuacaucagcuuccagccccccggcguguggcccgccaaccccgcccccaucacccagaccgugauccacaccgugcagagcgcccccggccagauguucagcacccccgccaucccccccaugauguacccccaccccgccuaccccaugcccuucaucaccaccauccugggcggccuguaccccagcaagagcauccugcugagcggcaccgugcugcccagcgcccagagauuccacaucaaccugugcagcggcaaccacaucgccuuccaccugaaccccagauucgacgagaacgccguggugagaaacacccagaucgacaacagcuggggcagcgaggagagaagccugcccagaaagaugcccuucgugagaggccagagcuucagcguguggauccugugcgaggcccacugccugaagguggccguggacggccagcaccuguucgaguacuaccacagacugagaaaccugcccaccaucaacagacuggaggugggcggcgacauccagcugacccacgugcagaccuaa

SEQ ID NO: 19231 - RNA, 519 nt, Artificial Sequence
  LGALSL__Homo_sapiens__NP_054900
auggccggcagcguggccgacagcgacgccguggugaagcuggacgacggccaccugaacaacagccugagcagccccgugcaggccgacguguacuuccccagacugaucgugcccuucugcggccacaucaagggcggcaugagacccggcaagaaggugcuggugaugggcaucguggaccugaaccccgagagcuucgccaucagccugaccugcggcgacagcgaggacccccccgccgacguggccaucgagcugaaggccguguucaccgacagacagcugcugagaaacagcugcaucagcggcgagagaggcgaggagcagagcgccauccccuacuuccccuucauccccgaccagcccuucagaguggagauccugugcgagcaccccagauucagaguguucguggacggccaccagcuguucgacuucuaccacagaauccagacccugagcgccaucgacaccaucaagaucaacggcgaccugcagaucaccaagcugggcuaa

SEQ ID NO: 19232 - RNA, 1674 nt, Artificial Sequence
  LGI1__Homo_sapiens__NP_005088
auggagagcgagagaagcaagagaaugggcaacgccugcaucccccugaagagaaucgccuacuuccugugccugcugagcgcccugcugcugaccgagggcaagaagcccgccaagcccaagugccccgccgugugcaccugcaccaaggacaacgcccugugcgagaacgccagaagcauccccagaaccgugccccccgacgugaucagccugagcuucgugagaagcggcuucaccgagaucagcgagggcagcuuccuguucacccccagccugcagcugcugcuguucaccagcaacagcuucgacgugaucagcgacgacgccuucaucggccugccccaccuggaguaccuguucaucgagaacaacaacaucaagagcaucagcagacacaccuucagaggccugaagagccugauccaccugagccuggccaacaacaaccugcagacccugcccaaggacaucuucaagggccuggacagccugaccaacguggaccugagaggcaacagcuucaacugcgacugcaagcugaaguggcugguggaguggcugggccacaccaacgccaccguggaggacaucuacugcgagggcccccccgaguacaagaagagaaagaucaacagccugagcagcaaggacuucgacugcaucaucaccgaguucgccaagagccaggaccugcccuaccagagccugagcaucgacaccuucagcuaccugaacgacgaguacguggugaucgcccagcccuucaccggcaagugcaucuuccuggagugggaccacguggagaagaccuucagaaacuacgacaacaucaccggcaccagcaccguggugugcaagcccaucgugaucgagacccagcuguacgugaucguggcccagcuguucggcggcagccacaucuacaagagagacagcuucgccaacaaguucaucaagauccaggacaucgagauccugaagaucagaaagcccaacgacaucgagaccuucaagaucgagaacaacugguacuucgugguggccgacagcagcaaggccggcuucaccaccaucuacaaguggaacggcaacggcuucuacagccaccagagccugcacgccugguacagagacaccgacguggaguaccuggagaucgugagaaccccccagacccugagaaccccccaccugauccugagcagcagcagccagagacccgugaucuaccaguggaacaaggccacccagcuguucaccaaccagaccgacauccccaacauggaggacguguacgccgugaagcacuucagcgugaagggcgacguguacaucugccugaccagauucaucggcgacagcaaggugaugaaguggggcggcagcagcuuccaggacauccagagaaugcccagcagaggcagcaugguguuccagccccugcagaucaacaacuaccaguacgccauccugggcagcgacuacagcuucacccagguguacaacugggacgccgagaaggccaaguucgugaaguuccaggagcugaacgugcaggcccccagaagcuucacccacgugagcaucaacaagagaaacuuccuguucgccagcagcuucaagggcaacacccagaucuacaagcacgugaucguggaccugagcgccuaa

SEQ ID NO: 19233 - RNA, 1638 nt, Artificial Sequence
  LGI2__Homo_sapiens__NP_060646
auggcccugagaagaggcggcugcggcgcccugggccugcugcugcugcugcugggcgccgccugccugauccccagaagcgcccaggugagaagacuggccagaugccccgccaccugcagcugcaccaaggagagcaucaucugcgugggcagcagcugggugcccagaaucgugcccggcgacaucagcagccugagccuggugaacggcaccuucagcgagaucaaggacagaauguucagccaccugcccagccugcagcugcugcugcugaacagcaacagcuucaccaucaucagagacgacgccuucgccggccuguuccaccuggaguaccuguucaucgagggcaacaagaucgagaccaucagcagaaacgccuucagaggccugagagaccugacccaccugagccuggccaacaaccacaucaaggcccugcccagagacguguucagcgaccuggacagccugaucgagcuggaccugagaggcaacaaguucgagugcgacugcaaggccaaguggcuguaccuguggcugaagaugaccaacagcaccgugagcgacgugcugugcaucggcccccccgaguaccaggagaagaagcugaacgacgugaccagcuucgacuacgagugcaccaccaccgacuucguggugcaccagacccugcccuaccagagcgugagcguggacaccuucaacagcaagaacgacguguacguggccaucgcccagcccagcauggagaacugcauggugcuggagugggaccacaucgagaugaacuucagaagcuacgacaacaucaccggccagagcaucgugggcugcaaggccauccugaucgacgaccagguguucguggugguggcccagcuguucggcggcagccacaucuacaaguacgacgagagcuggaccaaguucgugaaguuccaggacaucgaggugagcagaaucagcaagcccaacgacaucgagcuguuccagaucgacgacgagaccuucuucgugaucgccgacagcagcaaggccggccugagcaccguguacaaguggaacagcaagggcuucuacagcuaccagagccugcacgagugguucagagacaccgacgccgaguucguggacaucgacggcaagagccaccugauccugagcagcagaagccaggugcccaucauccugcaguggaacaagagcagcaagaaguucgugccccacggcgacauccccaacauggaggacgugcuggccgugaagagcuucagaaugcagaacacccuguaccugagccugaccagauucaucggcgacagcagagugaugagauggaacagcaagcaguucguggagauccaggcccugcccagcagaggcgccaugacccugcagcccuucagcuucaaggacaaccacuaccuggcccugggcagcgacuacaccuucagccagaucuaccagugggacaaggagaagcagcuguucaagaaguucaaggagaucuacgugcaggcccccagaagcuucaccgccgugagcaccgacagaagagacuucuucuucgccagcagcuucaagggcaagaccaagaucuucgagcacaucaucguggaccugagccuguaa

SEQ ID NO: 19234 - RNA, 1614 nt, Artificial Sequence
  LGI4__Homo_sapiens__NP_644813
augggcggcgccggcauccugcugcugcugcuggccggcgccggcguggugguggccuggagaccccccaagggcaagugcccccugagaugcagcugcagcaaggacagcgcccugugcgagggcagccccgaccugcccgugagcuucagccccacccugcugagccugagccuggugagaaccggcgugacccagcugaaggccggcagcuuccugagaauccccagccugcaccugcugcuguucaccagcaacagcuucagcgugaucgaggacgacgccuucgccggccugagccaccugcaguaccuguucaucgaggacaacgagaucggcagcaucagcaagaacgcccugagaggccugagaagccugacccaccugagccuggccaacaaccaccuggagacccugcccagauuccuguucagaggccuggacacccugacccacguggaccugagaggcaaccccuuccagugcgacugcagagugcuguggcugcugcaguggaugcccaccgugaacgccagcgugggcaccggcgccugcgccggccccgccagccugagccacaugcagcugcaccaccuggaccccaagaccuucaagugcagagccaucgagcugagcugguuccagaccgugggcgagagcgcccugagcguggagcccuucagcuaccagggcgagccccacaucgugcuggcccagcccuucgccggcagaugccugauccugagcugggacuacagccugcagagauucagacccgaggaggagcugcccgccgccagcguggugagcugcaagccccuggugcugggccccagccuguucgugcuggccgccagacuguggggcggcagccagcugugggccagacccagccccggccugagacuggcccccacccagacccuggcccccagaagacugcugagacccaacgacgccgagcugcuguggcuggagggccagcccugcuucgugguggccgacgccagcaaggccggcagcaccacccugcugugcagagacggccccggcuucuacccccaccagagccugcacgccuggcacagagacaccgacgccgaggcccuggagcuggacggcagaccccaccugcugcuggccagcgccagccagagacccgugcuguuccacuggaccggcggcagauucgagagaagaaccgacauccccgaggccgaggacguguacgccaccagacacuuccaggccggcggcgacguguuccugugccugaccagauacaucggcgacagcauggugaugagaugggacggcagcauguucagacugcugcagcagcugcccagcagaggcgcccacguguuccagccccugcugaucgccagagaccagcuggccauccugggcagcgacuucgccuucagccaggugcugagacuggagcccgacaagggccugcuggagccccugcaggagcugggcccccccgcccugguggcccccagagccuucgcccacaucaccauggccggcagaagauuccuguucgccgccugcuucaagggccccacccagaucuaccagcaccacgagaucgaccugagcgccuaa

SEQ ID NO: 19235 - RNA, 1302 nt, Artificial Sequence
  LGMN__Homo_sapiens__NP_005597
augguguggaagguggccguguuccugagcguggcccugggcaucggcgccgugcccaucgacgaccccgaggacggcggcaagcacuggguggugaucguggccggcagcaacggcugguacaacuacagacaccaggccgacgccugccacgccuaccagaucauccacagaaacggcauccccgacgagcagaucguggugaugauguacgacgacaucgccuacagcgaggacaaccccacccccggcaucgugaucaacagacccaacggcaccgacguguaccagggcgugcccaaggacuacaccggcgaggacgugaccccccagaacuuccuggccgugcugagaggcgacgccgaggccgugaagggcaucggcagcggcaaggugcugaagagcggcccccaggaccacguguucaucuacuucaccgaccacggcagcaccggcauccugguguuccccaacgaggaccugcacgugaaggaccugaacgagaccauccacuacauguacaagcacaagauguacagaaagaugguguucuacaucgaggccugcgagagcggcagcaugaugaaccaccugcccgacaacaucaacguguacgccaccaccgccgccaaccccagagagagcagcuacgccugcuacuacgacgagaagagaagcaccuaccugggcgacugguacagcgugaacuggauggaggacagcgacguggaggaccugaccaaggagacccugcacaagcaguaccaccuggugaagagccacaccaacaccagccacgugaugcaguacggcaacaagaccaucagcaccaugaaggugaugcaguuccagggcaugaagagaaaggccagcagccccgugccccugccccccgugacccaccuggaccugacccccagccccgacgugccccugaccaucaugaagagaaagcugaugaacaccaacgaccuggaggagagcagacagcugaccgaggagauccagagacaccuggacgccagacaccugaucgagaagagcgugagaaagaucgugagccugcuggccgccagcgaggccgagguggagcagcugcugagcgagagagccccccugaccggccacagcugcuaccccgaggcccugcugcacuucagaacccacugcuucaacuggcacagccccaccuacgaguacgcccugagacaccuguacgugcuggugaaccugugcgagaagcccuacccccugcacagaaucaagcugagcauggaccacgugugccugggccacuacuaa

SEQ ID NO: 19236 - RNA, 2856 nt, Artificial Sequence
  LGR4__Homo_sapiens__NP_060960
augcccggcccccugggccugcugugcuuccuggcccugggccugcugggcagcgccggccccagcggcgccgcccccccccugugcgccgcccccugcagcugcgacggcgacagaagaguggacugcagcggcaagggccugaccgccgugcccgagggccugagcgccuucacccaggcccuggacaucagcaugaacaacaucacccagcugcccgaggacgccuucaagaacuuccccuuccuggaggagcugcagcuggccggcaacgaccugagcuucauccaccccaaggcccugagcggccugaaggagcugaaggugcugacccugcagaacaaccagcugaagaccgugcccagcgaggccaucagaggccugagcgcccugcagagccugagacuggacgccaaccacaucaccagcgugcccgaggacagcuucgagggccuggugcagcugagacaccuguggcuggacgacaacagccugaccgaggugcccgugcacccccugagcaaccugcccacccugcaggcccugacccuggcccugaacaagaucagcagcauccccgacuucgccuucaccaaccugagcagccugguggugcugcaccugcacaacaacaagaucagaagccugagccagcacugcuucgacggccuggacaaccuggagacccuggaccugaacuacaacaaccugggcgaguucccccaggccaucaaggcccugcccagccugaaggagcugggcuuccacagcaacagcaucagcgugauccccgacggcgccuucgacggcaacccccugcugagaaccauccaccuguacgacaacccccugagcuucgugggcaacagcgccuuccacaaccugagcgaccugcacagccuggugaucagaggcgccagcauggugcagcaguuccccaaccugaccggcaccgugcaccuggagagccugacccugaccggcaccaagaucagcagcauccccaacaaccugugccaggagcagaagaugcugagaacccuggaccugagcuacaacaacaucagagaccugcccagcuucaacggcugccacgcccuggaggagaucagccugcagagaaaccagaucuaccagaucaaggagggcaccuuccagggccugaucagccugagaauccuggaccugagcagaaaccugauccacgagauccacagcagagccuucgccacccugggccccaucaccaaccuggacgugagcuucaacgagcugaccagcuuccccaccgagggccugaacggccugaaccagcugaagcuggugggcaacuucaagcugaaggaggcccuggccgccaaggacuucgugaaccugagaagccugagcgugcccuacgccuaccagugcugcgccuucuggggcugcgacagcuacgccaaccugaacaccgaggacaacagccugcaggaccacagcguggcccaggagaagggcaccgccgacgccgccaacgugaccagcacccuggagaacgaggagcacagccagaucaucauccacugcacccccagcaccggcgccuucaagcccugcgaguaccugcugggcagcuggaugaucagacugaccgugugguucaucuuccugguggcccuguucuucaaccugcuggugauccugaccaccuucgccagcugcaccagccugcccagcagcaagcuguucaucggccugaucagcgugagcaaccuguucaugggcaucuacaccggcauccugaccuuccuggacgccgugagcuggggcagauucgccgaguucggcaucuggugggagaccggcagcggcugcaagguggccggcuuccuggccguguucagcagcgagagcgccaucuuccugcugaugcuggccaccguggagagaagccugagcgccaaggacaucaugaagaacggcaagagcaaccaccugaagcaguucagaguggccgcccugcuggccuuccugggcgccaccguggccggcugcuucccccuguuccacagaggcgaguacagcgccagcccccugugccugcccuuccccaccggcgagacccccagccugggcuucaccgugacccuggugcugcugaacagccuggccuuccugcugauggccgugaucuacaccaagcuguacugcaaccuggagaaggaggaccugagcgagaacagccagagcagcaugaucaagcacguggccuggcugaucuucaccaacugcaucuucuucugccccguggccuucuucagcuucgccccccugaucaccgccaucagcaucagccccgagaucaugaagagcgugacccugaucuucuucccccugcccgccugccugaaccccgugcuguacguguucuucaaccccaaguucaaggaggacuggaagcugcugaagagaagagugaccaagaagagcggcagcgugagcgugagcaucagcagccagggcggcugccuggagcaggacuucuacuacgacugcggcauguacagccaccugcagggcaaccugaccgugugcgacugcugcgagagcuuccugcugaccaagcccgugagcugcaagcaccugaucaagagccacagcugccccgcccuggccguggccagcugccagagacccgagggcuacuggagcgacugcggcacccagagcgcccacagcgacuacgccgacgaggaggacagcuucgugagcgacagcagcgaccaggugcaggccugcggcagagccugcuucuaccagagcagaggcuucccccuggugagauacgccuacaaccugcccagagugaaggacuaa

SEQ ID NO: 19237 - RNA, 2652 nt, Artificial Sequence
  LGR5__Homo_sapiens__NP_001264155
auggacaccagcagacugggcgugcugcugagccugcccgugcugcugcagcuggccaccggcggcagcagccccagaagcggcgugcugcugagaggcugccccacccacugccacugcgagcccgacggcagaaugcugcugagaguggacugcagcgaccugggccugagcgagcugcccagcaaccugagcguguucaccagcuaccuggaccugagcaugaacaacaucagccagcugcugcccaacccccugcccagccugagauuccuggaggagcugagacuggccggcaacgcccugaccuacauccccaagggcgccuucaccggccuguacagccugaaggugcugaugcugcagaacaaccagcugagacacgugcccaccgaggcccugcagaaccugagaagccugcagagccugagacuggacgccaaccacaucagcuacgugccccccagcugcuucagcggccugcacagccugagacaccuguggcuggacgacaacgcccugaccgagauccccgugcaggccuucagaagccugagcgcccugcaggccaugacccuggcccugaacaagauccaccacauccccgacuacgccuucggcaaccugagcagccugguggugcugcaccugcacaacaacagaauccacagccugggcaagaagugcuucgacggccugcacagccuggagacccuggaccugaacuacaacaaccuggacgaguuccccaccgccaucagaacccugagcaaccugaaggagcugcacuucuacgacaaccccauccaguucgugggcagaagcgccuuccagcaccugcccgagcugagaacccugacccugaacggcgccagccagaucaccgaguuccccgaccugaccggcaccgccaaccuggagagccugacccugaccggcgcccagaucagcagccugccccagaccgugugcaaccagcugcccaaccugcaggugcuggaccugagcuacaaccugcuggaggaccugcccagcuucagcgugugccagaagcugcagaagaucgaccugagacacaacgagaucuacgagaucaagguggacaccuuccagcagcugcugagccugagaagccugaaccuggccuggaacaagaucgccaucauccaccccaacgccuucagcacccugcccagccugaucaagcuggaccugagcagcaaccugcugagcagcuuccccaucaccggccugcacggccugacccaccugaagcugaccggcaaccacgcccugcagagccugaucagcagcgagaacuuccccgagcugaaggugaucgagaugcccuacgccuaccagugcugcgccuucggcgugugcgagaacgccuacaagaucagcaaccaguggaacaagggcgacaacagcagcauggacgaccugcacaagaaggacgccggcauguuccaggcccaggacgagagagaccuggaggacuuccugcuggacuucgaggaggaccugaaggcccugcacagcgugcagugcagccccagccccggccccuucaagcccugcgagcaccugcuggacggcuggcugaucagaaucggcguguggaccaucgccgugcuggcccugaccugcaacgcccuggugaccagcaccguguucagaagcccccuguacaucagccccaucaagcugcugaucggcgugaucgccgccgugaacaugcugaccggcgugagcagcgccgugcuggccggcguggacgccuucaccuucggcagcuucgccagacacggcgccuggugggagaacggcgugggcugccacgugaucggcuuccugagcaucuucgccagcgagagcagcguguuccugcugacccuggccgcccuggagagaggcuucagcgugaaguacagcgccaaguucgagaccaaggcccccuucagcagccugaaggugaucauccugcugugcgcccugcuggcccugaccauggccgccgugccccugcugggcggcagcaaguacggcgccagcccccugugccugccccugcccuucggcgagcccagcaccaugggcuacaugguggcccugauccugcugaacagccugugcuuccugaugaugaccaucgccuacaccaagcuguacugcaaccuggacaagggcgaccuggagaacaucugggacugcagcauggugaagcacaucgcccugcugcuguucaccaacugcauccugaacugccccguggccuuccugagcuucagcagccugaucaaccugaccuucaucagccccgaggugaucaaguucauccugcuggugguggugccccugcccgccugccugaacccccugcuguacauccuguucaacccccacuucaaggaggaccuggugagccugagaaagcagaccuacguguggaccagaagcaagcaccccagccugaugagcaucaacagcgacgacguggagaagcagagcugcgacagcacccaggcccuggugaccuucaccagcagcagcaucaccuacgaccugccccccagcagcgugcccagccccgccuaccccgugaccgagagcugccaccugagcagcguggccuucgugcccugccuguaa

SEQ ID NO: 19238 - RNA, 2904 nt, Artificial Sequence
  LGR6__Homo_sapiens__NP_001017403
augcccagcccccccggccugagagcccuguggcugugcgccgcccugugcgccagcagaagagccggcggcgccccccagcccggccccggccccaccgccugccccgcccccugccacugccaggaggacggcaucaugcugagcgccgacugcagcgagcugggccugagcgccgugcccggcgaccuggacccccugaccgccuaccuggaccugagcaugaacaaccugaccgagcugcagcccggccuguuccaccaccugagauuccuggaggagcugagacugagcggcaaccaccugagccacauccccggccaggccuucagcggccuguacagccugaagauccugaugcugcagaacaaccagcugggcggcauccccgccgaggcccugugggagcugcccagccugcagagccugagacuggacgccaaccugaucagccuggugcccgagagaagcuucgagggccugagcagccugagacaccuguggcuggacgacaacgcccugaccgagauccccgugagagcccugaacaaccugcccgcccugcaggccaugacccuggcccugaacagaaucagccacauccccgacuacgccuuccagaaccugaccagccugguggugcugcaccugcacaacaacagaauccagcaccugggcacccacagcuucgagggccugcacaaccuggagacccuggaccugaacuacaacaagcugcaggaguuccccguggccaucagaacccugggcagacugcaggagcugggcuuccacaacaacaacaucaaggccauccccgagaaggccuucaugggcaacccccugcugcagaccauccacuucuacgacaaccccauccaguucgugggcagaagcgccuuccaguaccugcccaagcugcacacccugagccugaacggcgccauggacauccaggaguuccccgaccugaagggcaccaccagccuggagauccugacccugaccagagccggcaucagacugcugcccagcggcaugugccagcagcugcccagacugagagugcuggagcugagccacaaccagaucgaggagcugcccagccugcacagaugccagaagcuggaggagaucggccugcagcacaacagaaucugggagaucggcgccgacaccuucagccagcugagcagccugcaggcccuggaccugagcuggaacgccaucagaagcauccaccccgaggccuucagcacccugcacagccuggugaagcuggaccugaccgacaaccagcugaccacccugccccuggccggccugggcggccugaugcaccugaagcugaagggcaaccuggcccugagccaggccuucagcaaggacagcuuccccaagcugagaauccuggaggugcccuacgccuaccagugcugccccuacggcaugugcgccagcuucuucaaggccagcggccagugggaggccgaggaccugcaccuggacgacgaggagagcagcaagagaccccugggccugcuggccagacaggccgagaaccacuacgaccaggaccuggacgagcugcagcuggagauggaggacagcaagccccaccccagcgugcagugcagccccacccccggccccuucaagcccugcgaguaccuguucgagagcuggggcaucagacuggccgugugggccaucgugcugcugagcgugcugugcaacggccuggugcugcugaccguguucgccggcggccccgugccccugccccccgugaaguucguggugggcgccaucgccggcgccaacacccugaccggcaucagcugcggccugcuggccagcguggacgcccugaccuucggccaguucagcgaguacggcgccagaugggagaccggccugggcugcagagccaccggcuuccuggccgugcugggcagcgaggccagcgugcugcugcugacccuggccgccgugcagugcagcgugagcgugagcugcgugagagccuacggcaagagccccagccugggcagcgugagagccggcgugcugggcugccuggcccuggccggccuggccgccgcccugccccuggccagcgugggcgaguacggcgccagcccccugugccugcccuacgccccccccgagggccagcccgccgcccugggcuucaccguggcccuggugaugaugaacagcuucugcuuccuggugguggccggcgccuacaucaagcuguacugcgaccugcccagaggcgacuucgaggccgugugggacugcgccauggugagacacguggccuggcugaucuucgccgacggccugcuguacugccccguggccuuccugagcuucgccagcaugcugggccuguuccccgugacccccgaggccgugaagagcgugcugcugguggugcugccccugcccgccugccugaacccccugcuguaccugcuguucaacccccacuucagagacgaccugagaagacugagacccagagccggcgacagcggcccccuggccuacgccgccgccggcgagcuggagaagagcagcugcgacagcacccaggcccugguggccuucagcgacguggaccugauccuggaggccagcgaggccggcagaccccccggccuggagaccuacggcuuccccagcgugacccugaucagcugccagcagcccggcgcccccagacuggagggcagccacugcguggagcccgagggcaaccacuucggcaacccccagcccagcauggacggcgagcugcugcugagagccgagggcagcacccccgccggcggcggccugagcggcggcggcggcuuccagcccagcggccuggccuucgccagccacguguaa

SEQ ID NO: 19239 - RNA, 627 nt, Artificial Sequence
  LGSN__Homo_sapiens__NP_001137412
augaacaacgaggaggaccugcugcaggaggacagcaccagagacgagggcaacgagaccgaggccaacagcaugaacacccugagaagaaccagaaagaaggugaccaagcccuacgugugcagcaccgaggugggcgagaccgacaugagcaacagcaacgacugcaugagagacagcagccagauccugacccccccccagcugagcagcagaaugaagcacaucagacaggccauggccaagaacagacugcaguucgugagauucgaggccaccgaccugcacggcgugagcagaagcaagaccauccccgcccacuucuuccaggagaaggugagccacggcgugugcaugcccagaggcuaccuggaggugauccccaaccccaaggacaacgagaugaacaacaucagagccaccugcuucaacagcgacaucgugcugaugcccgagcugagcaccuucagagugcugcccugggccgacagaaccgccagagugaucugcgacaccuucaccgugaccgugagcggcaugagcaucggcagaaagaccugcagcgccgcccugcuggagcugagcagcagcagaagccugggcaagaacggcuggcaggacagcuaa

SEQ ID NO: 19240 - RNA, 426 nt, Artificial Sequence
  LHB__Homo_sapiens__NP_000885
auggagaugcugcagggccugcugcugcugcugcugcugagcaugggcggcgccugggccagcagagagccccugagacccuggugccaccccaucaacgccauccuggccguggagaaggagggcugccccgugugcaucaccgugaacaccaccaucugcgccggcuacugccccaccaugaugagagugcugcaggccgugcugcccccccugccccagguggugugcaccuacagagacgugagauucgagagcaucagacugcccggcugccccagaggcguggaccccguggugagcuuccccguggcccugagcugcagaugcggccccugcagaagaagcaccagcgacugcggcggccccaaggaccacccccugaccugcgaccacccccagcugagcggccugcuguuccuguaa

SEQ ID NO: 19241 - RNA, 2100 nt, Artificial Sequence
  LHCGR__Homo_sapiens__NP_000224
augaagcagagauucagcgcccugcagcugcugaagcugcugcugcugcugcagcccccccugcccagagcccugagagaggcccugugccccgagcccugcaacugcgugcccgacggcgcccugagaugccccggccccaccgccggccugaccagacugagccuggccuaccugcccgugaaggugauccccagccaggccuucagaggccugaacgaggugaucaagaucgagaucagccagaucgacagccuggagagaaucgaggccaacgccuucgacaaccugcugaaccugagcgagauccugauccagaacaccaagaaccugagauacaucgagcccggcgccuucaucaaccugcccagacugaaguaccugagcaucugcaacaccggcaucagaaaguuccccgacgugaccaagguguucagcagcgagagcaacuucauccuggagaucugcgacaaccugcacaucaccaccauccccggcaacgccuuccagggcaugaacaacgagagcgugacccugaagcuguacggcaacggcuucgaggaggugcagagccacgccuucaacggcaccacccugaccagccuggagcugaaggagaacgugcaccuggagaagaugcacaacggcgccuucagaggcgccaccggccccaagacccuggacaucagcagcaccaagcugcaggcccugcccagcuacggccuggagagcauccagagacugaucgccaccagcagcuacagccugaagaagcugcccagcagagagaccuucgugaaccugcuggaggccacccugaccuaccccagccacugcugcgccuucagaaaccugcccaccaaggagcagaacuucagccacagcaucagcgagaacuucagcaagcagugcgagagcaccgugagaaaggugaacaacaagacccuguacagcagcaugcuggccgagagcgagcugagcggcugggacuacgaguacggcuucugccugcccaagacccccagaugcgcccccgagcccgacgccuucaaccccugcgaggacaucaugggcuacgacuuccugagagugcugaucuggcugaucaacauccuggccaucaugggcaacaugaccgugcuguucgugcugcugaccagcagauacaagcugaccgugcccagauuccugaugugcaaccugagcuucgccgacuucugcaugggccuguaccugcugcugaucgccagcguggacagccagaccaagggccaguacuacaaccacgccaucgacuggcagaccggcagcggcugcagcaccgccggcuucuucaccguguucgccagcgagcugagcguguacacccugaccgugaucacccuggagagauggcacaccaucaccuacgccauccaccuggaccagaagcugagacugagacacgccauccugaucaugcugggcggcuggcuguucagcagccugaucgccaugcugccccuggugggcgugagcaacuacaugaaggugagcaucugcuuccccauggacguggagaccacccugagccagguguacauccugaccauccugauccugaacgugguggccuucuucaucaucugcgccugcuacaucaagaucuacuucgccgugagaaaccccgagcugauggccaccaacaaggacaccaagaucgccaagaagauggccauccugaucuucaccgacuucaccugcauggcccccaucagcuucuucgccaucagcgccgccuucaaggugccccugaucaccgugaccaacagcaaggugcugcuggugcuguucuaccccaucaacagcugcgccaaccccuuccuguacgccaucuucaccaagaccuuccagagagacuucuuccugcugcugagcaaguucggcugcugcaagagaagagccgagcuguacagaagaaaggacuucagcgccuacaccagcaacugcaagaacggcuucaccggcagcaacaagcccagccagagcacccugaagcugagcacccugcacugccagggcaccgcccugcuggacaagaccagauacaccgagugcuaa

SEQ ID NO: 19242 - RNA, 603 nt, Artificial Sequence
  LHFP__Homo_sapiens__XP_011533163
auggccagcagccugaccugcaccggcgugaucugggcccugcugagcuuccugugcgccgccaccagcugcgugggcuucuucaugcccuacuggcuguggggcagccagcugggcaagcccgugagcuucggcaccuucagaagaugcagcuaccccgugcacgacgagagcagacagaugauggugaugguggaggagugcggcagauacgccagcuuccagggcauccccagcgccgaguggagaaucugcaccaucgugaccggccugggcugcggccugcugcugcugguggcccugaccgcccugaugggcugcugcgugagcgaccugaucagcagaaccgugggcagaguggccggcggcauccaguuccugggcggccugcugaucggcgccggcugcgcccuguacccccugggcugggacagcgaggaggugagacagaccugcggcuacaccagcggccaguucgaccugggcaagugcgagaucggcugggccuacuacugcaccggcgccggcgccaccgccgccaugcugcugugcaccuggcuggccugcuucagcggcaagaagcagaagcacuaccccuacuaa

SEQ ID NO: 19243 - RNA, 732 nt, Artificial Sequence
  LHFPL1__Homo_sapiens__XP_011529245
auggugaccuacugcaucuggugcugcgaccccacccaccugcccauccccgccgagaagcccgugaccaugagaagcagccugaccauggugggcacccugugggccuuccugagccuggugaccgccgugaccagcagcaccagcuacuuccugcccuacuggcuguucggcagccagaugggcaagcccgugagcuucagcaccuucagaagaugcaacuaccccgugagaggcgagggccacagccugaucaugguggaggagugcggcagauacgccagcuucaacgccauccccagccuggccuggcagaugugcaccguggugaccggcgccggcugcgcccugcugcugcugguggcccuggccgccgugcugggcugcugcauggaggagcugaucagcagaaugaugggcagaugcaugggcgccgcccaguucgugggcggccugcugaucagcagcggcugcgcccuguacccccugggcuggaacagccccgagaucaugcagaccugcggcaacgugagcaaccaguuccagcugggcaccugcagacugggcugggccuacuacugcgccggcggcggcgccgccgccgccaugcugaucugcaccuggcugagcugcuucgccggcagaaaccccaagcccgugauccugguggagagcaucaugagaaacaccaacagcuacgccauggagcuggaccacugccugaagcccuaa

SEQ ID NO: 19244 - RNA, 687 nt, Artificial Sequence
  LHFPL2__Homo_sapiens__NP_005770
augugccacgugaucgugaccugcagaagcaugcuguggacccugcugagcaucgugguggccuucgccgagcugaucgccuucaugagcgccgacuggcugaucggcaaggccagaagcagaggcggcguggagcccgccggccccggcggcggcagccccgagcccuaccaccccacccugggcaucuacgccagaugcaucagaaaccccggcgugcagcacuuccagagagacacccugugcggccccuacgccgagagcuucggcgagaucgccagcggcuucuggcaggccaccgccaucuuccuggccgugggcaucuucauccugugcaugguggcccuggugagcguguucaccaugugcgugcagagcaucaugaagaagagcaucuucaacgugugcggccugcugcagggcaucgccggccuguuccugauccugggccugauccuguaccccgccggcuggggcugccagaaggccaucgacuacugcggccacuacgccagcgccuacaagcccggcgacugcagccugggcugggccuucuacaccgccaucggcggcaccgugcugaccuucaucugcgccguguucagcgcccaggccgagaucgccaccagcagcgacaaggugcaggaggagaucgaggagggcaagaaccugaucugccugcuguaa

SEQ ID NO: 19245 - RNA, 711 nt, Artificial Sequence
  LHFPL3__Homo_sapiens__NP_945351
augcccggcgccgccgccgccgccgccgccgccgccgccgccaugcugcccgcccaggaggccgccaagcuguaccacaccaacuacgugagaaacagcagagccaucggcgugcugugggccaucuucaccaucugcuucgccaucgugaacguggugugcuucauccagcccuacuggaucggcgacggcguggacaccccccaggccggcuacuucggccuguuccacuacugcaucggcaacggcuucagcagagagcugaccugcagaggcagcuucaccgacuucagcacccugcccagcggcgccuucaaggccgccagcuucuucaucggccugagcaugaugcugaucaucgccugcaucaucugcuucacccuguucuucuucugcaacaccgccaccguguacaagaucugcgccuggaugcagcugaccagcgccgccugccuggugcugggcugcaugaucuuccccgacggcugggacagcgacgaggugaagagaaugugcggcgagaagaccgacaaguacacccugggcgccugcagcgugagaugggccuacauccuggccaucaucggcauccuggacgcccugauccugagcuuccuggccuucgugcugggcaacagacaggacagccugauggccgaggagcugaaggccgagaacaaggugcugcugagccaguacagccuggaguaa

SEQ ID NO: 19246 - RNA, 744 nt, Artificial Sequence
  LHFPL4__Homo_sapiens__XP_011531995
augcugcccagccaggaggccagcaagcuguaccacgagcacuacaugagaaacagcagagccaucggcgugcugugggccaucuucaccaucugcuucgccaucaucaacguggugguguucauccagcccuacugggugggcgacagcgugagcacccccaagcccggcuacuucggccuguuccacuacugcgugggcagcggccuggccggcagagagcugaccugcagaggcagcuucaccgacuucagcaccauccccagcagcgccuucaaggccgccgccuucuucgugcugcugagcauggugcugauccugggcugcaucaccugcuucagccuguucuucuucugcaacaccgccaccguguacaagaucugcgccuggaugcagcugcuggccgcccugugccuggugcugggcugcaugaucuuccccgacggcugggacgccgagaccaucagagacaugugcggcgccaagaccggcaaguacagccugggcgacugcagcgugagaugggccuacauccuggccaucaucggcauccugaacgcccugauccugagcuuccuggccuucgugcugggcaacagacagaccgaccugcugcaggaggagcugaagcccgagaacaaggacuucgugggcagcaccgugagcagcgugcugagacccggcggcgacgugagcggcuggggcgugcugcccugccccguggcccacagccagggccccuaa

SEQ ID NO: 19247 - RNA, 660 nt, Artificial Sequence
  LHFPL5__Homo_sapiens__NP_872354
auggugaagcugcugcccgcccaggaggccgccaagaucuaccacaccaacuacgugagaaacagcagagccgugggcgugauguggggcacccugaccaucugcuucagcgugcuggugauggcccuguucauccagcccuacuggaucggcgacagcgugaacaccccccaggccggcuacuucggccuguucagcuacugcgugggcaacgugcugagcagcgagcugaucugcaagggcggcccccuggacuucagcagcauccccagcagagccuucaagaccgccauguucuucguggcccugggcauguuccugaucaucggcagcaucaucugcuucagccuguucuucaucugcaacaccgccaccguguacaagaucugcgccuggaugcagcuggccgccgccaccggccugaugaucggcugccugguguaccccgacggcugggacagcagcgaggugagaagaaugugcggcgagcagaccggcaaguacacccugggccacugcaccaucagaugggccuucaugcuggccauccugagcaucggcgacgcccugauccugagcuuccuggccuucgugcugggcuacagacaggacaagcugcugcccgacgacuacaaggccgacggcaccgaggagguguaa

SEQ ID NO: 19248 - RNA, 633 nt, Artificial Sequence
  LHPP__Homo_sapiens__NP_001161352
auggcccccuggggcaagagacuggccggcgugagaggcgugcugcuggacaucagcggcgugcuguacgacagcggcgccggcggcggcaccgccaucgccggcagcguggaggccguggccagacugaagagaagcagacugaaggugagauucugcaccaacgagagccagaagagcagagccgagcuggugggccagcugcagagacugggcuucgacaucagcgagcaggaggugaccgcccccgcccccgccgccugccagauccugaaggagcagggccugagacccuaccugcugauccacgacggcgugagaagcgaguucgaccagaucgacaccagcaaccccaacugcguggugaucgccgacgccggcgagagcuucagcuaccagaacaugaacaacgccuuccaggugcugauggagcuggagaagcccgugcugaucagccugggcaagggcagauacuacaaggagaccagcggccugaugcuggacgugggccccuacaugaaggcccuggaguacgccugcggcaucaaggccgagguggugggcaagcccagccccgaguucuucaagagcgcccugcaggccaucggcguggaggcccaccaggcccaguaa

SEQ ID NO: 19249 - RNA, 1221 nt, Artificial Sequence
  LHX1__Homo_sapiens__XP_011545112
auggugcacugcgccggcugcaagagacccauccuggacagauuccugcugaacgugcuggacagagccuggcacgugaagugcgugcagugcugcgagugcaagugcaaccugaccgagaagugcuucagcagagagggcaagcuguacugcaagaacgacuucuucagaugcuucggcaccaagugcgccggcugcgcccagggcaucagccccagcgaccuggugagaagagccagaagcaagguguuccaccugaacugcuucaccugcaugaugugcaacaagcagcugagcaccggcgaggagcuguacaucaucgacgagaacaaguucgugugcaaggaggacuaccugagcaacagcagcguggccaaggagaacagccugcacagcgccaccaccggcagcgaccccagccugagccccgacagccaggaccccagccaggacgacgccaaggacagcgagagcgccaacgugagcgacaaggaggccggcagcaacgagaacgacgaccagaaccugggcgccaagagaagaggccccagaaccaccaucaaggccaagcagcuggagacccugaaggccgccuucgccgccacccccaagcccaccagacacaucagagagcagcuggcccaggagaccggccugaacaugagagugauccaggugugguuccagaacagaagaagcaaggagagaagaaugaagcagcugagcgcccugggcgccagaagacacgccuucuucagaagccccagaagaaugagaccccugguggacagacuggagcccggcgagcugauccccaacggccccuucagcuucuacggcgacuaccagagcgaguacuacggccccggcggcaacuacgacuucuucccccagggcccccccagcagccaggcccagacccccguggaccugcccuucgugcccagcagcggccccagcggcaccccccugggcggccuggagcacccccugcccggccaccaccccagcagcgaggcccagagauucaccgacauccuggcccacccccccggcgacagccccagccccgagcccagccugcccggcccccugcacagcaugagcgccgagguguucggccccagcccccccuucagcagccugagcgugaacggcggcgccagcuacggcaaccaccugagccacccccccgagaugaacgaggccgccgugugguaa

SEQ ID NO: 19250 - RNA, 1221 nt, Artificial Sequence
  LHX2__Homo_sapiens__NP_004780
augcuguuccacagccugagcggccccgaggugcacggcgugaucgacgagauggacagaagagccaagagcgaggcccccgccaucagcagcgccaucgacagaggcgacaccgagaccaccaugcccagcaucagcagcgacagagccgcccugugcgccggcugcggcggcaagaucagcgacagauacuaccugcuggccguggacaagcaguggcacaugagaugccugaagugcugcgagugcaagcugaaccuggagagcgagcugaccugcuucagcaaggacggcagcaucuacugcaaggaggacuacuacagaagauucagcgugcagagaugcgccagaugccaccugggcaucagcgccagcgagauggugaugagagccagagaccugguguaccaccugaacugcuucaccugcaccaccugcaacaagaugcugaccaccggcgaccacuucggcaugaaggacagccugguguacugcagacugcacuucgaggcccugcugcagggcgaguaccccgcccacuucaaccacgccgacguggccgccgccgccgccgccgccgccgccgccaagagcgccggccugggcgccgccggcgccaacccccugggccugcccuacuacaacggcgugggcaccgugcagaagggcagacccagaaagagaaagagccccggccccggcgccgaccuggccgccuacaacgccgcccugagcugcaacgagaacgacgccgagcaccuggacagagaccagcccuaccccagcagccagaagaccaagagaaugagaaccagcuucaagcaccaccagcugagaaccaugaagagcuacuucgccaucaaccacaaccccgacgccaaggaccugaagcagcuggcccagaagaccggccugaccaagagagugcugcaggugugguuccagaacgccagagccaaguucagaagaaaccugcugagacaggagaacaccggcguggacaagagcaccgacgccgcccugcagaccggcacccccagcggccccgccagcgagcugagcaacgccagccugagccccagcagcacccccaccacccugaccgaccugaccagccccacccugcccaccgugaccagcgugcugaccagcgugcccggcaaccuggagggccacgagccccacagccccagccagaccacccugaccaaccuguucuaa

SEQ ID NO: 19251 - RNA, 1209 nt, Artificial Sequence
  LHX3__Homo_sapiens__NP_055379
auggaggccagaggcgagcugggccccgccagagagagcgccggcggcgaccugcugcuggcccugcuggccagaagagccgaccugagaagagagaucccccugugcgccggcugcgaccagcacauccuggacagauucauccugaaggcccuggacagacacuggcacagcaagugccugaagugcagcgacugccacaccccccuggccgagagaugcuucagcagaggcgagagcguguacugcaaggacgacuucuucaagagauucggcaccaagugcgccgccugccagcugggcaucccccccacccagguggugagaagagcccaggacuucguguaccaccugcacugcuucgccugcguggugugcaagagacagcuggccaccggcgacgaguucuaccugauggaggacagcagacuggugugcaaggccgacuacgagaccgccaagcagagagaggccgaggccaccgccaagagacccagaaccaccaucaccgccaagcagcuggagacccugaagagcgccuacaacaccagccccaagcccgccagacacgugagagagcagcugagcagcgagaccggccuggacaugagaguggugcaggugugguuccagaacagaagagccaaggagaagagacugaagaaggacgccggcagacagagauggggccaguacuucagaaacaugaagagaagcagaggcggcagcaagagcgacaaggacagcgugcaggagggccaggacagcgacgccgaggugagcuuccccgacgagcccagccuggccgagaugggccccgccaacggccuguacggcagccugggcgagcccacccaggcccugggcagacccagcggcgcccugggcaacuucagccuggagcacggcggccuggccggccccgagcaguacagagagcugagacccggcagccccuacggcgugccccccagccccgccgccccccagagccugcccggcccccagccccugcugagcagccugguguaccccgacaccagccugggccuggugcccagcggcgcccccggcggccccccccccaugagagugcuggccggcaacggccccagcagcgaccugagcaccggcagcagcggcggcuaccccgacuuccccgccagccccgccagcuggcuggacgagguggaccacgcccaguucuaa

SEQ ID NO: 19252 - RNA, 1173 nt, Artificial Sequence
  LHX4__Homo_sapiens__NP_203129
augaugcagagcgccaccgugcccgccgagggcgccgugaagggccugcccgagaugcugggcgugcccaugcagcagaucccccagugcgccggcugcaaccagcacauccuggacaaguucauccugaaggugcuggacagacacuggcacagcagcugccugaagugcgccgacugccagaugcagcuggccgacagaugcuucagcagagccggcagcguguacugcaaggaggacuucuucaagagauucggcaccaagugcaccgccugccagcagggcaucccccccacccagguggugagaaaggcccaggacuucguguaccaccugcacugcuucgccugcaucaucugcaacagacagcuggccaccggcgacgaguucuaccugauggaggacggcagacuggugugcaaggaggacuacgagaccgccaagcagaacgacgacagcgaggccggcgccaagagacccagaaccaccaucaccgccaagcagcuggagacccugaagaacgccuacaagaacagccccaagcccgccagacacgugagagagcagcugagcagcgagaccggccuggacaugagaguggugcaggugugguuccagaacagaagagccaaggagaagagacugaagaaggacgccggcagacacagauggggccaguucuacaagagcgugaagagaagcagaggcagcagcaagcaggagaaggagagcagcgccgaggacugcggcgugagcgacagcgagcugagcuucagagaggaccagauccugagcgagcugggccacaccaacagaaucuacggcaacgugggcgacgugaccggcggccagcugaugaacggcagcuucagcauggacggcaccggccagagcuaccaggaccugagagacggcagccccuacggcaucccccagagccccagcagcaucagcagccugcccagccacgccccccugcugaacggccuggacuacaccguggacagcaaccugggcaucaucgcccacgccggccagggcgugagccagacccugagagccauggccggcggccccaccagcgacaucagcaccggcagcagcgugggcuaccccgacuuccccaccagccccggcagcuggcuggacgagauggaccacccccccuucuaa

SEQ ID NO: 19253 - RNA, 1209 nt, Artificial Sequence
  LHX5__Homo_sapiens__NP_071758
augauggugcacugcgccggcugcgagagacccauccuggacagauuccugcugaacgugcuggacagagccuggcacaucaagugcgugcagugcugcgagugcaagaccaaccugagcgagaagugcuucagcagagagggcaagcuguacugcaagaacgacuucuucagaagauucggcaccaagugcgccggcugcgcccagggcaucagccccagcgaccuggugagaaaggccagaagcaagguguuccaccugaacugcuucaccugcauggugugcaacaagcagcugagcaccggcgaggagcuguacgugaucgacgagaacaaguucgugugcaaggacgacuaccugagcagcagcagccugaaggagggcagccugaacagcgugagcagcugcaccgacagaagccugagccccgaccugcaggacgcccugcaggacgaccccaaggagaccgacaacagcaccagcagcgacaaggagaccgccaacaacgagaacgaggagcagaacagcggcaccaagagaagaggccccagaaccaccaucaaggccaagcagcuggagacccugaaggccgccuucgccgccacccccaagcccaccagacacaucagagagcagcuggcccaggagaccggccugaacaugagagugauccaggugugguuccagaacagaagaagcaaggagagaagaaugaagcagcugagcgcccugggcgccagaagacacgccuucuucagaagccccagaagaaugagaccccugggcggcagacuggacgagagcgagaugcugggcagcacccccuacaccuacuacggcgacuaccagggcgacuacuacgcccccggcagcaacuacgacuucuucgcccacggcccccccagccaggcccagagccccgccgacagcagcuuccuggccgccagcggccccggcagcaccccccugggcgcccuggagcccccccuggccggcccccacgccgccgacaaccccagauucaccgacaugaucagccaccccgacacccccagccccgagcccggccugcccggcacccugcaccccaugcccggcgagguguucagcggcggccccagcccccccuuccccaugagcggcaccagcggcuacagcggcccccugagccaccccaaccccgagcugaacgaggccgccgugugguaa

SEQ ID NO: 19254 - RNA, 1101 nt, Artificial Sequence
  LHX6__Homo_sapiens__NP_001229262
augagaagaggccugugcagaagaagcgccgagaaccccgacgccggccccgugauggcccagcccggcagcggcugcaaggccaccaccagaugccuggagggcaccgccccccccgccauggcccagagcgacgccgaggcccuggccggcgcccuggacaaggacgagggccaggccagccccugcacccccagcacccccagcgugugcagcccccccagcgccgccagcagcgugcccagcgccggcaagaacaucugcagcagcugcggccuggagauccuggacagauaccugcugaaggugaacaaccugaucuggcacgugagaugccuggagugcagcgugugcagaaccagccugagacagcagaacagcugcuacaucaagaacaaggagaucuucugcaagauggacuacuucagcagauucggcaccaagugcgccagaugcggcagacagaucuacgccagcgacugggugagaagagccagaggcaacgccuaccaccuggccugcuucgccugcuucagcugcaagagacagcugagcaccggcgaggaguucggccugguggaggagaaggugcugugcagaauccacuacgacaccaugaucgagaaccugaagagagccgccgagaacggcaacggccugacccuggagggcgccgugcccagcgagcaggacagccagcccaagcccgccaagagagccagaaccagcuucaccgccgagcagcugcaggugaugcaggcccaguucgcccaggacaacaaccccgacgcccagacccugcagaagcuggccgacaugaccggccugagcagaagagugauccaggugugguuccagaacugcagagccagacacaagaagcacaccccccagcaccccgugccccccagcggcgccccccccagcagacugcccagcgcccugagcgacgacauccacuacacccccuucagcagccccgagagagccagaauggugacccugcacggcuacaucgagagccaccccuucagcgugcugacccugcccgcccugccccaccugcccgugggcgccccccagcugccccugagcagauaa

SEQ ID NO: 19255 - RNA, 1167 nt, Artificial Sequence
  LHX9__Homo_sapiens__NP_001014434
augcugaacggcaccacccuggaggccgccaugcuguuccacggcaucagcggcggccacauccagggcaucauggaggagauggagagaagaagcaagaccgaggccagacuggccaagggcgcccagcugaacggcagagacgccggcaugcccccccugagccccgagaagcccgcccugugcgccggcugcggcggcaagaucagcgacagauacuaccugcuggccguggacaagcaguggcaccugagaugccugaagugcugcgagugcaagcuggcccuggagagcgagcugaccugcuucgccaaggacggcagcaucuacugcaaggaggacuacuacagaagauucagcgugcagagaugcgccagaugccaccugggcaucagcgccagcgagauggugaugagagccagagacagcguguaccaccugagcugcuucaccugcagcaccugcaacaagacccugaccaccggcgaccacuucggcaugaaggacagccugguguacugcagagcccacuucgagacccugcugcagggcgaguaccccccccagcugagcuacaccgagcuggccgccaagagcggcggccuggcccugcccuacuucaacggcaccggcaccgugcagaagggcagacccagaaagagaaagagccccgcccugggcguggacaucgugaacuacaacagcggcugcaacgagaacgaggccgaccaccuggacagagaccagcagcccuacccccccagccagaagaccaagagaaugagaaccagcuucaagcaccaccagcugagaaccaugaagagcuacuucgccaucaaccacaaccccgacgccaaggaccugaagcagcuggcccagaagaccggccugaccaagagagugcugcaggugugguuccagaacgccagagccaaguucagaagaaaccugcugagacaggagaacggcggcguggacaaggccgacggcaccagccugcccgccccccccagcgccgacagcggcgcccugaccccccccggcaccgccaccacccugaccgaccugaccaaccccaccaucaccguggugaccagcgugaccagcaacauggacagccacgagagcggcagccccagccagaccacccugaccaaccuguucuaa

SEQ ID NO: 19256 - RNA, 1119 nt, Artificial Sequence
  LIAS__Homo_sapiens__NP_006850
augagccugagaugcggcgacgccgccagaacccugggccccagaguguucggcagauacuucugcagccccgugagaccccugagcagccugcccgacaagaagaaggagcugcugcagaacggccccgaccugcaggacuucgugagcggcgaccuggccgacagaagcaccugggacgaguacaagggcaaccugaagagacagaagggcgagagacugagacugccccccuggcugaagaccgagauccccaugggcaagaacuacaacaagcugaagaacacccugagaaaccugaaccugcacaccgugugcgaggaggccagaugccccaacaucggcgagugcuggggcggcggcgaguacgccaccgccaccgccaccaucaugcugaugggcgacaccugcaccagaggcugcagauucugcagcgugaagaccgccagaaacccccccccccuggacgccagcgagcccuacaacaccgccaaggccaucgccgaguggggccuggacuacguggugcugaccagcguggacagagacgacaugcccgacggcggcgccgagcacaucgccaagaccgugagcuaccugaaggagagaaaccccaagauccugguggagugccugacccccgacuucagaggcgaccugaaggccaucgagaagguggcccugagcggccuggacguguacgcccacaacguggagaccgugcccgagcugcagagcaaggugagagaccccagagccaacuucgaccagagccugagagugcugaagcacgccaagaaggugcagcccgacgugaucagcaagaccagcaucaugcugggccugggcgagaacgacgagcagguguacgccaccaugaaggcccugagagaggccgacguggacugccugacccugggccaguacaugcagcccaccagaagacaccugaagguggaggaguacaucacccccgagaaguucaaguacugggagaaggugggcaacgagcugggcuuccacuacaccgccagcggcccccuggugagaagcagcuacaaggccggcgaguucuuccugaagaaccugguggccaagagaaagaccaaggaccuguaa

SEQ ID NO: 19257 - RNA, 609 nt, Artificial Sequence
  LIF__Homo_sapiens__XP_011528474
augaaggugcuggccgccggcguggugccccugcugcuggugcugcacuggaagcacggcgccggcagcccccugcccaucacccccgugaacgccaccugcgccaucagacaccccugccacaacaaccugaugaaccagaucagaagccagcuggcccagcugaacggcagcgccaacgcccuguucauccuguacuacaccgcccagggcgagcccuuccccaacaaccuggacaagcugugcggccccaacgugaccgacuucccccccuuccacgccaacggcaccgagaaggccaagcugguggagcuguacagaaucgugguguaccugggcaccagccugggcaacaucaccagagaccagaagauccugaaccccagcgcccugagccugcacagcaagcugaacgccaccgccgacauccugagaggccugcugagcaacgugcugugcagacugugcagcaaguaccacgugggccacguggacgugaccuacggccccgacaccagcggcaaggacguguuccagaagaagaagcugggcugccagcugcugggcaaguacaagcagaucaucgccgugcuggcccaggccuucuaa

SEQ ID NO: 19258 - RNA, 3294 nt, Artificial Sequence
  LIFR__Homo_sapiens__XP_011512344
augauggacaucuacgugugccugaagagacccagcuggaugguggacaacaagagaaugagaaccgccagcaacuuccaguggcugcugagcaccuucauccugcuguaccugaugaaccaggugaacagccagaagaagggcgccccccacgaccugaagugcgugaccaacaaccugcagguguggaacugcagcuggaaggcccccagcggcaccggcagaggcaccgacuacgaggugugcaucgagaacagaagcagaagcugcuaccagcuggagaagaccagcaucaagauccccgcccugagccacggcgacuacgagaucaccaucaacagccugcacgacuucggcagcagcaccagcaaguucacccugaacgagcagaacgugagccugauccccgacacccccgagauccugaaccugagcgccgacuucagcaccagcacccuguaccugaaguggaacgacagaggcagcguguucccccacagaagcaacgugaucugggagaucaaggugcugagaaaggagagcauggagcuggugaagcuggugacccacaacaccacccugaacggcaaggacacccugcaccacuggagcugggccagcgacaugccccuggagugcgccauccacuucguggagaucagaugcuacaucgacaaccugcacuucagcggccuggaggaguggagcgacuggagccccgugaagaacaucagcuggauccccgacagccagaccaagguguucccccaggacaaggugauccuggugggcagcgacaucaccuucugcugcgugagccaggagaaggugcugagcgcccugaucggccacaccaacugcccccugauccaccuggacggcgagaacguggccaucaagaucagaaacaucagcgugagcgccagcagcggcaccaacgugguguucaccaccgaggacaacaucuucggcaccgugaucuucgccggcuacccccccgacaccccccagcagcugaacugcgagacccacgaccugaaggagaucaucugcagcuggaaccccggcagagugaccgcccuggugggccccagagccaccagcuacacccugguggagagcuucagcggcaaguacgugagacugaagagagccgaggcccccaccaacgagagcuaccagcugcuguuccagaugcugcccaaccaggagaucuacaacuucacccugaacgcccacaacccccugggcagaagccagagcaccauccuggugaacaucaccgagaagguguacccccacacccccaccagcuucaaggugaaggacaucaacagcaccgccgugaagcugagcuggcaccugcccggcaacuucgccaagaucaacuuccugugcgagaucgagaucaagaagagcaacagcgugcaggagcagagaaacgugaccaucaagggcguggagaacagcagcuaccugguggcccuggacaagcugaaccccuacacccuguacaccuucagaaucagaugcagcaccgagaccuucuggaaguggagcaaguggagcaacaagaagcagcaccugaccaccgaggccagccccagcaagggccccgacaccuggagagaguggagcagcgacggcaagaaccugaucaucuacuggaagccccugcccaucaacgaggccaacggcaagauccugagcuacaacgugagcugcagcagcgacgaggagacccagagccugagcgagauccccgacccccagcacaaggccgagaucagacuggacaagaacgacuacaucaucagcgugguggccaagaacagcgugggcagcagcccccccagcaagaucgccagcauggagauccccaacgacgaccugaagaucgagcagguggugggcaugggcaagggcauccugcugaccuggcacuacgaccccaacaugaccugcgacuacgugaucaaguggugcaacagcagcagaagcgagcccugccugauggacuggagaaaggugcccagcaacagcaccgagaccgugaucgagagcgacgaguucagacccggcaucagauacaacuucuuccuguacggcugcagaaaccagggcuaccagcugcugagaagcaugaucggcuacaucgaggagcuggcccccaucguggcccccaacuucaccguggaggacaccagcgccgacagcauccuggugaagugggaggacauccccguggaggagcugagaggcuuccugagaggcuaccuguucuacuucggcaagggcgagagagacaccagcaagaugagagugcuggagagcggcagaagcgacaucaaggugaagaacaucaccgacaucagccagaagacccugagaaucgccgaccugcagggcaagaccagcuaccaccuggugcugagagccuacaccgacggcggcgugggccccgagaagagcauguacguggugaccaaggagaacagcgugggccugaucaucgccauccugauccccguggccguggccgugaucgugggcguggugaccagcauccugugcuacagaaagagagaguggaucaaggagaccuucuaccccgacauccccaaccccgagaacugcaaggcccugcaguuccagaagagcgugugcgagggcagcagcgcccugaagacccuggagaugaaccccugcacccccaacaacguggaggugcuggagaccagaagcgccuuccccaagaucgaggacaccgagaucaucagccccguggccgagagacccgaggacagaagcgacgccgagcccgagaaccacgugguggugagcuacugcccccccaucaucgaggaggagauccccaaccccgccgccgacgaggccggcggcaccgcccaggugaucuacaucgacgugcagagcauguaccagccccaggccaagcccgaggaggagcaggagaacgaccccgugggcggcgccggcuacaagccccagaugcaccugcccaucaacagcaccguggaggacaucgccgccgaggaggaccuggacaagaccgccggcuacagaccccaggccaacgugaacaccuggaaccuggugagccccgacagccccagaagcaucgacagcaacagcgagaucgugagcuucggcagccccugcagcaucaacagcagacaguuccugaucccccccaaggacgaggacagccccaagagcaacggcggcggcuggagcuucaccaacuucuuccagaacaagcccaacgacuaa

SEQ ID NO: 19259 - RNA, 2667 nt, Artificial Sequence
  LIG1__Homo_sapiens__NP_001275992
augcagagaagcaucauggccgcccugaaggaguggaacggcguggugagcgagagcgacagccccgugaagagacccggcagaaaggccgccagagugcugggcagcgagggcgaggaggaggacgaggcccugagccccgccaagggccagaagcccgcccuggacugcagccaggugagcccccccagacccgccaccagccccgagaacaacgccagccugagcgacaccagccccauggacagcagccccagcggcauccccaagagaagaaccgccagaaagcagcugcccaagagaaccauccaggaggugcuggaggagcagagcgaggacgaggacagagaggccaagagaaagaaggaggaggaggaggagacccccaaggagagccugaccgaggccgagguggccaccgagaaggagggcgaggacggcgaccagcccaccaccccccccaagccccugaagaccagcaaggccgagacccccaccgagagcgugagcgagcccgagguggccaccaagcaggagcugcaggaggaggaggagcagaccaagccccccagaagagcccccaagacccugagcagcuucuucacccccagaaagcccgccgugaagaaggaggugaaggaggaggagcccggcgcccccggcaaggagggcgccgccgagggcccccuggaccccagcggcuacaaccccgccaagaacaacuaccaccccguggaggacgccugcuggaagcccggccagaaggugcccuaccuggccguggccagaaccuucgagaagaucgaggaggugagcgccagacugagaaugguggagacccugagcaaccugcugagaagcgugguggcccugagcccccccgaccugcugcccgugcuguaccugagccugaaccaccugggccccccccagcagggccuggagcugggcgugggcgacggcgugcugcugaaggccguggcccaggccaccggcagacagcuggagagcgugagagccgaggccgccgagaagggcgacgugggccugguggccgagaacagcagaagcacccagagacugaugcugcccccccccccccugaccgccagcggcguguucagcaaguucagagacaucgccagacugaccggcagcgccagcaccgccaagaagaucgacaucaucaagggccuguucguggccugcagacacagcgaggccagauucaucgccagaagccugagcggcagacugagacugggccuggccgagcagagcgugcuggccgcccugagccaggccgugagccugaccccccccggccaggaguucccccccgccaugguggacgccggcaagggcaagaccgccgaggccagaaagaccuggcuggaggagcagggcaugauccugaagcagaccuucugcgaggugcccgaccuggacagaaucauccccgugcugcuggagcacggccuggagagacugcccgagcacugcaagcugagccccggcaucccccugaagcccaugcuggcccaccccaccagaggcaucagcgaggugcugaagagauucgaggaggccgccuucaccugcgaguacaaguacgacggccagagagcccagauccacgcccuggagggcggcgaggugaagaucuucagcagaaaccaggaggacaacaccggcaaguaccccgacaucaucagcagaauccccaagaucaagcugcccagcgugaccagcuucauccuggacaccgaggccguggccugggacagagagaagaagcagauccagcccuuccaggugcugaccaccagaaagagaaaggagguggacgccagcgagauccaggugcaggugugccuguacgccuucgaccugaucuaccugaacggcgagagccuggugagagagccccugagcagaagaagacagcugcugagagagaacuucguggagaccgagggcgaguucguguucgccaccagccuggacaccaaggacaucgagcagaucgccgaguuccuggagcagagcgugaaggacagcugcgagggccugauggugaagacccuggacguggacgccaccuacgagaucgccaagagaagccacaacuggcugaagcugaagaaggacuaccuggacggcgugggcgacacccuggaccugguggugaucggcgccuaccugggcagaggcaagagagccggcagauacggcggcuuccugcuggccagcuacgacgaggacagcgaggagcugcaggccaucugcaagcugggcaccggcuucagcgacgaggagcuggaggagcaccaccagagccugaaggcccuggugcugcccagccccagacccuacgugagaaucgacggcgccgugauccccgaccacuggcuggaccccagcgccgugugggaggugaagugcgccgaccugagccugagccccaucuaccccgccgccagaggccugguggacagcgacaagggcaucagccugagauuccccagauucaucagagugagagaggacaagcagcccgagcaggccaccaccagcgcccagguggccugccuguacagaaagcagagccagauccagaaccagcagggcgaggacagcggcagcgaccccgaggacaccuacuaa

SEQ ID NO: 19260 - RNA, 3057 nt, Artificial Sequence
  LIG3__Homo_sapiens__XP_005258027
augagcaaguucagaggccugagauacaugagccuggccuucaagaucuucuucccccagacccugagagcccugagcagaaaggagcugugccuguucagaaagcaccacuggagagacgugagacaguucagccaguggagcgagaccgaccugcugcacggccacccccuguuccugagaagaaagcccgugcugagcuuccagggcagccaccugagaagcagagccaccuaccugguguuccugcccggccugcacgugggccugugcagcggccccugcgagauggccgagcagagauucugcguggacuacgccaagagaggcaccgccggcugcaagaagugcaaggagaagaucgugaagggcgugugcagaaucggcaagguggugcccaaccccuucagcgagagcggcggcgacaugaaggagugguaccacaucaagugcauguucgagaagcuggagagagccagagccaccaccaagaagaucgaggaccugaccgagcuggagggcugggaggagcuggaggacaacgagaaggagcagaucacccagcacaucgccgaccugagcagcaaggccgccggcacccccaagaagaaggccguggugcaggccaagcugaccaccaccggccaggugaccagccccgugaagggcgccagcuucgugaccagcaccaaccccagaaaguucagcggcuucagcgccaagcccaacaacagcggcgaggcccccagcagccccacccccaagagaagccugagcagcagcaagugcgaccccagacacaaggacugccugcugagagaguucagaaagcugugcgccaugguggccgacaaccccagcuacaacaccaagacccagaucauccaggacuuccugagaaagggcagcgccggcgacggcuuccacggcgacguguaccugaccgugaagcugcugcugcccggcgugaucaagaccguguacaaccugaacgacaagcagaucgugaagcuguucagcagaaucuucaacugcaaccccgacgacauggccagagaccuggagcagggcgacgugagcgagaccaucagaguguucuucgagcagagcaagagcuucccccccgccgccaagagccugcugaccauccaggagguggacgaguuccugcugagacugagcaagcugaccaaggaggacgagcagcagcaggcccugcaggacaucgccagcagaugcaccgccaacgaccugaagugcaucaucagacugaucaagcacgaccugaagaugaacagcggcgccaagcacgugcuggacgcccuggaccccaacgccuacgaggccuucaaggccagcagaaaccugcaggacgugguggagagagugcugcacaacgcccaggagguggagaaggagcccggccagagaagagcccugagcgugcaggccagccugaugacccccgugcagcccaugcuggccgaggccugcaagagcguggaguacgccaugaagaagugccccaacggcauguucagcgagaucaaguacgacggcgagagagugcaggugcacaagaacggcgaccacuucagcuacuucagcagaagccugaagcccgugcugccccacaagguggcccacuucaaggacuacaucccccaggccuuccccggcggccacagcaugauccuggacagcgaggugcugcugaucgacaacaagaccggcaagccccugcccuucggcacccugggcgugcacaagaaggccgccuuccaggacgccaacgugugccuguucguguucgacugcaucuacuucaacgacgugagccugauggacagaccccugugcgagagaagaaaguuccugcacgacaacaugguggagauccccaacagaaucauguucagcgagaugaagagagugaccaaggcccuggaccuggccgacaugaucaccagagugauccaggagggccuggagggccuggugcugaaggacgugaagggcaccuacgagcccggcaagagacacuggcugaaggugaagaaggacuaccugaacgagggcgccauggccgacaccgccgaccugguggugcugggcgccuucuacggccagggcagcaagggcggcaugaugagcaucuuccugaugggcugcuacgaccccggcagccagaaguggugcaccgugaccaagugcgccggcggccacgacgacgccacccuggccagacugcagaacgagcuggacauggugaagaucagcaaggaccccagcaagauccccagcuggcugaaggugaacaagaucuacuaccccgacuucaucgugcccgaccccaagaaggccgccgugugggagaucaccggcgccgaguucagcaagagcgaggcccacaccgccgacggcaucagcaucagauuccccagaugcaccagaaucagagacgacaaggacuggaagagcgccaccaaccugccccagcugaaggagcuguaccagcugagcaaggagaaggccgacuucaccgugguggccggcgacgagggcagcagcaccaccggcggcagcagcgaggagaacaagggccccagcggcagcgccgugagcagaaaggcccccagcaagcccagcgccagcaccaagaaggccgagggcaagcugagcaacagcaacagcaaggacggcaacaugcagaccgccaagcccagcgccaugaaggugggcgagaagcuggccaccaagagcagccccgugaaggugggcgagaagagaaaggccgccgacgagacccugugccagaccaaggugcugcuggacaucuucaccggcgugagacuguaccugccccccagcacccccgacuucagcagacugagaagauacuucguggccuucgacggcgaccuggugcaggaguucgacaugaccagcgccacccacgugcugggcagcagagacaagaaccccgccgcccagcaggugagccccgaguggaucugggccugcaucagaaagagaagacugguggcccccugcuaa

SEQ ID NO: 19261 - RNA, 2736 nt, Artificial Sequence
  LIG4__Homo_sapiens__XP_005254115
auggccgccagccagaccagccagaccguggccagccacgugcccuucgccgaccugugcagcacccuggagagaauccagaagagcaagggcagagccgagaagaucagacacuucagagaguuccuggacagcuggagaaaguuccacgacgcccugcacaagaaccacaaggacgugaccgacagcuucuaccccgccaugagacugauccugccccagcuggagagagagagaauggccuacggcaucaaggagaccaugcuggccaagcuguacaucgagcugcugaaccugcccagagacggcaaggacgcccugaagcugcugaacuacagaacccccaccggcacccacggcgacgccggcgacuucgccaugaucgccuacuucgugcugaagcccagaugccugcagaagggcagccugaccauccagcaggugaacgaccugcuggacagcaucgccagcaacaacagcgccaagagaaaggaccugaucaagaagagccugcugcagcugaucacccagagcagcgcccuggagcagaaguggcugaucagaaugaucaucaaggaccugaagcugggcgugagccagcagaccaucuucagcguguuccacaacgacgccgccgagcugcacaacgugaccaccgaccuggagaaggugugcagacagcugcacgaccccagcgugggccugagcgacaucagcaucacccuguucagcgccuucaagcccaugcuggccgccaucgccgacaucgagcacaucgagaaggacaugaagcaccagagcuucuacaucgagaccaagcuggacggcgagagaaugcagaugcacaaggacggcgacguguacaaguacuucagcagaaacggcuacaacuacaccgaccaguucggcgccagccccaccgagggcagccugacccccuucauccacaacgccuucaaggccgacauccagaucugcauccuggacggcgagaugauggccuacaaccccaacacccagaccuucaugcagaagggcaccaaguucgacaucaagagaaugguggaggacagcgaccugcagaccugcuacugcguguucgacgugcugauggugaacaacaagaagcugggccacgagacccugagaaagagauacgagauccugagcagcaucuucacccccauccccggcagaaucgagaucgugcagaagacccaggcccacaccaagaacgaggugaucgacgcccugaacgaggccaucgacaagagagaggagggcaucauggugaagcagccccugagcaucuacaagcccgacaagagaggcgagggcuggcugaagaucaagcccgaguacgugagcggccugauggacgagcuggacauccugaucgugggcggcuacuggggcaagggcagcagaggcggcaugaugagccacuuccugugcgccguggccgagaagcccccccccggcgagaagcccagcguguuccacacccugagcagagugggcagcggcugcaccaugaaggagcuguacgaccugggccugaagcuggccaaguacuggaagcccuuccacagaaaggccccccccagcagcauccugugcggcaccgagaagcccgagguguacaucgagcccugcaacagcgugaucgugcagaucaaggccgccgagaucgugcccagcgacauguacaagaccggcugcacccugagauuccccagaaucgagaagaucagagacgacaaggaguggcacgagugcaugacccuggacgaccuggagcagcugagaggcaaggccagcggcaagcuggccagcaagcaccuguacaucggcggcgacgacgagccccaggagaagaagagaaaggccgcccccaagaugaagaaggugaucggcaucaucgagcaccugaaggcccccaaccugaccaacgugaacaagaucagcaacaucuucgaggacguggaguucugcgugaugagcggcaccgacagccagcccaagcccgaccuggagaacagaaucgccgaguucggcggcuacaucgugcagaaccccggccccgacaccuacugcgugaucgccggcagcgagaacaucagagugaagaacaucauccugagcaacaagcacgacguggugaagcccgccuggcugcuggagugcuucaagaccaagagcuucgugcccuggcagcccagauucaugauccacaugugccccagcaccaaggagcacuucgccagagaguacgacugcuacggcgacagcuacuucaucgacaccgaccugaaccagcugaaggagguguucagcggcaucaagaacagcaacgagcagacccccgaggagauggccagccugaucgccgaccuggaguacagauacagcugggacugcagcccccugagcauguucagaagacacaccguguaccuggacagcuacgccgugaucaacgaccugagcaccaagaacgagggcaccagacuggccaucaaggcccuggagcugagauuccacggcgccaagguggugagcugccuggccgagggcgugagccacgugaucaucggcgaggaccacagcagaguggccgacuucaaggccuucagaagaaccuucaagagaaaguucaagauccugaaggagagcugggugaccgacagcaucgacaagugcgagcugcaggaggagaaccaguaccugaucuaa

SEQ ID NO: 19262 - RNA, 1470 nt, Artificial Sequence
  LILRA1__Homo_sapiens__NP_006854
augacccccaucgugaccgugcugaucugccugagacugagccugggccccagaacccacgugcaggccggcacccugcccaagcccacccugugggccgagcccggcagcgugaucacccagggcagccccgugacccuguggugccagggcauccuggagacccaggaguacagacuguacagagagaagaagaccgcccccuggaucaccagaaucccccaggagaucgugaagaagggccaguuccccauccccagcaucaccugggagcacaccggcagauacagaugcuucuacggcagccacaccgccggcuggagcgagcccagcgacccccuggagcugguggugaccggcgccuacaucaagcccacccugagcgcccugcccagccccguggugaccagcggcggcaacgugacccugcacugcgugagccagguggccuucggcagcuucauccugugcaaggagggcgaggacgagcacccccagugccugaacagccagcccagaacccacggcuggagcagagccaucuucagcgugggccccgugagccccagcagaagauggagcuacagaugcuacgccuacgacagcaacagcccccacguguggagccugcccagcgaccugcuggagcugcuggugcugggcgugagcaagaagcccagccugagcgugcagcccggccccaucguggcccccggcgagagccugacccugcagugcgugagcgacgugagcuacgacagauucgugcuguacaaggagggcgagagagacuuccugcagcugcccggcccccagccccaggccggccugagccaggccaacuucacccugggccccgugagcagaagcuacggcggccaguacagaugcagcggcgccuacaaccugagcagcgaguggagcgcccccagcgacccccuggacauccugaucgccggccaguucagaggcagacccuucaucagcgugcaccccggccccaccguggccagcggcgagaacgugacccugcugugccagagcuggggccccuuccacaccuuccugcugaccaaggccggcgccgccgacgccccccugagacugagaagcauccacgaguaccccaaguaccaggccgaguuccccaugagccccgugaccagcgcccacagcggcaccuacagaugcuacggcagccugagcagcaaccccuaccugcugagccaccccagcgacagccuggagcugauggugagcggcgccgccgagacccugagccccccccagaacaagagcgacagcaaggccggcgccgccaacacccugagccccagccagaacaagaccgccagccacccccaggacuacaccguggagaaccugaucagaaugggcaucgccggccuggugcugguggugcugggcauccugcuguucgaggcccagcacagccagagaagccuguaa

SEQ ID NO: 19263 - RNA, 1401 nt, Artificial Sequence
  LILRA2__Homo_sapiens__NP_006857
augacccccauccugaccgugcugaucugccugggccugagccugggccccagaacccacgugcaggccggccaccugcccaagcccacccugugggccgagcccggcagcgugaucauccagggcagccccgugacccugagaugccagggcagccugcaggccgaggaguaccaccuguacagagagaacaagagcgccagcugggugagaagaauccaggagcccggcaagaacggccaguuccccauccccagcaucaccugggagcacgccggcagauaccacugccaguacuacagccacaaccacagcagcgaguacagcgacccccuggagcugguggugaccggcgccuacagcaagcccacccugagcgcccugcccagccccguggugaccagcggcggcaacgugacccugcagugcgugagccagguggccuucgacggcuucauccugugcaaggagggcgaggacgagcacccccagagacugaacagccacagccacgccagaggcuggagcugggccaucuucagcgugggccccgugagccccagcagaagauggagcuacagaugcuacgccuacgacagcaacagccccuacguguggagccugcccagcgaccugcuggagcugcuggugcccggcgugagcaagaagcccagccugagcgugcagcccggccccaugguggcccccggcgagagccugacccugcagugcgugagcgacgugggcuacgacagauucgugcuguacaaggagggcgagagagacuuccugcagagacccggcuggcagccccaggccggccugagccaggccaacuucacccugggccccgugagccccagccacggcggccaguacagaugcuacagcgcccacaaccugagcagcgaguggagcgcccccagcgacccccuggacauccugaucaccggccaguucuacgacagacccagccugagcgugcagcccgugcccaccguggcccccggcaagaacgugacccugcugugccagagcagaggccaguuccacaccuuccugcugaccaaggagggcgccggccaccccccccugcaccugagaagcgagcaccaggcccagcagaaccaggccgaguucagaaugggccccgugaccagcgcccacgugggcaccuacagaugcuacagcagccugagcagcaaccccuaccugcugagccugcccagcgacccccuggagcugguggugagcgccagccugggccagcacccccaggacuacaccguggagaaccugaucagaaugggcguggccggccuggugcugguggugcugggcauccugcuguucgaggcccagcacagccagagaagccugcaggacgccgccggcagauaa

SEQ ID NO: 19264 - RNA, 1128 nt, Artificial Sequence
  LILRA3__Homo_sapiens__NP_001166125
augacccccauccugaccgugcugaucugccugggccugagccuggaccccagaacccacgugcaggccggcccccugcccaagcccacccugugggccgagcccggcagcgugaucacccagggcagccccgugacccugagaugccagggcagccuggagacccaggaguaccaccuguacagagagaagaagaccgcccuguggaucaccagaaucccccaggagcuggugaagaagggccaguuccccauccugagcaucaccugggagcacgccggcagauacugcugcaucuacggcagccacaccgccggccugagcgagagcagcgacccccuggagcugguggugaccggcgccuacagcaagcccacccugagcgcccugcccagccccguggugaccagcggcggcaacgugaccauccagugcgacagccagguggccuucgacggcuucauccugugcgugagcaagaagcccagccugagcgugcagcccggccccgugguggcccccggcgagaagcugaccuuccagugcggcagcgacgccggcuacgacagauucgugcuguacaaggaguggggcagagacuuccugcagagacccggcagacagccccaggccggccugagccaggccaacuucacccugggccccgugagcagaagcuacggcggccaguacaccugcagcggcgccuacaaccugagcagcgaguggagcgcccccagcgacccccuggacauccugaucaccggccagaucagagccagacccuuccugagcgugagacccggccccaccguggccagcggcgagaacgugacccugcugugccagagccagggcggcaugcacaccuuccugcugaccaaggagggcgccgccgacagcccccugagacugaagagcaagagacagagccacaaguaccaggccgaguuccccaugagccccgugaccagcgcccacgccggcaccuacagaugcuacggcagccugagcagcaaccccuaccugcugacccaccccagcgacccccuggagcugguggugagcggcgccgccgagacccugagccccccccagaacaagagcgacagcaaggccggcgaguaa

SEQ ID NO: 19265 - RNA, 1500 nt, Artificial Sequence
  LILRA4__Homo_sapiens__NP_036408
augacccugauccugaccagccugcuguucuucggccugagccugggccccagaaccagagugcaggccgagaaccugcugaagcccauccugugggccgagcccggccccgugaucaccuggcacaaccccgugaccaucuggugccagggcacccuggaggcccagggcuacagacuggacaaggagggcaacagcaugagcagacacauccugaagacccuggagagcgagaacaaggugaagcugagcauccccagcaugaugugggagcacgccggcagauaccacugcuacuaccagagccccgccggcuggagcgagcccagcgacccccuggagcugguggugaccgccuacagcagacccacccugagcgcccugcccagccccguggugaccagcggcgugaacgugacccugagaugcgccagcagacugggccugggcagauucacccugaucgaggagggcgaccacagacugagcuggacccugaacagccaccagcacaaccacggcaaguuccaggcccuguuccccaugggcccccugaccuucagcaacagaggcaccuucagaugcuacggcuacgagaacaacacccccuacguguggagcgagcccagcgacccccugcagcugcuggugagcggcgugagcagaaagcccagccugcugacccugcagggccccguggugacccccggcgagaaccugacccugcagugcggcagcgacgugggcuacaucagauacacccuguacaaggagggcgccgacggccugccccagagacccggcagacagccccaggccggccugagccaggccaacuucacccugagccccgugagcagaagcuacggcggccaguacagaugcuacggcgcccacaacgugagcagcgaguggagcgcccccagcgacccccuggacauccugaucgccggccagaucagcgacagacccagccugagcgugcagcccggccccaccgugaccagcggcgagaaggugacccugcugugccagagcugggaccccauguucaccuuccugcugaccaaggagggcgccgcccaccccccccugagacugagaagcauguacggcgcccacaaguaccaggccgaguuccccaugagccccgugaccagcgcccacgccggcaccuacagaugcuacggcagcagaagcagcaaccccuaccugcugagccaccccagcgagccccuggagcugguggugagcggcgccaccgagacccugaaccccgcccagaagaagagcgacagcaagaccgccccccaccugcaggacuacaccguggagaaccugaucagaaugggcguggccggccuggugcugcuguuccugggcauccugcuguucgaggcccagcacagccagagaagcccccccagaugcagccaggaggccaacagcagaaaggacaacgcccccuucagagugguggagcccugggagcagaucuaa

SEQ ID NO: 19266 - RNA, 900 nt, Artificial Sequence
  LILRA5__Homo_sapiens__NP_067073
auggcccccuggagccaccccagcgcccagcugcagcccgugggcggcgacgccgugagccccgcccugauggugcugcugugccugggccugagccugggccccagaacccacgugcaggccggcaaccugagcaaggccacccugugggccgagcccggcagcgugaucagcagaggcaacagcgugaccaucagaugccagggcacccuggaggcccaggaguacagacuggugaaggagggcagccccgagcccugggacacccagaacccccuggagcccaagaacaaggccagauucagcauccccagcaugaccgagcaccacgccggcagauacagaugcuacuacuacagccccgccggcuggagcgagcccagcgacccccuggagcugguggugaccggcuucuacaacaagcccacccugagcgcccugcccagccccguggugaccagcggcgagaacgugacccugcagugcggcagcagacugagauucgacagauucauccugaccgaggagggcgaccacaagcugagcuggacccuggacagccagcugacccccagcggccaguuccaggcccuguuccccgugggccccgugacccccagccacagauggaugcugagaugcuacggcagcagaagacacauccugcagguguggagcgagcccagcgaccugcuggagauccccgugagcggcgccgccgacaaccugagccccagccagaacaagagcgacagcggcaccgccagccaccugcaggacuacgccguggagaaccugaucagaaugggcauggccggccugauccugguggugcugggcauccugaucuuccaggacuggcacagccagagaagcccccaggccgccgccggcagauaa

SEQ ID NO: 19267 - RNA, 1956 nt, Artificial Sequence
  LILRB1__Homo_sapiens__NP_001075107
augacccccauccugaccgugcugaucugccugggccugagccugggccccagaacccacgugcaggccggccaccugcccaagcccacccugugggccgagcccggcagcgugaucacccagggcagccccgugacccugagaugccagggcggccaggagacccaggaguacagacuguacagagagaagaagaccgcccccuggaucaccagaaucccccaggagcuggugaagaagggccaguuccccauccccagcaucaccugggagcacaccggcagauacagaugcuacuacggcagcgacaccgccggcagaagcgagagcagcgacccccuggagcugguggugaccggcgccuacaucaagcccacccugagcgcccagcccagccccguggugaacagcggcggcaacgugacccugcagugcgacagccagguggccuucgacggcuucauccugugcaaggagggcgaggacgagcacccccagugccugaacagccagccccacgccagaggcagcagcagagccaucuucagcgugggccccgugagccccagcagaagauggugguacagaugcuacgccuacgacagcaacagccccuacgaguggagccugcccagcgaccugcuggagcugcuggugcugggcgugagcaagaagcccagccugagcgugcagcccggccccaucguggcccccgaggagacccugacccugcagugcggcagcgacgccggcuacaacagauucgugcuguacaaggacggcgagagagacuuccugcagcuggccggcgcccagccccaggccggccugagccaggccaacuucacccugggccccgugagcagaagcuacggcggccaguacagaugcuacggcgcccacaaccugagcagcgaguggagcgcccccagcgacccccuggacauccugaucgccggccaguucuacgacagagugagccugagcgugcagcccggccccaccguggccagcggcgagaacgugacccugcugugccagagccagggcuggaugcagaccuuccugcugaccaaggagggcgccgccgacgaccccuggagacugagaagcaccuaccagagccagaaguaccaggccgaguuccccaugggccccgugaccagcgcccacgccggcaccuacagaugcuacggcagccagagcagcaagcccuaccugcugacccaccccagcgacccccuggagcugguggugagcggccccagcggcggccccagcagccccaccaccggccccaccagcaccagcgccggccccgaggaccagccccugacccccaccggcagcgacccccagagcggccugggcagacaccugggcguggugaucggcauccugguggccgugauccugcugcugcugcugcugcugcugcuguuccugauccugagacacagaagacagggcaagcacuggaccagcacccagagaaaggccgacuuccagcaccccgccggcgccgugggccccgagcccaccgacagaggccugcaguggagaagcagccccgccgccgacgcccaggaggagaaccuguacgccgccgugaagcacacccagcccgaggacggcguggagauggacaccagaagcccccacgacgaggacccccaggccgugaccuacgccgaggugaagcacagcagacccagaagagagauggccagcccccccagcccccugagcggcgaguuccuggacaccaaggacagacaggccgaggaggacagacagauggacaccgaggccgccgccagcgaggccccccaggacgugaccuacgcccagcugcacagccugacccugagaagagaggccaccgagcccccccccagccaggagggccccagccccgccgugcccagcaucuacgccacccuggccauccacuaa

SEQ ID NO: 19268 - RNA, 1449 nt, Artificial Sequence
  LILRB2__Homo_sapiens__NP_001265333
augaccggcgccuaccccaagcccacccugagcgcccagcccagccccguggugaccagcggcggcagagugacccugcagugcgagagccagguggccuucggcggcuucauccugugcaaggagggcgaggacgagcacccccagugccugaacagccagccccacgccagaggcagcagcagagccaucuucagcgugggccccgugagccccaacagaagauggagccacagaugcuacggcuacgaccugaacagccccuacguguggagcagccccagcgaccugcuggagcugcuggugcccggcgugagcaagaagcccagccugagcgugcagcccggccccgugauggcccccggcgagagccugacccugcagugcgugagcgacgugggcuacgacagauucgugcuguacaaggagggcgagagagaccugagacagcugcccggcagacagccccaggccggccugagccaggccaacuucacccugggccccgugagcagaagcuacggcggccaguacagaugcuacggcgcccacaaccugagcagcgagugcagcgcccccagcgacccccuggacauccugaucaccggccagaucagaggcacccccuucaucagcgugcagcccggccccaccguggccagcggcgagaacgugacccugcugugccagagcuggagacaguuccacaccuuccugcugaccaaggccggcgccgccgacgccccccugagacugagaagcauccacgaguaccccaaguaccaggccgaguuccccaugagccccgugaccagcgcccacgccggcaccuacagaugcuacggcagccugaacagcgaccccuaccugcugagccaccccagcgagccccuggagcugguggugagcggccccagcaugggcagcagccccccccccaccggccccaucagcacccccgccggccccgaggaccagccccugacccccaccggcagcgacccccagagcggccugggcagacaccugggcguggugaucggcauccugguggccguggugcugcugcugcugcugcugcugcugcuguuccugauccugagacacagaagacagggcaagcacuggaccagcacccagagaaaggccgacuuccagcaccccgccggcgccgugggccccgagcccaccgacagaggccugcaguggagaagcagccccgccgccgacgcccaggaggagaaccuguacgccgccgugaaggacacccagcccgaggacggcguggagauggacaccagagccgccgccagcgaggccccccaggacgugaccuacgcccagcugcacagccugacccugagaagaaaggccaccgagcccccccccagccaggagagagagccccccgccgagcccagcaucuacgccacccuggccauccacuaa

SEQ ID NO: 19269 - RNA, 1446 nt, Artificial Sequence
  LILRB3__Homo_sapiens__XP_006726238
augacccccgcccugaccgcccugcugugccugggccugagccugggccccagaaccagagugcaggccggccccuuccccaagcccacccugugggccgagcccggcagcgugaucagcuggggcagccccgugaccaucuggugccagggcagccuggaggcccaggaguaccagcuggacaaggagggcagccccgagccccuggacagaaacaacccccuggagcccaagaacaaggccagauucagcauccccagcaugacccagcaccacgccggcagauacagaugccacuacuacagcagcgccggcuggagcgagcccagcgacccccuggagcuggugaugaccggcuucuacaacaagcccacccugagcgcccugcccagccccgugguggccagcggcggcaacaugacccugagaugcggcagccagaagggcuaccaccacuucgugcugaugaaggagggcgagcaccagcugcccagaacccuggacagccagcagcugcacagcggcggcuuccaggcccuguuccccgugggccccgugacccccagccacagauggagauucaccugcuacuacuacuacaccaacacccccagaguguggagccaccccagcgacccccuggagauccugcccagcggcgugagcagaaagcccagccugcugacccugcagggccccgugcuggcccccggccagagccugacccugcagugcggcagcgacgugggcuacgacagauucgugcuguacaaggagggcgagagagacuuccugcagagacccggccagcagccccaggccggccugagccaggccaacuucacccugggccccgugagccccagccacggcggccaguacagaugcuacggcgcccacaaccugagcagcgaguggagcgcccccagcgacccccugaacauccugauggccggccagaucuacgacaccgugagccugagcgcccagcccggccccaccguggccagcggcgagaacgugacccugcugugccagagcagaggcuacuucgacaccuuccugcugaccaaggagggcgccgcccaccccccccugagacugagaagcauguacggcgcccacaaguaccaggccgaguuccccaugagccccgugaccagcgcccacgccggcaccuacagaugcuacggcagcuacagcagcaacccccaccugcugagcuuccccagcgagccccuggagcugauggugagcggccacagcggcggcagcagccugccccccaccggcccccccagcacccccgccagccacgccaaggacuacaccguggagaaccugaucagaaugggcauggccggccuggugcugguguuccugggcauccugcuguucgaggcccagcacagccagagaaacccccaggacgccgccggcagauaa

SEQ ID NO: 19270 - RNA, 1473 nt, Artificial Sequence
  LILRB4__Homo_sapiens__XP_011546956
auggagcagccccacgacgagaaggaccccgccagcaagagaccccaccccgugugccuguucgugcugcccgcccugagaacccaccccagcgcccagcugggcccccugggcggcgacgccaugauccccaccuucaccgcccugcugugccugggccugagccugggccccagaacccacaugcaggccggcccccugcccaagcccacccugugggccgagcccggcagcgugaucagcuggggcaacagcgugaccaucuggugccagggcacccuggaggccagagaguacagacuggacaaggaggagagccccgcccccugggacagacagaacccccuggagcccaagaacaaggccagauucagcauccccagcaugaccgaggacuacgccggcagauacagaugcuacuacagaagccccgugggcuggagccagcccagcgacccccuggagcuggugaugaccggcgccuacagcaagcccacccugagcgcccugcccagcccccuggugaccagcggcaagagcgugacccugcugugccagagcagaagccccauggacaccuuccugcugaucaaggagagagccgcccacccccugcugcaccugagaagcgagcacggcgcccagcagcaccaggccgaguuccccaugagccccgugaccagcgugcacggcggcaccuacagaugcuucagcagccacggcuucagccacuaccugcugagccaccccagcgacccccuggagcugaucgugagcggcagccuggaggaccccagacccagccccaccagaagcgugagcaccgccgccggccccgaggaccagccccugaugcccaccggcagcgugccccacagcggccugagaagacacugggaggugcugaucggcgugcugguggugagcauccugcugcugagccugcugcuguuccugcugcugcagcacuggagacagggcaagcacagaacccuggcccagagacaggccgacuuccagagaccccccggcgccgccgagcccgagcccaaggacggcggccugcagagaagaagcagccccgccgccgacgugcagggcgagaacuucagcggcgccgccgugaagaacacccagcccgaggacggcguggagauggacaccagacagagcccccacgacgaggacccccaggccgugaccuacgccaaggugaagcacagcagacccagaagagagauggccagcccccccagcccccugagcggcgaguuccuggacaccaaggacagacaggccgaggaggacagacagauggacaccgaggccgccgccagcgaggccccccaggacgugaccuacgcccagcugcacagcuucacccugagacagaaggccaccgagcccccccccagccaggagggcgccagccccgccgagcccagcguguacgccacccuggccauccacuaa

SEQ ID NO: 19271 - RNA, 1776 nt, Artificial Sequence
  LILRB5__Homo_sapiens__NP_001074911
augacccugacccugagcgugcugaucugccugggccugagcgugggccccagaaccugcgugcaggccggcacccugcccaagcccacccugugggccgagcccgccagcgugaucgccagaggcaagcccgugacccuguggugccagggcccccuggagaccgaggaguacagacuggacaaggagggccugcccugggccagaaagagacagaacccccuggagcccggcgccaaggccaaguuccacauccccagcaccguguacgacagcgccggcagauacagaugcuacuacgagacccccgccggcuggagcgagcccagcgacccccuggagcugguggccaccggcuucuacgccgagcccacccugcuggcccugcccagccccgugguggccagcggcggcaacgugacccugcagugcgacacccuggacggccugcugaccuucgugcugguggaggaggagcagaagcugcccagaacccuguacagccagaagcugcccaagggccccagccaggcccuguuccccgugggccccgugacccccagcugcagauggagauucagaugcuacuacuacuacagaaagaacccccagguguggagcaaccccagcgaccugcuggagauccuggugcccggcgugagcagaaagcccagccugcugaucccccagggcagcgugguggccagaggcggcagccugacccugcagugcagaagcgacgugggcuacgacaucuucgugcuguacaaggagggcgagcacgaccuggugcagggcagcggccagcagccccaggccggccugagccaggccaacuucacccugggccccgugagcagaagccacggcggccaguacagaugcuacggcgcccacaaccugagccccagauggagcgcccccagcgacccccuggacauccugaucgccggccugauccccgacauccccgcccugagcgugcagcccggccccaagguggccagcggcgagaacgugacccugcugugccagagcuggcaccagaucgacaccuucuuccugaccaaggagggcgccgcccaccccccccugugccugaagagcaaguaccagagcuacagacaccaggccgaguucagcaugagccccgugaccagcgcccagggcggcaccuacagaugcuacagcgccaucagaagcuaccccuaccugcugagcagccccagcuacccccaggagcugguggugagcggccccagcggcgaccccagccugagccccaccggcagcacccccacccccgccggccccgaggaccagccccugacccccaccggccuggacccccagagcggccugggcagacaccugggcguggugaccggcgugagcguggccuucgugcugcugcuguuccugcugcuguuccugcugcugagacacagacaccagagcaagcacagaaccagcgcccacuucuacagacccgccggcgccgccggccccgagcccaaggaccagggccugcagaagagagccagccccguggccgacauccaggaggagauccugaacgccgccgugaaggacacccagcccaaggacggcguggagauggacgccagagccgccgccagcgaggccccccaggacgugaccuacgcccagcugcacagccugacccugagaagagaggccaccgagcccccccccagccaggagagagagccccccgccgagcccagcaucuacgccccccuggccauccacuaa

SEQ ID NO: 19272 - RNA, 522 nt, Artificial Sequence
  LIM2__Homo_sapiens__NP_001155220
auguacagcuucaugggcggcggccuguucugcgccugggugggcaccauccugcuggugguggccauggccaccgaccacuggaugcaguacagacugagcggcagcuucgcccaccagggccuguggagauacugccugggcaacaagugcuaccugcagaccgacagcaucgccuacuggaacgccaccagagccuucaugauccugagcgcccugugcgccaucagcggcaucaucaugggcaucauggccuucgcccaccagcccaccuucagcagaaucagcagacccuucagcgccggcaucauguucuucagcagcacccuguucguggugcuggcccuggccaucuacaccggcgugaccgugagcuuccugggcagaagauucggcgacuggagauucagcuggagcuacauccugggcuggguggccgugcugaugaccuucuucgccggcaucuucuacaugugcgccuacagagugcacgagugcagaagacugagcacccccagauaa

SEQ ID NO: 19273 - RNA, 1374 nt, Artificial Sequence
  LIMA1__Homo_sapiens__NP_001230704
auggagcagaaggagaacgugccccccggccccgaggugugcaucacccaccaggagggcgagaagaucagcgccaacgagaacagccuggccgugagaagcacccccgccgaggacgacagcagagacagccaggugaagagcgaggugcagcagcccgugcaccccaagccccugagccccgacagcagagccagcagccugagcgagagcagcccccccaaggccaugaagaaguuccaggcccccgccagagagaccugcguggagugccagaagaccguguaccccauggagagacugcuggccaaccagcagguguuccacaucagcugcuucagaugcagcuacugcaacaacaagcugagccugggcaccuacgccagccugcacggcagaaucuacugcaagccccacuucaaccagcuguucaagagcaagggcaacuacgacgagggcuucggccacagaccccacaaggaccugugggccagcaagaacgagaacgaggagauccuggagagacccgcccagcuggccaacgccagagagaccccccacagccccggcguggaggacgcccccaucgccaaggugggcgugcuggccgccagcauggaggccaaggccagcagccagcaggagaaggaggacaagcccgccgagaccaagaagcugagaaucgccuggcccccccccaccgagcugggcagcagcggcagcgcccuggaggagggcaucaagaugagcaagcccaaguggccccccgaggacgagaucagcaagcccgaggugcccgaggacguggaccuggaccugaagaagcugagaagaagcagcagccugaaggagagaagcagacccuucaccguggccgccagcuuccagagcaccagcgugaagagccccaagaccgugagcccccccaucagaaagggcuggagcaugagcgagcagagcgaggagagcgugggcggcagaguggccgagagaaagcagguggagaacgccaaggccagcaagaagaacggcaacgugggcaagaccaccuggcagaacaaggagagcaagggcgagaccggcaagagaagcaaggagggccacagccuggagauggagaacgagaaccugguggagaacggcgccgacagcgacgaggacgacaacagcuuccugaagcagcagagcccccaggagcccaagagccugaacuggagcagcuucguggacaacaccuucgccgaggaguucaccacccagaaccagaagagccaggacguggagcugugggagggcgagguggugaaggagcugagcguggaggagcagaucaagagaaacagauacuacgacgaggacgaggacgaggaguaa

SEQ ID NO: 19274 - RNA, 3174 nt, Artificial Sequence
  LIMCH1__Homo_sapiens__NP_001106188
auggccugccccgcccugggccuggaggcccugcagccccugcagcccgagcccccccccgagcccgccuucagcgaggcccagaaguggaucgagcaggugaccggcagaagcuucggcgacaaggacuucagaaccggccuggagaacggcauccugcugugcgagcugcugaacgccaucaagcccggccuggugaagaagaucaacagacugcccacccccaucgccggccuggacaacaucauccuguuccugagaggcugcaaggagcugggccugaaggagagccagcuguucgaccccagcgaccugcaggacaccagcaacagagugaccgugaagagccuggacuacagcagaaagcugaagaacgugcuggugaccaucuacuggcugggcaaggccgccaacagcugcaccagcuacagcggcaccacccugaaccugaaggaguucgagggccugcuggcccagaugagaaaggacaccgacgacaucgagagccccaagagaagcaucagagacagcggcuacaucgacugcugggacagcgagagaagcgacagccugagcccccccagacacggcagagacgacagcuucgacagccuggacagcuucggcagcagaagcagacagacccccagccccgacguggugcugagaggcagcagcgacggcagaggcagcgacagcgagagcgaccugccccacagaaagcugcccgacgugaagaaggacgacaugagcgccagaagaaccagccacggcgagcccaagagcgccgugcccuucaaccaguaccugcccaacaagagcaaccagaccgccuacgugcccgccccccugagaaagaagaaggccgagagagaggaguacagaaagagcuggagcaccgccaccagcccccugggcggcgagagacccuucagauacggccccagaacccccgugagcgacgacgccgagagcaccagcauguucgacaugagaugcgaggaggaggccgccgugcagccccacagcagagccagacaggagcagcugcagcugaucaacaaccagcugagagaggaggacgacaaguggcaggacgaccuggccagauggaagagcagaagaagaagcgugagccaggaccugaucaagaaggaggaggagagaaagaagauggagaagcugcuggccggcgaggacggcaccagcgagagaagaaagagcaucaagaccuacagagagaucgugcaggagaaggagagaagagagagagagcugcacgaggccuacaagaacgccagaagccaggaggaggccgagggcauccugcagcaguacaucgagagauucaccaucagcgaggccgugcuggagagacuggagaugcccaagauccuggagagaagccacagcaccgagcccaaccugagcagcuuccugaacgaccccaaccccaugaaguaccugagacagcagagccugcccccccccaaguucaccgccaccguggagaccaccaucgccagagccagcgugcuggacaccagcaugagcgccggcagcggcagccccagcaagaccgugacccccaaggccgugcccaugcugacccccaagcccuacagccagcccaagaacagccaggacgugcugaagaccuucaagguggacggcaaggugagcgugaacggcgagaccgugcacagagaggaggagaaggagagagagugccccaccguggcccccgcccacagccugaccaagagccagauguucgagggcguggccagagugcacggcagcccccuggagcugaagcaggacaacggcagcaucgagaucaacaucaagaagcccaacagcgugccccaggagcuggccgccaccaccgagaagaccgagcccaacagccaggaggacaagaacgacggcggcaagagcagaaagggcaacaucgagcuggccagcagcgagccccagcacuucaccaccaccgugaccagaugcagccccaccguggccuucguggaguuccccagcagcccccagcugaagaacgacgugagcgaggagaaggaccagaagaagcccgagaacgagaugagcggcaagguggagcuggugcugagccagaagguggugaagcccaagagccccgagcccgaggccacccugaccuuccccuuccuggacaagaugcccgaggccaaccagcugcaccugcccaaccugaacagccagguggacagccccagcagcgagaagagccccgugaugaccccccaguucaaguucugggccugggaccccgaggaggagagaagaagacaggagaaguggcagcaggagcaggagagacugcugcaggagagauaccagaaggagcaggacaagcugaaggaggagugggagaaggcccagaaggagguggaggaggaggagagaagauacuacgaggaggagagaaagaucaucgaggacaccguggugcccuucaccgugagcagcagcagcgccgaccagcugagcaccagcagcagcaugaccgagggcagcggcaccaugaacaagaucgaccugggcaacugccaggacgagaagcaggacagaagauggaagaagagcuuccagggcgacgacagcgaccugcugcugaagaccagagagagcgacagacuggaggagaagggcagccugaccgagggcgcccuggcccacagcggcaaccccgugagcaagggcgugcacgaggaccaccagcuggacaccgaggccggcgccccccacugcggcaccaacccccagcuggcccaggaccccagccagaaccagcagaccagcaaccccacccacagcagcgaggacgugaagcccaagacccugccccuggacaagagcaucaaccaccagaucgagagccccagcgagagaagaaagagcaucagcggcaagaagcugugcagcagcugcggccugccccugggcaagggcgccgccaugaucaucgagacccugaaccuguacuuccacauccagugcuucagaugcggcaucugcaagggccagcugggcgacgccgugagcggcaccgacgugagaaucagaaacggccugcugaacugcaacgacugcuacaugagaagcagaagcgccggccagcccaccacccuguaa

SEQ ID NO: 19275 - RNA, 2031 nt, Artificial Sequence
  LIMD1__Homo_sapiens__NP_055055
auggacaaguacgacgaccugggccuggaggccagcaaguucaucgaggaccugaacauguacgaggccagcaaggacggccuguucagaguggacaagggcgccggcaacaaccccgaguucgaggagaccagaagaguguucgccaccaagauggccaagauccaccugcagcagcagcagcagcagcugcugcaggaggagacccugcccagaggcagcagaggccccgugaacggcggcggcagacugggcccccaggccagaugggagguggugggcagcaagcugaccguggacggcgccgccaagcccccccuggccgccagcaccggcgcccccggcgccgugaccacccuggccgccggccagccccccuaccccccccaggagcagagaagcagacccuaccugcacggcaccagacacggcagccaggacugcggcagcagagagagccuggccaccagcgagaugagcgccuuccaccagcccggccccugcgaggaccccagcugccugacccacggcgacuacuacgacaaccugagccuggccagccccaaguggggcgacaagcccggcgugagccccagcaucggccugagcgugggcagcggcuggcccagcagccccggcagcgaccccccccugcccaagcccugcggcgaccacccccugaaccacagacagcugagccugagcagcagcagaagcagcgagggcagccugggcggccagaacagcggcaucggcggcagaagcagcgagaagcccaccggccuguggagcaccgccagcagccagagagugagccccggccugcccagccccaaccuggagaacggcgcccccgccgugggccccgugcagcccagaacccccagcgugagcgccccccuggcccugagcugccccagacagggcggccugcccagaagcaacagcggccugggcggcgaggugagcggcgugaugagcaagcccaacguggacccccagcccugguuccaggacggccccaagagcuaccugagcagcagcgcccccagcagcagccccgccggccuggacggcagccagcagggcgccgugcccggccugggccccaagcccggcugcaccgaccugggcaccggccccaagcugagccccaccagccuggugcaccccgugaugagcacccugcccgagcugagcugcaaggagggcccccugggcuggagcagcgacggcagccugggcagcgugcugcuggacagccccagcagccccagagugagacugcccugccagccccuggugcccggccccgagcugagacccagcgccgccgagcugaagcuggaggcccugacccagagacuggagagagagauggacgcccaccccaaggccgacuacuucggcgccugcgugaagugcagcaagggcguguucggcgccggccaggccugccaggccaugggcaaccuguaccacgacaccugcuucaccugcgccgccugcagcagaaagcugagaggcaaggccuucuacuucgugaacggcaagguguucugcgaggaggacuuccuguacagcggcuuccagcagagcgccgacagaugcuuccugugcggccaccugaucauggacaugauccugcaggcccugggcaagagcuaccaccccggcugcuucagaugcgugaucugcaacgagugccuggacggcgugcccuucaccguggacagcgagaacaagaucuacugcgugagagacuaccacaaggugcuggcccccaagugcgccgccugcggccugcccauccugccccccgagggcagcgacgagaccaucagaguggugagcauggacagagacuaccacguggagugcuaccacugcgaggacugcggccuggagcugaacgacgaggacggccacagaugcuacccccuggaggaccaccuguucugccacagcugccacgugaagagacuggagaagagacccagcagcaccgcccugcaccagcaccacuucuaa

SEQ ID NO: 19276 - RNA, 384 nt, Artificial Sequence
  LIMD2__Homo_sapiens__NP_085053
auguuccaggccgccggcgccgcccaggccacccccagccacgacgccaagggcggcggcagcagcaccgugcagagaagcaagagcuucagccugagagcccaggugaaggagaccugcgccgccugccagaagaccguguaccccauggagagacugguggccgacaagcugaucuuccacaacagcugcuucugcugcaagcacugccacaccaagcugagccugggcagcuacgccgcccugcacggcgaguucuacugcaagccccacuuccagcagcuguucaagagcaagggcaacuacgacgagggcuucggcagaaagcagcacaaggagcugugggcccacaaggagguggaccccggcaccaagaccgccuaa

SEQ ID NO: 19277 - RNA, 1842 nt, Artificial Sequence
  LIMK1__Homo_sapiens__NP_001191355
augcugcuggccagcgcccccagaagaagaagauuccugcagagagccaagugcugcgacugcagcgccagccugagccaccaguacuacgagaaggacggccagcuguucugcaagaaggacuacugggccagauacggcgagagcugccacggcugcagcgagcagaucaccaagggccuggugaugguggccggcgagcugaaguaccaccccgagugcuucaucugccugaccugcggcaccuucaucggcgacggcgacaccuacacccugguggagcacagcaagcuguacugcggccacugcuacuaccagaccguggugacccccgugaucgagcagauccugcccgacagccccggcagccaccugccccacaccgugacccuggugagcauccccgccagcagccacggcaagagaggccugagcgugagcaucgaccccccccacggcccccccggcugcggcaccgagcacagccacaccgugagagugcagggcguggaccccggcugcaugagccccgacgugaagaacagcauccacgugggcgacagaauccuggagaucaacggcacccccaucagaaacgugccccuggacgagaucgaccugcugauccaggagaccagcagacugcugcagcugacccuggagcacgacccccacgacacccugggccacggccugggccccgagaccagcccccugagcagccccgccuacacccccagcggcgaggccggcagcagcgccagacagaagcccgugcugagaagcugcagcaucgacagaagccccggcgccggcagccugggcagccccgccagccagagaaaggaccugggcagaagcgagagccugagaguggugugcagaccccacagaaucuucagacccagcgaccugauccacggcgaggugcugggcaagggcugcuucggccaggccaucaaggugacccacagagagaccggcgaggugauggugaugaaggagcugaucagauucgacgaggagacccagagaaccuuccugaaggaggugaaggugaugagaugccuggagcaccccaacgugcugaaguucaucggcgugcuguacaaggacaagagacugaacuucaucaccgaguacaucaagggcggcacccugagaggcaucaucaagagcauggacagccaguaccccuggagccagagagugagcuucgccaaggacaucgccagcggcauggccuaccugcacagcaugaacaucauccacagagaccugaacagccacaacugccuggugagagagaacaagaacguggugguggccgacuucggccuggccagacugaugguggacgagaagacccagcccgagggccugagaagccugaagaagcccgacagaaagaagagauacaccguggugggcaaccccuacuggauggcccccgagaugaucaacggcagaagcuacgacgagaagguggacguguucagcuucggcaucgugcugugcgagaucaucggcagagugaacgccgaccccgacuaccugcccagaaccauggacuucggccugaacgugagaggcuuccuggacagauacugcccccccaacugcccccccagcuucuuccccaucaccgugagaugcugcgaccuggaccccgagaagagacccagcuucgugaagcuggagcacuggcuggagacccugagaaugcaccuggccggccaccugccccugggcccccagcuggagcagcuggacagaggcuucugggagaccuacagaagaggcgagagcggccugcccgcccaccccgaggugcccgacuaa

SEQ ID NO: 19278 - RNA, 2061 nt, Artificial Sequence
  LIMK2__Homo_sapiens__NP_001026971
augggcagcuaccugagcgugcccgccuacuucaccagcagagaccuguucagaugcagcgagugccaggacagccugaccaacugguacuacgagaaggacggcaagcuguacugccccaaggacuacuggggcaaguucggcgaguucugccacggcugcagccugcugaugaccggccccuucaugguggccggcgaguucaaguaccaccccgagugcuucgccugcaugagcugcaaggugaucaucgaggacggcgacgccuacgcccuggugcagcacgccacccuguacugcggcaagugccacaacgagguggugcuggcccccauguucgagagacugagcaccgagagcgugcaggagcagcugcccuacagcgugacccugaucagcaugcccgccaccaccgagggcagaagaggcuucagcgugagcguggagagcgccugcagcaacuacgccaccaccgugcaggugaaggaggugaacagaaugcacaucagccccaacaacagaaacgccauccaccccggcgacagaauccuggagaucaacggcacccccgugagaacccugagaguggaggagguggaggacgccaucagccagaccagccagacccugcagcugcugaucgagcacgaccccgugagccagagacuggaccagcugagacuggaggccagacuggccccccacaugcagaacgccggccacccccacgcccugagcacccuggacaccaaggagaaccuggagggcacccugagaagaagaagccugagaagaagcaacagcaucagcaagagccccggccccagcagccccaaggagccccugcuguucagcagagacaucagcagaagcgagagccugagaugcagcagcagcuacagccagcagaucuucagacccugcgaccugauccacggcgaggugcugggcaagggcuucuucggccaggccaucaaggugacccacaaggccaccggcaaggugauggugaugaaggagcugaucagaugcgacgaggagacccagaagaccuuccugaccgaggugaaggugaugagaagccuggaccaccccaacgugcugaaguucaucggcgugcuguacaaggacaagaagcugaaccugcugaccgaguacaucgagggcggcacccugaaggacuuccugagaagcauggaccccuuccccuggcagcagaaggugagauucgccaagggcaucgccagcggcauggccuaccugcacagcaugugcaucauccacagagaccugaacagccacaacugccugaucaagcuggacaagaccguggugguggccgacuucggccugagcagacugaucguggaggagagaaagagagcccccauggagaaggccaccaccaagaagagaacccugagaaagaacgacagaaagaagagauacaccguggugggcaaccccuacuggauggcccccgagaugcugaacggcaagagcuacgacgagaccguggacaucuucagcuucggcaucgugcugugcgagaucaucggccagguguacgccgaccccgacugccugcccagaacccuggacuucggccugaacgugaagcuguucugggagaaguucgugcccaccgacugcccccccgccuucuucccccuggccgccaucugcugcagacuggagcccgagagcagagccccccccggcgccgccggcgagggccccggcugcgccgacgacgagggccccgugagaagacagggcaaggugaccaucaaguacgaccccaaggagcugagaaagcaccugaaccuggaggaguggauccuggagcagcugaccagacuguacgacugccaggaggaggagaucagcgagcuggagaucgacguggacgagcugcuggacauggagagcgacgacgccugggccagcagagugaaggagcugcugguggacugcuacaagcccaccgaggccuucaucagcggccugcuggacaagaucagagccaugcagaagcugagcaccccccagaagaaguaa

SEQ ID NO: 19279 - RNA, 990 nt, Artificial Sequence
  LIMS1__Homo_sapiens__NP_001180411
augaccugcaacauggccaacgcccuggccagcgccaccugcgagagaugcaagggcggcuucgcccccgccgagaagaucgugaacagcaacggcgagcuguaccacgagcagugcuucgugugcgcccagugcuuccagcaguuccccgagggccuguucuacgaguucgagggcagaaaguacugcgagcacgacuuccagaugcuguucgcccccugcugccaccagugcggcgaguucaucaucggcagagugaucaaggccaugaacaacagcuggcaccccgagugcuucagaugcgaccugugccaggaggugcuggccgacaucggcuucgugaagaacgccggcagacaccugugcagacccugccacaacagagagaaggccagaggccugggcaaguacaucugccagaagugccacgccaucaucgacgagcagccccugaucuucaagaacgaccccuaccaccccgaccacuucaacugcgccaacugcggcaaggagcugaccgccgacgccagagagcugaagggcgagcuguacugccugcccugccacgacaagaugggcgugcccaucugcggcgccugcagaagacccaucgagggcagaguggugaacgccaugggcaagcaguggcacguggagcacuucgugugcgccaagugcgagaagcccuuccugggccacagacacuacgagagaaagggccuggccuacugcgagacccacuacaaccagcuguucggcgacgugugcuuccacugcaacagagugaucgagggcgacguggugagcgcccugaacaaggccuggugcgugaacugcuucgccugcagcaccugcaacaccaagcugacccugaagaacaaguucguggaguucgacaugaagcccgugugcaagaagugcuacgagaaguucccccuggagcugaagaagagacugaagaagcuggccgagacccugggcagaaaguaa

SEQ ID NO: 19280 - RNA, 1092 nt, Artificial Sequence
  LIMS2__Homo_sapiens__NP_001129509
augaccggcagaaagagaaaguggggcgagaccggcaccggcagcggcgccgcccccgccgccgcccugagauggagcaacaugagcgacgcccuggccaacgccgugugccagagaugccaggccagauucagccccgccgagagaaucgugaacagcaacggcgagcuguaccacgagcacugcuucgugugcgcccagugcuucagacccuuccccgagggccuguucuacgaguucgagggcagaaaguacugcgagcacgacuuccagaugcuguucgcccccugcugcggcagcugcggcgaguucaucaucggcagagugaucaaggccaugaacaacaacuggcaccccggcugcuucagaugcgagcugugcgacguggagcuggccgaccugggcuucgugaagaacgccggcagacaccugugcagacccugccacaacagagagaaggccaagggccugggcaaguacaucugccagagaugccaccuggugaucgacgagcagccccugauguucagaagcgacgccuaccaccccgaccacuucaacugcacccacugcggcaaggagcugaccgccgaggccagagagcugaagggcgagcuguacugccugcccugccacgacaagaugggcgugcccaucugcggcgccugcagaagacccaucgagggcagaguggugaacgcccugggcaagcaguggcacguggagcacuucgugugcgccaagugcgagaagcccuuccugggccacagacacuacgagaagaagggccuggccuacugcgagacccacuacaaccagcuguucggcgacgugugcuacaacugcagccacgugaucgagggcgacguggugagcgcccugaacaaggccuggugcgugagcugcuucagcugcagcaccugcaacagcaagcugacccugaagaacaaguucguggaguucgacaugaagcccgugugcaagagaugcuacgagaaguucccccuggagcugaagaagagacugaagaagcugagcgagcugaccagcagaaaggcccagcccaaggccaccgaccugaacagcgccuaa

SEQ ID NO: 19281 - RNA, 753 nt, Artificial Sequence
  LIN28B__Homo_sapiens__NP_001004317
auggccgagggcggcgccagcaagggcggcggcgaggagcccggcaagcugcccgagcccgccgaggaggagagccaggugcugagaggcaccggccacugcaagugguucaacgugagaaugggcuucggcuucaucagcaugaucaacagagagggcagcccccuggacauccccguggacguguucgugcaccagagcaagcuguucauggagggcuucagaagccugaaggagggcgagcccguggaguucaccuucaagaagagcagcaagggccuggagagcaucagagugaccggccccggcggcagccccugccugggcagcgagagaagacccaagggcaagacccugcagaagagaaagcccaagggcgacagaugcuacaacugcggcggccuggaccaccacgccaaggagugcagccugcccccccagcccaagaagugccacuacugccagagcaucaugcacaugguggccaacugcccccacaagaacguggcccagccccccgccagcagccagggcagacaggaggccgagagccagcccugcaccagcacccugcccagagaggugggcggcggccacggcugcaccagcccccccuucccccaggaggccagagccgagaucagcgagagaagcggcagaagcccccaggaggccagcagcaccaagagcagcaucgcccccgaggagcagagcaagaagggccccagcgugcagaagagaaagaagaccuaa

SEQ ID NO: 19282 - RNA, 351 nt, Artificial Sequence
  LIN52__Homo_sapiens__NP_001019845
augggcuggaagauggccagccccaccgacggcaccgaccuggaggccagccugcugagcuucgagaagcuggacagagccagccccgaccuguggcccgagcagcugcccggcguggccgaguucgccgccagcuucaagagccccaucaccagcagcccccccaaguggauggccgagaucgagagagacgacaucgacaugcugaaggagcugggcagccugaccaccgccaaccugauggagaaggugagaggccugcagaaccuggccuaccagcugggccuggacgagagcagagagaugaccagaggcaaguuccugaacauccuggagaagcccaagaaguaa

SEQ ID NO: 19283 - RNA, 702 nt, Artificial Sequence
  LIN7A__Homo_sapiens__NP_004655
augcugaagcccagcgugaccagcgcccccaccgccgacauggccacccugaccguggugcagccccugacccuggacagagacguggccagagccaucgagcugcuggagaagcugcaggagagcggcgaggugcccgugcacaagcugcagagccugaagaaggugcugcagagcgaguucugcaccgccaucagagagguguaccaguacaugcacgagaccaucaccgugaacggcugccccgaguucagagccagagccaccgccaaggccaccguggccgccuucgccgccagcgagggccacagccaccccagagugguggagcugcccaagaccgacgagggccugggcuucaacgugaugggcggcaaggagcagaacagccccaucuacaucagcagaaucauccccggcggcguggccgagagacacggcggccugaagagaggcgaccagcugcugagcgugaacggcgugagcguggagggcgagcaccacgagaaggccguggagcugcugaaggccgccaaggacagcgugaagcugguggugagauacacccccaaggugcuggaggagauggaggccagauucgagaagcugagaaccgccagaagaagacagcagcagcagcugcugauccagcagcagcagcagcagcagcagcagcagacccagcagaaccacaugagcuaa

SEQ ID NO: 19284 - RNA, 624 nt, Artificial Sequence
  LIN7B__Homo_sapiens__NP_071448
auggccgcccugguggagccccugggccuggagagagacgugagcagagccguggagcugcuggagagacugcagagaagcggcgagcugcccccccagaagcugcaggcccugcagagagugcugcagagcagauucugcagcgccaucagagagguguacgagcagcuguacgacacccuggacaucaccggcagcgccgagaucagagcccacgccaccgccaaggccaccguggccgccuucaccgccagcgagggccacgcccaccccagagugguggagcugcccaagaccgacgagggccugggcuucaacaucaugggcggcaaggagcagaacagccccaucuacaucagcagagugauccccggcggcguggccgacagacacggcggccugaagagaggcgaccagcugcugagcgugaacggcgugagcguggagggcgagcagcacgagaaggccguggagcugcugaaggccgcccagggcagcgugaagcugguggugagauacacccccagagugcuggaggagauggaggccagauucgagaagaugagaagcgccagaagaagacagcagcaccagagcuacagcagccuggagagcagaggcuaa

SEQ ID NO: 19285 - RNA, 594 nt, Artificial Sequence
  LIN7C__Homo_sapiens__NP_060832
auggccgcccugggcgagcccgugagacuggagagagacaucugcagagccaucgagcugcuggagaagcugcagagaagcggcgaggugcccccccagaagcugcaggcccugcagagagugcugcagagcgaguucugcaacgccgugagagagguguacgagcacguguacgagaccguggacaucagcagcagccccgaggugagagccaacgccaccgccaaggccaccguggccgccuucgccgccagcgagggccacagccaccccagagugguggagcugcccaagaccgaggagggccugggcuucaacaucaugggcggcaaggagcagaacagccccaucuacaucagcagaaucauccccggcggcaucgccgacagacacggcggccugaagagaggcgaccagcugcugagcgugaacggcgugagcguggagggcgagcaccacgagaaggccguggagcugcugaaggccgcccagggcaaggugaagcugguggugagauacacccccaaggugcuggaggagauggagagcagauucgagaagaugagaagcgccaagagaagacagcagaccuaa

SEQ ID NO: 19286 - RNA, 1572 nt, Artificial Sequence
  LIN9__Homo_sapiens__NP_001257338
augcacagaggcggccagccccugaagaagagaagaggcagcuucaagauggccgagcuggaccagcugcccgacgagagcagcagcgccaaggcccuggugagccugaaggagggcagccugagcaacaccuggaacgagaaguacagcagccugcagaagacccccguguggaagggcagaaacaccagcagcgccguggagaugaaguucaccgccaccaugagcacccccgacaagaaggccagccagaagaucggcuucagacugagaaaccugcugaagcugcccaaggcccacaaguggugcaucuacgagugguucuacagcaacaucgacaagccccuguucgagggcgacaacgacuucugcgugugccugaaggagagcuuccccaaccugaagaccagaaagcugaccagaguggaguggggcaagaucagaagacugaugggcaagcccagaagaugcagcagcgccuucuucgaggaggagagaagcgcccugaagcagaagagacagaagaucagacugcugcagcagagaaagguggccgacgugagccaguucaaggaccugcccgacgagaucccccugccccuggugaucggcaccaaggugaccgccagacugagaggcgugcacgacggccuguucaccggccagaucgacgccguggacacccugaacgccaccuacagagugaccuucgacagaaccggccugggcacccacaccauccccgacuacgaggugcugagcaacgagccccacgagaccaugcccaucgccgccuucggccagaagcagagacccagcagauucuucaugaccccccccagacugcacuacacccccccccugcagagccccaucaucgacaacgacccccugcugggccagagccccuggagaagcaagaucagcggcagcgacaccgagacccugggcggcuuccccguggaguuccugauccaggugaccagacugagcaagauccugaugaucaagaaggagcacaucaagaagcugagagagaugaacaccgaggccgagaagcugaagagcuacagcaugcccaucagcaucgaguuccagagaagauacgccaccaucgugcuggagcuggagcagcugaacaaggaccugaacaaggugcugcacaaggugcagcaguacugcuacgagcuggcccccgaccagggccugcagcccgccgaccagcccaccgacaugagaagaagaugcgaggaggaggcccaggagaucgugagacacgccaacagcagcaccggccagcccugcguggagaacgagaaccugaccgaccugaucagcagacugaccgccauccugcugcagaucaagugccuggccgagggcggcgaccugaacagcuucgaguucaagagccugaccgacagccugaacgacaucaagagcaccaucgacgccagcaacaucagcugcuuccagaacaacguggagauccacguggcccacauccagagcggccugagccagaugggcaaccugcacgccuucgccgccaacaacaccaacagagacuaa

SEQ ID NO: 19287 - RNA, 1845 nt, Artificial Sequence
  LINGO1__Homo_sapiens__NP_001288126
augcuggccggcggcgugagaagcaugcccagcccccugcuggccugcuggcagcccauccugcugcuggugcugggcagcgugcugagcggcagcgccaccggcugcccccccagaugcgagugcagcgcccaggacagagccgugcugugccacagaaagagauucguggccgugcccgagggcauccccaccgagaccagacugcuggaccugggcaagaacagaaucaagacccugaaccaggacgaguucgccagcuucccccaccuggaggagcuggagcugaacgagaacaucgugagcgccguggagcccggcgccuucaacaaccuguucaaccugagaacccugggccugagaagcaacagacugaagcugaucccccugggcguguucaccggccugagcaaccugaccaagcuggacaucagcgagaacaagaucgugauccugcuggacuacauguuccaggaccuguacaaccugaagagccuggaggugggcgacaacgaccugguguacaucagccacagagccuucagcggccugaacagccuggagcagcugacccuggagaagugcaaccugaccagcauccccaccgaggcccugagccaccugcacggccugaucgugcugagacugagacaccugaacaucaacgccaucagagacuacagcuucaagagacuguacagacugaaggugcuggagaucagccacuggcccuaccuggacaccaugacccccaacugccuguacggccugaaccugaccagccugagcaucacccacugcaaccugaccgccgugcccuaccuggccgugagacaccugguguaccugagauuccugaaccugagcuacaaccccaucagcaccaucgagggcagcaugcugcacgagcugcugagacugcaggagauccagcuggugggcggccagcuggccgugguggagcccuacgccuucagaggccugaacuaccugagagugcugaacgugagcggcaaccagcugaccacccuggaggagagcguguuccacagcgugggcaaccuggagacccugauccuggacagcaacccccuggccugcgacugcagacugcuguggguguucagaagaagauggagacugaacuucaacagacagcagcccaccugcgccacccccgaguucgugcagggcaaggaguucaaggacuuccccgacgugcugcugcccaacuacuucaccugcagaagagccagaaucagagacagaaaggcccagcagguguucguggacgagggccacaccgugcaguucgugugcagagccgacggcgaccccccccccgccauccuguggcugagccccagaaagcaccuggugagcgccaagagcaacggcagacugaccguguuccccgacggcacccuggaggugagauacgcccaggugcaggacaacggcaccuaccugugcaucgccgccaacgccggcggcaacgacagcaugcccgcccaccugcacgugagaagcuacagccccgacuggccccaccagcccaacaagaccuucgccuucaucagcaaccagcccggcgagggcgaggccaacagcaccagagccaccgugcccuuccccuucgacaucaagacccugaucaucgccaccaccaugggcuucaucagcuuccugggcguggugcuguucugccuggugcugcuguuccuguggagcagaggcaagggcaacaccaagcacaacaucgagaucgaguacgugcccagaaagagcgacgccggcaucagcagcgccgacgcccccagaaaguucaacaugaagaugaucuaa

SEQ ID NO: 19288 - RNA, 1821 nt, Artificial Sequence
  LINGO2__Homo_sapiens__XP_011516032
augcugcacaccgccaucagcugcuggcagcccuuccugggccuggccguggugcugaucuucaugggcagcaccaucggcugccccgccagaugcgagugcagcgcccagaacaagagcgugagcugccacagaagaagacugaucgccauccccgagggcauccccaucgagaccaagauccuggaccugagcaagaacagacugaagagcgugaaccccgaggaguucaucagcuacccccugcuggaggagaucgaccugagcgacaacaucaucgccaacguggagcccggcgccuucaacaaccuguucaaccugagaagccugagacugaagggcaacagacugaagcuggugccccugggcguguucaccggccugagcaaccugaccaagcuggacaucagcgagaacaagaucgugauccugcuggacuacauguuccaggaccugcacaaccugaagagccuggaggugggcgacaacgaccugguguacaucagccacagagccuucagcggccugcugagccuggagcagcugacccuggagaagugcaaccugaccgccgugcccaccgaggcccugagccaccugagaagccugaucagccugcaccugaagcaccugaacaucaacaacaugcccguguacgccuucaagagacuguuccaccugaagcaccuggagaucgacuacuggccccugcuggacaugaugcccgccaacagccuguacggccugaaccugaccagccugagcgugaccaacaccaaccugagcaccgugcccuuccuggccuucaagcaccugguguaccugacccaccugaaccugagcuacaaccccaucagcaccaucgaggccggcauguucagcgaccugaucagacugcaggagcugcacaucgugggcgcccagcugagaaccaucgagccccacagcuuccagggccugagauuccugagagugcugaacgugagccagaaccugcuggagacccuggaggagaacguguucagcagccccagagcccuggaggugcugagcaucaacaacaacccccuggccugcgacugcagacugcuguggauccugcagagacagcccacccugcaguucggcggccagcagcccaugugcgccggccccgacaccaucagagagagaagcuucaaggacuuccacagcaccgcccugagcuucuacuucaccugcaagaagcccaagaucagagagaagaagcugcagcaccugcugguggacgagggccagaccgugcagcuggagugcagcgccgacggcgacccccagcccgugaucagcugggugacccccagaagaagauucaucaccaccaagagcaacggcagagccaccgugcugggcgacggcacccuggagaucagauucgcccaggaccaggacagcggcauguacgugugcaucgccagcaacgccgccggcaacgacaccuucaccgccagccugaccgugaagggcuucgccagcgacagauuccuguacgccaacagaacccccauguacaugaccgacagcaacgacaccaucagcaacggcaccaacgccaacaccuucagccuggaccugaagaccauccuggugagcaccgccaugggcugcuucaccuuccugggcguggugcuguucugcuuccugcugcuguucguguggagcagaggcaagggcaagcacaagaacagcaucgaccuggaguacgugcccagaaagaacaacggcgccgugguggagggcgagguggccggccccagaagauucaacaugaagaugaucuaa

SEQ ID NO: 19289 - RNA, 1782 nt, Artificial Sequence
  LINGO4__Homo_sapiens__NP_001004432
auggacgccgccaccgcccccaagcaggccuggccccccuggcccccccugcuguuccugcugcugcugcccggcggcagcggcggcagcugccccgccgugugcgacugcaccagccagccccaggccgugcugugcggccacagacagcuggaggccgugcccggcggccugccccuggacaccgagcugcuggaccugagcggcaacagacuguggggccugcagcagggcaugcugagcagacugagccugcugcaggagcuggaccugagcuacaaccagcugagcacccuggagcccggcgccuuccacggccugcagagccugcugacccugagacugcagggcaacagacugagaaucaugggccccggcguguucagcggccugagcgcccugacccugcuggaccugagacugaaccagaucgugcuguuccuggacggcgccuucggcgagcugggcagccugcagaagcuggaggugggcgacaaccaccugguguucguggcccccggcgccuucgccggccuggccaagcugagcacccugacccuggagagaugcaaccugagcaccgugcccggccuggcccuggccagacugcccgcccugguggcccugagacugagagagcuggacaucggcagacugcccgccggcgcccugagaggccugggccagcugaaggagcuggagauccaccuguggcccagccuggaggcccuggaccccggcagccuggugggccugaaccugagcagccuggccaucaccagaugcaaccugagcagcgugcccuuccaggcccuguaccaccugagcuuccugagagugcuggaccugagccagaaccccaucagcgccauccccgccagaagacugagcccccuggugagacugcaggagcugagacugagcggcgccugccugaccagcaucgccgcccacgccuuccacggccugaccgccuuccaccugcuggacguggccgacaacgcccugcagacccuggaggagaccgccuuccccagccccgacaagcuggugacccugagacugagcggcaacccccugaccugcgacugcagacugcuguggcugcugagacugagaagacaccuggacuucggcaugagcccccccgccugcgccggcccccaccacgugcagggcaagagccugaaggaguucagcgacauccugccccccggccacuucaccugcaagcccgcccugaucagaaagagcggccccagaugggugaucgccgaggagggcggccacgccguguucagcugcagcggcgacggcgaccccgcccccaccgugagcuggaugagaccccacggcgccuggcugggcagagccggcagagugagagugcuggaggacggcacccuggagaucagaagcgugcagcugagagacagaggcgccuacgugugcguggugagcaacguggccggcaacgacagccugagaaccuggcuggaggugauccagguggagccccccaacggcacccugagcgaccccaacaucaccgugcccggcauccccggccccuucuuccuggacagcagaggcguggccauggugcuggccgugggcuuccugcccuuccugaccagcgugacccugugcuucggccugaucgcccuguggagcaagggcaagggcagagugaagcaccacaugaccuucgacuucguggcccccagacccagcggcgacaagaacagcggcggcaacagagugaccgccaagcuguucuaa

SEQ ID NO: 19290 - RNA, 2274 nt, Artificial Sequence
  LINS__Homo_sapiens__NP_001035706
augaagguguucugcgaggugcuggaggagcuguacaagaaggugcugcugggcgccacccuggagaacgacagccacgacuacaucuucuaccugaaccccgccgugagcgaccaggacugcagcaccgccaccagccuggagugggccaacaccugcggcauccagggcagacaccagcccaucagcgugggcguggcccccaucgccguggcccccgugugccugaagaccaacagccagaugagcggcagcagagaggugaugcugcugcagcugaccgugaucaaggugaugaccaccagaauccugagcgugaagaccgaguuccacgccaaggagcaguacagagacgugaucaagauccugcuggagagcgccaagguggacagcaagcugaucugcauguuccagaacagcgacaagcugcugagccacauggccgcccagugccuggcccugcugcuguacuuccagcugagagagaagaucacccugagcaacagcuggaucgccuucugccagaagaaccugagcgaguacagcgagagcaacaaggccaucuacugccuguggacccugaccgccaucaucaaggagaucuucaaggacagcugcagccagaagaccgagauccugaagcaguuccugacccacuucgacaccaucuucgagguguucuacaacagccuguucagccagcacuucgagaacugcagagacaccagcaagaucgugaacauccugaugugcuuccuggaccugcuggagcugcugaucgccagcagaauccaccugaagcugcacuucaccugccagagaauccuguuccugaagcccagcugcaugcuggaggugaucaccuggcccauccaggccuucgugaagagaaaggugaucaucuuccugaagaagugccugcugugcaaggugggcgaggaccugugcagaggcagcgugcccgcccugaugccccccgaccaccacguggccguggacaugcuggcccuggccaacgccgugcugcaggccgugaacagcggccugcugaagacccugagcguguacgagaagcacagcuucuucggcggcgacgaggugcagcccgagugcgagcugaucaccagccccgaccacgugauccugagagccgccagccuggugaucaugaagagccuggagaucaaguuccagaacuacagcagcgccagcgagaugaagguggaccugcagagauucaugagcgagcugcugaccuuccugaagccccaccugcagcccagccugcagcugcacaaccccugcaaguggcugagcagaguguucaucgagcaggacgacgacaugcuggaggccgccaaggccagccugggcaucuaccugacccugaccagaggcugcgaggccaccgagagccugacccagggcaaggagaugugggaccaccacacccacgagaacggcuacaacccccacugcaucuuccuguucuuccugaagaacaucggcuucgacagcaccgugcugcuggacuuccugaucagcagcgagaccugcuuccuggaguacuucgugagauaccugaagcugcugcagaaggacugggacaacuucuucaccaucugcaacaacuucgacgccaccgagagcaaguacgacaucagcaucugcggcugcgugcccagccuggugcaggaccagagcagcaaccagaccaucccccacagacugaccgccccccacagccacagagacgugugcgccagacacagcugggccagcgacgcccccagcgagccccugaaggccgugaugagcaagggcgcccacaccaugugcgccagcagccugagcagccccagagccagccagagccugguggacuacgacagcagcgacgacagcgacguggagagcaccgagcagugccuggccaacagcaagcagaccagccugcaccagcaggccaccaaggagauccaggacgccgccggcaccagcagagacaagaaggaguucagccuggagccccccagcagaccccuggugcugaaggaguucgacaccgccuucagcuucgacugcgagguggcccccaacgacguggugagcgaggugggcaucuucuacagaaucgugaagugcuuccaggagcugcaggacgccaucugcagacugcagaagaagaaccuguuccccuacaaccccaccgcccugcugaagcugcugaaguacaucgaggugaucagcaacaagaccaugaacacccuguaa

SEQ ID NO: 19291 - RNA, 1200 nt, Artificial Sequence
  LIPA__Homo_sapiens__NP_000226
augaagaugagauuccugggccugguggugugccuggugcuguggacccugcacagcgagggcagcggcggcaagcugaccgccguggaccccgagaccaacaugaacgugagcgagaucaucagcuacuggggcuuccccagcgaggaguaccugguggagaccgaggacggcuacauccugugccugaacagaaucccccacggcagaaagaaccacagcgacaagggccccaagcccgugguguuccugcagcacggccugcuggccgacagcagcaacugggugaccaaccuggccaacagcagccugggcuucauccuggccgacgccggcuucgacguguggaugggcaacagcagaggcaacaccuggagcagaaagcacaagacccugagcgugagccaggacgaguucugggccuucagcuacgacgagauggccaaguacgaccugcccgccagcaucaacuucauccugaacaagaccggccaggagcagguguacuacgugggccacagccagggcaccaccaucggcuucaucgccuucagccagauccccgagcuggccaagagaaucaagauguucuucgcccugggccccguggccagcguggccuucugcaccagccccauggccaagcugggcagacugcccgaccaccugaucaaggaccuguucggcgacaaggaguuccugccccagagcgccuuccugaaguggcugggcacccacgugugcacccacgugauccugaaggagcugugcggcaaccugugcuuccugcugugcggcuucaacgagagaaaccugaacaugagcagaguggacguguacaccacccacagccccgccggcaccagcgugcagaacaugcugcacuggagccaggccgugaaguuccagaaguuccaggccuucgacuggggcagcagcgccaagaacuacuuccacuacaaccagagcuacccccccaccuacaacgugaaggacaugcuggugcccaccgccguguggagcggcggccacgacuggcuggccgacguguacgacgugaacauccugcugacccagaucaccaaccugguguuccacgagagcauccccgagugggagcaccuggacuucaucuggggccuggacgcccccuggagacuguacaacaagaucaucaaccugaugagaaaguaccaguaa

SEQ ID NO: 19292 - RNA, 1500 nt, Artificial Sequence
  LIPC__Homo_sapiens__XP_005254429
auggacaccagcccccugugcuucagcauccugcuggugcugugcaucuucauccagagcagcgcccugggccagagccugaagcccgagcccuucggcagaagagcccaggccguggagaccaacaagacccugcacgagaugaagaccagauuccugcuguucggcgagaccaaccagggcugccagaucagaaucaaccaccccgacacccugcaggagugcggcuucaacagcagccugccccuggugaugaucauccacggcuggagcguggacggcgugcuggagaacuggaucuggcagaugguggccgcccugaagagccagcccgcccagcccgugaacgugggccugguggacuggaucacccuggcccacgaccacuacaccaucgccgugagaaacaccagacuggugggcaaggagguggccgcccugcugagauggcuggaggagagcgugcagcugagcagaagccacgugcaccugaucggcuacagccugggcgcccacgugagcggcuucgccggcagcagcaucggcggcacccacaagaucggcagaaucaccggccuggacgccgccggcccccuguucgagggcagcgcccccagcaacagacugagccccgacgacgccaacuucguggacgccauccacaccuucaccagagagcacaugggccugagcgugggcaucaagcagcccaucggccacuacgacuucuaccccaacggcggcagcuuccagcccggcugccacuuccuggagcuguacagacacaucgcccagcacggcuucaacgccaucacccagaccaucaagugcagccacgagagaagcgugcaccuguucaucgacagccugcugcacgccggcacccagagcauggccuaccccugcggcgacaugaacagcuucagccagggccugugccugagcugcaagaagggcagaugcaacacccugggcuaccacgugagacaggagcccagaagcaagagcaagagacuguuccuggugaccagagcccagagccccuucaagguguaccacuaccaguucaagauccaguucaucaaccagaccgagacccccauccagaccaccuucaccaugagccugcugggcaccaaggagaagaugcagaagauccccaucacccugggcaagggcaucgccagcaacaagaccuacagcuuccugaucacccuggacguggacaucggcgagcugaucaugaucaaguucaagugggagaacagcgccgugugggccaacgugugggacaccgugcagaccaucauccccuggagcaccggccccagacacagcggccuggugcugaagaccaucagagugaaggccggcgagacccagcagagaaugaccuucugcagcgagaacaccgacgaccugcugcugagacccacccaggagaagaucuucgugaagugcgagaucaagagcaagaccagcaagagaaagaucagauaa

SEQ ID NO: 19293 - RNA, 3231 nt, Artificial Sequence
  LIPE__Homo_sapiens__NP_005348
auggagcccggcagcaagagcgugagcagaagcgacuggcagcccgagccccaccagagacccaucaccccccuggagcccggccccgagaagacccccaucgcccagcccgagagcaagacccugcagggcagcaacacccagcagaagcccgccagcaaccagagaccccugacccagcaggagacccccgcccagcacgacgccgagagccagaaggagcccagagcccagcagaagagcgccagccaggaggaguuccuggccccccagaagcccgccccccagcagagccccuacauccagagagugcugcugacccagcaggaggccgccagccagcagggccccggccugggcaaggagagcaucacccagcaggagcccgcccugagacagagacacguggcccagcccggccccggccccggcgagcccccccccgcccagcaggaggccgagagcacccccgccgcccaggccaagcccggcgccaagagagagcccagcgcccccaccgagagcaccagccaggagacccccgagcagagcgacaagcagaccacccccgugcagggcgccaagagcaagcagggcagccugaccgagcugggcuuccugaccaagcugcaggagcugagcauccagagaagcgcccuggaguggaaggcccugagcgagugggugaccgacagcgagagcgagagcgacgugggcagcagcagcgacaccgacagccccgccaccaugggcggcaugguggcccagggcgugaagcugggcuucaagggcaagagcggcuacaaggugaugagcggcuacagcggcaccagcccccacgagaagaccagcgccagaaaccacagacacuaccaggacaccgccagcagacugauccacaacauggaccugagaaccaugacccagagccuggugacccuggccgaggacaacaucgccuucuucagcagccagggccccggcgagaccgcccagagacugagcggcguguucgccggcgugagagagcaggcccugggccuggagcccgcccugggcagacugcugggcguggcccaccuguucgaccuggaccccgagacccccgccaacggcuacagaagccuggugcacaccgccagaugcugccuggcccaccugcugcacaagagcagauacguggccagcaacagaagaagcaucuucuucagaaccagccacaaccuggccgagcuggaggccuaccuggccgcccugacccagcugagagcccugguguacuacgcccagagacugcuggugaccaacagacccggcgugcuguucuucgagggcgacgagggccugaccgccgacuuccugagagaguacgugacccugcacaagggcugcuucuacggcagaugccugggcuuccaguucacccccgccaucagacccuuccugcagaccaucagcaucggccuggugagcuucggcgagcacuacaagagaaacgagaccggccugagcguggccgccagcagccuguucaccagcggcagauucgccaucgaccccgagcugagaggcgccgaguucgagagaaucacccagaaccuggacgugcacuucuggaaggccuucuggaacaucaccgagauggaggugcugagcagccuggccaacauggccagcgccaccgugagagugagcagacugcugagccugccccccgaggccuucgagaugccccugaccgccgaccccacccugaccgugaccaucagccccccccuggcccacaccggccccggccccgugcuggugagacugaucagcuacgaccugagagagggccaggacagcgaggagcugagcagccugaucaagagcaacggccagagaagccuggagcuguggcccagaccccagcaggcccccagaagcagaagccugaucgugcacuuccacggcggcggcuucguggcccagaccagcagaagccacgagcccuaccugaagagcugggcccaggagcugggcgcccccaucaucagcaucgacuacagccuggcccccgaggcccccuuccccagagcccuggaggagugcuucuucgccuacugcugggccaucaagcacugcgcccugcugggcagcaccggcgagagaaucugccuggccggcgacagcgccggcggcaaccugugcuucaccguggcccugagagccgccgccuacggcgugagagugcccgacggcaucauggccgccuaccccgccaccaugcugcagcccgccgccagccccagcagacugcugagccugauggacccccugcugccccugagcgugcugagcaagugcgugagcgccuacgccggcgccaagaccgaggaccacagcaacagcgaccagaaggcccugggcaugaugggccuggugagaagagacaccgcccugcugcugagagacuucagacugggcgccagcagcuggcugaacagcuuccuggagcugagcggcagaaagagccagaagaugagcgagcccaucgccgagcccaugagaagaagcgugagcgaggccgcccuggcccagccccagggcccccugggcaccgacagccugaagaaccugacccugagagaccugagccugagaggcaacagcgagaccagcagcgacacccccgagaugagccugagcgccgagacccugagccccagcacccccagcgacgugaacuuccugcugccccccgaggacgccggcgaggaggccgaggccaagaacgagcugagccccauggacagaggccugggcgugagagccgccuuccccgagggcuuccaccccagaagaagcagccagggcgccacccagaugccccuguacagcagccccaucgugaagaaccccuucaugagcccccugcuggcccccgacagcaugcugaagagccugccccccgugcacaucguggccugcgcccuggaccccaugcuggacgacagcgugaugcuggccagaagacugagaaaccugggccagcccgugacccugagagugguggaggaccugccccacggcuuccugacccuggccgcccugugcagagagaccagacaggccgccgagcugugcguggagagaaucagacuggugcugaccccccccgccggcgccggccccagcggcgagaccggcgccgccggcguggacggcggcugcggcggcagacacuaa

SEQ ID NO: 19294 - RNA, 1098 nt, Artificial Sequence
  LIPF__Homo_sapiens__NP_001185757
auguggcugcugcugaccauggccagccugaucagcgugcugggcaccacccacggccuguucggcaagcugcaccccggcagccccgaggugaccaugaacaucagccagaugaucaccuacuggggcuaccccaacgaggaguacgagguggugaccgaggacggcuacauccuggaggugaacagaauccccuacggcaagaagaacagcggcaacaccgacgccggcuacgacguguggcugggcaacagcagaggcaacaccugggccagaagaaaccuguacuacagccccgacagcguggaguucugggccuucagcuucgacgagauggccaaguacgaccugcccgccaccaucgacuucaucgugaagaagaccggccagaagcagcugcacuacgugggccacagccagggcaccaccaucggcuucaucgccuucagcaccaaccccagccuggccaagagaaucaagaccuucuacgcccuggcccccguggccaccgugaaguacaccaagagccugaucaacaagcugagauucgugccccagagccuguucaaguucaucuucggcgacaagaucuucuacccccacaacuucuucgaccaguuccuggccaccgaggugugcagcagagagaugcugaaccugcugugcagcaacgcccuguucaucaucugcggcuucgacagcaagaacuucaacaccagcagacuggacguguaccugagccacaaccccgccggcaccagcgugcagaacauguuccacuggacccaggccgugaagagcggcaaguuccaggccuacgacuggggcagccccgugcagaacagaaugcacuacgaccagagccagccccccuacuacaacgugaccgccaugaacgugcccaucgccguguggaacggcggcaaggaccugcuggccgacccccaggacgugggccugcugcugcccaagcugcccaaccugaucuaccacaaggagauccccuucuacaaccaccuggacuucaucugggccauggacgccccccaggagguguacaacgacaucgugagcaugaucagcgaggacaagaaguaa

SEQ ID NO: 19295 - RNA, 1503 nt, Artificial Sequence
  LIPG__Homo_sapiens__NP_006024
augagcaacagcgugccccugcugugcuucuggagccugugcuacugcuucgccgccggcagccccgugcccuucggccccgagggcagacuggaggacaagcugcacaagcccaaggccacccagaccgaggugaagcccagcgugagauucaaccugagaaccagcaaggaccccgagcacgagggcugcuaccugagcgugggccacagccagccccuggaggacugcagcuucaacaugaccgccaagaccuucuucaucauccacggcuggaccaugagcggcaucuucgagaacuggcugcacaagcuggugagcgcccugcacaccagagagaaggacgccaacgugguggugguggacuggcugccccuggcccaccagcuguacaccgacgccgugaacaacaccagaguggugggccacagcaucgccagaaugcuggacuggcugcaggagaaggacgacuucagccugggcaacgugcaccugaucggcuacagccugggcgcccacguggccggcuacgccggcaacuucgugaagggcaccgugggcagaaucaccggccuggaccccgccggccccauguucgagggcgccgacauccacaagagacugagccccgacgacgccgacuucguggacgugcugcacaccuacaccagaagcuucggccugagcaucggcauccagaugcccgugggccacaucgacaucuaccccaacggcggcgacuuccagcccggcugcggccugaacgacgugcugggcagcaucgccuacggcaccaucaccgagguggugaagugcgagcacgagagagccgugcaccuguucguggacagccuggugaaccaggacaagcccagcuucgccuuccagugcaccgacagcaacagauucaagaagggcaucugccugagcugcagaaagaacagaugcaacagcaucggcuacaacgccaagaagaugagaaacaagagaaacagcaagauguaccugaagaccagagccggcaugcccuucagaguguaccacuaccagaugaagauccacguguucagcuacaagaacaugggcgagaucgagcccaccuucuacgugacccuguacggcaccaacgccgacagccagacccugccccuggagaucguggagagaaucgagcagaacgccaccaacaccuuccugguguacaccgaggaggaccugggcgaccugcugaagauccagcugaccugggagggcgccagccagagcugguacaaccuguggaaggaguucagaagcuaccugagccagcccagaaaccccggcagagagcugaacaucagaagaaucagagugaagagcggcgagacccagagaaagcugaccuucugcaccgaggaccccgagaacaccagcaucagccccggcagagagcugugguucagaaagugcagagacggcuggagaaugaagaacgagaccagccccaccguggagcugcccuaa

SEQ ID NO: 19296 - RNA, 1356 nt, Artificial Sequence
  LIPH__Homo_sapiens__NP_640341
augcugagauucuaccuguucaucagccugcugugccugagcagaagcgacgccgaggagaccugccccagcuucaccagacugagcuuccacagcgccguggugggcaccggccugaacgugagacugaugcuguacaccagaaagaaccugaccugcgcccagaccaucaacagcagcgccuucggcaaccugaacgugaccaagaagaccaccuucaucgugcacggcuucagacccaccggcagcccccccguguggauggacgaccuggugaagggccugcugagcguggaggacaugaacgugguggugguggacuggaacagaggcgccaccacccugaucuacacccacgccagcagcaagaccagaaagguggccauggugcugaaggaguucaucgaccagaugcuggccgagggcgccagccuggacgacaucuacaugaucggcgugagccugggcgcccacaucagcggcuucgugggcgagauguacgacggcuggcugggcagaaucaccggccuggaccccgccggcccccuguucaacggcaagccccaccaggacagacuggaccccagcgacgcccaguucguggacgugauccacagcgacaccgacgcccugggcuacaaggagccccugggcaacaucgacuucuaccccaacggcggccuggaccagcccggcugccccaagaccauccugggcggcuuccaguacuucaagugcgaccaccagagaagcguguaccuguaccugagcagccugagagagagcugcaccaucaccgccuaccccugcgacagcuaccaggacuacagaaacggcaagugcgugagcugcggcaccagccagaaggagagcugcccccugcugggcuacuacgccgacaacuggaaggaccaccugagaggcaaggacccccccaugaccaaggccuucuucgacaccgccgaggagagccccuucugcauguaccacuacuucguggacaucaucaccuggaacaagaacgugagaagaggcgacaucaccaucaagcugagagacaaggccggcaacaccaccgagagcaagaucaaccacgagcccaccaccuuccagaaguaccaccaggugagccugcuggccagauucaaccaggaccuggacaagguggccgccaucagccugauguucagcaccggcagccugaucggccccagauacaagcugagaauccugagaaugaagcugagaagccuggcccaccccgagagaccccagcugugcagauacgaccuggugcugauggagaacguggagaccguguuccagcccauccugugccccgagcugcagcuguaa

SEQ ID NO: 19297 - RNA, 1383 nt, Artificial Sequence
  LIPI__Homo_sapiens__NP_001289927
augagaguguacaucuuccugugccugaugugcugggugagaagcgacaacaagagacccugccuggaguucagccagcugagcgugaaggacagcuucagagaccuguucauccccagaaucgagaccauccugaugauguacaccagaaacaaccugaacugcgccgagccccuguucgagcagaacaacagccugaacgugaacuucaacacccagaagaagaccguguggcugauccacggcuacagacccgugggcagcaucccccuguggcugcagaacuucgugagaauccugcugaacgaggaggacaugaacgugaucgugguggacuggagcagaggcgccaccaccuucaucuacaacagagccgugaagaacaccagaaagguggccgugagccugagcgugcacaucaagaaccugcugaagcacggcgccagccuggacaacuuccacuucaucggcgugagccugggcgcccacaucagcggcuucgugggcaagaucuuccacggccagcugggcagaaucaccggccuggaccccgccggccccagauucagcagaaagccccccuacagcagacuggacuacaccgacgccaaguucguggacgugauccacagcgacagcaacggccugggcauccaggagccccugggccacaucgacuucuaccccaacggcggcaacaagcagcccggcugccccaagagcaucuucagcggcauccaguucaucaagugcaaccaccagagagccgugcaccuguucauggccagccuggagaccaacugcaacuucaucagcuuccccugcagaagcuacaaggacuacaagaccagccugugcguggacugcgacugcuucaaggagaagagcugccccagacugggcuaccaggccaagcuguucaagggcgugcugaaggagagaauggagggcagaccccugagaaccaccguguuccuggacaccagcggcaccuaccccuucugcaccuacuacuucgugcugagcaucaucgugcccgacaagaccaugauggacggcagcuucagcuucaagcugcugaaccagcugggcaugaucgaggagcccagacuguacgagaagaacaagcccuucuacaagcugcaggaggugaagauccuggcccaguucuacaacgacuucgugaacaucagcagcaucggccugaccuacuuccagagcagcaaccugcagugcagcaccugcaccuacaagauccagagccugaugcugaagagccugaccuaccccgagagacccccccugugcagauacaacaucgugcugaaggacagagaggagguguuccugaaccccaacaccugcacccccaagaacaccuaa

SEQ ID NO: 19298 - RNA, 1197 nt, Artificial Sequence
  LIPN__Homo_sapiens__NP_001095939
augauguggcugcugcugaccaccaccugccugaucugcggcacccugaacgccggcggcuuccuggaccuggagaacgaggugaaccccgagguguggaugaacaccagcgagaucaucaucuacaacggcuaccccagcgaggaguacgaggugaccaccgaggacggcuacauccugcuggugaacagaauccccuacggcagaacccacgccagaagcaccggccccagacccgugguguacaugcagcacgcccuguucgccgacaacgccuacuggcuggagaacuacgccaacggcagccugggcuuccugcuggccgacgccggcuacgacguguggaugggcaacagcagaggcaacaccuggagcagaagacacaagacccugagcgagaccgacgagaaguucugggccuucagcuucgacgagauggccaaguacgaccugcccggcgugaucgacuucaucgugaacaagaccggccaggagaagcuguacuucaucggccacagccugggcaccaccaucggcuucguggccuucagcaccaugcccgagcuggcccagagaaucaagaugaacuucgcccugggccccaccaucagcuucaaguaccccaccggcaucuucaccagauucuuccugcugcccaacagcaucaucaaggccguguucggcaccaagggcuucuuccuggaggacaagaagaccaagaucgccagcaccaagaucugcaacaacaagauccuguggcugaucugcagcgaguucaugagccugugggccggcagcaacaagaagaacaugaaccagagcagaauggacguguacaugagccacgcccccaccggcagcagcgugcacaacauccugcacaucaagcagcuguaccacagcgacgaguucagagccuacgacuggggcaacgacgccgacaacaugaagcacuacaaccagagccacccccccaucuacgaccugaccgccaugaaggugcccaccgccaucugggccggcggccacgacgugcuggugaccccccaggacguggccagaauccugccccagaucaagagccugcacuacuucaagcugcugcccgacuggaaccacuucgacuucguguggggccuggacgccccccagagaauguacagcgagaucaucgcccugaugaaggccuacagcuaa

SEQ ID NO: 19299 - RNA, 1122 nt, Artificial Sequence
  LIPT1__Homo_sapiens__NP_057013
augcugauccccuucagcaugaagaacugcuuccagcugcugugcaacugccaggugcccgccgccggcuucaagaagaccgugaagaacggccugauccugcagagcaucagcaacgacguguaccagaaccuggccguggaggacuggauccacgaccacaugaaccuggagggcaagcccauccuguucuucuggcagaacagccccagcguggugaucggcagacaccagaaccccuggcaggagugcaaccugaaccugaugagagaggagggcaucaagcuggccagaagaagaagcggcggcggcaccguguaccacgacaugggcaacaucaaccugaccuucuucaccaccaagaagaaguacgacagaauggagaaccugaagcugaucgugagagcccugaacgccgugcagccccagcuggacgugcaggccaccaagagauucgaccugcugcuggacggccaguucaagaucagcggcaccgccagcaagaucggcagaaccaccgccuaccaccacugcacccugcugugcagcaccgacggcaccuuccugagcagccugcugaagagccccuaccagggcaucagaagcaacgccaccgccagcauccccagccuggugaagaaccugcuggagaaggaccccacccugaccugcgaggugcugaugaacgccguggccaccgaguacgccgccuaccaccagaucgacaaccacauccaccugaucaaccccaccgacgagacccuguuccccggcaucaacagcaaggccaaggagcugcagaccugggaguggaucuacggcaagacccccaaguucagcaucaacaccagcuuccacgugcuguacgagcagagccaccuggagaucaagguguucaucgacaucaagaacggcagaaucgagaucugcaacaucgaggcccccgaccacuggcugccccuggagaucagagacaagcugaacagcagccugaucggcagcaaguucugccccaccgagaccaccaugcugaccaacauccugcugagaaccugcccccaggaccacaagcugaacagcaaguggaacauccugugcgagaagaucaagggcaucauguaa

SEQ ID NO: 19300 - RNA, 696 nt, Artificial Sequence
  LIPT2__Homo_sapiens__NP_001138341
augagacagcccgccgugagacuggugagacugggcagagugcccuacgccgagcugcugggccugcaggacagauggcugagaagacugcaggccgagcccggcaucgaggcccccagcggcaccgaggccggcgcccugcugcugugcgagcccgccggccccguguacaccgccggccugagaggcggccugacccccgaggagaccgccagacugagagcccugggcgccgaggugagagugaccggcagaggcggccuggccaccuuccacggccccggccagcugcugugccaccccgugcuggaccugagaagacugggccugagacugagaaugcacguggccagccuggaggccugcgccgugagacugugcgagcugcagggccugcaggacgccagagccagacccccccccuacaccggcguguggcuggacgacagaaagaucugcgccaucggcgugagaugcggcagacacaucaccagccacggccuggcccugaacugcagcaccgaccugaccugguucgagcacaucgugcccugcggccuggugggcaccggcgugaccagccugagcaaggagcugcagagacacgugaccguggaggaggugaugccccccuuccugguggccuucaaggagaucuacaagugcacccugaucagcgaggacagccccaacuaa

SEQ ID NO: 19301 - RNA, 459 nt, Artificial Sequence
  LITAF__Homo_sapiens__NP_001129945
augagcgugcccggccccuaccaggccgccaccggccccagcagcgcccccagcgccccccccagcuacgaggagaccguggccgugaacagcuacuaccccaccccccccgcccccaugcccggccccaccaccggccuggugaccggccccgacggcaagggcaugaacccccccagcuacuacacccagcccgcccccauccccaacaacaaccccaucaccgugcagaccguguacgugcagcaccccaucaccuuccuggacagacccauccagaugugcugccccagcugcaacaagaugaucgugagccagcugagcuacaacgccggcgcccugaccuggcugagcugcggcagccugugccugcugggccaggagugcagcggcaccaucguggcccugagaagcuucgaccugcugggcagcugcaacccccccagcagcgccagcuaa

SEQ ID NO: 19302 - RNA, 849 nt, Artificial Sequence
  LIX1__Homo_sapiens__NP_694966
auggacagaacccuggagagccugagacacaucaucgcccaggugcugccccacagagaccccgcccugguguucaaggaccugaacguggugagcaugcugcaggaguucugggagagcaagcagcagcagaaggccgccuuccccagcgagggcguggugguguacgagagccugcccgcccccggcccccccuucgugagcuacgugacccugcccggcggcagcugcuucggcaacuuccagugcugccugagcagagccgaggccagaagagacgccgccaagguggcccugaucaacagccuguucaacgagcugcccagcagaagaaucaccaaggaguucaucauggagagcgugcaggaggccguggccagcaccagcggcacccuggacgacgccgacgaccccagcaccagcgugggcgccuaccacuacaugcuggagagcaacaugggcaagaccaugcuggaguuccaggagcugaugaccaucuuccagcugcugcacuggaacggcagccugaaggcccugagagagaccaagugcagcagacaggaggugaucagcuacuacagccaguacagccuggacgagaagaugagaagccacauggcccuggacuggaucaugaaggagagagacagccccggcaucgugagccaggagcugagaauggcccugagacagcuggaggaggccagaaaggccggccaggagcugagauucuacaaggagaagaaggagauccugagccuggcccugacccagaucugcagcgaccccgacaccagcagccccagcgacgaccagcugagccugaccgcccugugcggcuaccacuaa

SEQ ID NO: 19303 - RNA, 3195 nt, Artificial Sequence
  LLGL1__Homo_sapiens__NP_004131
augaugaaguucagauucagaagacagggcgccgacccccagagagagaagcugaagcaggagcuguucgccuucaacaagaccguggagcacggcuuccccaaccagcccagcgcccuggccuucgaccccgagcugagaaucauggccaucggcaccagaagcggcgccgugaagaucuacggcgcccccggcguggaguucaccggccugcacagagacgccgccaccgugacccagaugcacuuccugaccggccagggcagacugcugagccugcuggacgacagcagccugcaccugugggagaucgugcaccacaacggcugcgcccaccuggaggaggcccugagcuuccagcugcccagcagacccggcuucgacggcgccagcgccccccugagccugaccagagugaccguggugcugcugguggccgccggcgacaucgccgcccugggcaccgagggcagcagcguguucuuccuggacgugaccacccugacccugcuggagggccagacccuggcccccggcgaggugcugagaagcgugcccgacgacuacagaugcggcaaggcccugggccccguggagagccugcagggccaccugagagaccccaccaagauccugaucggcuacagcagaggccugcuggugaucuggaaccaggccagccagugcguggaccacaucuuccugggcaaccagcagcuggagagccugugcuggggcagagacagcagcaccguggugagcagccacagcgacggcagcuacgccguguggagcguggacgccggcagcuuccccacccugcagcccaccguggccaccacccccuacggccccuuccccugcaaggccaucaacaagauccuguggagaaacugcgagagcggcggccacuucaucaucuucagcggcggcaugcccagagccagcuacggcgacagacacugcgugagcgugcugagagccgagacccuggugacccuggacuucaccagcagaaucaucgacuucuucaccgugcacagcaccagacccgaggacgaguucgacgacccccaggcccuggccgugcugcuggaggaggagcugguggugcuggaccugcagacccccggcuggcccgccgugcccgcccccuaccuggccccccugcacagcagcgccaucaccugcagcgcccacguggccagcgugcccgccaagcugugggccagaaucgugagcgccggcgagcagcagagcccccagcccgugagcagcgcccugagcuggcccaucaccggcggcagaaaccuggcccaggagcccagccagagaggccugcugcugaccggccacgaggacggcaccgugagauucugggacgccagcggcguggcccugagaccccuguacaagcugagcaccgccggccuguuccagaccgacugcgagcacgccgacagccuggcccaggccgccgaggacgacuggccccccuucagaaaggugggcugcuucgaccccuacagcgacgaccccagacugggcgugcagaagguggcccugugcaaguacaccgcccagauggugguggccggcaccgccggccaggugcuggugcuggagcugagcgacgugcccguggagcaggccgugagcguggccaucaucgaccugcugcaggacagagagggcuucaccuggaagggccacgagagacugagccccagaaccggcccccugcccuggcccgccggcuuccagcccagagugcuggugcagugccugccccccgccgccgugaccgccgugacccugcacaccgaguggagccugguggccuucggcaccagccacggcuucggccuguucgacuaccagagaaagagccccgugcuggccagaugcacccugcaccccaacgacagccuggccauggagggcccccugagcagagugaagagccugaagaagagccugagacagagcuucagaagaaucagaaagagcagagugagcggcaagaagagagccgccaacgccagcagcaagcugcaggaggccaacgcccagcuggccgagcaggccugcccccacgacguggagaugacccccgugcagagaagaaucgagcccagaagcgccgacgacagccugagcggcguggugagaugccuguacuucgccgacaccuuccugagagacggcgcccaccacggccccaccaugugggccggcaccaacagcggcagcguguucgccuacgcccuggaggugcccgccgccgccgugggcggcgagaagagacccgagcaggccguggaggccgugcugggcaaggaggugcagcugaugcacagagcccccgugguggccaucgccgugcuggacggcagaggcagaccccugcccgagcccuacgaggccagcagagaccuggcccaggcccccgacaugcagggcggccacgccgugcugaucgccagcgaggagcaguucaagguguucacccugcccaaggugagcgccaagaccaaguucaagcugaccgcccacgagggcugcagagugagaaagguggcccuggccaccuucgccagcguggccugcgaggacuacgccgagaccugccuggccugccugaccaaccugggcgacgugcacguguucagcgugcccggccugagaccccaggugcacuacagcugcaucagaaaggaggacaucagcggcaucgccagcugcguguucaccagacacggccagggcuucuaccugaucagccccagcgaguucgagagauucagccugagcgccagaaacaucaccgagccccugugcagccuggacaucaacuggcccagagacgccacccaggccagcuacagaaucagagagagccccaagcugagccaggccaacggcacccccagcauccugcuggccccccagagccuggacggcagccccgaccccgcccacagcaugggccccgacacccccgagccccccgaggccgcccugagccccaugagcaucgacagcgccaccagcgccgacaccacccuggacaccaccggcgacgugaccguggaggacgugaaggacuuccugggcagcagcgaggagagcgagaagaaccugagaaaccuggccgaggacgaggcccacgccugcgccauccugaucaaguaa

SEQ ID NO: 19304 - RNA, 1071 nt, Artificial Sequence
  LLGL2__Homo_sapiens__NP_001015002
augagaagauuccugagacccggccacgaccccgugagagagagacugaagagagaccuguuccaguucaacaagaccguggagcacggcuucccccaccagcccagcgcccugggcuacagccccagccugagaauccuggccaucggcaccagaagcggcgccaucaagcuguacggcgcccccggcguggaguucaugggccugcaccaggagaacaacgccgugacccagauccaccugcugcccggccagugccagcuggugacccugcuggacgacaacagccugcaccuguggagccugaaggugaagggcggcgccagcgagcugcaggaggacgagagcuucacccugagaggcccccccggcgccgcccccagcgccacccagaucaccguggugcugccccacagcagcugcgagcugcuguaccugggcaccgagagcggcaacguguucguggugcagcugcccgccuucagagcccuggaggacagaaccaucagcagcgacgccgugcugcagagacugcccgaggaggccagacacagaagaguguucgagaugguggaggcccugcaggagcaccccagagaccccaaccagauccugaucggcuacagcagaggccugguggugaucugggaccugcagggcagcagagugcuguaccacuuccugagcagccagcagcuggagaacaucugguggcagagagacggcagacugcuggugagcugccacagcgacggcagcuacugccaguggcccgugagcagcgaggcccagcagcccgagccccugagaagccuggugcccuacggccccuuccccugcaaggccaucaccagaauccuguggcugaccaccagacagggccugcccuucaccaucuuccagggcggcaugcccagagccagcuacggcgacagacacugcaucagcgugauccacgacggccagcagaccgccuucgacuucaccagcagagugaucggcuucaccgugcugaccgaggccgaccccgccgccagcagaagagccagcggcgugggcgcccagggcuaa

SEQ ID NO: 19305 - RNA, 1533 nt, Artificial Sequence
  LMAN1__Homo_sapiens__NP_005561
auggccggcagcagacagagaggccugagagccagagugagaccccuguucugcgcccugcugcugagccugggcagauucgugagaggcgacggcgugggcggcgaccccgccguggcccugccccacagaagauucgaguacaaguacagcuucaagggcccccaccuggugcagagcgacggcaccgugcccuucugggcccacgccggcaacgccauccccagcagcgaccagaucagaguggcccccagccugaagagccagagaggcagcguguggaccaagaccaaggccgccuucgagaacugggagguggaggugaccuucagagugaccggcagaggcagaaucggcgccgacggccuggccaucugguacgccgagaaccagggccuggagggccccguguucggcagcgccgaccuguggaacggcgugggcaucuucuucgacagcuucgacaacgacggcaagaagaacaaccccgccaucgugaucaucggcaacaacggccagauccacuacgaccaccagaacgacggcgccagccaggcccuggccagcugccagagagacuucagaaacaagcccuaccccgugagagccaagaucaccuacuaccagaacacccugaccgugaugaucaacaacggcuucacccccgacaagaacgacuacgaguucugcgccaagguggagaacaugaucauccccgcccagggccacuucggcaucagcgccgccaccggcggccuggccgacgaccacgacgugcugagcuuccugaccuuccagcugaccgagcccggcaaggagccccccacccccgacaaggagaucagcgagaaggagaaggagaaguaccaggaggaguucgagcacuuccagcaggagcuggacaagaagaaggaggaguuccagaagggccaccccgaccugcagggccagcccgccgaggagaucuucgagagcgugggcgacagagagcugagacagguguucgagggccagaacagaauccaccuggagaucaagcagcugaacagacagcuggacaugauccuggacgagcagagaagauacgugagcagccugaccgaggagaucagcaagagaggcgccggcaugcccggccagcacggccagaucacccagcaggagcuggacaccguggugaagacccagcacgagauccugagacaggugaacgagaugaagaacagcaugagcgagaccgugagacuggugagcggcaugcagcaccccggcagcgccggcggcguguacgagaccacccagcacuucaucgacaucaaggagcaccugcacaucgugaagagagacaucgacaaccuggugcagagaaacaugcccagcaacgagaagcccaagugccccgagcugccccccuuccccagcugccugagcaccgugcacuucaucaucuucgugguggugcagaccgugcuguucaucggcuacaucauguacagaagccagcaggaggccgccgccaagaaguucuucuaa

SEQ ID NO: 19306 - RNA, 1581 nt, Artificial Sequence
  LMAN1L__Homo_sapiens__NP_068591
augcccgccgugagcggccccggcccccuguucugccugcugcugcugcugcuggacccccacagccccgagaccggcugccccccccugagaagauucgaguacaagcugagcuucaagggccccagacuggcccugcccggcgccggcauccccuucuggagccaccacggcgacgccauccugggccuggaggaggugagacugacccccagcaugagaaacagaagcggcgccguguggagcagagccagcgugcccuucagcgccugggagguggaggugcagaugagagugaccggccugggcagaagaggcgcccagggcauggccgugugguacaccagaggcagaggccacgugggcagcgugcugggcggccuggccagcugggacggcaucggcaucuucuucgacagccccgccgaggacacccaggacagccccgccaucagagugcuggccagcgacggccacauccccagcgagcagcccggcgacggcgccagccagggccugggcagcugccacugggacuucagaaacagaccccaccccuucagagccagaaucaccuacuggggccagagacugagaaugagccugaacagcggccugacccccagcgaccccggcgaguucugcguggacgugggcccccugcugcuggugcccggcggcuucuucggcgugagcgccgccaccggcacccuggccgacgaccacgacgugcugagcuuccugaccuucagccugagcgagcccagccccgaggugcccccccagcccuuccuggagaugcagcagcugagacuggccagacagcuggagggccugugggccagacugggccugggcaccagagaggacgugacccccaagagcgacagcgaggcccagggcgagggcgagagacuguucgaccuggaggagacccugggcagacacagaagaauccugcaggcccugagaggccugagcaagcagcuggcccaggccgagagacaguggaagaagcagcugggcccccccggccaggccagacccgacggcggcugggcccuggacgccagcugccagauccccagcacccccggcagaggcggccaccugagcaugagccugaacaaggacagcgccaaggugggcgcccugcugcacggccaguggacccugcugcaggcccugcaggagaugagagacgccgccgugagaauggccgccgaggcccaggugagcuaccugcccgugggcaucgagcaccacuuccuggagcuggaccacauccugggccugcugcaggaggagcugagaggccccgccaaggccgccgccaaggcccccagaccccccggccagccccccagagccagcagcugccugcagcccggcaucuuccuguucuaccugcugauccagaccgugggcuucuucggcuacgugcacuucagacaggagcugaacaagagccugcaggagugccugagcaccggcagccugccccugggccccgccccccacacccccagagcccugggcauccugagaagacagccccugcccgccagcaugcccgccuaa

SEQ ID NO: 19307 - RNA, 1080 nt, Artificial Sequence
  LMAN2L__Homo_sapiens__NP_001135764
auggccgccacccugggcccccugggcagcuggcagcaguggagaagaugccugagcgccagagacggcagcagaaugcugcugcugcugcugcugcugggcagcggccagggcccccagcaggugggcgccggccagaccuucgaguaccugaagagagagcacagccugagcaagcccuaccagggcgugggcaccggcagcagcagccuguggaaccugaugggcaacgccauggugaugacccaguacaucagacugacccccgacaugcagagcaagcagggcgcccuguggaacagagugcccugcuuccugagagacugggagcugcaggugcacuucaagauccacggccagggcaagaagaaccugcacggcgacggccuggccaucugguacaccaaggacagaaugcagcccggccccguguucggcaacauggacaaguucgugggccugggcguguucguggacaccuaccccaacgaggagaagcagcaggaggcccagaagagaagauacagccccggcgugcagagaguguuccccuacaucagcgccauggugaacaacggcagccugagcuacgaccacgagagagacggcagacccaccgagcugggcggcugcaccgccaucgugagaaaccugcacuacgacaccuuccuggugaucagauacgugaagagacaccugaccaucaugauggacaucgacggcaagcacgaguggagagacugcaucgaggugcccggcgugagacugcccagaggcuacuacuucggcaccagcagcaucaccggcgaccugagcgacaaccacgacgugaucagccugaagcuguucgagcugaccguggagagaacccccgaggaggagaagcugcacagagacguguuccugcccagcguggacaacaugaagcugcccgagaugaccgccccccugcccccccugagcggccuggcccuguuccugaucguguucuucagccugguguucagcguguucgccaucgugaucggcaucauccuguacaacaaguggcaggagcagagcagaaagagauucuacuaa

SEQ ID NO: 19308 - RNA, 1473 nt, Artificial Sequence
  LMBR1__Homo_sapiens__NP_071903
auggagggccaggacgaggugagcgccagagagcagcacuuccacagccaggugagagagagcaccaucugcuuccugcuguucgccauccuguacguggugagcuacuucaucaucaccagauacaagagaaagagcgacgagcaggaggacgaggacgccaucgugaacagaaucagccuguuccugagcaccuucacccuggccgugagcgccggcgccgugcugcugcugcccuucagcaucaucagcaacgagauccugcugagcuucccccagaacuacuacauccaguggcugaacggcagccugauccacggccuguggaaccuggccagccuguucagcaaccugugccuguucgugcugaugcccuucgccuucuucuuccuggagagcgagggcuucgccggccugaagaagggcaucagagccagaauccuggagacccuggugaugcugcugcugcuggcccugcugauccugggcaucguguggguggccagcgcccugaucgacaacgacgccgccagcauggagagccuguacgaccugugggaguucuaccugcccuaccuguacagcugcaucagccugaugggcugccugcugcugcugcugugcacccccgugggccugagcagaauguucaccgugaugggccagcugcuggugaagcccaccauccuggaggaccuggacgagcagaucuacaucaucacccuggaggaggaggcccugcagagaagacugaacggccugagcagcagcguggaguacaacaucauggagcuggagcaggagcuggagaacgugaagacccugaagaccaagcuggagagaagaaagaaggccagcgccugggagagaaaccugguguaccccgccgugauggugcugcugcugaucgagaccagcaucagcgugcugcugguggccugcaacauccugugccugcugguggacgagaccgccaugcccaagggcaccagaggccccggcaucggcaacgccagccugagcaccuucggcuucgugggcgccgcccuggagaucauccugaucuucuaccugauggugagcagcguggugggcuucuacagccugagauucuucggcaacuucacccccaagaaggacgacaccaccaugaccaagaucaucggcaacugcgugagcauccuggugcugagcagcgcccugcccgugaugagcagaacccugggcaucaccagauucgaccugcugggcgacuucggcagauucaacuggcugggcaacuucuacaucgugcugagcuacaaccugcuguucgccaucgugaccacccugugccuggugagaaaguucaccagcgccgugagagaggagcuguucaaggcccugggccugcacaagcugcaccugcccaacaccagcagagacagcgagaccgccaagcccagcgugaacggccaccagaaggcccuguaa

SEQ ID NO: 19309 - RNA, 1623 nt, Artificial Sequence
  LMBRD1__Homo_sapiens__NP_060838
auggccaccagcggcgccgccagcgccgagcuggugaucggcuggugcaucuucggccugcugcugcuggccauccuggccuucugcuggaucuacgugagaaaguaccagagcagaagagagagcgagguggugagcaccaucaccgccaucuucagccuggccaucgcccugaucaccagcgcccugcugcccguggacaucuuccuggugagcuacaugaagaaccagaacggcaccuucaaggacugggccaacgccaacgugagcagacagaucgaggacaccgugcuguacggcuacuacacccuguacagcgugauccuguucugcguguucuucuggauccccuucguguacuucuacuacgaggagaaggacgacgacgacaccagcaagugcacccagaucaagaccgcccugaaguacacccugggcuucguggugaucugcgcccugcugcugcuggugggcgccuucgugccccugaacgugcccaacaacaagaacagcaccgagugggagaaggugaagagccuguucgaggagcugggcagcagccacggccuggccgcccugagcuucagcaucagcagccugacccugaucggcaugcuggccgccaucaccuacaccgccuacggcaugagcgcccugccccugaaccugaucaagggcaccagaagcgccgccuacgagagacuggagaacaccgaggacaucgaggagguggagcagcacauccagaccaucaagagcaagagcaaggacggcagaccccugcccgccagagacaagagagcccugaagcaguucgaggagagacugagaacccugaagaagagagagagacaccuggaguucaucgagaacagcugguggaccaaguucugcggcgcccugagaccccugaagaucguguggggcaucuucuucauccugguggcccugcuguucgugaucagccuguuccugagcaaccuggacaaggcccugcacagcgccggcaucgacagcggcuucaucaucuucggcgccaaccugagcaacccccugaacaugcugcugccccugcugcagaccguguucccccuggacuacauccugaucaccaucaucaucauguacuucaucuucaccagcauggccggcaucagaaacaucggcaucugguucuucuggaucagacuguacaagaucagaagaggcagaaccagaccccaggcccugcuguuccugugcaugauccugcugcugaucgugcugcacaccagcuacaugaucuacagccuggccccccaguacgugauguacggcagccagaacuaccugaucgagaccaacaucaccagcgacaaccacaagggcaacagcacccugagcgugcccaagagaugcgacgccgacgcccccgaggaccagugcaccgugaccagaaccuaccuguuccugcacaaguucugguucuucagcgccgccuacuacuucggcaacugggccuuccugggcguguuccugaucggccugaucgugagcugcugcaagggcaagaagagcgugaucgagggcguggacgaggacagcgacaucagcgacgacgagcccagcguguacagcgccuaa

SEQ ID NO: 19310 - RNA, 2088 nt, Artificial Sequence
  LMBRD2__Homo_sapiens__NP_001007528
augagcggcgccgcccugggccuggagaucguguucguguucuuccuggcccuguuccugcugcacagauacggcgacuucaagaagcagcacagacuggugaucaucggcacccugcuggccugguaccugugcuuccugaucguguucauccugccccuggacgugagcaccaccaucuacaacagaugcaagcacgccgccgccaacagcagcccccccgagaacagcaacaucaccggccuguacgccaccgccaaccccgugcccagccagcaccccugcuucaagcccuggagcuacauccccgacggcaucaugcccaucuucuggagagugguguacuggaccagccaguuccugaccuggauccugcugcccuucaugcagagcuacgccagaagcggcggcuucagcaucaccggcaagaucaagaccgcccugaucgagaacgccaucuacuacggcaccuaccugcugaucuucggcgccuuccugaucuacguggccgugaacccccaccugcaccuggaguggaaccagcugcagaccaucggcaucgccgccgccaacaccuggggccuguuccugcuggugcugcugcugggcuacggccugguggagauccccagaagcuacuggaacggcgccaagagaggcuaccugcugaugaagaccuacuucaaggccgccaagcugaugaccgagaaggccgacgccgaggagaaccuggaggacgccauggaggaggugagaaaggugaacgagagcaucaaguacaaccacccccugagaaagugcguggacaccauccugaagaagugccccaccgaguaccaggagaagaugggcagaaacauggacgacuacgaggacuucgacgagaagcacagcaucuaccccagcgagaagagccuggugaagcugcacaagcaggugaucuacagcgugcagagacacagaagaacccaggugcaguggcagauccugcuggagcaggccuucuaccuggaggacguggccaagaacgagaccagcgccacccaccaguucgugcacaccuuccagagccccgagcccgagaacagauucauccaguacuucuacaaccccaccuucgagugguacugggagugccugcugagacccugguucuacaagauccuggccguggugcugagcaucuucagcgugaucgugguguggagcgagugcaccuucuucagcaccacccccgugcugagccuguucgccguguucauccagcuggccgagaagaccuacaacuacaucuacaucgagaucgccugcuuccugagcaucuucuuccugagcaucugcguguacagcaccguguucagaaucagaguguucaacuacuacuaccuggccagccaccaccagaccgacgccuacagccugcuguucagcggcaugcuguucugcagacugacccccccccugugccugaacuuccugggccugacccacauggacagcagcaucagccacaagaacacccagcccaccgccuacaccagcaucaugggcagcaugaaggugcugagcuucaucgccgacggcuucuacaucuacuaccccaugcugguggugauccugugcaucgccaccuacuucagccugggcaccagaugccugaaccugcugggcuuccagcaguucaugggcgacgacgacaugaccagcgaccuggugaacgagggcaaggagcugaucagaaaggagaagagaaagagacagagacaggaggagggcgagaacagaagaagagaguggaaggagagauacggccacaacagagaggacagcaccagaaacagaaacauccacaccgaccccaaggagagcaacuucagcgacgugaacaccaacagaagcgccuucaaguacaccagagccaacaacagaaccgagagagacagaaucgagcugcugcaggacgccgagccccuggacuucaacgccgagaccuucaccgacgacccccuggagagcgagagcggcagauaccagcccggcggcagauaccugagcaugagcagaagcgacaucuucaacgacguguaa

SEQ ID NO: 19311 - RNA, 879 nt, Artificial Sequence
  LMCD1__Homo_sapiens__NP_001265162
auggacagcaaguacagcacccugaccgccagagugaagggcggcgacggcaucagaaucuacaagagaaacagaaugaucaugaccaaccccaucgccaccggcaaggaccccaccuucgacaccaucaccuacgagugggccccccccggcgugacccagaagcugggccugcaguacauggagcugauccccaaggagaagcagcccgugaccggcaccgagggcgccuucuacagaagaagacagcugaugcaccagcugcccaucuacgaccaggaccccagcagaugcagaggccugcuggagaacgagcugaagcugauggaggaguucgugaagcaguacaagagcgaggcccugggcgugggcgagguggcccugcccggccagggcggccugcccaaggaggagggcaagcagcaggagaagcccgagggcgccgagaccaccgccgccaccaccaacggcagccugagcgaccccagcaaggagguggaguacgugugcgagcugugcaagggcgccgccccccccgacagccccgugguguacagcgacagagccggcuacaacaagcaguggcaccccaccugcuucgugugcgccaagugcagcgagccccugguggaccugaucuacuucuggaaggacggcgcccccuggugcggcagacacuacugcgagagccugagacccagaugcagcggcugcgacgagaucaucuucgccgaggacuaccagagaguggaggaccuggccuggcacagaaagcacuucgugugcgagggcugcgagcagcugcugagcggcagagccuacaucgugaccaagggccagcugcugugccccaccugcagcaagagcaagagaagcuaa

SEQ ID NO: 19312 - RNA, 1704 nt, Artificial Sequence
  LMF1__Homo_sapiens__NP_073610
augagacccgacagccccaccauggccgcccccgccgagagccugagaagaagaaagaccggcuacagcgaccccgagcccgagagcccccccgcccccggcagaggccccgccggcagccccgcccaccugcacaccggcaccuucuggcugaccagaaucgugcugcugaaggcccuggccuucguguacuucguggccuuccugguggccuuccaccagaacaagcagcugaucggcgacagaggccugcugcccugcagaguguuccugaagaacuuccagcaguacuuccaggacagaaccagcugggagguguucagcuacaugcccaccauccuguggcugauggacuggagcgacaugaacagcaaccuggaccugcuggcccugcugggccugggcaucagcagcuucgugcugaucaccggcugcgccaacaugcugcugauggccgcccuguggggccuguacaugagccuggugaacgugggccacgugugguacagcuucggcugggagagccagcugcuggagaccggcuuccugggcaucuuccugugcccccuguggacccugagcagacugccccagcacacccccaccagcagaaucgugcuguggggcuucagauggcugaucuucagaaucaugcugggcgccggccugaucaagaucagaggcgacagaugcuggagagaccugaccugcauggacuuccacuacgagacccagcccaugcccaaccccguggccuacuaccugcaccacagccccuggugguuccacagauucgagacccugagcaaccacuucaucgagcugcuggugcccuucuuccuguuccugggcagaagagccugcaucauccacggcgugcugcagauccuguuccaggccgugcugaucgugagcggcaaccugagcuuccugaacuggcugaccauggugcccagccuggccugcuucgacgacgccacccugggcuuccuguuccccagcggccccggcagccugaaggacagagugcugcagaugcagagagacaucagaggcgccagacccgagcccagauucggcagcguggugagaagagccgccaacgugagccugggcgugcugcuggccuggcugagcgugcccguggugcugaaccugcugagcagcagacaggugaugaacacccacuucaacagccugcacaucgugaacaccuacggcgccuucggcagcaucaccaaggagagagccgaggugauccugcagggcaccgccagcagcaacgccagcgcccccgacgccaugugggaggacuacgaguucaagugcaagcccggcgaccccagcagaagacccugccugaucagccccuaccacuacagacuggacuggcugaugugguucgccgccuuccagaccuacgagcacaacgacuggaucauccaccuggccggcaagcugcuggccagcgacgccgaggcccugagccugcuggcccacaaccccuucgccggcagacccccccccagaugggugagaggcgagcacuacagauacaaguucagcagacccggcggcagacacgccgccgagggcaaguggugggugagaaagagaaucggcgccuacuuccccccccugagccuggaggagcugagacccuacuucagagacagaggcuggccccugcccggcccccuguaa

SEQ ID NO: 19313 - RNA, 2079 nt, Artificial Sequence
  LMLN__Homo_sapiens__NP_001129521
auggugaccacccugggccccaagauggccgccgaguggggcggcggcgugggcuacagcggcagcggccccggcagaagcagauggagauggagcggcagcgugugggugagaagcgugcugcugcugcugggcggccugagagccagcgccaccagcacccccgugagccugggcagcagcccccccugcagacaccacgugcccagcgacaccgaggugaucaacaaggugcaccugaaggccaaccacguggugaagagagacguggacgagcaccugagaaucaagaccguguacgacaagagcguggaggagcugcugcccgagaagaagaaccuggugaagaacaagcuguucccccaggccaucagcuaccuggagaagaccuuccaggugagaagacccgccggcaccauccugcugagcagacagugcgccaccaaccaguaccugagaaaggagaacgacccccacagauacugcaccggcgagugcgccgcccacaccaagugcggccccgugaucgugcccgaggagcaccugcagcagugcagaguguacagaggcggcaaguggccccacggcgccgugggcgugcccgaccaggagggcaucagcgacgccgacuucgugcuguacgugggcgcccuggccaccgagagaugcagccacgagaacaucaucagcuacgccgccuacugccagcaggaggccaacauggacagacccaucgccggcuacgccaaccugugccccaacaugaucagcacccagccccaggaguucgugggcaugcugagcaccgugaagcacgaggugauccacgcccugggcuucagcgccggccuguucgccuucuaccacgacaaggacggcaacccccugaccagcagauucgccgacggccugccccccuucaacuacagccugggccuguaccaguggagcgacaagguggugagaaagguggagagacugugggacgugagagacaacaagaucgugagacacaccguguaccugcuggugacccccagagugguggaggaggccagaaagcacuucgacugccccgugcuggagggcauggagcuggagaaccagggcggcgugggcaccgagcugaaccacugggagaagagacugcuggagaacgaggccaugaccggcagccacacccagaacagagugcugagcagaaucacccuggcccugauggaggacaccggcugguacaaggccaacuacagcauggccgagaagcuggacuggggcagaggcaugggcugcgacuucgugagaaagagcugcaaguucuggaucgaccagcagagacagaagagacagaugcugagccccuacugcgacacccugagaagcaacccccugcagcugaccugcagacaggaccagagagccguggccgugugcaaccugcagaaguuccccaagccccugccccaggaguaccaguacuucgacgagcugagcggcauccccgccgaggaccugcccuacuacggcggcagcguggagaucgccgacuacugccccuucagccaggaguucagcuggcaccugagcggcgaguaccagagaagcagcgacugcagaauccuggagaaccagcccgagaucuucaagaacuacggcgccgagaaguacggcccccacagcgugugccugauccagaagagcgccuucgugauggagaagugcgagagaaagcugagcuaccccgacuggggcagcggcugcuaccaggugagcugcagcccccagggccugaaggugugggugcaggacaccagcuaccugugcagcagagccggccaggugcugcccgugagcauccagaugaacggcuggauccacgacggcaaccugcugugccccagcugcugggacuucugcgagcugugcccccccgagaccgacccccccgccaccaaccugaccagagcccugccccuggaccugugcagcugcagcagcagccugguggugacccuguggcugcugcugggcaaccuguucccccugcuggccggcuuccugcugugcaucuggcacuaa

SEQ ID NO: 19314 - RNA, 1725 nt, Artificial Sequence
  LMNA__Homo_sapiens__NP_001244303
augggcaacagcgagggcugcaacaccaagaaggagggcgaccugaucgccgcccaggccagacugaaggaccuggaggcccugcugaacagcaaggaggccgcccugagcaccgcccugagcgagaagagaacccuggagggcgagcugcacgaccugagaggccagguggccaagcuggaggccgcccugggcgaggccaagaagcagcugcaggacgagaugcugagaagaguggacgccgagaacagacugcagaccaugaaggaggagcuggacuuccagaagaacaucuacagcgaggagcugagagagaccaagagaagacacgagaccagacugguggagaucgacaacggcaagcagagagaguucgagagcagacuggccgacgcccugcaggagcugagagcccagcacgaggaccagguggagcaguacaagaaggagcuggagaagaccuacagcgccaagcuggacaacgccagacagagcgccgagagaaacagcaaccuggugggcgccgcccacgaggagcugcagcagagcagaaucagaaucgacagccugagcgcccagcugagccagcugcagaagcagcuggccgccaaggaggccaagcugagagaccuggaggacagccuggccagagagagagacaccagcagaagacugcuggccgagaaggagagagagauggccgagaugagagccagaaugcagcagcagcuggacgaguaccaggagcugcuggacaucaagcuggcccuggacauggagauccacgccuacagaaagcugcuggagggcgaggaggagagacugagacugagccccagccccaccagccagagaagcagaggcagagccagcagccacagcagccagacccagggcggcggcagcgugaccaagaagagaaagcuggagagcaccgagagcagaagcagcuucagccagcacgccagaaccagcggcagaguggccguggaggagguggacgaggagggcaaguucgugagacugagaaacaagagcaacgaggaccagagcaugggcaacuggcagaucaagagacagaacggcgacgacccccugcugaccuacagauucccccccaaguucacccugaaggccggccagguggugaccaucugggccgccggcgccggcgccacccacagcccccccaccgaccugguguggaaggcccagaacaccuggggcugcggcaacagccugagaaccgcccugaucaacagcaccggcgaggagguggccaugagaaagcuggugagaagcgugaccgugguggaggacgacgaggacgaggacggcgacgaccugcugcaccaccaccacggcagccacugcagcagcagcggcgaccccgccgaguacaaccugagaagcagaaccgugcugugcggcaccugcggccagcccgccgacaaggccagcgccagcggcagcggcgcccaggugggcggccccaucagcagcggcagcagcgccagcagcgugaccgugaccagaagcuacagaagcgugggcggcagcggcggcggcagcuucggcgacaaccuggugaccagaagcuaccugcugggcaacagcagccccagaacccagagcccccagaacugcagcaucauccaggagaugggcaugagaugggagguggaggagggcagaagaaaggugagccugagcugccugcccuaa

SEQ ID NO: 19315 - RNA, 1761 nt, Artificial Sequence
  LMNB1__Homo_sapiens__NP_005564
auggccaccgccacccccgugccccccagaaugggcagcagagccggcggccccaccaccccccugagccccaccagacugagcagacugcaggagaaggaggagcugagagagcugaacgacagacuggccguguacaucgacaaggugagaagccuggagaccgagaacagcgcccugcagcugcaggugaccgagagagaggaggugagaggcagagagcugaccggccugaaggcccuguacgagaccgagcuggccgacgccagaagagcccuggacgacaccgccagagagagagccaagcugcagaucgagcugggcaagugcaaggccgagcacgaccagcugcugcugaacuacgccaagaaggagagcgaccugaacggcgcccagaucaagcugagagaguacgaggccgcccugaacagcaaggacgccgcccuggccaccgcccugggcgacaagaagagccuggagggcgaccuggaggaccugaaggaccagaucgcccagcuggaggccagccuggccgccgccaagaagcagcuggccgacgagacccugcugaagguggaccuggagaacagaugccagagccugaccgaggaccuggaguucagaaagagcauguacgaggaggagaucaacgagaccagaagaaagcacgagaccagacugguggagguggacagcggcagacagaucgaguacgaguacaagcuggcccaggcccugcacgagaugagagagcagcacgacgcccaggugagacuguacaaggaggagcuggagcagaccuaccacgccaagcuggagaacgccagacugagcagcgagaugaacaccagcaccgugaacagcgccagagaggagcugauggagagcagaaugagaaucgagagccugagcagccagcugagcaaccugcagaaggagagcagagccugccuggagagaauccaggagcuggaggaccugcuggccaaggagaaggacaacagcagaagaaugcugaccgacaaggagagagagauggccgagaucagagaccagaugcagcagcagcugaacgacuacgagcagcugcuggacgugaagcuggcccuggacauggagaucagcgccuacagaaagcugcuggagggcgaggaggagagacugaagcugagccccagccccagcagcagagugaccgugagcagagccagcagcagcagaagcgugagaaccaccagaggcaagagaaagagaguggacguggaggagagcgaggccagcagcagcgugagcaucagccacagcgccagcgccaccggcaacgugugcaucgaggagaucgacguggacggcaaguucaucagacugaagaacaccagcgagcaggaccagcccaugggcggcugggagaugaucagaaagaucggcgacaccagcgugagcuacaaguacaccagcagauacgugcugaaggccggccagaccgugaccaucugggccgccaacgccggcgugaccgccagcccccccaccgaccugaucuggaagaaccagaacagcuggggcaccggcgaggacgugaaggugauccugaagaacagccagggcgaggagguggcccagagaagcaccguguucaagaccaccauccccgaggaggaggaggaggaggaggaggccgccggcguggugguggaggaggagcuguuccaccagcagggcacccccagagccagcaacagaagcugcgccaucauguaa

SEQ ID NO: 19316 - RNA, 1863 nt, Artificial Sequence
  LMNB2__Homo_sapiens__NP_116126
augagcccccccagccccggcagaagaagagagcagagaagacccagagccgccgccaccauggccaccccccugcccggcagagccggcggccccgccaccccccugagccccaccagacugagcagacugcaggagaaggaggagcugagagagcugaacgacagacuggcccacuacaucgacagagugagagcccuggagcuggagaacgacagacugcugcugaagaucagcgagaaggaggaggugaccaccagagaggugagcggcaucaaggcccuguacgagagcgagcuggccgacgccagaagagugcuggacgagaccgccagagagagagccagacugcagaucgagaucggcaagcugagagccgagcuggacgaggugaacaagagcgccaagaagagagagggcgagcugaccguggcccagggcagagugaaggaccuggagagccuguuccacagaagcgagguggagcuggccgccgcccugagcgacaagagaggccuggagagcgacguggccgagcugagagcccagcuggccaaggccgaggacggccacgccguggccaagaagcagcuggagaaggagacccugaugagaguggaccuggagaacagaugccagagccugcaggaggagcuggacuucagaaagagcguguucgaggaggaggugagagagaccagaagaagacacgagagaagacugguggagguggacagcagcagacagcaggaguacgacuucaagauggcccaggcccuggaggagcugagaagccagcacgacgagcaggugagacuguacaagcuggagcuggagcagaccuaccaggccaagcuggacagcgccaagcugagcagcgaccagaacgacaaggccgccagcgccgccagagaggagcugaaggaggccagaaugagacuggagagccugagcuaccagcugagcggccugcagaagcaggccagcgccgccgaggacagaaucagagagcuggaggaggccauggccggcgagagagacaaguucagaaagaugcuggacgccaaggagcaggagaugaccgagaugagagacgugaugcagcagcagcuggccgaguaccaggagcugcuggacgugaagcuggcccuggacauggagaucaacgccuacagaaagcugcuggagggcgaggaggagagacugaagcugagccccagccccagcagcagagugaccgugagcagagccaccagcagcagcagcggcagccugagcgccaccggcagacugggcagaagcaagagaaagagacuggagguggaggagccccugggcagcggccccagcgugcugggcaccggcaccggcggcagcggcggcuuccaccuggcccagcaggccagcgccagcggcagcgugagcaucgaggagaucgaccuggagggcaaguucgugcagcugaagaacaacagcgacaaggaccagagccugggcaacuggagaaucaagagacaggugcuggagggcgaggagaucgccuacaaguucacccccaaguacauccugagagccggccagauggugaccgugugggccgccggcgccggcguggcccacagcccccccagcacccugguguggaagggccagagcagcuggggcaccggcgagagcuucagaaccgugcuggugaacgccgacggcgaggagguggccaugagaaccgugaagaagagcagcgugaugagagagaacgagaacggcgaggaggaggaggaggaggccgaguucggcgaggaggaccuguuccaccagcagggcgaccccagaaccaccagcagaggcugcuacgugauguaa

SEQ ID NO: 19317 - RNA, 978 nt, Artificial Sequence
  LMNTD1__Homo_sapiens__NP_001139199
augcagcagcccgugagagccggcgacaucggcgugagcagagugcagacccaccacaacgccagccccuucagcgugcccaagaagcaggacgagagccccaugaucggcgacggcgaggacuacuuccugagccuguucggcgacagcaagaagcugaccgcccacagcaacuacacccagaagacccugaaguacuucagcaugauccuggaggaggugggccaguucaccagcagcagccugggcgacguggagaucgccgaggugaacgugaagggccuguucgugaagcugaucaacagcagccuggacaaggagauggccaucggcgaccacauccugcagcagaacgugaacggccagaccaucagccuguacagauuccugcccaacaucgugaugcaggccaacagcaccgugaccgugugggccgccgccagcgaggccaagcaccagccccccagcgacuuccuguggaaggagcaggacaaguucagagccagccccgacugcaucaccauccugugcaagcccaacggccaggccaucgccugguacacccccauccacuggaagcaggccugggagaagcuggacgccgacguggaguucaacagaugcagcguggugagccccaccuucagaaagagaguguuccaguggaccgccagcaccgccaccaucaccaaggagaagcaggaccagcccaagaaggacaucagcaacuaccagguggagcaggcccaggugcugcugaagagagagaaggagaucccccccaccguguuccccaacagaagccccuggugccagaaccccuacgugagcgcccaccccuacugcccccugaucgagccccacaacaccagcaccgccggcggcagacuggacagacagcccagaaccagaagcaccagacccaacagagccagcggcagcaagaagaagaagaccagcgagagccagaagcaguaa

SEQ ID NO: 19318 - RNA, 468 nt, Artificial Sequence
  LMO1__Homo_sapiens__NP_001257357
auggugcuggaccaggaggacggcgugcccaugcugagcgugcagcccaagggcaagcagaagggcugcgccggcugcaacagaaagaucaaggacagauaccugcugaaggcccuggacaaguacuggcacgaggacugccugaagugcgccugcugcgacugcagacugggcgaggugggcagcacccuguacaccaaggccaaccugauccugugcagaagagacuaccugagacuguucggcaccaccggcaacugcgccgccugcagcaagcugauccccgccuucgagauggugaugagagccagagacaacguguaccaccuggacugcuucgccugccagcugugcaaccagagauucugcgugggcgacaaguucuuccugaagaacaacaugauccugugccagauggacuacgaggagggccagcugaacggcaccuucgagagccaggugcaguaa

SEQ ID NO: 19319 - RNA, 477 nt, Artificial Sequence
  LMO2__Homo_sapiens__NP_001135787
augagcagcgccaucgagagaaagagccuggaccccagcgaggagcccguggacgaggugcugcagaucccccccagccugcugaccugcggcggcugccagcagaacaucggcgacagauacuuccugaaggccaucgaccaguacuggcacgaggacugccugagcugcgaccugugcggcugcagacugggcgaggugggcagaagacuguacuacaagcugggcagaaagcugugcagaagagacuaccugagacuguucggccaggacggccugugcgccagcugcgacaagagaaucagagccuacgagaugaccaugagagugaaggacaagguguaccaccuggagugcuucaagugcgccgccugccagaagcacuucugcgugggcgacagauaccugcugaucaacagcgacaucgugugcgagcaggacaucuacgaguggaccaagaucaacggcaugaucuaa

SEQ ID NO: 19320 - RNA, 438 nt, Artificial Sequence
  LMO3__Homo_sapiens__NP_001001395
augcugagcgugcagcccgacaccaagcccaagggcugcgccggcugcaacagaaagaucaaggacagauaccugcugaaggcccuggacaaguacuggcacgaggacugccugaagugcgccugcugcgacugcagacugggcgaggugggcagcacccuguacaccaaggccaaccugauccugugcagaagagacuaccugagacuguucggcgugaccggcaacugcgccgccugcagcaagcugauccccgccuucgagauggugaugagagccaaggacaacguguaccaccuggacugcuucgccugccagcugugcaaccagagauucugcgugggcgacaaguucuuccugaagaacaacaugauccugugccagaccgacuacgaggagggccugaugaaggagggcuacgccccccaggugagauaa

SEQ ID NO: 19321 - RNA, 4050 nt, Artificial Sequence
  LMO7__Homo_sapiens__NP_005349
augaagaagaucagaaucugccacaucuucaccuucuacagcuggaugagcuacgacgugcuguuccagagaaccgagcugggcgcccuggagaucuggagacagcugaucugcgcccacgugugcaucugcgugggcuggcuguaccugagagacagagugugcagcaagaaggacaucauccugagaaccgagcagaacagcggcagaaccauccugaucaaggccgugaccgagaagaacuucgagaccaaggacuucagagccagccuggagaacggcgugcugcugugcgaccugaucaacaagcugaagcccggcgugaucaagaagaucaacagacugagcacccccaucgccggccuggacaacaucaacguguuccugaaggccugcgagcagaucggccugaaggaggcccagcuguuccaccccggcgaccugcaggaccugagcaacagagugaccgugaagcaggaggagaccgacagaagagugaagaacgugcugaucacccuguacuggcugggcagaaaggcccagagcaaccccuacuacaacggcccccaccugaaccugaaggccuucgagaaccugcugggccaggcccugaccaaggcccuggaggacagcagcuuccugaagagaagcggcagagacagcggcuacggcgacaucuggugccccgagagaggcgaguuccuggccccccccagacaccacaagagagaggacagcuucgagagccuggacagccugggcagcagaagccugaccagcugcagcagcgacaucacccugagaggcggcagagagggcuucgagagcgacaccgacagcgaguucaccuucaagaugcaggacuacaacaaggacgacaugagcuacagaagaaucagcgccguggagcccaagaccgcccugcccuucaacagauuccugcccaacaagagcagacagcccagcuacgugcccgccccccugagaaagaagaagcccgacaagcacgaggacaacagaagaagcugggccagccccguguacaccgaggccgacggcaccuucagcagacuguuccagaagaucuacggcgagaacggcagcaagagcaugagcgacgugagcgccgaggacgugcagaaccugagacagcugagauacgaggagaugcagaagaucaagagccagcugaaggagcaggaccagaaguggcaggacgaccuggccaaguggaaggacagaagaaagagcuacaccagcgaccugcagaagaagaaggaggagagagaggagaucgagaagcaggcccuggagaagagcaagagaagcagcaagaccuucaaggagaugcugcaggacagagagagccagaaccagaagagcaccgugcccagcagaagaagaauguacagcuucgacgacgugcuggaggagggcaagagaccccccaccaugaccgugagcgaggccagcuaccagagcgagagaguggaggagaagggcgccaccuaccccagcgagauccccaaggaggacagcaccaccuucgccaagagagaggacagagugaccaccgagauccagcugcccagccagagccccguggaggagcagagccccgccagccugagcagccugagaagcagaagcacccagauggagagcaccagagugagcgccagccugcccagaagcuacagaaagaccgacaccgugagacugaccagcguggugacccccagacccuucggcagccagaccagaggcaucagcagccugcccagaagcuacaccauggacgacgccuggaaguacaacggcgacguggaggacaucaagagaacccccaacaacguggugagcacccccgcccccagccccgacgccagccagcuggccagcagccugagcagccagaaggagguggccgccaccgaggaggacgugaccagacugcccagccccaccagccccuucagcagccugagccaggaccaggccgccaccagcaaggccacccugagcagcaccagcggccuggaccugaugagcgagagcggcgagggcgagaucagcccccagagagaggugagcagaagccaggaccaguucagcgacaugagaaucagcaucaaccagacccccggcaagagccuggacuucggcuucaccaucaagugggacauccccggcaucuucguggccagcguggaggccggcagccccgccgaguucagccagcugcagguggacgacgagaucaucgccaucaacaacaccaaguucagcuacaacgacagcaaggagugggaggaggccauggccaaggcccaggagaccggccaccuggugauggacgugagaagauacggcaaggccggcagccccgagaccaaguggaucgacgccaccagcggcaucuacaacagcgagaagagcagcaaccugagcgugaccaccgacuucagcgagagccugcagagcagcaacaucgagagcaaggagaucaacggcauccacgacgagagcaacgccuucgagagcaaggccagcgagagcaucagccugaagaaccugaagagaagaagccaguucuucgagcagggcagcagcgacagcguggugcccgaccugcccgugcccaccaucagcgcccccagcagaugggugugggaccaggaggaggagagaaagagacaggagagauggcagaaggagcaggacagacugcugcaggagaaguaccagagagagcaggagaagcugagagaggaguggcagagagccaagcaggaggccgagagagagaacagcaaguaccuggacgaggagcugauggugcugagcagcaacagcaugagccugaccaccagagagcccagccuggccaccugggaggccaccuggagcgagggcagcaagagcagcgacagagagggcaccagagccggcgaggaggagagaagacagccccaggaggagguggugcacgaggaccagggcaagaagccccaggaccagcuggugaucgagagagagagaaagugggagcagcagcugcaggaggagcaggagcagaagagacugcaggccgaggccgaggagcagaagagacccgccgaggagcagaagagacaggccgagaucgagagagagaccagcgugagaaucuaccaguacagaagacccguggacagcuacgacauccccaagaccgaggaggccagcagcggcuuccugcccggcgacagaaacaagagcagaagcaccaccgagcuggacgacuacagcaccaacaagaacggcaacaacaaguaccuggaccagaucggcaacaugaccagcagccagagaagaagcaagaaggagcaggugcccagcggcgccgagcuggagagacagcagauccugcaggagaugagaaagagaaccccccugcacaacgacaacagcuggaucagacagagaagcgccagcgugaacaaggagcccgugagccugcccggcaucaugagaagaggcgagagccuggacaaccuggacagccccagaagcaacagcuggagacagccccccuggcugaaccagcccaccggcuucuacgccagcagcagcgugcaggacuucagcagaccccccccccagcuggugagcaccagcaacagagccuacaugagaaaccccagcagcagcgugcccccccccagcgccggcagcgugaagaccagcaccaccggcguggccaccacccagagccccacccccagaagccacagccccagcgccagccagagcggcagccagcugagaaacagaagcgugagcggcaagagaaucugcagcuacugcaacaacauccugggcaagggcgccgccaugaucaucgagagccugggccugugcuaccaccugcacugcuucaagugcguggccugcgagugcgaccugggcggcagcagcagcggcgccgaggugagaaucagaaaccaccagcuguacugcaacgacugcuaccugagauucaagagcggcagacccaccgccauguaa

SEQ ID NO: 19322 - RNA, 1803 nt, Artificial Sequence
  LMOD1__Homo_sapiens__NP_036266
augagcagaguggccaaguacagaagacaggugagcgaggaccccgacaucgacagccugcuggagacccugagccccgaggagauggaggagcuggagaaggagcuggacgugguggaccccgacggcagcgugcccgugggccugagacagagaaaccagaccgagaagcagagcaccggcguguacaacagagaggccaugcugaacuucugcgagaaggagaccaagaagcugaugcagagagagaugagcauggacgagagcaagcagguggagaccaagaccgacgccaagaacggcgaggagagaggcagagacgccagcaagaaggcccugggccccagaagagacagcgaccugggcaaggagcccaagagaggcggccugaagaagagcuucagcagagacagagacgaggccggcggcaagagcggcgagaagcccaaggaggagaagaucaucagaggcaucgacaagggcagagugagagccgccguggacaagaaggaggccggcaaggacggcagaggcgaggagagagccguggccaccaagaaggaggaggagaagaagggcagcgacagaaacaccggccugagcagagacaaggacaagaagagagaggagaugaaggagguggccaagaaggaggacgacgagaaggugaagggcgagagaagaaacaccgacaccagaaaggagggcgagaagaugaagagagccggcggcaacaccgacaugaagaaggaggacgagaaggugaagagaggcaccggcaacaccgacaccaagaaggacgacgagaaggugaagaagaacgagccccugcacgagaaggaggccaaggacgacagcaagaccaagacccccgagaagcagacccccagcggccccaccaagcccagcgagggccccgccaagguggaggaggaggccgcccccagcaucuucgacgagccccuggagagagugaagaacaacgaccccgagaugaccgaggugaacgugaacaacagcgacugcaucaccaacgagauccuggugagauucaccgaggcccuggaguucaacaccguggugaagcuguucgcccuggccaacaccagagccgacgaccacguggccuucgccaucgccaucaugcugaaggccaacaagaccaucaccagccugaaccuggacagcaaccacaucaccggcaagggcauccuggccaucuucagagcccugcugcagaacaacacccugaccgagcugagauuccacaaccagagacacaucugcggcggcaagaccgagauggagaucgccaagcugcugaaggagaacaccacccugcugaagcugggcuaccacuucgagcuggccggccccagaaugaccgugaccaaccugcugagcagaaacauggacaagcagagacagaagagacugcaggagcagagacaggcccaggaggccaagggcgagaagaaggaccugcuggaggugcccaaggccggcgccguggccaagggcagccccaagcccagcccccagcccagccccaagcccagccccaagaacagccccaagaagggcggcgcccccgccgccccccccccccccccccccccccuggcccccccccugaucauggagaaccugaagaacagccugagccccgccacccagagaaagaugggcgacaaggugcugcccgcccaggagaagaacagcagagaccagcugcuggccgccaucagaagcagcaaccugaagcagcugaagaagguggaggugcccaagcugcugcaguaa

SEQ ID NO: 19323 - RNA, 1683 nt, Artificial Sequence
  LMOD3__Homo_sapiens__NP_001291347
augagcgagcacagcagaaacagcgaccaggaggagcugcuggacgaggagaucaacgaggacgagauccuggccaaccugagcgccgaggagcugaaggagcugcagagcgagauggaggugauggcccccgaccccagccugcccgugggcaugauccagaaggaccagaccgacaagccccccaccggcaacuucaaccacaagagccugguggacuacauguacugggagaaggccagcagaagaaugcuggaggaggagagagugcccgugaccuucgugaagagcgaggagaagacccaggaggagcacgaggagaucgagaagagaaacaagaacauggcccaguaccugaaggagaagcugaacaacgagaucguggccaacaagagagagagcaagggcagcagcaacauccaggagaccgacgaggaggacgaggaggaggaggacgacgacgacgacgacgagggcgaggacgacggcgaggagagcgaggagaccaacagagaggaggagggcaaggccaaggagcagaucagaaacugcgagaacaacugccagcaggugaccgacaaggccuucaaggagcagagagacagacccgaggcccaggagcagagcgagaagaagaucagcaagcuggaccccaagaagcuggcccuggacaccagcuuccugaaggugagcaccagacccagcggcaaccagaccgaccuggacggcagccugagaagagugagaaagaacgaccccgacaugaaggagcugaaccugaacaacaucgagaacauccccaaggagaugcugcuggacuucgugaacgccaugaagaagaacaagcacaucaagaccuucagccuggccaacgugggcgccgacgagaacguggccuucgcccuggccaacaugcugagagagaacagaagcaucaccacccugaacaucgagagcaacuucaucaccggcaagggcaucguggccaucaugagaugccugcaguucaacgagacccugaccgagcugagauuccacaaccagagacacaugcugggccaccacgccgagauggagaucgccagacugcugaaggccaacaacacccugcugaagaugggcuaccacuucgagcugcccggccccagaaugguggugaccaaccugcugaccagaaaccaggacaagcagagacagaagagacaggaggagcagaagcagcagcagcugaaggagcagaagaagcugaucgccaugcuggagaacggccugggccugccccccggcaugugggagcugcugggcggccccaagcccgacagcagaaugcaggaguucuuccagccccccccccccagaccccccaacccccagaacgugcccuucagccagagaagcgagaugaugaagaagcccagccaggcccccaaguacagaaccgaccccgacagcuucagaguggugaagcugaagagaauccagagaaagagcagaaugcccgaggccagagagccccccgagaagaccaaccugaaggacgugaucaagacccugaagcccgugcccagaaacagaccccccccccugguggagaucacccccagagaccagcugcugaacgacaucagacacagcagcguggccuaccugaagcccgugcagcugcccaaggagcuggccuaa

SEQ ID NO: 19324 - RNA, 4512 nt, Artificial Sequence
  LMTK2__Homo_sapiens__NP_055731
augcccggcccccccgcccugagaagaagacugcugcugcugcugcuggugcugcugaucgccggcagcgccggcgccgccccccugccccagaccggcgccggcgaggccccccccgccgccgaggugagcagcagcuucgugauccugugcgugugcagccugaucauccugaucgugcugaucgccaacugcgugagcugcugcaaggaccccgagaucgacuucaaggaguucgaggacaacuucgacgacgagaucgacuucaccccccccgccgaggacacccccagcgugcagagccccgccgagguguucacccugagcgugcccaacaucagccugcccgcccccagccaguuccagcccagcguggagggccugaagagccagguggccagacacagccugaacuacauccaggagaucggcaacggcugguucggcaaggugcugcugggcgagaucuacaccggcaccagcguggccagagugaucgugaaggagcugaaggccagcgccaaccccaaggagcaggacaccuuccugaagaacggcgagcccuacuacauccugcagcaccccaacauccugcagugcgugggccagugcguggaggccauccccuaccugcugguguucgaguucugcgaccugggcgaccugaaggccuaccugagaagcgagcaggagcacaugagaggcgacagccagaccaugcugcugcagagaauggccugcgagguggccgccggccuggccgccaugcacaagcugcacuuccugcacagcgaccuggcccugagaaacugcuuccugaccagcgaccugaacgugaaggugggcgacuacggcaucggcuucagcagauacaaggaggacuacaucgagaccgacgacaagaagguguucccccugagauggaccgcccccgagcuggugaccagcuuccaggacagacugcugaccgccgaccagaccaaguacagcaacaucuggagccugggcgugacccugugggagcuguucgacaacgccgcccagcccuacagcaaccugagcaaccuggacgugcugaaccaggugaucagagagagagacaccaagcugcccaagccccagcuggagcagcccuacagcgacagaugguacgaggugcugcaguucugcuggcugagccccgagaagagacccgccgccgaggacgugcacagacugcugaccuaccugagacugcagagccagagagacagcgagguggacuucgagcagcaguggaacgcccugaagcccaacaccaacagcagagacagcagcaacaacgccgccuuccccauccuggaccacuucgccagagacagacugggcagagagauggaggaggugcugaccgugaccgagaccagccagggccugagcuucgaguacgugugggaggccgccaagcacgaccacuucgacgagagaagcagaggccaccuggacgagggccugagcuacaccagcaucuucuaccccguggagguguucgagagcagccugagcgaccccggccccggcaagcaggacgacagcggccaggacgugccccugagagugcccggcguggugcccguguucgacgcccacaaccugagcgugggcagcgacuacuacauccagcuggaggagaagagcggcagcaaccuggagcuggacuacccccccgcccugcugaccaccgacauggacaaccccgagagaaccggccccgagcugagccagcugaccgcccugagaagcguggagcuggaggagagcagcaccgacgaggacuucuuccagagcagcaccgaccccaaggacagcagccugcccggcgaccugcacgugaccagcggccccgagagccccuucaacaacaucuucaacgacguggacaagagcgaggaccugcccagccaccagaagaucuucgaccugauggagcugaacggcgugcaggccgacuucaagcccgccacccugagcagcagccuggacaaccccaaggagagcgugaucaccggccacuucgagaaggagaagcccagaaagaucuucgacagcgagccccugugccugagcgacaaccugaugcaccaggacaacuucgacccccugaacgugcaggagcugagcgagaacuuccuguuccugcaggagaagaaccugcugaagggcagccugagcagcaaggagcacaucaacgaccugcagaccgagcugaagaacgccggcuucaccgaggccaugcuggagaccagcugcagaaacagccuggacaccgagcugcaguucgccgagaacaagcccggccugagccugcugcaggagaacgugagcaccaagggcgacgacaccgacgugaugcugaccggcgacacccugagcaccagccugcagagcagccccgaggugcaggugccccccaccagcuucgagaccgaggagacccccagaagagugccccccgacagccugcccacccagggcgagacccagcccaccugccuggacgugaucgugcccgaggacugccugcaccaggacaucagccccgacgccgugaccgugcccguggagauccugagcaccgacgccagaacccacagccuggacaacagaagccaggacagccccggcgagagcgaggagacccugagacugaccgagagcgacagcgugcuggccgacgacauccuggccagcagagugagcgugggcagcagccugcccgagcugggccaggagcugcacaacaagcccuucagcgaggaccaccacagccacagaagacuggagaagaaccuggaggccguggagacccugaaccagcugaacagcaaggacgccgccaaggaggccggccuggugagcgcccugagcagcgacagcaccagccaggacagccugcuggaggacagccugagcgcccccuuccccgccagcgagcccagccuggagacccccgacagccuggagagcguggacgugcacgaggcccugcuggacagccugggcagccacaccccccagaagcuggugccccccgacaagcccgccgacagcggcuacgagaccgagaaccuggagagccccgaguggacccugcaccccgcccccgagggcaccgccgacagcgagcccgccaccaccggcgacggcggccacagcggccugccccccaaccccgugaucgugaucagcgacgccggcgacggccacagaggcaccgaggugacccccgagaccuucaccgccggcagccagggcagcuacagagacagcgccuacuucagcgacaacgacagcgagcccgagaagagaagcgaggaggugcccggcaccagccccagcgcccuggugcuggugcaggagcagccccugcccgagcccgugcugcccgagcagagccccgccgcccaggacagcugccuggaggccagaaagagccagcccgacgagagcugccugagcgcccugcacaacagcagcgaccuggagcugagagccacccccgagcccgcccagaccggcgugccccagcaggugcaccccaccgaggacgaggccagcagccccuggagcgugcugaacgccgagcugagcagcggcgacgacuucgagacccaggacgacagacccugcacccuggccagcaccggcaccaacaccaacgagcugcuggccuacaccaacagcgcccuggacaagagccugagcagccacagcgagggccccaagcugaaggagcccgacaucgagggcaaguaccugggcaagcugggcgugagcggcaugcuggaccugagcgaggacggcauggacgccgacgaggaggacgagaacagcgacgacagcgacgaggaccugagagccuucaaccugcacagccugagcagcgagagcgaggacgagaccgagcaccccgugcccaucauccugagcaacgaggacggcagacaccugagaagccugcugaagcccaccgccgccaacgcccccgacccccugcccgaggacuggaagaaggagaagaaggccgugaccuucuucgacgacgugaccguguaccuguucgaccaggagacccccaccaaggagcugggccccugcggcggcgaggccugcggccccgaccugagcggccccgcccccgccagcggcagccccuaccugagcagaugcaucaacagcgagagcagcaccgacgaggagggcggcggcuucgagugggacgacgacuucagccccgaccccuucaugagcaagaccaccagcaaccugcugagcagcaagcccagccugcagaccagcaaguacuucagcccccccccccccgccagaagcaccgagcagagcuggccccacagcgcccccuacagcagauucagcaucagccccgccaacaucgccagcuucagccugacccaccugaccgacagcgacaucgagcagggcggcagcagcgaggacggcgagaaggacuaa

SEQ ID NO: 19325 - RNA, 4470 nt, Artificial Sequence
  LMTK3__Homo_sapiens__NP_001073903
augagacaggugcuguggcugugcaacgugugcgugaccgccagagagaccagacaccaccugcaccugcccgccauccuggacaagaugcccgcccccggcgcccugauccugcuggccgccgugagcgccagcggcugccuggccagccccgcccaccccgacggcuucgcccugggcagagccccccuggccccccccuacgccguggugcugaucagcugcagcggccugcuggccuucaucuuccugcugcugaccugccugugcugcaagagaggcgacgugggcuucaaggaguucgagaaccccgagggcgaggacugcagcggcgaguacaccccccccgccgaggagaccagcagcagccagagccugcccgacguguacauccugccccuggccgaggugagccugcccaugcccgccccccagcccagccacagcgacaugaccaccccccugggccugagcagacagcaccugagcuaccugcaggagaucggcagcggcugguucggcaaggugauccugggcgagaucuucagcgacuacacccccgcccaggugguggugaaggagcugagagccagcgccggcccccuggagcagagaaaguucaucagcgaggcccagcccuacagaagccugcagcaccccaacgugcugcagugccugggccugugcguggagacccugcccuuccugcugaucauggaguucugccagcugggcgaccugaagagauaccugagagcccagagaccccccgagggccugagccccgagcugccccccagagaccugagaacccugcagagaaugggccuggagaucgccagaggccuggcccaccugcacagccacaacuacgugcacagcgaccuggcccugagaaacugccugcugaccagcgaccugaccgugagaaucggcgacuacggccuggcccacagcaacuacaaggaggacuacuaccugacccccgagagacuguggaucccccugagaugggccgcccccgagcugcugggcgagcugcacggcaccuucauggugguggaccagagcagagagagcaacaucuggagccugggcgugacccugugggagcuguucgaguucggcgcccagcccuacagacaccugagcgacgaggaggugcuggccuucguggugagacagcagcacgugaagcuggccagacccagacugaagcugcccuacgccgacuacugguacgacauccugcagagcugcuggagaccccccgcccagagacccagcgccagcgaccugcagcugcagcugaccuaccugcugagcgagagaccccccagaccccccccccccccccccccccccagagacggccccuuccccuggcccuggccccccgcccacagcgcccccagacccggcacccugagcagccccuucccccugcuggacggcuuccccggcgccgaccccgacgacgugcugaccgugaccgagagcagcagaggccugaaccuggagugccugugggagaaggccagaagaggcgccggcagaggcggcggcgcccccgccuggcagcccgccagcgccccccccgccccccacgccaaccccagcaaccccuucuacgaggcccugagcacccccagcgugcugcccgugaucagcgccagaagccccagcgugagcagcgaguacuacaucagacuggaggagcacggcagcccccccgagccccuguuccccaacgacugggacccccuggaccccggcgugcccgccccccaggccccccaggcccccagcgaggugccccagcuggugagcgagaccugggccagcccccuguuccccgcccccagacccuuccccgcccagagcagcgccagcggcagcuuccugcugagcggcugggaccccgagggcagaggcgccggcgagacccuggccggcgaccccgccgaggugcugggcgagagaggcaccgcccccuggguggaggaggaggaggaggaggaggagggcagcagccccggcgaggacagcagcagccugggcggcggccccagcagaagaggcccccugcccugcccccugugcagcagagagggcgccugcagcugccugccccuggagagaggcgacgccguggccggcuggggcggccaccccgcccugggcugcccccacccccccgaggacgacagcagccugagagccgagagaggcagccuggccgaccugcccauggccccccccgccagcgccccccccgaguuccuggacccccugaugggcgccgccgccccccaguaccccggcagaggccccccccccgccccccccccccccccccccccccccagagcccccgccgaccccgccgccagccccgacccccccagcgccguggccagccccggcagcggccugagcagccccggccccaagcccggcgacagcggcuacgagaccgagacccccuucagccccgagggcgccuuccccggcggcggcgccgccgaggaggagggcgugcccagacccagagccccccccgagccccccgaccccggcgcccccagacccccccccgaccccggcccccugccccugcccggccccagagagaagcccaccuucguggugcaggugagcaccgagcagcugcugaugagccugagagaggacgugaccagaaaccugcugggcgagaagggcgccaccgccagagagaccggccccagaaaggccggcagaggccccggcaacagagagaaggugcccggccugaacagagaccccaccgugcugggcaacggcaagcaggcccccagccugagccugcccgugaacggcgugaccgugcuggagaacggcgaccagagagcccccggcaucgaggagaaggccgccgagaacggcgcccugggcagccccgagagagaggagaaggugcuggagaacggcgagcugaccccccccagaagagaggagaaggcccuggagaacggcgagcugagaagccccgaggccggcgagaaggugcuggugaacggcggccugaccccccccaagagcgaggacaaggugagcgagaacggcggccugagauuccccagaaacaccgagagaccccccgagaccggccccuggagagcccccggccccugggagaagacccccgagagcuggggccccgcccccaccaucggcgagcccgcccccgagaccagccuggagagagcccccgcccccagcgccguggugagcagcagaaacggcggcgagaccgcccccggcccccugggccccgcccccaagaacggcacccuggagcccggcaccgagagaagagcccccgagaccggcggcgcccccagagcccccggcgccggcagacuggaccugggcagcggcggcagagcccccgugggcaccggcaccgcccccggcggcggccccggcagcggcguggacgccaaggccggcuggguggacaacaccagaccccagccccccccccccccccugccccccccccccgaggcccagcccagaagacuggagcccgccccccccagagccagacccgagguggcccccgagggcgagcccggcgcccccgacagcagagccggcggcgacaccgcccugagcggcgacggcgacccccccaagcccgagagaaagggccccgagaugcccagacuguuccuggaccugggccccccccagggcaacagcgagcagaucaaggccagacugagcagacugagccuggcccugcccccccugacccugacccccuuccccggccccggccccagaagaccccccugggagggcgccgacgccggcgccgccggcggcgaggccggcggcgccggcgcccccggccccgccgaggaggacggcgaggacgaggacgaggacgaggaggaggacgaggaggccgccgcccccggcgccgccgccggccccagaggccccggcagagccagagccgcccccgugcccgugguggugagcagcgccgacgccgacgccgccagaccccugagaggccugcugaagagccccagaggcgccgacgagcccgaggacagcgagcuggagagaaagagaaagauggugagcuuccacggcgacgugaccguguaccuguucgaccaggagacccccaccaacgagcugagcgugcaggccccccccgagggcgacaccgaccccagcaccccccccgccccccccacccccccccaccccgccacccccggcgacggcuuccccagcaacgacagcggcuucggcggcagcuucgagugggccgaggacuucccccugcugcccccccccggccccccccugugcuucagcagauucagcgugagccccgcccuggagacccccggcccccccgccagagcccccgacgccagacccgccggccccguggagaacuaa

SEQ ID NO: 19326 - RNA, 1149 nt, Artificial Sequence
  LMX1A__Homo_sapiens__NP_001167540
augcuggacggccugaagauggaggagaacuuccagagcgccaucgacaccagcgccagcuucagcagccugcugggcagagccgugagccccaagagcgugugcgagggcugccagagagugauccuggacagauuccugcugagacugaacgacagcuucuggcacgagcagugcgugcagugcgccagcugcaaggagccccuggagaccaccugcuucuacagagacaagaagcuguacugcaaguacgacuacgagaagcuguucgccgugaagugcggcggcugcuucgaggccaucgcccccaacgaguucgugaugagagcccagaagagcguguaccaccugagcugcuucugcugcugcgugugcgagagacagcugcagaagggcgacgaguucgugcugaaggagggccagcugcugugcaagggcgacuacgagaaggagagagagcugcugagccuggugagccccgccgccagcgacagcggcaagagcgacgacgaggagagccugugcaagagcgcccacggcgccggcaagggcaccgccgaggagggcaaggaccacaagagacccaagagacccagaaccauccugaccacccagcagagaagagccuucaaggccagcuucgaggugagcagcaagcccugcagaaaggugagagagacccuggccgccgagaccggccugagcgugagaguggugcaggugugguuccagaaccagagagccaagaugaagaagcuggccagaagacagcagcagcagcagcaggaccagcagaacacccagagacugagcagcgcccagaccaacggcggcggcagcgccggcauggagggcaucaugaaccccuacaccgcccugcccaccccccagcagcugcuggccaucgagcagagcguguacagcagcgaccccuucagacagggccugacccccccccagaugcccggcgaccacaugcaccccuacggcgccgagccccuguuccacgaccuggacagcgacgacaccagccugagcaaccugggcgacugcuuccuggccaccagcgaggccggcccccugcagagcagagugggcaaccccaucgaccaccuguacagcaugcagaacagcuacuucaccagcuaa

SEQ ID NO: 19327 - RNA, 1221 nt, Artificial Sequence
  LMX1B__Homo_sapiens__NP_001167617
auggacaucgccaccggccccgagagccuggagagaugcuuccccagaggccagaccgacugcgccaagaugcuggacggcaucaagauggaggagcacgcccugagacccggccccgccacccugggcgugcugcugggcagcgacugcccccaccccgccgugugcgagggcugccagagacccaucagcgacagauuccugaugagagugaacgagagcagcuggcacgaggagugccugcagugcgccgccugccagcaggcccugaccaccagcugcuacuucagagacagaaagcuguacugcaagcaggacuaccagcagcuguucgccgccaagugcagcggcugcauggagaagaucgcccccaccgaguucgugaugagagcccuggagugcguguaccaccugggcugcuucugcugcugcgugugcgagagacagcugagaaagggcgacgaguucgugcugaaggagggccagcugcugugcaagggcgacuacgagaaggagaaggaccugcugagcagcgugagccccgacgagagcgacagcgugaagagcgaggacgaggacggcgacaugaagcccgccaagggccagggcagccagagcaagggcagcggcgacgacggcaaggaccccagaagacccaagagacccagaaccauccugaccacccagcagagaagagccuucaaggccagcuucgaggugagcagcaagcccugcagaaaggugagagagacccuggccgccgagaccggccugagcgugagaguggugcaggugugguuccagaaccagagagccaagaugaagaagcuggccagaagacaccagcagcagcaggagcagcagaacagccagagacugggccagggcgagcccggccccggccagggccugggccaggaggugcugagcagcagaauggagggcaugauggccagcuacaccccccuggcccccccccagcagcagaucguggccauggagcagagccccuacggcagcagcgaccccuuccagcagggccugacccccccccagaugcccggcaacgacagcaucuuccacgacaucgacagcgacaccagccugaccagccugagcgacugcuuccugggcagcagcgacgugggcagccugcaggccagagugggcaaccccaucgacagacuguacagcaugcagagcagcuacuucgccagcuaa

SEQ ID NO: 19328 - RNA, 3078 nt, Artificial Sequence
  LNPEP__Homo_sapiens__NP_005566
auggagcccuucaccaacgacagacugcagcugcccagaaacaugaucgagaacagcauguucgaggaggagcccgacgugguggaccuggccaaggagcccugccugcacccccuggagcccgacgagguggaguacgagcccagaggcagcagacugcuggugagaggccugggcgagcacgagauggaggaggacgaggaggacuacgagagcagcgccaagcugcugggcaugagcuucaugaacagaagcagcggccugagaaacagcgccaccggcuacagacagagccccgacggcgccugcagcgugcccagcgccagaaccaugguggugugcgccuucgugaucgugguggccgugagcgugaucauggugaucuaccugcugcccagaugcaccuucaccaaggagggcugccacaagaagaaccagagcaucggccugauccagcccuucgccaccaacggcaagcuguuccccugggcccagaucagacugcccaccgccguggugccccugagauacgagcugagccugcaccccaaccugaccagcaugaccuucagaggcagcgugaccaucagcgugcaggcccugcaggugaccuggaacaucauccugcacagcaccggccacaacaucagcagagugaccuucaugagcgccgugagcagccaggagaagcaggccgagauccuggaguacgccuaccacggccagaucgccaucguggcccccgaggcccugcuggccggccacaacuacacccugaagaucgaguacagcgccaacaucagcagcagcuacuacggcuucuacggcuucagcuacaccgacgagagcaacgagaagaaguacuucgccgccacccaguucgagccccuggccgccagaagcgccuuccccugcuucgacgagcccgccuucaaggccaccuucaucaucaagaucaucagagacgagcaguacaccgcccugagcaacaugcccaagaagagcagcguggugcuggacgacggccuggugcaggacgaguucagcgagagcgugaagaugagcaccuaccugguggccuucaucgugggcgagaugaagaaccugagccaggacgugaacggcacccuggugagcaucuacgccgugcccgagaagaucggccaggugcacuacgcccuggagaccaccgugaagcugcuggaguucuuccagaacuacuucgagauccaguacccccugaagaagcuggaccugguggccauccccgacuucgaggccggcgccauggagaacuggggccugcugaccuucagagaggagacccugcuguacgacagcaacaccagcagcauggccgacagaaagcuggugaccaagaucaucgcccacgagcuggcccaccagugguucggcaaccuggugaccaugaagugguggaacgaccuguggcugaacgagggcuucgccaccuucauggaguacuucagccuggagaagaucuucaaggagcugagcagcuacgaggacuuccuggacgccagauucaagaccaugaagaaggacagccugaacagcagccaccccaucagcagcagcgugcagagcagcgagcagaucgaggagauguucgacagccugagcuacuucaagggcagcagccugcugcugaugcugaagaccuaccugagcgaggacguguuccagcacgccguggugcuguaccugcacaaccacagcuacgccagcauccagagcgacgaccugugggacagcuucaacgaggugaccaaccagacccuggacgugaagagaaugaugaagaccuggacccugcagaagggcuucccccuggugaccgugcagaagaagggcaaggagcuguucauccagcaggagagauucuuccugaacaugaagcccgagauccagcccagcgacaccagcuaccuguggcacaucccccugagcuacgugaccgagggcagaaacuacagcaaguaccagagcgugagccugcuggacaagaagagcggcgugaucaaccugaccgaggaggugcugugggugaaggugaacaucaacaugaacggcuacuacaucgugcacuacgccgacgacgacugggaggcccugauccaccagcugaagaucaaccccuacgugcugagcgacaaggacagagccaaccugaucaacaacaucuucgagcuggccggccugggcaaggugccccugaagagagccuucgaccugaucaacuaccugggcaacgagaaccacaccgcccccaucaccgaggcccuguuccagaccgaccugaucuacaaccugcuggagaagcugggcuacauggaccuggccagcagacuggugaccagaguguucaagcugcugcagaaccagauccagcagcagaccuggaccgacgagggcacccccagcaugagagagcugagaagcgcccugcuggaguucgccugcacccacaaccugggcaacugcagcaccaccgccaugaagcuguucgacgacuggauggccagcaacggcacccagagccugcccaccgacgugaugaccaccguguucaaggugggcgccaagaccgacaagggcuggagcuuccugcugggcaaguacaucagcaucggcagcgaggccgagaagaacaagauccuggaggcccuggccagcagcgaggacgugagaaagcuguacuggcugaugaagagcagccugaacggcgacaacuucagaacccagaagcugagcuucaucaucagaaccgugggcagacacuuccccggccaccugcuggccugggacuucgugaaggagaacuggaacaagcuggugcagaaguucccccugggcagcuacaccauccagaacaucguggccggcagcaccuaccuguucagcaccaagacccaccugagcgaggugcaggccuucuucgagaaccagagcgaggccaccuucagacugagaugcgugcaggaggcccuggaggugauccagcugaacauccaguggauggagaagaaccugaagagccugaccugguggcuguaa

SEQ ID NO: 19329 - RNA, 1899 nt, Artificial Sequence
  LNX1__Homo_sapiens__NP_116011
augaaggcccugcugcugcuggugcugcccuggcugagccccgccaacuacaucgacaacgugggcaaccugcacuuccuguacagcgagcugugcaagggcgccagccacuacggccugaccaaggacagaaagagaagaagccaggacggcugccccgacggcugcgccagccugaccgccaccgcccccagccccgaggugagcgccgccgccaccaucagccugaugaccgacgagcccggccuggacaaccccgccuacgugagcagcgccgaggacggccagcccgccaucagccccguggacagcggcagaagcaacagaaccagagccagacccuucgagagaagcaccaucagaagcagaagcuucaagaagaucaacagagcccugagcgugcugagaagaaccaagagcggcagcgccguggccaaccacgccgaccagggcagagagaacagcgagaacaccaccgcccccgagguguuccccagacuguaccaccugauccccgacggcgagaucaccagcaucaagaucaacagaguggaccccagcgagagccugagcaucagacuggugggcggcagcgagaccccccuggugcacaucaucauccagcacaucuacagagacggcgugaucgccagagacggcagacugcugcccggcgacaucauccugaaggugaacggcauggacaucagcaacgugccccacaacuacgccgugagacugcugagacagcccugccaggugcuguggcugaccgugaugagagagcagaaguucagaagcagaaacaacggccaggcccccgacgccuacagacccagagacgacagcuuccacgugauccugaacaagagcagccccgaggagcagcugggcaucaagcuggugagaaagguggacgagcccggcguguucaucuucaacgugcuggacggcggcguggccuacagacacggccagcuggaggagaacgacagagugcuggccaucaacggccacgaccugagauacggcagccccgagagcgccgcccaccugauccaggccagcgagagaagagugcaccugguggugagcagacaggugagacagagaagccccgacaucuuccaggaggccggcuggaacagcaacggcagcuggagccccggccccggcgagagaagcaacacccccaagccccugcaccccaccaucaccugccacgagaagguggugaacauccagaaggaccccggcgagagccugggcaugaccguggccggcggcgccagccacagagagugggaccugcccaucuacgugaucagcguggagcccggcggcgugaucagcagagacggcagaaucaagaccggcgacauccugcugaacguggacggcguggagcugaccgaggugagcagaagcgaggccguggcccugcugaagagaaccagcagcagcaucgugcugaaggcccuggaggugaaggaguacgagccccaggaggacugcagcagccccgccgcccuggacagcaaccacaacauggccccccccagcgacuggagccccagcugggugauguggcuggagcugcccagaugccuguacaacugcaaggacaucgugcugagaagaaacaccgccggcagccugggcuucugcaucgugggcggcuacgaggaguacaacggcaacaagcccuucuucaucaagagcaucguggagggcacccccgccuacaacgacggcagaaucagaugcggcgacauccugcuggccgugaacggcagaagcaccagcggcaugauccacgccugccuggccagacugcugaaggagcugaagggcagaaucacccugaccaucgugagcuggcccggcaccuuccuguaa

SEQ ID NO: 19330 - RNA, 2073 nt, Artificial Sequence
  LNX2__Homo_sapiens__NP_699202
augggcaccaccagcgacgagauggugagcguggagcagaccagcagcagcagccugaacccccugugcuucgagugcggccagcagcacuggaccagagagaaccaccuguacaacuaccagaacgagguggacgacgaccuggugugccacaucugccugcagccccugcugcagccccuggacacccccugcggccacaccuucugcuacaagugccugagaaacuuccugcaggagaaggacuucugcccccuggacagaaagagacugcacuucaagcugugcaagaagagcagcauccuggugcacaagcugcuggacaagcugcuggugcugugccccuucagcagcgugugcaaggacgugaugcagagaugcgaccuggaggcccaccugaagaacagaugccccggcgccagccacagaagaguggcccuggagagaagaaagaccagcagaacccaggccgagaucgagaacgagaacggccccacccugcuggaccccgccggcacccugagccccgaggccgacugccugggcaccggcgccgugcccguggagagacaccugaccagcgccagccugagcaccuggagcgaggagcccggccuggacaaccccgccuucgaggagagcgccggcgccgacaccacccagcagccccugagccugcccgagggcgagaucaccaccaucgagauccacagaagcaaccccuacauccagcugggcaucagcaucgugggcggcaacgagaccccccugaucaacaucgugauccaggagguguacagagacggcgugaucgccagagacggcagacugcuggccggcgaccagauccugcaggugaacaacuacaacaucagcaacgugagccacaacuacgccagagccgugcugagccagcccugcaacacccugcaccugaccgugcugagagagagaagauucggcaacagagcccacaaccacagcgacagcaacagccccagagaggagaucuuccagguggcccugcacaagagagacagcggcgagcagcugggcaucaagcuggugagaagaaccgacgagcccggcguguucauccuggaccugcuggagggcggccuggccgcccaggacggcagacugagcagcaacgacagagugcuggccaucaacggccacgaccugaaguacggcacccccgagcuggccgcccagaucauccaggccagcggcgagagagugaaccugaccaucgccagacccggcaagccccagcccggcaacaccaucagagaggccggcaaccacagcagcagcagccagcaccacacccccccccccuacuacagcagacccagcagccacaaggaccugacccagugcgugaccugccaggagaagcacaucaccgugaagaaggagccccacgagagccugggcaugaccguggccggcggcagaggcagcaagagcggcgagcugcccaucuucgugaccagcgugcccccccacggcugccuggccagagacggcagaaucaagagaggcgacgugcugcugaacaucaacggcaucgaccugaccaaccugagccacagcgaggccguggccaugcugaaggccagcgccgccagccccgccguggcccugaaggcccuggaggugcagaucguggaggaggccacccagaacgccgaggagcagcccagcaccuucagcgagaacgaguacgacgccagcuggagccccagcugggugauguggcugggccugcccagcacccugcacagcugccacgacaucgugcugagaagaagcuaccugggcagcuggggcuucagcaucgugggcggcuacgaggagaaccacaccaaccagcccuucuucaucaagaccaucgugcugggcacccccgccuacuacgacggcagacugaagugcggcgacaugaucguggccgugaacggccugagcaccgugggcaugagccacagcgcccuggugcccaugcugaaggagcagagaaacaaggugacccugaccgugaucugcuggcccggcagccugguguaa

SEQ ID NO: 19331 - RNA, 1755 nt, Artificial Sequence
  LOC100288966__Homo_sapiens__NP_001244291
augguggccgaggugugcagcaugcccaccgccagcaccgugaagaagcccuucgaccugagaagcaagaugggcaaguggugccaccacagauuccccugcugcagaggcagcggcaagagcaacaugggcaccagcggcgaccacgacgacagcuucaugaagaugcugagaagcaagaugggcaagugcugcagacacugcuuccccugcugcagaggcagcggcaccagcaacgugggcaccagcggcgaccacgagaacagcuucaugaagaugcugagaagcaagaugggcaaguggugcugccacugcuuccccugcugcagaggcagcagcaagagcaacgugggcgccuggggcgacuacgaccacagcgccuucauggagcccagauaccacgugagaagagaggaccuggacaagcugcacagagccgccugguggggcaaggugcccagaaaggaccugaucgugaugcugagagacaccgacaugaacaagagagacaaggagaagagaaccgcccugcaccuggccagcgccaacggcaacagcgagguggugcagcugcugcuggacagaagaugccagcugaacgugcuggacaacaagaagagaaccgcccugaucaaggccauccagugccaggaggacgagugcgugcugaugcugcuggagcacggcgccgacagaaacauccccgacgaguacggcaacaccgcccugcacuacgccaucuacaacgaggacaagcugauggccaaggcccugcugcuguacggcgccgacaucgagagcaagaacaagugcggccugaccccccugcugcugggcgugcacgagcagaagcagcagguggugaaguuccugaucaagaagaaggccaaccugaacgugcuggacagauacggcagaaccgcccugauccuggccgugugcugcggcagcgccagcaucgugaaccugcugcuggagcagaacguggacgugagcagccaggaccugagcggccagaccgccagagaguacgccgugagcagccaccaccacgugaucugcgagcugcugagcgacuacaaggagaagcagaugcugaagaucagcagcgagaacagcaaccccgagcaggaccugaagcugaccagcgaggaggagagccagagacugaaggugagcgagaacagccagcccgagaagaugagccaggagcccgagaucaacaaggacugcgacagagagguggaggaggagaucaagaagcacggcagcaaccccgugggccugcccgagaaccugaccaacggcgccagcgccggcaacggcgacgacggccugaucccccagagaagaagcagaaagcccgagaaccagcaguuccccgacaccgagaacgaggaguaccacagcgacgagcagaacgacaccagaaagcagcugagcgaggagcagaacaccggcaucagccaggacgagauccugaccaacaagcagaagcagaucgagguggccgagcagaagaugaacagcgagcugagccugagccacaagaaggaggaggaccugcugagagagaacagcgugcugcaggaggagaucgccgugcugagacuggagcuggacgagaccaagcaccagaaccagcugagagagaacaagauccuggaggagaucgagagcgugaaggagaagaccgacaagcugcugagagccaugcagcugaacgaggaggcccugaccaagaccaacaucuaa

SEQ ID NO: 19332 - RNA, 1650 nt, Artificial Sequence
  LOC101060321__Homo_sapiens__NP_001278391
auggacgugguggagguggccggcagcuggugggcccaggagagagaggacaucaucaugaaguacgagaagggccacagagccggccugcccgaggacaagggccccaagcccuucagaagcuacaacaacaacguggaccaccugggcaucgugcacgagaccgagcugcccccccugaccgccagagaggccaagcagaucagaagagagaucagcagaaagagcaaguggguggacaugcugggcgacugggagaaguacaagagcagcagaaagcugaucgacagagccuacaagggcaugcccaugaacaucagaggccccauguggagcgugcugcugaacaucgaggagaugaagcugaagaaccccggcagauaccagaucaugaaggagaagggcaagagaagcagcgagcacauccagagaaucgacagagacaucagcggcacccugagaaagcacauguucuucagagacagauacggcaccaagcagagagagcugcugcacauccugcuggccuacgaggaguacaaccccgaggugggcuacugcagagaccugagccacaucgccgcccuguuccugcuguaccugcccgaggaggacgccuucugggcccuggugcagcugcuggccagcgagagacacagccugcagggcuuccacagccccaacggcggcaccgugcagggccugcaggaccagcaggagcacgugguggccaccagccagcccaagaccaugggccaccaggacaagaaggaccugugcggccagugcagcccccugggcugccugaucagaauccugaucgacggcaucagccugggccugacccugagacugugggacguguaccugguggagggcgagcaggcccugaugcccaucaccagaaucgccuucaaggugcagcagaagagacugaccaagaccagcagaugcggccccugggccagauucugcaacagauucguggacaccugggccagagacgaggacaccgugcugaagcaccugagagccagcaugaagaagcugaccagaaagcagggcgaccugcccccccccgccaagcccgagcagggcagcagcgccagcagacccgugcccgccagcagaggcggcaagacccugugcaagggcgacagacaggccccccccggcccccccgccagauuccccagacccaucuggagcgccagcccccccagagcccccagaagcagcacccccugccccggcggcgccgugagagaggacaccuaccccgugggcacccagggcgugcccagccccgcccuggcccagggcggcccccagggcagcuggagauuccugcaguggaacagcaugcccagacugcccaccgaccuggacguggagggccccugguucagacacuacgacuucagacagagcugcugggugagagccaucagccaggaggaccagcuggcccccugcuggcaggccgagcaccccgccgagagagugagaagcgccuucgccgcccccagcaccgacagcgaccagggcacccccuucagagccagagacgagcagcagugcgcccccaccagcggccccugccugugcggccugcaccuggagagcagccaguucccccccggcuucuaa

SEQ ID NO: 19333 - RNA, 453 nt, Artificial Sequence
  LOC102723475__Homo_sapiens__XP_006724009
auggccuaccuggaggugugccugggcagccugagcugcagcagcggcacccugaugcccagaaugauccugagcaacaccaccgccgugacccccuuccugaccaagcuguggcaggagaccgugcagcagggcggcaacaugagcggccuggccagaagaagccccagaagcggcgacggcaagcuggaggcccuguacgugcugauggugcugggcuucuucggcuucuucacccugggcaucaugcugagcuacaucagaagcaagaagcuggagcacagcaacgaccccuucaacguguacaucgagagcaacgccuggcaggagaaggacaaggccuacgugcaggccagagugcuggagagcuacagaagcugcuacgugguggagaaccaccuggccaucgagcagcccaacacccaccugcccgagaccaagcccagccccuaa

SEQ ID NO: 19334 - RNA, 1551 nt, Artificial Sequence
  LOC102723996__Homo_sapiens__XP_006723962
augagacugggcagccccggccugcuguuccugcuguucagcagccugagagccgacacccaggagaaggaggugagagccauggugggcagcgacguggagcugagcugcgccugccccgagggcagcagauucgaccugaacgacguguacguguacuggcagaccagcgagagcaagaccguggugaccuaccacaucccccagaacagcagccuggagaacguggacagcagauacagaaacagagcccugaugagccccgccggcaugcugagaggcgacuucagccugagacuguucaacgugaccccccaggacgagcagaaguuccacugccuggugcugagccagagccugggcuuccaggaggugcugagcguggaggugacccugcacguggccgccaacuucagcgugcccguggugagcgccccccacagccccagccaggacgagcugaccuucaccugcaccagcaucaacggcuaccccagacccaacguguacuggaucaacaagaccgacaacagccugcuggaccaggcccugcagaacgacaccguguuccugaacaugagaggccuguacgacguggugagcgugcugagaaucgccagaacccccagcgugaacaucggcugcugcaucgagaacgugcugcugcagcagaaccugaccgugggcagccagaccggcaacgacaucggcgagagagacaagaucaccgagaaccccgugagcaccggcgagaagaacgccgccaccuggagcauccuggccgugcugugccugcugguggugguggccguggccaucggcugggugugcagagacagaugccugcagcacagcuacgccggcgccugggccgugagccccgagaccgagcugaccggcgaguucgccgugggcagcagcagauucuggggcgcccagggcagacugggcugccagcugagcuucagagugagcaagaacuuccagaaggccgaggugcccugccuggagcagcugcuguuccuggagacccagagaagccccagauggugcgccagacacuuccugcagcccccccugggcaugggcuggcaccccggcgugcacuucgugacccugagaugggacuuccccaacaugcacagaagcagagagaccagcgccagacugcccagaagccccgugcccagccccgaccagggcgugcagggcggcagcagacacagaagacccgcccccaugggcugccccgagugggugcaggcccccgcccccagccccagaggcgugagcagagccggccccggcaccggcgcccagccccccuggggcgugcagggcggcagcagacacagaagacccgcccccaugggcugccccgagugggugcaggcccccgcccccagccccagaggcgugugcagagccggccccggcaccggcgcccagccccuguggggcgugagaagcggcagcggccacagacagcugcugagcguggccgccacccccgccgcccuggugugccccagcgugcccggcgccaccuaa

SEQ ID NO: 19335 - RNA, 399 nt, Artificial Sequence
  LOC102724127__Homo_sapiens__XP_011544335
augagagccagccccugcaucagccagcccgccgccagcuggcaccccagacccagcgcccugagacccaccgccggcagcggccccgacaccagaacccccggcaccguggaggacggcagcgcccccugccccgccuucagaagccccgccgugagccccugcggcgaggagcccugcugcuuccagaucagccccgccgaggagacccuggagcugggcagacuggugagccccggcaacugcgacacccugagccccagagccgccggcuucuacgccugccacgugagaagccugauccccugcagaagcaccaagggcagauggccccugaccgccagcgccgccggccugagcagacacgcccagugcggccccagccugggccugggcuaa

SEQ ID NO: 19336 - RNA, 1656 nt, Artificial Sequence
  LOC102724560__Homo_sapiens__XP_011544402
augcccagcgagaccccccaggccgaggugggccccaccggcugcccccacagaagcggcccccacagcgccaagggcagccuggagaagggcagccccgaggacaaggaggccaaggagccccuguggaucagacccgacgcccccagcagaugcaccuggcagcugggcagacccgccagcgagagcccccaccaccacaccgcccccgccaagagccccaagauccugcccgacauccugaagaagaucggcgacacccccauggugagaaucaacaagaucggcaagaaguucggccugaagugcgagcugcuggccaagugcgaguucuucaacgccggcggcagcgugaaggacagaaucagccugagaaugaucgaggacgccgagagagacggcacccugaagcccggcgacaccaucaucgagcccaccagcggcaacaccggcaucggccuggcccuggccgccgccgugagaggcuacagaugcaucaucgugaugcccgagaagaugagcagcgagaagguggacgugcugagagcccugggcgccgagaucgugagaacccccaccaacgccagauucgacagccccgagagccacgugggcguggccuggagacugaagaacgagauccccaacagccacauccuggaccaguacagaaacgccagcaacccccuggcccacuacgacaccaccgccgacgagauccugcagcagugcgacggcaagcuggacaugcugguggccagcgugggcaccggcggcaccaucaccggcaucgccagaaagcugaaggagaagugccccggcugcagaaucaucggcguggaccccgagggcagcauccuggccgagcccgaggagcugaaccagaccgagcagaccaccuacgagguggagggcaucggcuacgacuucauccccaccgugcuggacagaaccgugguggacaagugguucaagagcaacgacgaggaggccuucaccuucgccagaaugcugaucgcccaggagggccugcugugcggcggcagcgccggcagcaccguggccguggccgugaaggccgcccaggagcugcaggagggccagagaugcguggugauccugcccgacagcgugagaaacuacaugaccaaguuccugagcgacagauggaugcugcagaagggcuuccugaaggaggaggaccugaccgagaagaagcccuggugguggcaccugagagugcaggagcugggccugagcgccccccugaccgugcugcccaccaucaccugcggccacaccaucgagauccugagagagaagggcuucgaccaggcccccgugguggacgaggccggcgugauccugggcauggugacccugggcaacaugcugagcagccugcuggccggcaaggugcagcccagcgaccaggugggcaaggugaucuacaagcaguucaagcagaucagacugaccgacacccugggcagacugagccacauccuggagauggaccacuucgcccugguggugcacgagcagauccaguaccacagcaccggcaagagcagccagagacagaugguguucggcguggugaccgccaucgaccugcugaacuucguggccgcccaggagagagaccagaaguaa

SEQ ID NO: 19337 - RNA, 663 nt, Artificial Sequence
  LOC102724770__Homo_sapiens__XP_006724997
auggagagauacgccggcgcccuggaggagguggccgacggcgccagacagcaggagagacacuaccagcugcugagcgcccugcagagccuggugaaggagcugcccagcagcuuccagcagagacugagcuacaccacccugagcgaccuggcccuggcccugcuggacggcaccguguucgagaucgugcagggccugcuggagauccagcaccugaccgagaagagccuguacaaccagagacugagacugcagaacgagcacagagugcugagacaggcccugagacagaagcaccaggaggcccagcaggccugcagaccccacaaccugcccgugcugcaggccgcccagcagagagagcuggaggccguggagcacagaaucagagaggagcagagagccauggaccagaagaucgugcuggagcuggacagaaagguggccgaccagcagagcacccuggagaaggccggcguggccggcuucuacgugaccaccaacccccaggagcugaugcugcagaugaaccugcuggagcugaucagaaagcugcagcagagaggcugcugggccggcaaggccgcccugggccugggcggccccuggcagcugcccgccgcccagugcgaccagaagggcagccccgugccccccuaa

SEQ ID NO: 19338 - RNA, 2292 nt, Artificial Sequence
  LOC102725016__Homo_sapiens__XP_006725712
augcacggcgccugcagcaugagaagauuccacccccugcuggcccuggccggcacccacugcgccugcagccacuucagaagcagcagaaccgccaccccccccugggccgccccccugaagauccugaacgccgagagagccagagccgugagacccccccagccccugcccagaccccacagaagcagaagcgccccccccaagccccccgccaaggcccccagagccgccggcagagccuggcuggccgccgccagccccagagacgacaucguggccaugaccagaagaagcgacgugaacgccggcgcccuggugugggagagaggcagaagagccagauucgaggccgcccugagcagcgccggcagaaccgcccccccccccagaagccccagacccgccagccccagaagcagcagaggcgccggccccgugcccugcgccgcccccccccagagagccgugcuggccagccccagaagcgugagaggcggccccaagccccccggcagaggcggcgccagagccagcggcggcgccgccggccccgcccccgccaugccccccggcaaggugcugcagcccgugcugaagaugaagguggacgagcuguuccuguacuggcugagcgaggccagcacccagagaaugcugcaggacugccugagaagaaucaaggcccccggcagagaccagcccacccccggcgacggcgagcagcccggcgccuggcccaccgccccccuggccgcccccagacccagcggccuggagccccccggcacccccggccccggccccgcccugccccugggcgccgccagcagccccagaaacgccccccacgugagaggcaccagaagaagcgccggcaccagaguggugcagaccagaaaggaggagccccugccccccgccaccagccagagcauccccaccuucuacuuccccagaggcagaccccaggacagcgugaacguggacgccgugaucagcaagaucgagagcaccuucgccagauucccccacgagagagccaccauggacgacaugggccugguggccaaggccugcggcugcccccuguacuggaagggcccccuguucuacggcgccggcggcgagagaaccggcagcgugagcgugcacaaguucguggccauguggagaaagauccugcagaacugccacgacgacgccgccaaguucgugcaccugcugaugagccccggcugcaacuaccuggugcaggaggacuucgugcccuuccugcaggacguggugaacacccaccccggccugagcuuccugaaggaggccagcgaguuccacagcagauacaucaccaccgugauccagagaaucuucuacgccgugaacagaagcuggagcggcagaaucaccugcgccgagcugagaagaagcagcuuccugcagaacguggcccugcuggaggaggaggccgacaucaaccagcugaccgaguucuucagcuacgagcacuucuacgugaucuacugcaaguucugggagcuggacaccgaccacgaccugcugaucgacgccgacgaccuggccagacacaacgaccacgcccugagcaccaagaugaucgacagaaucuucagcggcgccgugaccagaggcagaaaggugcagaaggagggcaagaucagcuacgccgacuucgugugguuccugaucagcgaggaggacaagaagacccccaccagcaucgaguacugguucagaugcauggaccuggacggcgacggcgcccugagcauguucgagcuggaguacuucuacgaggagcagugcagaagacuggacagcauggccaucgaggcccugcccuuccaggacugccugugccagaugcuggaccuggugaagcccagaaccgagggcaagaucacccugcaggaccugaagagaugcaagcuggccaacguguucuucgacaccuucuucaacaucgagaaguaccuggaccacgagcagaaggagcagaucagccugcugagagacggcgacagcggcggccccgagcugagcgacugggagaaguacgccgccgaggaguacgacauccugguggccgaggagaccgugggcgagcccugggaggacggcuucgaggccgagcugagccccguggagcagaagcugagcgcccugagaagcccccuggcccagagacccuucuucgaggcccccagcccccugggcgccguggaccuguacgaguacgccugcggcgacgaggaccuggagccccuguaa

SEQ ID NO: 19339 - RNA, 1899 nt, Artificial Sequence
  LOC102725035__Homo_sapiens__XP_006726376
augacccccgcccugaccgcccugcugugccugggccugagccugggccccagaaccagagugcaggccggccccuuccccaagcccacccugugggccgagcccggcagcgugaucagcuggggcagccccgugaccaucuggugccagggcagccuggaggcccaggaguacagacuggacaaggagggcagccccgagccccuggacagaaacaacccccuggagcccaagaacaaggccagauucagcauccccagcaugaccgagcaccacgccggcagauacagaugccacuacuacagcagcgccggcuggagcgagcccagcgacccccuggagcuggugaugaccggcuucuacaacaagcccacccugagcgcccugcccagccccgugguggccagcggcggcaacaugacccugagaugcggcagccagaagggcuaccaccacuucgugcugaugaaggagggcgagcaccagcugcccagaacccuggacagccagcagcugcacagcggcggcuuccaggcccuguuccccgugggccccgugaaccccagccacagauggagauucaccugcuacuacuacuacaugaacaccccccagguguggagccaccccagcgacccccuggagauccugcccagcggcgugagcagaaagcccagccugcugacccugcagggccccgugcuggcccccggccagagccugacccugcagugcggcagcgacgugggcuacgacagauucgugcuguacaaggagggcgagagagacuuccugcagagacccggccagcagccccaggccggccugagccaggccaacuucacccugggccccgugagccccagccacggcggccaguacagaugcuacggcgcccacaaccugagcagcgaguggagcgcccccagcgacccccugaacauccugauggccggccagaucuacgacaccgugagccugagcgcccagcccggccccaccguggccagcggcgagaacgugacccugcugugccagagcugguggcaguucgacaccuuccugcugaccaaggagggcgccgcccaccccccccugagacugagaagcauguacggcgcccacaaguaccaggccgaguuccccaugagccccgugaccagcgcccacgccggcaccuacagaugcuacggcagcuacagcagcaacccccaccugcugagcuuccccagcgagccccuggagcugauggugagcggccacagcggcggcagcagccugccccccaccggcccccccagcacccccggccugggcagauaccuggaggugcugaucggcgugagcguggccuucgugcugcugcuguuccugcugcuguuccugcugcugagaagacagagacacagcaagcacagaaccagcgaccagagaaagaccgacuuccagagacccgccggcgccgccgagaccgagcccaaggacagaggccugcugagaagaagcagccccgccgccgacgugcaggaggagaaccuguacgccgccgugaaggacacccagagcgaggacagaguggagcuggacagccagcagagcccccacgacgaggacccccaggccgugaccuacgcccccgugaagcacagcagccccagaagagagauggccagcccccccagcagccugagcggcgaguuccuggacaccaaggacagacagguggaggaggacagacagauggacaccgaggccgccgccagcgaggccagccaggacgugaccuacgcccagcugcacagccugacccugagaagaaaggccaccgagcccccccccagccaggagggcgagccccccgccgagcccagcaucuacgccacccuggccauccacuaa

SEQ ID NO: 19340 - RNA, 9861 nt, Artificial Sequence
  LOC400499__Homo_sapiens__XP_006721060
augaccgccugcaccggcagcgccggcccccaccugcccgugggcaccagauacaccuaccacuucagcaccaacaccagcaccagccugcaggacgugcugguggagggcagcggccugggccugcagggccuggccgugcuggacgugcugggccugugccagauggcccuguggcugcaggacuuccaggugaccagcauccugggcgccaagguggagcugcugaaggagagcgagagccugagcgccacccugggcagaaacccccugagauucauccugcacagcggcagaguggcccaccugugcccccaccccaccgagcccagaugggugcugaacgugaagagagccgugcugagccugcugcagggccaccccggcgcccacagccccaagaccuucgacgagguggacauccugggcagaugccccaccaccuaccagcaccacggcgacuggcugcacaagaccaaggaccuggccagaugcagccugagaagaggcagaagcagccugcacagccaggcccugcccggcguggcccccggccugaccagcagacugaccugcgugcagagcuucagagccggcgugcugagagaggccagcugcaccgagcuggacagcgccggcccccugcccgccaaggccagcgccgugcagaugagaacccugagcagccugagccugcugcacgagaugccccaggaccccgccggcaccgaccccgacgacagagacgacgaggacaugacccccagcagccugcuguacgagugggaggagacccccagccaggccaugguggccaccgccgccacccuggugagaagacugugccuggcccagaccaccagccuggaggccauggaccuguuccugacccuggugagccagcugcagggccugagcggcggcgagcugauggagcuguggcaguacagcagcuucaagugcagagacaacggccagccccugcuggacgcccugcccagcugcggcaccgagcacugcgugggccugaugaaggagcugaucgccagcgccgccguggaggccgacgagguggaggccuggcugagcagccuggccuuccugccccagcccaccgacgccauggugcacaugcugcugccccugcugcagacccccagagccagccccggcgccuuccugggcaucagcgcccuggugcacaaccugugcgccagccuggacggccccugcggccagcugcccggcgugggcagccuggugagaauccugggcgacgcccugggcgagaacugcaccauccaggagcccagcgacgacgacaagcugcagcuggugcugaaggccgugggcaacgccggccuggccgccauggcccugacccccacccugagcgccugcgccagccugagaagcagcacccccgagaucagacugggcgccauccaggccuucagaagagugcccugcagcgccgacagaagcgugcugagcagacuguaccagagccuggaggaggacgccgagaucagaaucaacgccuaccuggcccugaugagaugccccagcgaggagguguucgcccaggugagaagaacccaggccggcgagcugagcacccaggugggcagcuucguguggagccacauccugcagcugcuggagacccacgacccccugaagagagcccugagagacacccugcccgaggacauccugagccaggaguuccaccccgagauguggaagcacagcagcuacagcgacgugaccuucagaagcgugagcggcagccugggcgccaaccuggagggcacccugcuguucagccccgccagcuuccugcccagaagcgccaccgugaaccugaccauccacaccaugggcagagccuucaaccugcuggagcugggccugagacuggagaacgccgaggagaucgcccacagacuguucggcagaaagagcuucuggggccaggaggacggcagagagcccgagcccgaggagccccccggccccgagcccggccccgccccccagcccgccagccccgagugccccggcgacagagacagaagaaugagauaccugcagcagaaggugaccagaagaagaggcgccagacaggcccugagaugcgagcugagcgugaagcugcugggccaggagcugagcuucgugaacugcggcgccaccggcagccacgugaaccacuggccccugaaccuggccgagcuggccaucaagcugaugaagggccaggaggugcagaugaacagaagacugagccuggccgcccaggagcugguguuccccaccgugagcggccugcccgccagacugacccugaacgccagcgccgccaucagcaucagagugagaggcaccaccgacuuccagcagagaagcgacuucagcgugaacggcuacgugaagcccagcgcccugcugcagaucagcgcccagaugggcaccgccggcauccugggccaggccggccugagaugggugaccagcgugagaagcgccgccagccuggacggcggcauccaggugcagaagggcagagugcugaaggugcaccugaacacccccgaggaggccguggagcugcugagcuucagcagccagcuguaccugaucaccagagacggcgugagaagccugagacacgugcccggccccagcgaggugcagagcugcaccggcgaggaggugagcuacaccuggggcuggagacugugcaccggcgugaccuggcccgugcccggccagcccuaccugcugagccugcccguguucgccgccgugacccugcagaagagagaccccggccugagacaguaccugcuggaggccgccuacacccugcagccccagaagggcagcugguucccccaggaggccaccgcccacguguucaugggcacccccggcagcgaggugcugagagacgugggcguggacaugagcuacagccugccccagaacaaguucagacugaagcugcugcaccccaagaagaagaucgagcuggacggcaagauggaggcccugggcagcgcccacaccggccaccuggagcuggugcuggacgacagagacguguacuacaucaagggcuggagcgaccugcagcccgccaugggcggcgaggccgagagauuccaggcccagcuggaggugaagcuggugaccggcggcagccccgugguguucaccggcaaccugaccagacaggugggcagcaagcuggccuucagcgccagccugagccaccugcugagcgaccaggccaacgugaccgcccugcuggagagaaaggaggagaacggcagaagaguggccgcccugggcgccgagcuguucgugcccggccuggugggccugagagcccugggccugcugcagcagagaggccagcuguggaccaacagccugagaauccaguacagccugcugggccaggccaagcaggccgcccacgagugcagcaccagccagaagcugagagccgacagcggcagcgacggcgccuacagacuggagcugagacacgagcugcacugcacccagauccuggccuucagccacaaggugcagcuguggcacgaggaggacagcggccaccugcacagccagcuggaggugagcuacggcaagcacugggacaagaacagcaacaagagacaccugagagugagccagaccuucaagaacgacagcggccccgcccugagcaaccacuucauggaguucgugcugcaggugcccgagagacagguggacugcagagugcagcuguaccaccugagccugagacugcccuacguggagagcagcagccaccugaaggugcaguacaacggcagaccccuguucguggccggcggccaguggaaggacaccagcagagccacccuguggaagugggagggcgcccugaaccuggacagccccuggcugauggugagcgccgcccacagacuguacuggccccacagagccguguuccaggccgugcuggagcugacccugggcaaggccuggacccugaaggaccugguggugagcgugggcugcagaagccagggccccaacagagagggcaagauccagguguacaccgccgccaccaccuaccugagagugagcaccgugaccgugcuggcccagagccuguuccacagcuggagcgagcuggagagcgccuggaacgccgccgugcagggcgagauccacgccgagaacagcagagacagaaagauccugaacugcuggcugaagggcccccagcaggagcugaaccugaccgccgccuacagacaccuggaguggcccagaaagacccaggugagccugaccgccgugagaaucggcgcccagggccagcccagaggccugcagcuggagggcgagcuggaggagcugagacaggacagaacccuguacagaaagagaggcgcccugcugcugagacacccccugcaccugcccaucccccagagccugcugcugcaggagaccuucaccgccgacagaagacaccagagauacagccuggagaccagaguggugcugaacggcagagaggagacccugcagaccauggugcugggcugccaggccggccaccccuacgugugcgccggccugaugcaccccuacgacggcaaggugauccccagaaacaccgagggcugccuggugaccuggaaccagcacaccgccaagaacagagagguggaggccacccugaaggugcacagaaagguggugcugcaccugaagggccugcaccacgacagaagccagcacggcgagaucagacacagccuggcccuggaccuggcccacagcuaccagcugagcuucccccaggcccugagccuggacggcggcaucaucuucagacagagcccccagggcaccuucaacuucggcauggacgccagagccgccgugaaccacaacgugaccagccaggccagcgugcagcugaacggcagcgacagcgacuucgccuucuucuuccagcugagacacccccacggccccaccuucccccccaacuuccaggugcaggccgccgccggcagauacagagugagaagccugaacggcagccugagcgugcagaugagcggcagagagcuggugcugcuggagguggacgccagccaggacaccagaagaagcagcagaggcuggggcgugagcgugcugcugcaccaggccgugcugagcgcccccagagccgugagacugcagcugagcgccaagaucacccccgccagaaucuggcuguucagcaaggcccugcuggaccagaacaccgcccagcugcugcugaaggccagcgaggaguggagaggcggcagaauccugaccuuccagagccagaccagacacaccguggccggcugggccgccaugcccagacugcugacccugaccggcagacugaagcagaaggagacccugcaggagggcacccugagcgugaccgccgacagcgccgugcugggcuuccugcugagagaccagcacgagaaggccggcaacggcaccagcgugagaagcgugaccugcgugcuggcccagaacagcagccaggcccugcccggcgagcugcagcugaagggcagacugcaggcccagaccagaaaccugagagcccaggccagcaucagagcccacgccgccagccuggcccugggcggcgccugcagcuggggccccagacacggccagcuggccggcggccccacccacaacaucagcacccugagcgacgccggccugcccagcgaggccggcaugcugcugagccugacccacguggccagcaacugcagcgccagacuggcccuguggaacgccggcgcccagcuggacggcgccaucggccuggaggacgugacccccgagagcagcggccugcagcugcacgccagccugagacacacccacaccaugcccagccugaagcacuggggccugcccuucagccuggacggccacggccacuuccagagcgugggcagaagccuggccgccggccugaccgugauccuggacggcgagcagcugagagccgcccuggagagaaaggccgagggcggcagacagggccuggugcugggccugcaccacggccugagcggccugcagggcacccugcccagccagcuggaggugaacugcagcggcgacgccagccccacccagcugcugggcuggugcagaggcgacaucgccggccagccccuggaggugagcguggacauccacaacggcagcagcggcuucgagcacagcggcagaauccugaugggccccaccuuccugaacuacagcgugagcugcuacuaccacgacggccaccuggagcugagcggcagaagcuggcacaacagcgaggcccugcugugggccggcuuccccggcgaggccugccugagcgccgagcugcagauccacgagacccagacccaggccagaguggcccugcacggcggcgacagcggcgugagcauggaccuggccgcccugguggccagacccagaagaggcccccugcagcugguggccagcgccagccacaccgugcccgcccugcagagacugggccugcccuucaccaaccagcugguguuccagggccugugggaggccgaggagaugagcagcagccugcagcugaccugcgacagccaggccacccuggugcuggacgugagaggccagaaccaggccgugagcaaggagcugcuguucagcggcagacacagacugcccuuccugcugggccugugccccagcagcgccagcgccagcgccaagcugcacuacagcaagggcgaggugcagagcauguucgcccugggcguggaggagagacacuuccacaucagcaccagacagguggccgccaaggccggccugaacaacuucaucaagcuggagcagaccuuccugcagcugagcgcccugcccagagagcuguuccugcagaccgccuacgagagagcccacggcaccagagugcugagacagguggugcugugggacggccaggagguggcccugaccggcagccugagcggccccuuccccaagcccaccagaaaccugagccugcagguggagcugacccacccccugccccugccccugcccagacacugcagccugagacugagcagcgagcaccugggcggcagccacagagacggccugguggugggcugggacggcagagaccaggugcuggugagcagcagccuguggcugggcaagagcgagcuggccgccagacuggcccuggcccaccccuucaaccugcccuggagacaggccgaggccagcggccuggccgagagcagaggcggcagacagagcagacaggugcagcugaccuggaacagaggccagcccgccacccugcagcugaccugggccgacggcagccuggcccacagcaccgccugggacggcugccuggccgccagccccggccagcugcaggagaccuggggccugaacagccugcaggccugcggcgccuucacccagacccccgccguguucguggagcagcugaacgugagcuggggccagcacagaaugagacagaaccugaccuacgagagacacuggcccagccagcccgacaagaucaucauggaggccacccuggagcacgugcugggcgccagcugcaccagacagagcuucuggggcgaggugcagaccgacuacgccagauggcugagacacagccugcaccugggccugugcgaccugcccagagcccugcugguggugggcgagcacacccugggccagggcggccugcugcugagaagcagaugccaccugggccuggcccccgaccccgaccacggccugcaccugagccugacccugcagaaccacagcagacccagaagcgccgacuucagcggcgcccuggagcugagaggcagcaaggcccagagagugggccugcugggcagagugagcaccagcaccagccagagccuggugagacuggagggcagcguggacaacagagaggagaaggugagacugagcguguucagagcccccagcugccugcaggccagcguggcccacgaggagggcggcagagaggagagcguggugcugagagccugcgcccacggcagaaccgccgaggccgaggugcuguucagagacggcagacagcccagccagccccugggcagacugacccugcaggccgccaaccagagccugcugcuggccgccagaggcugccagggcggccugcugggccacguggagagcagaaucgccgccgugggcagccaggugcaggccagacuggaggagaaggugcagggccugggcgccagcgugagaagauuccagcagcuggugcagcccgccggcacccuggacggcguggccggccugcugcugcagcugagccaggccggcagagaggccaugcaggccagcggcugggccguggccacccugugggccagaagccaggcccugacccagcaccugccccuguaccuggaguggcugcaggugggccuggagcagcugagagaggagcuggaguggccccuggccacccugaaggacgccuaccuggaggugacccugagaccccuggaggagguguggagagagagagccgaggaggccaugagaagacugcaggccugggugcccggcaugcccggcaagggcggccccagacccaucagagccgcccugggcgccaugaagggcgcccuggagcuggccgcccagcagaugcugagcugggccgaggccaccuucagcagagcccugaagagacugugcaagccccugcuggaccuguacagccugagcgccagaaacagaagcgugguggugaugcugccccugcugcccgccggcgacgagccccuggacguggccagagugaccagcuaccugauggaggagaagcugcugagaccccugagagagcugagcggcgccaacgugcuggccgaguacuacuggcugagaagaagacugcuggccggccccugggaguaccacgcccugguggccggcgcccagcacguggugaccuucgacggcagagugugggaccugagcacccagugcggcagcauccugcuggcccaggacuucgcccacaacaccuucagccugacccugagcagaaccggcagcggccugaccgcccuguucguggagcugaaccacaagacccugauccuguaccccagccugcaggccuacagacuguacaacagcagccugcccggcgacagcugccccgaccugaagcugcaccccgccaccaccagaaaggacgugagcagaaucgagcuggccagcgaggacggcgugagcgugagcugcgacgugcccaccggccugugcagccugacccugggccuguggcagcacggcaucagcgccggccugcugggcaccaacgacaacgaggccggcaacgagcugaugcugcccgacggcagcauggccagaagccuggaggagcugagccuggccuggcaggugggcggcgacugcagagccaccgagaagccccagcaggagcaggccugccccggccagcugcccgccugcugggccuucuucgagggcccccacagcagccugagagacugcuucagagugguggaccccacccccuuccugagccugugcgugcaggugcccugcggcacccaggagcugcagcccgccugcaaccuggccgccgccuacauccaccugugcgccagaggcuucgugccccuggccccccccccccagugcgcccccuaa

SEQ ID NO: 19341 - RNA, 1251 nt, Artificial Sequence
  LOC400927-CSNK1E__Homo_sapiens__NP_001276841
auggagcugagagugggcaacaaguacagacugggcagaaagaucggcagcggcagcuucggcgacaucuaccugggcgccaacaucgccagcggcgaggagguggccaucaagcuggagugcgugaagaccaagcacccccagcugcacaucgagagcaaguucuacaagaugaugcagggcggcgugggcauccccagcaucaaguggugcggcgccgagggcgacuacaacgugauggugauggagcugcugggccccagccuggaggaccuguucaacuucugcagcagaaaguucagccugaagaccgugcugcugcuggccgaccagaugaucagcagaaucgaguacauccacagcaagaacuucauccacagagacgugaagcccgacaacuuccugaugggccugggcaagaagggcaaccugguguacaucaucgacuucggccuggccaagaaguacagagacgccagaacccaccagcacauccccuacagagagaacaagaaccugaccggcaccgccagauacgccagcaucaacacccaccugggcaucgagcagagcagaagagacgaccuggagagccugggcuacgugcugauguacuucaaccugggcagccugcccuggcagggccugaaggccgccaccaagagacagaaguacgagagaaucagcgagaagaagaugagcacccccaucgaggugcugugcaagggcuaccccagcgaguucagcaccuaccugaacuucugcagaagccugagauucgacgacaagcccgacuacagcuaccugagacagcuguucagaaaccuguuccacagacagggcuucagcuacgacuacguguucgacuggaacaugcugaaguucggcgccgccagaaaccccgaggacguggacagagagagaagagagcacgagagagaggagagaaugggccagcugagaggcagcgccaccagagcccugccccccggcccccccaccggcgccaccgccaacagacugagaagcgccgccgagcccguggccagcacccccgccagcagaauccagcccgccggcaacaccagccccagagccaucagcagaguggacagagagagaaaggugagcaugagacugcacagaggcgcccccgccaacgugagcagcagcgaccugaccggcagacaggaggugagcagaauccccgccagccagaccagcgugcccuucgaccaccugggcaaguaa

SEQ ID NO: 19342 - RNA, 2583 nt, Artificial Sequence
  LOC645177__Homo_sapiens__XP_011519208
auggccagccccagaaaggugaccgagaagagacacaaccccguggagagcaucugcagaaagaucagagccauccacaagagagaggccaucagcaaccccauccagcagaucaucaaguaccagagcagcagcuucgacagcccccagaccaacaccaagaaguacuucgaggaggugcugagaaagaugaccgccgccugcgugcccacccccggcagccacuggagcagcagcgaggagguggacgccuucaucagcagcccccagaucaucagccccagaacccccagcaccagccaccugagcagccccgagaccgccaccuacagcgugauccugaccagcagcgagaacgugagcaagcccaagagccagagcaacaagaacuacaccagccugaugagccagaucagaaaggccgaguucuucagcaacaaggaccugaacaacuacugcagcgagaacaacuucagcacccugacccuggacuucgacagcaccuucgugcagagccugaagugcuucgacccccaggacagcguggugaagaagcugagccugaacgaggacggcuggaagcaggaggccgacgacggcaaggaggacgugaucuacagcaucaacagagccugcaaggaggaggcccugaccagcaucuucaacgccugcgacaucaagagaaagggcagcgugggcguggccaagaucaucaacuuccugagacagaccaccagccagaacagcgaggacagcggccuggagcagcuguggaacaugcuggaccccgagaagagagacccccacguggaccuggagaccuuccaggccaugaugaaggacuggauggccuacugcggcaacaccugggagggcgugaaccacagacugagcagcaucaucgacgacagcgugugcgagcaggacggcaucaagagcgacggcaccaugaagaugagcaccgacaucaccgacagcacccugggcagcuucgaggcccugggcggcgagaccagcaagggcgugcuggaggugagcgaccugaucgccuacguggccgaccugcacuucaacaagagaaagcuggaggaggagaacaacaaguucaagcuggcccuggagacccuggaggagaccaacagccagcugagcgaggacugcaccgagcugagacugcaggugaagagcgcccaccaggccaucaugagaaccaaccugcugaaggaggagcuggaggagcugaagcugagcaugaacgccagcgaggagcagaagagcaugaucguggcccagagcaagcagcuggagaccgagaacagagcccugauccugaagaucagaauccugcaggaggagaacuucaagaacaucauggacaucgacagacuggagaagaagaucgaggaccugagcaagaccgagaccgagcaccaggugagcaccagccagauccugaugcagcugcacaccuacgagaacacccugcugaacaaggacaccagccugcagaagaagggccuguacaucgaggagcugaagagcaccaucaucgaguacggcagcaucaucgagaaccugagaggcgagaagagcaagcuggcccacgagcugcagcaccugcagcaggcccugaucaccaacggcauccagcugaacgugaacggcgagugcaacagcaucaucagcgagggcgagaagagccugcacuacgagcugacccuggcccagagcgccgagaacaccgagaccgagagacagcacaacgugaucaaccugagcagccuggacgccaugauggaccaggagaugcugcugcugcugagagagcccgcccagaaggccguggaguucaccgccacccugcagaagcugcacgaggagaucagcaagaucgccacccugaucgagaacagcagaagaugggugaccaaccccgagaucaccgugaaggagaagugggaggagcagcugaccgaguucaacaacaucauggaggagaagcuggaccugugcauccugaugcugaacauccugggcaaccacaaggagagccuggacaaggaguucgccaagcugaucgagauccugaagagauucagacaggaguacuucuacuucagaaaggaguuccuggccagaaaccccaccagcggccagaagcagcuggaggccaucaagcagcugcaggaggacgccgugaaccaggagggcauccugagaaagagacugcaggagaccagccagagacuggaggacguggaggagcagggcaaggacagagacagagaggcccacaccgccagcgagaaggccaccagccugcugcacaagcuggaggaggccaucagcgagcagagaaaccugcagaccaucaacaccgagcugagcaacaccugccaggcccugcagcagaagaccagaaagcugaagaacgcccugagccuggacagcuucaccgccgugcccacccuggagagcacccccuucagcggcguggccaaccagauccacacccugugcgagagacccaccuacggcgaggugaaggacggcgcccuggacgugaagagacagcacaaguaa

SEQ ID NO: 19343 - RNA, 2688 nt, Artificial Sequence
  LONP1__Homo_sapiens__NP_001263408
auggccgccagcaccggcuacgugagacuguggggcgccgccagaugcugggugcugagaagacccaugcuggccgccgccggcggcagagugcccaccgccgccggcgccuggcugcugagaggccccgugaucaccgcccugacccccaugaccauccccgacguguucccccaccugccccugaucgccaucaccagaaaccccguguuccccagauucaucaagaucaucgaggugaagaacaagaagcugguggagcugcugagaagaaaggugagacuggcccagcccuacgugggcguguuccugaagagagacgacagcaacgagagcgacgugguggagagccuggacgagaucuaccacaccggcaccuucgcccagauccacgagaugcaggaccugggcgacaagcugagaaugaucgugaugggccacagaagagugcacaucagcagacagcuggagguggagcccgaggagcccgaggccgagaacaagcacaagcccagaagaaagagcaagagaggcaagaaggaggccgaggacgagcugagcgccagacaccccgccgagcuggccauggagcccacccccgagcugcccgccgaggugcugaugguggagguggagaacguggugcacgaggacuuccaggugaccgaggaggugaaggcccugaccgccgagaucgugaagaccaucagagacaucaucgcccugaacccccuguacagagagagcgugcugcagaugaugcaggccggccagagagugguggacaaccccaucuaccugagcgacaugggcgccgcccugaccggcgccgagagccacgagcugcaggacgugcuggaggagaccaacauccccaagagacuguacaaggcccugagccugcugaagaaggaguucgagcugagcaagcugcagcagagacugggcagagagguggaggagaagaucaagcagacccacagaaaguaccugcugcaggagcagcugaagaucaucaagaaggagcugggccuggagaaggacgacaaggacgccaucgaggagaaguucagagagagacugaaggagcugguggugcccaagcacgugauggacgugguggacgaggagcugagcaagcugggccugcuggacaaccacagcagcgaguucaacgugaccagaaacuaccuggacuggcugaccagcauccccuggggcaaguacagcaacgagaaccuggaccuggccagagcccaggccgugcuggaggaggaccacuacggcauggaggacgugaagaagagaauccuggaguucaucgccgugagccagcugagaggcagcacccagggcaagauccugugcuucuacggcccccccggcgugggcaagaccagcaucgccagaagcaucgccagagcccugaacagagaguacuucagauucagcgugggcggcaugaccgacguggccgagaucaagggccacagaagaaccuacgugggcgccaugcccggcaagaucauccagugccugaagaagaccaagaccgagaacccccugauccugaucgacgagguggacaagaucggcagaggcuaccagggcgaccccagcagcgcccugcuggagcugcuggaccccgagcagaacgccaacuuccuggaccacuaccuggacgugcccguggaccugagcaaggugcuguucaucugcaccgccaacgugaccgacaccauccccgagccccugagagacagaauggagaugaucaacgugagcggcuacguggcccaggagaagcuggccaucgccgagagauaccuggugccccaggccagagcccugugcggccuggacgagagcaaggccaagcugagcagcgacgugcugacccugcugaucaagcaguacugcagagagagcggcgugagaaaccugcagaagcagguggagaaggugcugagaaagagcgccuacaagaucgugagcggcgaggccgagagcguggaggugacccccgagaaccugcaggacuucgugggcaagcccguguucaccguggagagaauguacgacgugaccccccccggcguggugaugggccuggccuggaccgccaugggcggcagcacccuguucguggagaccagccugagaagaccccaggacaaggacgccaagggcgacaaggacggcagccuggaggugaccggccagcugggcgaggugaugaaggagagcgccagaaucgccuacaccuucgccagagccuuccugaugcagcacgcccccgccaacgacuaccuggugaccagccacauccaccugcacgugcccgagggcgccacccccaaggacggccccagcgccggcugcaccaucgugaccgcccugcugagccuggccaugggcagacccgugagacagaaccuggccaugaccggcgaggugagccugaccggcaagauccugcccgugggcggcaucaaggagaagaccaucgccgccaagagagccggcgugaccugcaucgugcugcccgccgagaacaagaaggacuucuacgaccuggccgccuucaucaccgagggccuggaggugcacuucguggagcacuacagagagaucuucgacaucgccuuccccgacgagcaggccgaggcccuggccguggagagauaa

SEQ ID NO: 19344 - RNA, 2322 nt, Artificial Sequence
  LONRF1__Homo_sapiens__NP_689484
augagcagccccgccguggccagaaccagccccggcggcagcagagagauggcccccgccccccagggcagaggcagauucugggaggugggcggcggcagcggccacagacuggagagagccgccgccgagagcgagagaugggagcugcugcugagaagaggcgagcugcuggcccugggcggccaccugaagggcgcccuggaggccuucgccgccgcccugagaagaggcgcccccgccagacccgagugccugggcgcccugguggacugccugguguucaacuacagacugagacacggccugggcuggagcgccgcccccguggccggcgccgacggcggcgccggcggccugcugagaugccugggcugcagaggcuuccugagcgagcccgugaccgugcccugcggccacagcuacugcagaagaugccugagaagagagcugagagccagaugcagacugugcagagacagacugccccccgccaccgccagcgccaccgacgccgagggcaccgcccccagaccccccccccuggccgccgccaucgccgccagcgacuucagaaccagcguggugcugaaccaccuggccgagaagugguuccccggccagagagagagagccagagccgccggcagacugggcgagcugcugcaccagggcagauacagagaggcccuggccgccgccugcgaggcccugagagccgagcccagcgaccugaucgugaagaucuacagagccgagagcuacgccggccugcaggaguucaaggccgccaucgaggaccugaacgccgugcuguuccagcugcccgacuggcccgagguguacuucagaaagggcaaggugcugugcgacgccggcuuccugggcgacgcccugcagcuguuccugcagugccuggcccuggacgaggacuucgcccccgccaagcugcaggugcagaagauccugugcgaccugcugcugcccgagaaccugaaggagggccugaaggagagcagcuggagcagccugcccugcaccaagaacagacccuucgacuuccacagcgugauggaggagagccagagccugaacgagcccagccccaagcagagcgaggagauccccgaggugaccagcgagcccgugaagggcagccugaacagagcccagagcgcccagagcaucaacagcaccgagaugcccgccagagaggacugccugaagagagugagcagcgagcccgugcugagcgugcaggagaagggcgugcugcugaagagaaagcugagccugcuggagcaggacgugaucgugaacgaggacggcagaaacaagcugaagaagcagggcgagacccccaacgaggugugcauguucagccuggccuacggcgacauccccgaggagcugaucgacgugagcgacuucgagugcagccugugcaugagacuguucuucgagcccgugaccacccccugcggccacagcuucugcaagaacugccuggagagaugccuggaccacgcccccuacugcccccugugcaaggagagccugaaggaguaccuggccgacagaagauacugcgugacccagcugcuggaggagcugaucgugaaguaccugcccgacgagcugagcgagagaaagaagaucuacgacgaggagaccgccgagcugagccaccugaccaagaacgugcccaucuucgugugcaccauggccuaccccaccgugcccugcccccugcacguguucgagcccagauacagacugaugaucagaagaagcauccagaccggcaccaagcaguucggcaugugcgugagcgacacccagaacagcuucgccgacuacggcugcaugcugcagaucagaaacgugcacuuccugcccgacggcagaagcgugguggacaccgugggcggcaagagauucagagugcugaagagaggcaugaaggacggcuacugcaccgccgacaucgaguaccuggaggacgugaagguggagaacgaggacgagaucaagaaccugagagagcugcacgaccugguguacagccaggccugcagcugguuccagaaccugagagacagauucagaagccagauccugcagcacuucggcagcaugcccgagagagaggagaaccugcaggccgcccccaacggccccgccuggugcugguggcugcuggccgugcugcccguggaccccagauaccagcugagcgugcugagcaugaagagccugaaggagagacugaccaagauccagcacauccugaccuacuucagcagagaccagagcaaguaa

SEQ ID NO: 19345 - RNA, 939 nt, Artificial Sequence
  LOR__Homo_sapiens__NP_000418
augagcuaccagaagaagcagcccaccccccagccccccguggacugcgugaagaccagcggcggcggcggcggcggcggcggcagcggcggcggcggcugcggcuucuucggcggcggcggcagcggcggcggcagcagcggcagcggcugcggcuacagcggcggcggcggcuacagcggcggcggcugcggcggcggcagcagcggcggcggcggcggcggcggcaucggcggcugcggcggcggcagcggcggcagcgugaaguacagcggcggcggcggcagcagcggcggcggcagcggcugcuucagcagcggcggcggcggcagcggcugcuucagcagcggcggcggcggcagcagcggcggcggcagcggcugcuucagcagcggcggcggcggcagcagcggcggcggcagcggcugcuucagcagcggcggcggcggcuucagcggccaggccgugcagugccagagcuacggcggcgugagcagcggcggcagcagcggcggcggcagcggcugcuucagcagcggcggcggcggcggcagcgugugcggcuacagcggcggcggcagcggcugcggcggcggcagcagcggcggcagcggcagcggcuacgugagcagccagcaggugacccagaccagcugcgccccccagcccagcuacggcggcggcagcagcggcggcggcggcagcggcggcagcggcugcuucagcagcggcggcggcggcggcagcagcggcugcggcggcggcagcagcggcaucggcagcggcugcaucaucagcggcggcggcagcgugugcggcggcggcagcagcggcggcggcggcggcggcagcagcgugggcggcagcggcagcggcaagggcgugcccaucugccaccagacccagcagaagcaggcccccaccuggcccagcaaguaa

SEQ ID NO: 19346 - RNA, 3345 nt, Artificial Sequence
  LOXHD1__Homo_sapiens__NP_001138944
augaacaacgagaucaccuacuacuuccccugccagagauggcuggccguggaggaggacgacggccagcugagcagagagcugcugcccguggacgagagcuacgugcugccccagagcgaggagggcagaggcggcggcgacaacaacccccuggacaaccuggcccuggagcagaaggacaagagcaccaccuucagcgugaccaucaagaccggcgugaagaagaacgccggcaccgacgccaacguguucaucacccuguucggcacccaggacgacaccggcaugacccugcugaagagcagcaagaccaacagcgacaaguucgagagagacagcaucgagaucuucaccguggagacccuggaccugggcgaccuguggaaggugagacugggccacgacaacaccggcaaggcccccggcugguucguggacuggguggagguggacgcccccagccugggcaagugcaugaccuuccccugcggcagauggcuggccaagaacgaggacgacggcagcaucaucagagaccuguuccacgccgagcugcagaccagacuguacacccccuucgugcccuacgagaucacccuguacaccagcgacguguucgccgccggcaccgacgccaacaucuucaucaucaucuacggcugcgacgccgugugcacccagcagaaguaccugugcaccaacaagagagagcagaagcaguucuucgagagaaagagcgccagcagauucaucguggagcuggaggacgugggcgagaucaucgagaagaucagaaucggccacaacaacaccggcaugaaccccggcuggcacugcagccacguggacaucagaagacugcugcccgacaaggacggcgccgagacccugaccuuccccugcgacagauggcuggccaccagcgaggacgacaagaagaccaucagagagcuggugcccuacgacaucuucaccgagaaguacaugaaggacggcagccugagacagguguacaaggagguggaggagccccuggacaucgugcuguacagcgugcagaucuucaccggcaacauccccggcgccggcaccgacgccaagguguacaucaccaucuacggcgaccugggcgacaccggcgagagauaccugggcaagagcgagaacagaaccaacaaguucgagagaggcaccgccgacaccuucaucaucgaggccgccgaccugggcgugaucuacaagaucaagcugagacacgacaacagcaaguggugcgccgacugguacguggagaagguggagaucuggaacgacaccaacgaggacgaguuccuguuccugugcggcagauggcugagccugaagaaggaggacggcagacuggagagacuguucuacgagaaggaguacaccggcgacagaagcagcaacugcagcagccccgccgacuucugggagaucgcccugagcagcaagauggccgacguggacaucagcaccgugaccggccccauggccgacuacgugcaggagggccccaucauccccuacuacgugagcgugaccaccggcaagcacaaggacgccgccaccgacagcagagccuucaucuuccugaucggcgaggacgacgagagaagcaagagaaucuggcuggacuaccccagaggcaagagaggcuucagcagaggcagcguggaggaguucuacguggccggccuggacgugggcaucaucaagaagaucgagcugggccacgacggcgccagccccgagagcugcuggcugguggaggagcugugccuggccgugcccacccagggcaccaaguacaugcugaacugcaacugcuggcuggccaaggacagaggcgacggcaucaccagcagaguguucgaccugcuggacgccaugguggugaacaucggcgugaaggugcuguacgagaugaccguguggaccggcgacguggugggcggcggcaccgacagcaacaucuucaugacccuguacggcaucaacggcagcaccgaggagaugcagcuggacaagaagaaggccagauucgagagagagcagaacgacaccuucaucauggagauccuggacaucgcccccuucaccaagaugagaaucagaaucgacggccugggcagcagacccgagugguuccuggagagaauccugcugaagaacaugaacaccggcgaccugaccauguucuacuacggcgacuggcugagccagagaaagggcaagaagacccuggugugcgagaugugcgccgugaucgacgaggaggagaugauggaguggaccagcuacaccguggccgugaagaccagcgacauccugggcgccggcaccgacgccaacguguucaucaucaucuucggcgagaacggcgacagcggcacccuggcccugaagcagagcgccaacuggaacaaguucgagagaaacaacaccgacaccuucaacuuccccgacaugcugagccugggccaccugugcaagcugagaguguggcacgacaacaagggcaucuuccccggcuggcaccugagcuacguggacgugaaggacaacagcagagacgagaccuuccacuuccagugcgacugcuggcugagcaagagcgagggcgacggccagaccgugagagacuucgccugcgccaacaacaagaucugcgacgagcuggaggagaccaccuacgagaucgugaucgagaccggcaacggcggcgagaccagagagaacguguggcugauccuggagggcagaaagaacagaagcaaggaguuccugauggagaacagcagcagacagagagccuucagaaagggcaccaccgacaccuucgaguucgacagcaucuaccugggcgacaucgccagccugugcgugggccaccuggccagagaggacagauucauccccaagagagagcuggccuggcacgugaagaccaucaccaucaccgagauggaguacggcaacguguacuucuucaacugcgacugccugaucccccugaagagaaagagaaaguacuucaagguguucgaggugaccaagaccaccgagagcuucgccagcaaggugcagagccuggugcccgugaaguacgaggugaucgugaccaccggcuacgagcccggcgccggcaccgacgccaacguguucgugaccaucuucggcgccaacggcgacaccggcaagagagagcugaagcagaagaugagaaaccuguucgagagaggcagcaccgacagauucuuccuggagacccuggagcugguggugaccagacugggccuggccgccgagugcggcuaa

SEQ ID NO: 19347 - RNA, 1254 nt, Artificial Sequence
  LOX__Homo_sapiens__NP_002308
augagauucgccuggaccgugcugcugcugggcccccugcagcugugcgcccuggugcacugcgccccccccgccgccggccagcagcagccccccagagagccccccgccgcccccggcgccuggagacagcagauccagugggagaacaacggccagguguucagccugcugagccugggcagccaguaccagccccagagaagaagagaccccggcgccgccgugcccggcgccgccaacgccagcgcccagcagcccagaacccccauccugcugaucagagacaacagaaccgccgccgccagaaccagaaccgccggcagcagcggcgugaccgccggcagacccagacccaccgccagacacugguuccaggccggcuacagcaccagcagagccagagaggccggcgccagcagagccgagaaccagaccgcccccggcgaggugcccgcccugagcaaccugagaccccccagcagaguggacggcauggugggcgacgaccccuacaaccccuacaaguacagcgacgacaaccccuacuacaacuacuacgacaccuacgagagacccagacccggcggcagauacagacccggcuacggcaccggcuacuuccaguacggccugcccgaccugguggccgaccccuacuacauccaggccagcaccuacgugcagaagaugagcauguacaaccugagaugcgccgccgaggagaacugccuggccagcaccgccuacagagccgacgugagagacuacgaccacagagugcugcugagauucccccagagagugaagaaccagggcaccagcgacuuccugcccagcagacccagauacagcugggaguggcacagcugccaccagcacuaccacagcauggacgaguucagccacuacgaccugcuggacgccaacacccagagaagaguggccgagggccacaaggccagcuucugccuggaggacaccagcugcgacuacggcuaccacagaagauucgccugcaccgcccacacccagggccugagccccggcugcuacgacaccuacggcgccgacaucgacugccaguggaucgacaucaccgacgugaagcccggcaacuacauccugaaggugagcgugaaccccagcuaccuggugcccgagagcgacuacaccaacaacguggugagaugcgacaucagauacaccggccaccacgccuacgccagcggcugcaccaucagccccuacuaa

SEQ ID NO: 19348 - RNA, 1725 nt, Artificial Sequence
  LOXL1__Homo_sapiens__NP_005567
auggcccuggccagaggcagcagacagcugggcgcccugguguggggcgccugccugugcgugcuggugcacggccagcaggcccagcccggccagggcagcgaccccgccagauggagacagcugauccagugggagaacaacggccagguguacagccugcugaacagcggcagcgaguacgugcccgccggcccccagagaagcgagagcagcagcagagugcugcuggccggcgccccccaggcccagcagagaagaagccacggcagccccagaagaagacaggcccccagccugccccugcccggcagagugggcagcgacaccgugagaggccaggccagacaccccuucggcuucggccaggugcccgacaacuggagagagguggccgugggcgacagcaccggcauggccagagccagaaccagcgugagccagcagagacacggcggcagcgccagcagcgugagcgccagcgccuucgccagcaccuacagacagcagcccagcuacccccagcaguuccccuacccccaggcccccuucgugagccaguacgagaacuacgaccccgccagcagaaccuacgaccagggcuucguguacuacagacccgccggcggcggcgugggcgccggcgccgccgccguggccagcgccggcgugaucuaccccuaccagcccagagccagauacgaggaguacggcggcggcgaggagcugcccgaguaccccccccagggcuucuaccccgcccccgagagacccuacgugcccccccccccccccccccccgacggccuggacagaagauacagccacagccuguacagcgagggcacccccggcuucgagcaggccuaccccgaccccggccccgaggccgcccaggcccacggcggcgaccccagacugggcugguacccccccuacgccaaccccccccccgaggccuacggcccccccagagcccuggagccccccuaccugcccgugagaagcagcgacacccccccccccggcggcgagagaaacggcgcccagcagggcagacugagcgugggcagcguguacagacccaaccagaacggcagaggccugcccgaccuggugcccgaccccaacuacgugcaggccagcaccuacgugcagagagcccaccuguacagccugagaugcgccgccgaggagaagugccuggccagcaccgccuacgcccccgaggccaccgacuacgacgugagagugcugcugagauucccccagagagugaagaaccagggcaccgccgacuuccugcccaacagacccagacacaccugggaguggcacagcugccaccagcacuaccacagcauggacgaguucagccacuacgaccugcuggacgccgccaccggcaagaagguggccgagggccacaaggccagcuucugccuggaggacagcaccugcgacuucggcaaccugaagagauacgccugcaccagccacacccagggccugagccccggcugcuacgacaccuacaacgccgacaucgacugccaguggaucgacaucaccgacgugcagcccggcaacuacauccugaaggugcacgugaaccccaaguacaucgugcuggagagcgacuucaccaacaacguggugagaugcaacauccacuacaccggcagauacgugagcgccaccaacugcaagaucgugcagagcuaa

SEQ ID NO: 19349 - RNA, 2325 nt, Artificial Sequence
  LOXL2__Homo_sapiens__NP_002309
auggagagaccccugugcagccaccugugcagcugccuggccaugcuggcccugcugagcccccugagccuggcccaguacgacagcuggccccacuaccccgaguacuuccagcagcccgcccccgaguaccaccagccccaggcccccgccaacguggccaagauccagcugagacuggccggccagaagagaaagcacagcgagggcagaguggagguguacuacgacggccaguggggcaccgugugcgacgacgacuucagcauccacgccgcccacguggugugcagagagcugggcuacguggaggccaagagcuggaccgccagcagcagcuacggcaagggcgagggccccaucuggcuggacaaccugcacugcaccggcaacgaggccacccuggccgccugcaccagcaacggcuggggcgugaccgacugcaagcacaccgaggacgugggcguggugugcagcgacaagagaauccccggcuucaaguucgacaacagccugaucaaccagaucgagaaccugaacauccagguggaggacaucagaaucagagccauccugagcaccuacagaaagagaacccccgugauggagggcuacguggaggugaaggagggcaagaccuggaagcagaucugcgacaagcacuggaccgccaagaacagcagaguggugugcggcauguucggcuuccccggcgagagaaccuacaacaccaagguguacaagauguucgccagcagaagaaagcagagauacuggcccuucagcauggacugcaccggcaccgaggcccacaucagcagcugcaagcugggcccccaggugagccuggaccccaugaagaacgugaccugcgagaacggccugcccgccguggugagcugcgugcccggccagguguucagccccgacggccccagcagauucagaaaggccuacaagcccgagcagccccuggugagacugagaggcggcgccuacaucggcgagggcagaguggaggugcugaagaacggcgaguggggcaccgugugcgacgacaagugggaccuggugagcgccagcguggugugcagagagcugggcuucggcagcgccaaggaggccgugaccggcagcagacugggccagggcaucggccccauccaccugaacgagauccagugcaccggcaacgagaagagcaucaucgacugcaaguucaacgccgagagccagggcugcaaccacgaggaggacgccggcgugagaugcaacacccccgccaugggccugcagaagaagcugagacugaacggcggcagaaaccccuacgagggcagaguggaggugcugguggagagaaacggcagccugguguggggcauggugugcggccagaacuggggcaucguggaggccaugguggugugcagacagcugggccugggcuucgccagcaacgccuuccaggagaccugguacuggcacggcgacgugaacagcaacaagguggugaugagcggcgugaagugcagcggcaccgagcugagccuggcccacugcagacacgacggcgaggacguggccugcccccagggcggcgugcaguacggcgccggcguggccugcagcgagaccgcccccgaccuggugcugaacgccgagauggugcagcagaccaccuaccuggaggacagacccauguucaugcugcagugcgccauggaggagaacugccugagcgccagcgccgcccagaccgaccccaccaccggcuacagaagacugcugagauucagcagccagauccacaacaacggccagagcgacuucagacccaagaacggcagacacgccuggaucuggcacgacugccacagacacuaccacagcauggagguguucacccacuacgaccugcugaaccugaacggcaccaagguggccgagggccacaaggccagcuucugccuggaggacaccgagugcgagggcgacauccagaagaacuacgagugcgccaacuucggcgaccagggcaucaccaugggcugcugggacauguacagacacgacaucgacugccaguggguggacaucaccgacgugccccccggcgacuaccuguuccagguggugaucaaccccaacuucgagguggccgagagcgacuacagcaacaacaucaugaagugcagaagcagauacgacggccacagaaucuggauguacaacugccacaucggcggcagcuucagcgaggagaccgagaagaaguucgagcacuucagcggccugcugaacaaccagcugagcccccaguaa

SEQ ID NO: 19350 - RNA, 1827 nt, Artificial Sequence
  LOXL3__Homo_sapiens__NP_001276093
augagacccgugagcguguggcaguggagccccuggggccugcugcugugccugcugugcagcagcugccugggcagccccagccccagcaccggccccgagaagaaggccggcagccagggccugagauucagacuggccggcuuccccagaaagcccuacgagggcagaguggagauccagagagccggcgaguggggcaccaucugcgacgacgacuucacccugcaggccgcccacauccugugcagagagcugggcuucaccgaggccaccggcuggacccacagcgccaaguacggccccggcaccggcagaaucuggcuggacaaccugagcugcagcggcaccgagcagagcgugaccgagugcgccagcagaggcuggggcaacagcgacugcacccacgacgaggacgccggcgugaucugcaaggaccagagacugcccggcuucagcgacagcaacgugaucgaggccagagugagacugaagggcggcgcccaccccggcgagggcagaguggaggugcugaaggccagcaccuggggcaccgugugcgacagaaagugggaccugcacgccgccagcguggugugcagagagcugggcuucggcagcgccagagaggcccugagcggcgccagaaugggccagggcaugggcgccauccaccugagcgaggugagaugcagcggccaggagcugagccuguggaagugcccccacaagaacaucaccgccgaggacugcagccacagccaggacgccggcgugagaugcaaccugcccuacaccggcgccgagaccagaaucagacugagcggcggcagaagccagcacgagggcagaguggaggugcagaucggcggccccggcccccugagauggggccugaucugcggcgacgacuggggcacccuggaggccaugguggccugcagacagcugggccugggcuacgccaaccacggccugcaggagaccugguacugggacagcggcaacaucaccgagguggugaugagcggcgugagaugcaccggcaccgagcugagccuggaccagugcgcccaccacggcacccacaucaccugcaagagaaccggcaccagauucaccgccggcgugaucugcagcgagaccgccagcgaccugcugcugcacagcgcccuggugcaggagaccgccuacaucgaggacagaccccugcacaugcuguacugcgccgccgaggagaacugccuggccagcagcgccagaagcgccaacuggcccuacggccacagaagacugcugagauucagcagccagauccacaaccugggcagagccgacuucagacccaaggccggcagacacagcuggguguggcacgagugccacggccacuaccacagcauggacaucuucacccacuacgacauccugacccccaacggcaccaagguggccgagggccacaaggccagcuucugccuggaggacaccgagugccaggaggacgugagcaagagauacgagugcgccaacuucggcgagcagggcaucaccgugggcugcugggaccuguacagacacgacaucgacugccaguggaucgacaucaccgacgugaagcccggcaacuacauccugcagguggugaucaaccccaacuucgagguggccgagagcgacuucaccaacaacgccaugaagugcaacugcaaguacgacggccacagaaucugggugcacaacugccacaucggcgacgccuucagcgaggaggccaacagaagauucgagagauaccccggccagaccagcaaccagaucaucuaa

SEQ ID NO: 19351 - RNA, 2271 nt, Artificial Sequence
  LOXL4__Homo_sapiens__NP_115587
auggccuggagcccccccgccacccuguuccuguuccugcugcugcugggccagcccccccccagcagaccccagagccugggcaccaccaagcugagacuggugggccccgagagcaagcccgaggagggcagacuggaggugcugcaccagggccaguggggcaccgugugcgacgacaacuucgccauccaggaggccaccguggccugcagacagcugggcuucgaggccgcccugaccugggcccacagcgccaaguacggccagggcgagggccccaucuggcuggacaacgugagaugcgugggcaccgagagcagccuggaccagugcggcagcaacggcuggggcgugagcgacugcagccacagcgaggacgugggcgugaucugccaccccagaagacacagaggcuaccugagcgagaccgugagcaacgcccugggcccccagggcagaagacuggaggaggugagacugaagcccauccuggccagcgccaagcagcacagccccgugaccgagggcgccguggaggugaaguacgagggccacuggagacaggugugcgaccagggcuggaccaugaacaacagcagaguggugugcggcaugcugggcuuccccagcgaggugcccguggacagccacuacuacagaaaggugugggaccugaagaugagagaccccaagagcagacugaagagccugaccaacaagaacagcuucuggauccaccaggugaccugccugggcaccgagccccacauggccaacugccaggugcagguggcccccgccagaggcaagcugagacccgccugccccggcggcaugcacgccguggugagcugcguggccggcccccacuucagaccccccaagaccaagccccagagaaagggcagcugggccgaggagcccagagugagacugagaagcggcgcccaggugggcgagggcagaguggaggugcugaugaacagacaguggggcaccgugugcgaccacagauggaaccugaucagcgccagcguggugugcagacagcugggcuucggcagcgccagagaggcccuguucggcgccagacugggccagggccugggccccauccaccugagcgaggugagaugcagaggcuacgagagaacccugagcgacugccccgcccuggagggcagccagaacggcugccagcacgagaacgacgccgccgugagaugcaacgugcccaacaugggcuuccagaaccaggugagacuggccggcggcagaauccccgaggagggccugcuggaggugcagguggaggugaacggcgugcccagauggggcagcgugugcagcgagaacuggggccugaccgaggccaugguggccugcagacagcugggccugggcuucgccauccacgccuacaaggagaccugguucuggagcggcacccccagagcccaggagguggugaugagcggcgugagaugcagcggcaccgagcuggcccugcagcagugccagagacacggccccgugcacugcagccacggcggcggcagauuccuggccggcgugagcugcauggacagcgcccccgaccuggugaugaacgcccagcuggugcaggagaccgccuaccuggaggacagaccccugagccagcuguacugcgcccacgaggagaacugccugagcaagagcgccgaccacauggacuggcccuacggcuacagaagacugcugagauucagcacccagaucuacaaccugggcagaaccgacuucagacccaagaccggcagagacagcuggguguggcaccagugccacagacacuaccacagcaucgagguguucacccacuacgaccugcugacccugaacggcagcaagguggccgagggccacaaggccagcuucugccuggaggacaccaacugccccaccggccugcagagaagauacgccugcgccaacuucggcgagcagggcgugaccgugggcugcugggacaccuacagacacgacaucgacugccaguggguggacaucaccgacgugggccccggcaacuacaucuuccaggugaucgugaacccccacuacgagguggccgagagcgacuucagcaacaacaugcugcagugcagaugcaaguacgacggccacagaguguggcugcacaacugccacaccggcaacagcuaccccgccaacgccgagcugagccuggagcaggagcagagacugagaaacaaccugaucuaa

SEQ ID NO: 19352 - RNA, 6123 nt, Artificial Sequence
  LPA__Homo_sapiens__NP_005568
auggagcacaaggagguggugcugcugcugcugcuguuccugaagagcgccgcccccgagcagagccacguggugcaggacugcuaccacggcgacggccagagcuacagaggcaccuacagcaccaccgugaccggcagaaccugccaggccuggagcagcaugaccccccaccagcacaacagaaccaccgagaacuaccccaacgccggccugaucaugaacuacugcagaaaccccgacgccguggccgcccccuacugcuacaccagagaccccggcgugagaugggaguacugcaaccugacccagugcagcgacgccgagggcaccgccguggccccccccaccgugacccccgugcccagccuggaggcccccagcgagcaggcccccaccgagcagagacccggcgugcaggagugcuaccacggcaacggccagagcuacagaggcaccuacagcaccaccgugaccggcagaaccugccaggccuggagcagcaugaccccccacagccacagcagaacccccgaguacuaccccaacgccggccugaucaugaacuacugcagaaaccccgacgccguggccgcccccuacugcuacaccagagaccccggcgugagaugggaguacugcaaccugacccagugcagcgacgccgagggcaccgccguggccccccccaccgugacccccgugcccagccuggaggcccccagcgagcaggcccccaccgagcagagacccggcgugcaggagugcuaccacggcaacggccagagcuacagaggcaccuacagcaccaccgugaccggcagaaccugccaggccuggagcagcaugaccccccacagccacagcagaacccccgaguacuaccccaacgccggccugaucaugaacuacugcagaaaccccgacgccguggccgcccccuacugcuacaccagagaccccggcgugagaugggaguacugcaaccugacccagugcagcgacgccgagggcaccgccguggccccccccaccgugacccccgugcccagccuggaggcccccagcgagcaggcccccaccgagcagagacccggcgugcaggagugcuaccacggcaacggccagagcuacagaggcaccuacagcaccaccgugaccggcagaaccugccaggccuggagcagcaugaccccccacagccacagcagaacccccgaguacuaccccaacgccggccugaucaugaacuacugcagaaaccccgacgccguggccgcccccuacugcuacaccagagaccccggcgugagaugggaguacugcaaccugacccagugcagcgacgccgagggcaccgccguggccccccccaccgugacccccgugcccagccuggaggcccccagcgagcaggcccccaccgagcagagacccggcgugcaggagugcuaccacggcaacggccagagcuacagaggcaccuacagcaccaccgugaccggcagaaccugccaggccuggagcagcaugaccccccacagccacagcagaacccccgaguacuaccccaacgccggccugaucaugaacuacugcagaaaccccgacgccguggccgcccccuacugcuacaccagagaccccggcgugagaugggaguacugcaaccugacccagugcagcgacgccgagggcaccgccguggccccccccaccgugacccccgugcccagccuggaggcccccagcgagcaggcccccaccgagcagagacccggcgugcaggagugcuaccacggcaacggccagagcuacagaggcaccuacagcaccaccgugaccggcagaaccugccaggccuggagcagcaugaccccccacagccacagcagaacccccgaguacuaccccaacgccggccugaucaugaacuacugcagaaaccccgacgccguggccgcccccuacugcuacaccagagaccccggcgugagaugggaguacugcaaccugacccagugcagcgacgccgagggcaccgccguggccccccccaccgugacccccgugcccagccuggaggcccccagcgagcaggcccccaccgagcagagacccggcgugcaggagugcuaccacggcaacggccagagcuacagaggcaccuacagcaccaccgugaccggcagaaccugccaggccuggagcagcaugaccccccacagccacagcagaacccccgaguacuaccccaacgccggccugaucaugaacuacugcagaaaccccgacgccguggccgcccccuacugcuacaccagagaccccggcgugagaugggaguacugcaaccugacccagugcagcgacgccgagggcaccgccguggccccccccaccgugacccccgugcccagccuggaggcccccagcgagcaggcccccaccgagcagagacccggcgugcaggagugcuaccacggcaacggccagagcuacagaggcaccuacagcaccaccgugaccggcagaaccugccaggccuggagcagcaugaccccccacagccacagcagaacccccgaguacuaccccaacgccggccugaucaugaacuacugcagaaaccccgaccccguggccgcccccuacugcuacaccagagaccccagcgugagaugggaguacugcaaccugacccagugcagcgacgccgagggcaccgccguggccccccccaccaucacccccauccccagccuggaggcccccagcgagcaggcccccaccgagcagagacccggcgugcaggagugcuaccacggcaacggccagagcuaccagggcaccuacuucaucaccgugaccggcagaaccugccaggccuggagcagcaugaccccccacagccacagcagaacccccgccuacuaccccaacgccggccugaucaagaacuacugcagaaaccccgaccccguggccgcccccuggugcuacaccaccgaccccagcgugagaugggaguacugcaaccugaccagaugcagcgacgccgaguggaccgccuucgugccccccaacgugauccuggcccccagccuggaggccuucuucgagcaggcccugaccgaggagacccccggcgugcaggacugcuacuaccacuacggccagagcuacagaggcaccuacagcaccaccgugaccggcagaaccugccaggccuggagcagcaugaccccccaccagcacagcagaacccccgagaacuaccccaacgccggccugaccagaaacuacugcagaaaccccgacgccgagaucagacccuggugcuacaccauggaccccagcgugagaugggaguacugcaaccugacccagugccuggugaccgagagcagcgugcuggccacccugaccguggugcccgaccccagcaccgaggccagcagcgaggaggcccccaccgagcagagccccggcgugcaggacugcuaccacggcgacggccagagcuacagaggcagcuucagcaccaccgugaccggcagaaccugccagagcuggagcagcaugaccccccacuggcaccagagaaccaccgaguacuaccccaacggcggccugaccagaaacuacugcagaaaccccgacgccgagaucagccccuggugcuacaccauggaccccaacgugagaugggaguacugcaaccugacccagugccccgugaccgagagcagcgugcuggccaccagcaccgccgugagcgagcaggcccccaccgagcagagccccaccgugcaggacugcuaccacggcgacggccagagcuacagaggcagcuucagcaccaccgugaccggcagaaccugccagagcuggagcagcaugaccccccacuggcaccagagaaccaccgaguacuaccccaacggcggccugaccagaaacuacugcagaaaccccgacgccgagaucagacccuggugcuacaccauggaccccagcgugagaugggaguacugcaaccugacccagugccccgugauggagagcacccugcugaccacccccaccguggugcccgugcccagcaccgagcugcccagcgaggaggcccccaccgagaacagcaccggcgugcaggacugcuacagaggcgacggccagagcuacagaggcacccugagcaccaccaucaccggcagaaccugccagagcuggagcagcaugaccccccacuggcacagaagaaucccccuguacuaccccaacgccggccugaccagaaacuacugcagaaaccccgacgccgagaucagacccuggugcuacaccauggaccccagcgugagaugggaguacugcaaccugaccagaugccccgugaccgagagcagcgugcugaccacccccaccguggcccccgugcccagcaccgaggcccccagcgagcaggccccccccgagaagagccccguggugcaggacugcuaccacggcgacggcagaagcuacagaggcaucagcagcaccaccgugaccggcagaaccugccagagcuggagcagcaugaucccccacuggcaccagagaacccccgagaacuaccccaacgccggccugaccgagaacuacugcagaaaccccgacagcggcaagcagcccuggugcuacaccaccgaccccugcgugagaugggaguacugcaaccugacccagugcagcgagaccgagagcggcgugcuggagacccccaccguggugcccgugcccagcauggaggcccacagcgaggccgcccccaccgagcagacccccguggugagacagugcuaccacggcaacggccagagcuacagaggcaccuucagcaccaccgugaccggcagaaccugccagagcuggagcagcaugaccccccacagacaccagagaacccccgagaacuaccccaacgacggccugaccaugaacuacugcagaaaccccgacgccgacaccggccccuggugcuucaccauggaccccagcaucagaugggaguacugcaaccugaccagaugcagcgacaccgagggcaccgugguggccccccccaccgugauccaggugcccagccugggcccccccagcgagcaggacugcauguucggcaacggcaagggcuacagaggcaagaaggccaccaccgugaccggcacccccugccaggagugggccgcccaggagccccacagacacagcaccuucauccccggcaccaacaagugggccggccuggagaagaacuacugcagaaaccccgacggcgacaucaacggccccuggugcuacaccaugaaccccagaaagcuguucgacuacugcgacaucccccugugcgccagcagcagcuucgacugcggcaagccccagguggagcccaagaagugccccggcagcaucgugggcggcugcguggcccacccccacagcuggcccuggcaggugagccugagaaccagauucggcaagcacuucugcggcggcacccugaucagccccgagugggugcugaccgccgcccacugccugaagaagagcagcagacccagcagcuacaaggugauccugggcgcccaccaggaggugaaccuggagagccacgugcaggagaucgaggugagcagacuguuccuggagcccacccaggccgacaucgcccugcugaagcugagcagacccgccgugaucaccgacaaggugaugcccgccugccugcccagccccgacuacauggugaccgccagaaccgagugcuacaucaccggcuggggcgagacccagggcaccuucggcaccggccugcugaaggaggcccagcugcuggugaucgagaacgaggugugcaaccacuacaaguacaucugcgccgagcaccuggccagaggcaccgacagcugccagggcgacagcggcggcccccuggugugcuucgagaaggacaaguacauccugcagggcgugaccagcuggggccugggcugcgccagacccaacaagcccggcguguacgccagagugagcagauucgugaccuggaucgagggcaugaugagaaacaacuaa

SEQ ID NO: 19353 - RNA, 1095 nt, Artificial Sequence
  LPAR1__Homo_sapiens__XP_005251839
auggccgccaucagcaccagcauccccgugaucagccagccccaguucaccgccaugaacgagccccagugcuucuacaacgagagcaucgccuucuucuacaacagaagcggcaagcaccuggccaccgaguggaacaccgugagcaagcuggugaugggccugggcaucaccgugugcaucuucaucaugcuggccaaccugcuggugaugguggccaucuacgugaacagaagauuccacuuccccaucuacuaccugauggccaaccuggccgccgccgacuucuucgccggccuggccuacuucuaccugauguucaacaccggccccaacaccagaagacugaccgugagcaccuggcugcugagacagggccugaucgacaccagccugaccgccagcguggccaaccugcuggccaucgccaucgagagacacaucaccguguucagaaugcagcugcacaccagaaugagcaacagaagaguggugguggugaucguggugaucuggaccauggccaucgugaugggcgccauccccagcgugggcuggaacugcaucugcgacaucgagaacugcagcaacauggccccccuguacagcgacagcuaccugguguucugggccaucuucaaccuggugaccuucguggugaugguggugcuguacgcccacaucuucggcuacgugagacagagaaccaugagaaugagcagacacagcagcggccccagaagaaacagagacaccaugaugagccugcugaagaccguggugaucgugcugggcgccuucaucaucugcuggacccccggccuggugcugcugcugcuggacgugugcugcccccagugcgacgugcuggccuacgagaaguucuuccugcugcuggccgaguucaacagcgccaugaaccccaucaucuacagcuacagagacaaggagaugagcgccaccuucagacagauccugugcugccagagaagcgagaaccccaccggccccaccgagggcagcgacagaagcgccagcagccugaaccacaccauccuggccggcgugcacagcaacgaccacagcgugguguaa

SEQ ID NO: 19354 - RNA, 1056 nt, Artificial Sequence
  LPAR2__Homo_sapiens__XP_011526723
auggugaucaugggccagugcuacuacaacgagaccaucggcuucuucuacaacaacagcggcaaggagcugagcagccacuggagacccaaggacgugguggugguggcccugggccugaccgugagcgugcuggugcugcugaccaaccugcuggugaucgccgccaucgccagcaacagaagauuccaccagcccaucuacuaccugcugggcaaccuggccgccgccgaccuguucgccggcguggccuaccuguuccugauguuccacaccggccccagaaccgccagacugagccuggagggcugguuccugagacagggccugcuggacaccagccugaccgccagcguggccacccugcuggccaucgccguggagagacacagaagcgugauggccgugcagcugcacagcagacugcccagaggcagaguggugaugcugaucgugggcguguggguggccgcccugggccugggccugcugcccgcccacagcuggcacugccugugcgcccuggacagaugcagcagaauggccccccugcugagcagaagcuaccuggccgugugggcccugagcagccugcugguguuccugcugaugguggccguguacaccagaaucuucuucuacgugagaagaagagugcagagaauggccgagcacgugagcugccaccccagauacagagagaccacccugagccuggugaagaccguggugaucauccugggcgccuucguggugugcuggacccccggccagguggugcugcugcuggacggccugggcugcgagagcugcaacgugcuggccguggagaaguacuuccugcugcuggccgaggccaacagccuggugaacgccgccguguacagcugcagagacgccgagaugagaagaaccuucagaagacugcugugcugcgccugccugagacagagcaccagagagagcgugcacuacaccagcagcgcccagggcggcgccagcaccagaaucaugcugcccgagaacggccacccccugauggacagcacccuguaa

SEQ ID NO: 19355 - RNA, 1062 nt, Artificial Sequence
  LPAR3__Homo_sapiens__XP_011539451
augaacgagugccacuacgacaagcacauggacuucuucuacaacagaagcaacaccgacaccguggacgacuggaccggcaccaagcuggugaucgugcugugcgugggcaccuucuucugccuguucaucuucuucagcaacagccuggugaucgccgccgugaucaagaacagaaaguuccacuuccccuucuacuaccugcuggccaaccuggccgccgccgacuucuucgccggcaucgccuacguguuccugauguucaacaccggccccgugagcaagacccugaccgugaacagaugguuccugagacagggccugcuggacagcagccugaccgccagccugaccaaccugcuggugaucgccguggagagacacaugagcaucaugagaaugagagugcacagcaaccugaccaagaagagagugacccugcugauccugcuggugugggccaucgccaucuucaugggcgccgugcccacccugggcuggaacugccugugcaacaucagcgccugcagcagccuggcccccaucuacagcagaagcuaccugguguucuggaccgugagcaaccugauggccuuccugaucaugguggugguguaccugagaaucuacguguacgugaagagaaagaccaacgugcugagcccccacaccagcggcagcaucagcagaagaagaacccccaugaagcugaugaagaccgugaugaccgugcugggcgccuucguggugugcuggacccccggccugguggugcugcugcuggacggccugaacugcagacagugcggcgugcagcacgugaagagaugguuccugcugcuggcccugcugaacagcguggugaaccccaucaucuacagcuacaaggacgaggacauguacggcaccaugaagaagaugaucugcugcuucagccaggagaaccccgagagaagacccagcagaauccccagcaccgugcugagcagaagcgacaccggcagccaguacaucgaggacagcaucagccagggcgccgugugcaacaagagcaccagcuaa

SEQ ID NO: 19356 - RNA, 1035 nt, Artificial Sequence
  LPAR6__Homo_sapiens__NP_001155970
auggugagcgugaacagcagccacugcuucuacaacgacagcuucaaguacacccuguacggcugcauguucagcaugguguucgugcugggccugaucagcaacugcguggccaucuacaucuucaucugcgugcugaaggugagaaacgagaccaccaccuacaugaucaaccuggccaugagcgaccugcuguucguguucacccugcccuucagaaucuucuacuucaccaccagaaacuggcccuucggcgaccugcugugcaagaucagcgugaugcuguucuacaccaacauguacggcagcauccuguuccugaccugcaucagcguggacagauuccuggccaucguguaccccuucaagagcaagacccugagaaccaagagaaacgccaagaucgugugcaccggcguguggcugaccgugaucggcggcagcgcccccgccguguucgugcagagcacccacagccagggcaacaacgccagcgaggccugcuucgagaacuuccccgaggccaccuggaagaccuaccugagcagaaucgugaucuucaucgagaucgugggcuucuucaucccccugauccugaacgugaccugcagcagcauggugcugaagacccugaccaagcccgugacccugagcagaagcaagaucaacaagaccaaggugcugaagaugaucuucgugcaccugaucaucuucugcuucugcuucgugcccuacaacaucaaccugauccuguacagccuggugagaacccagaccuucgugaacugcagcgugguggccgccgugagaaccauguaccccaucacccugugcaucgccgugagcaacugcugcuucgaccccaucguguacuacuucaccagcgacaccauccagaacagcaucaagaugaagaacuggagcgugagaagaagcgacuucagauucagcgaggugcacggcgccgagaacuucauccagcacaaccugcagacccugaagagcaagaucuucgacaacgagagcgccgccuaa

SEQ ID NO: 19357 - RNA, 1605 nt, Artificial Sequence
  LPCAT1__Homo_sapiens__NP_079106
augagacugagaggcugcggccccagagccgcccccgccagcagcgccggcgccagcgacgccagacugcuggccccccccggcagaaaccccuucgugcacgagcugagacugagcgcccugcagaaggcccagguggcccugaugacccugacccuguuccccgugagacugcugguggccgccgccaugaugcugcuggccuggccccuggcccugguggccagccugggcagcgccgagaaggagcccgagcagccccccgcccuguggagaaaggugguggacuuccugcugaaggccaucaugagaaccaugugguucgccggcggcuuccacagaguggccgugaagggcagacaggcccugcccaccgaggccgccauccugacccuggccccccacagcagcuacuucgacgccauccccgugaccaugaccaugagcagcaucgugaugaaggccgagagcagagacauccccaucuggggcacccugauccaguacaucagacccguguucgugagcagaagcgaccaggacagcagaagaaagaccguggaggagaucaagagaagagcccagagcaacggcaaguggccccagaucaugaucuuccccgagggcaccugcaccaacagaaccugccugaucaccuucaagcccggcgccuucauccccggcgcccccgugcagcccguggugcugagauaccccaacaagcuggacaccaucaccuggaccuggcagggccccggcgcccuggagauccuguggcugacccugugccaguuccacaaccagguggagaucgaguuccugcccguguacagccccagcgaggaggagaagagaaaccccgcccuguacgccagcaacgugagaagagugauggccgaggcccugggcgugagcgugaccgacuacaccuucgaggacugccagcuggcccuggccgagggccagcugagacugcccgccgacaccugccugcuggaguucgccagacuggugagaggccugggccugaagcccgagaagcuggagaaggaccuggacagauacagcgagagagccagaaugaagggcggcgagaagaucggcaucgccgaguucgccgccagccuggaggugcccgugagcgaccugcuggaggacauguucagccuguucgacgagagcggcagcggcgagguggaccugagagagugcgugguggcccugagcguggugugcagacccgccagaacccuggacaccauccagcuggccuucaagauguacggcgcccaggaggacggcagcgugggcgagggcgaccugagcugcauccugaagaccgcccugggcguggccgagcugaccgugaccgaccuguucagagccaucgaccaggaggagaagggcaagaucaccuucgccgacuuccacagauucgccgagauguaccccgccuucgccgaggaguaccuguaccccgaccagacccacuucgagagcugcgccgagaccagccccgcccccauccccaacggcuucugcgccgacuucagccccgagaacagcgacgccggcagaaagcccgugagaaagaagcuggacuaa

SEQ ID NO: 19358 - RNA, 1635 nt, Artificial Sequence
  LPCAT2__Homo_sapiens__NP_060309
augagcagaugcgcccaggccgccgagguggccgccaccgugcccggcgccggcgugggcaacgugggccugagaccccccauggugcccagacaggccagcuucuuccccccccccgugcccaaccccuucgugcagcagacccagaucggcagcgccagaagagugcagaucgugcugcugggcaucauccugcugcccaucagagugcugcugguggcccugauccugcugcuggccuggcccuucgccgccaucagcaccgugugcugccccgagaagcugacccaccccaucaccggcuggagaagaaagaucacccagaccgcccugaaguuccugggcagagccauguucuucagcaugggcuucaucguggccgugaagggcaagaucgccagcccccuggaggcccccguguucguggccgccccccacagcaccuucuucgacggcaucgccugcgugguggccggccugcccagcauggugagcagaaacgagaacgcccaggugccccugaucggcagacugcugagagccgugcagcccgugcuggugagcagaguggaccccgacagcagaaagaacaccaucaacgagaucaucaagagaaccaccagcggcggcgaguggccccagauccugguguuccccgagggcaccugcaccaacagaagcugccugaucaccuucaagcccggcgccuucauccccggcgugcccgugcagcccgugcugcugagauaccccaacaagcuggacaccgugaccuggaccuggcagggcuacaccuucauccagcugugcaugcugaccuucugccagcuguucaccaagguggagguggaguucaugcccgugcaggugcccaacgacgaggagaagaacgaccccgugcuguucgccaacaaggugagaaaccugauggccgaggcccugggcauccccgugaccgaccacaccuacgaggacugcagacugaugaucagcgccggccagcugacccugcccauggaggccggccugguggaguucaccaagaucagcagaaagcugaagcuggacugggacggcgugagaaagcaccuggacgaguacgccagcaucgccagcagcagcaagggcggcagaaucggcaucgaggaguucgccaaguaccugaagcugcccgugagcgacgugcugagacagcuguucgcccuguucgacagaaaccacgacggcagcaucgacuucagagaguacgugaucggccuggccgugcugugcaaccccagcaacaccgaggagaucauccagguggccuucaagcuguucgacguggacgaggacggcuacaucaccgaggaggaguucagcaccauccugcaggccagccugggcgugcccgaccuggacgugagcggccuguucaaggagaucgcccagggcgacagcaucagcuacgaggaguucaagagcuucgcccugaagcaccccgaguacgccaagaucuucaccaccuaccuggaccugcagaccugccacguguucagccugcccaaggaggugcagaccacccccagcaccgccagcaacaaggugagccccgagaagcacgaggagagcaccagcgacaagaaggacgacuaa

SEQ ID NO: 19359 - RNA, 1464 nt, Artificial Sequence
  LPCAT3__Homo_sapiens__NP_005759
auggccagcagcgccgagggcgacgagggcaccgugguggcccuggccggcgugcugcagagcggcuuccaggagcugagccugaacaagcuggccaccagccugggcgccagcgagcaggcccugagacugaucaucagcaucuuccugggcuaccccuucgcccuguucuacagacacuaccuguucuacaaggagaccuaccugauccaccuguuccacaccuucaccggccugagcaucgccuacuucaacuucggcaaccagcuguaccacagccugcugugcaucgugcugcaguuccugauccugagacugaugggcagaaccaucaccgccgugcugaccaccuucugcuuccagauggccuaccugcuggccggcuacuacuacaccgccaccggcaacuacgacaucaaguggaccaugccccacugcgugcugacccugaagcugaucggccuggccguggacuacuucgacggcggcaaggaccagaacagccugagcagcgagcagcagaaguacgccaucagaggcgugcccagccugcuggagguggccggcuucagcuacuucuacggcgccuuccuggugggcccccaguucagcaugaaccacuacaugaagcuggugcagggcgagcugaucgacauccccggcaagauccccaacagcaucauccccgcccugaagagacugagccugggccuguucuaccuggugggcuacacccugcugagcccccacaucaccgaggacuaccugcugaccgaggacuacgacaaccaccccuucugguucagaugcauguacaugcugaucuggggcaaguucgugcuguacaaguacgugaccugcuggcuggugaccgagggcgugugcauccugaccggccugggcuucaacggcuucgaggagaagggcaaggccaagugggacgccugcgccaacaugaagguguggcuguucgagaccaaccccagauucaccggcaccaucgccagcuucaacaucaacaccaacgccuggguggccagauacaucuucaagagacugaaguuccugggcaacaaggagcugagccagggccugagccugcuguuccuggcccuguggcacggccugcacagcggcuaccuggugugcuuccagauggaguuccugaucgugaucguggagagacaggccgccagacugauccaggagagccccacccugagcaagcuggccgccaucaccgugcugcagcccuucuacuaccuggugcagcagaccauccacuggcuguucaugggcuacagcaugaccgccuucugccuguucaccugggacaaguggcugaagguguacaagagcaucuacuuccugggccacaucuucuuccugagccugcuguucauccugcccuacauccacaaggccauggugcccagaaaggagaagcugaagaagauggaguaa

SEQ ID NO: 19360 - RNA, 1575 nt, Artificial Sequence
  LPCAT4__Homo_sapiens__NP_705841
augagccagggcagccccggcgacugggccccccuggaccccacccccggcccccccgccagccccaaccccuucgugcacgagcugcaccugagcagacugcagagagugaaguucugccugcugggcgcccugcuggcccccaucagagugcugcuggccuucaucgugcuguuccugcuguggcccuucgccuggcugcagguggccggccugagcgaggagcagcugcaggagcccaucaccggcuggagaaagaccgugugccacaacggcgugcugggccugagcagacugcuguucuuccugcugggcuuccugagaaucagagugagaggccagagagccagcagacugcaggcccccgugcugguggccgccccccacagcaccuucuucgaccccaucgugcugcugcccugcgaccugcccaagguggugagcagagccgagaaccugagcgugcccgugaucggcgcccugcugagauucaaccaggccauccuggugagcagacacgaccccgccagcagaagaagagugguggaggaggugagaagaagagccaccagcggcggcaaguggccccaggugcuguucuuccccgagggcaccugcagcaacaagaaggcccugcugaaguucaagcccggcgccuucaucgccggcgugcccgugcagcccgugcugaucagauaccccaacagccuggacaccaccagcugggccuggagaggccccggcgugcugaaggugcuguggcugaccgccagccagcccugcagcaucguggacguggaguuccugcccguguaccaccccagccccgaggagagcagagaccccacccuguacgccaacaacgugcagagagugauggcccaggcccugggcauccccgccaccgagugcgaguucgugggcagccugcccgugaucguggugggcagacugaagguggcccuggagccccagcugugggagcugggcaaggugcugagaaaggccggccugagcgccggcuacguggacgccggcgccgagcccggcagaagcagaaugaucagccaggaggaguucgccagacagcugcagcugagcgacccccagaccguggccggcgccuucggcuacuuccagcaggacaccaagggccugguggacuucagagacguggcccuggcccuggccgcccuggacggcggcagaagccuggaggagcugaccagacuggccuucgagcuguucgccgaggagcaggccgagggccccaacagacugcuguacaaggacggcuucagcaccauccugcaccugcugcugggcagcccccaccccgccgccaccgcccugcacgccgagcugugccaggccggcagcagccagggccugagccugugccaguuccagaacuucagccugcacgacccccuguacggcaagcuguucagcaccuaccugagacccccccacaccagcagaggcaccagccagacccccaacgccagcagccccggcaaccccaccgcccuggccaacggcaccgugcaggcccccaagcagaagggcgacuaa

SEQ ID NO: 19361 - RNA, 1113 nt, Artificial Sequence
  LPGAT1__Homo_sapiens__NP_055688
auggccaucacccuggaggaggcccccuggcugggcuggcugcuggugaaggcccugaugagauucgccuucaugguggugaacaaccugguggccauccccagcuacaucugcuacgugaucauccugcagccccugagagugcuggacagcaagagauucugguacaucgagggcaucauguacaaguggcugcugggcaugguggccagcuggggcugguacgccggcuacaccgugauggaguggggcgaggacaucaaggccgugagcaaggacgaggccgugaugcuggugaaccaccaggccaccggcgacgugugcacccugaugaugugccugcaggacaagggccuggugguggcccagaugauguggcugauggaccacaucuucaaguacaccaacuucggcaucgugagccuggugcacggcgacuucuucaucagacagggcagaagcuacagagaccagcagcugcugcugcugaagaagcaccuggagaacaacuacagaagcagagacagaaaguggaucgugcuguuccccgagggcggcuuccugagaaagagaagagagaccagccaggccuucgccaagaagaacaaccugcccuuccugaccaacgugacccugcccagaagcggcgccaccaagaucauccugaacgcccugguggcccagcagaagaacggcagccccgccggcggcgacgccaaggagcuggacagcaagagcaagggccugcaguggaucaucgacaccaccaucgccuaccccaaggccgagcccaucgacauccagaccuggauccugggcuacagaaagcccaccgugacccacgugcacuacagaaucuuccccaucaaggacgugccccuggagaccgacgaccugaccaccuggcuguaccagagauucguggagaaggaggaccugcugagccacuucuacgagaccggcgccuucccccccagcaagggccacaaggaggccgugagcagagagaugacccugagcaaccuguggaucuuccugauccagagcuucgccuuccugagcggcuacaugugguacaacaucauccaguacuucuaccacugccuguucuaa

SEQ ID NO: 19362 - RNA, 2691 nt, Artificial Sequence
  LPIN1__Homo_sapiens__NP_001248356
augagcagagugcagaccaugaacuacgugggccagcuggccggccagguguucgugaccgugaaggagcuguacaagggccugaaccccgccacccugagcggcugcaucgacaucaucgugaucagacagcccaacggcaaccugcagugcagccccuuccacgugagauucggcaagaugggcgugcugagaagcagagagaaggugguggacaucgagaucaacggcgagagcguggaccugcacaugaagcugggcgacaacggcgaggccuucuucgugcaggagaccgacaacgaccaggaggugauccccaugcaccuggccaccagccccauccugagcgagggcgccagcagaauggagugccagcugaagagaggcagcguggacagaaugagaggccuggaccccagcacccccgcccaggugaucgcccccagcgagacccccagcagcagcagcguggugaagaagagaagaaagagaagaagaaagagccagcuggacagccugaagagagacgacaacaugaacaccagcgaggacgaggacauguuccccaucgagaugagcagcgacgaggccauggagcugcuggagagcagcagaacccugcccaacgacaucccccccuuccaggacgacauccccgaggagaaccugagccuggccgugaucuacccccagagcgccagcuaccccaacagcgacagagaguggagccccacccccagccccagcggcagcagacccagcacccccaagagcgacagcgagcuggugagcaagagcaccgagagaaccggccagaagaaccccgagaugcuguggcuguggggcgagcugccccaggccgccaagagcagcagcccccacaagaugaaggagagcagcccccugagcagcagaaagaucugcgacaagagccacuuccaggccauccacagcgagagcagcgacaccuucagcgaccagagccccacccuggugggcggcgcccugcuggaccagaacaagccccagaccgagaugcaguucgugaacgaggaggaccuggagacccugggcgccgccgccccccugcugcccaugaucgaggagcugaagccccccagcgccagcguggugcagaccgccaacaagaccgacagccccagcagaaagagagacaagagaagcagacaccugggcgccgacggcguguaccuggacgaccugaccgacauggaccccgagguggccgcccuguacuuccccaagaacggcgaccccagcggccuggccaagcacgccagcgacaacggcgccagaagcgccaaccagagcccccagagcgugggcagcagcggcguggacagcggcguggagagcaccagcgacggccugagagaccugcccagcaucgccaucagccugugcggcggccugagcgaccacagagagaucaccaaggacgccuuccuggagcaggccgugagcuaccagcaguucguggacaaccccgccaucaucgacgaccccaaccugguggugaagaucggcagcaaguacuacaacuggaccaccgccgccccccugcugcuggccaugcaggccuuccagaagccccugcccaaggccaccguggagagcaucaugagagacaagaugcccaagaagggcggcagauggugguucagcuggagaggcagaaacaccaccaucaaggaggagagcaagcccgagcagugccuggccggcaaggcccacagcaccggcgagcagcccccccagcugagccuggccaccagagugaagcacgagagcagcagcagcgacgaggagagagccgccgccaagcccagcaacgccggccaccugccccugcugcccaacgugagcuacaagaagacccugagacugaccagcgagcagcugaagagccugaagcugaagaacggccccaacgacgugguguucagcgugaccacccaguaccagggcaccugcagaugcgagggcaccaucuaccuguggaacugggacgacaaggugaucaucagcgacaucgacggcaccaucaccagaagcgacacccugggccacauccugcccacccugggcaaggacuggacccaccagggcaucgccaagcuguaccacaaggugagccagaacggcuacaaguuccuguacugcagcgccagagccaucggcauggccgacaugaccagaggcuaccugcacugggugaacgagagaggcaccgugcugccccagggcccccugcugcugagccccagcagccuguucagcgcccugcacagagaggugaucgagaagaagcccgagaaguucaaggugcagugccugaccgacaucaagaaccuguucuuccccaacaccgagcccuucuacgccgccuucggcaacagacccgccgacguguacagcuacaagcaggugggcgugagccugaacagaaucuucaccgugaaccccaagggcgagcuggugcaggagcacgccaagaccaacaucagcagcuacgugagacugugcgaggugguggaccacguguucccccugcugaagagaagccacagcagcgacuuccccugcagcgacaccuucagcaacuucaccuucuggagagagccccugccccccuucgagaaccaggacauccacagcgccagcgccuaa

SEQ ID NO: 19363 - RNA, 2691 nt, Artificial Sequence
  LPIN2__Homo_sapiens__NP_055461
augaacuacgugggccagcuggccggccaggugaucgugaccgugaaggagcuguacaagggcaucaaccaggccacccugagcggcugcaucgacgugaucguggugcagcagcaggacggcagcuaccagugcagccccuuccacgugagauucggcaagcugggcgugcugagaagcaaggagaaggugaucgacaucgagaucaacggcagcgccguggaccugcacaugaagcugggcgacaacggcgaggccuucuucguggaggagaccgaggaggaguacgagaagcugcccgccuaccuggccaccagccccauccccaccgaggaccaguucuucaaggacaucgacaccccccuggugaagagcggcggcgacgagacccccagccagagcagcgacaucagccacgugcuggagaccgagaccaucuucacccccagcagcgugaagaagaagaagagaagaagaaagaaguacaagcaggacagcaagaaggaggagcaggccgccagcgccgccgccgaggacaccugcgacgugggcgugagcagcgacgacgacaagggcgcccaggccgccagaggcagcagcaacgccagccugaaggaggaggagugcaaggagccccugcuguuccacagcggcgaccacuacccccugagcgacggcgacuggagcccccuggagaccaccuacccccagaccgccugccccaagagcgacagcgagcuggaggugaagcccgccgagagccugcugagaagcgagagccacauggaguggaccuggggcggcuuccccgagagcaccaaggugagcaagagagagagaagcgaccaccaccccagaaccgccaccaucacccccagcgagaacacccacuucagagugauccccagcgaggacaaccugaucagcgagguggagaaggacgccagcauggaggacaccgugugcaccaucgugaagcccaagcccagagcccugggcacccagaugagcgaccccaccagcguggccgagcugcuggagcccccccuggagagcacccagaucagcagcaugcuggacgccgaccaccugcccaacgccgcccuggccgaggcccccagcgagagcaagcccgccgccaagguggacagccccagcaagaagaagggcgugcacaagagaagccagcaccagggccccgacgacaucuaccuggacgaccugaagggccuggagcccgagguggccgcccuguacuuccccaagagcgagagcgagcccggcagcagacaguggcccgagagcgacacccugagcggcagccagagcccccagagcgugggcagcgccgccgccgacagcggcaccgagugccugagcgacagcgccauggaccugcccgacgugacccugagccugugcggcggccugagcgagaacggcgagaucagcaaggagaaguucauggagcacaucaucaccuaccacgaguucgccgagaaccccggccugaucgacaaccccaaccuggugaucagaaucuacaacagauacuacaacugggcccuggccgcccccaugauccugagccugcagguguuccagaagagccugcccaaggccaccguggagagcugggugaaggacaagaugcccaagaagagcggcagauggugguucuggagaaagagagagagcaugaccaagcagcugcccgagagcaaggagggcaagagcgaggccccccccgccagcgaccugcccagcagcagcaaggagcccgccggcgccagacccgccgagaacgacagcagcagcgacgagggcagccaggagcuggaggagagcaucaccguggaccccauccccaccgagccccugagccacggcagcaccaccagcuacaagaagagccugagacugagcagcgaccagaucgccaagcugaagcugcacgacggccccaacgacgugguguucagcaucaccacccaguaccagggcaccugcagaugcgccggcaccaucuaccuguggaacuggaacgacaagaucaucaucagcgacaucgacggcaccaucaccaagagcgacgcccugggccagauccugccccagcugggcaaggacuggacccaccagggcaucgccaagcuguaccacagcaucaacgagaacggcuacaaguuccuguacugcagcgccagagccaucggcauggccgacaugaccagaggcuaccugcacugggugaacgacaagggcaccauccugcccagaggcccccugaugcugagccccagcagccuguucagcgccuuccacagagaggugaucgagaagaagcccgagaaguucaagaucgagugccugaacgacaucaagaaccuguucgcccccagcaagcagcccuucuacgccgccuucggcaacagacccaacgacguguacgccuacacccaggugggcgugcccgacugcagaaucuucaccgugaaccccaagggcgagcugauccaggagagaaccaagggcaacaagagcagcuaccacagacugagcgagcugguggagcacguguucccccugcugagcaaggagcagaacagcgccuuccccugccccgaguucagcagcuucugcuacuggagagaccccauccccgagguggaccuggacgaccugagcuaa

SEQ ID NO: 19364 - RNA, 1428 nt, Artificial Sequence
  LPL__Homo_sapiens__NP_000228
auggagagcaaggcccugcuggugcugacccuggccguguggcugcagagccugaccgccagcagaggcggcguggccgccgccgaccagagaagagacuucaucgacaucgagagcaaguucgcccugagaacccccgaggacaccgccgaggacaccugccaccugauccccggcguggccgagagcguggccaccugccacuucaaccacagcagcaagaccuucauggugauccacggcuggaccgugaccggcauguacgagagcugggugcccaagcugguggccgcccuguacaagagagagcccgacagcaacgugaucgugguggacuggcugagcagagcccaggagcacuaccccgugagcgccggcuacaccaagcuggugggccaggacguggccagauucaucaacuggauggaggaggaguucaacuacccccuggacaacgugcaccugcugggcuacagccugggcgcccacgccgccggcaucgccggcagccugaccaacaagaaggugaacagaaucaccggccuggaccccgccggccccaacuucgaguacgccgaggcccccagcagacugagccccgacgacgccgacuucguggacgugcugcacaccuucaccagaggcagccccggcagaagcaucggcauccagaagcccgugggccacguggacaucuaccccaacggcggcaccuuccagcccggcugcaacaucggcgaggccaucagagugaucgccgagagaggccugggcgacguggaccagcuggugaagugcagccacgagagaagcauccaccuguucaucgacagccugcugaacgaggagaaccccagcaaggccuacagaugcagcagcaaggaggccuucgagaagggccugugccugagcugcagaaagaacagaugcaacaaccugggcuacgagaucaacaaggugagagccaagagaagcagcaagauguaccugaagaccagaagccagaugcccuacaagguguuccacuaccaggugaagauccacuucagcggcaccgagagcgagacccacaccaaccaggccuucgagaucagccuguacggcaccguggccgagagcgagaacauccccuucacccugcccgaggugagcaccaacaagaccuacagcuuccugaucuacaccgagguggacaucggcgagcugcugaugcugaagcugaaguggaagagcgacagcuacuucagcuggagcgacugguggagcagccccggcuucgccauccagaagaucagagugaaggccggcgagacccagaagaaggugaucuucugcagcagagagaaggugagccaccugcagaagggcaaggcccccgccguguucgugaagugccacgacaagagccugaacaagaagagcggcuaa

SEQ ID NO: 19365 - RNA, 1890 nt, Artificial Sequence
  LPO__Homo_sapiens__NP_001153574
augagagugcugcugcaccugcccgcccugcuggccagccugauccugcugcaggccgccgccagcaccaccagagaccccagccuggaccugaccagccugagccuggaggugggcugcggcgcccccgcccccguggugagaugcgaccccugcagccccuacagaaccaucaccggcgacugcaacaacagaagaaagcccgcccugggcgccgccaacagagcccuggccagauggcugcccgccgaguacgaggacggccugagccugcccuucggcuggacccccggcaagaccagaaacggcuucccccugccccuggccagagaggugagcaacaagaucgugggcuaccugaacgaggagggcgugcuggaccagaacagaagccugcuguucaugcaguggggccagaucguggaccacgaccuggacuucgcccccgacaccgagcugggcagcagcgaguacagcaaggcccagugcgacgaguacugcauccagggcgacaacugcuuccccaucauguucccccccaacgaccccaaggccggcacccagggcaagugcaugcccuucuucagagccggcuucgugugccccaccccccccuacaagagccuggccagagagcagaucaacgcccugaccagcuuccuggacgccagcuucguguacagcagcgagcccagccuggccagcagacugagaaaccugagcagcccccugggccugauggccgugaaccaggaggugagcgaccacggccugcccuaccugcccuacgacagcaagaagcccagccccugcgaguucaucaacaccaccgccagagugcccugcuuccuggccggcgacagcagagccagcgagcacauccugcuggccaccagccacacccuguuccugagagagcacaacagacuggccagagagcugaagagacugaacccccagugggacggcgagaagcuguaccaggaggccagaaagauccugggcgccuucgugcagaucaucaccuucagagacuaccugcccauccugcugggcgaccacaugcagaaguggaucccccccuaccagggcuacagcgagagcguggaccccagaaucagcaacguguucaccuucgccuucagauucggccaccuggaggugcccagcagcauguucagacuggacgagaacuaccagcccuggggccccgagcccgagcugccccugcacacccuguucuucaacaccuggagaauggugaaggacggcggcaucgacccccuggugagaggccugcuggccaagaagagcaagcugaugaagcagaacaagaugaugaccggcgagcugagaaacaagcuguuccagcccacccacagaauccacggcuucgaccuggccgccaucaacacccagagaugcagagaccacggccagcccggcuacaacagcuggagagccuucugcgaccugagccagccccagacccuggaggagcugaacaccgugcugaagagcaagaugcuggccaagaagcugcugggccuguacggcacccccgacaacaucgacaucuggaucggcgccaucgccgagccccugguggagagaggcagagugggcccccugcuggccugccugcugggcaagcaguuccagcagaucagagacggcgacagauucuggugggagaaccccggcguguucaccaacgagcagaaggacagccugcagaagaugagcuucagcagacuggugugcgacaacaccagaaucaccaaggugcccagagaccccuucugggccaacagcuaccccuacgacuucguggacugcagcgccaucgacaagcuggaccugagccccugggccagcgugaagaacuaa

SEQ ID NO: 19366 - RNA, 1839 nt, Artificial Sequence
  LPP__Homo_sapiens__NP_001161143
augagccaccccagcuggcugccccccaagagcaccggcgagccccugggccacgugcccgccagaauggagaccacccacagcuucggcaaccccagcaucagcgugagcacccagcagccccccaagaaguucgcccccgugguggcccccaagcccaaguacaaccccuacaagcagcccggcggcgagggcgacuuccugcccccccccccccccccccuggacgacagcagcgcccugcccagcaucagcggcaacuucccccccccccccccccuggacgaggaggccuucaaggugcagggcaaccccggcggcaagacccuggaggagagaagaagcagccuggacgccgagaucgacagccugaccagcauccuggccgaccuggagugcagcagccccuacaagcccagacccccccagagcagcaccggcagcaccgccagcccccccgugagcacccccgugaccggccacaagagaauggugauccccaaccagcccccccugaccgccaccaagaagagcacccugaagccccagcccgccccccaggccggccccauccccguggcccccaucggcacccugaagccccagccccagcccgugcccgccagcuacaccaccgccagcaccagcagcagacccaccuucaacgugcaggugaagagcgcccagcccagcccccacuacauggccgcccccagcagcggccagaucuacggcagcggcccccagggcuacaacacccagcccgugcccgugagcggccagugccccccccccagcaccagaggcggcauggacuacgccuacauccccccccccggccugcagcccgagcccggcuacggcuacgcccccaaccagggcagauacuacgagggcuacuacgccgccggccccggcuacggcggcagaaacgacagcgaccccaccuacggccagcagggccaccccaacaccuggaagagagagcccggcuacaccccccccggcgccggcaaccagaacccccccggcauguaccccgugaccggccccaagaagaccuacaucaccgaccccgugagcgcccccugcgcccccccccugcagcccaagggcggccacagcggccagcugggccccagcagcguggcccccagcuucagacccgaggacgagcuggagcaccugaccaagaagaugcuguacgacauggagaacccccccgccgacgaguacuucggcagaugcgccagaugcggcgagaacguggugggcgagggcaccggcugcaccgccauggaccagguguuccacguggacugcuucaccugcaucaucugcaacaacaagcugagaggccagcccuucuacgccguggagaagaaggccuacugcgagcccugcuacaucaacacccuggagcagugcaacgugugcagcaagcccaucauggagagaauccugagagccaccggcaaggccuaccacccccacugcuucaccugcgugaugugccacagaagccuggacggcauccccuucaccguggacgccggcggccugauccacugcaucgaggacuuccacaagaaguucgcccccagaugcagcgugugcaaggagcccaucaugcccgcccccggccaggaggagaccgugagaaucguggcccuggacagagacuuccacgugcacugcuacagaugcgaggacugcggcggccugcugagcgagggcgacaaccagggcugcuacccccuggacggccacauccugugcaagaccugcaacagcgccagaaucagagugcugaccgccaaggccagcaccgaccuguaa

SEQ ID NO: 19367 - RNA, 1284 nt, Artificial Sequence
  LPPR2__Homo_sapiens__NP_001164106
auggccggcggcagaccccaccugaagagaagcuucagcaucauccccugcuucguguucguggagggcuucuucugcuacgacagcaccuacgccaagcccuaccccggccccgaggccgccagcagagugccccccgcccugguguacgcccuggugaccgccggccccacccugaccauccugcugggcgagcuggccagagccuucuuccccgccccccccagcgccgugcccgugaucggcgagagcaccaucgugagcggcgccugcugcagauucagcccccccgugagaagacuggugagauuccugggcguguacagcuucggccuguucaccaccaccaucuucgccaacgccggccagguggugaccggcaaccccaccccccacuuccugagcgugugcagacccaacuacaccgcccugggcugccugccccccagccccgacagacccggccccgacagauucgugaccgaccagggcgccugcgccggcagccccagccugguggccgccgccagaagagccuuccccugcaaggacgccgcccugugcgccuacgccgugaccuacaccgccauguacgugacccugguguucagagugaagggcagcagacuggugaagcccagccugugccuggcccugcugugccccgccuuccuggugggcguggugagaguggccgaguacagaaaccacuggagcgacgugcuggccggcuuccugaccggcgccgccaucgccaccuuccuggugaccugcguggugcacaacuuccagagcagaccccccagcggcagaagacugagccccugggaggaccugggccaggcccccaccauggacagcccccuggagaagcugagcguggcccaggagcccgaggugugcagaccccacagcacccccgccagacugacccccagcaagagccagaacugcgccagaagaggccaccugauccccagcugcgugagcagcagagcccccgccaugugcagcagccccagagugcccagacccagacugagaagcgagcccaccccccugccccugccccugccccugcccgcccccacccccagccagggccccagccccagcagccccggccccggcggccccggcggcggcggcggcagaggcagaaagcugcugcugcccaccccccugcugagagaccuguacacccugagcggccuguaccccagccccuuccacagagacaacuucagccccuaccuguucgccagcagagaccaccugcuguaa

SEQ ID NO: 19368 - RNA, 1965 nt, Artificial Sequence
  LPPR4__Homo_sapiens__XP_011540800
augcccuacaucgagcccacccaggaggccauccccuuccugaugcugcugagccuggccuucgccggccccgccaucaccaucauggugggcgagggcauccuguacugcugccugagcaagagaagaaacggcgugggccuggagcccaacaucaacgccggcggcugcaacuucaacagcuuccugagaagagccgugagauucgugggcgugcacguguucggccugugcagcaccgcccugaucaccgacaucauccagcugagcaccggcuaccaggcccccuacuuccugaccgugugcaagcccaacuacaccagccugaacgugagcugcaaggagaacagcuacaucguggaggacaucugcagcggcagcgaccugaccgugaucaacagcggcagaaagagcuuccccagccagcacgccacccuggccgccuucgccgccguguacgugagcauguacuucaacagcacccugaccgacagcagcaagcugcugaagccccugcugguguucaccuucaucaucugcggcaucaucugcggccugaccagaaucacccaguacaagaaccaccccguggacguguacugcggcuuccugaucggcggcggcaucgcccuguaccugggccuguacgccgugggcaacuuccugcccagcgacgagagcauguuccagcacagagacgcccugagaagccugaccgaccugaaccaggaccccaacagacugcugagcgccaagaacggcagcagcagcgacggcaucgcccacaccgagggcauccugaacagaaaccacagagacgccagcagccugaccaaccugaagagagccaacgccgacguggagaucaucacccccagaagccccaugggcaaggagaacauggugaccuucagcaacacccugcccagagccaacacccccagcguggaggaccccgugagaagaaacgccagcauccacgccagcauggacagcgccagaagcaagcagcugcugacccaguggaagaacaagaacgagagcagaaagcugagccugcaggugaucgagcccgagcccggccagagcccccccagaagcaucgagaugagaagcagcagcgagcccagcagagugggcgugaacggcgaccaccacggccccggcaaccaguaccugaagauccagcccggcgccgugcccggcugcaacaacagcaugcccggcggccccagagugagcauccagagcagacccggcagcagccagcuggugcacauccccgaggagacccaggagaacaucagcaccagccccaagagcagcagcgccagagccaaguggcugaaggccgccgagaagaccguggccugcaacagaagcaacagccagcccagaaucaugcaggugaucgccaugagcaagcagcagggcgugcugcagagcagccccaagaacaccgagggcagcaccgugagcugcaccggcagcaucagauacaagacccugaccgaccacgagcccagcggcaucgugagaguggaggcccaccccgagaacaacagacccaucauccagauccccagcaccgagggcgagggcagcggcagcuggaaguggaaggcccccgagaagggcagccugagacagaccuacgagcugaacgaccugaacagagacagcgagagcugcgagagccugaaggacagcuucggcagcggcgacagaaagagaagcaacaucgacagcaacgagcaccaccaccacggcaucaccaccaucagagugacccccguggagggcagcgagaucggcagcgagacccugagcaucagcagcagcagagacagcacccugagaagaaagggcaacaucauccugauccccgagagaagcaacagccccgagaacaccagaaacaucuucuacaagggcaccagccccaccagagccuacaaggacuaa

SEQ ID NO: 19369 - RNA, 1176 nt, Artificial Sequence
  LPXN__Homo_sapiens__NP_001137467
augagcacccugcugaucagcagcagcgacgcccugcuggaggagcuggagagaagcacccugcaggacagcgacgaguacagcaaccccgccccccugccccuggaccagcacagcagaaaggagaccaaccuggacgagaccagcgagauccugagcauccaggacaacaccagcccccugcccgcccagcugguguacaccaccaacauccaggagcugaacguguacagcgaggcccaggagcccaaggagagccccccccccagcaagaccagcgccgccgcccagcuggacgagcugauggcccaccugaccgagaugcaggccaagguggccgugagagccgacgccggcaagaagcaccugcccgacaagcaggaccacaaggccagccuggacagcaugcugggcggccuggagcaggagcugcaggaccugggcaucgccaccgugcccaagggccacugcgccagcugccagaagcccaucgccggcaaggugauccacgcccugggccagagcuggcaccccgagcacuucgugugcacccacugcaaggaggagaucggcagcagccccuucuucgagagaagcggccuggccuacugccccaacgacuaccaccagcuguucagccccagaugcgccuacugcgccgcccccauccuggacaaggugcugaccgccaugaaccagaccuggcaccccgagcacuucuucugcagccacugcggcgagguguucggcgccgagggcuuccacgagaaggacaagaagcccuacugcagaaaggacuuccuggccauguucagccccaagugcggcggcugcaacagacccgugcuggagaacuaccugagcgccauggacaccguguggcaccccgagugcuucgugugcggcgacugcuucaccagcuucagcaccggcagcuucuucgagcuggacggcagacccuucugcgagcugcacuaccaccacagaagaggcacccugugccacggcugcggccagcccaucaccggcagaugcaucagcgccaugggcuacaaguuccaccccgagcacuucgugugcgccuucugccugacccagcugagcaagggcaucuucagagagcagaacgacaagaccuacugccagcccugcuucaacaagcuguucccccuguaa

SEQ ID NO: 19370 - RNA, 693 nt, Artificial Sequence
  LRAT__Homo_sapiens__NP_001288574
augaagaaccccaugcuggagguggugagccugcugcuggagaagcugcugcugaucagcaacuucacccuguucagcagcggcgccgccggcgaggacaagggcagaaacagcuucuacgagaccagcagcuuccacagaggcgacgugcuggaggugcccagaacccaccugacccacuacggcaucuaccugggcgacaacagaguggcccacaugaugcccgacauccugcuggcccugaccgacgacaugggcagaacccagaagguggugagcaacaagagacugauccugggcgugaucgugaagguggccagcaucagaguggacaccguggaggacuucgccuacggcgccaacauccuggugaaccaccuggacgagagccugcagaagaaggcccugcugaacgaggagguggccagaagagccgagaagcugcugggcuucacccccuacagccugcuguggaacaacugcgagcacuucgugaccuacugcagauacggcacccccaucagcccccagagcgacaaguucugcgagaccgugaagaucaucaucagagaccagagaagcgugcuggccagcgccgugcugggccuggccagcaucgugugcaccggccuggugagcuacaccacccugcccgccaucuucauccccuucuuccuguggauggccggcuaa

SEQ ID NO: 19371 - RNA, 8592 nt, Artificial Sequence
  LRBA__Homo_sapiens__NP_006717
auggccagcgaggacaacagagugcccagccccccccccaccggcgacgacggcggcggcggcggcagagaggagacccccaccgagggcggcgcccugagccugaagcccggccugcccaucagaggcaucagaaugaaguucgccgugcugaccggccugguggaggugggcgaggugagcaacagagacaucguggagaccguguucaaccugcuggugggcggccaguucgaccuggagaugaacuucaucauccaggagggcgagagcaucaacugcaugguggaccugcuggagaagugcgacaucaccugccaggccgagguguggagcauguucaccgccauccugaagaagagcaucagaaaccugcaggugugcaccgaggugggccugguggagaaggugcugggcaagaucgagaagguggacaacaugaucgccgaccugcugguggacaugcugggcgugcuggccagcuacaaccugaccgugagagagcugaagcuguucuucagcaagcugcagggcgacaagggcagauggcccccccacgccggcaagcugcugagcgugcugaagcacaugccccagaaguacggccccgacgccuucuucaacuuccccggcaagagcgccgccgccaucgcccugccccccaucgccaaguggcccuaccagaacggcuucaccuuccacaccuggcugagaauggaccccgugaacaacaucaacguggacaaggacaagcccuaccuguacugcuucagaaccagcaagggccugggcuacagcgcccacuucgugggcggcugccugaucgugaccagcaucaagagcaagggcaagggcuuccagcacugcgugaaguucgacuucaagccccagaagugguacauggugaccaucgugcacaucuacaacagauggaagaacagcgagcugagaugcuacgugaacggcgagcuggccagcuacggcgagaucaccugguucgugaacaccagcgacaccuucgacaagugcuuccugggcagcagcgagaccgccgacgccaacagaguguucugcggccagaugaccgccguguaccuguucagcgaggcccugaacgccgcccagaucuucgccaucuaccagcugggccugggcuacaagggcaccuucaaguucaaggccgagagcgaccuguuccuggccgagcaccacaagcugcugcuguacgacggcaagcugagcagcgccaucgccuucaccuacaaccccagagccaccgacgcccagcugugccuggagagcagccccaaggacaaccccagcaucuucgugcacagcccccacgcccugaugcugcaggacgugaaggccgugcugacccacagcauccagagcgccaugcacagcaucggcggcgugcaggugcuguucccccuguucgcccagcuggacuacagacaguaccugagcgacgagaucgaccugaccaucugcagcacccugcuggccuucaucauggagcugcugaagaacagcaucgccaugcaggagcagaugcuggccugcaagggcuuccuggugaucggcuacagccuggagaagagcagcaagagccacgugagcagagccgugcuggagcugugccuggccuucagcaaguaccugagcaaccugcagaacggcaugccccugcugaagcagcugugcgaccacgugcugcugaaccccgccaucuggauccacacccccgccaaggugcagcugaugcuguacaccuaccugagcaccgaguucaucggcaccgugaacaucuacaacaccaucagaagagugggcaccgugcugcugaucaugcacacccugaaguacuacuacugggccgugaacccccaggacagaagcggcaucacccccaagggccuggacggccccagacccaaccagaaggagaugcugagccugagagccuuccugcugauguucaucaagcagcuggugaugaaggacagcggcgugaaggaggacgagcugcaggccauccugaacuaccugcugaccaugcacgaggacgacaaccugauggacgugcugcagcugcugguggcccugaugagcgagcaccccaacagcaugauccccgccuucgaccagagaaacggccugagagugaucuacaagcugcuggccagcaagagcgagggcaucagagugcaggcccugaaggccaugggcuacuuccugaagcaccuggcccccaagagaaaggccgaggugaugcugggccacggccuguucagccugcuggccgagagacugaugcugcagaccaaccugaucaccaugaccaccuacaacgugcuguucgagauccugaucgagcagaucggcacccaggugauccacaagcagcaccccgaccccgacagcagcgugaagauccagaacccccagauccugaaggugaucgccacccugcugagaaacagcccccagugccccgagagcauggaggugagaagagccuuccugagcgacaugaucaagcuguucaacaacagcagagagaacagaagaagccugcugcagugcagcguguggcaggaguggaugcugagccugugcuacuucaaccccaagaacagcgacgagcagaagaucaccgagaugguguacgccaucuucagaauccugcuguaccacgccgugaaguacgaguggggcggcuggagaguguggguggacacccugagcaucacccacagcaaggugaccuucgagauccacaaggagaaccuggccaacaucuucagagagcagcagggcaagguggacgaggagaucggccugugcagcagcaccagcgugcaggccgccagcggcaucagaagagacaucaacgugagcgugggcagccagcagcccgacaccaaggacagccccgugugcccccacuucaccaccaacggcaacgagaacagcagcaucgagaagaccagcagccuggagagcgccagcaacaucgagcugcagaccaccaacaccagcuacgaggagaugaaggccgagcaggagaaccaggagcugcccgacgagggcacccuggaggagacccugaccaacgagaccagaaacgccgacgaccuggaggugagcagcgacaucaucgaggccguggccaucagcagcaacagcuucaucaccaccggcaaggacagcaugaccgugagcgaggugaccgccagcaucagcagccccagcgaggaggacgccagcgagaugcccgaguuccuggacaagagcaucguggaggaggaggaggacgacgacuacguggagcugaagguggagggcagccccaccgaggaggccaaccugcccaccgagcugcaggacaacagccugagccccgccgccagcgaggccggcgagaagcuggacauguucggcaacgacgacaagcugaucuuccaggagggcaagcccgugaccgagaagcagaccgacaccgagacccaggacagcaaggacagcggcauccagaccaugaccgccagcggcagcagcgccaugagccccgagaccaccgugagccagaucgccguggagagcgaccugggccagaugcuggaggagggcaagaaggccaccaaccugaccagagagaccaagcugaucaacgacugccacggcagcgugagcgaggccagcagcgagcagaagaucgccaagcuggacgugagcaacguggccaccgacaccgagagacuggagcugaaggccagccccaacguggaggccccccagccccacagacacgugcuggagaucagcagacagcacgagcagcccggccagggcaucgcccccgacgccgugaacggccagagaagagacagcagaagcaccguguucagaauccccgaguucaacuggagccagaugcaccagagacugcugaccgaccugcuguucagcaucgagaccgacauccagauguggagaagccacagcaccaagaccgugauggacuucgugaacagcagcgacaacgugaucuucgugcacaacaccauccaccugaucagccaggugauggacaacauggugauggccugcggcggcauccugccccugcugagcgccgccaccagcgccacccacgagcuggagaacaucgagcccacccagggccugagcaucgaggccagcgugaccuuccugcagagacugaucagccugguggacgugcugaucuucgccagcagccugggcuucaccgagaucgaggccgagaagagcaugagcagcggcggcauccugagacagugccugagacuggugugcgccguggccgugagaaacugccuggagugccagcagcacagccagcugaagaccagaggcgacaaggcccugaagcccaugcacagccugaucccccugggcaagagcgccgccaagagccccguggacaucgugaccggcggcaucagccccgugagagaccuggacagacugcugcaggacauggacaucaacagacugagagccgugguguucagagacaucgaggacagcaagcaggcccaguuccuggcccuggccgugguguacuucaucagcgugcugauggugagcaaguacagagacauccuggagccccagaacgagagacacagccagagcugcaccgagaccggcagcgagaacgagaacgugagccugagcgagaucacccccgccgccuucagcacccugaccaccgccagcguggaggagagcgagagcaccagcagcgccagaagaagagacagcggcaucggcgaggagaccgccaccggccugggcagccacguggaggugaccccccacaccgccccccccggcgugagcgccggccccgacgccaucagcgaggugcugagcacccugagccuggaggugaacaagagccccgagaccaagaacgacagaggcaacgaccuggacaccaaggccacccccagcgugagcgugagcaagaacgugaacgugaaggacauccugagaagccuggugaacauccccgccgacggcgugaccguggaccccgcccugcugccccccgccugccugggcgcccugggcgaccugagcguggagcagcccgugcaguucagaagcuucgacagaagcgugaucguggccgccaagaagagcgccgugagccccagcaccuucaacaccagcauccccaccaacgccgugagcguggugagcagcguggacagcgcccaggccagcgacaugggcggcgagagccccggcagcagaagcagcaacgccaagcugcccagcgugcccaccguggacagcgugagccaggaccccgugagcaacaugagcaucaccgagagacuggagcacgcccuggagaaggccgccccccugcugagagagaucuucguggacuucgcccccuuccugagcagaacccugcugggcagccacggccaggagcugcugaucgagggcaccagccuggugugcaugaagagcagcagcagcgugguggagcuggugaugcugcugugcagccaggaguggcagaacagcauccagaagaacgccggccuggccuucaucgagcuggugaacgagggcagacugcugagccagaccaugaaggaccaccuggugagaguggccaacgaggccgaguucauccugagcagacagagagccgaggacauccacagacacgccgaguucgagagccugugcgcccaguacagcgccgacaagagagaggacgagaagaugugcgaccaccugaucagagccgccaaguacagagaccacgugaccgccacccagcugauccagaagaucaucaacauccugaccgacaagcacggcgccuggggcaacagcgccgugagcagaccccuggaguucuggagacuggacuacugggaggacgaccugagaagaagaagaagauucgugagaaacccccugggcagcacccaccccgaggccacccugaagaccgccguggagcacgugugcaucuucaagcugagagagaacagcaaggccaccgacgaggacauccuggccaagggcaagcagagcaucagaagccaggcccugggcaaccagaacagcgagaacgagauccugcuggagggcgacgacgacacccugagcagcguggacgagaaggaccuggagaaccuggccggccccgugagccugagcacccccgcccagcugguggcccccagcgugguggugaagggcacccugagcgugaccagcagcgagcuguacuucgagguggacgaggaggaccccaacuucaagaagaucgaccccaagauccuggccuacaccgagggccugcacggcaaguggcuguucaccgagaucagaagcaucuucagcagaagauaccugcugcagaacaccgcccuggagaucuucauggccaacagaguggccgugauguucaacuuccccgaccccgccaccgugaagaagguggugaacuaccugcccagagugggcgugggcaccagcuucggccugccccagaccagaagaaucagccuggccagccccagacagcuguucaaggccagcaacaugacccagagauggcagcacagagagaucagcaacuucgaguaccugauguuccugaacaccaucgccggcagaagcuacaacgaccugaaccaguaccccguguuccccugggugaucaccaacuacgagagcgaggagcuggaccugacccugcccaccaacuucagagaccugagcaagcccaucggcgcccugaaccccaagagagccgccuucuucgccgagagauacgagagcugggaggacgaccaggugcccaaguuccacuacggcacccacuacagcaccgccagcuucgugcuggccuggcugcugagaaucgagcccuucaccaccuacuuccugaaccugcagggcggcaaguucgaccacgccgacagaaccuucagcagcaucagcagagccuggagaaacagccagagagacaccagcgacaucaaggagcugauccccgaguucuacuaccugcccgagauguucgugaacuucaacaacuacaaccugggcgugauggacgacggcaccguggugagcgacguggagcugccccccugggccaagaccagcgaggaguucgugcacaucaacagacuggcccuggagagcgaguucgugagcugccagcugcaccaguggaucgaccugaucuucggcuacaagcagcagggccccgaggccgugagagcccugaacguguucuacuaccugaccuacgagggcgccgugaaccugaacagcaucaccgaccccgugcugagagaggccguggaggcccagaucagaagcuucggccagacccccagccagcugcugaucgagccccacccccccagaggcagcgccaugcaggugagcccccugauguucaccgacaaggcccagcaggacgugaucauggugcugaaguuccccagcaacagccccgugacccacguggccgccaacacccagcccggccuggccacccccgccgugaucaccgugaccgccaacagacuguucgccgugaacaaguggcacaaccugcccgcccaccagggcgccgugcaggaccagcccuaccagcugcccguggagaucgacccccugaucgccagcaacaccggcaugcacagaagacagaucaccgaccugcuggaccagagcauccaggugcacagccagugcuucgugaucaccagcgacaacagauacauccuggugugcggcuucugggacaagagcuucagaguguacagcaccgacaccggcagacugauccaggugguguucggccacugggacguggugaccugccuggccagaagcgagagcuacaucggcggcaacugcuacauccugagcggcagcagagacgccacccugcugcugugguacuggaacggcaagugcagcggcaucggcgacaaccccggcagcgagaccgccgcccccagagccauccugaccggccacgacuacgaggugaccugcgccgccgugugcgccgagcugggccuggugcugagcggcagccaggagggccccugccugauccacagcaugaacggcgaccugcugagaacccuggagggccccgagaacugccugaagcccaagcugauccaggccagcagagagggccacugcgugaucuucuacgagaacggccuguucugcaccuucagcgugaacggcaagcugcaggccaccauggagaccgacgacaacaucagagccauccagcugagcagagacggccaguaccugcugaccggcggcgacagaggcguggugguggugagacaggugagcgaccugaagcagcuguucgccuaccccggcugcgacgccggcaucagagccauggcccugagcuacgaccagagaugcaucaucagcggcauggccagcggcagcaucgugcuguucuacaacgacuucaacagauggcaccacgaguaccagaccagauacuaa

SEQ ID NO: 19372 - RNA, 2292 nt, Artificial Sequence
  LRCH1__Homo_sapiens__NP_001157683
auggccacccccggcagcgagccccagcccuucgugcccgcccugagcguggccacccugcacccccugcaccacccccaccaccaccaccaccaccaccagcaccacggcggcaccggcgcccccggcggcgccggcggcggcggcggcggcagcggcggcuucaaccugccccugaacagaggccuggagagagcccuggaggaggccgccaacagcggcggccugaaccugagcgccagaaagcugaaggaguuccccagaaccgccgcccccggccacgaccugagcgacaccgugcaggccgaccugagcaagaacagacugguggaggugcccauggagcugugccacuucgugagccuggagauccugaaccuguaccacaacugcaucagagugauccccgaggccaucgugaaccugcagaugcugaccuaccugaaccugagcagaaaccagcugagcgcccugcccgccugccugugcggccugccccugaaggugcugaucgccagcaacaacaagcugggcagccugcccgaggagaucggccagcugaagcagcugauggagcuggacgugagcugcaacgagaucaccgcccugccccagcagaucggccagcugaagagccugagagagcugaacgugagaagaaacuaccugaaggugcugccccaggagcugguggaccugccccuggugaaguucgacuucagcugcaacaaggugcuggugauccccaucugcuucagagagaugaagcagcugcaggugcugcugcuggagaacaacccccugcagagcccccccgcccagaucugcaccaagggcaaggugcacaucuucaaguaccugagcauccaggccugccagaucaagaccgccgacagccuguaccugcacaccauggagagaccccaccugcaccagcacguggaggacggcaagaaggacagcgacagcggcgugggcagcgacaacggcgacaagagacugagcgccaccgagcccagcgacgaggacaccgugagccugaacgugcccaugagcaacaucauggaggaggagcagaucaucaaggaggacagcugccacagacugagccccgugaagggcgaguuccaccaggaguuccagcccgagcccagccugcugggcgacagcaccaacagcggcgaggagagagaccaguucaccgacagagccgacggccugcacagcgaguucaugaacuacaaggccagagccgaggacugcgaggagcugcugagaaucgaggaggacgugcacuggcagaccgagggcaucaucagcagcagcaaggaccaggacauggacaucgccaugaucgagcagcugagagaggccguggaccugcugcaggaccccaacggccugagcaccgacaucaccgagagaagcgugcugaaccuguaccccaugggcagcgccgaggcccuggagcugcaggacagcgcccugaacggccagauccagcuggagaccagccccgugugcgaggugcagagcgaccugacccugcagagcaacggcagccaguacagccccaacgagaucagagagaacagccccgccgugagccccaccaccaacagcaccgcccccuucggccugaagcccagaagcgaccccgcccugauccugccccccaucagcuucaacacccugacccaggcccagaccugggacagcagcagcuacagcgugcccagcgagggcgacagcgacaacguguuccugagaccccagagaaaccuggagagcaucgacccccaguucaccaucagaagaaagauggagcagaugagagaggagaaggagcugguggagcagcugagagagagcaucgagaugagacugaaggugagccugcacgaggaccugggcgccgcccugauggacggcguggugcugugccaccuggugaaccacaucagacccagaagcguggccagcauccacgugcccagccccgccgugcccaagcugagcauggccaagugcagaagaaacguggagaacuuccuggaggccugcagaaagcugggcgugcccgaggccgaccugugcagccccugcgacauccugcagcuggacuucagacacaucagaaagaccguggacacccugcuggcccugggcgagaaggcccccccccccaccagcgcccugagaagcagagaccugaucggcuucugccuggugcacauccuguucaucgugcugguguacaucaccuaccacuggaacgcccugagcgccuaa

SEQ ID NO: 19373 - RNA, 2052 nt, Artificial Sequence
  LRCH4__Homo_sapiens__NP_002310
auggccgccgccguggccgccccccuggccgccggcggcgaggaggccgccgccaccaccagcgugcccggcagccccggccugcccggcagaagaagcgccgagagagcccuggaggaggccguggccaccggcacccugaaccugagcaacagaagacugaagcacuuccccagaggcgccgccagaagcuacgaccugagcgacaucacccaggccgaccugagcagaaacagauuccccgaggugcccgaggccgccugccagcuggugagccuggagggccugagccuguaccacaacugccugagaugccugaaccccgcccugggcaaccugaccgcccugaccuaccugaaccugagcagaaaccagcugagccugcugccccccuacaucugccagcugccccugagagugcugaucgugagcaacaacaagcugggcgcccugccccccgacaucggcacccugggcagccugagacagcuggacgugagcagcaacgagcugcagagccugcccagcgagcugugcggccugagcagccugagagaccugaacgugagaagaaaccagcugagcacccugcccgaggagcugggcgaccugccccuggugagacuggacuucagcugcaacagagugagcagaauccccgugagcuucugcagacugagacaccugcaggugauccugcuggacagcaacccccugcagagcccccccgcccaggugugccugaagggcaagcugcacaucuucaaguaccugagcaccgaggccggccagagaggcagcgcccugggcgaccuggcccccagcagaccccccagcuucagccccugccccgccgaggaccuguuccccggccacagauacgacggcggccuggacagcggcuuccacagcguggacagcggcagcaagagauggagcggcaacgagagcaccgacgaguucagcgagcugagcuucagaaucagcgagcuggccagagagcccagaggccccagagagagaaaggaggacggcagcgccgacggcgaccccgugcagaucgacuucaucgacagccacgugcccggcgaggacgaggagagaggcaccguggaggagcagagaccccccgagcugagccccggcgccggcgacagagagagagcccccagcagcagaagagaggagcccgccggcgaggagagaagaagacccgacacccugcagcuguggcaggagagagagagaagacagcagcagcagagcggcgccuggggcgcccccagaaaggacagccugcugaagcccggccugagagccguggugggcggcgccgccgccgugagcacccaggccaugcacaacggcagccccaagagcagcgccagccaggccggcgccgccgccggccagggcgcccccgcccccgcccccgccagccaggagccccugcccaucgccggccccgccaccgcccccgcccccagaccccugggcagcauccagagacccaacagcuuccuguucagaagcagcagccagagcggcagcggccccagcagccccgacagcgugcugagacccagaagauacccccaggugcccgacgagaaggaccugaugacccagcugagacaggugcuggagagcagacugcagagaccccugcccgaggaccuggccgaggcccuggccagcggcgugauccugugccagcuggccaaccagcugagacccagaagcgugcccuucauccacgugcccagccccgccgugcccaagcugagcgcccugaaggccagaaagaacguggagagcuuccuggaggccugcagaaagaugggcgugcccgaggccgaccugugcagccccagcgaccugcugcagggcaccgccagaggccugagaaccgcccuggaggccgugaagagagugggcggcaaggcccugcccccccuguggccccccagcggccugggcggcuucgugguguucuacguggugcugaugcugcugcuguacgugaccuacaccagacugcugggcagcuaa

SEQ ID NO: 19374 - RNA, 2370 nt, Artificial Sequence
  LRFN2__Homo_sapiens__NP_065788
auggagacccugcugggcggccugcuggccuucggcauggccuucgccgugguggacgccugccccaaguacugcgugugccagaaccugagcgagagccugggcacccugugccccagcaagggccugcuguucgugccccccgacaucgacagaagaaccguggagcugagacugggcggcaacuucaucauccacaucagcagacaggacuucgccaacaugaccggccugguggaccugacccugagcagaaacaccaucagccacauccagcccuucagcuuccuggaccuggagagccugagaagccugcaccuggacagcaacagacugcccagccugggcgaggacacccugagaggccuggugaaccugcagcaccugaucgugaacaacaaccagcugggcggcaucgccgacgaggccuucgaggacuuccugcugacccuggaggaccuggaccugagcuacaacaaccugcacggccugcccugggacagcgugagaagaauggugaaccugcaccagcugagccuggaccacaaccugcuggaccacaucgccgagggcaccuucgccgaccugcagaagcuggccagacuggaccugaccagcaacagacugcagaagcugccccccgaccccaucuucgccagaagccaggccagcgcccugaccgccacccccuucgcccccccccugagcuucagcuucggcggcaacccccugcacugcaacugcgagcugcuguggcugagaagacuggagagagacgacgaccuggagaccugcggcagccccggcggccugaagggcagauacuucuggcacgugagagaggaggaguucgugugcgagcccccccugaucacccagcacacccacaagcugcuggugcuggagggccaggccgccacccugaagugcaaggccaucggcgaccccagcccccugauccacuggguggcccccgacgacagacuggugggcaacagcagcagaaccgccguguacgacaacggcacccuggacaucuucaucaccaccagccaggacagcggcgccuucaccugcaucgccgccaacgccgccggcgaggccaccgccaugguggaggugagcaucgugcagcugccccaccugagcaacagcaccagcagaaccgccccccccaagagcagacugagcgacaucaccggcagcagcaagaccagcagaggcggcggcggcagcggcggcggcgagccccccaagagcccccccgagagagccgugcuggugagcgaggugaccaccaccagcgcccuggugaaguggagcgugagcaagagcgcccccagagugaagauguaccagcugcaguacaacugcagcgacgacgaggugcugaucuacagaaugauccccgccagcaacaaggccuucguggugaacaaccuggugagcggcaccggcuacgaccugugcgugcuggccaugugggacgacaccgccaccacccugaccgccaccaacaucgugggcugcgcccaguucuucaccaaggccgacuacccccagugccagagcaugcacagccagauccugggcggcaccaugauccuggugaucggcggcaucaucguggccacccugcugguguucaucgugauccugauggugagauacaaggugugcaaccacgaggcccccagcaagauggccgccgccgugagcaacguguacagccagaccaacggcgcccagccccccccccccagcagcgcccccgccggcgcccccccccagggcccccccaaggugguggugagaaacgagcugcuggacuucaccgccagccuggccagagccagcgacagcagcagcagcagcagccugggcagcggcgaggccgccggccugggcagagcccccuggagaaucccccccagcgcccccagacccaagcccagccuggacagacugaugggcgccuucgccagccuggaccugaagagccagagaaaggaggagcugcuggacagcagaacccccgccggcagaggcgccggcaccagcgccagaggccaccacagcgacagagagccccugcugggcccccccgccgccagagccagaagccugcugccccugccccuggagggcaaggccaagagaagccacagcuucgacaugggcgacuucgccgccgccgccgccggcggcguggugcccggcggcuacagcccccccagaaaggugagcaacaucuggaccaagagaagccugagcgugaacggcaugcugcugcccuucgaggagagcgaccuggugggcgccagaggcaccuucggcagcagcgagugggugauggagagcaccguguaa

SEQ ID NO: 19375 - RNA, 2160 nt, Artificial Sequence
  LRFN5__Homo_sapiens__NP_689660
auggagaagauccuguucuaccuguuccugaucggcaucgccgugaaggcccagaucugccccaagagaugcgugugccagauccugagccccaaccuggccacccugugcgccaagaagggccugcuguucgugccccccaacaucgacagaagaaccguggagcugagacuggccgacaacuucgugaccaacaucaagagaaaggacuucgccaacaugaccagccugguggaccugacccugagcagaaacaccaucagcuucaucaccccccacgccuucgccgaccugagaaaccugagagcccugcaccugaacagcaacagacugaccaagaucaccaacgacauguucagcggccugagcaaccugcaccaccugauccugaacaacaaccagcugacccugaucagcagcaccgccuucgacgacguguucgcccuggaggagcuggaccugagcuacaacaaccuggagaccauccccugggacgccguggagaagauggugagccugcacacccugagccuggaccacaacaugaucgacaacauccccaagggcaccuucagccaccugcacaagaugaccagacuggacgugaccagcaacaagcugcagaagcugccccccgacccccuguuccagagagcccaggugcuggccaccagcggcaucaucagccccagcaccuucgcccugagcuucggcggcaacccccugcacugcaacugcgagcugcuguggcugagaagacugagcagagaggacgaccuggagaccugcgccagccccccccugcugaccggcagauacuucuggagcauccccgaggaggaguuccugugcgagcccccccugaucaccagacacacccacgagaugagagugcuggagggccagagagccacccugagaugcaaggccagaggcgaccccgagcccgccauccacuggaucagccccgagggcaagcugaucagcaacgccaccagaagccugguguacgacaacggcacccuggacauccugaucaccaccgugaaggacaccggcgccuucaccugcaucgccagcaaccccgccggcgaggccacccagaucguggaccugcacaucaucaagcugccccaccugcugaacagcaccaaccacauccacgagcccgaccccggcagcagcgacaucagcaccagcaccaagagcggcagcaacaccagcagcagcaacggcgacaccaagcugagccaggacaagaucgugguggccgaggccaccagcagcaccgcccugcugaaguucaacuuccagagaaacauccccggcaucagaauguuccagauccaguacaacggcaccuacgacgacacccugguguacagaaugaucccccccaccagcaagaccuuccuggugaacaaccuggccgccggcaccauguacgaccugugcgugcuggccaucuacgacgacggcaucaccagccugaccgccaccagaguggugggcugcauccaguucaccaccgagcaggacuacgugagaugccacuucaugcagagccaguuccugggcggcaccaugaucaucaucaucggcggcaucaucguggccagcgugcugguguucaucaucauccugaugaucagauacaaggugugcaacaacaacggccagcacaaggugaccaaggugagcaacguguacagccagaccaacggcgcccagauccagggcugcagcgugacccugccccagagcgugagcaagcaggccgugggccacgaggagaacgcccagugcugcaaggccaccagcgacaacgugauccagagcagcgagaccugcagcagccaggacagcagcaccaccaccagcgcccugccccccagcuggaccagcagcaccagcgugagccagaagcagaagagaaagaccggcaccaagcccagcaccgagccccagaacgaggccgugaccaacguggagagccagaacaccaacagaaacaacagcaccgcccugcagcuggccagcagaccccccgacagcgugaccgagggccccaccagcaagagagcccacaucaagcccaacgcccugcugaccaacguggaccagaucgugcaggagacccagagacuggagcugaucuaa

SEQ ID NO: 19376 - RNA, 1044 nt, Artificial Sequence
  LRG1__Homo_sapiens__NP_443204
augagcagcuggagcagacagagacccaagagccccggcggcauccagccccacgugagcagaacccuguuccugcugcugcugcuggccgccagcgccuggggcgugacccugagccccaaggacugccagguguucagaagcgaccacggcagcagcaucagcugccagccccccgccgagauccccggcuaccugcccgccgacaccgugcaccuggccguggaguucuucaaccugacccaccugcccgccaaccugcugcagggcgccagcaagcugcaggagcugcaccugagcagcaacggccuggagagccugagccccgaguuccugagacccgugccccagcugagagugcuggaccugaccagaaacgcccugaccggccugccccccggccuguuccaggccagcgccacccuggacacccuggugcugaaggagaaccagcuggaggugcuggaggugagcuggcugcacggccugaaggcccugggccaccuggaccugagcggcaacagacugagaaagcugccccccggccugcuggccaacuucacccugcugagaacccuggaccugggcgagaaccagcuggagacccugccccccgaccugcugagaggcccccugcagcuggagagacugcaccuggagggcaacaagcugcaggugcugggcaaggaccugcugcugccccagcccgaccugagauaccuguuccugaacggcaacaagcuggccagaguggccgccggcgccuuccagggccugagacagcuggacaugcuggaccugagcaacaacagccuggccagcgugcccgagggccugugggccagccugggccagcccaacugggacaugagagacggcuucgacaucagcggcaaccccuggaucugcgaccagaaccugagcgaccuguacagauggcugcaggcccagaaggacaagauguucagccagaacgacaccagaugcgccggccccgaggccgugaagggccagacccugcuggccguggccaagagccaguaa

SEQ ID NO: 19377 - RNA, 2478 nt, Artificial Sequence
  LRGUK__Homo_sapiens__NP_653249
auggccaccagcgagagagcccugcugagaaccagagccgccagccugcugagaggccugggcagaagcagaaccggcgccagaagccugcaguucagagccgagaaggagagacagcccugcuggagcuuccccaugggccagaagaccaagggcagcagcaacaucgccagcagcuaccugcugcagcagcugaugcacagauaccaggagcuggacagcgacggcgacgaggaccagggcgagggcgaggccggcagcgaggagagcagcgagagcgagaugcugaaccuggaggaggaguucgacggcgugcugagagaggaggccguggccaaggcccugcaccaccugggcagaagcggcagcggcaccgagcagguguaccugaaccugacccugagcggcugcaaccugaucgacgugagcauccugugcggcuacgugcaccugcagaagcuggaccugagcgccaacaagaucgaggaccugagcugcgugagcugcaugcccuaccugcuggagcugaacgccagccagaacaaccugaccaccuucuucaacuucaagccccccaagaaccugaagaaggccgacuucagccacaaccagaucagcgagaucugcgaccugagcgccuaccacgcccugaccaagcugauccuggacggcaacgagaucgaggagaucagcggccuggagaugugcaacaaccugauccaccugagccuggccaacaacaagaucaccaccaucaacggccugaacaagcugcccaucaagauccugugccugagcaacaaccagaucgagaugaucaccggccuggaggaccugaaggcccugcagaaccuggaccugagccacaaccagaucagcagccugcagggccuggagaaccacgaccugcuggaggugaucaaccuggaggacaacaagaucgccgagcugagagagaucgaguacaucaagaaccugcccauccugagagugcugaaccugcuggagaaccccauccaggagaagagcgaguacugguucuucgugaucuucaugcugcugagacugaccgagcuggaccagaagaagaucaagguggaggagaaggugagcgccgugaacaaguacgaccccccccccgaggugguggccgcccaggaccaccugacccacguggugaacagcgugaugcagccccagagaaucuucgacagcacccugcccagccuggacgcccccuaccccaugcugauccuggccggccccgaggccugcggcaagagagagcuggcccacagacugugcagacaguucagcaccuacuucagauacggcgccugccacaccaccagaccccccuacuucggcgagggcgacagaguggacuaccacuucaucagccaggacguguucgacgagauggugaacaugggcaaguucauccugaccuucagcuacggcaaccacaaguacggccugaacagagacaccguggagggcaucgccagagacggccuggccagcugcauccacauggagaucgagggcgugagaagccugaaguacagcuacuucgagcccagauacauccugguggugcccaugaacaaggagaaguacgagggcuaccugagaagaaagggccuguucagcagagccgagaucgaguucgccgugagcagaguggaccuguacaucaagaucaaccagaacuuccccggcuacuucgacgaggugaucaacgccgacgaccuggacguggccuaccagaagcugagccagcugaucagagaguaccugggccugaccgaggagcccgccaagagccuggccaccaccgccgacgugaagaccagccaccugaagcccgaggcccaccccaccaaguacaucagcagcaacaugggcgacuuccugcacagcaccgacagaaacuaccugaucaaguucugggccaagcugagcgccaagaagacccccgccgagagagacagcauccacagacagcacgaggccgccagacaggcccugaugggcagaaucagacccgaccacacccugcuguuccagagaggccccgugcccgccccccugaccagcggccugcacuacuacaccacccuggaggagcuguggaagagcuucgaccugugcgaggacuacuucaagccccccuucggccccuaccccgagaagagcggcaaggacagccuggugagcaugaagugcagccuguucagauucugccccuggagcaaggagcugcccuuccagccccccgagggcagcaucagcagccaccugggcagcggcgccagcgacagcgagaccgaggagaccagaaaggcccugcccauccagagcuucagccacgagaaggagagccaccagcacagacagcacagcgugcccgugaucagcagacccggcagcaacgugaagcccacccugccccccaucccccagggcagaagauaa

SEQ ID NO: 19378 - RNA, 2229 nt, Artificial Sequence
  LRIF1__Homo_sapiens__XP_011540070
auguaccagguggugcagaccaucggcagcgacggcaagaaccugcugcagcugcugcccauccccaagagcagcggcaaccugaucccccuggugcagagcagcgugaugagcgacgcccugaagggcaacaccggcaagcccgugcaggugaccuuccagacccagaucagcagcagcagcaccagcgccagcgugcagcugcccaucuuccagcccgccagcagcagcaacuacuuccugaccagaaccguggacaccagcgagaagggcagagugaccagcgugggcaccggcaacuucagcagcagcgugagcaaggugcagagccacggcgugaagaucgacggccugaccaugcagaccuucgccgugccccccagcacccagaaggacagcagcuucaucguggugaacacccagagccugcccgugaccgugaagagccccgugcugcccagcggccaccaccugcagauccccgcccacgccgaggugaagagcgugcccgccagcagccugccccccagcgugcagcagaagauccuggccaccgccaccaccagcaccagcggcaugguggaggccagccagaugcccaccgugaucuacgugagccccgugaacaccgugaagaacguggugaccaagaacuuccagaacaucuaccccaagcccgugaccgagaucgccaagcccgugauccugaacaccacccagauccccaagaacguggccaccgagacccagcugaagggcggccagcacagccaggccgcccccgugaaguggaucuuccaggacaaccugcagcccuucacccccagccuggugcccgugaagagcagcaacaacguggccagcaagauccugaagaccuucguggacagaaagaaccugggcgacaacaccaucaacaugcccccccugagcaccaucgaccccagcggcaccagaagcaagaacaugcccaucaaggacaacgcccuggugauguucaacggcaagguguaccugcuggccaagaagggcaccgacgugcugcccagccagaucgaccagcagaacagcgugagccccgacacccccgugagaaaggacacccugcagaccgugagcagcagccccgugaccgagaucagcagagagguggugaacaucgugcuggccaagagcaagagcagccagauggagaccaagagccugagcaacacccagcuggccagcauggccaaccugagagccgagaagaacaagguggagaagcccagccccagcaccaccaacccccacaugaaccagagcagcaacuaccugaagcagagcaagacccuguucaccaaccccaucuuccccgugggcuucagcaccggccacaacgcccccagaaaggugaccgccgugaucuacgccagaaagggcagcgugcugcagagcaucgagaagaucagcagcagcguggacgccaccaccgugaccagccagcagugcguguucagagaccaggagcccaagauccacaacgagauggccagcaccagcgacaagggcgcccagggcagaaacgacaagaaggacagccagggcagaagcaacaaggcccugcaccugaagagcgacgccgaguucaagaagaucuucggccugaccaaggaccugagagugugccugaccagaauccccgaccaccugaccagcggcgagggcuucgacagcuucagcagccuggugaagagcggcaccuacaaggagaccgaguucauggugaaggagggcgagagaaagcagcagaacuucgacaagaagagaaaggccaagaccaacaagaagauggaccacaucaagaagagaaagaccgagaacgccuacaacgccaucaucaacggcgaggccaacgugaccggcagccagcugcugagcagcauccugcccaccagcgacgugagccagcacaacauccugaccagccacagcaagaccagacaggagaagagaaccgagauggaguacuacacccacgagaagcaggagaagggcacccugaacagcaacgccgccuacgagcagagccacuucuucaacaagaacuacaccgaggacaucuuccccgugaccccccccgagcuggaggagaccaucagagacgagaagaucagaagacugaagcaggugcugagagagaaggaggccgcccuggaggagaugagaaagaagaugcaccagaaguaa

SEQ ID NO: 19379 - RNA, 3282 nt, Artificial Sequence
  LRIG1__Homo_sapiens__NP_056356
auggccagacccgugagaggcggccugggcgcccccagaagaagccccugccugcugcugcuguggcugcugcugcugagacuggagcccgugaccgccgccgccggccccagagcccccugcgccgccgccugcaccugcgccggcgacagccuggacugcggcggcagaggccuggccgcccugcccggcgaccugcccagcuggaccagaagccugaaccugagcuacaacaagcugagcgagaucgaccccgccggcuucgaggaccugcccaaccugcaggagguguaccugaacaacaacgagcugaccgccgugcccagccugggcgccgccagcagccacguggugagccuguuccugcagcacaacaagaucagaagcguggagggcagccagcugaaggccuaccugagccuggaggugcuggaccugagccugaacaacaucaccgaggugagaaacaccugcuucccccacggcccccccaucaaggagcugaaccuggccggcaacagaaucggcacccuggagcugggcgccuucgacggccugagcagaagccugcugacccugagacugagcaagaacagaaucacccagcugcccgugagagccuucaagcugcccagacugacccagcuggaccugaacagaaacagaaucagacugaucgagggccugaccuuccagggccugaacagccuggaggugcugaagcugcagagaaacaacaucagcaagcugaccgacggcgccuucuggggccugagcaagaugcacgugcugcaccuggaguacaacagccugguggaggugaacagcggcagccuguacggccugaccgcccugcaccagcugcaccugagcaacaacagcaucgccagaauccacagaaagggcuggagcuucugccagaagcugcacgagcuggugcugagcuucaacaaccugaccagacuggacgaggagagccuggccgagcugagcagccugagcgugcugagacugagccacaacagcaucagccacaucgccgagggcgccuucaagggccugagaagccugagagugcuggaccuggaccacaacgagaucagcggcaccaucgaggacaccagcggcgccuucagcggccuggacagccugagcaagcugacccuguucggcaacaagaucaagagcguggccaagagagccuucagcggccuggagggccuggagcaccugaaccugggcggcaacgccaucagaagcgugcaguucgacgccuucgugaagaugaagaaccugaaggagcugcacaucagcagcgacagcuuccugugcgacugccagcugaaguggcugccccccuggcugaucggcagaaugcugcaggccuucgugaccgccaccugcgcccaccccgagagccugaagggccagagcaucuucagcgugccccccgagagcuucgugugcgacgacuuccugaagccccagaucaucacccagcccgagaccaccauggccauggugggcaaggacaucagauucaccugcagcgccgccagcagcagcagcagccccaugaccuucgccuggaagaaggacaacgaggugcugaccaacgccgacauggagaacuucgugcacgugcacgcccaggacggcgaggugauggaguacaccaccauccugcaccugagacaggugaccuucggccacgagggcagauaccagugcgugaucaccaaccacuucggcagcaccuacagccacaaggccagacugaccgugaacgugcugcccagcuucaccaagaccccccacgacaucaccaucagaaccaccaccauggccagacuggagugcgccgccaccggccaccccaacccccagaucgccuggcagaaggacggcggcaccgacuuccccgccgccagagagagaagaaugcacgugaugcccgacgacgacguguucuucaucaccgacgugaagaucgacgacgccggcguguacagcugcaccgcccagaacagcgccggcagcaucagcgccaacgccacccugaccgugcuggagacccccagccugguggugccccuggaggacagaguggugagcgugggcgagaccguggcccugcagugcaaggccaccggcaaccccccccccagaaucaccugguucaagggcgacagaccccugagccugaccgagagacaccaccugacccccgacaaccagcugcugguggugcagaacgugguggccgaggacgccggcagauacaccugcgagaugagcaacacccugggcaccgagagagcccacagccagcugagcgugcugcccgccgccggcugcagaaaggacggcaccaccgugggcaucuucaccaucgccguggugagcagcaucgugcugaccagccuggugugggugugcaucaucuaccagaccagaaagaagagcgaggaguacagcgugaccaacaccgacgagaccguggugccccccgacgugcccagcuaccugagcagccagggcacccugagcgacagacaggagaccguggugagaaccgagggcggcccccaggccaacggccacaucgagagcaacggcgugugccccagagacgccagccacuuccccgagcccgacacccacagcguggccugcagacagcccaagcugugcgccggcagcgccuaccacaaggagcccuggaaggccauggagaaggccgagggcacccccggcccccacaagauggagcacggcggcagaguggugugcagcgacugcaacaccgagguggacugcuacagcagaggccaggccuuccacccccagcccgugagcagagacagcgcccagcccagcgcccccaacggccccgagcccggcggcagcgaccaggagcacagcccccaccaccagugcagcagaaccgccgccggcagcugccccgagugccagggcagccuguaccccagcaaccacgacagaaugcugaccgccgugaagaagaagcccauggccagccuggacggcaagggcgacagcagcuggacccuggccagacuguaccaccccgacagcaccgagcugcagcccgccagcagccugaccagcggcagccccgagagagccgaggcccaguaccugcuggugagcaacggccaccugcccaaggccugcgacgccagccccgagagcaccccccugaccggccagcugcccggcaagcagagagugccccugcugcuggcccccaagagcuaa

SEQ ID NO: 19380 - RNA, 3180 nt, Artificial Sequence
  LRIG3__Homo_sapiens__NP_001129523
augguggacgugcugcugcuguucagccugugccugcuguuccacaucagcagacccgaccugagccacaacagacugagcuucaucaaggccagcagcaugagccaccugcagagccugagagaggugaagcugaacaacaacgagcuggagaccauccccaaccugggccccgugagcgccaacaucacccugcugagccuggccggcaacagaaucguggagauccugcccgagcaccugaaggaguuccagagccuggagacccuggaccugagcagcaacaacaucagcgagcugcagaccgccuuccccgcccugcagcugaaguaccuguaccugaacagcaacagagugaccagcauggagcccggcuacuucgacaaccuggccaacacccugcuggugcugaagcugaacagaaacagaaucagcgccaucccccccaagauguucaagcugccccagcugcagcaccuggagcugaacagaaacaagaucaagaacguggacggccugaccuuccagggccugggcgcccugaagagccugaagaugcagagaaacggcgugaccaagcugauggacggcgccuucuggggccugagcaacauggagauccugcagcuggaccacaacaaccugaccgagaucaccaagggcuggcuguacggccugcugaugcugcaggagcugcaccugagccagaacgccaucaacagaaucagccccgacgccugggaguucugccagaagcugagcgagcuggaccugaccuucaaccaccugagcagacuggacgacagcagcuuccugggccugagccugcugaacacccugcacaucggcaacaacagagugagcuacaucgccgacugcgccuucagaggccugagcagccugaagacccuggaccugaagaacaacgagaucagcuggaccaucgaggacaugaacggcgccuucagcggccuggacaagcugagaagacugauccugcagggcaacagaaucagaagcaucaccaagaaggccuucaccggccuggacgcccuggagcaccuggaccugagcgacaacgccaucaugagccugcagggcaacgccuucagccagaugaagaagcugcagcagcugcaccugaacaccagcagccugcugugcgacugccagcugaaguggcugccccaguggguggccgagaacaacuuccagagcuucgugaacgccagcugcgcccacccccagcugcugaagggcagaagcaucuucgccgugagccccgacggcuucgugugcgacgacuuccccaagccccagaucaccgugcagcccgagacccagagcgccaucaagggcagcaaccugagcuucaucugcagcgccgccagcagcagcgacagccccaugaccuucgccuggaagaaggacaacgagcugcugcacgacgccgagauggagaacuacgcccaccugagagcccagggcggcgaggugauggaguacaccaccauccugagacugagagagguggaguucgccagcgagggcaaguaccagugcgugaucagcaaccacuucggcagcagcuacagcgugaaggccaagcugaccgugaacaugcugcccagcuucaccaagacccccauggaccugaccaucagagccggcgccauggccagacuggagugcgccgccgugggccaccccgccccccagaucgccuggcagaaggacggcggcaccgacuuccccgccgccagagagagaagaaugcacgugaugcccgaggacgacguguucuucaucguggacgugaagaucgaggacaucggcguguacagcugcaccgcccagaacagcgccggcagcaucagcgccaacgccacccugaccgugcuggagacccccagcuuccugagaccccugcuggacagaaccgugaccaagggcgagaccgccgugcugcagugcaucgccggcggcagccccccccccaagcugaacuggaccaaggacgacagcccccugguggugaccgagagacacuucuucgccgccggcaaccagcugcugaucaucguggacagcgacgugagcgacgccggcaaguacaccugcgagaugagcaacacccugggcaccgagagaggcaacgugagacugagcgugauccccacccccaccugcgacagcccccagaugaccgcccccagccuggacgacgacggcugggccaccgugggcguggugaucaucgccguggugugcugcguggugggcaccagccugguguggguggugaucaucuaccacaccagaagaagaaacgaggacugcagcaucaccaacaccgacgagaccaaccugcccgccgacauccccagcuaccugagcagccagggcacccuggccgacagacaggacggcuacgugagcagcgagagcggcagccaccaccaguucgugaccagcagcggcgccggcuucuuccugccccagcacgacagcagcggcaccugccacaucgacaacagcagcgaggccgacguggaggccgccaccgaccuguuccugugccccuuccugggcagcaccggccccauguaccugaagggcaacguguacggcagcgaccccuucgagaccuaccacaccggcugcagccccgaccccagaaccgugcugauggaccacuacgagcccagcuacaucaagaagaaggagugcuaccccugcagccaccccagcgaggagagcugcgagagaagcuucagcaacaucagcuggcccagccacgugagaaagcugcugaacaccagcuacagccacaacgagggccccggcaugaagaaccugugccugaacaagagcagccuggacuucagcgccaaccccgagcccgccagcguggccagcagcaacagcuucaugggcaccuucggcaaggcccugagaagaccccaccuggacgccuacagcagcuucggccagcccagcgacugccagcccagagccuucuaccugaaggcccacagcagccccgaccuggacagcggcagcgaggaggacggcaaggagagaaccgacuuccaggaggagaaccacaucugcaccuucaagcagacccuggagaacuacagaacccccaacuuccagagcuacgaccuggacaccuaa

SEQ ID NO: 19381 - RNA, 1872 nt, Artificial Sequence
  LRIT1__Homo_sapiens__NP_056428
augagaguggcccugggcaugcuguggcugcuggcccuggccuggcccccccaggccagaggcuucugccccagccagugcagcugcagccugcacaucaugggcgacggcagcaaggccagaaccguggugugcaacgaccccgacaugacccugccccccgccagcaucccccccgacaccagcagacugagacuggagagaaccgccaucagaagagugcccggcgaggccuucagaccccugggcagacuggagcagcuguggcugcccuacaacgcccugagcgagcugaacgcccugaugcugagaggccugagaagacugagagagcugagacugcccggcaacagacuggccgccuuccccugggccgcccugagagacgcccccaagcugagacugcuggaccugcaggccaacagacugagcgccgugcccgccgaggccgccagauuccuggagaaccugaccuuccuggaccugagcagcaaccagcugaugagacugccccaggagcugaucgugagcugggcccaccuggagaccggcaucuucccccccggccaccaccccagaagagugcugggccugcaggacaaccccugggccugcgacugcagacuguacgaccuggugcaccugcuggacggcugggcccccaaccuggccuucaucgagaccgagcugagaugcgccagccccagaagccuggccggcguggccuucagccagcuggagcugagaaagugccagggccccgagcugcaccccggcguggccagcaucagaagccugcugggcggcaccgcccugcugagaugcggcgccaccggcgugcccggccccgagaugagcuggagaagagccaacggcagaccccugaacggcaccgugcaccaggaggugagcagcgacggcaccagcuggacccugcugggccugcccgccgugagccaccuggacagcggcgacuacaucugccaggccaagaacuuccugggcgccagcgagaccgugaucagccugaucgugaccgagccccccaccagcaccgagcacagcggcagccccggcgcccugugggccagaaccggcggcggcggcgaggccgccgccuacaacaacaagcugguggccagacacgugccccagauccccaagcccgccgugcuggccaccggccccagcgugcccagcaccaaggaggagcugacccuggagcacuuccagauggacgcccugggcgagcugagcgacggcagagccggccccagcgaggccagaauggugagaagcgugaagguggugggcgacaccuaccacagcgugagccugguguggaaggccccccaggccaagaacaccaccgccuucagcgugcuguacgccguguucggccagcacagcaugagaagagugaucgugcagcccggcaagaccagagugaccaucaccggccugcugcccaagaccaaguacguggccugcgugugcgugcagggccuggugcccagaaaggagcagugcgugaucuucagcaccaacgaggugguggacgccgagaacacccagcagcugaucaacgugguggugaucagcguggccaucgugaucgcccugccccugacccugcuggugugcugcagcgcccugcagaagagaugcagaaagugcuucaacaaggacagcaccgaggccaccgugaccuacgugaaccuggagagacugggcuacagcgaggacggccuggaggagcugagcagacacagcgugagcgaggccgacagacugcugagcgccagaagcagcguggacuuccaggccuucggcgugaagggcggcagaagaaucaacgaguacuucugcuaa

SEQ ID NO: 19382 - RNA, 2040 nt, Artificial Sequence
  LRIT3__Homo_sapiens__NP_940908
augcaccuguucgccugccugugcaucgugcugagcuuccuggagggcgugggcugccugugccccagccagugcaccugcgacuaccacggcagaaacgacggcagcggcagcagacuggugcugugcaacgacauggacaugaacgagcugcccaccaaccugcccguggacaccgugaagcugagaaucgagaagaccgugaucagaagaaucagcgccgaggccuucuacuaccugguggagcugcaguaccugugggugaccuacaacagcguggccagcaucgaccccagcagcuucuacaaccugaagcagcugcacgagcugagacuggacggcaacagccuggccgccuuccccugggccagccugcuggacaugccccugcugagaacccuggaccugcacaacaacaagaucaccagcgugcccaacgaggcccugagauaccugaagaaccuggccuaccuggaccugagcagcaacagacugaccacccugccccccgacuuccuggagagcuggacccaccuggugagcacccccagcggcgugcuggaccugagccccagcagaaucauccugggccugcaggacaaccccugguucugcgacugccacaucagcaagaugaucgagcugagcaaggugguggaccccgccaucgugcugcuggacccccugaugaccugcagcgagcccgagagacugaccggcauccuguuccagagagccgagcuggagcacugccugaagcccagcgugaugaccagcgccaccaagaucaugagcgcccugggcagcaacgugcugcugagaugcgacgccaccggcuuccccaccccccagaucaccuggaccagaagcgacagcagccccgugaacuacaccgugauccaggagagccccgaggagggcgugagauggagcaucaugagccugaccggcaucagcagcaaggacgccggcgacuacaagugcaaggccaagaaccuggccggcaugagcgaggccguggugaccgugaccgugcugggcaucaccaccacccccaucccccccgacaccagcgagagaaccggcgaccaccccgagugggacgugcagcccggcagcggcagaagcaccagcgugagcagcgccagcagcuaccuguggagcagcagcuucagccccaccagcagcuucagcgccagcacccugagcccccccagcaccgccagcuucagccugagccccuucagcagcagcaccgugagcagcaccaccacccugagcaccagcaucagcgccagcaccaccauggccaacaagagaagcuuccagcugcaccagggcggcaagagaaaccugaagguggccaagaacggcagcaagcugccccccgccagcaccagcaagaaggaggagcuggcccugcuggaccagaccaugcugaccgagaccaacgccgccaucgagaaccugagaguggugagcgagaccaaggagagcgugacccugaccuggaacaugaucaacaccacccacaacagcgccgugaccgugcuguacagcaaguacggcggcaaggaccugcugcugcugaacgccgacagcagcaagaaccaggugaccaucgacggccuggagcccggcggccaguacauggccugcgugugccccaagggcgugcccccccagaaggaccagugcaucaccuucagcaccgagagaguggagggcgacgacagccaguggagccugcugcugguggugaccagcaccgccugcguggugauccugccccugaucugcuuccugcuguacaaggugugcaagcugcagugcaagagcgagcccuucugggaggacgaccuggccaaggagaccuacauccaguucgagacccuguuccccagaagccagagcgugggcgagcuguggaccagaagccacagagacgacagcgagaagcugcugcugugcagcagaagcagcguggagagccaggugaccuucaagagcgagggcagcagacccgaguacuacugcuaa

SEQ ID NO: 19383 - RNA, 1500 nt, Artificial Sequence
  LRMP__Homo_sapiens__NP_006143
augaacgacgaccccagcauggaggagaacggcguggagagagugugccccgagagccugcugcagagcagagaguacagcagccugccccugcccagacacaccagcagcaccgacggcaccaucaccagcagcgaccccggccuggagauccugaacauggccagcugcgaccuggacagaaacagccugugcaagaaggaggaggacaccagaagcgccagccccaccaucgaggcccagggcaccagccccgcccacgacaacaucgccuuccaggacagcaccagcaaggacaagaccauccugaaccuggaggccaaggaggagcccgagaccaucgaggagcacaagaaggagcacgccagcggcgacagcguggugagcccccugcccgugaccaccgugaagagcgugaaccugagacagagcgagaacaccagcgccaacgagaaggagguggaggccgaguuccugagacugagccugggcuucaagugcgacugguucacccuggagaagagagugaagcuggaggagagaagcagagaccuggccgaggagaaccugaagaaggagaucaccaacugccugaagcugcuggagagccugaccccccugugcgaggacgacaaccaggcccaggagaucaucaagaagcuggagaagagcaucaaguuccugagccagugcgccgccagaguggccagcagagccgagaugcugggcgccaucaaccaggagagcagagugagcaaggccguggaggugaugauccagcacguggagaaccugaagagaauguacgccaaggagcacgccgagcuggaggagcugaagcaggugcugcugcagaacgagagaagcuucaacccccuggaggacgacgacgacugccagaucaagaagagaagcgccagccugaacagcaagcccagcagccugagaagagugaccaucgccagccugcccagaaacaucggcaacgccggcaugguggccggcauggagaacaacgacagauucagcagaagaagcagcagcuggagaauccugggcagcaagcagagcgagcacagacccagccugcccagauucaucagcaccuacagcugggccgacgccgaggaggagaagugcgagcugaagaccaaggacgacagcgagcccagcggcgaggagaccguggagagaaccagaaagcccagccugagcgagaagaagaacaaccccagcaagugggacgugagcagcguguacgacaccaucgccagcugggccaccaaccugaagagcagcaucagaaaggccaacaaggcccuguggcugagcaucgccuucaucgugcuguucgccgcccugaugagcuuccugaccggccagcuguuccagaagagcguggacgccgcccccacccagcaggaggacagcuggaccagccuggagcacauccuguggcccuucaccagacugagacacaacggccccccccccguguaa

SEQ ID NO: 19384 - RNA, 2142 nt, Artificial Sequence
  LRP10__Homo_sapiens__NP_054764
augcugcuggccacccugcugcugcugcugcugggcggcgcccuggcccaccccgacagaaucaucuuccccaaccacgccugcgaggacccccccgccgugcugcuggaggugcagggcacccugcagagaccccuggugagagacagcagaaccagccccgccaacugcaccuggcugauccugggcagcaaggagcagaccgugaccaucagauuccagaagcugcaccuggccugcggcagcgagagacugacccugagaagcccccugcagccccugaucagccugugcgaggccccccccagcccccugcagcugcccggcggcaacgugaccaucaccuacagcuacgccggcgccagagcccccaugggccagggcuuccugcugagcuacagccaggacuggcugaugugccugcaggaggaguuccagugccugaaccacagaugcgugagcgccgugcagagaugcgacggcguggacgccugcggcgacggcagcgacgaggccggcugcagcagcgaccccuuccccggccugacccccagacccgugcccagccugcccugcaacgugacccuggaggacuucuacggcguguucagcagccccggcuacacccaccuggccagcgugagccacccccagagcugccacuggcugcuggacccccacgacggcagaagacuggccgugagauucaccgcccuggaccugggcuucggcgacgccgugcacguguacgacggccccggcccccccgagagcagcagacugcugagaagccugacccacuucagcaacggcaaggccgugaccguggagacccugagcggccaggccguggugagcuaccacaccguggccuggagcaacggcagaggcuucaacgccaccuaccacgugagaggcuacugccugcccugggacagacccugcggccugggcagcggccugggcgccggcgagggccugggcgagagaugcuacagcgaggcccagagaugcgacggcagcugggacugcgccgacggcaccgacgaggaggacugccccggcugcccccccggccacuuccccugcggcgccgccggcaccagcggcgccaccgccugcuaccugcccgccgacagaugcaacuaccagaccuucugcgccgacggcgccgacgagagaagaugcagacacugccagcccggcaacuucagaugcagagacgagaagugcguguacgagaccugggugugcgacggccagcccgacugcgccgacggcagcgacgagugggacugcagcuacgugcugcccagaaaggugaucaccgccgccgugaucggcagccuggugugcggccugcugcuggugaucgcccugggcugcaccugcaagcuguacgccaucagaacccaggaguacagcaucuucgccccccugagcagaauggaggccgagaucgugcagcagcaggccccccccagcuacggccagcugaucgcccagggcgccaucccccccguggaggacuuccccaccgagaaccccaacgacaacagcgugcugggcaaccugagaagccugcugcagauccugagacaggacaugacccccggcggcggccccggcgccagaagaagacagagaggcagacugaugagaagacuggugagaagacugagaagauggggccugcugcccagaaccaacacccccgccagagccagcgaggccagaagccaggugacccccagcgccgccccccuggaggcccuggacggcggcaccggccccgccagagagggcggcgccgugggcggccaggacggcgagcaggcccccccccugcccaucaaggccccccugcccagcgccagcaccagccccgcccccaccaccgugcccgaggcccccggcccccugcccagccugccccuggagcccagccugcugagcggcguggugcaggcccugagaggcagacugcugcccagccugggcccccccggccccaccagaagcccccccggcccccacaccgccgugcuggcccuggaggacgaggacgacgugcugcuggugccccuggccgagcccggcguguggguggccgaggccgaggacgagccccugcugaccuaa

SEQ ID NO: 19385 - RNA, 2523 nt, Artificial Sequence
  LRP12__Homo_sapiens__NP_001129175
auggccugcagauggagcaccaaggagagccccagauggagaagcgcccugcugcugcuguuccuggccggcguguacgccugcggcgagacccccgagcagaucagagcccccagcggcaucaucaccagccccggcuggcccagcgaguaccccgccaagaucaacugcagcugguucaucagagccaaccccggcgagaucaucaccaucagcuuccaggacuucgacauccagggcagcagaagaugcaaccuggacuggcugaccaucgagaccuacaagaacaucgagagcuacagagccugcggcagcaccauccccccccccuacaucagcagccaggaccacaucuggaucagauuccacagcgacgacaacaucagcagaaagggcuucagacuggccuacuucagcggcaagagcgaggagcccaacugcgccugcgaccaguucagaugcggcaacggcaagugcauccccgaggccuggaagugcaacaacauggacgagugcggcgacagcagcgacgaggagaucugcgccaaggaggccaacccccccaccgccgccgccuuccagcccugcgccuacaaccaguuccagugccugagcagauucaccaagguguacaccugccugcccgagagccugaagugcgacggcaacaucgacugccuggaccugggcgacgagaucgacugcgacgugcccaccugcggccaguggcugaaguacuucuacggcaccuucaacagccccaacuaccccgacuucuacccccccggcagcaacugcaccuggcugaucgacaccggcgaccacagaaaggugauccugagauucaccgacuucaagcuggacggcaccggcuacggcgacuacgugaagaucuacgacggccuggaggagaacccccacaagcugcugagagugcugaccgccuucgacagccacgccccccugaccguggugagcagcagcggccagaucagagugcacuucugcgccgacaaggugaacgccgccagaggcuucaacgccaccuaccagguggacggcuucugccugcccugggagauccccugcggcggcaacuggggcugcuacaccgagcagcagagaugcgacggcuacuggcacugccccaacggcagagacgagaccaacugcaccaugugccagaaggaggaguuccccugcagcagaaacggcgugugcuaccccagaagcgacagaugcaacuaccagaaccacugccccaacggcagcgacgagaagaacugcuucuucugccagcccggcaacuuccacugcaagaacaacagaugcguguucgagagcugggugugcgacagccaggacgacugcggcgacggcagcgacgaggagaacugccccgugaucgugcccaccagagugaucaccgccgccgugaucggcagccugaucugcggccugcugcuggugaucgcccugggcugcaccugcaagcuguacagccugagaauguucgagagaagaagcuucgagacccagcugagcagaguggaggccgagcugcugagaagagaggccccccccagcuacggccagcugaucgcccagggccugaucccccccguggaggacuuccccgugugcagccccaaccaggccagcgugcuggagaaccugagacuggccgugagaagccagcugggcuucaccagcgugagacugcccauggccggcagaagcagcaacaucuggaacagaaucuucaacuucgccagaagcagacacagcggcagccuggcccuggugagcgccgacggcgacgagguggugcccagccagagcaccagcagagagcccgagagaaaccacacccacagaagccuguucagcguggagagcgacgacaccgacaccgagaacgagagaagagacauggccggcgccagcggcggcguggccgccccccugccccagaaggugccccccaccaccgccguggaggccaccgugggcgccugcgccagcagcagcacccagagcaccagaggcggccacgccgacaacggcagagacgugaccagcguggagccccccagcgugagccccgccagacaccagcugaccagcgcccugagcagaaugacccagggccugagaugggugagauucacccugggcagaagcagcagccugagccagaaccagagcccccugagacagcuggacaacggcgugagcggcagagaggacgacgacgacguggagaugcugauccccaucagcgacggcagcagcgacuucgacgugaacgacugcagcagaccccugcuggaccuggccagcgaccagggccagggccugagacagcccuacaacgccaccaaccccggcgugagacccagcaacagagacggccccugcgagagaugcggcaucgugcacaccgcccagauccccgacaccugccuggaggugacccugaagaacgagaccagcgacgacgaggcccugcugcugugcuaa

SEQ ID NO: 19386 - RNA, 13800 nt, Artificial Sequence
  LRP1B__Homo_sapiens__NP_061027
augagcgaguuccugcuggcccugcugacccugagcggccugcugcccaucgccagagugcugaccgugggcgccgacagagaccagcagcugugcgaccccggcgaguuccugugccacgaccacgugaccugcgugagccagagcuggcugugcgacggcgaccccgacugccccgacgacagcgacgagagccuggacaccugccccgaggagguggagaucaagugcccccugaaccacaucgccugccugggcaccaacaagugcgugcaccugagccagcugugcaacggcgugcuggacugccccgacggcuacgacgagggcgugcacugccaggagcugcugagcaacugccagcagcugaacugccaguacaagugcaccauggugagaaacagcaccagaugcuacugcgaggacggcuucgagaucaccgaggacggcagaagcugcaaggaccaggacgagugcgccguguacggcaccugcagccagaccugcagaaacacccacggcagcuacaccugcagcugcguggagggcuaccugaugcagcccgacaacagaagcugcaaggccaagaucgagcccaccgacagaccccccauccugcugaucgccaacuucgagaccaucgagguguucuaccugaacggcagcaagauggccacccugagcagcgugaacggcaacgagauccacacccuggacuucaucuacaacgaggacaugaucugcuggaucgagagcagagagagcagcaaccagcugaagugcauccagaucaccaaggccggcggccugaccgacgaguggaccaucaacauccugcagagcuuccacaacgugcagcagauggccaucgacuggcugaccagaaaccuguacuucguggaccacgugggcgacagaaucuucgugugcaacagcaacggcagcgugugcgugacccugaucgaccuggagcugcacaaccccaaggccaucgccguggaccccaucgccggcaagcuguucuucaccgacuacggcaacguggccaagguggagagaugcgacauggacggcaugaacagaaccagaaucaucgacagcaagaccgagcagcccgccgcccuggcccuggaccuggugaacaagcugguguacuggguggaccuguaccuggacuacgugggcgugguggacuaccagggcaagaacagacacaccgugauccagggcagacaggugagacaccuguacggcaucaccguguucgaggacuaccuguacgccaccaacagcgacaacuacaacaucgugagaaucaacagauucaacggcaccgacauccacagccugaucaagaucgagaacgccuggggcaucagaaucuaccagaagagaacccagcccaccgugagaagccacgccugcgagguggaccccuacggcaugcccggcggcugcagccacaucugccugcugagcagcagcuacaagaccagaaccugcagaugcagaaccggcuucaaccugggcagcgacggcagaagcugcaagagacccaagaacgagcuguuccuguucuacggcaagggcagacccggcaucgugagaggcauggaccugaacaccaagaucgccgacgaguacaugauccccaucgagaaccuggugaaccccagagcccuggacuuccacgccgagaccaacuacaucuacuucgccgacaccaccagcuuccugaucggcagacagaagaucgacggcaccgagagagagaccauccugaaggacgaccuggacaacguggagggcaucgccguggacuggaucggcaacaaccuguacuggaccaacgacggccacagaaagaccaucaacguggccagacuggagaaggccagccagagcagaaagacccugcuggagggcgagaugagccaccccagaggcaucgugguggaccccgugaacggcuggauguacuggaccgacugggaggaggacgagaucgacgacagcgugggcagaaucgagaaggccuggauggacggcuucaacagacagaucuucgugaccagcaagaugcuguggcccaacggccugacccuggacuuccacaccaacacccuguacuggugcgacgccuacuacgaccacaucgagaagguguuccugaacggcacccacagaaagaucguguacagcggcagagagcugaaccaccccuucggccugagccaccacggcaacuacguguucuggaccgacuacaugaacggcagcaucuuccagcuggaccugaucaccagcgaggugacccugcugagacacgagagacccccccuguucggccugcagaucuacgaccccagaaagcagcagggcgacaacaugugcagagugaacaacggcggcugcagcacccugugccuggccauccccggcggcagagugugcgccugcgccgacaaccagcugcuggacgagaacggcaccaccugcaccuucaaccccggcgaggcccugccccacaucugcaaggccggcgaguucagaugcaagaacagacacugcauccaggccagauggaagugcgacggcgacgacgacugccuggacggcagcgacgaggacagcgugaacugcuucaaccacagcugccccgacgaccaguucaagugccagaacaacagaugcauccccaagagauggcugugcgacggcgccaacgacugcggcagcaacgaggacgagagcaaccagaccugcaccgccagaaccugccagguggaccaguucagcugcggcaacggcagaugcauccccagagccuggcugugcgacagagaggacgacugcggcgaccagaccgacgagauggccagcugcgaguuccccaccugcgagccccugacccaguucgugugcaagagcggcagaugcaucagcagcaaguggcacugcgacagcgacgacgacugcggcgacggcagcgacgaggugggcugcgugcacagcugcuucgacaaccaguucagaugcagcagcggcagaugcauccccggccacugggccugcgacggcgacaacgacugcggcgacuucagcgacgaggcccagaucaacugcaccaaggaggagauccacagccccgccggcugcaacggcaacgaguuccagugccaccccgacggcaacugcgugcccgaccuguggagaugcgacggcgagaaggacugcgaggacggcagcgacgagaagggcugcaacggcaccaucagacugugcgaccacaagaccaaguucagcugcuggagcaccggcagaugcaucaacaaggccugggugugcgacggcgacaucgacugcgaggaccagagcgacgaggacgacugcgacagcuuccugugcggcccccccaagcaccccugcgccaacgacaccagcgugugccugcagcccgagaagcugugcaacggcaagaaggacugccccgacggcagcgacgagggcuaccugugcgacgagugcagccugaacaacggcggcugcagcaaccacugcagcguggugcccggcagaggcaucgugugcagcugccccgagggccugcagcugaacaaggacaacaagaccugcgagaucguggacuacugcagcaaccaccugaagugcagccaggugugcgagcagcacaagcacaccgugaagugcagcugcuacgagggcuggaagcuggacguggacggcgagagcugcaccagcguggaccccuucgaggccuucaucaucuucagcaucagacacgagaucagaagaaucgaccugcacaagagagacuacagccugcuggugcccggccugagaaacaccaucgcccuggacuuccacuucaaccagagccugcuguacuggaccgacgugguggaggacagaaucuacagaggcaagcugagcgagagcggcggcgugagcgccaucgagguggugguggagcacggccuggccacccccgagggccugaccguggacuggaucgccggcaacaucuacuggaucgacagcaaccuggaccagaucgagguggccaagcuggacggcagccugagaaccacccugaucgccggcgccauggagcaccccagagccaucgcccuggaccccagauacggcauccuguucuggaccgacugggacgccaacuuccccagaaucgagagcgccagcaugagcggcgccggcagaaagaccaucuacaaggacaugaagaccggcgccuggcccaacggccugaccguggaccacuucgagaagagaaucguguggaccgacgccagaagcgacgccaucuacagcgcccuguacgacggcaccaacaugaucgagaucaucagaggccacgaguaccugagccaccccuucgccgugagccuguacggcagcgagguguacuggaccgacuggagaaccaacacccugagcaaggccaacaaguggaccggccagaacgugagcgugauccagaagaccagcgcccagcccuucgaccugcagaucuaccaccccagcagacagccccaggcccccaaccccugcgccgccaacgacggcaagggccccugcagccacaugugccugaucaaccacaacagaagcgccgccugcgccugcccccaccugaugaagcugagcagcgacaagaagaccugcuacgagaugaagaaguuccugcuguacgccagaagaagcgagaucagaggcguggacaucgacaaccccuacuucaacuucaucaccgccuucaccgugcccgacaucgacgacgugaccgugaucgacuucgacgccagcgaggagagacuguacuggaccgacaucaagacccagaccaucaagagagccuucaucaacggcaccggccuggagaccgugaucagcagagacauccagagcaucagaggccuggccguggacugggugagcagaaaccuguacuggaucagcagcgaguucgacgagacccagaucaacguggccagacuggacggcagccugaagaccagcaucauccacggcaucgacaagccccagugccuggccgcccaccccgugagaggcaagcuguacuggaccgacggcaacaccaucaacauggccaacauggacggcagcaacagcaagauccuguuccagaaccagaaggagcccgugggccugagcaucgacuacguggagaacaagcuguacuggaucagcagcggcaacggcaccaucaacagaugcaaccuggacggcggcaaccuggaggugaucgagagcaugaaggaggagcugaccaaggccaccgcccugaccaucauggacaagaagcuguggugggccgaccagaaccuggcccagcugggcaccugcagcaagagagacggcagaaaccccaccauccugagaaacaagaccagcggcguggugcacaugaagguguacgacaaggaggcccagcagggcagcaacagcugccagcugaacaacggcggcugcagccagcugugccugcccaccagcgagaccaccagaaccugcaugugcaccgugggcuacuaccugcagaagaacagaaugagcugccagggcaucgagagcuuccugauguacagcgugcacgagggcaucagaggcaucccccuggagcccagcgacaagauggacgcccugaugcccaucagcggcaccagcuucgccgugggcaucgacuuccacgccgagaacgacaccaucuacuggaccgacaugggcuucaacaagaucagcagagccaagagagaccagaccuggaaggaggacaucaucaccaacggccugggcagaguggagggcaucgccguggacuggaucgccggcaacaucuacuggaccgaccacggcuucaaccugaucgagguggccagacugaacggcagcuucagauacgugaucaucagccagggccuggaccagcccagaagcaucgccgugcaccccgagaagggccugcuguucuggaccgaguggggccagaugcccugcaucggcaaggccagacuggacggcagcgagaagguggugcuggugagcaugggcaucgccuggcccaacggcaucagcaucgacuacgaggagaacaagcuguacuggugcgacgccagaaccgacaagaucgagagaaucgaccuggagaccggcggcaacagagagauggugcugagcggcagcaacguggacauguucagcguggccguguucggcgccuacaucuacuggagcgacagagcccacgccaacggcagcgugagaagaggccacaagaacgacgccaccgagaccaucaccaugagaaccggccugggcgugaaccugaaggaggugaagaucuucaacagagugagagagaagggcaccaacgugugcgccagagacaacggcggcugcaagcagcugugccuguacagaggcaacagcagaagaaccugcgccugcgcccacggcuaccuggccgaggacggcgugaccugccugagacacgagggcuaccugcuguacagcggcagaaccauccugaagagcauccaccugagcgacgagaccaaccugaacagccccaucagacccuacgagaaccccagauacuucaagaacgugaucgcccuggccuucgacuacaaccagagaagaaagggcaccaacagaaucuucuacagcgacgcccacuucggcaacauccagcugaucaaggacaacugggaggacagacaggugaucguggagaacgugggcagcguggagggccuggccuaccacagagccugggacacccuguacuggaccagcagcaccaccagcagcaucaccagacacaccguggaccagaccagacccggcgccuucgacagagaggccgugaucaccaugagcgaggacgaccacccccacgugcuggcccuggacgagugccagaaccugauguucuggaccaacuggaacgagcagcaccccagcaucaugagaagcacccugaccggcaagaacgcccaggugguggugagcaccgacauccugacccccaacggccugaccaucgacuacagagccgagaagcuguacuucagcgacggcagccugggcaagaucgagagaugcgaguacgacggcagccagagacacgugaucgugaagagcggccccggcaccuuccugagccuggccguguacgacaacuacaucuucuggagcgacuggggcagaagagccauccugagaagcaacaaguacaccggcggcgacaccaagauccugagaagcgacaucccccaccagcccaugggcaucaucgccguggccaacgacaccaacagcugcgagcugagccccugcgcccugcugaacggcggcugccacgaccugugccugcugacccccaacggcagagugaacugcagcugcagaggcgacagaauccugcuggaggacaacagaugcgugaccaagaacagcagcugcaacgccuacagcgaguucgagugcggcaacggcgagugcaucgacuaccagcugaccugcgacggcaucccccacugcaaggacaagagcgacgagaagcugcuguacugcgagaacagaagcugcagaagaggcuucaagcccugcuacaacagaagaugcaucccccacggcaagcugugcgacggcgagaacgacugcggcgacaacagcgacgagcuggacugcaaggugagcaccugcgccaccguggaguucagaugcgccgacggcaccugcauccccagaagcgccagaugcaaccagaacaucgacugcgccgacgccagcgacgagaagaacugcaacaacaccgacugcacccacuucuacaagcugggcgugaagaccaccggcuucaucagaugcaacagcaccagccugugcgugcugcccaccuggaucugcgacggcagcaacgacugcggcgacuacagcgacgagcugaagugccccgugcagaacaagcacaagugcgaggagaacuacuucagcugccccagcggcagaugcauccugaacaccuggaucugcgacggccagaaggacugcgaggacggcagagacgaguuccacugcgacagcagcugcagcuggaaccaguucgccugcagcgcccagaagugcaucagcaagcacuggaucugcgacggcgaggacgacugcggcgacggccuggacgagagcgacagcaucugcggcgccaucaccugcgccgccgacauguucagcugccagggcagcagagccugcgugcccagacacuggcugugcgacggcgagagagacugccccgacggcagcgacgagcugagcaccgccggcugcgcccccaacaacaccugcgacgagaacgccuucaugugccacaacaaggugugcauccccaagcaguucgugugcgaccacgacgacgacugcggcgacggcagcgacgagagcccccagugcggcuacagacagugcggcaccgaggaguucagcugcgccgacggcagaugccugcugaacacccaguggcagugcgacggcgacuucgacugccccgaccacagcgacgaggccccccugaaccccaagugcaagagcgccgagcagagcugcaacagcagcuucuucaugugcaagaacggcagaugcauccccagcggcggccugugcgacaacaaggacgacugcggcgacggcagcgacgagagaaacugccacaucaacgagugccugagcaagaaggugagcggcugcagccaggacugccaggaccugcccgugagcuacaagugcaagugcuggcccggcuuccagcugaaggacgacggcaagaccugcguggacaucgacgagugcagcagcggcuuccccugcagccagcagugcaucaacaccuacggcaccuacaagugccugugcaccgacggcuacgagauccagcccgacaaccccaacggcugcaagagccugagcgacgaggagcccuuccugauccuggccgaccaccacgagaucagaaagaucagcaccgacggcagcaacuacacccugcugaagcagggccugaacaacgugaucgccaucgacuucgacuacagagaggaguucaucuacuggaucgacagcagcagacccaacggcagcagaaucaacagaaugugccugaacggcagcgacaucaagguggugcacaacaccgccgugcccaacgcccuggccguggacuggaucggcaagaaccuguacuggagcgacaccgagaagagaaucaucgaggugagcaagcugaacggccuguaccccaccauccuggugagcaagagacugaaguuccccagagaccugagccuggacccccaggccggcuaccuguacuggaucgacugcugcgaguacccccacaucggcagagugggcauggacggcaccaaccagagcguggugaucgagaccaagaucagcagacccauggcccugaccaucgacuacgugaacagaagacuguacugggccgacgagaaccacaucgaguucagcaacauggacggcagccacagacacaaggugcccaaccaggacauccccggcgugaucgcccugacccuguucgaggacuacaucuacuggaccgacggcaagaccaagagccugagcagagcccacaagaccagcggcgccgacagacugagccugaucuacagcuggcacgccaucaccgacauccagguguaccacagcuacagacagcccgacgugagcaagcaccugugcaugaucaacaacggcggcugcagccaccugugccugcuggcccccggcaagacccacaccugcgccugccccaccaacuucuaccuggccgccgacaacagaaccugccugagcaacugcaccgccagccaguucagaugcaagaccgacaagugcauccccuucugguggaagugcgacaccguggacgacugcggcgacggcagcgacgagcccgacgacugccccgaguucagaugccagcccggcagauuccagugcggcaccggccugugcgcccugcccgccuucaucugcgacggcgagaacgacugcggcgacaacagcgacgagcugaacugcgacacccacgugugccugagcggccaguucaagugcaccaagaaccagaagugcauccccgugaaccugagaugcaacggccaggacgacugcggcgacgaggaggacgagagagacugccccgagaacagcugcagccccgacuacuuccagugcaagaccaccaagcacugcaucagcaagcugugggugugcgacgaggaccccgacugcgccgacgccagcgacgaggccaacugcgacaagaagaccugcggcccccacgaguuccagugcaagaacaacaacugcauccccgaccacuggagaugcgacagccagaacgacugcagcgacaacagcgacgaggagaacugcaagccccagaccugcacccugaaggacuuccugugcgccaacggcgacugcgugagcagcagauucuggugcgacggcgacuucgacugcgccgacggcagcgacgagagaaacugcgagaccagcugcagcaaggaccaguucagaugcagcaacggccagugcauccccgccaaguggaagugcgacggccacgaggacugcaaguacggcgaggacgagaagagcugcgagcccgccagccccaccugcagcagcagagaguacaucugcgccagcgacggcugcaucagcgccagccugaagugcaacggcgaguacgacugcgccgacggcagcgacgagauggacugcgugaccgagugcaaggaggaccaguucagaugcaagaacaaggcccacugcauccccaucagauggcugugcgacggcauccacgacugcguggacggcagcgacgaggagaacugcgagagaggcggcaacaucugcagagccgacgaguuccugugcaacaacagccugugcaagcugcacuucugggugugcgacggcgaggacgacugcggcgacaacagcgacgaggcccccgacaugugcgugaaguuccugugccccagcaccagaccccacagaugcagaaacaacagaaucugccugcagagcgagcagaugugcaacggcaucgacgagugcggcgacaacagcgacgaggaccacugcggcggcaagcugaccuacaaggccagacccugcaagaaggacgaguucgccugcagcaacaagaagugcauccccauggaccugcagugcgacagacuggacgacugcggcgacggcagcgacgagcagggcugcagaaucgcccccaccgaguacaccugcgaggacaacgugaaccccugcggcgacgacgccuacugcaaccagaucaagaccagcguguucugcagaugcaagcccggcuuccagagaaacaugaagaacagacagugcgaggaccugaacgagugccugguguucggcaccugcagccaccagugcaucaacguggagggcagcuacaagugcgugugcgaccagaacuuccaggagagaaacaacaccugcaucgccgagggcagcgaggaccaggugcuguacaucgccaacgacaccgacauccugggcuucaucuaccccuucaacuacagcggcgaccaccagcagaucagccacaucgagcacaacagcagaaucaccggcauggacguguacuaccagagagacaugaucaucuggagcacccaguucaaccccggcggcaucuucuacaagagaauccacggcagagagaagagacaggccaacagcggccugaucugccccgaguucaagagacccagagacaucgccguggacuggguggccggcaacaucuacuggaccgaccacagcagaaugcacugguucagcuacuacaccacccacuggaccagccugagauacagcaucaacgugggccagcugaacggccccaacugcaccagacugcugaccaacauggccggcgagcccuacgccaucgccgugaaccccaagagaggcaugauguacuggaccguggugggcgaccacagccacaucgaggaggccgccauggacggcacccugagaagaauccuggugcagaagaaccugcagagacccaccggccuggccguggacuacuucagcgagagaaucuacugggccgacuucgagcugagcaucaucggcagcgugcuguacgacggcagcaacagcguggugagcgugagcagcaagcagggccugcugcacccccacagaaucgacaucuucgaggacuacaucuacggcgccggccccaagaacggcguguucagagugcagaaguucggccacggcagcguggaguaccuggcccugaacaucgacaagaccaagggcgugcugaucagccacagauacaagcagcuggaccugcccaaccccugccuggaccuggccugcgaguuccugugccugcugaaccccagcggcgccaccugcgugugccccgagggcaaguaccugaucaacggcaccugcaacgacgacagccugcuggacgacagcugcaagcugaccugcgagaacggcggcagaugcauccugaacgagaagggcgaccugagaugccacugcuggcccagcuacagcggcgagagaugcgaggugaaccacugcagcaacuacugccagaacggcggcaccugcgugcccagcgugcugggcagacccaccugcagcugcgcccugggcuucaccggccccaacugcggcaagaccgugugcgaggacuucugccagaacggcggcaccugcaucgugaccgccggcaaccagcccuacugccacugccagcccgaguacaccggcgacagaugccaguacuacgugugccaccacuacugcgugaacagcgagagcugcaccaucggcgacgacggcagcguggagugcgugugccccaccagauacgagggccccaagugcgagguggacaagugcgugagaugccacggcggccacugcaucaucaacaaggacagcgaggacaucuucugcaacugcaccaacggcaagaucgccagcagcugccagcugugcgacggcuacugcuacaacggcggcaccugccagcuggaccccgagaccaacgugcccgugugccugugcagcaccaacuggagcggcacccagugcgagagacccgcccccaagagcagcaagagcgaccacaucagcaccagaagcaucgccaucaucgugccccuggugcugcuggugacccugaucaccacccuggugaucggccuggugcugugcaagagaaagagaagaaccaagaccaucagaagacagcccaucaucaacggcggcaucaacguggagaucggcaaccccagcuacaacauguacgagguggaccacgaccacaacgacggcggccugcuggaccccggcuucaugaucgaccccaccaaggccagauacaucggcggcggccccagcgccuucaagcugccccacaccgccccccccaucuaccugaacagcgaccugaagggcccccugaccgccggccccaccaacuacagcaaccccguguacgccaagcuguacauggacggccagaacugcagaaacagccugggcagcguggacgagagaaaggagcugcugcccaagaagaucgagaucggcaucagagagaccguggccuaa

SEQ ID NO: 19387 - RNA, 13635 nt, Artificial Sequence
  LRP1__Homo_sapiens__NP_002323
augcugacccccccccugcugcugcugcugccccugcugagcgcccugguggccgccgccaucgacgcccccaagaccugcagccccaagcaguucgccugcagagaccagaucaccugcaucagcaagggcuggagaugcgacggcgagagagacugccccgacggcagcgacgaggcccccgagaucugcccccagagcaaggcccagagaugccagcccaacgagcacaacugccugggcaccgagcugugcgugcccaugagcagacugugcaacggcgugcaggacugcauggacggcagcgacgagggcccccacugcagagagcugcagggcaacugcagcagacugggcugccagcaccacugcgugcccacccuggacggccccaccugcuacugcaacagcagcuuccagcugcaggccgacggcaagaccugcaaggacuucgacgagugcagcguguacggcaccugcagccagcugugcaccaacaccgacggcagcuucaucugcggcugcguggagggcuaccugcugcagcccgacaacagaagcugcaaggccaagaacgagcccguggacagaccccccgugcugcugaucgccaacagccagaacauccuggccaccuaccugagcggcgcccaggugagcaccaucacccccaccagcaccagacagaccaccgccauggacuucagcuacgccaacgagaccgugugcugggugcacgugggcgacagcgccgcccagacccagcugaagugcgccagaaugcccggccugaagggcuucguggacgagcacaccaucaacaucagccugagccugcaccacguggagcagauggccaucgacuggcugaccggcaacuucuacuucguggacgacaucgacgacagaaucuucgugugcaacagaaacggcgacaccugcgugacccugcuggaccuggagcuguacaaccccaagggcaucgcccuggaccccgccaugggcaagguguucuucaccgacuacggccagauccccaagguggagagaugcgacauggacggccagaacagaaccaagcugguggacagcaagaucguguucccccacggcaucacccuggaccuggugagcagacugguguacugggccgacgccuaccuggacuacaucgaggugguggacuacgagggcaagggcagacagaccaucauccagggcauccugaucgagcaccuguacggccugaccguguucgagaacuaccuguacgccaccaacagcgacaacgccaacgcccagcagaagaccagcgugaucagagugaacagauucaacagcaccgaguaccagguggugaccagaguggacaagggcggcgcccugcacaucuaccaccagagaagacagcccagagugagaagccacgccugcgagaacgaccaguacggcaagcccggcggcugcagcgacaucugccugcuggccaacagccacaaggccagaaccugcagaugcagaagcggcuucagccugggcagcgacggcaagagcugcaagaagcccgagcacgagcuguuccugguguacggcaagggcagacccggcaucaucagaggcauggacaugggcgccaaggugcccgacgagcacaugauccccaucgagaaccugaugaaccccagagcccuggacuuccacgccgagaccggcuucaucuacuucgccgacaccaccagcuaccugaucggcagacagaagaucgacggcaccgagagagagaccauccugaaggacggcauccacaacguggagggcguggccguggacuggaugggcgacaaccuguacuggaccgacgacggccccaagaagaccaucagcguggccagacuggagaaggccgcccagaccagaaagacccugaucgagggcaagaugacccaccccagagccaucgugguggacccccugaacggcuggauguacuggaccgacugggaggaggaccccaaggacagcagaagaggcagacuggagagagccuggauggacggcagccacagagacaucuucgugaccagcaagaccgugcuguggcccaacggccugagccuggacauccccgccggcagacuguacuggguggacgccuucuacgacagaaucgagaccauccugcugaacggcaccgacagaaagaucguguacgagggccccgagcugaaccacgccuucggccugugccaccacggcaacuaccuguucuggaccgaguacagaagcggcagcguguacagacuggagagaggcgugggcggcgccccccccaccgugacccugcugagaagcgagagaccccccaucuucgagaucagaauguacgacgcccagcagcagcaggugggcaccaacaagugcagagugaacaacggcggcugcagcagccugugccuggccacccccggcagcagacagugcgccugcgccgaggaccaggugcuggacgccgacggcgugaccugccuggccaaccccagcuacgugccccccccccagugccagcccggcgaguucgccugcgccaacagcagaugcauccaggagagauggaagugcgacggcgacaacgacugccuggacaacagcgacgaggcccccgcccugugccaccagcacaccugccccagcgacagauucaagugcgagaacaacagaugcauccccaacagauggcugugcgacggcgacaacgacugcggcaacagcgaggacgagagcaacgccaccugcagcgccagaaccugcccccccaaccaguucagcugcgccagcggcagaugcauccccaucagcuggaccugcgaccuggacgacgacugcggcgacagaagcgacgagagcgccagcugcgccuaccccaccugcuucccccugacccaguucaccugcaacaacggcagaugcaucaacaucaacuggagaugcgacaacgacaacgacugcggcgacaacagcgacgaggccggcugcagccacagcugcagcagcacccaguucaagugcaacagcggcagaugcauccccgagcacuggaccugcgacggcgacaacgacugcggcgacuacagcgacgagacccacgccaacugcaccaaccaggccaccagaccccccggcggcugccacaccgacgaguuccagugcagacuggacggccugugcaucccccugagauggagaugcgacggcgacaccgacugcauggacagcagcgacgagaagagcugcgagggcgugacccacgugugcgaccccagcgugaaguucggcugcaaggacagcgccagaugcaucagcaaggccugggugugcgacggcgacaacgacugcgaggacaacagcgacgaggagaacugcgagagccuggccugcagaccccccagccaccccugcgccaacaacaccagcgugugccugccccccgacaagcugugcgacggcaacgacgacugcggcgacggcagcgacgagggcgagcugugcgaccagugcagccugaacaacggcggcugcagccacaacugcagcguggcccccggcgagggcaucgugugcagcugcccccugggcauggagcugggccccgacaaccacaccugccagauccagagcuacugcgccaagcaccugaagugcagccagaagugcgaccagaacaaguucagcgugaagugcagcugcuacgagggcugggugcuggagcccgacggcgagagcugcagaagccuggaccccuucaagcccuucaucaucuucagcaacagacacgagaucagaagaaucgaccugcacaagggcgacuacagcgugcuggugcccggccugagaaacaccaucgcccuggacuuccaccugagccagagcgcccuguacuggaccgacgugguggaggacaagaucuacagaggcaagcugcuggacaacggcgcccugaccagcuucgagguggugauccaguacggccuggccacccccgagggccuggccguggacuggaucgccggcaacaucuacuggguggagagcaaccuggaccagaucgagguggccaagcuggacggcacccugagaaccacccugcuggccggcgacaucgagcaccccagagccaucgcccuggaccccagagacggcauccuguucuggaccgacugggacgccagccugcccagaaucgaggccgccagcaugagcggcgccggcagaagaaccgugcacagagagaccggcagcggcggcuggcccaacggccugaccguggacuaccuggagaagagaauccuguggaucgacgccagaagcgacgccaucuacagcgccagauacgacggcagcggccacauggaggugcugagaggccacgaguuccugagccaccccuucgccgugacccuguacggcggcgagguguacuggaccgacuggagaaccaacacccuggccaaggccaacaaguggaccggccacaacgugaccguggugcagagaaccaacacccagcccuucgaccugcagguguaccaccccagcagacagcccauggcccccaaccccugcgaggccaacggcggccagggccccugcagccaccugugccugaucaacuacaacagaaccgugagcugcgccugcccccaccugaugaagcugcacaaggacaacaccaccugcuacgaguucaagaaguuccugcuguacgccagacagauggagaucagaggcguggaccuggacgcccccuacuacaacuacaucaucagcuucaccgugcccgacaucgacaacgugaccgugcuggacuacgacgccagagagcagagaguguacuggagcgacgugagaacccaggccaucaagagagccuucaucaacggcaccggcguggagaccguggugagcgccgaccugcccaacgcccacggccuggccguggacugggugagcagaaaccuguucuggaccagcuacgacaccaacaagaagcagaucaacguggccagacuggacggcagcuucaagaacgccguggugcagggccuggagcagccccacggccugguggugcacccccugagaggcaagcuguacuggaccgacggcgacaacaucagcauggccaacauggacggcagcaacagaacccugcuguucagcggccagaagggccccgugggccuggccaucgacuuccccgagagcaagcuguacuggaucagcagcggcaaccacaccaucaacagaugcaaccuggacggcagcggccuggaggugaucgacgccaugagaagccagcugggcaaggccaccgcccuggccaucaugggcgacaagcuguggugggccgaccaggugagcgagaagaugggcaccugcagcaaggccgacggcagcggcagcguggugcugagaaacagcaccacccuggugaugcacaugaagguguacgacgagagcauccagcuggaccacaagggcaccaaccccugcagcgugaacaacggcgacugcagccagcugugccugcccaccagcgagaccaccagaagcugcaugugcaccgccggcuacagccugagaagcggccagcaggccugcgagggcgugggcagcuuccugcuguacagcgugcacgagggcaucagaggcaucccccuggaccccaacgacaagagcgacgcccuggugcccgugagcggcaccagccuggccgugggcaucgacuuccacgccgagaacgacaccaucuacuggguggacaugggccugagcaccaucagcagagccaagagagaccagaccuggagagaggacguggugaccaacggcaucggcagaguggagggcaucgccguggacuggaucgccggcaacaucuacuggaccgaccagggcuucgacgugaucgagguggccagacugaacggcagcuucagauacguggugaucagccagggccuggacaagcccagagccaucaccgugcaccccgagaagggcuaccuguucuggaccgaguggggccaguaccccagaaucgagagaagcagacuggacggcaccgagagaguggugcuggugaacgugagcaucagcuggcccaacggcaucagcguggacuaccaggacggcaagcuguacuggugcgacgccagaaccgacaagaucgagagaaucgaccuggagaccggcgagaacagagagguggugcugagcagcaacaacauggacauguucagcgugagcguguucgaggacuucaucuacuggagcgacagaacccacgccaacggcagcaucaagagaggcagcaaggacaacgccaccgacagcgugccccugagaaccggcaucggcgugcagcugaaggacaucaagguguucaacagagacagacagaagggcaccaacgugugcgccguggccaacggcggcugccagcagcugugccuguacagaggcagaggccagagagccugcgccugcgcccacggcaugcuggccgaggacggcgccagcugcagagaguacgccggcuaccugcuguacagcgagagaaccauccugaagagcauccaccugagcgacgagagaaaccugaacgcccccgugcagcccuucgaggaccccgagcacaugaagaacgugaucgcccuggccuucgacuacagagccggcaccagccccggcacccccaacagaaucuucuucagcgacauccacuucggcaacauccagcagaucaacgacgacggcagcagaagaaucaccaucguggagaacgugggcagcguggagggccuggccuaccacagaggcugggacacccuguacuggaccagcuacaccaccagcaccaucaccagacacaccguggaccagaccagacccggcgccuucgagagagagaccgugaucaccaugagcggcgacgaccaccccagagccuucgugcuggacgagugccagaaccugauguucuggaccaacuggaacgagcagcaccccagcaucaugagagccgcccugagcggcgccaacgugcugacccugaucgagaaggacaucagaacccccaacggccuggccaucgaccacagagccgagaagcuguacuucagcgacgccacccuggacaagaucgagagaugcgaguacgacggcagccacagauacgugauccugaagagcgagcccgugcaccccuucggccuggccguguacggcgagcacaucuucuggaccgacugggugagaagagccgugcagagagccaacaagcacgugggcagcaacaugaagcugcugagaguggacaucccccagcagcccaugggcaucaucgccguggccaacgacaccaacagcugcgagcugagccccugcagaaucaacaacggcggcugccaggaccugugccugcugacccaccagggccacgugaacugcagcugcagaggcggcagaauccugcaggacgaccugaccugcagagccgugaacagcagcugcagagcccaggacgaguucgagugcgccaacggcgagugcaucaacuucagccugaccugcgacggcgugccccacugcaaggacaagagcgacgagaagcccagcuacugcaacagcagaagaugcaagaagaccuucagacagugcagcaacggcagaugcgugagcaacaugcuguggugcaacggcgccgacgacugcggcgacggcagcgacgagauccccugcaacaagaccgccugcggcgugggcgaguucagaugcagagacggcaccugcaucggcaacagcagcagaugcaaccaguucguggacugcgaggacgccagcgacgagaugaacugcagcgccaccgacugcagcagcuacuucagacugggcgugaagggcgugcuguuccagcccugcgagagaaccagccugugcuacgcccccagcugggugugcgacggcgccaacgacugcggcgacuacagcgacgagagagacugccccggcgugaagagacccagaugcccccugaacuacuucgccugccccagcggcagaugcauccccaugagcuggaccugcgacaaggaggacgacugcgagcacggcgaggacgagacccacugcaacaaguucugcagcgaggcccaguucgagugccagaaccacagaugcaucagcaagcaguggcugugcgacggcagcgacgacugcggcgacggcagcgacgaggccgcccacugcgagggcaagaccugcggccccagcagcuucagcugccccggcacccacgugugcgugcccgagagauggcugugcgacggcgacaaggacugcgccgacggcgccgacgagagcaucgccgccggcugccuguacaacagcaccugcgacgacagagaguucaugugccagaacagacagugcauccccaagcacuucgugugcgaccacgacagagacugcgccgacggcagcgacgagagccccgagugcgaguaccccaccugcggccccagcgaguucagaugcgccaacggcagaugccugagcagcagacagugggagugcgacggcgagaacgacugccacgaccagagcgacgaggcccccaagaacccccacugcaccagccaggagcacaagugcaacgccagcagccaguuccugugcagcagcggcagaugcguggccgaggcccugcugugcaacggccaggacgacugcggcgacagcagcgacgagagaggcugccacaucaacgagugccugagcagaaagcugagcggcugcagccaggacugcgaggaccugaagaucggcuucaagugcagaugcagacccggcuucagacugaaggacgacggcagaaccugcgccgacguggacgagugcagcaccaccuuccccugcagccagagaugcaucaacacccacggcagcuacaagugccugugcguggagggcuacgcccccagaggcggcgacccccacagcugcaaggccgugaccgacgaggagcccuuccugaucuucgccaacagauacuaccugagaaagcugaaccuggacggcagcaacuacacccugcugaagcagggccugaacaacgccguggcccuggacuucgacuacagagagcagaugaucuacuggaccgacgugaccacccagggcagcaugaucagaagaaugcaccugaacggcagcaacgugcaggugcugcacagaaccggccugagcaaccccgacggccuggccguggacugggugggcggcaaccuguacuggugcgacaagggcagagacaccaucgaggugagcaagcugaacggcgccuacagaaccgugcuggugagcagcggccugagagagcccagagcccuggugguggacgugcagaacggcuaccuguacuggaccgacuggggcgaccacagccugaucggcagaaucggcauggacggcagcagcagaagcgugaucguggacaccaagaucaccuggcccaacggccugacccuggacuacgugaccgagagaaucuacugggccgacgccagagaggacuacaucgaguucgccagccuggacggcagcaacagacacguggugcugagccaggacaucccccacaucuucgcccugacccuguucgaggacuacguguacuggaccgacugggagaccaagagcaucaacagagcccacaagaccaccggcaccaacaagacccugcugaucagcacccugcacagacccauggaccugcacguguuccacgcccugagacagcccgacgugcccaaccaccccugcaaggugaacaacggcggcugcagcaaccugugccugcugagccccggcggcggccacaagugcgccugccccaccaacuucuaccugggcagcgacggcagaaccugcgugagcaacugcaccgccagccaguucgugugcaagaacgacaagugcauccccuucugguggaagugcgacaccgaggacgacugcggcgaccacagcgacgagccccccgacugccccgaguucaagugcagacccggccaguuccagugcagcaccggcaucugcaccaaccccgccuucaucugcgacggcgacaacgacugccaggacaacagcgacgaggccaacugcgacauccacgugugccugcccagccaguucaagugcaccaacaccaacagaugcauccccggcaucuucagaugcaacggccaggacaacugcggcgacggcgaggacgagagagacugccccgaggugaccugcgcccccaaccaguuccagugcagcaucaccaagagaugcauccccagagugugggugugcgacagagacaacgacugcguggacggcagcgacgagcccgccaacugcacccagaugaccugcggcguggacgaguucagaugcaaggacagcggcagaugcauccccgccagauggaagugcgacggcgaggacgacugcggcgacggcagcgacgagcccaaggaggagugcgacgagagaaccugcgagcccuaccaguucagaugcaagaacaacagaugcgugcccggcagauggcagugcgacuacgacaacgacugcggcgacaacagcgacgaggagagcugcacccccagacccugcagcgagagcgaguucagcugcgccaacggcagaugcaucgccggcagauggaagugcgacggcgaccacgacugcgccgacggcagcgacgagaaggacugcacccccagaugcgacauggaccaguuccagugcaagagcggccacugcaucccccugagauggagaugcgacgccgacgccgacugcauggacggcagcgacgaggaggccugcggcaccggcgugagaaccugcccccuggacgaguuccagugcaacaacacccugugcaagccccuggccuggaagugcgacggcgaggacgacugcggcgacaacagcgacgagaaccccgaggagugcgccagauucgugugcccccccaacagacccuucagaugcaagaacgacagagugugccuguggaucggcagacagugcgacggcaccgacaacugcggcgacggcaccgacgaggaggacugcgagccccccaccgcccacaccacccacugcaaggacaagaaggaguuccugugcagaaaccagagaugccugagcagcagccugagaugcaacauguucgacgacugcggcgacggcagcgacgaggaggacugcagcaucgaccccaagcugaccagcugcgccaccaacgccagcaucugcggcgacgaggccagaugcgugagaaccgagaaggccgccuacugcgccugcagaagcggcuuccacaccgugcccggccagcccggcugccaggacaucaacgagugccugagauucggcaccugcagccagcugugcaacaacaccaagggcggccaccugugcagcugcgccagaaacuucaugaagacccacaacaccugcaaggccgagggcagcgaguaccaggugcuguacaucgccgacgacaacgagaucagaagccuguuccccggccacccccacagcgccuacgagcaggccuuccagggcgacgagagcgugagaaucgacgccauggacgugcacgugaaggccggcagaguguacuggaccaacuggcacaccggcaccaucagcuacagaagccugccccccgccgccccccccaccaccagcaacagacacagaagacagaucgacagaggcgugacccaccugaacaucagcggccugaagaugcccagaggcaucgccaucgacuggguggccggcaacguguacuggaccgacagcggcagagacgugaucgagguggcccagaugaagggcgagaacagaaagacccugaucagcggcaugaucgacgagccccacgccaucgugguggacccccugagaggcaccauguacuggagcgacuggggcaaccaccccaagaucgagaccgccgccauggacggcacccugagagagacccuggugcaggacaacauccaguggcccaccggccuggccguggacuaccacaacgagagacuguacugggccgacgccaagcugagcgugaucggcagcaucagacugaacggcaccgaccccaucguggccgccgacagcaagagaggccugagccaccccuucagcaucgacguguucgaggacuacaucuacggcgugaccuacaucaacaacagaguguucaagauccacaaguucggccacagcccccuggugaaccugaccggcggccugagccacgccagcgacguggugcuguaccaccagcacaagcagcccgaggugaccaaccccugcgacagaaagaagugcgaguggcugugccugcugagccccagcggccccgugugcaccugccccaacggcaagagacuggacaacggcaccugcgugcccgugcccagccccacccccccccccgacgcccccagacccggcaccugcaaccugcagugcuucaacggcggcagcugcuuccugaacgccagaagacagcccaagugcagaugccagcccagauacaccggcgacaagugcgagcuggaccagugcugggagcacugcagaaacggcggcaccugcgccgccagccccagcggcaugcccaccugcagaugccccaccggcuucaccggccccaagugcacccagcaggugugcgccggcuacugcgccaacaacagcaccugcaccgugaaccagggcaaccagccccagugcagaugccugcccggcuuccugggcgacagaugccaguacagacagugcagcggcuacugcgagaacuucggcaccugccagauggccgccgacggcagcagacagugcagaugcaccgccuacuucgagggcagcagaugcgaggugaacaagugcagcagaugccuggagggcgccugcguggugaacaagcagagcggcgacgugaccugcaacugcaccgacggcagaguggcccccagcugccugaccugcgugggccacugcagcaacggcggcagcugcaccaugaacagcaagaugaugcccgagugccagugccccccccacaugaccggccccagaugcgaggagcacguguucagccagcagcagcccggccacaucgccagcauccugaucccccugcugcugcugcugcugcuggugcugguggccggcgugguguucugguacaagagaagagugcagggcgccaagggcuuccagcaccagagaaugaccaacggcgccaugaacguggagaucggcaaccccaccuacaagauguacgagggcggcgagcccgacgacgugggcggccugcuggacgccgacuucgcccuggaccccgacaagcccaccaacuucaccaaccccguguacgccacccuguacaugggcggccacggcagcagacacagccuggccagcaccgacgagaagagagagcugcugggcagaggccccgaggacgagaucggcgacccccuggccuaa

SEQ ID NO: 19388 - RNA, 1044 nt, Artificial Sequence
  LRP2BP__Homo_sapiens__NP_060879
augaagcugaccagcgagaagcugcccaagaaccccuucuacgccagcgugagccaguacgccgccaagaaccagaaguucuuccaguggaagaaggagaagaccgacuacacccacgccaaccugguggacaaggcccugcagcugcugaaggagagaauccugaagggcgacacccuggccuacuuccugagaggccagcuguacuucgaggagggcugguacgaggaggcccuggagcaguucgaggagaucaaggagaaggaccaccaggccaccuaccagcugggcgugauguacuacgacggccugggcaccacccuggacgccgagaagggcguggacuacaugaagaagauccuggacagccccugccccaaggccagacaccugaaguucgccgccgccuacaaccugggcagagccuacuacgagggcaagggcgugaagagaagcaacgaggaggccgagagacuguggcugaucgccgccgacaacggcaaccccaaggccagcgugaaggcccagagcaugcugggccuguacuacagcaccaaggagcccaaggagcuggagaaggccuucuacuggcacagcgaggccugcggcaacggcaaccuggagagccagggcgcccugggccugauguaccuguacggccagggcaucagacaggacaccgaggccgcccugcagugccugagagaggccgccgagagaggcaacguguacgcccagggcaaccugguggaguacuacuacaagaugaaguucuucaccaagugcguggccuucagcaagagaaucgccgacuacgacgaggugcacgacauccccaugaucgcccaggugaccgacugccugcccgaguucaucggcagaggcauggccauggccagcuucuaccacgccagaugccugcagcugggccugggcaucaccagagacgagaccaccgccaagcacuacuacagcaaggccugcagacugaaccccgcccuggccgacgagcugcacagccugcugaucagacagagaaucuaa

SEQ ID NO: 19389 - RNA, 13968 nt, Artificial Sequence
  LRP2__Homo_sapiens__NP_004516
auggacagaggccccgccgccguggccugcacccugcugcuggcccugguggccugccuggcccccgccagcggccaggagugcgacagcgcccacuucagaugcggcagcggccacugcauccccgccgacuggagaugcgacggcaccaaggacugcagcgacgacgccgacgagaucggcugcgccguggugaccugccagcagggcuacuucaagugccagagcgagggccagugcauccccaacagcugggugugcgaccaggaccaggacugcgacgacggcagcgacgagagacaggacugcagccagagcaccugcagcagccaccagaucaccugcagcaacggccagugcauccccagcgaguacagaugcgaccacgugagagacugccccgacggcgccgacgagaacgacugccaguaccccaccugcgagcagcugaccugcgacaacggcgccugcuacaacaccagccagaagugcgacuggaagguggacugcagagacagcagcgacgagaucaacugcaccgagaucugccugcacaacgaguucagcugcggcaacggcgagugcauccccagagccuacgugugcgaccacgacaacgacugccaggacggcagcgacgagcacgccugcaacuaccccaccugcggcggcuaccaguucaccugccccagcggcagaugcaucuaccagaacugggugugcgacggcgaggacgacugcaaggacaacggcgacgaggacggcugcgagagcggcccccacgacgugcacaagugcagccccagagaguggagcugccccgagagcggcagaugcaucagcaucuacaaggugugcgacggcauccuggacugccccggcagagaggacgagaacaacaccagcaccggcaaguacugcagcaugacccugugcagcgcccugaacugccaguaccagugccacgagacccccuacggcggcgccugcuucugcccccccggcuacaucaucaaccacaacgacagcagaaccugcguggaguucgacgacugccagaucuggggcaucugcgaccagaagugcgagagcagacccggcagacaccugugccacugcgaggagggcuacauccuggagagaggccaguacugcaaggccaacgacagcuucggcgaggccagcaucaucuucagcaacggcagagaccugcugaucggcgacauccacggcagaagcuucagaauccugguggagagccagaacagaggcguggccgugggcguggccuuccacuaccaccugcagagaguguucuggaccgacaccgugcagaacaagguguucagcguggacaucaacggccugaacauccaggaggugcugaacgugagcguggagacccccgagaaccuggccguggacugggugaacaacaagaucuaccugguggagaccaaggugaacagaaucgacauggugaaccuggacggcagcuacagagugacccugaucaccgagaaccugggccaccccagaggcaucgccguggaccccaccgugggcuaccuguucuucagcgacugggagagccugagcggcgagcccaagcuggagagagccuucauggacggcagcaacagaaaggaccuggugaagaccaagcugggcuggcccgccggcgugacccuggacaugaucagcaagagaguguacuggguggacagcagauucgacuacaucgagaccgugaccuacgacggcauccagagaaagaccguggugcacggcggcagccugaucccccaccccuucggcgugagccuguucgagggccagguguucuucaccgacuggaccaagauggccgugcugaaggccaacaaguucaccgagaccaacccccagguguacuaccaggccagccugagacccuacggcgugaccguguaccacagccugagacagcccuacgccaccaaccccugcaaggacaacaacggcggcugcgagcaggugugcgugcugagccacagaaccgacaacgacggccugggcuucagaugcaagugcaccuucggcuuccagcuggacaccgacgagagacacugcaucgccgugcagaacuuccugaucuucagcagccagguggccaucagaggcauccccuucacccugagcacccaggaggacgugauggugcccgugagcggcaaccccagcuucuucgugggcaucgacuucgacgcccaggacagcaccaucuucuucagcgacaugagcaagcacaugaucuucaagcagaagaucgacggcaccggcagagagauccuggccgccaacagaguggagaacguggagagccuggccuucgacuggaucagcaagaaccuguacuggaccgacagccacuacaagagcaucagcgugaugagacuggccgacaagaccagaagaaccguggugcaguaccugaacaaccccagaagcgugguggugcaccccuucgccggcuaccuguucuucaccgacugguucagacccgccaagaucaugagagccuggagcgacggcagccaccugcugcccgugaucaacaccacccugggcuggcccaacggccuggccaucgacugggccgccagcagacuguacuggguggacgccuacuucgacaagaucgagcacagcaccuucgacggccuggacagaagaagacugggccacaucgagcagaugacccaccccuucggccuggccaucuucggcgagcaccuguucuucaccgacuggagacugggcgccaucaucagagugagaaaggccgacggcggcgagaugaccgugaucagaagcggcaucgccuacauccugcaccugaagagcuacgacgugaacauccagaccggcagcaacgccugcaaccagcccacccaccccaacggcgacugcagccacuucugcuuccccgugcccaacuuccagagagugugcggcugccccuacggcaugagacuggccagcaaccaccugaccugcgagggcgaccccaccaacgagccccccaccgagcagugcggccuguucagcuuccccugcaagaacggcagaugcgugcccaacuacuaccugugcgacggcguggacgacugccacgacaacagcgacgagcagcugugcggcacccugaacaacaccugcagcagcagcgccuucaccugcggccacggcgagugcauccccgcccacuggagaugcgacaagagaaacgacugcguggacggcagcgacgagcacaacugccccacccacgcccccgccagcugccuggacacccaguacaccugcgacaaccaccagugcaucagcaagaacugggugugcgacaccgacaacgacugcggcgacggcagcgacgagaagaacugcaacagcaccgagaccugccagcccagccaguucaacugccccaaccacagaugcaucgaccugagcuucgugugcgacggcgacaaggacugcguggacggcagcgacgaggugggcugcgugcugaacugcaccgccagccaguucaagugcgccagcggcgacaagugcaucggcgugaccaacagaugcgacggcguguucgacugcagcgacaacagcgacgaggccggcugccccaccagaccccccggcaugugccacagcgacgaguuccagugccaggaggacggcaucugcauccccaacuucugggagugcgacggccaccccgacugccuguacggcagcgacgagcacaacgccugcgugcccaagaccugccccagcagcuacuuccacugcgacaacggcaacugcauccacagagccuggcugugcgacagagacaacgacugcggcgacaugagcgacgagaaggacugccccacccagcccuucagaugccccagcuggcaguggcagugccugggccacaacaucugcgugaaccugagcguggugugcgacggcaucuucgacugccccaacggcaccgacgagagcccccugugcaacggcaacagcugcagcgacuucaacggcggcugcacccacgagugcgugcaggagcccuucggcgccaagugccugugcccccugggcuuccugcuggccaacgacagcaagaccugcgaggacaucgacgagugcgacauccugggcagcugcagccagcacugcuacaacaugagaggcagcuucagaugcagcugcgacaccggcuacaugcuggagagcgacggcagaaccugcaaggugaccgccagcgagagccugcugcugcugguggccagccagaacaagaucaucgccgacagcgugaccagccaggugcacaacaucuacagccugguggagaacggcagcuacaucguggccguggacuucgacagcaucagcggcagaaucuucuggagcgacgccacccagggcaagaccuggagcgccuuccagaacggcaccgacagaagagugguguucgacagcagcaucauccugaccgagaccaucgccaucgacugggugggcagaaaccuguacuggaccgacuacgcccuggagaccaucgaggugagcaagaucgacggcagccacagaaccgugcugaucagcaagaaccugaccaaccccagaggccuggcccuggaccccagaaugaacgagcaccugcuguucuggagcgacuggggccaccaccccagaaucgagagagccagcauggacggcagcaugagaaccgugaucgugcaggacaagaucuucuggcccugcggccugaccaucgacuaccccaacagacugcuguacuucauggacagcuaccuggacuacauggacuucugcgacuacaacggccaccacagaagacaggugaucgccagcgaccugaucaucagacaccccuacgcccugacccuguucgaggacagcguguacuggaccgacagagccaccagaagagugaugagagccaacaaguggcacggcggcaaccagagcguggugauguacaacauccaguggccccugggcaucguggccgugcaccccagcaagcagcccaacagcgugaaccccugcgccuucagcagaugcagccaccugugccugcugagcagccagggcccccacuucuacagcugcgugugccccagcggcuggagccugagccccgaccugcugaacugccugagagacgaccagcccuuccugaucaccgugagacagcacaucaucuucggcaucagccugaaccccgaggugaagagcaacgacgccauggugcccaucgccggcauccagaacggccuggacguggaguucgacgacgccgagcaguacaucuacuggguggagaaccccggcgagauccacagagugaagaccgacggcaccaacagaaccguguucgccagcaucagcauggugggccccagcaugaaccuggcccuggacuggaucagcagaaaccuguacagcaccaaccccagaacccagagcaucgaggugcugacccugcacggcgacaucagauacagaaagacccugaucgccaacgacggcaccgcccugggcgugggcuuccccaucggcaucaccguggaccccgccagaggcaagcuguacuggagcgaccagggcaccgacagcggcgugcccgccaagaucgccagcgccaacauggacggcaccagcgugaagacccuguucaccggcaaccuggagcaccuggagugcgugacccuggacaucgaggagcagaagcuguacugggccgugaccggcagaggcgugaucgagagaggcaacguggacggcaccgacagaaugauccuggugcaccagcugagccaccccuggggcaucgccgugcacgacagcuuccuguacuacaccgacgagcaguacgaggugaucgagagaguggacaaggccaccggcgccaacaagaucgugcugagagacaacgugcccaaccugagaggccugcagguguaccacagaagaaacgccgccgagagcagcaacggcugcagcaacaacaugaacgccugccagcagaucugccugcccgugcccggcggccuguucagcugcgccugcgccaccggcuucaagcugaaccccgacaacagaagcugcagccccuacaacagcuucaucguggugagcaugcugagcgccaucagaggcuucagccuggagcugagcgaccacagcgagaccauggugcccguggccggccagggcagaaacgcccugcacguggacguggacgugagcagcggcuucaucuacuggugcgacuucagcagcagcguggccagcgacaacgccaucagaagaaucaagcccgacggcagcagccugaugaacaucgugacccacggcaucggcgagaacggcgugagaggcaucgccguggacuggguggccggcaaccuguacuucaccaacgccuucgugagcgagacccugaucgaggugcugagaaucaacaccaccuacagaagagugcugcugaaggugaccguggacaugcccagacacaucgugguggaccccaagaacagauaccuguucugggccgacuacggccagagacccaagaucgagagaagcuuccuggacugcaccaacagaaccgugcuggugagcgagggcaucgugacccccagaggccuggccguggacagaagcgacggcuacguguacuggguggacgacagccuggacaucaucgccagaaucagaaucaacggcgagaacagcgaggugaucagauacggcagcagauaccccacccccuacggcaucaccguguucgagaacagcaucaucuggguggacagaaaccugaagaagaucuuccaggccagcaaggagcccgagaacaccgagccccccaccgugaucagagacaacaucaacuggcugagagacgugaccaucuucgacaagcaggugcagcccagaagccccgccgaggugaacaacaaccccugccuggagaacaacggcggcugcagccaccugugcuucgcccugcccggccugcacacccccaagugcgacugcgccuucggcacccugcagagcgacggcaagaacugcgccaucagcaccgagaacuuccugaucuucgcccugagcaacagccugagaagccugcaccuggaccccgagaaccacagcccccccuuccagaccaucaacguggagagaaccgugaugagccuggacuacgacagcgugagcgacagaaucuacuucacccagaaccuggccagcggcgugggccagaucagcuacgccacccugagcagcggcauccacacccccaccgugaucgccagcggcaucggcaccgccgacggcaucgccuucgacuggaucaccagaagaaucuacuacagcgacuaccugaaccagaugaucaacagcauggccgaggacggcagcaacagaaccgugaucgccagagugcccaagcccagagccaucgugcuggaccccugccagggcuaccuguacugggccgacugggacacccacgccaagaucgagagagccacccugggcggcaacuucagagugcccaucgugaacagcagccuggugaugcccagcggccugacccuggacuacgaggaggaccugcuguacuggguggacgccagccugcagagaaucgagagaagcacccugaccggcguggacagagaggugaucgugaacgccgccgugcacgccuucggccugacccuguacggccaguacaucuacuggaccgaccuguacacccagagaaucuacagagccaacaaguacgacggcagcggccagaucgccaugaccaccaaccugcugagccagcccagaggcaucaacaccguggugaagaaccagaagcagcagugcaacaaccccugcgagcaguucaacggcggcugcagccacaucugcgcccccggccccaacggcgccgagugccagugcccccacgagggcaacugguaccuggccaacaacagaaagcacugcaucguggacaacggcgagagaugcggcgccagcagcuucaccugcagcaacggcagaugcaucagcgaggaguggaagugcgacaacgacaacgacugcggcgacggcagcgacgagauggagagcgugugcgcccugcacaccugcagccccaccgccuucaccugcgccaacggcagaugcgugcaguacagcuacagaugcgacuacuacaacgacugcggcgacggcagcgacgaggccggcugccuguucagagacugcaacgccaccaccgaguucaugugcaacaacagaagaugcauccccagagaguucaucugcaacggcguggacaacugccacgacaacaacaccagcgacgagaagaacugccccgacagaaccugccagagcggcuacaccaagugccacaacagcaacaucugcauccccagaguguaccugugcgacggcgacaacgacugcggcgacaacagcgacgagaaccccaccuacugcaccacccacaccugcagcagcagcgaguuccagugcgccagcggcagaugcaucccccagcacugguacugcgaccaggagaccgacugcuucgacgccagcgacgagcccgccagcugcggccacagcgagagaaccugccuggccgacgaguucaagugcgacggcggcagaugcauccccagcgaguggaucugcgacggcgacaacgacugcggcgacaugagcgacgaggacaagagacaccagugccagaaccagaacugcagcgacagcgaguuccugugcgugaacgacagaccccccgacagaagaugcaucccccagagcugggugugcgacggcgacguggacugcaccgacggcuacgacgagaaccagaacugcaccagaagaaccugcagcgagaacgaguucaccugcggcuacggccugugcauccccaagaucuucagaugcgacagacacaacgacugcggcgacuacagcgacgagagaggcugccuguaccagaccugccagcagaaccaguucaccugccagaacggcagaugcaucagcaagaccuucgugugcgacgaggacaacgacugcggcgacggcagcgacgagcugaugcaccugugccacacccccgagcccaccugccccccccacgaguucaagugcgacaacggcagaugcaucgagaugaugaagcugugcaaccaccuggacgacugccuggacaacagcgacgagaagggcugcggcaucaacgagugccacgaccccagcaucagcggcugcgaccacaacugcaccgacacccugaccagcuucuacugcagcugcagacccggcuacaagcugaugagcgacaagagaaccugcguggacaucgacgagugcaccgagaugcccuucgugugcagccagaagugcgagaacgugaucggcagcuacaucugcaagugcgcccccggcuaccugagagagcccgacggcaagaccugcagacagaacagcaacaucgagcccuaccugaucuucagcaacagauacuaccugagaaaccugaccaucgacggcuacuucuacagccugauccuggagggccuggacaacgugguggcccuggacuucgacagaguggagaagagacuguacuggaucgacacccagagacaggugaucgagagaauguuccugaacaagaccaacaaggagaccaucaucaaccacagacugcccgccgccgagagccuggccguggacugggugagcagaaagcuguacuggcuggacgccagacuggacggccuguucgugagcgaccugaacggcggccacagaagaaugcuggcccagcacugcguggacgccaacaacaccuucugcuucgacaaccccagaggccuggcccugcacccccaguacggcuaccuguacugggccgacuggggccacagagccuacaucggcagagugggcauggacggcaccaacaagagcgugaucaucagcaccaagcuggaguggcccaacggcaucaccaucgacuacaccaacgaccugcuguacugggccgacgcccaccugggcuacaucgaguacagcgaccuggagggccaccacagacacaccguguacgacggcgcccugccccaccccuucgccaucaccaucuucgaggacaccaucuacuggaccgacuggaacaccagaaccguggagaagggcaacaaguacgacggcagcaacagacagacccuggugaacaccacccacagacccuucgacauccacguguaccaccccuacagacagcccaucgugagcaaccccugcggcaccaacaacggcggcugcagccaccugugccugaucaagcccggcggcaagggcuucaccugcgagugccccgacgacuucagaacccugcagcugagcggcagcaccuacugcaugcccaugugcagcagcacccaguuccugugcgccaacaacgagaagugcauccccaucugguggaagugcgacggccagaaggacugcagcgacggcagcgacgagcuggcccugugcccccagagauucugcagacugggccaguuccagugcagcgacggcaacugcaccagcccccagacccugugcaacgcccaccagaacugccccgacggcagcgacgaggacagacugcugugcgagaaccaccacugcgacagcaacgaguggcagugcgccaacaagagaugcauccccgagagcuggcagugcgacaccuucaacgacugcgaggacaacagcgacgaggacagcagccacugcgccagcagaaccugcagacccggccaguucagaugcgccaacggcagaugcaucccccaggccuggaagugcgacguggacaacgacugcggcgaccacagcgacgagcccaucgaggagugcaugagcagcgcccaccugugcgacaacuucaccgaguucagcugcaagaccaacuacagaugcauccccaagugggccgugugcaacggcguggacgacugcagagacaacagcgacgagcagggcugcgaggagagaaccugccaccccgugggcgacuucagaugcaagaaccaccacugcaucccccugagauggcagugcgacggccagaacgacugcggcgacaacagcgacgaggagaacugcgcccccagagagugcaccgagagcgaguucagaugcgugaaccagcagugcauccccagcagauggaucugcgaccacuacaacgacugcggcgacaacagcgacgagagagacugcgagaugagaaccugccaccccgaguacuuccagugcaccagcggccacugcgugcacagcgagcugaagugcgacggcagcgccgacugccuggacgccagcgacgaggccgacugccccaccagauuccccgacggcgccuacugccaggccaccauguucgagugcaagaaccacgugugcaucccccccuacuggaagugcgacggcgacgacgacugcggcgacggcagcgacgaggagcugcaccugugccuggacgugcccugcaacagccccaacagauucagaugcgacaacaacagaugcaucuacagccacgaggugugcaacggcguggacgacugcggcgacggcaccgacgagaccgaggagcacugcagaaagcccacccccaagcccugcaccgaguacgaguacaagugcggcaacggccacugcaucccccacgacaacgugugcgacgacgccgacgacugcggcgacuggagcgacgagcugggcugcaacaagggcaaggagagaaccugcgccgagaacaucugcgagcagaacugcacccagcugaacgagggcggcuucaucugcagcugcaccgccggcuucgagaccaacguguucgacagaaccagcugccuggacaucaacgagugcgagcaguucggcaccugcccccagcacugcagaaacaccaagggcagcuacgagugcgugugcgccgacggcuucaccagcaugagcgacagacccggcaagagaugcgccgccgagggcagcagcccccugcugcugcugcccgacaacgugagaaucagaaaguacaaccugagcagcgagagauucagcgaguaccugcaggacgaggaguacauccaggccguggacuacgacugggaccccaaggacaucggccugagcgugguguacuacaccgugagaggcgagggcagcagauucggcgccaucaagagagccuacauccccaacuucgagagcggcagaaacaaccuggugcaggagguggaccugaagcugaaguacgugaugcagcccgacggcaucgccguggacugggugggcagacacaucuacuggagcgacgugaagaacaagagaaucgagguggccaagcuggacggcagauacagaaaguggcugaucagcaccgaccuggaccagcccgccgccaucgccgugaaccccaagcugggccugauguucuggaccgacuggggcaaggagcccaagaucgagagcgccuggaugaacggcgaggacagaaacauccugguguucgaggaccugggcuggcccaccggccugagcaucgacuaccugaacaacgacagaaucuacuggagcgacuucaaggaggacgugaucgagaccaucaaguacgacggcaccgacagaagagugaucgccaaggaggccaugaaccccuacagccuggacaucuucgaggaccagcuguacuggaucagcaaggagaagggcgagguguggaagcagaacaaguucggccagggcaagaaggagaagacccugguggugaaccccuggcugacccaggugagaaucuuccaccagcugagauacaacaagagcgugcccaaccugugcaagcagaucugcagccaccugugccugcugagacccggcggcuacagcugcgccugcccccagggcagcagcuucaucgagggcagcaccaccgagugcgacgccgccaucgagcugcccaucaaccugcccccccccugcagaugcaugcacggcggcaacugcuacuucgacgagaccgaccugcccaagugcaagugccccagcggcuacaccggcaaguacugcgagauggccuucagcaagggcaucagccccggcaccaccgccguggccgugcugcugaccauccugcugaucguggugaucggcgcccuggccaucgccggcuucuuccacuacagaagaaccggcagccugcugcccgcccugcccaagcugcccagccugagcagccuggugaagcccagcgagaacggcaacggcgugaccuucagaagcggcgccgaccugaacauggacaucggcgugagcggcuucggccccgagaccgccaucgacagaagcauggccaugagcgaggacuucgugauggagaugggcaagcagcccaucaucuucgagaaccccauguacagcgccagagacagcgccgugaagguggugcagcccauccaggugaccgugagcgagaacguggacaacaagaacuacggcagccccaucaaccccagcgagaucgugcccgagaccaaccccaccagccccgccgccgacggcacccaggugaccaaguggaaccuguucaagagaaagagcaagcagaccaccaacuucgagaaccccaucuacgcccagauggagaacgagcagaaggagagcguggccgccacccccccccccagccccagccugcccgccaagcccaagccccccagcagaagagaccccacccccaccuacagcgccaccgaggacaccuucaaggacaccgccaaccuggugaaggaggacagcgagguguaa

SEQ ID NO: 19390 - RNA, 5718 nt, Artificial Sequence
  LRP4__Homo_sapiens__NP_002325
augagaagacaguggggcgcccugcugcugggcgcccugcugugcgcccacggccuggccagcagccccgagugcgccugcggcagaagccacuucaccugcgccgugagcgcccugggcgagugcaccugcauccccgcccaguggcagugcgacggcgacaacgacugcggcgaccacagcgacgaggacggcugcauccugcccaccugcagcccccuggacuuccacugcgacaacggcaagugcaucagaagaagcugggugugcgacggcgacaacgacugcgaggacgacagcgacgagcaggacugcccccccagagagugcgaggaggacgaguuccccugccagaacggcuacugcaucagaagccuguggcacugcgacggcgacaacgacugcggcgacaacagcgacgagcagugcgacaugagaaagugcagcgacaaggaguucagaugcagcgacggcagcugcaucgccgagcacugguacugcgacggcgacaccgacugcaaggacggcagcgacgaggagaacugccccagcgccgugcccgccccccccugcaaccuggaggaguuccagugcgccuacggcagaugcauccuggacaucuaccacugcgacggcgacgacgacugcggcgacuggagcgacgagagcgacugcagcagccaccagcccugcagaagcggcgaguucaugugcgacagcggccugugcaucaacgccggcuggagaugcgacggcgacgccgacugcgacgaccagagcgacgagagaaacugcaccaccagcaugugcaccgccgagcaguucagaugccacagcggcagaugcgugagacugagcuggagaugcgacggcgaggacgacugcgccgacaacagcgacgaggagaacugcgagaacaccggcagcccccagugcgcccuggaccaguuccugugcuggaacggcagaugcaucggccagagaaagcugugcaacggcgugaacgacugcggcgacaacagcgacgagagcccccagcagaacugcagacccagaaccggcgaggagaacugcaacgugaacaacggcggcugcgcccagaagugccagauggugagaggcgccgugcagugcaccugccacaccggcuacagacugaccgaggacggccacaccugccaggacgugaacgagugcgccgaggagggcuacugcagccagggcugcaccaacagcgagggcgccuuccagugcuggugcgagaccggcuacgagcugagacccgacagaagaagcugcaaggcccugggccccgagcccgugcugcuguucgccaacagaaucgacaucagacaggugcugccccacagaagcgaguacacccugcugcugaacaaccuggagaacgccaucgcccuggacuuccaccacagaagagagcugguguucuggagcgacgugacccuggacagaauccugagagccaaccugaacggcagcaacguggaggagguggugagcaccggccuggagagccccggcggccuggccguggacugggugcacgacaagcuguacuggaccgacagcggcaccagcagaaucgagguggccaaccuggacggcgcccacagaaaggugcugcuguggcagaaccuggagaagcccagagccaucgcccugcaccccauggagggcaccaucuacuggaccgacuggggcaacacccccagaaucgaggccagcagcauggacggcagcggcagaagaaucaucgccgacacccaccuguucuggcccaacggccugaccaucgacuacgccggcagaagaauguacuggguggacgccaagcaccacgugaucgagagagccaaccuggacggcagccacagaaaggccgugaucagccagggccugccccaccccuucgccaucaccguguucgaggacagccuguacuggaccgacuggcacaccaagagcaucaacagcgccaacaaguucaccggcaagaaccaggagaucaucagaaacaagcugcacuuccccauggacauccacacccugcacccccagagacagcccgccggcaagaacagaugcggcgacaacaacggcggcugcacccaccugugccugcccagcggccagaacuacaccugcgccugccccaccggcuucagaaagaucagcagccacgccugcgcccagagccuggacaaguuccugcuguucgccagaagaauggacaucagaagaaucagcuucgacaccgaggaccugagcgacgacgugaucccccuggccgacgugagaagcgccguggcccuggacugggacagcagagacgaccacguguacuggaccgacgugagcaccgacaccaucagcagagccaagugggacggcaccggccaggagguggugguggacaccagccuggagagccccgccggccuggccaucgacugggugaccaacaagcuguacuggaccgacgccggcaccgacagaaucgagguggccaacaccgacggcagcaugagaaccgugcugaucugggagaaccuggacagacccagagacaucgugguggagcccaugggcggcuacauguacuggaccgacuggggcgccagccccaagaucgagagagccggcauggacgccagcggcagacaggugaucaucagcagcaaccugaccuggcccaacggccuggccaucgacuacggcagccagagacuguacugggccgacgccggcaugaagaccaucgaguucgccggccuggacggcagcaagagaaaggugcugaucggcagccagcugccccaccccuucggccugacccuguacggcgagagaaucuacuggaccgacuggcagaccaagagcauccagagcgccgacagacugaccggccuggacagagagacccugcaggagaaccuggagaaccugauggacauccacguguuccacagaagaagaccccccgugagcacccccugcgccauggagaacggcggcugcagccaccugugccugagaagccccaaccccagcggcuucagcugcaccugccccaccggcaucaaccugcugagcgacggcaagaccugcagccccggcaugaacagcuuccugaucuucgccagaagaaucgacaucagaauggugagccuggacauccccuacuucgccgacgugguggugcccaucaacaucaccaugaagaacaccaucgccaucggcguggacccccaggagggcaagguguacuggagcgacagcacccugcacagaaucagcagagccaaccuggacggcagccagcacgaggacaucaucaccaccggccugcagaccaccgacggccuggccguggacgccaucggcagaaagguguacuggaccgacaccggcaccaacagaaucgaggugggcaaccuggacggcagcaugagaaaggugcugguguggcagaaccuggacagccccagagccaucgugcuguaccacgagaugggcuucauguacuggaccgacuggggcgagaacgccaagcuggagagaagcggcauggacggcagcgacagagccgugcugaucaacaacaaccugggcuggcccaacggccugaccguggacaaggccagcagccagcugcugugggccgacgcccacaccgagagaaucgaggccgccgaccugaacggcgccaacagacacacccuggugagccccgugcagcaccccuacggccugacccugcuggacagcuacaucuacuggaccgacuggcagaccagaagcauccacagagccgacaagggcaccggcagcaacgugauccuggugagaagcaaccugcccggccugauggacaugcaggccguggacagagcccagccccugggcuucaacaagugcggcagcagaaacggcggcugcagccaccugugccugcccagacccagcggcuucagcugcgccugccccaccggcauccagcugaagggcgacggcaagaccugcgaccccagccccgagaccuaccugcuguucagcagcagaggcagcaucagaagaaucagccuggacaccagcgaccacaccgacgugcacgugcccgugcccgagcugaacaacgugaucagccuggacuacgacagcguggacggcaagguguacuacaccgacguguuccuggacgugaucagaagagccgaccugaacggcagcaacauggagaccgugaucggcagaggccugaagaccaccgacggccuggccguggacuggguggccagaaaccuguacuggaccgacaccggcagaaacaccaucgaggccagcagacuggacggcagcugcagaaaggugcugaucaacaacagccuggacgagcccagagccaucgccguguuccccagaaagggcuaccuguucuggaccgacuggggccacaucgccaagaucgagagagccaaccuggacggcagcgagagaaaggugcugaucaacaccgaccugggcuggcccaacggccugacccuggacuacgacaccagaagaaucuacuggguggacgcccaccuggacagaaucgagagcgccgaccugaacggcaagcugagacaggugcuggugagccacgugagccaccccuucgcccugacccagcaggacagauggaucuacuggaccgacuggcagaccaagagcauccagagaguggacaaguacagcggcagaaacaaggagaccgugcuggccaacguggagggccugauggacaucaucguggugagcccccagagacagaccggcaccaacgccugcggcgugaacaacggcggcugcacccaccugugcuucgccagagccagcgacuucgugugcgccugccccgacgagcccgacagcagacccugcagccuggugcccggccuggugccccccgcccccagagccaccggcaugagcgagaagagccccgugcugcccaacaccccccccaccacccuguacagcagcaccaccagaaccagaaccagccuggaggagguggagggcagaugcagcgagagagacgccagacugggccugugcgccagaagcaacgacgccgugcccgccgcccccggcgagggccugcacaucagcuacgccaucggcggccugcugagcauccugcugauccugguggugaucgccgcccugaugcuguacagacacaagaagagcaaguucaccgaccccggcaugggcaaccugaccuacagcaaccccagcuacagaaccagcacccaggaggugaagaucgaggccauccccaagcccgccauguacaaccagcugugcuacaagaaggagggcggccccgaccacaacuacaccaaggagaagaucaagaucguggagggcaucugccugcugagcggcgacgacgccgagugggacgaccugaagcagcugagaagcagcagaggcggccugcugagagaccacgugugcaugaagaccgacaccgugagcauccaggccagcagcggcagccuggacgacaccgagaccgagcagcugcugcaggaggagcagagcgagugcagcagcgugcacaccgccgccacccccgagagaagaggcagccugcccgacaccggcuggaagcacgagagaaagcugagcagcgagagccagguguaa

SEQ ID NO: 19391 - RNA, 4848 nt, Artificial Sequence
  LRP5__Homo_sapiens__NP_002326
auggaggccgccccccccggcccccccuggccccugcugcugcugcugcugcugcugcuggcccugugcggcugccccgcccccgccgccgccagcccccugcugcuguucgccaacagaagagacgugagacugguggacgccggcggcgugaagcuggagagcaccaucguggugagcggccuggaggacgccgccgccguggacuuccaguucagcaagggcgccguguacuggaccgacgugagcgaggaggccaucaagcagaccuaccugaaccagaccggcgccgccgugcagaacguggugaucagcggccuggugagccccgacggccuggccugcgacugggugggcaagaagcuguacuggaccgacagcgagaccaacagaaucgagguggccaaccugaacggcaccagcagaaaggugcuguucuggcaggaccuggaccagcccagagccaucgcccuggaccccgcccacggcuacauguacuggaccgacuggggcgagacccccagaaucgagagagccggcauggacggcagcaccagaaagaucaucguggacagcgacaucuacuggcccaacggccugaccaucgaccuggaggagcagaagcuguacugggccgacgccaagcugagcuucauccacagagccaaccuggacggcagcuucagacagaaggugguggagggcagccugacccaccccuucgcccugacccugagcggcgacacccuguacuggaccgacuggcagaccagaagcauccacgccugcaacaagagaaccggcggcaagagaaaggagauccugagcgcccuguacagccccauggacauccaggugcugagccaggagagacagcccuucuuccacaccagaugcgaggaggacaacggcggcugcagccaccugugccugcugagccccagcgagcccuucuacaccugcgccugccccaccggcgugcagcugcaggacaacggcagaaccugcaaggccggcgccgaggaggugcugcugcuggccagaagaaccgaccugagaagaaucagccuggacacccccgacuucaccgacaucgugcugcagguggacgacaucagacacgccaucgccaucgacuacgacccccuggagggcuacguguacuggaccgacgacgaggugagagccaucagaagagccuaccuggacggcagcggcgcccagacccuggugaacaccgagaucaacgaccccgacggcaucgccguggacuggguggccagaaaccuguacuggaccgacaccggcaccgacagaaucgaggugaccagacugaacggcaccagcagaaagauccuggugagcgaggaccuggacgagcccagagccaucgcccugcaccccgugaugggccugauguacuggaccgacuggggcgagaaccccaagaucgagugcgccaaccuggacggccaggagagaagagugcuggugaacgccagccugggcuggcccaacggccuggcccuggaccugcaggagggcaagcuguacuggggcgacgccaagaccgacaagaucgaggugaucaacguggacggcaccaagagaagaacccugcuggaggacaagcugccccacaucuucggcuucacccugcugggcgacuucaucuacuggaccgacuggcagagaagaagcaucgagagagugcacaaggugaaggccagcagagacgugaucaucgaccagcugcccgaccugaugggccugaaggccgugaacguggccaagguggugggcaccaaccccugcgccgacagaaacggcggcugcagccaccugugcuucuucaccccccacgccaccagaugcggcugccccaucggccuggagcugcugagcgacaugaagaccugcaucgugcccgaggccuuccugguguucaccagcagagccgccauccacagaaucagccuggagaccaacaacaacgacguggccaucccccugaccggcgugaaggaggccagcgcccuggacuucgacgugagcaacaaccacaucuacuggaccgacgugagccugaagaccaucagcagagccuucaugaacggcagcagcguggagcacgugguggaguucggccuggacuaccccgagggcauggccguggacuggaugggcaagaaccuguacugggccgacaccggcaccaacagaaucgagguggccagacuggacggccaguucagacaggugcugguguggagagaccuggacaaccccagaagccuggcccuggaccccaccaagggcuacaucuacuggaccgaguggggcggcaagcccagaaucgugagagccuucauggacggcaccaacugcaugacccugguggacaaggugggcagagccaacgaccugaccaucgacuacgccgaccagagacuguacuggaccgaccuggacaccaacaugaucgagagcagcaacaugcugggccaggagagaguggugaucgccgacgaccugccccaccccuucggccugacccaguacagcgacuacaucuacuggaccgacuggaaccugcacagcaucgagagagccgacaagaccagcggcagaaacagaacccugauccagggccaccuggacuucgugauggacauccugguguuccacagcagcagacaggacggccugaacgacugcaugcacaacaacggccagugcggccagcugugccuggccauccccggcggccacagaugcggcugcgccagccacuacacccuggaccccagcagcagaaacugcagcccccccaccaccuuccugcuguucagccagaagagcgccaucagcagaaugauccccgacgaccagcacagccccgaccugauccugccccugcacggccugagaaacgugaaggccaucgacuacgacccccuggacaaguucaucuacuggguggacggcagacagaacaucaagagagccaaggacgacggcacccagcccuucgugcugaccagccugagccagggccagaaccccgacagacagccccacgaccugagcaucgacaucuacagcagaacccuguucuggaccugcgaggccaccaacaccaucaacgugcacagacugagcggcgaggccaugggcguggugcugagaggcgacagagacaagcccagagccaucguggugaacgccgagagaggcuaccuguacuucaccaacaugcaggacagagccgccaagaucgagagagccgcccuggacggcaccgagagagaggugcuguucaccaccggccugaucagacccguggcccuggugguggacaacacccugggcaagcuguucuggguggacgccgaccugaagagaaucgagagcugcgaccugagcggcgccaacagacugacccuggaggacgccaacaucgugcagccccugggccugaccauccugggcaagcaccuguacuggaucgacagacagcagcagaugaucgagagaguggagaagaccaccggcgacaagagaaccagaauccagggcagaguggcccaccugaccggcauccacgccguggaggaggugagccuggaggaguucagcgcccaccccugcgccagagacaacggcggcugcagccacaucugcaucgccaagggcgacggcacccccagaugcagcugccccgugcaccuggugcugcugcagaaccugcugaccugcggcgagccccccaccugcagccccgaccaguucgccugcgccaccggcgagaucgacugcauccccggcgccuggagaugcgacggcuuccccgagugcgacgaccagagcgacgaggagggcugccccgugugcagcgccgcccaguuccccugcgccagaggccagugcguggaccugagacugagaugcgacggcgaggccgacugccaggacagaagcgacgaggccgacugcgacgccaucugccugcccaaccaguucagaugcgccagcggccagugcgugcugaucaagcagcagugcgacagcuuccccgacugcaucgacggcagcgacgagcugaugugcgagaucaccaagccccccagcgacgacagccccgcccacagcagcgccaucggccccgugaucggcaucauccugagccuguucgugaugggcggcguguacuucgugugccagagaguggugugccagagauacgccggcgccaacggccccuucccccacgaguacgugagcggcaccccccacgugccccugaacuucaucgcccccggcggcagccagcacggccccuucaccggcaucgccugcggcaagagcaugaugagcagcgugagccugaugggcggcagaggcggcgugccccuguacgacagaaaccacgugaccggcgccagcagcagcagcagcagcagcaccaaggccacccuguacccccccauccugaaccccccccccagccccgccaccgaccccagccuguacaacauggacauguucuacagcagcaacauccccgccaccgccagacccuacagacccuacaucaucagaggcauggccccccccaccacccccugcagcaccgacgugugcgacagcgacuacagcgccagcagauggaaggccagcaaguacuaccuggaccugaacagcgacagcgaccccuacccccccccccccaccccccacagccaguaccugagcgccgaggacagcugcccccccagccccgccaccgagagaagcuacuuccaccuguucccccccccccccagccccugcaccgacagcagcuaa

SEQ ID NO: 19392 - RNA, 4842 nt, Artificial Sequence
  LRP6__Homo_sapiens__NP_002327
augggcgccgugcugagaagccugcuggccugcagcuucugcgugcugcugagagccgccccccugcugcuguacgccaacagaagagaccugagacugguggacgccaccaacggcaaggagaacgccaccaucguggugggcggccuggaggacgccgccgccguggacuucguguucagccacggccugaucuacuggagcgacgugagcgaggaggccaucaagagaaccgaguucaacaagaccgagagcgugcagaacgugguggugagcggccugcugagccccgacggccuggccugcgacuggcugggcgagaagcuguacuggaccgacagcgagaccaacagaaucgaggugagcaaccuggacggcagccugagaaaggugcuguucuggcaggagcuggaccagcccagagccaucgcccuggaccccagcagcggcuucauguacuggaccgacuggggcgaggugcccaagaucgagagagccggcauggacggcagcagcagauucaucaucaucaacagcgagaucuacuggcccaacggccugacccuggacuacgaggagcagaagcuguacugggccgacgccaagcugaacuucauccacaagagcaaccuggacggcaccaacagacaggccguggugaagggcagccugccccaccccuucgcccugacccuguucgaggacauccuguacuggaccgacuggagcacccacagcauccuggccugcaacaaguacaccggcgagggccugagagagauccacagcgacaucuucagccccauggacauccacgccuucagccagcagagacagcccaacgccaccaaccccugcggcaucgacaacggcggcugcagccaccugugccugaugagccccgugaagcccuucuaccagugcgccugccccaccggcgugaagcugcuggagaacggcaagaccugcaaggacggcgccaccgagcugcugcugcuggccagaagaaccgaccugagaagaaucagccuggacacccccgacuucaccgacaucgugcugcagcuggaggacaucagacacgccaucgccaucgacuacgaccccguggagggcuacaucuacuggaccgacgacgaggugagagccaucagaagaagcuucaucgacggcagcggcagccaguucguggugaccgcccagaucgcccaccccgacggcaucgccguggacuggguggccagaaaccuguacuggaccgacaccggcaccgacagaaucgaggugaccagacugaacggcaccaugagaaagauccugaucagcgaggaccuggaggagcccagagccaucgugcuggaccccauggugggcuacauguacuggaccgacuggggcgagauccccaagaucgagagagccgcccuggacggcagcgacagaguggugcuggugaacaccagccugggcuggcccaacggccuggcccuggacuacgacgagggcaagaucuacuggggcgacgccaagaccgacaagaucgaggugaugaacaccgacggcaccggcagaagagugcugguggaggacaagaucccccacaucuucggcuucacccugcugggcgacuacguguacuggaccgacuggcagagaagaagcaucgagagagugcacaagagaagcgccgagagagaggugaucaucgaccagcugcccgaccugaugggccugaaggccaccaacgugcacagagugaucggcagcaaccccugcgccgaggagaacggcggcugcagccaccugugccuguacagaccccagggccugagaugcgccugccccaucggcuucgagcugaucagcgacaugaagaccugcaucgugcccgaggccuuccugcuguucagcagaagagccgacaucagaagaaucagccuggagaccaacaacaacaacguggccaucccccugaccggcgugaaggaggccagcgcccuggacuucgacgugaccgacaacagaaucuacuggaccgacaucagccugaagaccaucagcagagccuucaugaacggcagcgcccuggagcacgugguggaguucggccuggacuaccccgagggcauggccguggacuggcugggcaagaaccuguacugggccgacaccggcaccaacagaaucgaggugagcaagcuggacggccagcacagacaggugcugguguggaaggaccuggacagccccagagcccuggcccuggaccccgccgagggcuucauguacuggaccgaguggggcggcaagcccaagaucgacagagccgccauggacggcagcgagagaaccacccuggugcccaacgugggcagagccaacggccugaccaucgacuacgccaagagaagacuguacuggaccgaccuggacaccaaccugaucgagagcagcaacaugcugggccugaacagagaggugaucgccgacgaccugccccaccccuucggccugacccaguaccaggacuacaucuacuggaccgacuggagcagaagaagcaucgagagagccaacaagaccagcggccagaacagaaccaucauccagggccaccuggacuacgugauggacauccugguguuccacagcagcagacagagcggcuggaacgagugcgccagcagcaacggccacugcagccaccugugccuggccgugcccgugggcggcuucgugugcggcugccccgcccacuacagccugaacgccgacaacagaaccugcagcgcccccaccaccuuccugcuguucagccagaagagcgccaucaacagaauggugaucgacgagcagcagagccccgacaucauccugcccauccacagccugagaaacgugagagccaucgacuacgacccccuggacaagcagcuguacuggaucgacagcagacagaacaugaucagaaaggcccaggaggacggcagccagggcuucaccgugguggugagcagcgugcccagccagaaccuggagauccagcccuacgaccugagcaucgacaucuacagcagauacaucuacuggaccugcgaggccaccaacgugaucaacgugaccagacuggacggcagaagcgugggcguggugcugaagggcgagcaggacagacccagagccgugguggugaaccccgagaagggcuacauguacuucaccaaccugcaggagagaagccccaagaucgagagagccgcccuggacggcaccgagagagaggugcuguucuucagcggccugagcaagcccaucgcccuggcccuggacagcagacugggcaagcuguucugggccgacagcgaccugagaagaaucgagagcagcgaccugagcggcgccaacagaaucgugcuggaggacagcaacauccugcagcccgugggccugaccguguucgagaacuggcuguacuggaucgacaagcagcagcagaugaucgagaagaucgacaugaccggcagagagggcagaaccaaggugcaggccagaaucgcccagcugagcgacauccacgccgugaaggagcugaaccugcaggaguacagacagcaccccugcgcccaggacaacggcggcugcagccacaucugccuggugaagggcgacggcaccaccagaugcagcugccccaugcaccuggugcugcugcaggacgagcugagcugcggcgagccccccaccugcagcccccagcaguucaccugcuucaccggcgagaucgacugcauccccguggccuggagaugcgacggcuucaccgagugcgaggaccacagcgacgagcugaacugccccgugugcagcgagagccaguuccagugcgccagcggccagugcaucgacggcgcccugagaugcaacggcgacgccaacugccaggacaagagcgacgagaagaacugcgaggugcugugccugaucgaccaguucagaugcgccaacggccagugcaucggcaagcacaagaagugcgaccacaacguggacugcagcgacaagagcgacgagcuggacugcuaccccaccgaggagcccgccccccaggccaccaacaccgugggcagcgugaucggcgugaucgugaccaucuucgugagcggcaccguguacuucaucugccagagaaugcugugccccagaaugaagggcgacggcgagaccaugaccaacgacuacguggugcacggccccgccagcgugccccugggcuacgugccccaccccagcagccugagcggcagccugcccggcaugagcagaggcaagagcaugaucagcagccugagcaucaugggcggcagcagcggcccccccuacgacagagcccacgugaccggcgccagcagcagcagcagcagcagcaccaagggcaccuacuuccccgccauccugaaccccccccccagccccgccaccgagagaagccacuacaccauggaguucggcuacagcagcaacagccccagcacccacagaagcuacagcuacagacccuacagcuacagacacuucgccccccccaccacccccugcagcaccgacgugugcgacagcgacuacgcccccagcagaagaaugaccagcguggccaccgccaagggcuacaccagcgaccugaacuacgacagcgagcccgugccccccccccccacccccagaagccaguaccugagcgccgaggagaacuacgagagcugcccccccagccccuacaccgagagaagcuacagccaccaccuguacccccccccccccagccccugcaccgacagcagcuaa

SEQ ID NO: 19393 - RNA, 1074 nt, Artificial Sequence
  LRPAP1__Homo_sapiens__NP_002328
auggcccccagaagagugagaagcuuccugagaggccugcccgcccugcugcugcugcugcuguuccugggccccuggcccgccgccagccacggcggcaaguacagcagagagaagaaccagcccaagcccagccccaagagagagagcggcgaggaguucagaauggagaagcugaaccagcugugggagaaggcccagagacugcaccugccccccgugagacuggccgagcugcacgccgaccugaagauccaggagagagacgagcuggccuggaagaagcugaagcuggacggccuggacgaggacggcgagaaggaggccagacugaucagaaaccugaacgugauccuggccaaguacggccuggacggcaagaaggacgccagacaggugaccagcaacagccugagcggcacccaggaggacggccuggacgaccccagacuggagaagcuguggcacaaggccaagaccagcggcaaguucagcggcgaggagcuggacaagcuguggagagaguuccugcaccacaaggagaaggugcacgaguacaacgugcugcuggagacccugagcagaaccgaggagauccacgagaacgugaucagccccagcgaccugagcgacaucaagggcagcgugcugcacagcagacacaccgagcugaaggagaagcugagaagcaucaaccagggccuggacagacugagaagagugagccaccagggcuacagcaccgaggccgaguucgaggagcccagagugaucgaccugugggaccuggcccagagcgccaaccugaccgacaaggagcuggaggccuucagagaggagcugaagcacuucgaggccaagaucgagaagcacaaccacuaccagaagcagcuggagaucgcccacgagaagcugagacacgccgagagcgugggcgacggcgagagagugagcagaagcagagagaagcacgcccugcuggagggcagaaccaaggagcugggcuacaccgugaagaagcaccugcaggaccugagcggcagaaucagcagagccagacacaacgagcuguaa

SEQ ID NO: 19394 - RNA, 4185 nt, Artificial Sequence
  LRPPRC__Homo_sapiens__NP_573566
auggccgcccugcugagaagcgccagauggcugcugagagccggcgccgcccccagacugccccugagccugagacugcugcccggcggccccggcagacugcacgccgccagcuaccugcccgccgccagagccggccccguggccggcggccugcugagccccgccagacuguacgccaucgccgccaaggagaaggacauccaggaggagagcaccuucagcagcagaaagaucagcaaccaguucgacugggcccugaugagacuggaccugagcgugagaagaaccggcagaauccccaagaagcugcugcagaagguguucaacgacaccugcagaagcggcggccugggcggcagccacgcccugcugcugcugagaagcugcggcagccugcugcccgagcugaagcuggaggagagaaccgaguucgcccacagaaucugggacacccugcagaagcugggcgccguguacgacgugagccacuacaacgcccugcugaagguguaccugcagaacgaguacaaguucagccccaccgacuuccuggccaagauggaggaggccaacauccagcccaacagagugaccuaccagagacugaucgccagcuacugcaacgugggcgacaucgagggcgccagcaagauccugggcuucaugaagaccaaggaccugcccgugaccgaggccguguucagcgcccuggugaccggccacgccagagccggcgacauggagaacgccgagaacauccugaccgugaugagagacgccggcaucgagcccggccccgacaccuaccuggcccugcugaacgccuacgccgagaagggcgacaucgaccacgugaagcagacccuggagaagguggagaagagcgagcugcaccugauggacagagaccugcugcagaucaucuucagcuucagcaaggccggcuacccccaguacgugagcgagauccuggagaaggugaccugcgagagaagauacauccccgacgccaugaaccugauccugcugcuggugaccgagaagcuggaggacguggcccugcagauccugcuggccugccccgugagcaaggaggacggccccagcguguucggcagcuucuuccugcagcacugcgugaccaugaacacccccguggagaagcugaccgacuacugcaagaagcugaaggaggugcagaugcacagcuucccccugcaguucacccugcacugcgcccugcuggccaacaagaccgaccuggccaaggcccugaugaaggccgugaaggaggagggcuuccccaucagaccccacuacuucuggccccugcuggugggcagaagaaaggagaagaacgugcagggcaucaucgagauccugaagggcaugcaggagcugggcgugcaccccgaccaggagaccuacaccgacuacgugauccccugcuucgacagcgugaacagcgccagagccauccugcaggagaacggcugccugagcgacagcgacauguucagccaggccggccugagaagcgaggccgccaacggcaaccuggacuucgugcugagcuuccugaagagcaacacccugcccaucagccugcagagcaucagaagcagccugcugcugggcuucagaagaagcaugaacaucaaccuguggagcgagaucaccgagcugcuguacaaggacggcagauacugccaggagcccagaggccccaccgaggccgugggcuacuuccuguacaaccugaucgacagcaugagcgacagcgaggugcaggccaaggaggagcaccugagacaguacuuccaccagcuggagaagaugaacgugaagauccccgagaacaucuacagaggcaucagaaaccugcuggagagcuaccacgugcccgagcugaucaaggacgcccaccugcugguggagagcaagaaccuggacuuccagaagaccgugcagcugaccagcagcgagcuggagagcacccuggagacccugaaggccgagaaccagcccaucagagacgugcugaagcagcugauccuggugcugugcagcgaggagaacaugcagaaggcccuggagcugaaggccaaguacgagagcgacauggugaccggcggcuacgccgcccugaucaaccugugcugcagacacgacaagguggaggacgcccugaaccugaaggaggaguucgacagacuggacagcagcgccgugcuggacaccggcaaguacgugggccuggugagagugcuggccaagcacggcaagcugcaggacgccaucaacauccugaaggagaugaaggagaaggacgugcugaucaaggacaccaccgcccugagcuucuuccacaugcugaacggcgccgcccugagaggcgagaucgagaccgugaagcagcugcacgaggccaucgugacccugggccuggccgagcccagcaccaacaucagcuucccccuggugaccgugcaccuggagaagggcgaccugagcaccgcccuggagguggccaucgacugcuacgagaaguacaaggugcugcccagaauccacgacgugcugugcaagcugguggagaagggcgagaccgaccugauccagaaggccauggacuucgugagccaggagcagggcgagauggugaugcuguacgaccuguucuucgccuuccugcagaccggcaacuacaaggaggccaagaagaucaucgagacccccggcaucagagccagaagcgccagacugcagugguucugcgacagaugcguggccaacaaccagguggagacccuggagaagcugguggagcugacccagaagcuguucgagugcgacagagaccagauguacuacaaccugcugaagcuguacaagaucaacggcgacuggcagagagccgacgccguguggaacaagauccaggaggagaacgugauccccagagagaagacccugagacugcuggccgagauccugagagagggcaaccaggaggugcccuucgacgugcccgagcugugguacgaggacgagaagcacagccugaacagcagcagcgccagcaccaccgagcccgacuuccagaaggacauccugaucgccugcagacugaaccagaagaagggcgccuacgacaucuuccugaacgccaaggagcagaacaucguguucaacgccgagaccuacagcaaccugaucaagcugcugaugagcgaggacuacuucacccaggccauggaggugaaggccuucgccgagacccacaucaagggcuucacccugaacgacgccgccaacagcagacugaucaucacccaggugagaagagacuaccugaaggaggccgugaccacccugaagaccgugcuggaccagcagcagacccccagcagacuggccgugaccagagugauccaggcccuggccaugaagggcgacguggagaacaucgagguggugcagaagaugcugaacggccuggaggacagcaucggccugagcaagaugguguucaucaacaacaucgcccuggcccagaucaagaacaacaacaucgacgccgccaucgagaacaucgagaacaugcugaccagcgagaacaaggugaucgagccccaguacuucggccuggccuaccuguucagaaaggugaucgaggagcagcuggagcccgccguggagaagaucagcaucauggccgagagacuggccaaccaguucgccaucuacaagcccgugaccgacuucuuccugcagcugguggacgccggcaagguggacgacgccagagcccugcugcagagaugcggcgccaucgccgagcagacccccauccugcugcuguuccugcugagaaacagcagaaagcagggcaaggccagcaccgugaagagcgugcuggagcugauccccgagcugaacgagaaggaggaggccuacaacagccugaugaagagcuacgugagcgagaaggacgugaccagcgccaaggcccuguacgagcaccugaccgccaagaacaccaagcuggacgaccuguuccugaagagauacgccagccugcugaaguacgccggcgagcccgugcccuucaucgagccccccgagagcuucgaguucuacgcccagcagcugagaaagcugagagagaacagcagcuaa

SEQ ID NO: 19395 - RNA, 1245 nt, Artificial Sequence
  LRR1__Homo_sapiens__NP_689542
augaagcugcacugcgagguggaggugaucagcagacaccugcccgcccugggccugagaaacagaggcaagggcgugagagccgugcugagccugugccagcagaccagcagaagccagccccccgugagagccuuccugcugaucagcacccugaaggacaagagaggcaccagauacgagcugagagagaacaucgagcaguucuucaccaaguucguggacgagggcaaggccaccgugagacugaaggagccccccguggacaucugccugagcaaggccaucagcagcagccugaagggcuuccugagcgccaugagacuggcccacagaggcugcaacguggacacccccgugagcacccugacccccgugaagaccagcgaguucgagaacuucaagaccaagauggugaucaccagcaagaaggacuacccccugagcaagaacuuccccuacagccuggagcaccugcagaccagcuacugcggccuggugagaguggacaugagaaugcugugccugaagagccugagaaagcuggaccugagccacaaccacaucaagaagcugcccgccaccaucggcgaccugauccaccugcaggagcugaaccugaacgacaaccaccuggagagcuucagcguggcccugugccacagcacccugcagaagagccugagaagccuggaccugagcaagaacaagaucaaggcccugcccgugcaguucugccagcugcaggagcugaagaaccugaagcuggacgacaacgagcugauccaguuccccugcaagaucggccagcugaucaaccugagauuccugagcgccgccagaaacaagcugcccuuccugcccagcgaguucagaaaccugagccuggaguaccuggaccuguucggcaacaccuucgagcagcccaaggugcugcccgugaucaagcugcaggccccccugacccugcuggagagcagcgccagaaccauccugcacaacagaauccccuacggcagccacaucauccccuuccaccugugccaggaccuggacaccgccaagaucugcgugugcggcagauucugccugaacagcuucauccagggcaccaccaccaugaaccugcacagcguggcccacaccguggugcugguggacaaccugggcggcaccgaggcccccaucaucagcuacuucugcagccugggcugcuacgugaacagcagcgacaugcugaaguaa

SEQ ID NO: 19396 - RNA, 1764 nt, Artificial Sequence
  LRRC15__Homo_sapiens__NP_001128529
augccccuggacaaggccaugccccugaagcacuaccugcugcugcuggugggcugccaggccuggggcgccggccuggccuaccacggcugccccagcgagugcaccugcagcagagccagccagguggagugcaccggcgccagaaucguggccgugcccaccccccugcccuggaacgccaugagccugcagauccugaacacccacaucaccgagcugaacgagagccccuuccugaacaucagcgcccugaucgcccugagaaucgagaagaacgagcugagcagaaucacccccggcgccuucagaaaccugggcagccugagauaccugagccuggccaacaacaagcugcaggugcugcccaucggccuguuccagggccuggacagccuggagagccugcugcugagcagcaaccagcugcugcagauccagcccgcccacuucagccagugcagcaaccugaaggagcugcagcugcacggcaaccaccuggaguacauccccgacggcgccuucgaccaccuggugggccugaccaagcugaaccugggcaagaacagccugacccacaucagccccagaguguuccagcaccugggcaaccugcaggugcugagacuguacgagaacagacugaccgacauccccaugggcaccuucgacggccuggugaaccugcaggagcuggcccugcagcagaaccagaucggccugcugagccccggccuguuccacaacaaccacaaccugcagagacuguaccugagcaacaaccacaucagccagcugccccccagcguguucaugcagcugccccagcugaacagacugacccuguucggcaacagccugaaggagcugagccccggcaucuucggccccaugcccaaccugagagagcuguggcuguacgacaaccacaucagcagccugcccgacaacguguucagcaaccugagacagcugcaggugcugauccugagcagaaaccagaucagcuucaucagccccggcgccuucaacggccugaccgagcugagagagcugagccugcacaccaacgcccugcaggaccuggacggcaacguguucagaaugcuggccaaccugcagaacaucagccugcagaacaacagacugagacagcugcccggcaacaucuucgccaacgugaacggccugauggccauccagcugcagaacaaccagcuggagaaccugccccugggcaucuucgaccaccugggcaagcugugcgagcugagacuguacgacaaccccuggagaugcgacagcgacauccugccccugagaaacuggcugcugcugaaccagcccagacugggcaccgacaccgugcccgugugcuucagccccgccaacgugagaggccagagccugaucaucaucaacgugaacguggccgugcccagcgugcacgugcccgaggugcccagcuaccccgagacccccugguaccccgacacccccagcuaccccgacaccaccagcgugagcagcaccaccgagcugaccagccccguggaggacuacaccgaccugaccaccauccaggugaccgacgacagaagcguguggggcaugacccaggcccagagcggccuggccaucgccgccaucgugaucggcaucguggcccuggccugcagccuggccgccugcgugggcugcugcugcugcaagaagagaagccaggccgugcugaugcagaugaaggcccccaacgagugcuaa

SEQ ID NO: 19397 - RNA, 4098 nt, Artificial Sequence
  LRRC16A__Homo_sapiens__NP_001167448
augaccgaggagagcagcgacgugcccagagagcugaucgagagcaucaaggacgugaucggcagaaagaucaagaucagcgugaagaagaaggugaagcuggaggugaagggcgacaagguggagaacaaggugcuggugcugaccagcugcagagccuuccuggugaccgccagaauccccaccaagcuggagcugaccuucagcuaccuggagauccacggcguggugugcagcaagagcgcccagaugaucguggagaccgagaagugcagcaucagcaugaagauggccagccccgaggacgugagcgaggugcuggcccacaucggcaccugccugagaaagaucuuccccggccugagccccgugagaaucaugaagaaggugagcauggagcccagcgagagacuggccagccugcaggcccugugggacagccagaccguggccgagcagggccccugcggcggcuucagccagauguacgccugcgugugcgacuggcugggcuucagcuacagagaggaggugcagugggacguggacaccaucuaccugacccaggacaccagagagcugaaccugcaggacuucagccaccuggaccacagagaccugauccccaucaucgccgcccuggaguacaaccagugguucaccaagcugagcagcaaggaccugaagcugagcaccgacgugugcgagcagauccugagaguggugagcagaagcaacagacuggaggagcuggugcuggagaacgccggccugagaaccgacuucgcccagaagcuggccagcgcccuggcccacaaccccaacagcggccugcacaccaucaaccuggccggcaacccccuggaggacagaggcgugagcagccugagcauccaguucgccaagcugcccaagggccugaagcaccugaaccugagcaagaccagccugagccccaagggcgugaacagccugagccagagccugagcgccaacccccugaccgccagcacccuggugcaccuggaccugagcggcaacgugcugagaggcgacgaccugagccacauguacaacuuccuggcccagcccaacgccaucgugcaccuggaccugagcaacaccgagugcagccuggacauggugugcggcgcccugcugagaggcugccugcaguaccuggccgugcugaaccugagcagaaccguguucagccacagaaagggcaaggaggugccccccagcuucaagcaguucuucagcagcagccuggcccugaugcacaucaaccugagcggcaccaagcugagccccgagccccugaaggcccugcugcugggccuggccugcaaccacaaccugaagggcgugagccuggaccugagcaacugcgagcugagaagcggcggcgcccaggugcuggagggcugcaucgccgagauccacaacaucaccagccuggacaucagcgacaacggccuggagagcgaccugagcacccugaucguguggcugagcaagaacagaagcauccagcaccuggcccugggcaagaacuucaacaacaugaagagcaagaaccugacccccgugcuggacaaccuggugcagaugauccaggacgaggagagcccccugcagagccugagccuggccgacagcaagcugaagaccgaggugaccaucaucaucaacgcccugggcagcaacaccagccugaccaagguggacaucagcggcaacggcaugggcgacaugggcgccaagaugcuggccaaggcccugcagaucaacaccaagcugagaaccgugaucugggacaagaacaacaucaccgcccagggcuuccaggacaucgccguggccauggagaagaacuacacccugagauucaugcccauccccauguacgacgccagccaggcccugaagaccaaccccgagaagaccgaggacgcccugcagaagaucgagaacuaccugcugagaaaccacgagaccagaaaguaccugcaggagcaggccuacagacugcagcagggcaucgugaccagcaccacccagcagaugaucgacagaaucugcgugaaggugcaggaccaccugaacagccugagaaacugcggcggcgacgccauccaggaggaccugaagagcgccgagagacugaugagagacgccaagaacagcaagacccugcugcccaaccuguaccacgugggcggcgccagcugggccggcgccagcggccugcugagcagccccauccaggagacccuggagagcauggccggcgaggugaccagagugguggacgagcagcugaaggcccugcuggagagcaugguggacgccgccgagaaccugugccccaacgugaugaagaaggcccacaucagacaggaccugauccacgccagcaccgagaagaucagcauccccagaaccuucgugaagaacgugcugcuggagcagagcggcaucgacauccugaacaagaucagcgaggugaagcugaccguggccagcuuccugagcgacagaaucguggacgagauccuggacgcccugagccacugccaccacaagcuggccgaccacuucagcagaagaggcaagacccugccccagcaggagagccuggagaucgagcuggccgaggagaagcccgugaagagaagcaucaucaccguggaggagcugaccgagaucgagagacuggaggaccuggacaccugcaugaugacccccaagagcaagagaaagagcauccacagcagaaugcugagacccgugagcagagccuucgagauggaguucgaccuggacaaggcccuggaggaggugcccauccacaucgaggacccccccuuccccagccugagacaggagaagagaagcagcggcuucaucagcgagcugcccagcgaggagggcaagaagcuggagcacuucaccaagcugagacccaagagaaacaagaagcagcagcccacccaggccgccgugugcgccgccaacaucgugagccaggacggcgagcagaacggccugaugggcagaguggacgagggcguggacgaguucuucaccaagaaggugaccaagauggacagcaagaaguggagcaccagaggcagcgagagccacgagcugaacgagggcggcgacgagaagaagaagagagacagcagaaagagcagcggcuuccugaaccugaucaagagcagaagcaagagcgagagaccccccaccauccugaugaccgaggagcccagcagccccaagggcgccgugagaagcccccccguggacugccccagaaaggacaccaaggccgccgagcacaacggcaacagcgagagaaucgaggagaucaagacccccgacagcuucgaggagagccagggcgaggagaucggcaagguggagagaagcgacagcaagagcagcccccaggccggcagaagauacggcgugcaggugaugggcagcggccugcuggccgagaugaaggccaagcaggagaagagagccgccugcgcccagaagaagcugggcaacgacgccgugagccaggacagcagcagccccgcccugagcggcguggagagaagcgacggcggcggcgccggccugcccgagaacagauucggccugggcacccccgagaagaacaccaaggccgagcccaaggccgaggccggcagcagaagcagaagcagcagcagcacccccaccagccccaagccccugcugcagagccccaagcccagccuggccgccagacccgugaucccccagaagcccagaaccgccagcagacccgacgacauccccgacagccccagcagccccaagguggcccugcugccccccgugcugaagaaggugcccagcgacaaggagagagacggccagagcagcccccagcccagccccagaaccuucagccaggaggugagcagaagaagcuggggccagcaggcccaggaguaccaggagcagaagcagagaagcagcagcaaggacggccaccagggcagcaagagcaacgacagcggcgaggaggccgagaaggaguucaucuucguguaa

SEQ ID NO: 19398 - RNA, 4119 nt, Artificial Sequence
  LRRC16B__Homo_sapiens__NP_612369
auggccaagcccagcguggagcugaccagagagcugcaggacagcaucagaagaugccugagccagggcgccgugcugcagcagcaccacgugaagcuggagaccaagcccaagaaguucgaggacagagugcuggcccugaccagcuggagacugcaccuguuccugcugaaggugcccgccaagguggagagcagcuucaacgugcuggagaucagagccuucaacacccugagccagaaccagauccugguggagaccgagagaggcauggugagcaugagacugcccagcgccgagagcguggaccaggugaccagacacgugagcagcgcccugagcaaggugugccccggccccggcugccugaucagaagaggcaacgccgacacccccgagggccccagagacaccagccccaacagcgagaccagcaccagcaccacccacagcgugugcggcggcuucagcgagaccuacgccgcccugugcgacuacaacggccugcacugcagagaggaggugcagugggacguggacaccaucuaccacgccgaggacaacagagaguucaaccugcuggacuucagccaccuggagagcagagaccuggcccugaugguggccgcccuggccuacaaccagugguucaccaagcuguacugcaaggaccugagacugggcagcgaggugcuggagcaggugcugcacacccugagcaagagcggcagccuggaggagcuggugcuggacaacgccggccugaagaccgacuucgugcagaagcuggccggcguguucggcgagaacggcagcugcgugcugcacgcccugacccugagccacaaccccaucgaggacaagggcuuccugagccugagccagcagcugcugugcuuccccagcggccugaccaagcugugccuggccaagaccgccaucagccccagaggccugcaggcccugggccagaccuucggcgccaaccccgccuucgccagcagccugagauaccuggaccugagcaagaaccccggccugcuggccaccgacgaggccaacgcccuguacagcuuccuggcccagcccaacgcccuggugcaccuggaccugagcggcaccgacugcgugaucgaccugcugcugggcgcccugcugcacggcugcugcagccaccugaccuaccugaaccuggccagaaacagcugcagccacagaaagggcagagaggccccccccgccuucaagcaguucuucagcagcgccuacacccugagccacgugaaccugagcgccaccaagcugccccuggaggcccugagagcccugcugcagggccugagccugaacagccaccugagcgaccugcaccuggaccugagcagcugcgagcugagaagcgccggcgcccaggcccugcaggagcagcugggcgccgugaccugcgugggcagccuggaccugagcgacaacggcuucgacagcgaccugcugacccuggugcccgcccugggcaagaacaagagccugaagcaccuguuccugggcaagaacuucaacgugaaggccaagacccuggaggagauccugcacaagcuggugcagcugauccaggaggaggacugcagccugcagagccugagcguggccgacagcagacugaagcugagaaccagcauccugaucaacgcccugggcagcaacaccugccuggccaagguggaccugagcggcaacggcauggaggacaucggcgccaagaugcugagcaaggcccugcagaucaacagcagccugagaaccauccugugggacagaaacaacaccagcgcccugggcuuccuggacaucgccagagcccuggagagcaaccacacccugagauucaugagcuuccccgugagcgacaucagccaggccuacagaagcgcccccgagagaaccgaggacguguggcagaagauccaguggugccuggugagaaacaaccacagccagaccugcccccaggagcaggccuucagacugcagcagggccuggugaccagcagcgccgagcagaugcugcagagacugugcggcagagugcaggaggaggugagagcccugagacugugcccccuggagcccgugcaggacgagcugcuguacgccagagaccugaucaaggacgccaagaacagcagagcccuguuccccagccuguacgagcugggccacgugcuggccaacgacggccccgugagacagagacuggagagcguggccagcgaggugagcaaggccguggacaaggagcugcaggugauccuggagagcauggugagccugacccaggagcugugccccguggccaugagaguggccgagggccacaacaagaugcugagcaacguggccgagagagugaccgugcccagaaacuucaucagaggcgcccugcuggagcaggccggccaggacauccagaacaagcuggacgaggugaagcugagcguggugaccuaccugaccagcagcaucguggacgagauccugcaggagcuguaccacagccacaagagccuggccagacaccugacccagcugagaacccugagcgacccccccggcugccccggccagggccaggaccugagcagcagaggcagaggcagaaaccacgaccacgaggagaccaccgacgacgagcugggcaccaacaucgacaccauggccaucaagaagcagaagagaugcagaaagaucagacccgugagcgccuucaucagcggcagcccccaggacauggagagccagcugggcaaccugggcaucccccccggcugguucagcggccugggcggcagccagcccaccgccagcggcagcugggagggccugagcgagcugcccacccacggcuacaagcugagacaccagacccagggcagacccagaccccccagaaccaccccccccggccccggcagacccagcaugcccgcccccggcaccagacaggagaacggcauggccaccagacuggacgagggccuggaggacuucuucagcagaagagugcuggaggagagcagcagcuaccccagaacccugagaaccgugagacccggccugagcgaggccccccugcccccccugcagaagaagagaagaagaggccuguuccacuucagaagacccagaagcuucaagggcgacagaggccccggcagccccaccaccggccugcugcugccccccccccccccccccccccccacccaggagagcccccccagccccgacccccccagccugggcaacaacagcagccccugcuggagccccgaggaggagagcagccugcugcccggcuucggcggcggcagaggccccagcuucagaagaaagaugggcaccgagggcagcgagcccggcgagggcggccccgcccccggcaccgcccagcagcccagagugcacggcguggcccugcccggccuggagagagccaagggcuggagcuucgacggcaagagagagggccccggccccgaccaggagggcagcacccaggccuggcagaagagaagaagcagcgacgacgccggccccggcagcuggaagccccccccccccccccagagcaccaagcccagcuucagcgccaugagaagagccgaggccaccuggcacaucgccgaggagagcgcccccaaccacagcugccagagccccagccccgccagccaggacggcgaggaggagaaggagggcacccuguuccccgagagaacccugcccgccagaaacgccaagcugcaggaccccgcccuggcccccuggccccccaagcccguggccgugcccagaggcagacagcccccccaggagcccggcgugagagaggaggccgaggccggcgacgccgcccccggcgugaacaagcccagacugagacugagcagccagcaggaccaggaggagcccgaggugcagggcccccccgaccccggcagaagaaccgccccccugaagcccaagagaaccagaagagcccagagcugcgacaagcuggagcccgacagaagaagaccccccgaccccaccggcaccagcgagcccggcaccgacuaa

SEQ ID NO: 19399 - RNA, 942 nt, Artificial Sequence
  LRRC17__Homo_sapiens__NP_005815
augagaguggugaccaucgugauccugcugugcuucugcaaggccgccgagcugagaaaggccagccccggcagcgugagaagcagagugaaccacggcagagccggcggcggcagaagaggcagcaaccccgugaagagauacgcccccggccugcccugcgacguguacaccuaccugcacgagaaguaccuggacugccaggagagaaagcugguguacgugcugcccggcuggccccaggaccugcugcacaugcugcuggccagaaacaagaucagaacccugaagaacaacauguucagcaaguucaagaagcugaagagccuggaccugcagcagaacgagaucagcaagaucgagagcgaggccuucuucggccugaacaagcugaccacccugcugcugcagcacaaccagaucaaggugcugaccgaggagguguucaucuacaccccccugcugagcuaccugagacuguacgacaaccccuggcacugcaccugcgagaucgagacccugaucagcaugcugcagauccccagaaacagaaaccugggcaacuacgccaagugcgagagcccccaggagcagaagaacaagaagcugagacagaucaagagcgagcagcugugcaacgaggaggagaaggagcagcuggaccccaagccccaggugagcggcagaccccccgugaucaagcccgagguggacagcaccuucugccacaacuacguguuccccauccagacccuggacugcaagagaaaggagcugaagaaggugcccaacaacaucccccccgacaucgugaagcuggaccugagcuacaacaagaucaaccagcugagacccaaggaguucgaggacgugcacgagcugaagaagcugaaccugagcagcaacggcaucgaguucaucgaccccggcagccugagauaa

SEQ ID NO: 19400 - RNA, 786 nt, Artificial Sequence
  LRRC18__Homo_sapiens__XP_011538131
auggugaagggcgagaagggccccaagggcaagaagaucacccugaagguggccagaaacugcaucaagaucaccuucgacggcaagaagagacuggaccugagcaagaugggcaucaccaccuuccccaagugcauccugagacugagcgacauggacgagcuggaccugagcagaaaccugaucagaaagauccccgacagcaucagcaaguuccagaaccugagauggcuggaccugcacagcaacuacaucgacaagcugcccgagagcaucggccagaugaccagccugcuguaccugaacgugagcaacaacagacugaccagcaacggccugcccguggagcugaagcagcugaagaacaucagagccgugaaccugggccugaaccaccuggacagcgugcccaccacccugggcgcccugaaggagcugcacgaggugggccugcacgacaaccugcugaacaacauccccgugagcaucagcaagcugcccaagcugaagaagcugaacaucaagagaaaccccuuccccaagcccggcgagagcgagaucuucaucgacagcaucagaagacuggagaaccuguacgugguggaggagaaggaccugugcgccgccugccugagaaagugccagaacgccagagacaaccugaacagaaucaagaacauggccaccaccacccccagaaagaccaucuuccccaaccugaucagccccaacagcauggccaaggacagcugggaggacuggagaaucagacugaccagcagcuaa

SEQ ID NO: 19401 - RNA, 1575 nt, Artificial Sequence
  LRRC1__Homo_sapiens__NP_060684
auguuccacugcaucccccuguggagaugcaacagacacguggagagcaucgacaagagacacugcagccugguguacgugcccgaggagaucuacagauacgccagaagccuggaggagcugcugcuggacgccaaccagcugagagagcugcccgagcaguucuuccagcuggugaagcugagaaagcugggccugagcgacaacgagauccagagacugccccccgagaucgccaacuucaugcagcugguggagcuggacgugagcagaaacgagauccccgagauccccgagagcaucagcuucugcaaggcccugcagguggccgacuucagcggcaacccccugaccagacugcccgagagcuuccccgagcugcagaaccugaccugccugagcgugaacgacaucagccugcagagccugcccgagaacaucggcaaccuguacaaccuggccagccuggagcugagagagaaccugcugaccuaccugcccgacagccugacccagcugagaagacuggaggagcuggaccugggcaacaacgagaucuacaaccugcccgagagcaucggcgcccugcugcaccugaaggaccuguggcuggacggcaaccagcugagcgagcugccccaggagaucggcaaccugaagaaccugcugugccuggacgugagcgagaacagacuggagagacugcccgaggagaucagcggccugaccagccugaccgaccuggugaucagccagaaccugcuggagaccauccccgacggcaucggcaagcugaagaagcugagcauccugaagguggaccagaacagacugacccagcugcccgaggccgugggcgagugcgagagccugaccgagcuggugcugaccgagaaccagcugcugacccugcccaagagcaucggcaagcugaagaagcugagcaaccugaacgccgacagaaacaagcuggugagccugcccaaggagaucggcggcugcugcagccugaccguguucugcgugagagacaacagacugaccagaauccccgccgaggugagccaggccaccgagcugcacgugcuggacguggccggcaacagacugcugcaccugccccugagccugaccgcccugaagcugaaggcccuguggcugagcgacaaccagagccagccccugcugaccuuccagaccgacaccgacuacaccaccggcgagaagauccugaccugcgugcugcugccccagcugcccagcgagcccaccugccaggagaaccugcccagaugcggcgcccuggagaaccuggugaacgacgugagcgacgaggccuggaacgagagagccgugaacagagugagcgccaucagauucguggaggacgagaaggacgaggaggacaacgagaccagaacccugcugagaagagccaccccccaccccggcgagcugaagcacaugaagaagaccguggagaaccugagaaacgacaugaacgccgccaagggccuggacagcaacaagaacgaggugaaccacgccaucgacagagugaccaccagcguguaa

SEQ ID NO: 19402 - RNA, 555 nt, Artificial Sequence
  LRRC20__Homo_sapiens__NP_001265141
augcugaagaagaugggcgaggccguggccagaguggccagaaaggugaacgagaccguggagagcggcagcgacacccuggaccuggccgagugcaagcuggugagcuuccccaucggcaucuacaaggugcugagaaacgugagcggccagauccaccugaucacccuggccaacaacgagcugaagagccugaccagcaaguucaugaccaccuucagccagcugagagagcugcaccuggagggcaacuuccugcacagacugcccagcgaggugagcgcccugcagcaccugaaggccaucgaccugagcagaaaccaguuccaggacuuccccgagcagcugaccgcccugcccgcccuggagaccaucaaccuggaggagaacgagaucguggacgugcccguggagaagcuggccgccaugcccgcccugagaagcaucaaccugagauucaacccccugaacgccgaggugagagugaucgcccccccccugaucaaguucgacaugcugaugagccccgagggcgccagagccccccugcccuaa

SEQ ID NO: 19403 - RNA, 1005 nt, Artificial Sequence
  LRRC26__Homo_sapiens__NP_001013675
augagaggccccagcuggagcagacccagaccccugcugcugcugcugcugcugcugagccccuggcccgugugggcccaggugagcgccaccgccagccccagcggcagccugggcgcccccgacugccccgaggugugcaccugcgugcccggcggccuggccagcugcagcgcccugagccugcccgccgugccccccggccugagccugagacugagagcccugcugcuggaccacaacagagugagagcccugccccccggcgccuucgccggcgccggcgcccugcagagacuggaccugagagagaacggccugcacagcgugcacgugagagccuucuggggccugggcgcccugcagcugcuggaccugagcgccaaccagcuggaggcccuggcccccggcaccuucgccccccugagagcccugagaaaccugagccuggccggcaacagacuggccagacuggagcccgccgcccugggcgcccugccccugcugagaagccugagccugcaggacaacgagcuggccgcccuggcccccggccugcugggcagacugcccgcccuggacgcccugcaccugagaggcaaccccuggggcugcggcugcgcccugagaccccugugcgccuggcugagaagacacccccugcccgccagcgaggccgagaccgugcugugcguguggcccggcagacugacccugagcccccugaccgccuucagcgacgccgccuucagccacugcgcccagccccuggcccugagagaccuggccgugguguacacccugggccccgccagcuuccuggugagccuggccagcugccuggcccugggcagcggccugaccgccugcagagccagaagaagaagacugagaaccgccgcccugagaccccccagaccccccgaccccaaccccgaccccgacccccacggcugcgccagccccgccgaccccggcagccccgccgccgccgcccaggccuaa

SEQ ID NO: 19404 - RNA, 906 nt, Artificial Sequence
  LRRC30__Homo_sapiens__NP_001099051
augggcgccagacagagcagagccagcagcaaggacaagggccccaagagaaugcuguucaccggcagaagacagaaguucagccccugggacgacgcccugcugagcggcagagaccccagaagccugcugaagagaggcaugcaccacgugagcuucagccuggugaccagaggcaugaccgacauccccgacuuccuguggggccugagcgaggugcagaagcugaaccugagccacaaccagcugagagugcugccccccgaggugggcaagcugaccagaaucguggugcugaaccugugcggcaacagacugaagagccugcccagagaggugagccugcugcagugccugaaggugcuguucgugaacaugaacugccugaccgaggugcccgccgagcugagccugugcagaaagcuggaggugcugagccugagccacaacugccugagccagcugcccgccugcuucgccgaccugagcagacugagaaagcugaaccugagcaacaacuucuucgcccacauccccaugugcguguucagccugaaggagcugaucuuccugcacgugggcagcaacagacuggagaacaucgccgagagcauccagcaccuggccagccugcagaucuucaucgccgagggcaacaacauccacagcuuccccagaagccugugccuggugaccagccuggagcugcugaaccugaacaacaacgacauccagacccugcccagcgagcugcaccugcugugcagacuggugagaaucgccuggaaccccauggacaagggccugcacaucagccacaacccccugagcaagccccugcccgagcugguggagggcggccuggagaugcuguucggcuaccugaaggacaagaagcacaccuaa

SEQ ID NO: 19405 - RNA, 1989 nt, Artificial Sequence
  LRRC32__Homo_sapiens__XP_005273959
augagaccccagauccugcugcugcuggcccugcugacccugggccuggccgcccagcaccaggacaaggugcccugcaagaugguggacaagaaggugagcugccaggugcugggccugcugcaggugcccagcgugcugccccccgacaccgagacccuggaccugagcggcaaccagcugagaagcauccuggccagcccccugggcuucuacaccgcccugagacaccuggaccugagcaccaacgagaucagcuuccugcagcccggcgccuuccaggcccugacccaccuggagcaccugagccuggcccacaacagacuggccauggccaccgcccugagcgccggcggccugggcccccugcccagagugaccagccuggaccugagcggcaacagccuguacagcggccugcuggagagacugcugggcgaggcccccagccugcacacccugagccuggccgagaacagccugaccagacugaccagacacaccuucagagacaugcccgcccuggagcagcuggaccugcacagcaacgugcugauggacaucgaggacggcgccuucgagggccugcccagacugacccaccugaaccugagcagaaacagccugaccugcaucagcgacuucagccugcagcagcugagagugcuggaccugagcugcaacagcaucgaggccuuccagaccgccagccagccccaggccgaguuccagcugaccuggcuggaccugagagagaacaagcugcugcacuuccccgaccuggccgcccugcccagacugaucuaccugaaccugagcaacaaccugaucagacugcccaccggccccccccaggacagcaagggcauccacgcccccagcgagggcuggagcgcccugccccugagcgcccccagcggcaacgccagcggcagaccccugagccagcugcugaaccuggaccugagcuacaacgagaucgagcugauccccgacagcuuccuggagcaccugaccagccugugcuuccugaaccugagcagaaacugccugagaaccuucgaggccagaagacugggcagccugcccugccugaugcugcuggaccugagccacaacgcccuggagacccuggagcugggcgccagagcccugggcagccugagaacccugcugcugcagggcaacgcccugagagaccugccccccuacaccuucgccaaccuggccagccugcagagacugaaccugcagggcaacagagugagccccugcggcggccccgacgagcccggccccagcggcugcguggccuucagcggcaucaccagccugagaagccugagccugguggacaacgagaucgagcugcugagagccggcgccuuccugcacaccccccugaccgagcuggaccugagcagcaaccccggccuggagguggccaccggcgcccugggcggccuggaggccagccuggaggugcuggcccugcagggcaacggccugauggugcugcagguggaccugcccugcuucaucugccugaagagacugaaccuggccgagaacagacugagccaccugcccgccuggacccaggccgugagccuggaggugcuggaccugagaaacaacagcuucagccugcugcccggcagcgccaugggcggccuggagaccagccugagaagacuguaccugcagggcaacccccugagcugcugcggcaacggcuggcuggccgcccagcugcaccagggcagaguggacguggacgccacccaggaccugaucugcagauucagcagccaggaggaggugagccugagccacgugagacccgaggacugcgagaagggcggccugaagaacaucaaccugaucaucauccugaccuucauccuggugagcgccauccugcugaccacccuggccgccugcugcugcgugagaagacagaaguucaaccagcaguacaaggccuaa

SEQ ID NO: 19406 - RNA, 5103 nt, Artificial Sequence
  LRRC37A__Homo_sapiens__NP_055649
augagcagcgcccagugccccgcccuggugugcgugaugagcagacugagauucuggggccccuggccccugcugauguggcagcugcuguggcugcuggugaaggaggcccagccccuggagugggugaaggacccccugcagcugaccagcaacccccugggcccccccgagagcuggagcagccacagcagccacuuccccagagagagcccccacgcccccacccugcccgccgaccccugggacuucgaccaccugggccccagcgccagcagcgagaugcccgcccccccccaggagagcaccgagaaccuggugcccuuccuggacaccugggacagcgccggcgagcagccccuggagcccgagcaguuccuggccagccagcaggaccugaaggacaagcugagcccccaggagagacugcccgugagccccaagaagcugaagaaggaccccgcccagagauggagccuggccgagaucaucggcaucaccagacagcugagcaccccccagagccagaagcagacccugcagaacgaguacagcagcaccgacacccccuaccccggcagccugccccccgagcugagagugaagagcgacgagccccccggccccagcgagcaggugggccccagccaguuccaccuggagcccgagacccagaaccccgagacccuggaggacauccagagcagcagccugcagcaggaggcccccgcccagcugccccagcugcuggaggaggagcccagcagcaugcagcaggaggcccccgcccugccccccgagagcagcauggagagccugacccugcccaaccacgaggugagcgugcagccccccggcgaggaccaggccuacuaccaccugcccaacaucaccgugaagcccgccgacguggaggugaccaucaccagcgagcccaccaacgagaccgagagcagccaggcccagcaggagacccccauccaguuccccgaggagguggagcccagcgccacccagcaggaggcccccaucgagccccccgugccccccauggagcacgagcugagcaucagcgagcagcagcagcccgugcagcccagcgagagccccagagagguggagagcagccccacccagcaggagacccccggccagccccccgagcaccacgaggugaccgugagcccccccggccaccaccagacccaccaccuggccagccccagcgugagcgugaagccccccgacgugcagcugaccaucgccgccgagcccagcgccgaggugggcaccagccuggugcaccaggaggccaccaccagacugagcggcagcggcaacgacguggagccccccgccauccagcacggcggccccccccugcugcccgagagcagcgaggaggccggcccccuggccgugcagcaggagaccagcuuccagagccccgagcccaucaacaacgagaaccccagccccacccagcaggaggccgccgccgagcacccccagaccgccgaggagggcgagagcagccugacccaccaggaggcccccgcccagacccccgaguuccccaacguggugguggcccagccccccgagcacagccaccugacccaggccaccgugcagccccuggaccugggcuucaccaucacccccgagagcaagaccgagguggagcugagccccaccaugaaggagacccccacccagccccccaagaagguggugccccagcugagaguguaccagggcgugaccaaccccacccccggccaggaccaggcccagcaccccgugagccccagcgugaccgugcagcugcuggaccugggccugaccaucacccccgagcccaccaccgaggugggccacagcaccccccccaagagaaccaucgugagccccaagcaccccgaggugacccugccccaccccgaccaggugcagacccagcacagccaccugaccagagccaccgugcagccccuggaccugggcuucaccaucacccccaagagcaugaccgagguggagcccagcaccgcccugaugaccaccgcccccccccccggccaccccgaggugacccugccccccagcgacaagggccaggcccagcacagccaccugacccaggccaccgugcagccccuggaccuggagcugaccaucaccaccaagcccaccaccgaggugaagcccagccccaccaccgaggagaccagcacccagccccccgaccugggccuggccaucauccccgagcccaccaccgagaccggccacagcaccgcccuggagaagaccaccgcccccagacccgacagagugcagacccugcacagaagccugaccgaggugaccggcccccccaccgagcuggagcccgcccaggacagccuggugcagagcgagagcuacacccagaacaaggcccugaccgcccccgaggagcacaaggccagcaccagcaccaacaucugcgagcugugcaccugcggcgacgagaugcugagcugcaucgaccugaaccccgagcagagacugagacaggugcccgugcccgagcccaacacccacaacggcaccuucaccauccugaacuuccagggcaacuacaucagcuacaucgacggcaacguguggaaggccuacagcuggaccgagaagcugauccugagagagaacaaccugaccgagcugcacaaggacagcuucgagggccugcugagccugcaguaccuggaccugagcugcaacaagauccagagcaucgagagacacaccuucgagccccugcccuuccugaaguucaucaaccugagcugcaacgugaucaccgagcugagcuucggcaccuuccaggccuggcacggcaugcaguuccugcacaagcugauccugaaccacaacccccugaccaccguggaggaccccuaccuguucaagcugcccgcccugaaguaccuggacaugggcaccacccuggugccccugaccacccugaagaacauccugaugaugaccguggagcuggagaagcugauccugcccagccacauggccugcugccugugccaguucaagaacagcaucgaggccgugugcaagaccgugaagcugcacugcaacagcgccugccugaccaacaccacccacugccccgaggaggccagcgugggcaaccccgagggcgccuucaugaaggugcugcaggccagaaagaacuacaccagcaccgagcugaucguggagcccgaggagcccagcgacagcagcggcaucaaccugagcggcuucggcagcgagcagcuggacaccaacgacgagagcgacuucaucagcacccugagcuacauccugcccuacuucagcgccgugaaccuggacgugaagagccugcugcugcccuucaucaagcugcccaccaccggcaacagccuggccaagauccagaccgugggccagaacagacagagagugaagagagugcugaugggccccagaagcauccagaagagacacuucaaggaggugggcagacagagcaucagaagagagcagggcgcccaggccagcguggagaacgccgccgaggagaagagacugaccagccccgcccccagagagguggagcagccccacacccagcagggccccgagaagcuggccggcaacgccguguacaccaagcccagcuucacccaggagcacaaggccgccgugagcgugcugaagcccuucagcaagggcacccccagcaccagcagccccgccaaggcccugccccaggugagagacagaagcaaggaccugacccacgccaucagcauccuggagagcgccaaggccagagugaccaacaccaagaccagcaagcccaucgugcacgccagaaagaaguacagauuccacaagaccagaagccacgugacccacagaaccaccaaggugaagaagagccccaaggugagaaagaagagcuaccugagcagacugaugcuggccaacagacugcccuucagcgccgccaagagccugaucaacagccccagccagggcgccuucagcagccugggcgaccugagcccccaggagaaccccuuccuggaggugagcgcccugagcgagcacuucaucgagaagaacaacaccaagcacaccaccgccagaaacgccuucgaggagaacgacuucauggagaacaccaacaugcccgagggcaccaucagcgagaacaccaacuacaaccacccccccgaggccgacagcgccggcaccgccuucaaccugggccccaccgugaagcagaccgagaccaagugggaguacaacaacgugggcaccgaccugagccccgagcccaagagcuucaacuacccccugcugagcagccccggcgaccaguucgagauccagcugacccagcagcugcagagccugauccccaacaacaacgugagaagacugaucgcccacgugaucagaacccugaagauggacugcagcggcgcccacgugcaggugaccugcgccaagcugaucagcagaaccggccaccugaugaagcugcugagcggccagcaggaggugaaggccagcaagaucgagugggacaccgaccaguggaagaucgagaacuacaucaacgagagcaccgaggcccagagcgagcagaaggagaagagccuggagcugaagaaggaggugcccggcuacggcuacaccgacaagcugauccuggcccugaucgugaccggcauccugaccauccugaucauccuguucugccugaucgugaucugcugccacagaagaagccugcaggaggacgaggagggcuucagcagaggcaucuucagauuccugcccuggagaggcugcagcagcagaagagagagccaggacggccugagcagcuucggccagccccugugguucaaggaccuguacaagccccugagcgccaccagaaucaacaaccacgccuggaagcugcacaagaagagcagcaacgaggacaagauccugaacagagaccccggcgacagcgaggcccccaccgaggaggaggagagcgaggcccugcccuaa

SEQ ID NO: 19407 - RNA, 2844 nt, Artificial Sequence
  LRRC37B__Homo_sapiens__NP_443120
augagcuggcugagauucuggggccccuggccccugcugaccuggcagcugcugagccugcuggugaaggaggcccagccccuggugugggugaaggacccccugcagcugaccagcaacccccugggcccccccgagcccuggagcagcagaagcagccaccugcccugggagagcccccacgcccccgccccccccgccgcccccggcgacuucgacuaccugggccccagcgccagcagccagaugagcgcccugccccaggagcccaccgagaaccuggcccccuuccugaaggagcuggacagcgccggcgagcugccccugggccccgagcccuuccuggccgcccaccaggaccugaacgacaagagaacccccgaggagagacugcccgagguggugccccugcugaacagagaccagaaccaggcccuggugcagcugcccagacugaagugggugcagaccaccgaccuggacagagccgccggccaccaggccgacgagauccuggugccccuggacagcaaggugagcagacccaccaaguucguggugagccccaagaaccugaagaaggaccuggccgagagauggagccugcccgagaucgugggcaucccccaccagcugagcaagccccagagacagaagcagacccugcccgacgacuaccugagcauggacacccuguaccccggcagccugccccccgagcugagagugaacgccgacgagccccccggcccccccgagcaggugggccugagccaguuccaccuggagcccaagagccagaaccccgagacccuggaggacauccagagcagcagccugcaggaggaggcccccgcccagcugcugcagcugccccaggagguggagcccagcacccagcaggaggcccccgcccugccccccgagagcagcauggagagccuggcccagaccccccugaaccacgaggugaccgugcagccccccggcgaggaccaggcccacuacaaccugcccaaguucaccgugaagcccgccgacguggaggugaccaugaccagcgagcccaagaacgagaccgagagcacccaggcccagcaggaggcccccauccagccccccgaggaggccgagcccagcagcaccgcccugagaaccaccgaccccccccccgagcaccccgaggugacccugccccccagcgacaagggccaggcccagcacagccaccugaccgaggccaccgugcagccccuggaccuggagcugagcaucaccaccgagcccaccaccgaggugaagcccagccccaccaccgaggagaccagcgcccagccccccgaccccggccuggccaucacccccgagcccaccaccgagaucggccacagcaccgcccuggagaagaccagagccccccaccccgaccaggugcagacccugcacagaagccugaccgaggugaccggcccccccaccaagcuggagagcagccaggacagccuggugcagagcgagaccgcccccgaggagcagaaggccagcaccagcaccaacaucugcgagcugugcaccugcggcgacgagacccugagcugcgugggccugagccccaagcagagacugagacaggugcccgugcccgagcccgacaccuacaacggcaucuucaccacccugaacuuccagggcaacuacaucagcuaccuggacggcaacguguggaaggccuacagcuggaccgagaagcugauccugagcgagaacuaccugaccgagcugcccaaggacagcuucgagggccugcuguaccugcaguaccuggaccugagcugcaacaagaucagauacaucgagagacagaccuucgagagccugcccuuccugcaguacaucaaccugggcugcaaccugaucaccaagcugagccugggcaccuuccaggccuggcacggcaugcaguuccugcacaaccugauccugaacagaaacccccugaccaccguggaggaccccuaccuguucgagcugcccgcccugaaguaccuggacaugggcaccacccacaucacccugaccacccugaagaacauccugaccaugaccguggagcuggagaagcugauccugcccagccacauggccugcugccugugccaguucaagaacagcaucgaggccgugugcaagaccgugaagcugcacugcaacaccgccugccugaccaacagcauccacugccccgaggaggccagcgugggcaaccccgagggcgccuucaugaagaugcugcaggccagaaagcagcacaugagcacccagcugaccaucgagagcgaggcccccagcgacagcagcggcaucaaccugagcggcuucggcggcgaccagcuggagauccagcugaccgagcagcugagaagccugauccccaacgaggacgugagaaaguucaugagccacgugaucagaacccugaagauggagugcagcgagacccacgugcagggcagcugcgccaagcugaugcugagaaccggccugcugaugaagcugcugagcgagcagcaggaggccaaggcccugaacguggagugggacaccgaccagcagaagaccaacuacaucaacgagaacauggagcagaacgagcagaaggagcagaagagcagcgagcugaugaaggaggugcccggcgacgacuacaagaacaagcugaucuucgccaucagcgugaccgugauccugaucauccugaucaucaucuucugccugaucgaggugaacagccacaagagagccagcgagaaguacaaggacaaccccagcaucagcggcgccuaa

SEQ ID NO: 19408 - RNA, 1008 nt, Artificial Sequence
  LRRC39__Homo_sapiens__XP_011538980
augaccgagaacguggugugcaccggcgccgugaacgccgugaaggaggugugggagaagagaaucaagaagcugaacgaggaccugaagagagagaaggaguuccagcacaagcuggugagaaucugggaggagagagugagccugaccaagcugagagagaaggugaccagagaggacggcagagugauccugaagaucgagaaggaggaguggaagacccugcccagcagccugcugaagcugaaccagcugcaggaguggcagcugcacagaaccggccugcugaagauccccgaguucaucggcagauuccagaaccugaucgugcuggaccugagcagaaacaccaucagcgagaucccccccggcaucggccugcugaccagacugcaggagcugauccugagcuacaacaagaucaagaccgugcccaaggagcugagcaacugcgccagccuggagaagcuggagcuggccgugaacagagacaucugcgaccugccccaggagcugagcaaccugcugaagcugacccaccuggaccugagcaugaacgacuucaccaccaucccccuggccgugcugaacaugcccgcccuggaguggcuggacaugggcagcaacaagcuggagcagcugcccgacaccaucgagagaaugcagaaccugcacacccuguggcugcagagaaacgagaucaccugccugccccagaccaucagcaacaugaagaaccugggcacccuggugcugagcaacaacaagcugcaggacauccccgugugcauggaggagauggccaaccugagauucgugaacuucagagacaacccccugaagcugaaggugagccugccccccagcgagggcaccgacgaggaggaggagagagagcuguucggccugcaguucaugcacaccuacauccaggagagcagaagaagagccgaccaccaggugaacggcagcaccacccugcccaucagcaucaacaccgacggcuaa

SEQ ID NO: 19409 - RNA, 2061 nt, Artificial Sequence
  LRRC49__Homo_sapiens__NP_060161
augauccccggcaaguacagaagcgugagcggcagagccgccaacaacgugaacugcggccugcaccuggugauccagaccagcagccugcccgagaagaacaagguggaguucaagcugaacaaggacaccagcagcuuccccggcagacugcugcagcacgaccuggagagaaacuacagcagcagacagggcgaccacaucaaccuggugagcagcagccugagcagcuuccccauccugcagagaagcagcgaggagaagauccuguacagcgacagacugagccuggagagacagaagcugaccgugugccccaucaucaacggcgaggaccaccugagacugcugaacuuccagcacaacuucaucaccagaauccagaacaucagcaaccugcagaagcugaucagccuggaccuguacgacaaccagaucgaggagaucagcggccugagcacccugagaugccugagagugcugcugcugggcaagaacagaaucaagaagaucagcaaccuggagaaccugaagagccuggacgugcuggaccugcacggcaaccagaucaccaagaucgagaacaucaaccaccugugcgagcugagagugcugaaccuggccagaaacuuccugagccacguggacaaccugaacggccuggacagccugaccgagcugaaccugagacacaaccagaucaccuucgugagagacguggacaaccugcccugccugcagcaccuguuccugagcuucaacaacaucagcagcuucgacagcgugagcugccuggccgacagcagcagccugagcgacaucaccuucgacggcaaccccaucgcccaggagagcugguacaagcacaccgugcugcagaacaugaugcagcugagacagcuggacaugaagagaaucaccgaggaggagagaagaauggccagcgugcuggccaagaaggaggaggagaagaagagagagagccacaagcagagccugcugaaggagaagaagagacugaccaucaacaacguggccagacagugggaccugcagcagcagagaguggccaacaucgccaccaacgaggacagaaaggacagcgacagcccccaggaccccugccagaucgacggcagcacccugagcgccuuccccgaggagaccggcccccuggacagcggccugaacaacgcccugcagggccugagcgugaucgacaccuaccugguggagguggacggcgacacccugagccuguacggcagcggcgcccuggagagccuggacagaaacuggagcgugcagaccgccggcaugaucaccaccgugagcuucaccuucaucgaguucgacgagaucgugcaggugcugcccaagcugaagaucaaguuccccaacagccugcaccugaaguucaaggagaccaaccuggugaugcugcagcaguucaacgcccuggcccagcugagaagaaucgaccagcugaccaucgacccccagggcaaccccguggugaacuucacccuguggaaguacuacgugcuguucagacugagccacuucagcaugcagaagaucaacggcaccgaggugacccagaacgacaugaucauggccgagagacuguucggcauccuggcccacguggccagcagcgagcugccccaguacagacugaucagcauccugggcgacgccagaaagaagcaguucagauaccugcuggagagcaagggcaagaagcccggcaucaucaacgaggagaacaacgacagcaagagacuggugggcgagaacaccaacagagccacccugaacuacaccaccagagacuucuacaacgagaagcuggaggagaucaaggagaagaagaaguucugcaagaccuacaucgaggaccuggugaaggaggccaccgagaucaacaugaagaacgaggcccugcagaagcuguggccccagauguucaucgagcuggugagagacgccgugaucgagaucagaaacaagaacagcuacaugaagcugugccugcagcagaucaccgaccagaaguaa

SEQ ID NO: 19410 - RNA, 2142 nt, Artificial Sequence
  LRRC4B__Homo_sapiens__XP_011525822
auggccagagccagaggcagccccugccccccccugccccccggcagaaugagcuggccccacggcgcccugcuguuccuguggcuguucagccccccccugggcgccggcggcggcggcguggccgugaccagcgccgccggcggcggcagcccccccgccaccagcugccccguggccugcagcugcagcaaccaggccagcagagugaucugcaccagaagagaccuggccgaggugcccgccagcauccccgugaacaccagauaccugaaccugcaggagaacggcauccaggugaucagaaccgacaccuucaagcaccugagacaccuggagauccugcagcugagcaagaaccuggugagaaagaucgaggugggcgccuucaacggccugcccagccugaacacccuggagcuguucgacaacagacugaccaccgugcccacccaggccuucgaguaccugagcaagcugagagagcuguggcugagaaacaaccccaucgagagcauccccagcuacgccuucaacagagugcccagccugagaagacuggaccugggcgagcugaagagacuggaguacaucagcgaggccgccuucgagggccuggugaaccugagauaccugaaccugggcaugugcaaccugaaggacauccccaaccugaccgcccuggugagacuggaggagcuggagcugagcggcaacagacuggaccugaucagacccggcagcuuccagggccugaccagccugagaaagcuguggcugaugcacgcccagguggccaccaucgagagaaacgccuucgacgaccugaagagccuggaggagcugaaccugagccacaacaaccugaugagccugccccacgaccuguucaccccccugcacagacuggagagagugcaccugaaccacaaccccuggcacugcaacugcgacgugcuguggcugagcugguggcugaaggagaccgugcccagcaacaccaccugcugcgccagaugccacgcccccgccggccugaagggcagauacaucggcgagcuggaccagagccacuucaccugcuacgcccccgugaucguggagccccccaccgaccugaacgugaccgagggcauggccgccgagcugaagugcagaaccggcaccagcaugaccagcgugaacuggcugacccccaacggcacccugaugacccacggcagcuacagagugagaaucagcgugcugcacgacggcacccugaacuucaccaacgugaccgugcaggacaccggccaguacaccugcauggugaccaacagcgccggcaacaccaccgccagcgccacccugaacgugagcgccguggaccccguggccgccggcggcaccggcagcggcggcggcggccccggcggcagcggcggcgugggcggcggcagcggcggcuacaccuacuucaccaccgugaccguggagacccuggagacccagcccggcgaggaggcccugcagcccagaggcaccgagaaggagccccccggccccaccaccgacggcguguggggcggcggcagacccggcgacgccgccggccccgccagcagcagcaccaccgcccccgcccccagaagcagcagacccaccgagaaggccuucaccgugcccaucaccgacgugaccgagaacgcccugaaggaccuggacgacgugaugaagaccaccaagaucaucaucggcugcuucguggccaucaccuucauggccgccgugaugcugguggccuucuacaagcugagaaagcagcaccagcugcacaagcaccacggccccaccagaaccguggagaucaucaacguggaggacgagcugcccgccgccagcgccgugagcguggccgccgccgccgccguggccagcggcggcggcgugggcggcgacagccaccuggcccugcccgcccuggagagagaccaccugaaccaccaccacuacguggccgccgccuucaaggcccacuacagcagcaaccccagcggcggcggcugcggcggcaagggcccccccggccugaacagcauccacgagccccugcuguucaagagcggcagcaaggagaacgugcaggagacccagaucuaa

SEQ ID NO: 19411 - RNA, 1923 nt, Artificial Sequence
  LRRC4C__Homo_sapiens__NP_001245348
augcugaacaagaugacccugcacccccagcagaucaugaucggccccagauucaacagagcccuguucgacccccugcugguggugcugcuggcccugcagcugcuggugguggccggccuggugagagcccagaccugccccagcgugugcagcugcagcaaccaguucagcaaggugaucugcgugagaaagaaccugagagaggugcccgacggcaucagcaccaacaccagacugcugaaccugcacgagaaccagauccagaucaucaaggugaacagcuucaagcaccugagacaccuggagauccugcagcugagcagaaaccacaucagaaccaucgagaucggcgccuucaacggccuggccaaccugaacacccuggagcuguucgacaacagacugaccaccauccccaacggcgccuucguguaccugagcaagcugaaggagcuguggcugagaaacaaccccaucgagagcauccccagcuacgccuucaacagaauccccagccugagaagacuggaccugggcgagcugaagagacugagcuacaucagcgagggcgccuucgagggccugagcaaccugagauaccugaaccuggccaugugcaaccugagagagauccccaaccugaccccccugaucaagcuggacgagcuggaccugagcggcaaccaccugagcgccaucagacccggcagcuuccagggccugaugcaccugcagaagcuguggaugauccagagccagauccaggugaucgagagaaacgccuucgacaaccugcagagccugguggagaucaaccuggcccacaacaaccugacccugcugccccacgaccuguucaccccccugcaccaccuggagagaauccaccugcaccacaaccccuggaacugcaacugcgacauccuguggcugagcugguggaucaaggacauggcccccagcaacaccgccugcugcgccagaugcaacaccccccccaaccugaagggcagauacaucggcgagcuggaccagaacuacuucaccugcuacgcccccgugaucguggagccccccgccgaccugaacgugaccgagggcauggccgccgagcugaagugcagagccagcaccagccugaccagcgugagcuggaucacccccaacggcaccgugaugacccacggcgccuacaaggugagaaucgccgugcugagcgacggcacccugaacuucaccaacgugaccgugcaggacaccggcauguacaccugcauggugagcaacagcgugggcaacaccaccgccagcgccacccugaacgugaccgccgccaccaccacccccuucagcuacuucagcaccgugaccguggagaccauggagcccagccaggacgaggccagaaccaccgacaacaacgugggccccacccccgugguggacugggagaccaccaacgugaccaccagccugaccccccagagcaccagaagcaccgagaagaccuucaccauccccgugaccgacaucaacagcggcauccccggcaucgacgaggugaugaagaccaccaagaucaucaucggcugcuucguggccaucacccugauggccgccgugaugcuggugaucuucuacaagaugagaaagcagcaccacagacagaaccaccacgcccccaccagaaccguggagaucaucaacguggacgacgagaucaccggcgacacccccauggagagccaccugcccaugcccgccaucgagcacgagcaccugaaccacuacaacagcuacaagagccccuucaaccacaccaccaccgugaacaccaucaacagcauccacagcagcgugcacgagccccugcugaucagaaugaacagcaaggacaacgugcaggagacccagaucuaa

SEQ ID NO: 19412 - RNA, 1962 nt, Artificial Sequence
  LRRC4__Homo_sapiens__XP_011514763
augaagcugcuguggcaggugaccgugcaccaccacaccuggaacgccauccugcugcccuucguguaccugaccgcccagguguggauccugugcgccgccaucgccgccgccgccagcgccggcccccagaacugccccagcgugugcagcugcagcaaccaguucagcaagguggugugcaccagaagaggccugagcgaggugccccagggcauccccagcaacaccagauaccugaaccugauggagaacaacauccagaugauccaggccgacaccuucagacaccugcaccaccuggaggugcugcagcugggcagaaacagcaucagacagaucgaggugggcgccuucaacggccuggccagccugaacacccuggagcuguucgacaacuggcugaccgugauccccagcggcgccuucgaguaccugagcaagcugagagagcuguggcugagaaacaaccccaucgagagcauccccagcuacgccuucaacagagugcccagccugaugagacuggaccugggcgagcugaagaagcuggaguacaucagcgagggcgccuucgagggccuguucaaccugaaguaccugaaccugggcaugugcaacaucaaggacaugcccaaccugaccccccuggugggccuggaggagcuggagaugagcggcaaccacuuccccgagaucagacccggcagcuuccacggccugagcagccugaagaagcugugggugaugaacagccaggugagccugaucgagagaaacgccuucgacggccuggccagccugguggagcugaaccuggcccacaacaaccugagcagccugccccacgaccuguucaccccccugagauaccugguggagcugcaccugcaccacaaccccuggaacugcgacugcgacauccuguggcuggccugguggcugagagaguacauccccaccaacagcaccugcugcggcagaugccacgcccccaugcacaugagaggcagauaccugguggagguggaccaggccagcuuccagugcagcgcccccuucaucauggacgcccccagagaccugaacaucagcgagggcagaauggccgagcugaagugcagaaccccccccaugagcagcgugaaguggcugcugcccaacggcaccgugcugagccacgccagcagacaccccagaaucagcgugcugaacgacggcacccugaacuucagccacgugcugcugagcgacaccggcguguacaccugcauggugaccaacguggccggcaacagcaacgccagcgccuaccugaacgugagcaccgccgagcugaacaccagcaacuacagcuucuucaccaccgugaccguggagaccaccgagaucagccccgaggacaccaccagaaaguacaagcccgugcccaccaccagcaccggcuaccagcccgccuacaccaccagcaccaccgugcugauccagaccaccagagugcccaagcagguggccgugcccgccaccgacaccaccgacaagaugcagaccagccuggacgaggugaugaagaccaccaagaucaucaucggcugcuucguggccgugacccugcuggccgccgccaugcugaucguguucuacaagcugagaaagagacaccagcagagaagcaccgugaccgccgccagaaccguggagaucauccagguggacgaggacauccccgccgccaccagcgccgccgccaccgccgcccccagcggcgugagcggcgagggcgccguggugcugcccaccauccacgaccacaucaacuacaacaccuacaagcccgcccacggcgcccacuggaccgagaacagccugggcaacagccugcaccccaccgugaccaccaucagcgagcccuacaucauccagacccacaccaaggacaaggugcaggagacccagaucuaa

SEQ ID NO: 19413 - RNA, 942 nt, Artificial Sequence
  LRRC52__Homo_sapiens__NP_001005214
augagccuggccagcggccccggccccggcuggcugcuguucagcuucggcaugggccuggugagcggcagcaagugccccaacaacugccugugccaggcccaggaggugaucugcaccggcaagcagcugaccgaguacccccuggacaucccccugaacaccagaagacuguuccugaacgagaacagaaucaccagccugcccgccaugcaccugggccugcugagcgaccugguguaccuggacugccagaacaacagaaucagagaggugauggacuacaccuucaucggcguguucaagcugaucuaccuggaccugagcagcaacaaccugaccagcaucagccccuucaccuucagcgugcugagcaaccuggugcagcugaacaucgccaacaacccccaccugcugagccugcacaaguucaccuucgccaacaccaccagccugagauaccuggaccugagaaacaccggccugcagacccuggacagcgccgcccuguaccaccugaccacccuggagacccuguuccugagcggcaaccccuggaagugcaacugcagcuuccuggacuucgccaucuuccugaucguguuccacauggaccccagcgacgaccugaacgccaccugcguggagcccaccgagcugaccggcuggcccaucaccagagugggcaacccccugagauacaugugcaucacccaccuggaccacaaggacuacaucuuccugcugcugaucggcuucugcaucuucgccgccggcaccguggccgccuggcugaccggcgugugcgccgugcuguaccagaacaccagacacaagagcagcgaggaggacgaggacgaggccggcaccagaguggaggugagcagaagaaucuuccagacccagaccagcagcgugcaggaguucccccagcugaucuaa

SEQ ID NO: 19414 - RNA, 924 nt, Artificial Sequence
  LRRC59__Homo_sapiens__NP_060979
augaccaaggccggcagcaagggcggcaaccugagagacaagcuggacggcaacgagcuggaccugagccugagcgaccugaacgaggugcccgugaaggagcuggccgcccugcccaaggccaccauccuggaccugagcugcaacaagcugaccacccugcccagcgacuucugcggccugacccaccuggugaagcuggaccugagcaagaacaagcugcagcagcugcccgccgacuucggcagacuggugaaccugcagcaccuggaccugcugaacaacaagcuggugacccugcccgugagcuucgcccagcugaagaaccugaaguggcuggaccugaaggacaacccccuggaccccgugcuggccaagguggccggcgacugccuggacgagaagcagugcaagcagugcgccaacaaggugcugcagcacaugaaggccgugcaggccgaccaggagagagagagacagagaagacuggagguggagagagaggccgagaagaagagagaggccaagcagagagccaaggaggcccaggagagagagcugagaaagagagagaaggccgaggagaaggagagaagaagaaaggaguacgacgcccugaaggccgccaagagagagcaggagaagaagcccaagaaggaggccaaccaggcccccaagagcaagagcggcagcagacccagaaagcccccccccagaaagcacaccagaagcugggccgugcugaagcugcugcugcugcugcugcuguucggcguggccggcggccugguggccugcagagugaccgagcugcagcagcagccccugugcaccagcgugaacaccaucuacgacaacgccgugcagggccugagaagacacgagauccugcagugggugcugcagaccgacagccagcaguaa

SEQ ID NO: 19415 - RNA, 780 nt, Artificial Sequence
  LRRC61__Homo_sapiens__XP_011514822
auggacccccccgccgagaagcccggcgaggccggcggccugcagaucaccccccagcugcugaagagcagaaccggcgaguucagccuggagagcauccugcugcugaagcugagaggccugggccuggccgaccugggcugccugggcgagugccugggccuggaguggcuggaccugagcggcaacgcccugacccaccugggcccccuggccagccugagacagcuggccgugcugaacgugagcaacaacagacugaccggccuggagccccuggccaccugcgagaaccugcagagccugaacgccgccggcaaccugcuggccacccccggccagcugcagugccuggccggccugcccugccuggaguaccugagacugagagacccccuggccagacugagcaacccccugugcgccaaccccagcuacugggccgccgugagagagcugcugcccggccugaaggugaucgacggcgagagagugaucggcagaggcagcgaguucuaccagcugugcagagaccuggacagcagccugagacccagcagcagccccggccccagagccaccgaggcccagcccuggguggagcccggcuacugggagagcuggcccagcagaagcagcagcauccuggaggaggccugcagacaguuccaggacacccugcaggagugcugggaccuggacagacaggccagcgacagccuggcccaggccgagcaggugcugagcagcgccggccccaccagcagcuucguguucuaa

SEQ ID NO: 19416 - RNA, 1764 nt, Artificial Sequence
  LRRC63__Homo_sapiens__NP_001269389
augcagaagcccccccugcugcugagaagaccccugccccccaaguucaccaagcugagccugcacgagaagaagacccacaccgccaagaccggcaagaucgagagccugcacguggccuucaccgaggacgagaccaccagcaucaagauggacagaaccagauuccccgacgugcugagaaaccagagccugacccccaucaacauccagaacaucuuccuggaccacugcgugcaggagagagugaccgccaucagcagcccccagaagagcaccaagcacgugagagagcagauccccgacaccgccaccggcagcaucuucuucccccacugcaacagcgccagcaccagaaucuucggcaagcagaccaacaagauggagagcagcagaaaguucaagaccaugaaggacguguacaccgagaagagacuggagaacauccugauccugagcagcaaguucagcaagcccaagagcacccccggcagcgugaucgcccagaagcuggagaagaugcaccccaagcaccagccccugcccgagagccccggcuacaccuaccagcacaucagcagagaccugagcgccaccgugcccagccccccccccaugaccgugagcaugaagcccgagggccaguggcccgagcacuucaagagcaccgccacccugacccugagagugaccgaguuccccggcuucgugagccugcccacccccgugcugcccagaaagccccacagacagagcgugaucgagacccuggugaccgagaacggcaacaucgagagcgugcccaagcagaucccccccagaccccccgagggccugaccaagaccgagaagaucgagagcgagauccacguggugagaggcgagggcuucaagaccguggccgccaccagauacgagaccaucaccgccaugaccaaccuggccaucgugaacugccagguguacggcagaaacgcccugaaccugaagggcuucuucauccugaacugccccgaccugaccccccuggccuuccagcugaucuaccugaaccugagcuucaacgaccugcacuacuuccccaccgagauccugugccugaagaaccugcagauccugaagcugagaaacaaccccaucaaggagauccccagcgagauccagcagcuggaguuccugagaaucuucaccaucgccuucaaccugaucaccgugcugcccaucggccuguucagccugagcuaccuggaggagcuggacgugagcuacaacgagcugaccuucauccccaacgagauccagaagcugagaagccuggagaagcugaccguggacggcaacgagcugagcuucuucccccacggcauccugaagcugaaccugaccaagauccaguucgagaacaacuucacccaccccugcuucuggagagacaacuaccugaacaacccccagcagcugacccagaucaucagccuguucaucgugcagaacaagcugcacaaguucuacgacaagauccccguggaggugcagaagcugcugaagugcaccagcagaugcgaguggugccacggccccaaguucggcgagggcuucagagugaucagaagcugcgacaucuucggcgccagccagcugcccgugauguucuacgugugcagccccagcugcuacagaagaaucaaggagagcagcuucgugcuggacggcagccccagcagaagaaucgcccuggacguggagcugagcaaggagcuguaa

SEQ ID NO: 19417 - RNA, 1044 nt, Artificial Sequence
  LRRC69__Homo_sapiens__NP_001123362
augaccgagagacugcugaucaaggcccugagcggcggcaagaacaccaagaucaucacccugaacggcaagaagaugaccaagaugcccagcgcccugggcaagcugcccggccugaagacccuggugcugcagaacaaccugauccccaaggugugccccgagcugugcaaccugacccagcugaccacccugaaccugggcaacaaccugcuggaggaggugcccgaggagaugaaguaccugaccagccugaagaaccugcaccugagcggcaacagaaucugcagauucgcccccggcgccugcgacggccugcagaaccugauccugcugaaccugaacaacaaccaccugacccagcugccccaggaggugagcagacugaagagccugaccuacaugagcaucaacuacaaccagcuggccagcauccccagagagcugugcuuccuggagaaccugguggagcugcagcugaacuacaaccagcugaucugcauccccgaggagaucaaguuccugaagaagcugcagaagcugcugcuggccagaaacaacaucggcgugcugcccgaggagcugugcgaccugaagaagcugagaauccuggacaucgccggcaacaucauccagaucuuccccagcggcuuccaggaccugaagcugagagaguucuacugcgagggcaacccccuguuccugcagcagcccgugaucagcacccagcaggagaacguguggagccugcaggagaucaccagcagauucgugaugaaccagcuggccgagaacaaccccuuccugauggacgacaucgagagauacccccaggugagaagcaugaucagccagggcaagaccugcgccaucugcggccaguacuucaucaccguguggcuggagugcgugagauucgugcccccccccaaggacuggaagaucagcaagaaccugaagcuggugccccugcaggugcugaucugcagcuacaagugcuucacccagagagaccccaaccuguucggcaucgcccagguguaa

SEQ ID NO: 19418 - RNA, 1401 nt, Artificial Sequence
  LRRC6__Homo_sapiens__NP_036604
augggcuggaucaccgaggaccugaucagaagaaacgccgagcacaacgacugcgugaucuucagccuggaggagcugagccugcaccagcaggagaucgagagacuggagcacaucgacaaguggugcagagaccugaagauccuguaccugcagaacaaccugaucggcaagaucgagaacgugagcaagcugaagaagcuggaguaccugaaccuggcccugaacaacaucgagaagaucgagaaccuggagggcugcgaggagcuggccaagcuggaccugaccgugaacuucaucggcgagcugagcagcaucaagaaccugcagcacaacauccaccugaaggagcuguuccugaugggcaaccccugcgccagcuucgaccacuacagagaguucgugguggccacccugccccagcugaaguggcuggacggcaaggagaucgagcccagcgagagaaucaaggcccugcaggacuacagcgugaucgagccccagaucagagagcaggagaaggaccacugccugaagagagccaagcugaaggaggaggcccagagaaagcaccaggaggaggacaagaacgaggacaagagaagcaacgccggcuucgacggcagaugguacaccgacaucaacgccacccugagcagccuggagagcaaggaccaccugcaggcccccgacaccgaggagcacaacaccaagaagcuggacaacagcgaggacgaccuggaguucuggaacaagcccugccuguucacccccgagagcagacuggagacccugagacacauggagaagcagagaaagaagcaggagaagcugagcgagaagaagaagaaggugaagccccccagaacccugaucaccgaggacggcaaggcccugaacgugaacgagcccaagaucgacuucagccugaaggacaacgagaagcagaucauccuggaccuggccguguacagauacauggacaccagccugaucgacguggacgugcagcccaccuacgugagagugaugaucaagggcaagcccuuccagcuggugcugcccgccgaggugaagcccgacagcagcagcgccaagagaagccagaccaccggccaccuggugaucugcaugcccaaggugggcgaggugaucaccggcggccagagagccuucaagagcaugaagaccaccagcgacagaagcagagagcagaccaacaccagaagcaagcacauggagaagcuggagguggaccccagcaagcacagcuuccccgacgugaccaacaucgugcaggagaagaagcacacccccagaagaagacccgagcccaagaucauccccagcgaggaggaccccaccuucgaggacaaccccgaggugcccccccugaucuaa

SEQ ID NO: 19419 - RNA, 1467 nt, Artificial Sequence
  LRRC74A__Homo_sapiens__NP_919263
augcacauccaguuccccagcaagcccacccugcccagagccugcugggagggcagaaucaccgccggcagccccggcaugccccccgacgagaucgagaucgagcccgugagacagagcagcgacaagaugcuguacugcgaggccgagagcccccccaccguggagaaggugaagcccgccagagagaacagcgagaccgaccuggagaucgaggacgacgagaaguucuucaccaccggccagaaggagcuguaccuggaggccugcaagcugaugggcguggugcccgugagcuacuucaucagaaacauggaggagagcuacgugaaccugaaccaccacggccugggccccagaggcaccaaggccaucgccaucgcccuggugagcaacauggccgugaccaagcuggagcuggaggacaacugcaucauggaggagggcgugcugagccugguggagaugcugcaggagaacuacuaccugcaggagaugaacaucagcaacaaccaccugggccuggagggcgccagaaucaucagcgacuucuucgagagaaacagcagcagcaucuggagccuggagcugagcggcaacgacuucaaggaggacagcgccgcccugcugugccaggcccugagcaccaacuaccagaucaagaagcuggaccugagccacaaccaguucagcgacgugggcggcgagcaccugggccagaugcuggccaucaacgugggccugaccagccuggaccugagcuggaacaacuuccacaccagaggcgccguggcccugugcaacggccugagaggcaacgugacccugaccaagcuggaccugagcaugaacggcuucggcaacgagguggcccuggcccugggcgaggugcugagacugaacagaugccugguguaccuggacaucggcggcaacgacaucggcaacgagggcgccagcaagaucagcaagggccuggagagcaacgagagccugagagugcugaagcuguuccugaaccccaucaacauggacggcgccauccugcugauccuggccaucaagagaaaccccaagagcagaauggaggagcuggacaucagcaacgugcuggugagcgagcaguucaugaagacccuggacggcguguacgccgugcacccccagcuggacgugguguucaaggccgugcagggccugagccccaagaagaccaucuuccugcugaccaaccccaugaagcugauccagagcuacgccgaccagcacaagaucaccaucguggacuucuucaagagccugaaccccaccggcaccaugaagaugagcguggacgaguuccagaaggugaugaucgagcagaacaaggugccccugaaccaguaccaggugagagaggugaucaagaagcuggacgagaagaccggcauggugaacuucagcuuccugaacaccaugaagcccuaa

SEQ ID NO: 19420 - RNA, 4944 nt, Artificial Sequence
  LRRC7__Homo_sapiens__XP_011540138
auguggauggagaaccugaucagaggcagaaaccccccccaguaccagagaagccccugcaaggaggugagagccgcccugagaaagagacccgaggaggagcugcagugccuggagaugaccaccaagagaaagaucaucggcagacuggugcccugcagaugcuucagaggcgaggaggagaucaucagcgugcuggacuacagccacugcagccugcagcaggugcccaaggagguguucaacuucgagagaacccuggaggagcuguaccuggacgccaaccagaucgaggagcugcccaagcagcuguucaacugccaggcccugagaaagcugagcauccccgacaacgaccugagcaaccugcccaccaccaucgccagccuggugaaccugaaggagcuggacaucagcaagaacggcgugcaggaguuccccgagaacaucaagugcugcaagugccugaccaucaucgaggccagcgugaaccccaucagcaagcugcccgacggcuucacccagcugcugaaccugacccagcuguaccugaacgacgccuuccuggaguuccugcccgccaacuucggcagacuggugaagcugagaauccuggagcugagagagaaccaccugaagacccugcccaagagcaugcacaagcuggcccagcuggagagacuggaccugggcaacaacgaguucggcgagcugcccgaggugcuggaccagauccagaaccugagagagcuguggauggacaacaacgcccugcaggugcugcccggcagcaucggcaagcugaagaugcugguguaccuggacaugagcaagaacagaaucgagaccguggacauggacaucagcggcugcgaggcccuggaggaccugcugcugagcagcaacaugcugcagcagcugcccgacagcaucggccugcugaagaagcugaccacccugaagguggacgacaaccagcugaccaugcugcccaacaccaucggcaaccugagccugcuggaggaguucgacugcagcugcaacgagcuggagagccugcccagcaccaucggcuaccugcacagccugagaacccuggccguggacgagaacuuccugcccgagcugcccagagagaucggcagcugcaagaacgugaccgugaugagccugagaagcaacaagcuggaguuccugcccgaggagaucggccagaugcagaagcugagagugcugaaccugagcgacaacagacugaagaaccugcccuucagcuucaccaagcugaaggagcuggccgcccuguggcugagcgacaaccagagcaaggcccugaucccccugcagaccgaggcccaccccgagaccaagcagagagugcugaccaacuacauguucccccagcagcccagaggcgacgaggacuuccagagcgacagcgacagcuucaaccccacccugugggaggagcagagacagcagagaaugaccguggccuucgaguucgaggacaagaaggaggacgacgagaacgccggcaaggugaaggaccugagcugccaggcccccugggagagaggccagagaggcaucacccugcagcccgccagacugagcggcgacugcugcacccccugggccagaugcgaccagcagauccaggacaugcccgugccccagaacgacccccagcuggccuggggcugcaucagcggccugcagcaggagagaagcaugugcaccccccugcccguggccgcccagagcaccacccugcccagccugagcggcagacagguggagaucaaccugaagagauaccccacccccuaccccgaggaccugaagaacauggugaagagcgugcagaaccuggugggcaagcccagccacggcgugagaguggagaacagcaaccccaccgccaacaccgagcagaccgugaaggagaaguacgagcacaaguggcccguggcccccaaggagaucaccguggaggacagcuucgugcaccccgccaacgagaugagaaucggcgagcugcaccccagccuggccgagaccccccuguacccccccaagcuggugcugcugggcaaggacaagaaggagagcaccgacgagagcgagguggacaagacccacugccugaacaacagcgugagcagcggcaccuacagcgacuacagccccagccaggccagcagcggcagcagcaacaccagagugaaggugggcagccugcagaccaccgccaaggacgccgugcacaacagccuguggggcaacagaaucgcccccagcuucccccagccccuggacagcaagccccugcugagccagagagaggccgugccccccggcaacaucccccagagacccgacagacugcccaugagcgacaccuucaccgacaacuggaccgacggcagccacuacgacaacaccggcuucguggccgaggagaccaccgccgagaacgccaacagcaacccccugcugagcagcaagagcagaagcaccagcagccacggcagaagaccccugaucagacaggacagaaucgugggcgugccccuggagcuggagcagagcacccacagacacacccccgagaccgaggugccccccagcaaccccuggcagaacuggaccagaacccccagccccuucgaggacagaaccgccuuccccagcaagcuggagaccacccccaccaccagcccccugcccgagagaaaggagcacaucaaggagagcaccgagauccccagccccuucagccccggcgugcccugggaguaccacgacagcaaccccaacagaagccugagcaacguguucagccagauccacugcagacccgagagcagcaagggcgugaucagcaucagcaagagcaccgagagacugagcccccugaugaaggacaucaagagcaacaaguucaagaagagccagagcaucgacgagaucgacaucggcaccuacaagguguacaacaucccccuggagaacuacgccagcggcagcgaccaccugggcagccacgagagacccgacaagaugcugggccccgagcacggcaugagcagcaugagcagaagccagagcgugcccaugcuggacgacgagaugcugaccuacggcagcagcaagggcccccagcagcagaaggccagcaugaccaagaagguguaccaguucgaccagagcuucaacccccagggcagcguggaggugaaggccgagaagagaauccccccccccuuccagcacaaccccgaguacgugcagcaggccagcaagaacaucgccaaggaccugaucagccccagagccuacagaggcuacccccccauggagcagauguucagcuucagccagcccagcgugaacgaggacgccguggugaacgcccaguucgccagccagggcgccagagccggcuuccugagaagagccgacagccuggugagcgccaccgagauggccauguucagaagagugaacgagccccacgagcugccccccaccgacagauacggcagaccccccuacagaggcggccuggacagacagagcagcgugaccgugaccgagagccaguuccugaagagaaacggcagauacgaggacgagcaccccagcuaccaggaggugaaggcccaggccggcagcuuccccgugaagaaccugacccagagaagaccccugagcgccagaagcuacagcaccgagagcuacggcgccagccagaccagacccgugagcgccagacccaccauggccgcccugcuggagaagauccccagcgacuacaaccugggcaacuacggcgacaagcccagcgacaacagcgaccugaagaccagacccacccccgugaagggcgaggagagcugcggcaagaugcccgccgacuggagacagcagcugcugagacacaucgaggccagaagacuggacagaaacgccgccuacaagcacaacaccgugaaccugggcaugcugcccuacggcggcaucagcgccaugcacgccggcagaagcaugacccugaaccugcagaccaagagcaaguucgaccaccaggagcugccccugcagaagacccccagccagcagagcaacauccuggacaacggccaggaggacgugagccccagcggccaguggaaccccuacccccugggcagaagagacgugccccccgacaccaucaccaagaaggccggcagccacauccagacccugaugggcagccagagccugcagcacagaagcagagagcagcagcccuacgagggcaacaucaacaaggugaccauccagcaguuccagagcccccugcccauccagauccccagcagccaggccaccagaggcccccagcccggcagaugccugauccagaccaagggccagagaagcauggacggcuaccccgagcaguucugcgugagaaucgagaagaaccccggccugggcuucagcaucagcggcggcaucagcggccagggcaaccccuucaagcccagcgacaagggcaucuucgugaccagagugcagcccgacggccccgccagcaaccugcugcagcccggcgacaagauccugcaggccaacggccacagcuucgugcacauggagcacgagaaggccgugcugcugcugaagagcuuccagaacaccguggaccuggugauccagcuguucccccugagaggccugcuguucggccugaacguggagaaggccagcggcagcgagaagaagcugaucaccguggacccccacuacagcugggugcuguaccugcagaccugccugcugaccaagguguacacccccaagagcaugugcggcaccagcgaggugauccacaagcaggcccagagaagcaagaagcuggagagcccccacggccacgugcccagauaa

SEQ ID NO: 19421 - RNA, 2433 nt, Artificial Sequence
  LRRC8A__Homo_sapiens__NP_062540
augauccccgugaccgagcugagauacuucgccgacacccagcccgccuacagaauccugaagcccuggugggacguguucaccgacuacaucagcaucgugaugcugaugaucgccguguucggcggcacccugcaggugacccaggacaagaugaucugccugcccugcaagugggugaccaaggacagcugcaacgacagcuucagaggcugggccgcccccggccccgagcccaccuaccccaacagcaccauccugcccacccccgacaccggccccaccggcaucaaguacgaccuggacagacaccaguacaacuacguggacgccgugugcuacgagaacagacugcacugguucgccaaguacuuccccuaccuggugcugcugcacacccugaucuuccuggccugcagcaacuucugguucaaguuccccagaaccagcagcaagcuggagcacuucgugagcauccugcugaagugcuucgacagccccuggaccaccagagcccugagcgagaccgugguggaggagagcgaccccaagcccgccuucagcaagaugaacggcagcauggacaagaagagcagcaccgugagcgaggacguggaggccaccgugcccaugcugcagagaaccaagagcagaaucgagcagggcaucguggacagaagcgagaccggcgugcuggacaagaaggagggcgagcaggccaaggcccuguucgagaaggugaagaaguucagaacccacguggaggagggcgacaucguguacagacuguacaugagacagaccaucaucaaggugaucaaguucauccugaucaucugcuacaccguguacuacgugcacaacaucaaguucgacguggacugcaccguggacaucgagagccugaccggcuacagaaccuacagaugcgcccacccccuggccacccuguucaagauccuggccagcuucuacaucagccuggugaucuucuacggccugaucugcauguacacccugugguggaugcugagaagaagccugaagaaguacagcuucgagagcaucagagaggagagcagcuacagcgacauccccgacgugaagaacgacuucgccuucaugcugcaccugaucgaccaguacgacccccuguacagcaagagauucgccguguuccugagcgaggugagcgagaacaagcugagacagcugaaccugaacaacgaguggacccuggacaagcugagacagagacugaccaagaacgcccaggacaagcuggagcugcaccuguucaugcugagcggcauccccgacaccguguucgaccugguggagcuggaggugcugaagcuggagcugauccccgacgugaccaucccccccagcaucgcccagcugaccggccugaaggagcuguggcuguaccacaccgccgccaagaucgaggcccccgcccuggccuuccugagagagaaccugagagcccugcacaucaaguucaccgacaucaaggagaucccccuguggaucuacagccugaagacccuggaggagcugcaccugaccggcaaccugagcgccgagaacaacagauacaucgugaucgacggccugagagagcugaagagacugaaggugcugagacugaagagcaaccugagcaagcugccccagguggugaccgacgugggcgugcaccugcagaagcugagcaucaacaacgagggcaccaagcugaucgugcugaacagccugaagaagauggccaaccugaccgagcuggagcugaucagaugcgaccuggagagaaucccccacagcaucuucagccugcacaaccugcaggagaucgaccugaaggacaacaaccugaagaccaucgaggagaucaucagcuuccagcaccugcacagacugaccugccugaagcugugguacaaccacaucgccuacauccccauccagaucggcaaccugaccaaccuggagagacuguaccugaacagaaacaagaucgagaagauccccacccagcuguucuacugcagaaagcugagauaccuggaccugagccacaacaaccugaccuuccugcccgccgacaucggccugcugcagaaccugcagaaccuggccaucaccgccaacagaaucgagacccugccccccgagcuguuccagugcagaaagcugagagcccugcaccugggcaacaacgugcugcagagccugcccagcagagugggcgagcugaccaaccugacccagaucgagcugagaggcaacagacuggagugccugcccguggagcugggcgagugcccccugcugaagagaagcggccuggugguggaggaggaccuguucaacacccugccccccgaggugaaggagagacuguggagagccgacaaggagcaggccuaa

SEQ ID NO: 19422 - RNA, 2412 nt, Artificial Sequence
  LRRC8C__Homo_sapiens__XP_011540584
augauccccgugaccgaguucagacaguucagcgagcagcagcccgccuucagagugcugaagcccuggugggacguguucaccgacuaccugagcguggccaugcugaugaucggcguguucggcugcacccugcaggugaugcaggacaagaucaucugccugcccaagagagugcagcccgcccagaaccacagcagccugagcaacgugagccaggccguggccagcaccaccccccugcccccccccaagcccagccccgccaaccccaucaccguggagaugaagggccugaagaccgaccuggaccugcagcaguacagcuucaucaaccagaugugcuacgagagagcccugcacugguacgccaaguacuuccccuaccuggugcugauccacacccugguguucaugcugugcagcaacuucugguucaaguuccccggcagcagcagcaagaucgagcacuucaucagcauccugggcaagugcuucgacagccccuggaccaccagagcccugagcgaggugagcggcgaggacagcgaggagaaggacaacagaaagaacaacaugaacagaagcaacaccauccagagcggccccgaggacagccuggugaacagccagagccugaagagcauccccgagaaguucgugguggacaagagcaccgccggcgcccuggacaagaaggagggcgagcaggccaaggcccuguucgagaaggugaagaaguucagacugcacguggaggagggcgacauccuguacgccauguacgugagacagaccgugcugaaggugaucaaguuccugaucaucaucgccuacaacagcgcccuggugagcaaggugcaguucaccguggacugcaacguggacauccaggacaugaccggcuacaagaacuucagcugcaaccacaccauggcccaccuguucagcaagcugagcuucugcuaccugugcuucgugagcaucuacggccugaccugccuguacacccuguacuggcuguucuacagaagccugagagaguacagcuucgaguacgugagacaggagaccggcaucgacgacauccccgacgugaagaacgacuucgccuucaugcugcacaugaucgaccaguacgacccccuguacagcaagagauucgccguguuccugagcgaggugagcgagaacaagcugaagcagcugaaccugaacaacgaguggacccccgacaagcugagacagaagcugcagaccaacgcccacaacagacuggagcugccccugaucaugcugagcggccugcccgacaccguguucgagaucaccgagcugcagagccugaagcuggagaucaucaagaacgugaugauccccgccaccaucgcccagcuggacaaccugcaggagcugagccugcaccagugcagcgugaagauccacagcgccgcccugagcuuccugaaggagaaccugaaggugcugagcgugaaguucgacgacaugagagagcugccccccuggauguacggccugagaaaccuggaggagcuguaccuggugggcagccugagccacgacaucagcagaaacgugacccuggagagccugagagaccugaagagccugaagauccugagcaucaagagcaacgugagcaagaucccccaggccgugguggacgugagcagccaccugcagaagaugugcauccacaacgacggcaccaagcuggugaugcugaacaaccugaagaagaugaccaaccugaccgagcuggagcuggugcacugcgaccuggagagaaucccccacgccguguucagccugcugagccugcaggagcuggaccugaaggagaacaaccugaagagcaucgaggagaucgugagcuuccagcaccugagaaagcugaccgugcugaagcuguggcacaacagcaucaccuacauccccgagcacaucaagaagcugaccagccuggagagacugagcuucagccacaacaagaucgaggugcugcccagccaccuguuccugugcaacaagaucagauaccuggaccugagcuacaacgacaucagauucaucccccccgagaucggcgugcugcagagccugcaguacuucagcaucaccugcaacaagguggagagccugcccgacgagcuguacuucugcaagaagcugaagacccugaagaucggcaagaacagccugagcgugcugagccccaagaucggcaaccugcuguuccugagcuaccuggacgugaagggcaaccacuucgagauccugccccccgagcugggcgacugcagagcccugaagagagccggccuggugguggaggacgcccuguucgagacccugcccagcgacgugagagagcagaugaagaccgaguaa

SEQ ID NO: 19423 - RNA, 3099 nt, Artificial Sequence
  LRRCC1__Homo_sapiens__NP_208325
auggaggccgccgccgccgugguggccgccgaggccgagguggagaacgaggacggcgacagcagcugcggcgacgugugcuucauggacaagggccugcagagcaucagcgagcugagccuggacagcacccugcacgccgugaaccugcacugcaacaacaucagcaagaucgaggccaucgaccacaucuggaaccugcagcaccuggaccugagcagcaaccagaucagcagaaucgagggccugaacacccugaccaagcugugcacccugaaccugagcugcaaccugaucaccaagguggagggccuggaggagcugaucaaccugaccagacugaacgugagcuacaaccacaucgacgaccugagcggccugaucccccugcacggcaucaagcacaagcugagauacaucgaccugcacagcaacagaaucgacagcauccaccaccugcugcagugcauggugggccugcacuuccugaccaaccugauccuggagaaggacggcgacgacaaccccgugugcagacugcccggcuacagagccgugauccugcagacccugccccagcugagaauccuggacugcaagaacaucuucggcgagcccgugaaccugaccgagaucaacagcagccagcugcagugccuggagggccugcuggacaaccuggugagcagcgacagcccccugaacaucagcgaggacgagaucaucgacagaaugcccgugaucaccgcccccaucgacgagcuggugccccuggagcaguucgccagcacccccagcgacgccgugcugaccagcuucaugagcgugugccagagcagcgagcccgagaagaacaaccacgagaacgaccugcagaacgagaucaagcugcagaagcuggacgaccagauccugcagcugcugaacgagaccagcaacagcaucgacaacgugcuggagaaggaccccagacccaagagagacaccgacaucaccagcgagagcgacuacggcaacagaaaggagugcaacagaaaggugcccagaagaagcaagauccccuacgacgccaagaccauccagaccaucaagcaccacaacaagaacuacaacagcuucgugagcugcaacagaaagaugaagccccccuaccugaaggagcuguacgugagcagcagccuggccaacugccccaugcugcaggagagcgagaagcccaagaccgagaucaucaagguggaccagagccacagcgaggacaacaccuaccagagccugguggagcagcuggaccaggagagagagaagagauggagagccgagcaggccgagaacaagcugauggacuacaucgacgagcugcacaagcacgccaacgagaaggaggacauccacagccuggcccugcugaccaccgacagacugaaggagaucaucuucagagagagaaacagcaagggccagcuggaggugauggugcacaagcugcagaacgagaucaagaagcugaccguggagcugaugaaggccaaggaccagcaggaggaccaccugaagcaccugagaacccuggagaagacccuggagaagauggagagacagaagagacagcagcaggccgcccagaucagacugauccaggagguggagcugaaggccagcgccgccgacagagagaucuaccugcugagaaccagccugcacagagagagagagcaggcccagcagcugcaccagcugcuggcccugaaggagcaggagcacagaaaggagcuggagaccagagaguucuucaccgacgccgacuuccaggacgcccuggccaaggagaucgccaaggaggagaagaagcacgagcagaugaucaaggaguaccaggagaagaucgacgugcugagccagcaguacauggaccuggagaacgaguucagaaucgcccugaccguggaggccagaagauuccaggacgugaaggacggcuucgagaacguggccaccgagcuggccaagagcaagcacgcccugaucugggcccagagaaaggagaacgagagcagcagccugaucaaggaccugaccugcauggugaaggagcagaagaccaagcuggccgaggugagcaagcugaagcaggagaccgccgccaaccugcagaaccagaucaacacccuggagauccugaucgaggacgacaagcagaagagcauccagaucgagcugcugaagcacgagaaggugcagcugaucagcgagcuggccgccaaggagagccugaucuucggccugagaaccgagagaaagguguggggccacgagcuggcccagcagggcagcagccuggcccagaacagaggcaagcuggaggcccagaucgagagccugagcagagagaacgagugccugagaaagaccaacgagagcgacagcgacgcccugagaaucaagugcaagaucaucgacgaccagaccgagaccaucagaaagcugaaggacugccugcaggagaaggacgagcacaucaagagacugcaggagaagaucaccgagaucgagaagugcacccaggagcagcuggacgagaagagcagccagcuggacgaggugcuggagaagcuggagagacacaacgagagaaaggagaagcugaagcagcagcugaagggcaaggagguggagcuggaggagaucagaaaggccuacagcacccugaacagaaaguggcacgacaagggcgagcugcugugccaccuggagacccaggugaaggaggugaaggagaaguucgagaacaaggagaagaagcugaaggccgagagagacaagagcaucgagcugcagaagaacgccauggagaagcugcacagcauggacgacgccuucaagagacagguggacgccaucguggaggcccaccaggccgagaucgcccagcuggccaacgagaagcagaagugcaucgacagcgccaaccugaaggugcaccagaucgagaaggagaugagagagcugcuggaggagaccugcaagaacaagaagaccauggaggccaagaucaagcagcuggccuucgcccugaacgagauccagcaggacauguaa

SEQ ID NO: 19424 - RNA, 1923 nt, Artificial Sequence
  LRRFIP1__Homo_sapiens__NP_001131022
auggacaugggcacccagggcagcggcagaaagagacugcccaacagagagagacugaccgccgaggacgacgcccugaaccagaucgccagagaggccgaggccagacuggccgccaagagagccgccagagccgaggccagagagaucagaaugaaggagcuggagagacagcagaaggagaucuaccaggugcagaagaaguacuacggccuggacaccaaguggggcgacaucgagcaguggauggaggacagcgagagauacagcagaagaagcagaagaaacaccagcgccagcgacgaggacgagagaaugagcgugggcagcagaggcagccugagaagccagcccgaccuggaguacggcggccccuacgccuggaccaacggcuacgacggcgagcuguacggcagccagagccugaacagaagaagcggcagacccagcugccuguacagcgccgccagacccagcggcagcuacagagccagcgugcuggacgagggcagcuucggcggcaccagaagaggcagcaccagcggcagcagagcccccagcgaguacagcggccaccugaacagcagcagcagagccagcagcagagccagcagcgccagagccagccccgugguggaggagagacccgagaaggacuucaccgagaagggcagcagaaacaugcccggccugagcgccgccacccuggccagccugggcggcaccagcagcagaagaggcagcggcgacaccagcaucagcaucgacaccgaggccagcaucagagagaucaaggagcugaacgagcugaaggaccagauccaggacguggagggcaaguacaugcagggccugaaggagaugaaggacagccuggccgagguggaggagaaguacaagaaggccauggugagcaacgcccagcuggacaacgagaagaccaacuucauguaccagguggacacccugaaggacaugcugcuggagcuggaggagcagcuggccgagagcagaagacaguacgaggagaagaacaaggaguucgagagagagaagcacgcccacagcauccugcaguuccaguucgccgaggugaaggaggcccugaagcagagagaggagaugcuggaggagaucagacagcugcagcagaagcaggccagcagcaucagagagaucagcgaccugcaggagaccaucgaguggaaggacaagaagaucggcgcccuggagagacagaaggaguucuucgacagcgugagaagcgagagagacgaccugagagaggagguggugaugcugaaggaggagcugaagaagcacggcaucauccugaacagcgagaucgccaccaacggcgagaccagcgacacccugaacaacgugggcuaccagggccccaccaagaugaccaaggaggagcugaacgcccugaagagcaccggcgacggcacccuggacaucagacugaagaagcugguggacgagagagagugccugcuggagcagaucaagaagcugaagggccagcuggaggagagacagaagaucggcaagcuggacaaccugagaagcgaggacgacgugcuggagaacggcaccgacaugcacgugauggaccugcagagagacgccaacagacagaucagcgaccugaaguucaagcuggccaagagcgagcaggagaucaccgcccuggagcagaacgugaucagacuggagagccaggugagcagauacaagagcgccgccgagaacgccgagaagaucgaggacgagcugaaggccgagaagagaaagcugcagagagagcugagaagcgcccuggacaagaccgaggagcuggaggugagcaacggccaccuggugaagagacuggagaagaugaaggccaacagaagcgcccugcugagccagcaguaa

SEQ ID NO: 19425 - RNA, 1275 nt, Artificial Sequence
  LRRFIP2__Homo_sapiens__NP_001127841
augggcacccccgccagcggcagaaagagaacccccgugaaggacagauucagcgccgaggacgaggcccugagcaacaucgccagagaggccgaggccagacuggccgccaagagagccgccagagccgaggccagagacaucagaaugagagagcuggagagacagcagaaggagcuggacgagaagagcgacaagcaguacgccgagaacuacaccagacccagcagcagaaacagcgccagcgccaccaccccccugagcggcaacagcagcagaagaggcagcggcgacaccagcagccugaucgaccccgacaccagccugagcgagcugagagacaucuacgaccugaaggaccagauccaggacguggagggcagauacaugcagggccugaaggagcugaaggagagccugagcgagguggaggagaaguacaagaaggccauggugagcaacgcccagcuggacaacgagaagaacaaccugaucuaccagguggacacccugaaggacgugaucgaggagcaggaggagcagauggccgaguucuacagagagaacgaggagaagagcaaggagcuggagagacagaagcacaugugcagcgugcugcagcacaagauggaggagcugaaggagggccugagacagagagacgagcugaucgagaagcacggccuggugaucauccccgacggcacccccaacggcgacgugagccacgagcccguggccggcgccaucaccguggugagccaggaggccgcccaggugcuggagagcgccggcgagggcccccuggacgugagacugagaaagcuggccggcgagaaggaggagcugcugagccagaucagaaagcugaagcugcagcuggaggaggagagacagaagugcagcagaaacgacggcaccgugggcgaccuggccggccugcagaacggcagcgaccugcaguucaucgagaugcagagagacgccaacagacagaucagcgaguacaaguucaagcugagcaaggccgagcaggacaucaccacccuggagcagagcaucagcagacuggagggccaggugcugagauacaagaccgccgccgagaacgccgagaagguggaggacgagcugaaggccgagaagagaaagcugcagagagagcugagaaccgcccuggacaagaucgaggagauggagaugaccaacagccaccuggccaagagacuggagaagaugaaggccaacagaaccgcccugcuggcccagcaguaa

SEQ ID NO: 19426 - RNA, 6048 nt, Artificial Sequence
  LRRK1__Homo_sapiens__XP_011520315
auggccggcaugagccagagaccccccagcauguacuggugcgugggccccgaggagagcgccgugugccccgagagagccauggagacccugaacggcgccggcgacaccggcggcaagcccagcaccagaggcggcgaccccgccgccagaagcagaagaaccgagggcaucagagccgccuacagaagaggcgacagaggcggcgccagagaccugcuggaggaggccugcgaccagugcgccagccagcuggagaagggccagcugcugagcauccccgccgccuacggcgaccuggagauggugagauaccugcugagcaagagacugguggagcugcccaccgagcccaccgacgacaaccccgccgugguggccgccuacuucggccacaccgccguggugcaggagcugcuggagagccugcccggccccugcagcccccagagacugcugaacuggaugcuggcccuggccugccagagaggccaccugggcguggugaagcugcuggugcugacccacggcgccgaccccgagagcuacgccgugagaaagaacgaguuccccgugaucgugagacugccccuguacgccgccaucaagagcggcaacgaggacaucgccaucuuccugcugagacacggcgccuacuucugcagcuacauccugcuggacagccccgaccccagcaagcaccugcugagaaaguacuucaucgaggccagcccccugcccagcagcuaccccggcaagaccgcccugagagugaaguggagccaccugagacugcccuggguggaccuggacuggcugaucgacaucagcugccagaucaccgagcuggaccugagcgccaacugccuggccacccugcccagcgugauccccuggggccugaucaaccugagaaagcugaaccugagcgacaaccaccugggcgagcugcccggcgugcagagcagcgacgagaucaucugcagcagacugcuggagaucgacaucagcagcaacaagcugagccaccugccccccggcuuccugcaccugagcaagcugcagaagcugaccgccagcaagaacugccuggagaagcuguucgaggaggagaacgccaccaacuggaucggccugagaaagcugcaggagcuggacaucagcgacaacaagcugaccgagcugcccgcccuguuccugcacagcuucaagagccugaacagccugaacgugagcagaaacaaccugaagguguuccccgaccccugggccugcccccugaagugcugcaaggccagcagaaacgcccuggagugccugcccgacaagauggccguguucuggaagaaccaccugaaggacguggacuucagcgagaacgcccugaaggaggugccccugggccuguuccagcuggacgcccugauguuccugagacugcagggcaaccagcuggccgcccugcccccccaggagaaguggaccugcagacagcugaagacccuggaccugagcagaaaccagcugggcaagaacgaggacggccugaagaccaagagaaucgccuucuucaccaccagaggcagacagagaagcggcaccgaggccgccagcgugcuggaguuccccgccuuccugagcgagagccuggaggugcugugccugaacgacaaccaccuggacaccgugccccccagcgugugccugcugaagagccugagcgagcuguaccugggcaacaaccccggccugagagagcugccccccgagcugggccagcugggcaaccuguggcagcuggacaccgaggaccugaccaucagcaacgugcccgccgagauccagaaggagggccccaaggccaugcugagcuaccugagagcccagcugagaaaggccgagaagugcaagcugaugaagaugaucaucgugggcccccccagacagggcaagagcacccugcuggagauccugcagaccggcagagccccccagguggugcacggcgaggccaccaucagaaccaccaagugggagcugcagagacccgccggcagcagagccaagguggagagcguggaguucaacgugugggacaucggcggccccgccagcauggccaccgugaaccagugcuucuucaccgacaaggcccuguacguggugguguggaaccuggcccugggcgaggaggccguggccaaccugcaguucuggcugcugaacaucgaggccaaggcccccaacgccguggugcugguggugggcacccaccuggaccugaucgaggccaaguucagaguggagagaaucgccacccugagagccuacgugcuggcccugugcagaagccccagcggcagcagagccaccggcuuccccgacaucaccuucaagcaccugcacgagaucagcugcaagagccuggagggccaggagggccugagacagcugaucuuccacgugaccugcagcaugaaggacgugggcagcaccaucggcugccagagacuggccggcagacugauccccagaagcuaccugagccugcaggaggccgugcuggccgagcagcagagaagaagcagagacgacgacgugcaguaccugaccgacagacagcuggagcagcugguggagcagacccccgacaacgacaucaaggacuacgaggaccugcagagcgccaucagcuuccugaucgagaccggcacccugcugcacuuccccgacaccagccacggccugagaaaccuguacuuccuggaccccaucuggcugagcgagugccugcagagaaucuucaacaucaagggcagcagaagcguggccaagaacggcgugaucagagccgaggaccugagaaugcugcuggugggcaccggcuucacccagcagaccgaggagcaguacuuccaguuccuggccaaguucgagaucgcccugcccguggccaacgacagcuaccugcugccccaccugcugcccagcaagcccggccuggacacccacggcaugagacaccccaccgccaacaccauccagagaguguucaagaugagcuucgugcccgugggcuucuggcagagauucaucgccagaaugcugaucagccuggccgagauggaccugcagcuguucgagaacaagaagaacaccaagagcagaaacagaaaggugaccaucuacagcuucaccggcaaccagagaaacagaugcagcaccuucagagugaagagaaaccagaccaucuacuggcaggagggccugcuggugaccuucgacggcggcuaccugagcguggagagcagcgacgugaacuggaagaagaagaagagcggcggcaugaagaucgugugccagagcgaggugagagacuucagcgccauggccuucaucaccgaccacgugaacagccugaucgaccagugguuccccgcccugaccgccaccgagagcgacggcaccccccugauggagcaguacgugcccugccccgugugcgagaccgccugggcccagcacaccgaccccagcgagaagagcgaggacgugcaguacuucgacauggaggacugcgugcugaccgccaucgagagagacuucaucagcugccccagacaccccgaccugcccgugccccugcaggagcuggugcccgagcuguucaugaccgacuuccccgccagacuguuccuggagaacagcaagcuggagcacagcgaggacgagggcagcgugcugggccagggcggcagcggcaccgugaucuacagagccagauaccagggccagcccguggccgugaagagauuccacaucaagaaguucaagaacuucgccaacgugcccgccgacaccaugcugagacaccugagagccaccgacgccaugaagaacuucagcgaguucagacaggaggccagcaugcugcacgcccugcagcaccccugcaucguggcccugaucggcaucagcauccacccccugugcuucgcccuggagcuggccccccugagcagccugaacaccgugcugagcgagaacgccagagacagcagcuucaucccccugggccacaugcugacccagaagaucgccuaccagaucgccagcggccuggccuaccugcacaagaagaacaucaucuucugcgaccugaagagcgacaacauccugguguggagccuggacgugaaggagcacaucaacaucaagcugagcgacuacggcaucagcagacagagcuuccacgagggcgcccugggcguggagggcacccccggcuaccaggcccccgagaucagacccagaaucguguacgacgagaagguggacauguucagcuacggcauggugcuguacgagcugcugagcggccagagacccgcccugggccaccaccagcugcagaucgccaagaagcugagcaagggcaucagacccgugcugggccagcccgaggaggugcaguucagaagacugcaggcccugaugauggagugcugggacaccaagcccgagaagagaccccuggcccugagcguggugagccagaugaaggaccccaccuucgccaccuucauguacgagcugugcugcggcaagcagaccgccuucuucagcagccagggccaggaguacaccgugguguucugggacggcaaggaggagagcagaaacuacaccguggugaacaccgagaagggccugauggaggugcagagaaugugcugccccggcaugaaggugagcugccagcugcaggugcagagaagccuguggaccgccaccgaggaccagaagaucuacaucuacacccugaagggcaugugcccccugaacaccccccagcaggcccuggacacccccgccguggugaccugcuuccuggccgugcccgugaucaagaagaacagcuaccuggugcuggccggccuggccgacggccugguggccguguuccccguggugagaggcacccccaaggacagcugcagcuaccugugcagccacaccgccaacagaagcaaguucagcaucgccgacgaggacgccagacagaaccccuaccccgugaaggccauggagguggugaacagcggcagcgaggugugguacagcaacggccccggccugcuggugaucgacugcgccagccuggagaucugcagaagacuggagcccuacauggcccccagcauggugaccagcguggugugcagcagcgagggcagaggcgaggaggugguguggugccuggacgacaaggccaacagccuggugauguaccacagcaccaccuaccagcugugcgccagauacuucugcggcgugcccagcccccugagagacauguuccccgugagaccccuggacaccgagccccccgccgccagccacaccgccaaccccaaggugcccgagggcgacagcaucgccgacgugagcaucauguacagcgaggagcugggcacccagauccugauccaccaggagagccugaccgacuacugcagcaugagcagcuacagcagcagcccccccagacaggccgccagaagccccagcagccugcccagcagccccgccagcagcagcagcgugcccuucagcaccgacugcgaggacagcgacaugcugcacacccccggcgccgccagcgacagaagcgagcacgaccugacccccauggacggcgagaccuucagccagcaccugcaggccgugaagauccuggccgugagagaccugaucugggugcccagaagaggcggcgacgugaucgugaucggccuggagaaggacagcggcgcccagagaggcagagugaucgccgugcugaaggccagagagcugaccccccacggcgugcugguggacgccgccgugguggccaaggacaccguggugugcaccuucgagaacgagaacaccgaguggugccuggccguguggagaggcuggggcgccagagaguucgacaucuucuaccagagcuacgaggagcugggcagacuggaggccugcaccagaaagagaagauaa

SEQ ID NO: 19427 - RNA, 7584 nt, Artificial Sequence
  LRRK2__Homo_sapiens__NP_940980
auggccagcggcagcugccagggcugcgaggaggacgaggagacccugaagaagcugaucgugagacugaacaacgugcaggagggcaagcagaucgagacccuggugcagauccuggaggaccugcugguguucaccuacagcgagcacgccagcaagcuguuccagggcaagaacauccacgugccccugcugaucgugcuggacagcuacaugagaguggccagcgugcagcaggugggcuggagccugcugugcaagcugaucgaggugugccccggcaccaugcagagccugaugggcccccaggacgugggcaacgacugggaggugcugggcgugcaccagcugauccugaagaugcugaccgugcacaacgccagcgugaaccugagcgugaucggccugaagacccuggaccugcugcugaccagcggcaagaucacccugcugauccuggacgaggagagcgacaucuucaugcugaucuucgacgccaugcacagcuuccccgccaacgacgaggugcagaagcugggcugcaaggcccugcacgugcuguucgagagagugagcgaggagcagcugaccgaguucguggagaacaaggacuacaugauccugcugagcgcccugaccaacuucaaggacgaggaggagaucgugcugcacgugcugcacugccugcacagccuggccauccccugcaacaacguggaggugcugaugagcggcaacgugagaugcuacaacaucgugguggaggccaugaaggccuuccccaugagcgagagaauccaggaggugagcugcugccugcugcacagacugacccugggcaacuucuucaacauccuggugcugaacgaggugcacgaguucguggugaaggccgugcagcaguaccccgagaacgccgcccugcagaucagcgcccugagcugccuggcccugcugaccgagaccaucuuccugaaccaggaccuggaggagaagaacgagaaccaggagaacgacgacgagggcgaggaggacaagcuguucuggcuggaggccugcuacaaggcccugaccuggcacagaaagaacaagcacgugcaggaggccgccugcugggcccugaacaaccugcugauguaccagaacagccugcacgagaagaucggcgacgaggacggccacuuccccgcccacagagaggugaugcugagcaugcugaugcacagcagcagcaaggagguguuccaggccagcgccaacgcccugagcacccugcuggagcagaacgugaacuucagaaagauccugcugagcaagggcauccaccugaacgugcuggagcugaugcagaagcacauccacagccccgagguggccgagagcggcugcaagaugcugaaccaccuguucgagggcagcaacaccagccuggacaucauggccgccguggugcccaagauccugaccgugaugaagagacacgagaccagccugcccgugcagcuggaggcccugagagccauccugcacuucaucgugcccggcaugcccgaggagagcagagaggacaccgaguuccaccacaagcugaacauggugaagaagcagugcuucaagaacgacauccacaagcuggugcuggccgcccugaacagauucaucggcaaccccggcauccagaagugcggccugaaggugaucagcagcaucgugcacuuccccgacgcccuggagaugcugagccuggagggcgccauggacagcgugcugcacacccugcagauguaccccgacgaccaggagauccagugccugggccugagccugaucggcuaccugaucaccaagaagaacguguucaucggcaccggccaccugcuggccaagauccuggugagcagccuguacagauucaaggacguggccgagauccagaccaagggcuuccagaccauccuggccauccugaagcugagcgccagcuucagcaagcugcuggugcaccacagcuucgaccuggugaucuuccaccagaugagcagcaacaucauggagcagaaggaccagcaguuccugaaccugugcugcaagugcuucgccaagguggccauggacgacuaccugaagaacgugaugcuggagagagccugcgaccagaacaacagcaucaugguggagugccugcugcugcugggcgccgacgccaaccaggccaaggagggcagcagccugaucugccaggugugcgagaaggagagcagccccaagcugguggagcugcugcugaacagcggcagcagagagcaggacgugagaaaggcccugaccaucagcaucggcaagggcgacagccagaucaucagccugcugcugagaagacuggcccuggacguggccaacaacagcaucugccugggcggcuucugcaucggcaagguggagcccagcuggcugggcccccuguuccccgacaagaccagcaaccugagaaagcagaccaacaucgccagcacccuggccagaauggugaucagauaccagaugaagagcgccguggaggagggcaccgccagcggcagcgacggcaacuucagcgaggacgugcugagcaaguucgacgaguggaccuucauccccgacagcagcauggacagcguguucgcccagagcgacgaccuggacagcgagggcagcgagggcagcuuccuggugaagaagaagagcaacagcaucagcgugggcgaguucuacagagacgccgugcugcagagaugcagccccaaccugcagagacacagcaacagccugggccccaucuucgaccacgaggaccugcugaagagaaagagaaagauccugagcagcgacgacagccugagaagcagcaagcugcagagccacaugagacacagcgacagcaucagcagccuggccagcgagagagaguacaucaccagccuggaccugagcgccaacgagcugagagacaucgacgcccugagccagaagugcugcaucagcgugcaccuggagcaccuggagaagcuggagcugcaccagaacgcccugaccagcuucccccagcagcugugcgagacccugaagagccugacccaccuggaccugcacagcaacaaguucaccagcuuccccagcuaccugcugaagaugagcugcaucgccaaccuggacgugagcagaaacgacaucggccccagcguggugcuggaccccaccgugaagugccccacccugaagcaguucaaccugagcuacaaccagcugagcuucgugcccgagaaccugaccgacgugguggagaagcuggagcagcugauccuggagggcaacaagaucagcggcaucugcagcccccugagacugaaggagcugaagauccugaaccugagcaagaaccacaucagcagccugagcgagaacuuccuggaggccugccccaagguggagagcuucagcgccagaaugaacuuccuggccgccaugcccuuccugccccccagcaugaccauccugaagcugagccagaacaaguucagcugcauccccgaggccauccugaaccugccccaccugagaagccuggacaugagcagcaacgacauccaguaccugcccggccccgcccacuggaagagccugaaccugagagagcugcuguucagccacaaccagaucagcauccuggaccugagcgagaaggccuaccuguggagcagaguggagaagcugcaccugagccacaacaagcugaaggagaucccccccgagaucggcugccuggagaaccugaccagccuggacgugagcuacaaccuggagcugagaagcuuccccaacgagaugggcaagcugagcaagaucugggaccugccccuggacgagcugcaccugaacuucgacuucaagcacaucggcugcaaggccaaggacaucaucagauuccugcagcagagacugaagaaggccgugcccuacaacagaaugaagcugaugaucgugggcaacaccggcagcggcaagaccacccugcugcagcagcugaugaagaccaagaagagcgaccugggcaugcagagcgccaccgugggcaucgacgugaaggacuggcccauccagaucagagacaagagaaagagagaccuggugcugaacgugugggacuucgccggcagagaggaguucuacagcacccacccccacuucaugacccagagagcccuguaccuggccguguacgaccugagcaagggccaggccgagguggacgccaugaagcccuggcuguucaacaucaaggccagagccagcagcagccccgugauccuggugggcacccaccuggacgugagcgacgagaagcagagaaaggccugcaugagcaagaucaccaaggagcugcugaacaagagaggcuuccccgccaucagagacuaccacuucgugaacgccaccgaggagagcgacgcccuggccaagcugagaaagaccaucaucaacgagagccugaacuucaagaucagagaccagcugguggugggccagcugauccccgacugcuacguggagcuggagaagaucauccugagcgagagaaagaacgugcccaucgaguuccccgugaucgacagaaagagacugcugcagcuggugagagagaaccagcugcagcuggacgagaacgagcugccccacgccgugcacuuccugaacgagagcggcgugcugcugcacuuccaggaccccgcccugcagcugagcgaccuguacuucguggagcccaaguggcugugcaagaucauggcccagauccugaccgugaagguggagggcugccccaagcaccccaagggcaucaucagcagaagagacguggagaaguuccugagcaagaagagaaaguuccccaagaacuacaugagccaguacuucaagcugcuggagaaguuccagaucgcccugcccaucggcgaggaguaccugcuggugcccagcagccugagcgaccacagacccgugaucgagcugccccacugcgagaacagcgagaucaucaucagacuguacgagaugcccuacuuccccaugggcuucuggagcagacugaucaacagacugcuggagaucagccccuacaugcugagcggcagagagagagcccugagacccaacagaauguacuggagacagggcaucuaccugaacuggagccccgaggccuacugccuggugggcagcgaggugcuggacaaccaccccgagagcuuccugaagaucaccgugcccagcugcagaaagggcugcauccugcugggccaggugguggaccacaucgacagccugauggaggagugguuccccggccugcuggagaucgacaucugcggcgagggcgagacccugcugaagaagugggcccuguacagcuucaacgacggcgaggagcaccagaagauccugcuggacgaccugaugaagaaggccgaggagggcgaccugcuggugaaccccgaccagcccagacugaccauccccaucagccagaucgcccccgaccugauccuggccgaccugcccagaaacaucaugcugaacaacgacgagcuggaguucgagcaggcccccgaguuccugcugggcgacggcagcuucggcagcguguacagagccgccuacgagggcgaggagguggccgugaagaucuucaacaagcacaccagccugagacugcugagacaggagcugguggugcugugccaccugcaccaccccagccugaucagccugcuggccgccggcaucagacccagaaugcuggugauggagcuggccagcaagggcagccuggacagacugcugcagcaggacaaggccagccugaccagaacccugcagcacagaaucgcccugcacguggccgacggccugagauaccugcacagcgccaugaucaucuacagagaccugaagccccacaacgugcugcuguucacccuguaccccaacgccgccaucaucgccaagaucgccgacuacggcaucgcccaguacugcugcagaaugggcaucaagaccagcgagggcacccccggcuucagagcccccgagguggccagaggcaacgugaucuacaaccagcaggccgacguguacagcuucggccugcugcuguacgacauccugaccaccggcggcagaaucguggagggccugaaguuccccaacgaguucgacgagcuggagauccagggcaagcugcccgaccccgugaaggaguacggcugcgcccccuggcccaugguggagaagcugaucaagcagugccugaaggagaacccccaggagagacccaccagcgcccagguguucgacauccugaacagcgccgagcuggugugccugaccagaagaauccugcugcccaagaacgugaucguggagugcaugguggccacccaccacaacagcagaaacgccagcaucuggcugggcugcggccacaccgacagaggccagcugagcuuccuggaccugaacaccgagggcuacaccagcgaggagguggccgacagcagaauccugugccuggcccuggugcaccugcccguggagaaggagagcuggaucgugagcggcacccagagcggcacccugcuggugaucaacaccgaggacggcaagaagagacacacccuggagaagaugaccgacagcgugaccugccuguacugcaacagcuucagcaagcagagcaagcagaagaacuuccugcuggugggcaccgccgacggcaagcuggccaucuucgaggacaagaccgugaagcugaagggcgccgccccccugaagauccugaacaucggcaacgugagcaccccccugaugugccugagcgagagcaccaacagcaccgagagaaacgugauguggggcggcugcggcaccaagaucuucagcuucagcaacgacuucaccauccagaagcugaucgagaccagaaccagccagcuguucagcuacgccgccuucagcgacagcaacaucaucaccguggugguggacaccgcccuguacaucgccaagcagaacagccccgugguggaggugugggacaagaagaccgagaagcugugcggccugaucgacugcgugcacuuccugagagaggugauggugaaggagaacaaggagagcaagcacaagaugagcuacagcggcagagugaagacccugugccugcagaagaacaccgcccuguggaucggcaccggcggcggccacauccugcugcuggaccugagcaccagaagacugaucagagugaucuacaacuucugcaacagcgugagagugaugaugaccgcccagcugggcagccugaagaacgugaugcuggugcugggcuacaacagaaagaacaccgagggcacccagaagcagaaggagauccagagcugccugaccgugugggacaucaaccugccccacgaggugcagaaccuggagaagcacaucgaggugagaaaggagcuggccgagaagaugagaagaaccagcguggaguaa

SEQ ID NO: 19428 - RNA, 2151 nt, Artificial Sequence
  LRRN1__Homo_sapiens__NP_065924
auggccagaaugagcuucgugaucgccgccugccagcuggugcugggccugcugaugaccagccugaccgagagcagcauccagaacagcgagugcccccagcugugcgugugcgagaucagacccugguucaccccccagagcaccuacagagaggccaccaccguggacugcaacgaccugagacugaccagaauccccagcaaccugagcagcgacacccaggugcugcugcugcagagcaacaacaucgccaagaccguggacgagcugcagcagcuguucaaccugaccgagcuggacuucagccagaacaacuucaccaacaucaaggaggugggccuggccaaccugacccagcugaccacccugcaccuggaggagaaccagaucaccgagaugaccgacuacugccugcaggaccugagcaaccugcaggagcuguacaucaaccacaaccagaucagcaccaucagcgcccacgccuucgccggccugaagaaccugcugagacugcaccugaacagcaacaagcugaaggugaucgacagcagaugguucgacagcacccccaaccuggagauccugaugaucggcgagaaccccgugaucggcauccuggacaugaacuucaagccccuggccaaccugagaagccuggugcuggccggcauguaccugaccgacauccccggcaacgcccuggugggccuggacagccuggagagccugagcuucuacgacaacaagcuggugaaggugccccagcuggcccugcagaaggugcccaaccugaaguuccuggaccugaacaagaaccccauccacaagauccaggagggcgacuucaagaacaugcugagacugaaggagcugggcaucaacaacaugggcgagcuggugagcguggacagauacgcccuggacaaccugcccgagcugaccaagcuggaggccaccaacaaccccaagcugagcuacauccacagacuggccuucagaagcgugcccgcccuggagagccugaugcugaacaacaacgcccugaacgccaucuaccagaagaccguggagagccugcccaaccugagagagaucagcauccacagcaacccccugagaugcgacugcgugauccacuggaucaacagcaacaagaccaacaucagauucauggagccccugagcauguucugcgccaugccccccgaguacaagggccaccaggugaaggaggugcugauccaggacagcagcgagcagugccugcccaugaucagccacgacagcuuccccaacagacugaacguggacaucggcaccaccguguuccuggacugcagagccauggccgagcccgagcccgagaucuacugggugacccccaucggcaacaagaucaccguggagacccugagcgacaaguacaagcugagcagcgagggcacccuggagaucagcaacauccagaucgaggacagcggcagauacaccugcguggcccagaacgugcagggcgccgacaccagaguggccaccaucaaggugaacggcacccugcuggacggcacccaggugcugaagaucuacgugaagcagaccgagagccacagcauccuggugagcuggaaggugaacagcaacgugaugaccagcaaccugaaguggagcagcgccaccaugaagaucgacaacccccacaucaccuacaccgccagagugcccguggacgugcacgaguacaaccugacccaccugcagcccagcaccgacuacgaggugugccugaccgugagcaacauccaccagcagacccagaagagcugcgugaacgugaccaccaagaacgccgccuucgccguggacaucagcgaccaggagaccagcaccgcccuggccgccgugaugggcagcauguucgccgugaucagccuggccagcaucgccguguacuucgccaagagauucaagagaaagaacuaccaccacagccugaagaaguacaugcagaagaccagcagcaucccccugaacgagcuguaccccccccugaucaaccugugggagggcgacagcgagaaggacaaggacggcagcgccgacaccaagcccacccagguggacaccagcagaagcuacuacaugugguaa

SEQ ID NO: 19429 - RNA, 2142 nt, Artificial Sequence
  LRRN2__Homo_sapiens__NP_006329
augagacugcugguggccccccugcugcuggccuggguggccggcgccaccgccgccgugcccguggugcccuggcacgugcccugccccccccagugcgccugccagaucagacccugguacacccccagaagcagcuacagagaggccaccaccguggacugcaacgaccuguuccugaccgccgugccccccgcccugcccgccggcacccagacccugcugcugcagagcaacagcaucgugagaguggaccagagcgagcugggcuaccuggccaaccugaccgagcuggaccugagccagaacagcuucagcgacgccagagacugcgacuuccacgcccugccccagcugcugagccugcaccuggaggagaaccagcugaccagacuggaggaccacagcuucgccggccuggccagccugcaggagcuguaccugaaccacaaccagcuguacagaaucgcccccagagccuucagcggccugagcaaccugcugagacugcaccugaacagcaaccugcugagagccaucgacagcagaugguucgagaugcugcccaaccuggagauccugaugaucggcggcaacaagguggacgccauccuggacaugaacuucagaccccuggccaaccugagaagccuggugcuggccggcaugaaccugagagagaucagcgacuacgcccuggagggccugcagagccuggagagccugagcuucuacgacaaccagcuggccagagugcccagaagagcccuggagcaggugcccggccugaaguuccuggaccugaacaagaacccccugcagagagugggccccggcgacuucgccaacaugcugcaccugaaggagcugggccugaacaacauggaggagcuggugagcaucgacaaguucgcccuggugaaccugcccgagcugaccaagcuggacaucaccaacaaccccagacugagcuucauccaccccagagccuuccaccaccugccccagauggagacccugaugcugaacaacaacgcccugagcgcccugcaccagcagaccguggagagccugcccaaccugcaggaggugggccugcacggcaaccccaucagaugcgacugcgugaucagaugggccaacgccaccggcaccagagugagauucaucgagccccagagcacccugugcgccgagccccccgaccugcagagacugcccgugagagaggugcccuucagagagaugaccgaccacugccugccccugaucagccccagaagcuucccccccagccugcagguggccagcggcgagagcauggugcugcacugcagagcccuggccgagcccgagcccgagaucuacugggugacccccgccggccugagacugacccccgcccacgccggcagaagauacagaguguaccccgagggcacccuggagcugagaagagugaccgccgaggaggccggccuguacaccugcguggcccagaaccuggugggcgccgacaccaagaccgugagcgugguggugggcagagcccugcugcagcccggcagagacgagggccagggccuggagcugagagugcaggagacccaccccuaccacauccugcugagcugggugaccccccccaacaccgugagcaccaaccugaccuggagcagcgccagcagccugagaggccagggcgccaccgcccuggccagacugcccagaggcacccacagcuacaacaucaccagacugcugcaggccaccgaguacugggccugccugcagguggccuucgccgacgcccacacccagcuggccugcgugugggccagaaccaaggaggccaccagcugccacagagcccugggcgacagacccggccugaucgccauccuggcccuggccgugcugcugcuggccgccggccuggccgcccaccugggcaccggccagcccagaaagggcgugggcggcagaagaccccugccccccgccugggccuucuggggcuggagcgcccccagcgugagaguggugagcgccccccuggugcugcccuggaaccccggcagaaagcugcccagaagcagcgagggcgagacccugcugcccccccugagccagaacagcuaa

SEQ ID NO: 19430 - RNA, 2127 nt, Artificial Sequence
  LRRN3__Homo_sapiens__NP_001093128
augaaggacaugccccugagaauccacgugcugcugggccuggccaucaccacccuggugcaggccguggacaagaagguggacugccccagacugugcaccugcgagaucagacccugguucacccccagaagcaucuacauggaggccagcaccguggacugcaacgaccugggccugcugaccuuccccgccagacugcccgccaacacccagauccugcugcugcagaccaacaacaucgccaagaucgaguacagcaccgacuuccccgugaaccugaccggccuggaccugagccagaacaaccugagcagcgugaccaacaucaacgugaagaagaugccccagcugcugagcguguaccuggaggagaacaagcugaccgagcugcccgagaagugccugagcgagcugagcaaccugcaggagcuguacaucaaccacaaccugcugagcaccaucagccccggcgccuucaucggccugcacaaccugcugagacugcaccugaacagcaacagacugcagaugaucaacagcaagugguucgacgcccugcccaaccuggagauccugaugaucggcgagaaccccaucaucagaaucaaggacaugaacuucaagccccugaucaaccugagaagccuggugaucgccggcaucaaccugaccgagauccccgacaacgcccuggugggccuggagaaccuggagagcaucagcuucuacgacaacagacugaucaaggugccccacguggcccugcagaagguggugaaccugaaguuccuggaccugaacaagaaccccaucaacagaaucagaagaggcgacuucagcaacaugcugcaccugaaggagcugggcaucaacaacaugcccgagcugaucagcaucgacagccuggccguggacaaccugcccgaccugagaaagaucgaggccaccaacaaccccagacugagcuacauccaccccaacgccuucuucagacugcccaagcuggagagccugaugcugaacagcaacgcccugagcgcccuguaccacggcaccaucgagagccugcccaaccugaaggagaucagcauccacagcaaccccaucagaugcgacugcgugaucagauggaugaacaugaacaagaccaacaucagauucauggagcccgacagccuguucugcguggacccccccgaguuccagggccagaacgugagacaggugcacuucagagacaugauggagaucugccugccccugaucgcccccgagagcuuccccagcaaccugaacguggaggccggcagcuacgugagcuuccacugcagagccaccgccgagccccagcccgagaucuacuggaucacccccagcggccagaagcugcugcccaacacccugaccgacaaguucuacgugcacagcgagggcacccuggacaucaacggcgugacccccaaggagggcggccuguacaccugcaucgccaccaaccuggugggcgccgaccugaagagcgugaugaucaagguggacggcagcuucccccaggacaacaacggcagccugaacaucaagaucagagacauccaggccaacagcgugcuggugagcuggaaggccagcagcaagauccugaagagcagcgugaaguggaccgccuucgugaagaccgagaacagccacgccgcccagagcgccagaauccccagcgacgugaagguguacaaccugacccaccugaaccccagcaccgaguacaagaucugcaucgacauccccaccaucuaccagaagaacagaaagaagugcgugaacgugaccaccaagggccugcaccccgaccagaaggaguacgagaagaacaacaccaccacccugauggccugccugggcggccugcugggcaucaucggcgugaucugccugaucagcugccugagccccgagaugaacugcgacggcggccacagcuacgugagaaacuaccugcagaagcccaccuucgcccugggcgagcuguaccccccccugaucaaccugugggaggccggcaaggagaagagcaccagccugaaggugaaggccaccgugaucggccugcccaccaacaugagcuaa

SEQ ID NO: 19431 - RNA, 2223 nt, Artificial Sequence
  LRRN4__Homo_sapiens__NP_689824
augagacagacccugccccugcugcugcugaccgugcugagacccagcugggccgaccccccccaggagaaggugccccuguucagagugacccagcagggccccuggggcagcagcggcagcaacgccaccgacagccccugcgagggccugcccgccgccgacgccaccgcccugacccuggccaacagaaaccuggagagacugcccggcugccugcccagaacccugagaagccuggacgccagccacaaccugcugagagcccugagcaccagcgagcugggccaccuggagcagcugcaggugcugacccugagacacaacagaaucgccgcccugagauggggccccggcggccccgccggccugcacacccuggaccugagcuacaaccagcuggccgcccugccccccugcaccggccccgcccugagcagccugagagcccuggcccuggccggcaacccccugagagcccugcagcccagagccuucgccugcuuccccgcccugcagcugcugaaccugagcugcaccgcccugggcagaggcgcccagggcggcaucgccgaggccgccuucgccggcgaggacggcgccccccuggugacccuggaggugcuggaccugagcggcaccuuccuggagagaguggagagcggcuggaucagagaccugcccaagcugaccagccuguaccugagaaagaugcccagacugaccacccuggagggcgacaucuucaagaugacccccaaccugcagcagcuggacugccaggacagccccgcccuggccagcguggccacccacaucuuccaggacaccccccaccugcaggugcugcuguuccagaacugcaaccugagcagcuucccccccuggacccuggacagcagccaggugcugagcaucaaccuguucggcaacccccugaccugcagcugcgaccugagcuggcugcugaccgacgccaagagaaccgugcugagcagagccgccgacaccaugugcgcccccgccgccggcagcagcggccccuucagcgccagccugagccugagccagcugcccggcgugugccagagcgaccagagcaccacccugggcgccagccacccccccugcuucaacagaagcaccuacgcccagggcaccaccguggcccccagcgccgcccccgccaccagacccgccggcgaccagcagagcgugagcaaggcccccaacgugggcagcagaaccaucgccgccuggccccacagcgacgccagagagggcaccgcccccagcaccaccaacagcguggccggccacagcaacagcagcguguuccccagagccgccagcaccaccagaacccagcacagaggcgagcacgcccccgagcuggugcuggagcccgacaucagcgccgccagcaccccccuggccagcaagcugcugggccccuuccccaccagcugggacagaagcaucagcagcccccagcccggccagagaacccacgccaccccccaggcccccaaccccagccugagcgagggcgagauccccgugcugcugcuggacgacuacagcgaggaggaggagggcagaaaggaggaggugggcaccccccaccaggacgugcccugcgacuaccaccccugcaagcaccugcagacccccugcgccgagcugcagagaagauggagaugcagaugccccggccugagcggcgaggacaccauccccgacccccccagacugcagggcgugaccgagaccaccgacaccagcgcccuggugcacuggugcgcccccaacagcguggugcacggcuaccagaucagauacagcgccgagggcugggccggcaaccagagcguggugggcgugaucuacgccaccgccagacagcacccccuguacggccugagccccggcaccaccuacagagugugcgugcuggccgccaacagagccggccugagccagcccagaagcagcggcuggagaagccccugcgccgccuucaccaccaagcccagcuucgcccugcugcugagcggccugugcgccgccagcggccugcugcuggccagcaccguggugcugagcgccugccugugcagaagaggccagacccugggccugcagagaugcgacacccaccugguggccuacaagaaccccgccuucgacgacuacccccugggccugcagaccgugagcuaa

SEQ ID NO: 19432 - RNA, 1569 nt, Artificial Sequence
  LRRTM1__Homo_sapiens__NP_849161
auggacuuccugcugcugggccugugccuguacuggcugcugagaagacccagcggcguggugcugugccugcugggcgccugcuuccagaugcugcccgccgcccccagcggcugcccccagcugugcagaugcgagggcagacugcuguacugcgaggcccugaaccugaccgaggccccccacaaccugagcggccugcugggccugagccugagauacaacagccugagcgagcugagagccggccaguucaccggccugaugcagcugaccuggcuguaccuggaccacaaccacaucugcagcgugcagggcgacgccuuccagaagcugagaagagugaaggagcugacccugagcagcaaccagaucacccagcugcccaacaccaccuucagacccaugcccaaccugagaagcguggaccugagcuacaacaagcugcaggcccuggcccccgaccuguuccacggccugagaaagcugaccacccugcacaugagagccaacgccauccaguucgugcccgugagaaucuuccaggacugcagaagccugaaguuccuggacaucggcuacaaccagcugaagagccuggccagaaacagcuucgccggccuguucaagcugaccgagcugcaccuggagcacaacgaccuggugaaggugaacuucgcccacuuccccagacugaucagccugcacagccugugccugagaagaaacaagguggccaucguggugagcagccuggacuggguguggaaccuggagaagauggaccugagcggcaacgagaucgaguacauggagccccacguguucgagaccgugccccaccugcagagccugcagcuggacagcaacagacugaccuacaucgagcccagaauccugaacagcuggaagagccugaccagcaucacccuggccggcaaccugugggacugcggcagaaacgugugcgcccuggccagcuggcugaacaacuuccagggcagauacgacggcaaccugcagugcgccagccccgaguacgcccagggcgaggacgugcuggacgccguguacgccuuccaccugugcgaggacggcgccgagcccaccagcggccaccugcugagcgccgugaccaacagaagcgaccugggcccccccgccagcagcgccaccacccuggccgacggcggcgagggccagcacgacggcaccuucgagcccgccaccguggcccugcccggcggcgagcacgccgagaacgccgugcagauccacaagguggugaccggcaccauggcccugaucuucagcuuccugaucguggugcuggugcuguacgugagcuggaagugcuuccccgccagccugagacagcugagacagugcuucgugacccagagaagaaagcagaagcagaagcagaccaugcaccagauggccgccaugagcgcccaggaguacuacguggacuacaagcccaaccacaucgagggcgcccuggugaucaucaacgaguacggcagcugcaccugccaccagcagcccgccagagagugcgagguguaa

SEQ ID NO: 19433 - RNA, 1551 nt, Artificial Sequence
  LRRTM2__Homo_sapiens__NP_056379
augggccugcacuucaaguggccccugggcgcccccaugcuggccgccaucuacgccaugagcauggugcugaagaugcugcccgcccugggcauggccugcccccccaagugcagaugcgagaagcugcuguucuacugcgacagccagggcuuccacagcgugcccaacgccaccgacaagggcagccugggccugagccugagacacaaccacaucaccgagcuggagagagaccaguucgccagcuucagccagcugaccuggcugcaccuggaccacaaccagaucagcaccgugaaggaggacgccuuccagggccuguacaagcugaaggagcugauccugagcagcaacaagaucuucuaccugcccaacaccaccuucacccagcugaucaaccugcagaaccuggaccugagcuucaaccagcugagcagccugcaccccgagcuguucuacggccugagaaagcugcagacccugcaccugagaagcaacagccugagaaccauccccgugagacuguucugggacugcagaagccuggaguuccuggaccugagcaccaacagacugagaagccuggccagaaacggcuucgccggccugaucaagcugagagagcugcaccuggagcacaaccagcugaccaagaucaacuucgcccacuuccugagacugagcagccugcacacccuguuccugcaguggaacaagaucagcaaccugaccugcggcauggaguggaccuggggcacccuggagaagcuggaccugaccggcaacgagaucaaggccaucgaccugaccguguucgagaccaugcccaaccugaagauccugcugauggacaacaacaagcugaacagccuggacagcaagauccugaacagccugagaagccugaccaccgugggccugagcggcaaccugugggagugcagcgccagaaucugcgcccuggccagcuggcugggcagcuuccagggcagaugggagcacagcauccugugccacagccccgaccacacccagggcgaggacauccuggacgccgugcacggcuuccagcugugcuggaaccugagcaccaccgugaccgugauggccaccaccuacagagaccccaccaccgaguacaccaagagaaucagcagcagcagcuaccacgugggcgacaaggagauccccaccaccgccggcaucgccgugaccaccgaggagcacuuccccgagcccgacaacgccaucuucacccagagagugaucaccggcaccauggcccugcuguucagcuucuucuucaucaucuucaucguguucaucagcagaaagugcugcccccccacccugagaagaaucagacagugcagcauggugcagaaccacagacagcugagaagccagaccagacugcacaugagcaacaugagcgaccagggccccuacaacgaguacgagcccacccacgagggccccuucaucaucaucaacggcuacggccagugcaagugccagcagcugcccuacaaggagugcgagguguaa

SEQ ID NO: 19434 - RNA, 1746 nt, Artificial Sequence
  LRRTM3__Homo_sapiens__NP_821079
augggcuucaacgugaucagacugcugagcggcagcgccguggcccuggugaucgcccccaccgugcugcugaccaugcugagcagcgccgagagaggcugccccaagggcugcagaugcgagggcaagaugguguacugcgagagccagaagcugcaggagauccccagcagcaucagcgccggcugccugggccugagccugagauacaacagccugcagaagcugaaguacaaccaguucaagggccugaaccagcugaccuggcuguaccuggaccacaaccacaucagcaacaucgacgagaacgccuucaacggcaucagaagacugaaggagcugauccugagcagcaacagaaucagcuacuuccugaacaacaccuucagacccgugaccaaccugagaaaccuggaccugagcuacaaccagcugcacagccugggcagcgagcaguucagaggccugagaaagcugcugagccugcaccugagaagcaacagccugagaaccauccccgugagaaucuuccaggacugcagaaaccuggagcugcuggaccugggcuacaacagaaucagaagccuggccagaaacguguucgccggcaugaucagacugaaggagcugcaccuggagcacaaccaguucagcaagcugaaccuggcccuguuccccagacuggugagccugcagaaccuguaccugcaguggaacaagaucagcgugaucggccagaccaugagcuggaccuggagcagccugcagagacuggaccugagcggcaacgagaucgaggccuucagcggccccagcguguuccagugcgugcccaaccugcagagacugaaccuggacagcaacaagcugaccuucaucggccaggagauccuggacagcuggaucagccugaacgacaucagccuggccggcaacaucugggagugcagcagaaacaucugcagccuggugaacuggcugaagagcuucaagggccugagagagaacaccaucaucugcgccagccccaaggagcugcagggcgugaacgugaucgacgccgugaagaacuacagcaucugcggcaagagcaccaccgagagauucgaccuggccagagcccugcccaagcccaccuucaagcccaagcugcccagacccaagcacgagagcaagcccccccugccccccaccgugggcgccaccgagcccggccccgagaccgacgccgacgccgagcacaucagcuuccacaagaucaucgccggcagcguggcccuguuccugagcgugcuggugauccugcuggugaucuacgugagcuggaagagauaccccgccagcaugaagcagcugcagcagagaagccugaugagaagacacagaaagaagaagagacagagccugaagcagaugacccccagcacccaggaguucuacguggacuacaagcccaccaacaccgagaccagcgagaugcugcugaacggcaccggccccugcaccuacaacaagagcggcagcagagagugcgagaucccccugagcaugaacgugagcaccuuccuggccuacgaccagcccaccaucagcuacugcggcgugcaccacgagcugcugagccacaagagcuucgagaccaacgcccaggaggacaccauggagacccaccuggagaccgagcuggaccugagcaccaucaccaccgccggcagaaucagcgaccacaagcagcagcuggccuaa

SEQ ID NO: 19435 - RNA, 1773 nt, Artificial Sequence
  LRRTM4__Homo_sapiens__NP_001128217
augggcuuccaccugaucacccagcugaagggcaugagcguggugcuggugcugcugcccacccugcugcuggugaugcugaccggcgcccagagagccugccccaagaacugcagaugcgacggcaagaucguguacugcgagagccacgccuucgccgacauccccgagaacaucagcggcggcagccagggccugagccugagauucaacagcauccagaagcugaagagcaaccaguucgccggccugaaccagcugaucuggcuguaccuggaccacaacuacaucagcagcguggacgaggacgccuuccagggcaucagaagacugaaggagcugauccugagcagcaacaagaucaccuaccugcacaacaagaccuuccaccccgugcccaaccugagaaaccuggaccugagcuacaacaagcugcagacccugcagagcgagcaguucaagggccugagaaagcugaucauccugcaccugagaagcaacagccugaagaccgugcccaucagaguguuccaggacugcagaaaccuggacuuccuggaccugggcuacaacagacugagaagccugagcagaaacgccuucgccggccugcugaagcugaaggagcugcaccuggagcacaaccaguucagcaagaucaacuucgcccacuuccccagacuguucaaccugagaagcaucuaccugcaguggaacagaaucagaagcaucagccagggccugaccuggaccuggagcagccugcacaaccuggaccugagcggcaacgacauccagggcaucgagcccggcaccuucaagugccugcccaaccugcagaagcugaaccuggacagcaacaagcugaccaacaucagccaggagaccgugaacgccuggaucagccugaucagcaucacccugagcggcaacaugugggagugcagcagaagcaucugcccccuguucuacuggcugaagaacuucaagggcaacaaggagagcaccaugaucugcgccggccccaagcacauccagggcgagaaggugagcgacgccguggagaccuacaacaucugcagcgaggugcagguggugaacaccgagagaagccaccuggugccccagaccccccagaagccccugaucauccccagacccaccaucuucaagcccgacgugacccagagcaccuucgagacccccagccccagccccggcuuccagauccccggcgccgagcaggaguacgagcacgugagcuuccacaagaucaucgccggcagcguggcccuguuccugagcguggccaugauccugcuggugaucuacgugagcuggaagagauaccccgccagcaugaagcagcugcagcagcacagccugaugaagagaagaagaaagaaggccagagagagcgagagacagaugaacagcccccugcaggaguacuacguggacuacaagcccaccaacagcgagaccauggacaucagcgugaacggcagcggccccugcaccuacaccaucagcggcagcagagagugcgagaugccccaccacaugaagccccugcccuacuacagcuacgaccagcccgugaucggcuacugccaggcccaccagccccugcacgugaccaagggcuacgagaccgugagccccgagcaggacgagagccccggccuggagcugggcagagaccacagcuucaucgccaccaucgccagaagcgccgcccccgccaucuaccuggagagaaucgccaacuaa

SEQ ID NO: 19436 - RNA, 2091 nt, Artificial Sequence
  LRSAM1__Homo_sapiens__NP_001177652
augccccuguucuucagaaagagaaagcccagcgaggaggccagaaagagacuggaguaccagaugugccuggccaaggaggccggcgccgacgacauccuggacaucagcaagugcgagcugagcgagauccccuucggcgccuucgccaccugcaaggugcugcagaagaaggugcugaucgugcacaccaaccaccugaccagccugcugcccaagagcugcagccugcugagccuggccaccaucaaggugcuggaccugcacgacaaccagcugaccgcccugcccgacgaccugggccagcugaccgcccugcaggugcugaacguggagagaaaccagcugaugcagcugcccagaagcaucggcaaccugacccagcugcagacccugaacgugaaggacaacaagcugaaggagcugcccgacaccgugggcgagcugagaagccugagaacccugaacaucagcggcaacgagauccagagacugccccagaugcuggcccacgugagaacccuggagaugcugagccuggacgccagcgccaugguguacccccccagagaggugugcggcgccggcaccgccgccauccugcaguuccugugcaaggagagcggccuggaguacuacccccccagccaguaccugcugcccauccuggagcaggacggcaucgagaacagcagagacagccccgacggccccaccgacagauucagcagagaggagcuggaguggcagaacagauucagcgacuacgagaagagaaaggagcagaagaugcuggagaagcuggaguucgagagaagacuggagcugggccagagagagcacacccagcugcugcagcagagcagcagccagaaggacgagauccugcagaccgugaaggaggagcagagcagacuggagcagggccugagcgagcaccagagacaccugaacgccgagagacagagacugcaggagcagcugaagcagaccgagcagaacaucagcagcagaauccagaagcugcugcaggacaaccagagacagaagaagagcagcgagauccugaagagccuggagaacgagagaaucagaauggagcagcugaugagcaucacccaggaggagaccgagagccugagaagaagagacguggccagcgccaugcagcagaugcugaccgagagcugcaagaacagacugauccagauggccuacgagagccagagacagaaccuggugcagcaggccugcagcagcauggccgagauggacgagagauuccagcagauccugagcuggcagcagauggaccagaacaaggccaucagccagauccugcaggagagcgccaugcagaaggccgccuucgaggcccugcaggugaagaaggaccugaugcacagacagaucagaagccaggagaugaucagcgagcagagaugggcccugagcagccugcugcagcagcugcugaaggagaagcagcagagagaggaggagcugagagagauccugaccgagcuggaggccaagagcgagaccagacaggagaacuacuggcugauccaguaccagagacugcugaaccagaagccccugagccugaagcugcaggaggagggcauggagagacagcugguggcccugcuggaggagcugagcgccgagcacuaccugcccaucuucgcccaccacagacugagccuggaccugcugagccagaugagccccggcgaccuggccaaggugggcgugagcgaggccggccugcagcacgagauccugagaagagugcaggagcugcuggacgccgccagaauccagcccgagcugaagccccccaugggcgagguggugacccccaccgccccccaggagccccccgagagcgugagacccagcgccccccccgccgagcuggaggugcaggccagcgagugcguggugugccuggagagagaggcccagaugaucuuccugaacugcggccacgugugcugcugccagcagugcugccagccccugagaaccugcccccugugcagacaggacaucgcccagagacugagaaucuaccacagcagcuaa

SEQ ID NO: 19437 - RNA, 810 nt, Artificial Sequence
  LRTM1__Homo_sapiens__NP_001291318
augacccugaaccugagcaacaacagccugagcaaccuggcccccggcgccuuccacggccugcagcaccugcaggugcugaaccugacccagaacagccugcugagccuggagagcagacuguuccacagccugccccagcugagagagcuggaccugagcagcaacaacaucagccaccugcccaccagccugggcgagaccugggagaaccugaccauccuggccgugcagcagaaccagcugcagcagcuggacagagcccugcuggagagcaugcccagcgugagacugcugcugcugaaggacaaccuguggaagugcaacugccaccugcugggccugaagcuguggcuggagaaguucguguacaagggcggccugaccgacggcaucaucugcgagagccccgacaccuggaagggcaaggaccugcugagaaucccccacgagcuguaccagcccugcccccugcccgcccccgaccccgugagcagccaggcccaguggcccggcagcgcccacggcguggugcugagaccccccgagaaccacaacgccggcgagagagagcugcuggagugcgagcugaagcccaagcccagacccgccaaccugagacacgccaucgccaccgugaucaucaccggcguggugugcggcaucgugugccugaugaugcuggccgccgccaucuacggcugcaccuacgccgccaucaccgcccaguaccacggcggcccccuggcccagaccaacgaccccggcaagguggaggagaaggagagauucgacagcagccccgccuaa

SEQ ID NO: 19438 - RNA, 477 nt, Artificial Sequence
  LRTOMT__Homo_sapiens__NP_001138779
augaacaagagagacuacaugaacaccagcgugcaggagcccccccuggacuacagcuucagaagcauccacgugauccaggaccuggugaacgaggagcccagaaccggccugagaccccugaagagaagcaagagcggcaagagccugacccagagccuguggcugaacaacaacgugcugaacgaccugagagacuucaaccagguggccagccagcugcuggagcaccccgagaaccuggccuggaucgaccugagcuucaacgaccugaccagcaucgaccccgugcugaccaccuucuucaaccugagcgugcuguaccugcacggcaacagcauccagagacugggcgaggugaacaagcuggccgugcugcccagacugagaagccugacccugcacggcaaccccauggaggaggagaagggcuacagagugcccggcagcguggagaugccccacagaccccccuaa

SEQ ID NO: 19439 - RNA, 1017 nt, Artificial Sequence
  LSAMP__Homo_sapiens__NP_002329
auggugagaagagugcagcccgacagaaagcagcugccccuggugcugcugagacugcugugccugcugcccaccggccugcccgugagaagcguggacuucaacagaggcaccgacaacaucaccgugagacagggcgacaccgccauccugagaugcgugguggaggacaagaacagcaagguggccuggcugaacagaagcggcaucaucuucgccggccacgacaaguggagccuggaccccagaguggagcuggagaagagacacagccuggaguacagccugagaauccagaagguggacguguacgacgagggcagcuacaccugcagcgugcagacccagcacgagcccaagaccagccagguguaccugaucgugcaggugccccccaagaucagcaacaucagcagcgacgugaccgugaacgagggcagcaacgugacccuggugugcauggccaacggcagacccgagcccgugaucaccuggagacaccugacccccaccggcagagaguucgagggcgaggaggaguaccuggagauccugggcaucaccagagagcagagcggcaaguacgagugcaaggccgccaacgaggugagcagcgccgacgugaagcaggugaaggugaccgugaacuacccccccaccaucaccgagagcaagagcaacgaggccaccaccggcagacaggccagccugaagugcgaggccagcgccgugcccgcccccgacuucgagugguacagagacgacaccagaaucaacagcgccaacggccuggagaucaagagcaccgagggccagagcagccugaccgugaccaacgugaccgaggagcacuacggcaacuacaccugcguggccgccaacaagcugggcgugaccaacgccagccuggugcuguucagacccggcagcgugagaggcaucaacggcagcaucagccuggccgugccccuguggcugcuggccgccagccugcugugccugcugagcaagugcuaa

SEQ ID NO: 19440 - RNA, 1083 nt, Artificial Sequence
  LSM11__Homo_sapiens__NP_775762
auggaggagagagagagaggcgccagaagcgccggcgccggcagccccgccagaccccccagccccagacuggacgugagcagcgacagcuucgacccccugcuggcccuguacgcccccagacugccccccauccccuaccccaacgcccccugcuucaacaacguggccgaguacgagagcuuccugagaaccggcgugagaggcggcggcagaggcagaggcagagccagaggcgccgccgccggcagcggcgugcccgccgcccccggccccagcggcagaaccagaagaagacccgacgcccccgcccccgaccccgagagaauccagagacugagaagacugaugguggccaaggaggagggcgacggcgccgccggcgccggcagaagaggccccggcagaagcagaaaggcccccagaaacgugcugaccagaaugccccugcacgagggcagcccccugggcgagcugcacagaugcaucagagagggcgugaaggugaacgugcacaucagaaccuucaagggccugagaggcgugugcaccggcuuccugguggccuucgacaaguucuggaacauggcccugaccgacguggacgagaccuacagaaagcccgugcugggcaaggccuacgagagagacagcagccugacccugaccagacuguucgacagacugaagcugcaggacagcagcaagaaggaggccgacagcaagagcgccguggaggacagcacccugagcagauacagccagaccagcaccuggaagcuggccagcguguggggcagagccgacaccggcagaggcagccacaagagaagcagaagcgugcccagcagccugcaggccagcgccagagaggagagcagaagcgagcugagcggcagaaccaccagaaccgacggcagcagcgugggcggcaccuucagcagagccaccacccugagcagaggccagagcagaaagaagaagagaaagcccaagguggacuaccagcagguguucaccagacacaucaaccagaucuucaucagaggcgagaacgugcugcuggugcaccuggcccaguaa

SEQ ID NO: 19441 - RNA, 402 nt, Artificial Sequence
  LSM1__Homo_sapiens__NP_055277
augaacuacaugcccggcaccgccagccugaucgaggacaucgacaagaagcaccuggugcugcugagagacggcagaacccugaucggcuuccugagaagcaucgaccaguucgccaaccuggugcugcaccagaccguggagagaauccacgugggcaagaaguacggcgacauccccagaggcaucuucguggugagaggcgagaacguggugcugcugggcgagaucgaccuggagaaggagagcgacaccccccugcagcaggugagcaucgaggagauccuggaggagcagagaguggagcagcagaccaagcuggaggccgagaagcugaaggugcaggcccugaaggacagaggccugagcauccccagagccgacacccuggacgaguacuaa

SEQ ID NO: 19442 - RNA, 288 nt, Artificial Sequence
  LSM2__Homo_sapiens__NP_067000
augcuguucuacagcuucuucaagagccuggugggcaaggacguggugguggagcugaagaacgaccugagcaucugcggcacccugcacagcguggaccaguaccugaacaucaagcugaccgacaucagcgugaccgaccccgagaaguacccccacaugcugagcgugaagaacugcuucaucagaggcagcguggugagauacgugcagcugcccgccgacgagguggacacccagcugcugcaggacgccgccagaaaggaggcccugcagcagaagcaguaa

SEQ ID NO: 19443 - RNA, 309 nt, Artificial Sequence
  LSM3__Homo_sapiens__NP_055278
auggccgacgacguggaccagcagcagaccaccaacaccguggaggagccccuggaccugaucagacugagccuggacgagagaaucuacgugaagaugagaaacgacagagagcugagaggcagacugcacgccuacgaccagcaccugaacaugauccugggcgacguggaggagaccgugaccaccaucgagaucgacgaggagaccuacgaggagaucuacaagagcaccaagagaaacauccccaugcuguucgugagaggcgacggcguggugcugguggcccccccccugagagugggcuaa

SEQ ID NO: 19444 - RNA, 420 nt, Artificial Sequence
  LSM4__Homo_sapiens__NP_036453
augcugccccugagccugcugaagaccgcccagaaccaccccaugcugguggagcugaagaacggcgagaccuacaacggccaccuggugagcugcgacaacuggaugaacaucaaccugagagaggugaucugcaccagcagagacggcgacaaguucuggagaaugcccgagugcuacaucagaggcagcaccaucaaguaccugagaauccccgacgagaucaucgacauggugaaggaggaggugguggccaagggcagaggcagaggcggccugcagcagcagaagcagcagaagggcagaggcaugggcggcgccggcagaggcguguucggcggcagaggcagaggcggcauccccggcaccggcagaggccagcccgagaagaagcccggcagacaggccggcaagcaguaa

SEQ ID NO: 19445 - RNA, 276 nt, Artificial Sequence
  LSM5__Homo_sapiens__NP_036454
auggccgccaacgccaccaccaaccccagccagcugcugccccuggagcugguggacaagugcaucggcagcagaauccacaucgugaugaagagcgacaaggagaucgugggcacccugcugggcuucgacgacuucgugaacauggugcuggaggacgugaccgaguucgagaucacccccgagggcagaagaaucaccaagcuggaccagauccugcugaacggcaacaacaucaccaugcuggugcccggcggcgagggccccgagguguaa

SEQ ID NO: 19446 - RNA, 243 nt, Artificial Sequence
  LSM6__Homo_sapiens__NP_009011
augagccugagaaagcagacccccagcgacuuccugaagcagaucaucggcagacccgugguggugaagcugaacagcggcguggacuacagaggcgugcuggccugccuggacggcuacaugaacaucgcccuggagcagaccgaggaguacgugaacggccagcugaagaacaaguacggcgacgccuucaucagaggcaacaacgugcuguacaucagcacccagaagagaagaauguaa

SEQ ID NO: 19447 - RNA, 312 nt, Artificial Sequence
  LSM7__Homo_sapiens__NP_057283
auggccgacaaggagaagaagaagaaggagagcauccuggaccugagcaaguacaucgacaagaccaucagagugaaguuccagggcggcagagaggccagcggcauccugaagggcuucgacccccugcugaaccuggugcuggacggcaccaucgaguacaugagagaccccgacgaccaguacaagcugaccgaggacaccagacagcugggccugguggugugcagaggcaccagcguggugcugaucugcccccaggacggcauggaggccauccccaaccccuucauccagcagcaggacgccuaa

SEQ ID NO: 19448 - RNA, 834 nt, Artificial Sequence
  LSP1__Homo_sapiens__NP_001013273
augcugcugagccugaagcccagcgaggcccccgagcuggacgaggacgagggcuucggcgacuggagccagagacccgagcagagacagcagcacgagggcgcccagggcgcccuggacagcggcgagcccccccagugcagaagccccgagggcgagcaggaggacagacccggccugcacgccuacgagaaggaggacagcgacgaggugcaccuggaggagcugagccugagcaaggagggccccggccccgaggacaccgugcaggacaaccugggcgccgccggcgccgaggaggagcaggaggagcaccagaagugccagcagcccagaacccccagcccccuggugcuggagggcaccaucgagcagagcagccccccccugagccccaccaccaagcugaucgacagaaccgagagccugaacagaagcaucgagaagagcaacagcgugaagaagagccagcccgaccugcccaucagcaagaucgaccaguggcuggagcaguacacccaggccaucgagaccgccggcagaacccccaagcuggccagacaggccagcaucgagcugcccagcauggccguggccagcaccaagagcagaugggagaccggcgaggugcaggcccagagcgccgccaagacccccagcugcaaggacaucguggccggcgacaugagcaagaagagccugugggagcagaagggcggcagcaagaccagcagcaccaucaagagcacccccagcggcaagagauacaaguucguggccaccggccacggcaaguacgagaaggugcugguggagggcggccccgcccccuaa

SEQ ID NO: 19449 - RNA, 1890 nt, Artificial Sequence
  LSR__Homo_sapiens__NP_001247418
augcagcaggacggccugggcgugggcaccagaaacggcagcggcaagggcagaagcgugcaccccagcuggcccuggugcgcccccagaccccugagauacuucggcagagacgccagagccagaagagcccagaccgccgccauggcccugcuggccggcggccugagcagaggccugggcagccaccccgccgccgccggcagagacgccgugguguucguguggcugcugcugagcaccuggugcaccgcccccgccagagccauccaggugaccgugagcaaccccuaccacguggugauccuguuccagcccgugacccugcccugcaccuaccagaugaccagcacccccacccagcccaucgugaucuggaaguacaagagcuucugcagagacagaaucgccgacgccuucagccccgccagcguggacaaccagcugaacgcccagcuggccgccggcaaccccggcuacaaccccuacguggagugccaggacagcgugagaaccgugagagugguggccaccaagcagggcaacgccgugacccugggcgacuacuaccagggcagaagaaucaccaucaccggcaacgccgaccugaccuucgaccagaccgccuggggcgacagcggcguguacuacugcagcguggugagcgcccaggaccugcagggcaacaacgaggccuacgccgagcugaucgugcuggacuggcuguucguggugguggugugccuggccgccuuccugaucuuccugcugcugggcaucugcuggugccagugcugcccccacaccugcugcugcuacgugagaugccccugcugccccgacaagugcugcugccccgaggcccuguacgccgccggcaaggccgccaccagcggcgugcccagcaucuacgcccccagcaccuacgcccaccugagccccgccaagaccccccccccccccgccaugauccccaugggccccgccuacaacggcuaccccggcggcuaccccggcgacguggacagaagcagcagcgccggcggccagggcagcuacgugccccugcugagagacaccgacagcagcguggccagcgugagaagcggcuacagaauccaggccagccagcaggacgacagcaugagagugcuguacuacauggagaaggagcuggccaacuucgaccccagcagacccggcccccccagcggcagaguggagagagccaugagcgaggugaccagccugcacgaggacgacuggagaagcagacccagcagaggccccgcccugacccccaucagagacgaggaguggggcggccacagccccagaagccccagaggcugggaccaggagcccgccagagagcaggccggcggcggcuggagagccagaagacccagagccagaagcguggacgcccuggacgaccugaccccccccagcaccgccgagagcggcagcagaagccccaccagcaacggcggcagaagcagagccuacaugccccccagaagcagaagcagagacgaccuguacgaccaggacgacagcagagacuuccccagaagcagagacccccacuacgacgacuucagaagcagagagagaccccccgccgaccccagaagccaccaccacagaaccagagaccccagagacaacggcagcagaagcggcgaccugcccuacgacggcagacugcuggaggaggccgugagaaagaagggcagcgaggagagaagaagaccccacaaggaggaggaggaggaggccuacuacccccccgcccccccccccuacagcgagaccgacagccaggccagcagagagagaagacugaagaagaaccuggcccugagcagagagagccuggugguguaa

SEQ ID NO: 19450 - RNA, 2199 nt, Artificial Sequence
  LSS__Homo_sapiens__NP_001001438
augaccgagggcaccugccugagaagaagaggcggccccuacaagaccgagcccgccaccgaccugggcagauggagacugaacugcgagagaggcagacagaccuggaccuaccugcaggacgagagagccggcagagagcagaccggccuggaggccuacgcccugggccuggacaccaagaacuacuucaaggaccugcccaaggcccacaccgccuucgagggcgcccugaacggcaugaccuucuacgugggccugcaggccgaggacggccacuggaccggcgacuacggcggcccccuguuccugcugcccggccugcugaucaccugccacguggccagaaucccccugcccgccggcuacagagaggagaucgugagauaccugagaagcgugcagcugcccgacggcggcuggggccugcacaucgaggacaagagcaccguguucggcaccgcccugaacuacgugagccugagaauccugggcgugggccccgacgaccccgaccuggugagagccagaaacauccugcacaagaagggcggcgccguggccauccccagcuggggcaaguucuggcuggccgugcugaacguguacagcugggagggccugaacacccuguuccccgagauguggcuguuccccgacugggcccccgcccaccccagcacccuguggugccacugcagacagguguaccugcccaugagcuacugcuacgccgugagacugagcgccgccgaggacccccuggugcagagccugagacaggagcuguacguggaggacuucgccagcaucgacuggcuggcccagagaaacaacguggcccccgacgagcuguacaccccccacagcuggcugcugagagugguguacgcccugcugaaccuguacgagcaccaccacagcgcccaccugagacagagagccgugcagaagcuguacgagcacaucguggccgacgacagauucaccaagagcaucagcaucggccccaucagcaagaccaucaacaugcuggugagaugguacguggacggccccgccagcaccgccuuccaggagcacgugagcagaauccccgacuaccuguggaugggccuggacggcaugaagaugcagggcaccaacggcagccagaucugggacaccgccuucgccauccaggcccugcuggaggccggcggccaccacagacccgaguucagcagcugccugcagaaggcccacgaguuccugagacugagccaggugcccgacaacccccccgacuaccagaaguacuacagacagaugagaaagggcggcuucagcuucagcacccuggacugcggcuggaucgugagcgacugcaccgccgaggcccugaaggccgugcugcugcugcaggagaagugcccccacgugaccgagcacauccccagagagagacugugcgacgccguggccgugcugcugaacaugagaaaccccgacggcggcuucgccaccuacgagaccaagagaggcggccaccugcuggagcugcugaaccccagcgagguguucggcgacaucaugaucgacuacaccuacguggagugcaccagcgccgugaugcaggcccugaaguacuuccacaagagauuccccgagcacagagccgccgagaucagagagacccugacccagggccuggaguucugcagaagacagcagagagccgacggcagcugggagggcagcuggggcgugugcuucaccuacggcaccugguucggccuggaggccuucgccugcaugggccagaccuacagagacggcaccgccugcgccgaggugagcagagccugcgacuuccugcugagcagacagauggccgacggcggcuggggcgaggacuucgagagcugcgaggagagaagauaccugcagagcgcccagagccagauccacaacaccugcugggccaugaugggccugauggccgugagacaccccgacaucgaggcccaggagagaggcgugagaugccugcuggagaagcagcugcccaacggcgacuggccccaggagaacaucgccggcguguucaacaagagcugcgccaucagcuacaccagcuacagaaacaucuuccccaucugggcccugggcagauucagccagcuguaccccgagagagcccuggccggccaccccuaa

SEQ ID NO: 19451 - RNA, 201 nt, Artificial Sequence
  LST1__Homo_sapiens__NP_995309
augcugagcagaaacgacgacaucugcaucuacggcggccugggccugggcggccugcugcugcuggccguggugcugcugagcgccugccugugcuggcugcacagaagagcccccagcgugcuggugcccggccccggccugcugagagccggcaccccccugugcaucagcgccgaggccgccagcgcccagcaguaa

SEQ ID NO: 19452 - RNA, 1836 nt, Artificial Sequence
  LTA4H__Homo_sapiens__NP_000886
augcccgagaucguggacaccugcagccuggccagccccgccagcgugugcagaaccaagcaccugcaccugagaugcagcguggacuucaccagaagaacccugaccggcaccgccgcccugaccgugcagagccaggaggacaaccugagaagccuggugcuggacaccaaggaccugaccaucgagaagguggugaucaacggccaggaggugaaguacgcccugggcgagagacagagcuacaagggcagccccauggagaucagccugcccaucgcccugagcaagaaccaggagaucgugaucgagaucagcuucgagaccagccccaagagcagcgcccugcaguggcugacccccgagcagaccagcggcaaggagcaccccuaccuguucagccagugccaggccauccacugcagagccauccugcccugccaggacacccccagcgugaagcugaccuacaccgccgaggugagcgugcccaaggagcugguggcccugaugagcgccaucagagacggcgagacccccgaccccgaggaccccagcagaaagaucuacaaguucauccagaaggugcccauccccugcuaccugaucgcccugguggugggcgcccuggagagcagacagaucggccccagaacccugguguggagcgagaaggagcagguggagaagagcgccuacgaguucagcgagaccgagagcaugcugaagaucgccgaggaccugggcggccccuacguguggggccaguacgaccugcuggugcugccccccagcuuccccuacggcggcauggagaaccccugccugaccuucgugacccccacccugcuggccggcgacaagagccugagcaacgugaucgcccacgagaucagccacagcuggaccggcaaccuggugaccaacaagaccugggaccacuucuggcugaacgagggccacaccguguaccuggagagacacaucugcggcagacuguucggcgagaaguucagacacuucaacgcccugggcggcuggggcgagcugcagaacagcgugaagaccuucggcgagacccaccccuucaccaagcuggugguggaccugaccgacaucgaccccgacguggccuacagcagcgugcccuacgagaagggcuucgcccugcuguucuaccuggagcagcugcugggcggccccgagaucuuccugggcuuccugaaggccuacguggagaaguucagcuacaagagcaucaccaccgacgacuggaaggacuuccuguacagcuacuucaaggacaagguggacgugcugaaccagguggacuggaacgccuggcuguacagccccggccugccccccaucaagcccaacuacgacaugacccugaccaacgccugcaucgcccugagccagagauggaucaccgccaaggaggacgaccugaacagcuucaacgccaccgaccugaaggaccugagcagccaccagcugaacgaguuccuggcccagacccugcagagagccccccugccccugggccacaucaagagaaugcaggagguguacaacuucaacgccaucaacaacagcgagaucagauucagauggcugagacugugcauccagagcaagugggaggacgccaucccccuggcccugaagauggccaccgagcagggcagaaugaaguucaccagaccccuguucaaggaccuggccgccuucgacaagagccacgaccaggccgugagaaccuaccaggagcacaaggccagcaugcaccccgugaccgccaugcuggugggcaaggaccugaagguggacuaa

SEQ ID NO: 19453 - RNA, 618 nt, Artificial Sequence
  LTA__Homo_sapiens__XP_011512920
augaccccccccgagagacuguuccugcccagagugugcggcaccacccugcaccugcugcugcugggccugcugcuggugcugcugcccggcgcccagggccugcccggcgugggccugacccccagcgccgcccagaccgccagacagcaccccaagaugcaccuggcccacagcacccugaagcccgccgcccaccugaucggcgaccccagcaagcagaacagccugcuguggagagccaacaccgacagagccuuccugcaggacggcuucagccugagcaacaacagccugcuggugcccaccagcggcaucuacuucguguacagccaggugguguucagcggcaaggccuacagccccaaggccaccagcagcccccuguaccuggcccacgaggugcagcuguucagcagccaguaccccuuccacgugccccugcugagcagccagaagaugguguaccccggccugcaggagcccuggcugcacagcauguaccacggcgccgccuuccagcugacccagggcgaccagcugagcacccacaccgacggcaucccccaccuggugcugagccccagcaccguguucuucggcgccuucgcccuguaa

SEQ ID NO: 19454 - RNA, 1077 nt, Artificial Sequence
  LTB4R2__Homo_sapiens__NP_062813
augagcgugugcuacagaccccccggcaacgagacccugcugagcuggaagaccagcagagccaccggcaccgccuuccugcugcuggccgcccugcugggccugcccggcaacggcuucgugguguggagccuggccggcuggagacccgccagaggcagaccccuggccgccacccuggugcugcaccuggcccuggccgacggcgccgugcugcugcugaccccccuguucguggccuuccugaccagacaggccuggccccugggccaggccggcugcaaggccguguacuacgugugcgcccugagcauguacgccagcgugcugcugaccggccugcugagccugcagagaugccuggccgugaccagacccuuccuggcccccagacugagaagccccgcccuggccagaagacugcugcuggccguguggcuggccgcccugcugcuggccgugcccgccgccguguacagacaccuguggagagacagagugugccagcugugccaccccagccccgugcacgccgccgcccaccugagccuggagacccugaccgccuucgugcugcccuucggccugaugcugggcugcuacagcgugacccuggccagacugagaggcgccagauggggcagcggcagacacggcgccagagugggcagacuggugagcgccaucgugcuggccuucggccugcugugggcccccuaccacgccgugaaccugcugcaggccguggccgcccuggccccccccgagggcgcccuggccaagcugggcggcgccggccaggccgccagagccggcaccaccgcccuggccuucuucagcagcagcgugaaccccgugcuguacguguucaccgccggcgaccugcugcccagagccggccccagauuccugaccagacuguucgagggcagcggcgaggccagaggcggcggcagaagcagagagggcaccauggagcugagaaccaccccccagcugaagguggugggccagggcagaggcaacggcgaccccggcggcggcauggagaaggacggccccgagugggaccuguaa

SEQ ID NO: 19455 - RNA, 1059 nt, Artificial Sequence
  LTB4R__Homo_sapiens__NP_001137391
augaacaccaccagcagcgccgccccccccagccugggcguggaguucaucagccugcuggccaucauccugcugagcguggcccuggccgugggccugcccggcaacagcuucgugguguggagcauccugaagagaaugcagaagagaagcgugaccgcccugauggugcugaaccuggcccuggccgaccuggccgugcugcugaccgcccccuucuuccugcacuuccuggcccagggcaccuggagcuucggccuggccggcugcagacugugccacuacgugugcggcgugagcauguacgccagcgugcugcugaucaccgccaugagccuggacagaagccuggccguggccagacccuucgugagccagaagcugagaaccaaggccauggccagaagagugcuggccggcaucugggugcugagcuuccugcuggccacccccgugcuggccuacagaaccguggugcccuggaagaccaacaugagccugugcuuccccagauaccccagcgagggccacagagccuuccaccugaucuucgaggccgugaccggcuuccugcugcccuuccuggccgugguggccagcuacagcgacaucggcagaagacugcaggccagaagauucagaagaagcagaagaaccggcagacugguggugcugaucauccugaccuucgccgccuucuggcugcccuaccacguggugaaccuggccgaggccggcagagcccuggccggccaggccgccggccugggccuggugggcaagagacugagccuggccagaaacgugcugaucgcccuggccuuccugagcagcagcgugaaccccgugcuguacgccugcgccggcggcggccugcugagaagcgccggcgugggcuucguggccaagcugcuggagggcaccggcagcgaggccagcagcaccagaagaggcggcagccugggccagaccgccagaagcggccccgccgcccuggagcccggccccagcgagagccugaccgccagcagcccccugaagcugaacgagcugaacuaa

SEQ ID NO: 19456 - RNA, 735 nt, Artificial Sequence
  LTB__Homo_sapiens__NP_002332
augggcgcccugggccuggagggcagaggcggcagacugcagggcagaggcagccugcugcuggccguggccggcgccaccagccuggugacccugcugcuggccgugcccaucaccgugcuggccgugcuggcccuggugccccaggaccagggcggccuggugaccgagaccgccgaccccggcgcccaggcccagcagggccugggcuuccagaagcugcccgaggaggagcccgagaccgaccugagccccggccugcccgccgcccaccugaucggcgccccccugaagggccagggccugggcugggagaccaccaaggagcaggccuuccugaccagcggcacccaguucagcgacgccgagggccuggcccugccccaggacggccuguacuaccuguacugccuggugggcuacagaggcagagccccccccggcggcggcgacccccagggcagaagcgugacccugagaagcagccuguacagagccggcggcgccuacggccccggcacccccgagcugcugcuggagggcgccgagaccgugacccccgugcuggaccccgccagaagacagggcuacggcccccugugguacaccagcgugggcuucggcggccuggugcagcugagaagaggcgagagaguguacgugaacaucagccaccccgacaugguggacuucgccagaggcaagaccuucuucggcgccgugauggugggcuaa

SEQ ID NO: 19457 - RNA, 4188 nt, Artificial Sequence
  LTBP1__Homo_sapiens__NP_000618
auggacaccaagcugaugugccugcuguucuucuucagccugcccccccugcuggugagcaaccacaccggcagaaucaaggugguguucacccccagcaucugcaaggugaccugcaccaagggcagcugccagaacagcugcgagaagggcaacaccaccacccugaucagcgagaacggccacgccgccgacacccugaccgccaccaacuucagaguggugaucugccaccugcccugcaugaacggcggccagugcagcagcagagacaagugccagugcccccccaacuucaccggcaagcugugccagauccccgugcacggcgccagcgugcccaagcuguaccagcacagccagcagcccggcaaggcccugggcacccacgugauccacagcacccacacccugccccugaccgugaccagccagcagggcgugaaggugaaguucccccccaacaucgugaacauccacgugaagcacccccccgaggccagcgugcagauccaccaggugagcagaaucgacggccccaccggccagaagaccaaggaggcccagcccggccagagccaggugagcuaccagggccugcccgugcagaagacccagaccauccacagcaccuacagccaccagcaggugaucccccacguguaccccguggccgccaagacccagcugggcagaugcuuccaggagaccaucggcagccagugcggcaaggcccugcccggccugagcaagcaggaggacugcugcggcaccgugggcaccagcuggggcuucaacaagugccagaagugccccaagaagcccagcuaccacggcuacaaccagaugauggagugccugcccggcuacaagagagugaacaacaccuucugccaggacaucaacgagugccagcugcagggcgugugccccaacggcgagugccugaacaccaugggcagcuacagaugcaccugcaagaucggcuucggccccgaccccaccuucagcagcugcgugcccgacccccccgugaucagcgaggagaagggccccugcuacagacuggugagcagcggcagacagugcaugcacccccugagcgugcaccugaccaagcagcugugcugcugcagcgugggcaaggccuggggcccccacugcgagaagugcccccugcccggcaccgccgccuucaaggagaucugccccggcggcaugggcuacaccgugagcggcgugcacagaagaagacccauccaccaccacgugggcaagggccccguguucgugaagcccaagaacacccagcccguggccaagagcacccacccccccccccugcccgccaaggaggagcccguggaggcccugaccuucagcagagagcacggccccggcguggccgagcccgagguggccaccgccccccccgagaaggagauccccagccuggaccaggagaagaccaagcuggagcccggccagccccagcugagccccggcaucagcaccauccaccugcacccccaguuccccguggugaucgagaagaccagcccccccgugcccguggagguggcccccgaggccagcaccagcagcgccagccaggugaucgcccccacccaggugaccgagaucaacgagugcaccgugaaccccgacaucugcggcgccggccacugcaucaaccugcccgugagauacaccugcaucugcuacgagggcuacagauucagcgagcagcagagaaagugcguggacaucgacgagugcacccaggugcagcaccugugcagccagggcagaugcgagaacaccgagggcagcuuccugugcaucugccccgccggcuucauggccagcgaggagggcaccaacugcaucgacguggacgagugccugagacccgacgugugcggcgagggccacugcgugaacaccgugggcgccuucagaugcgaguacugcgacagcggcuacagaaugacccagagaggcagaugcgaggacaucgacgagugccugaaccccagcaccugccccgacgagcagugcgugaacagccccggcagcuaccagugcgugcccugcaccgagggcuucagaggcuggaacggccagugccuggacguggacgagugccuggagcccaacgugugcgccaacggcgacugcagcaaccuggagggcagcuacaugugcagcugccacaagggcuacaccagaacccccgaccacaagcacugcagagacaucgacgagugccagcagggcaaccugugcgugaacggccagugcaagaacaccgagggcagcuucagaugcaccugcggccagggcuaccagcugagcgccgccaaggaccagugcgaggacaucgacgagugccagcacagacaccugugcgcccacggccagugcagaaacaccgagggcagcuuccagugcgugugcgaccagggcuacagagccagcggccugggcgaccacugcgaggacaucaacgagugccuggaggacaagagcgugugccagagaggcgacugcaucaacaccgccggcagcuacgacugcaccugccccgacggcuuccagcuggacgacaacaagaccugccaggacaucaacgagugcgagcaccccggccugugcggcccccagggcgagugccugaacaccgagggcagcuuccacugcgugugccagcagggcuucagcaucagcgccgacggcagaaccugcgaggacaucgacgagugcgugaacaacaccgugugcgacagccacggcuucugcgacaacaccgccggcagcuucagaugccugugcuaccagggcuuccaggccccccaggacggccagggcugcguggacgugaacgagugcgagcugcugagcggcgugugcggcgaggccuucugcgagaacguggagggcagcuuccugugcgugugcgccgacgagaaccaggaguacagccccaugaccggccagugcagaagcagaaccagcaccgaccuggacguggacguggaccagcccaaggaggagaagaaggagugcuacuacaaccugaacgacgccagccugugcgacaacgugcuggcccccaacgugaccaagcaggagugcugcugcaccagcggcgccggcuggggcgacaacugcgagaucuuccccugccccgugcugggcaccgccgaguucaccgagaugugccccaagggcaagggcuucgugcccgccggcgagagcagcagcgaggccggcggcgagaacuacaaggacgccgacgagugccugcuguucggccaggagaucugcaagaacggcuucugccugaacaccagacccggcuacgagugcuacugcaagcagggcaccuacuacgaccccgugaagcugcagugcuucgacauggacgagugccaggaccccagcagcugcaucgacggccagugcgugaacaccgagggcagcuacaacugcuucugcacccaccccauggugcuggacgccagcgagaagagaugcaucagacccgccgagagcaacgagcagaucgaggagaccgacguguaccaggaccugugcugggagcaccugagcgacgaguacgugugcagcagaccccuggugggcaagcagaccaccuacaccgagugcugcugccuguacggcgaggccuggggcaugcagugcgcccugugcccccugaaggacagcgacgacuacgcccagcugugcaacauccccgugaccggcagaagacagcccuacggcagagacgcccugguggacuucagcgagcaguacacccccgaggccgaccccuacuucauccaggacagauuccugaacagcuucgaggagcugcaggccgaggagugcggcauccugaacggcugcgagaacggcagaugcgugagagugcaggagggcuacaccugcgacugcuucgacggcuaccaccuggacaccgccaagaugaccugcguggacgugaacgagugcgacgagcugaacaacagaaugagccugugcaagaacgccaagugcaucaacaccgacggcagcuacaagugccugugccugcccggcuacgugcccagcgacaagcccaacuacugcaccccccugaacaccgcccugaaccuggagaaggacagcgaccuggaguaa

SEQ ID NO: 19458 - RNA, 5466 nt, Artificial Sequence
  LTBP2__Homo_sapiens__NP_000419
augagacccagaaccaaggccagaagccccggcagagcccugagaaaccccuggagaggcuuccugccccugacccuggcccuguucgugggcgccggccacgcccagagagaccccgugggcagauacgagcccgccggcggcgacgccaacagacugagaagacccggcggcagcuaccccgccgccgccgccgccaagguguacagccuguucagagagcaggacgcccccguggccggccugcagcccguggagagagcccagcccggcuggggcagccccagaagacccaccgaggccgaggccagaagacccagcagagcccagcagagcagaagagugcagccccccgcccagaccagaagaagcaccccccugggccagcagcagcccgcccccagaaccagagccgcccccgcccugcccagacugggcaccccccagagaagcggcgccgccccccccaccccccccagaggcagacugaccggcagaaacgugugcggcggccagugcugccccggcuggaccaccgccaacagcaccaaccacugcaucaagcccgugugcgagccccccugccagaacagaggcagcugcagcagaccccagcugugcgugugcagaagcggcuucagaggcgccagaugcgaggaggugauccccgacgaggaguucgacccccagaacagcagacuggcccccagaagaugggccgagagaagccccaaccugagaagaagcagcgccgccggcgagggcacccuggccagagcccagccccccgccccccagagcccccccgccccccagagcccccccgccggcacccugagcggccugagccagacccaccccagccagcagcacgugggccugagcagaaccgugagacugcaccccaccgccaccgccagcagccagcugagcagcaacgcccugccccccggccccggccuggagcagagagacggcacccagcaggccgugccccuggagcaccccagcagccccuggggccugaaccugaccgagaagaucaagaagaucaagaucguguucacccccaccaucugcaagcagaccugcgccagaggccacugcgccaacagcugcgagagaggcgacaccaccacccuguacagccagggcggccacggccacgaccccaagagcggcuucagaaucuacuucugccagauccccugccugaacggcggcagaugcaucggcagagacgagugcuggugccccgccaacagcaccggcaaguucugccaccugcccaucccccagcccgacagagagccccccggcagaggcagcagacccagagcccugcuggaggccccccugaagcagagcaccuucacccugccccugagcaaccagcuggccagcgugaaccccagccuggugaaggugcacauccaccacccccccgaggccagcgugcagauccaccagguggcccaggugagaggcggcguggaggaggcccugguggagaacagcguggagaccagacccccccccuggcugcccgccagccccggccacagccugugggacagcaacaacauccccgccagaagcggcgagccccccagaccccugccccccgccgcccccagacccagaggccugcugggcagaugcuaccugaacaccgugaacggccagugcgccaacccccugcuggagcugaccacccaggaggacugcugcggcagcgugggcgccuucuggggcgugacccugugcgcccccugcccccccagacccgccagccccgugaucgagaacggccagcuggagugcccccagggcuacaagagacugaaccugacccacugccaggacaucaacgagugccugacccugggccugugcaaggacgccgagugcgugaacaccagaggcagcuaccugugcaccugcagacccggccugaugcuggaccccagcagaagcagaugcgugagcgacaaggccaucagcaugcugcagggccugugcuacagaagccugggccccggcaccugcacccugccccuggcccagagaaucaccaagcagaucugcugcugcagcagagugggcaaggccuggggcagcgagugcgagaagugcccccugcccggcaccgaggccuucagagagaucugccccgccggccacggcuacaccuacgccagcagcgacaucagacugagcaugagaaaggccgaggaggaggagcuggccagaccccccagagagcagggccagagaagcagcggcgcccugcccggccccgccgagagacagccccugagaguggugaccgacaccuggcuggaggccggcaccauccccgacaagggcgacagccaggccggccaggugaccaccagcgugacccacgcccccgccugggugaccggcaacgccaccaccccccccaugcccgagcagggcaucgccgagauccaggaggagcaggugacccccagcaccgacgugcuggugacccugagcacccccggcaucgacagaugcgccgccggcgccaccaacgugugcggccccggcaccugcgugaaccugcccgacggcuacagaugcgugugcagccccggcuaccagcugcaccccagccaggccuacugcaccgacgacaacgagugccugagagaccccugcaagggcaagggcagaugcaucaacagagugggcagcuacagcugcuucugcuaccccggcuacacccuggccaccagcggcgccacccaggagugccaggacaucaacgagugcgagcagcccggcgugugcagcggcggccagugcaccaacaccgagggcagcuaccacugcgagugcgaccagggcuacaucauggugagaaagggccacugccaggacaucaacgagugcagacaccccggcaccugccccgacggcagaugcgugaacagccccggcagcuacaccugccuggccugcgaggagggcuacagaggccagagcggcagcugcguggacgugaacgagugccugacccccggcgugugcgcccacggcaagugcaccaaccuggagggcagcuucagaugcagcugcgagcagggcuacgaggugaccagcgacgagaagggcugccaggacguggacgagugcgccagcagagccagcugccccaccggccugugccugaacaccgagggcagcuucgccugcagcgccugcgagaacggcuacugggugaacgaggacggcaccgccugcgaggaccuggacgagugcgccuuccccggcgugugccccagcggcgugugcaccaacaccgccggcagcuucagcugcaaggacugcgacggcggcuacagacccagcccccugggcgacagcugcgaggacguggacgagugcgaggacccccagagcagcugccugggcggcgagugcaagaacaccgugggcagcuaccagugccugugcccccagggcuuccagcuggccaacggcaccgugugcgaggacgugaacgagugcaugggcgaggagcacugcgccccccacggcgagugccugaacagccacggcagcuucuucugccugugcgcccccggcuucgugagcgccgagggcggcaccagcugccaggacguggacgagugcgccaccaccgaccccugcgugggcggccacugcgugaacaccgagggcagcuucaacugccugugcgagaccggcuuccagcccagccccgagagcggcgagugcguggacaucgacgagugcgaggacuacggcgaccccgugugcggcaccuggaagugcgagaacagccccggcagcuacagaugcgugcugggcugccagcccggcuuccacauggcccccaacggcgacugcaucgacaucgacgagugcgccaacgacaccaugugcggcagccacggcuucugcgacaacaccgacggcagcuucagaugccugugcgaccagggcuucgagaucagccccagcggcugggacugcguggacgugaacgagugcgagcugaugcuggccgugugcggcgccgcccugugcgagaacguggagggcagcuuccugugccugugcgccagcgaccuggaggaguacgacgcccaggagggccacugcagacccagaggcgccggcggccagagcaugagcgaggcccccaccggcgaccacgcccccgcccccaccagaauggacugcuacagcggccagaagggccacgcccccugcagcagcgugcugggcagaaacaccacccaggccgagugcugcugcacccagggcgccagcuggggcgacgccugcgaccugugccccagcgaggacagcgccgaguucagcgagaucugccccagcggcaagggcuacauccccguggagggcgccuggaccuucggccagaccauguacaccgacgccgacgagugcgugaucuucggccccggccugugccccaacggcagaugccugaacaccgugcccggcuacgugugccugugcaaccccggcuuccacuacgacgccagccacaagaagugcgaggaccacgacgagugccaggaccuggccugcgagaacggcgagugcgugaacaccgagggcagcuuccacugcuucugcagccccccccugacccuggaccugagccagcagagaugcaugaacagcaccagcagcaccgaggaccugcccgaccacgacauccacauggacaucugcuggaagaaggugaccaacgacgugugcagcgagccccugagaggccacagaaccaccuacaccgagugcugcugccaggacggcgaggccuggagccagcagugcgcccugugcccccccagaagcagcgagguguacgcccagcugugcaacguggccagaaucgaggccgagagagaggccggcgugcacuucagacccggcuacgaguacggccccggccccgacgaccugcacuacagcaucuacggccccgacggcgcccccuucuacaacuaccugggccccgaggacaccgugcccgagcccgccuuccccaacaccgccggccacagcgccgacagaacccccauccuggagagcccccugcagcccagcgagcugcagccccacuacguggccagccaccccgagccccccgccggcuucgagggccugcaggccgaggagugcggcauccugaacggcugcgagaacggcagaugcgugagagugagagagggcuacaccugcgacugcuucgagggcuuccagcuggacgccgcccacauggccugcguggacgugaacgagugcgacgaccugaacggccccgccgugcugugcgugcacggcuacugcgagaacaccgagggcagcuacagaugccacugcagccccggcuacguggccgaggccggccccccccacugcaccgccaaggaguaa

SEQ ID NO: 19459 - RNA, 3912 nt, Artificial Sequence
  LTBP3__Homo_sapiens__NP_001123616
augcccggccccagaggcgccgccggcggccuggcccccgagaugagaggcgccggcgccgccggccugcuggcccugcugcugcugcugcugcugcugcugcugggccugggcggcagaguggagggcggccccgccggcgagagaggcgccggcggcggcggcgcccuggccagagagagauucaaggugguguucgcccccgugaucugcaagagaaccugccugaagggccagugcagagacagcugccagcagggcagcaacaugacccugaucggcgagaacggccacagcaccgacacccugaccggcagcggcuucagagugguggugugcccccugcccugcaugaacggcggccagugcagcagcagaaaccagugccugugcccccccgacuucaccggcagauucugccaggugcccgccggcggcgccggcggcggcaccggcggcagcggccccggccugagcagaaccggcgcccugagcaccggcgcccugcccccccuggcccccgagggcgacagcguggccagcaagcacgccaucuacgccgugcaggugaucgccgacccccccggccccggcgagggcccccccgcccagcacgccgccuuccuggugccccugggccccggccagaucagcgccgaggugcaggcccccccccccguggugaacgugagagugcaccacccccccgaggccagcgugcaggugcacagaaucgagagcagcaacgccgagagcgccgcccccagccagcaccugcugccccaccccaagcccagccaccccagaccccccacccagaagccccugggcagaugcuuccaggacacccugcccaagcagcccugcggcagcaacccccugcccggccugaccaagcaggaggacugcugcggcagcaucggcaccgccuggggccagagcaagugccacaagugcccccagcugcaguacaccggcgugcagaagcccggccccgugagaggcgaggugggcgccgacugcccccagggcuacaagagacugaacagcacccacugccaggacaucaacgagugcgccaugcccggcgugugcagacacggcgacugccugaacaaccccggcagcuacagaugcgugugcccccccggccacagccugggccccagcagaacccagugcaucgccgacaagcccgaggagaagagccugugcuucagacuggugagccccgagcaccagugccagcacccccugaccaccagacugaccagacagcugugcugcugcagcgugggcaaggccuggggcgccagaugccagagaugccccaccgacggcaccgccgccuucaaggagaucugccccgccggcaagggcuaccacauccugaccagccaccagacccugaccauccagggcgagagcgacuucagccuguuccugcaccccgacggcccccccaagccccagcagcugcccgagagccccagccaggcccccccccccgaggacaccgaggaggagagaggcgugaccaccgacagccccgugagcgaggagagaagcgugcagcagagccaccccaccgccaccaccacccccgccagacccuaccccgagcugaucagcagacccagcccccccaccaugagaugguuccugcccgaccugccccccagcagaagcgccguggagaucgcccccacccaggugaccgagaccgacgagugcagacugaaccagaacaucugcggccacggcgagugcgugcccggcccccccgacuacagcugccacugcaaccccggcuacagaagccacccccagcacagauacugcguggacgugaacgagugcgaggccgagcccugcggccccggcagaggcaucugcaugaacaccggcggcagcuacaacugccacugcaacagaggcuacagacugcacgugggcgccggcggcagaagcugcguggaccugaacgagugcgccaagccccaccugugcggcgacggcggcuucugcaucaacuuccccggccacuacaagugcaacugcuaccccggcuacagacugaaggccagcagaccccccgugugcgaggacaucgacgagugcagagaccccagcagcugccccgacggcaagugcgagaacaagcccggcagcuucaagugcaucgccugccagcccggcuacagaagccagggcggcggcgccugcagagacgugaacgagugcgccgagggcagccccugcagccccggcuggugcgagaaccugcccggcagcuucagaugcaccugcgcccagggcuacgcccccgcccccgacggcagaagcugccuggacguggacgagugcgaggccggcgacgugugcgacaacggcaucugcagcaacacccccggcagcuuccagugccagugccugagcggcuaccaccugagcagagacagaagccacugcgaggacaucgacgagugcgacuuccccgccgccugcaucggcggcgacugcaucaacaccaacggcagcuacagaugccugugcccccagggccacagacuggugggcggcagaaagugccaggacaucgacgagugcagccaggaccccagccugugccugccccacggcgccugcaagaaccugcagggcagcuacgugugcgugugcgacgagggcuucacccccacccaggaccagcacggcugcgaggagguggagcagccccaccacaagaaggagugcuaccugaacuucgacgacaccguguucugcgacagcgugcuggccaccaacgugacccagcaggagugcugcugcagccugggcgccggcuggggcgaccacugcgagaucuaccccugccccguguacagcagcgccgaguuccacagccugugccccgacggcaagggcuacacccaggacaacaacaucgugaacuacggcauccccgcccacagagacaucgacgagugcaugcuguucggcagcgagaucugcaaggagggcaagugcgugaacacccagcccggcuacgagugcuacugcaagcagggcuucuacuacgacggcaaccugcuggagugcguggacguggacgagugccuggacgagagcaacugcagaaacggcgugugcgagaacaccagaggcggcuacagaugcgccugcaccccccccgccgaguacagccccgcccagagacagugccugagccccgaggagauggacguggacgagugccaggaccccgccgccugcagacccggcagaugcgugaaccugcccggcagcuacagaugcgagugcagaccccccugggugcccggccccagcggcagagacugccagcugcccgagagccccgccgagagagcccccgagagaagagacgugugcuggagccagagaggcgaggacggcaugugcgccggcccccuggccggccccgcccugaccuucgacgacugcugcugcagacagggcagaggcuggggcgcccagugcagacccugcccccccagaggcgccggcagccacugccccaccagccagagcgagagcaacagcuucugggacaccagcccccugcugcugggcaagccccccagagacgaggacagcagcgaggaggacagcgacgagugcagaugcgugagcggcagaugcgugcccagacccggcggcgccgugugcgagugccccggcggcuuccagcuggacgccagcagagccagaugcguggacaucgacgagugcagagagcugaaccagagaggccugcugugcaagagcgagagaugcgugaacaccagcggcagcuucagaugcgugugcaaggccggcuucgccagaagcagaccccacggcgccugcgugccccagagaagaagauaa

SEQ ID NO: 19460 - RNA, 4875 nt, Artificial Sequence
  LTBP4__Homo_sapiens__NP_001036009
augcccagacccggcaccagcggcagaagaccccugcugcuggugcugcugcugccccuguucgccgccgccaccagcgccgccagccccagccccagccccagccaggugguggaggugcccggcgugcccagcagacccgccagcguggccgugugcagaugcugccccggccagaccagcagaagaagcagaugcaucagagccuucugcagagugagaagcugccagcccaagaagugcgccggcccccagagaugccugaaccccgugcccgccgugcccagccccagccccagcgugagaaagagacaggugagccugaacuggcagccccugacccugcaggaggccagagcccugcugaagagaagaagacccagaggccccggcggcagaggccugcugagaagaagacccccccagagagcccccgccggcaaggcccccgugcugugcccccugaucugccacaacggcggcgugugcgugaagcccgacagaugccugugcccccccgacuucgccggcaaguucugccagcugcacagcagcggcgccagaccccccgcccccgccgugcccggccugaccagaagcguguacaccaugccccuggccaaccacagagacgacgagcacggcguggccagcauggugagcgugcacguggagcacccccaggaggccagcgugguggugcaccagguggagagagugagcggccccugggaggaggccgacgccgaggccguggccagagccgaggccgccgccagagccgaggccgccgcccccuacaccgugcuggcccagagcgcccccagagaggacggcuacagcgacgccagcggcuucggcuacugcuucagagagcugagaggcggcgagugcgccagcccccugcccggccugagaacccaggaggugugcugcagaggcgccggccuggccuggggcgugcacgacugccagcugugcagcgagagacugggcaacagcgagagagugagcgcccccgacggccccugccccaccggcuucgagagagugaacggcagcugcgaggacguggacgagugcgccaccggcggcagaugccagcacggcgagugcgccaacaccagaggcggcuacaccugcgugugccccgacggcuuccugcuggacagcagcagaagcagcugcaucagccagcacgugaucagcgaggccaagggccccugcuucagagugcugagagacggcggcugcagccugcccauccugagaaacaucaccaagcagaucugcugcugcagcagagugggcaaggccuggggcagaggcugccagcugugcccccccuucggcagcgagggcuucagagagaucugccccgccggccccggcuaccacuacagcgccagcgaccugagauacaacaccagaccccugggccaggagccccccagagugagccugagccagcccagaacccugcccgccaccagcagacccagcgccggcuuccugcccacccacagacuggagcccagacccgagcccagacccgaccccagacccggccccgagcugccccugcccagcauccccgccuggaccggccccgagauccccgagagcggccccagcagcggcaugugccagagaaacccccaggugugcggccccggcagaugcaucagcagacccagcggcuacaccugcgccugcgacagcggcuucagacugagcccccagggcaccagaugcaucgacguggacgagugcagaagagugcccccccccugcgcccccggcagaugcgagaacagccccggcagcuucagaugcgugugcggccccggcuucagagccggccccagagccgccgagugccuggacguggacgagugccacagagugcccccccccugcgaccugggcagaugcgagaacacccccggcagcuuccugugcgugugccccgccggcuaccaggccgccccccacggcgccagcugccaggacguggacgagugcacccagagccccggccugugcggcagaggcgccugcaagaaccugcccggcagcuucagaugcgugugccccgccggcuucagaggcagcgccugcgaggaggacguggacgagugcgcccaggagcccccccccugcggccccggcagaugcgacaacaccgccggcagcuuccacugcgccugccccgccggcuucagaagcagaggccccggcgcccccugccaggacguggacgagugcgccagaagccccccccccugcaccuacggcagaugcgagaacaccgagggcagcuuccagugcgugugccccaugggcuuccagcccaacaccgccggcagcgagugcgaggacguggacgagugcgagaaccaccuggccugccccggccaggagugcgugaacagccccggcagcuuccagugcagaaccugccccagcggccaccaccugcacagaggcagaugcaccgacguggacgagugcagcagcggcgccccccccugcggcccccacggccacugcaccaacaccgagggcagcuucagaugcagcugcgcccccggcuacagagcccccagcggcagacccggccccugcgccgacgugaacgagugccuggagggcgacuucugcuucccccacggcgagugccugaacaccgacggcagcuucgccugcaccugcgcccccggcuacagacccggccccagaggcgccagcugccuggacguggacgagugcagcgaggaggaccugugccagagcggcaucugcaccaacaccgacggcagcuucgagugcaucugcccccccggccacagagccggccccgaccuggccagcugccuggacguggacgagugcagagagagaggccccgcccugugcggcagccagagaugcgagaacagccccggcagcuacagaugcgugagagacugcgaccccggcuaccacgccggccccgagggcaccugcgacgacguggacgagugccaggaguacggccccgagaucugcggcgcccagagaugcgagaacacccccggcagcuacagaugcacccccgccugcgaccccggcuaccagcccacccccggcggcggcugccaggacguggacgagugcagaaacagaagcuucugcggcgcccacgccgugugccagaaccugcccggcagcuuccagugccugugcgaccagggcuacgagggcgccagagacggcagacacugcguggacgugaacgagugcgagacccugcagggcgugugcggcgccgcccugugcgagaacguggagggcagcuuccugugcgugugccccaacagccccgaggaguucgaccccaugaccggcagaugcgugccccccagaaccagcgccggcaccuuccccggcagccagccccaggcccccgccagccccgugcugcccgccagaccccccccccccccccugcccagaagacccagcacccccagacagggccccgugggcagcggcagaagagagugcuacuucgacaccgccgcccccgacgccugcgacaacauccuggccagaaacgugaccuggcaggagugcugcugcaccgugggcgagggcuggggcagcggcugcagaauccagcagugccccggcaccgagaccgccgaguaccagagccugugcccccacggcagaggcuaccuggcccccagcggcgaccugagccugagaagagacguggacgagugccagcuguucagagaccaggugugcaagagcggcgugugcgugaacaccgcccccggcuacagcugcuacugcagcaacggcuacuacuaccacacccagagacuggagugcaucgacaacgacgagugcgccgacgaggagcccgccugcgagggcggcagaugcgugaacaccgugggcagcuaccacugcaccugcgagcccccccuggugcuggacggcagccagagaagaugcgugagcaacgagagccagagccuggacgacaaccugggcgugugcuggcaggaggugggcgccgaccuggugugcagccaccccagacuggacagacaggccaccuacaccgagugcugcugccuguacggcgaggccuggggcauggacugcgcccugugccccgcccaggacagcgacgacuucgaggcccugugcaacgugcugagaccccccgccuacagcccccccagacccggcggcuucggccugcccuacgaguacggccccgaccugggcccccccuaccagggccugcccuacggccccgagcuguaccccccccccgcccugcccuacgaccccuacccccccccccccggccccuucgccagaagagaggcccccuacggcgcccccagauucgacaugcccgacuucgaggacgacggcggccccuacggcgagagcgaggcccccgccccccccggccccggcaccagauggcccuacagaagcagagacaccagaagaagcuuccccgagcccgaggagccccccgagggcggcagcuacgccggcagccuggccgagcccuacgaggagcuggaggccgaggagugcggcauccuggacggcugcaccaacggcagaugcgugagagugcccgagggcuucaccugcagaugcuucgacggcuacagacuggacaugaccagaauggccugcguggacaucaacgagugcgacgaggccgaggccgccagcccccugugcgugaacgccagaugccugaacaccgacggcagcuucagaugcaucugcagacccggcuucgcccccacccaccagccccaccacugcgcccccgccagacccagagccuaa

SEQ ID NO: 19461 - RNA, 1251 nt, Artificial Sequence
  LTBR__Homo_sapiens__NP_001257916
auggaggccaccggcaucagccuggccagccagcugaaggugccccccuacgccagcgagaaccagaccugcagagaccaggagaaggaguacuacgagccccagcacagaaucugcugcagcagaugcccccccggcaccuacgugagcgccaagugcagcagaaucagagacaccgugugcgccaccugcgccgagaacagcuacaacgagcacuggaacuaccugaccaucugccagcugugcagacccugcgaccccgugaugggccuggaggagaucgcccccugcaccagcaagagaaagacccagugcagaugccagcccggcauguucugcgccgccugggcccuggagugcacccacugcgagcugcugagcgacugcccccccggcaccgaggccgagcugaaggacgaggugggcaagggcaacaaccacugcgugcccugcaaggccggccacuuccagaacaccagcagccccagcgccagaugccagccccacaccagaugcgagaaccagggccugguggaggccgcccccggcaccgcccagagcgacaccaccugcaagaacccccuggagccccugccccccgagaugagcggcaccaugcugaugcuggccgugcugcugccccuggccuucuuccugcugcuggccaccguguucagcugcaucuggaagagccaccccagccugugcagaaagcugggcagccugcugaagagaagaccccagggcgagggccccaaccccguggccggcagcugggagccccccaaggcccaccccuacuuccccgaccuggugcagccccugcugcccaucagcggcgacgugagccccgugagcaccggccugcccgccgcccccgugcuggaggccggcgugccccagcagcagagcccccuggaccugaccagagagccccagcuggagcccggcgagcagagccagguggcccacggcaccaacggcauccacgugaccggcggcagcaugaccaucaccggcaacaucuacaucuacaacggccccgugcugggcggcccccccggccccggcgaccugcccgccacccccgagccccccuaccccauccccgaggagggcgaccccggcccccccggccugagcaccccccaccaggaggacggcaaggccuggcaccuggccgagaccgagcacugcggcgccacccccagcaacagaggccccagaaaccaguucaucacccacgacuaa

SEQ ID NO: 19462 - RNA, 453 nt, Artificial Sequence
  LTC4S__Homo_sapiens__NP_665874
augaaggacgagguggcccugcuggccgccgugacccugcugggcgugcugcugcaggccuacuucagccugcaggugaucagcgccagaagagccuucagagugagccccccccugaccaccggcccccccgaguucgagagaguguacagagcccaggugaacugcagcgaguacuucccccuguuccuggccacccuguggguggccggcaucuucuuccacgagggcgccgccgcccugugcggccugguguaccuguucgccagacugagauacuuccagggcuacgccagaagcgcccagcugagacuggccccccuguacgccagcgccagagcccuguggcugcugguggcccuggccgcccugggccugcuggcccacuuccugcccgccgcccugagagccgcccugcugggcagacugagaacccugcugcccugggccuaa

SEQ ID NO: 19463 - RNA, 2001 nt, Artificial Sequence
  LTF__Homo_sapiens__NP_001186078
augagaaaggugagaggcccccccgugagcugcaucaagagagacagccccauccagugcauccaggccaucgccgagaacagagccgacgccgugacccuggacggcggcuucaucuacgaggccggccuggcccccuacaagcugagacccguggccgccgagguguacggcaccgagagacagcccagaacccacuacuacgccguggccguggugaagaagggcggcagcuuccagcugaacgagcugcagggccugaagagcugccacaccggccugagaagaaccgccggcuggaacgugcccaucggcacccugagacccuuccugaacuggaccggcccccccgagcccaucgaggccgccguggccagauucuucagcgccagcugcgugcccggcgccgacaagggccaguuccccaaccugugcagacugugcgccggcaccggcgagaacaagugcgccuucagcagccaggagcccuacuucagcuacagcggcgccuucaagugccugagagacggcgccggcgacguggccuucaucagagagagcaccguguucgaggaccugagcgacgaggccgagagagacgaguacgagcugcugugccccgacaacaccagaaagcccguggacaaguucaaggacugccaccuggccagagugcccagccacgccgugguggccagaagcgugaacggcaaggaggacgccaucuggaaccugcugagacaggcccaggagaaguucggcaaggacaagagccccaaguuccagcuguucggcagccccagcggccagaaggaccugcuguucaaggacagcgccaucggcuucagcagagugccccccagaaucgacagcggccuguaccugggcagcggcuacuucaccgccauccagaaccugagaaagagcgaggaggagguggccgccagaagagccagagugguguggugcgccgugggcgagcaggagcugagaaagugcaaccaguggagcggccugagcgagggcagcgugaccugcagcagcgccagcaccaccgaggacugcaucgcccuggugcugaagggcgaggccgacgccaugagccuggacggcggcuacguguacaccgccggcaagugcggccuggugcccgugcuggccgagaacuacaagagccagcagagcagcgaccccgaccccaacugcguggacagacccguggagggcuaccuggccguggccguggugagaagaagcgacaccagccugaccuggaacagcgugaagggcaagaagagcugccacaccgccguggacagaaccgccggcuggaacauccccaugggccugcuguucaaccagaccggcagcugcaaguucgacgaguacuucagccagagcugcgcccccggcagcgaccccagaagcaaccugugcgcccugugcaucggcgacgagcagggcgagaacaagugcgugcccaacagcaacgagagauacuacggcuacaccggcgccuucagaugccuggccgagaacgccggcgacguggccuucgugaaggacgugaccgugcugcagaacaccgacggcaacaacaacgaggccugggccaaggaccugaagcuggccgacuucgcccugcugugccuggacggcaagagaaagcccgugaccgaggccagaagcugccaccuggccauggcccccaaccacgccguggugagcagaauggacaagguggagagacugaagcaggugcugcugcaccagcaggccaaguucggcagaaacggcagcgacugccccgacaaguucugccuguuccagagcgagaccaagaaccugcuguucaacgacaacaccgagugccuggccagacugcacggcaagaccaccuacgagaaguaccugggcccccaguacguggccggcaucaccaaccugaagaagugcagcaccagcccccugcuggaggccugcgaguuccugagaaaguaa

SEQ ID NO: 19464 - RNA, 2205 nt, Artificial Sequence
  LTK__Homo_sapiens__NP_001129157
augggcugcuggggccagcugcuggugugguucggcgccgccggcgccauccugugcagcagccccggcagccaggagaccuuccugagaagcagcccccugccccuggccagccccagccccagagaccccaaggugagcgccccccccagcauccuggagcccgccagcccccugaacagccccggcaccgagggcagcuggcuguucagcaccugcggcgccagcggcagacacggccccacccagacccagugcgacggcgccuacgccggcaccagcgugguggugaccgugggcgccgccggccagcugagaggcgugcagcuguggagagugcccggccccggccaguaccugaucagcgccuacggcgccgccggcggcaagggcgccaagaaccaccugagcagagcccacggcguguucgugagcgccaucuucagccugggccugggcgagagccuguacauccuggugggccagcagggcgaggacgccugccccggcggcagccccgagagccagcuggugugccugggcgagagcagagccguggaggagcacgccgccauggacggcagcgagggcgugcccggcagcagaagaugggccggcggcggcggcggcggcggcggcgccaccuacguguucagagugagagccggcgagcuggagccccugcugguggccgccggcggcggcggcagagccuaccugagacccagagacagaggcagaacccaggccagccccgagaagcuggagaacagaagcgaggcccccggcagcggcggcagaggcggcgccgccggcggcgacgccagcgagaccgacaaccugugggccgacggcgaggacggcgugagcuucauccaccccagcagcgagcuguuccugcagccccuggccgugaccgagaaccacggcgagguggagaucagaagacaccugaacugcagccacugcccccugagagacugccaguggcaggccgagcugcagcuggccgagugccugugccccgagggcauggagcuggccguggacaacgugaccugcauggaccugcacaagccccccggcccccuggugcugaugguggccgugguggccaccagcacccugagccugcugauggugugcggcgugcugauccugggcggcgccuggcccggccccgugcuggccagcgccaccagaugccacagaggcuuccccagccagugcuacagcgcccagacccugcccgagcugugcagcccccaggacgagcuggacuuccugauggaggcccugaucaucagcaaguucagacaccagaacaucgugagaugcgugggccugagccugagagccacccccagacugauccugcuggagcugaugagcggcggcgacaugaagagcuuccugagacacagcagaccccaccugggccagcccagcccccuggugaugagagaccugcugcagcuggcccaggacaucgcccagggcugccacuaccuggaggagaaccacuucauccacagagacaucgccgccagaaacugccugcugagcugcgccggccccagcagaguggccaagaucggcgacuucggcauggccagagacaucuacagagccagcuacuacagaagaggcgacagagcccugcugcccgugaaguggaugccccccgaggccuuccuggagggcaucuucaccagcaagaccgacagcuggagcuucggcgugcugcugugggagaucuucagccugggcuacaugcccuaccccggcagaaccaaccaggaggugcuggacuucguggugggcggcggcagaauggacccccccagaggcugccccggccccguguacagaaucaugacccagugcuggcagcacgagcccgagcugagacccagcuucgccagcauccuggagagacugcaguacugcacccaggaccccgacgugcugaacagccugcugcccauggagcugggccccacccccgaggaggagggcaccagcggccugggcaacagaagccuggagugccugagacccccccagccccaggagcugagccccgagaagcugaagagcuggggcggcagcccccugggccccuggcugagcagcggccugaagccccugaagagcagaggccugcagccccagaaccuguggaaccccaccuacagaagcuaa

SEQ ID NO: 19465 - RNA, 1299 nt, Artificial Sequence
  LUC7L3__Homo_sapiens__NP_057508
augaucagcgccgcccagcugcuggacgagcugaugggcagagacagaaaccuggcccccgacgagaagagaagcaacgugagaugggaccacgagagcgugugcaaguacuaccugugcggcuucugccccgccgagcuguucaccaacaccagaagcgaccugggccccugcgagaagauccacgacgagaaccugagaaagcaguacgagaagagcagcagauucaugaaggugggcuacgagagagacuuccugagauaccugcagagccugcuggccgagguggagagaagaaucagaagaggccacgccagacuggcccugagccagaaccagcagagcagcggcgccgccggccccaccggcaagaacgaggagaagauccaggugcugaccgacaagaucgacgugcugcugcagcagaucgaggagcugggcagcgagggcaagguggaggaggcccagggcaugaugaagcugguggagcagcugaaggaggagagagagcugcugagaagcaccaccagcaccaucgagagcuucgccgcccaggagaagcagauggaggugugcgaggugugcggcgccuuccugaucgugggcgacgcccagagcagaguggacgaccaccugaugggcaagcagcacaugggcuacgccaagaucaaggccaccguggaggagcugaaggagaagcugagaaagagaaccgaggagcccgacagagacgagagacugaagaaggagaagcaggagagagaggagagagagaaggagagagagagagagagagaggagagagagagaaagagaagaagagaggaggaggagagagagaaggagagagccagagacagagagagaagaaagagaagcagaagcagaagcagacacagcagcagaaccagcgacagaagaugcagcagaagcagagaccacaagagaagcagaagcagagagagaagaagaagcagaagcagagacagaagaagaagcagaagccacgacagaagcgagagaaagcacagaagcagaagcagagacagaagaagaagcaagagcagagacagaaagagcuacaagcacagaagcaagagcagagacagagagcaggacagaaagagcaaggagaaggagaagagaggcagcgacgacaagaagagcagcgugaagagcggcagcagagagaagcagagcgaggacaccaacaccgagagcaaggagagcgacaccaagaacgaggugaacggcaccagcgaggacaucaagagcgagggcgacacccagagcaacuaa

SEQ ID NO: 19466 - RNA, 978 nt, Artificial Sequence
  LUC7L__Homo_sapiens__NP_060502
augagcgcccaggcccagaugagagcccugcuggaccagcugaugggcaccgccagagacggcgacgagaccagacagagagugaaguucaccgacgacagagugugcaagagccaccugcuggacugcugcccccacgacauccuggccggcaccagaauggaccugggcgagugcaccaagauccacgaccuggcccugagagccgacuacgagaucgccagcaaggagagagaccuguucuucgagcuggacgccauggaccaccuggagagcuucaucgccgagugcgacagaagaaccgagcuggccaagaagagacuggccgagacccaggaggagaucagcgccgaggugagcgccaaggccgagaaggugcacgagcugaacgaggagaucggcaagcugcuggccaaggccgagcagcugggcgccgagggcaacguggacgagagccagaagauccugauggagguggagaaggugagagccaagaagaaggaggccgaggaggaguacagaaacagcaugcccgccagcagcuuccagcagcagaagcugagagugugcgaggugugcagcgccuaccugggccugcacgacaacgacagaagacuggccgaccacuucggcggcaagcugcaccugggcuucauccagaucagagagaagcuggaccagcugagaaagaccguggccgagaagcaggagaagagaaaccaggacagacugagaagaagagaggagagagagagagaggagagacugagcagaagaagcggcagcagaaccagagacagaagaagaagcagaagcagagacagaagaagaagaagaagcagaagcaccagcagagagagaagaaagcugagcagaagcagaagcagagacagacacagaagacacagaagcagaagcagaagccacagcagaggccacagaagagccagcagagacagaagcgccaaguacaaguaa

SEQ ID NO: 19467 - RNA, 1017 nt, Artificial Sequence
  LUM__Homo_sapiens__NP_002336
augagccugagcgccuucacccuguuccuggcccugaucggcggcaccagcggccaguacuacgacuacgacuucccccugagcaucuacggccagagcagccccaacugcgcccccgagugcaacugccccgagagcuaccccagcgccauguacugcgacgagcugaagcugaagagcgugcccauggugccccccggcaucaaguaccuguaccugagaaacaaccagaucgaccacaucgacgagaaggccuucgagaacgugaccgaccugcaguggcugauccuggaccacaaccugcuggagaacagcaagaucaagggcagaguguucagcaagcugaagcagcugaagaagcugcacaucaaccacaacaaccugaccgagagcgugggcccccugcccaagagccuggaggaccugcagcugacccacaacaagaucaccaagcugggcagcuucgagggccuggugaaccugaccuucauccaccugcagcacaacagacugaaggaggacgccgugagcgccgccuucaagggccugaagagccuggaguaccuggaccugagcuucaaccagaucgccagacugcccagcggccugcccgugagccugcugacccuguaccuggacaacaacaagaucagcaacauccccgacgaguacuucaagagauucaacgcccugcaguaccugagacugagccacaacgagcuggccgacagcggcauccccggcaacagcuucaacgugagcagccugguggagcuggaccugagcuacaacaagcugaagaacauccccaccgugaacgagaaccuggagaacuacuaccuggaggugaaccagcuggagaaguucgacaucaagagcuucugcaagauccugggcccccugagcuacagcaagaucaagcaccugagacuggacggcaacagaaucagcgagaccagccugccccccgacauguacgagugccugagaguggccaacgaggugacccugaacuaa

SEQ ID NO: 19468 - RNA, 687 nt, Artificial Sequence
  LURAP1L__Homo_sapiens__NP_981948
auggaggacagcccccugcccgaccugagagacaucgagcugaagcugggcagaaaggugcccgagagccuggugagaagccugagaggcgaggagcccgugcccagagagagagacagagaccccugcggcggcagcggcggcggcggcggcggcggcggcggcugcagcagcagcagcagcuacugcagcuucccccccagccugagcagcagcagcagcagcagccccaccagcggcagccccagaggcagccacagcagcgcccuggagagacuggagaccaagcugcaccugcugagacaggagauggugaaccugagagccaccgacgugagacugaugagacagcugcuggugaucaacgagagcaucgagagcaucaaguggaugaucgaggagaaggccaccaucaccagcagaggcagcagccugagcggcagccugugcagccugcuggagagccagagcaccagccugagaggcagcuacaacagccugcacgacggcagcgacggccuggacggcaucagcgugggcagcuaccuggacacccuggccgacgacgugcccggccaccagacccccagcgaccuggaccaguucagcgacagcagccugaucgaggacagccaggcccugcacaagagacccaagcuggacagcgaguacuacugcuucggcuaa

SEQ ID NO: 19469 - RNA, 942 nt, Artificial Sequence
  LUZP4__Homo_sapiens__NP_057467
auggccagcuucagaaagcugacccugagcgagaaggugccccccaaccaccccagcagaaagaaggugaacuuccuggacaugagccuggacgacaucaucaucuacaaggagcuggagggcaccaacgccgaggaggagaagaacaagagacagaaccacagcaagaaggagagccccagcagacagcagagcaaggcccacagacacagacacagaagaggcuacagcagaugcagaagcaacagcgaggagggcaaccacgacaagaagcccagccagaagcccagcggcuucaagagcggccagcacccccugaacggccagccccugaucgagcaggagaagugcagcgacaacuacgaggcccaggccgagaagaaccagggccagagcgagggcaaccagcaccagagcgagggcaaccccgacaagagcgaggagagccagggccagcccgaggagaaccaccacagcgagagaagcagaaaccaccuggagagaagccugagccagagcgacagaagccagggccagcugaagagacaccacccccaguacgagagaagccacggccaguacaagagaagccacggccagagcgagagaagccacggccacagcgagagaagccacggccacagcgagagaagccacggccacagcgagagaagccacggccacagcaagagaagcagaagccagggcgaccugguggacacccagagcgaccugaucgccacccagagagaccugaucgccacccagaaggaccugaucgccacccagagagaccugaucgccacccagagagaccugaucgugacccagagagaccugguggccaccgagagagaccugaucaaccagagcggcagaagccacggccagagcgagagacaccagagauacagcaccggcaagaacaccaucaccaccuaa

SEQ ID NO: 19470 - RNA, 177 nt, Artificial Sequence
  LUZP6__Homo_sapiens__NP_001122091
augaagagcgugaucagcuacgcccuguaccaggugcagaccggcagccugcccguguacagcagcgugcugaccaagagcccccugcagcugcagaccgugaucuacagacugaucgugcagauccagcaccugaacauccccagcagcagcagcacccacagcagccccuucuaa

SEQ ID NO: 19471 - RNA, 2973 nt, Artificial Sequence
  LVRN__Homo_sapiens__NP_776161
augggcccccccagcagcagcggcuucuacgugagcagagccguggcccugcugcuggccggccugguggccgcccugcugcuggcccuggccgugcuggccgcccuguacggccacugcgagagagugccccccagcgagcugcccggccugagagaccuggaggccgagagcagccccccccugagacagaagcccacccccacccccaagcccagcagcgccagagagcuggccgugaccaccacccccagcaacuggagaccccccggccccugggaccagcugagacugccccccuggcuggugccccugcacuacgaccuggagcuguggccccagcugagacccgacgagcugcccgccggcagccugcccuucaccggcagagugaacaucaccgugagaugcaccguggccaccagcagacugcugcugcacagccuguuccaggacugcgagagagccgaggugagaggcccccugagccccggcaccggcaacgccaccgugggcagagugcccguggacgacgugugguucgcccuggacaccgaguacauggugcuggagcugagcgagccccugaagcccggcagcagcuacgagcugcagcugagcuucagcggccuggugaaggaggaccugagagagggccuguuccugaacguguacaccgaccagggcgagagaagagcccugcuggccagccagcuggagcccaccuucgccagauacguguuccccugcuucgacgagcccgcccugaaggccaccuucaacaucaccaugauccaccaccccagcuacguggcccugagcaacaugcccaagcugggccagagcgagaaggaggacgugaacggcagcaaguggaccgugaccaccuucagcaccaccccccacaugcccaccuaccugguggccuucgugaucugcgacuacgaccacgugaacagaaccgagagaggcaaggagaucagaaucugggccagaaaggacgccaucgccaacggcagcgccgacuucgcccugaacaucaccggccccaucuucagcuuccuggaggaccuguucaacaucagcuacagccugcccaagaccgacaucaucgcccugcccagcuucgacaaccacgccauggagaacuggggccugaugaucuucgacgagagcggccugcugcuggagcccaaggaccagcugaccgagaagaagacccugaucagcuacguggugagccacgagaucggccaccagugguucggcaaccuggugaccaugaacugguggaacaacaucuggcugaacgagggcuucgccagcuacuucgaguucgaggugaucaacuacuucaaccccaagcugcccagaaacgagaucuucuucagcaacauccugcacaacauccugagagaggaccacgcccuggugaccagagccguggccaugaagguggagaacuucaagaccagcgagauccaggagcuguucgacaucuucaccuacagcaagggcgccagcauggccagaaugcugagcugcuuccugaacgagcaccuguucgugagcgcccugaagagcuaccugaagaccuucagcuacagcaacgccgagcaggacgaccuguggagacacuuccagauggccaucgacgaccagagcaccgugauccugcccgccaccaucaagaacaucauggacagcuggacccaccagagcggcuuccccgugaucacccugaacgugagcaccggcgugaugaagcaggagcccuucuaccuggagaacaucaagaacagaacccugcugaccagcaacgacaccuggaucgugcccauccuguggaucaagaacggcaccacccagccccugguguggcuggaccagagcagcaagguguuccccgagaugcaggugagcgacagcgaccacgacugggugauccugaaccugaacaugaccggcuacuacagagugaacuacgacaagcugggcuggaagaagcugaaccagcagcuggagaaggaccccaaggccauccccgugauccacagacugcagcugaucgacgacgccuucagccugagcaagaacaacuacaucgagaucgagaccgcccuggagcugaccaaguaccuggccgaggaggacgagaucaucguguggcacaccgugcuggugaaccuggugaccagagaccuggugagcgaggugaacaucuacgacaucuacagccugcugaagagauaccugcugaagagacugaaccugaucuggaacaucuacagcaccaucaucagagagaacgugcuggcccugcaggacgacuaccuggcccugaucagccuggagaagcuguucgugaccgccugcuggcugggccuggaggacugccugcagcugagcaaggagcuguucgccaaguggguggaccaccccgagaacgagauccccuaccccaucaaggacguggugcugugcuacggcaucgcccugggcagcgacaaggagugggacauccugcugaacaccuacaccaacaccaccaacaaggaggagaagauccagcuggccuacgccaugagcugcagcaaggaccccuggauccugaacagauacauggaguacgccaucagcaccagccccuucaccagcaacgagaccaacaucaucgaggugguggccagcagcgaggugggcagauacguggccaaggacuuccuggugaacaacuggcaggccgugagcaagagauacggcacccagagccugaucaaccugaucuacaccaucggcagaaccgugaccaccgaccugcagaucguggagcugcagcaguucuucagcaacaugcuggaggagcaccagagaaucagagugcacgccaaccugcagaccaucaagaacgagaaccugaagaacaagaagcugagcgccagaaucgccgccuggcugagaagaaacaccuaa

SEQ ID NO: 19472 - RNA, 669 nt, Artificial Sequence
  LXN__Homo_sapiens__NP_064554
auggagaucccccccaccaacuaccccgccagcagagccgcccugguggcccagaacuacaucaacuaccagcagggcaccccccacagaguguucgaggugcagaaggugaagcaggccagcauggaggacauccccggcagaggccacaaguaccaccugaaguucgccguggaggagaucauccagaagcaggugaaggugaacugcaccgccgaggugcuguaccccagcaccggccaggagaccgcccccgaggugaacuucaccuucgagggcgagaccggcaagaaccccgacgaggaggacaacaccuucuaccagagacugaagagcaugaaggagccccuggaggcccagaacauccccgacaacuucggcaacgugagccccgagaugacccuggugcugcaccuggccuggguggccugcggcuacaucaucuggcagaacagcaccgaggacaccugguacaagauggugaagauccagaccgugaagcaggugcagagaaacgacgacuucaucgagcuggacuacaccauccugcugcacaacaucgccagccaggagaucauccccuggcagaugcaggugcuguggcacccccaguacggcaccaaggugaagcacaacagcagacugcccaaggaggugcagcuggaguaa

SEQ ID NO: 19473 - RNA, 387 nt, Artificial Sequence
  LY6D__Homo_sapiens__NP_003686
augagaaccgcccugcugcugcuggccgcccuggccguggccaccggccccgcccugacccugagaugccacgugugcaccagcagcagcaacugcaagcacagcguggugugccccgccagcagcagauucugcaagaccaccaacaccguggagccccugagaggcaaccuggugaagaaggacugcgccgagagcugcacccccagcuacacccugcagggccaggugagcagcggcaccagcagcacccagugcugccaggaggaccugugcaacgagaagcugcacaacgccgcccccaccagaaccgcccuggcccacagcgcccugagccugggccuggcccugagccugcuggccgugauccuggcccccagccuguaa

SEQ ID NO: 19474 - RNA, 396 nt, Artificial Sequence
  LY6E__Homo_sapiens__NP_001120685
augaagaucuuccugcccgugcugcuggccgcccugcugggcguggagagagccagcagccugaugugcuucagcugccugaaccagaagagcaaccuguacugccugaagcccaccaucugcagcgaccaggacaacuacugcgugaccgugagcgccagcgccggcaucggcaaccuggugaccuucggccacagccugagcaagaccugcagccccgccugccccauccccgagggcgugaacgugggcguggccagcaugggcaucagcugcugccagagcuuccugugcaacuucagcgccgccgacggcggccugagagccagcgugacccugcugggcgccggccugcugcugagccugcugcccgcccugcugagauucggccccuaa

SEQ ID NO: 19475 - RNA, 606 nt, Artificial Sequence
  LY6G5B__Homo_sapiens__NP_067044
augaaggugcacaugcuggugggcgugcuggugauggugggcuucaccgugggcaaggugcccgugcccgacaucagaaccugccacuucugccugguggaggaccccagcgugggcugcaucagcggcagcgagaagugcaccaucagcagcagcagccugugcauggugaucaccaucuacuacgacgugaaggugagauucaucgugagaggcugcggccaguacaucagcuacagaugccaggagaagagaaacaccuacuucgccgaguacugguaccaggcccagugcugccaguacgacuacugcaacagcuggagcagcccccagcugcagagcagccugcccgagccccacgacagaccccuggcccugccccugagcgacagccagauccagugguucuaccaggcccugaaccugagccugccccugcccaacuuccacgccggcaccgagcccgacggccuggaccccauggugacccugagccugaaccugggccugagcuucgccgagcugagaagaauguaccuguuccugaacagcagcggccugcuggugcugccccaggccggccugcugaccccccaccccagcuaa

SEQ ID NO: 19476 - RNA, 453 nt, Artificial Sequence
  LY6G5C__Homo_sapiens__NP_079538
augagauucauggccggccccgccggcagccagagccugggcccccugugcuuccacagcagcccccaggcccuguacaccgugcugcugaucgugcuggugaugaugagccugguguucggcaaguucgugcccgugaacugggagcccccccagccccugcccuuccccaaguaccugagaugcuacagaugccugcuggagaccaaggagcugggcugccugcugggcagcgacaucugccugacccccgccggcagcagcugcaucacccugcacaagaagaacagcagcggcagcgacgugauggugagcgacugcagaagcaaggagcagaugagcgacugcagcaacaccagaaccagccccgugagcggcuucuggaucuucagccaguacugcuuccuggacuucugcaacgacccccagaacagaggccuguacacccccuaa

SEQ ID NO: 19477 - RNA, 378 nt, Artificial Sequence
  LY6G6C__Homo_sapiens__NP_079537
augaaggcccugaugcugcugacccugagcgugcugcugugcugggugagcgccgacaucagaugccacagcugcuacaaggugcccgugcugggcugcguggacagacagagcugcagacuggagcccggccagcagugccugaccacccacgccuaccugggcaagauguggguguucagcaaccugagaugcggcacccccgaggagcccugccaggaggccuucaaccagaccaacagaaagcugggccugaccuacaacaccaccugcugcaacaaggacaacugcaacagcgccggccccagacccacccccgcccugggccugguguuccugaccagccuggccggccugggccuguggcugcugcacuaa

SEQ ID NO: 19478 - RNA, 894 nt, Artificial Sequence
  LY6G6F__Homo_sapiens__NP_001003693
auggccgugcuguuccugcugcuguuccugugcggcaccccccaggccgccgacaacaugcaggccaucuacguggcccugggcgaggccguggagcugcccugccccagcccccccacccugcacggcgacgagcaccugagcugguucugcagccccgccgccggcagcuucaccacccugguggcccaggugcaggugggcagacccgcccccgaccccggcaagcccggcagagagagcagacugagacugcugggcaacuacagccuguggcuggagggcagcaaggaggaggacgccggcagauacuggugcgccgugcugggccagcaccacaacuaccagaacuggagaguguacgacgugcuggugcugaagggcagccagcugagcgccagagccgccgacggcagccccugcaacgugcugcugugcagcguggugcccagcagaagaauggacagcgugaccuggcaggagggcaagggccccgugagaggcagagugcagagcuucuggggcagcgaggccgcccugcugcuggugugccccggcgagggccugagcgagcccagaagcagaagacccagaaucaucagaugccugaugacccacaacaagggcgugagcuucagccuggccgccagcaucgacgccagccccgcccugugcgcccccagcaccggcugggacaugcccuggauccugaugcugcugcugaccaugggccagggcguggugauccuggcccugagcaucgugcuguggagacagagagugagaggcgcccccggcagagacgccagcaucccccaguucaagcccgagauccagguguacgagaacauccaccuggccagacugggcccccccgcccacaagcccagauaa

SEQ ID NO: 19479 - RNA, 498 nt, Artificial Sequence
  LY6K__Homo_sapiens__NP_059997
auggcccugcuggcccugcugcuggugguggcccugcccagaguguggaccgacgccaaccugaccgccagacagagagaccccgaggacagccagagaaccgacgagggcgacaacagaguguggugccacgugugcgagagagagaacaccuucgagugccagaaccccagaagaugcaaguggaccgagcccuacugcgugaucgccgccgugaagaucuuccccagauucuucaugguggccaagcagugcagcgccggcugcgccgccauggagagacccaagcccgaggagaagagauuccugcuggaggagcccaugcccuucuucuaccugaagugcugcaagaucagauacugcaaccuggagggcccccccaucaacagcagcguguucaaggaguacgccggcagcaugggcgagagcugcggcggccuguggcuggccauccugcugcugcuggccagcaucgccgccggccugagccugagcuaa

SEQ ID NO: 19480 - RNA, 5622 nt, Artificial Sequence
  LY75-CD302__Homo_sapiens__NP_001185688
augagaaccggcugggccacccccagaagacccgccggccugcugaugcugcuguucugguucuucgaccuggccgagcccagcggcagagccgccaacgaccccuucaccaucgugcacggcaacaccggcaagugcaucaagcccguguacggcuggaucguggccgacgacugcgacgagaccgaggacaagcuguggaagugggugagccagcacagacuguuccaccugcacagccagaagugccugggccuggacaucaccaagagcgugaacgagcugagaauguucagcugcgacagcagcgccaugcugugguggaagugcgagcaccacagccuguacggcgccgccagauacagacuggcccugaaggacggccacggcaccgccaucagcaacgccagcgacguguggaagaagggcggcagcgaggagagccugugcgaccagcccuaccacgagaucuacaccagagacggcaacagcuacggcagacccugcgaguuccccuuccugaucgacggcaccuggcaccacgacugcauccuggacgaggaccacagcggccccuggugcgccaccacccugaacuacgaguacgacagaaaguggggcaucugccugaagcccgagaacggcugcgaggacaacugggagaagaacgagcaguucggcagcugcuaccaguucaacacccagaccgcccugagcuggaaggaggccuacgugagcugccagaaccagggcgccgaccugcugagcaucaacagcgccgccgagcugaccuaccugaaggagaaggagggcaucgccaagaucuucuggaucggccugaaccagcuguacagcgccagaggcugggaguggagcgaccacaagccccugaacuuccugaacugggaccccgacagacccagcgcccccaccaucggcggcagcagcugcgccagaauggacgccgagagcggccuguggcagagcuucagcugcgaggcccagcugcccuacgugugcagaaagccccugaacaacaccguggagcugaccgacguguggaccuacagcgacaccagaugcgacgccggcuggcugcccaacaacggcuucugcuaccugcuggugaacgagagcaacagcugggacaaggcccacgccaagugcaaggccuucagcagcgaccugaucagcauccacagccuggccgacguggaggugguggugaccaagcugcacaacgaggacaucaaggaggagguguggaucggccugaagaacaucaacauccccacccuguuccaguggagcgacggcaccgaggugacccugaccuacugggacgagaacgagcccaacgugcccuacaacaagacccccaacugcgugagcuaccugggcgagcugggccaguggaaggugcagagcugcgaggagaagcugaaguacgugugcaagagaaagggcgagaagcugaacgacgccagcagcgacaagaugugcccccccgacgagggcuggaagagacacggcgagaccugcuacaagaucuacgaggacgaggugcccuucggcaccaacugcaaccugaccaucaccagcagauucgagcaggaguaccugaacgaccugaugaagaaguacgacaagagccugagaaaguacuucuggaccggccugagagacguggacagcugcggcgaguacaacugggccaccgugggcggcagaagaagagccgugaccuucagcaacuggaacuuccuggagcccgccagccccggcggcugcguggccaugagcaccggcaagagcgugggcaagugggaggugaaggacugcagaagcuucaaggcccugagcaucugcaagaagaugagcggcccccugggccccgaggaggccagccccaagcccgacgaccccugccccgagggcuggcagagcuuccccgccagccugagcugcuacaagguguuccacgccgagagaaucgugagaaagagaaacugggaggaggccgagagauucugccaggcccugggcgcccaccugagcagcuucagccacguggacgagaucaaggaguuccugcacuuccugaccgaccaguucagcggccagcacuggcuguggaucggccugaacaagagaagccccgaccugcagggcagcuggcaguggagcgacagaacccccgugagcaccaucaucaugcccaacgaguuccagcaggacuacgacaucagagacugcgccgccgugaagguguuccacagacccuggagaagaggcuggcacuucuacgacgacagagaguucaucuaccugagacccuucgccugcgacaccaagcuggagugggugugccagauccccaagggcagaacccccaagacccccgacugguacaaccccgacagagccggcauccacggccccccccugaucaucgagggcagcgaguacugguucguggccgaccugcaccugaacuacgaggaggccgugcuguacugcgccagcaaccacagcuuccuggccaccaucaccagcuucgugggccugaaggccaucaagaacaagaucgccaacaucagcggcgacggccagaagugguggaucagaaucagcgaguggcccaucgacgaccacuucaccuacagcagauaccccuggcacagauuccccgugaccuucggcgaggagugccuguacaugagcgccaagaccuggcugaucgaccugggcaagcccaccgacugcagcaccaagcugcccuucaucugcgagaaguacaacgugagcagccuggagaaguacagccccgacagcgccgccaaggugcagugcagcgagcaguggauccccuuccagaacaagugcuuccugaagaucaagcccgugagccugaccuucagccaggccagcgacaccugccacagcuacggcggcacccugcccagcgugcugagccagaucgagcaggacuucaucaccagccugcugcccgacauggaggccacccuguggaucggccugagauggaccgccuacgagaagaucaacaaguggaccgacaacagagagcugaccuacagcaacuuccacccccugcuggugagcggcagacugagaauccccgagaacuucuucgaggaggagagcagauaccacugcgcccugauccugaaccugcagaagagccccuucaccggcaccuggaacuucaccagcugcagcgagagacacuucgugagccugugccagaaguacagcgaggugaagagcagacagacccugcagaacgccagcgagaccgugaaguaccugaacaaccuguacaagaucauccccaagacccugaccuggcacagcgccaagagagagugccugaagagcaacaugcagcuggugagcaucaccgaccccuaccagcaggccuuccugagcgugcaggcccugcugcacaacagcagccuguggaucggccuguucagccaggacgacgagcugaacuucggcuggagcgacggcaagagacugcacuucagcagaugggccgagaccaacggccagcuggaggacugcguggugcuggacaccgacggcuucuggaagaccguggacugcaacgacaaccagcccggcgccaucugcuacuacagcggcaacgagaccgagaaggaggugaagcccguggacagcgugaagugccccagccccgugcugaacacccccuggauccccuuccagaacugcugcuacaacuucaucaucaccaagaacagacacauggccaccacccaggacgaggugcacaccaagugccagaagcugaaccccaagagccacauccugagcaucagagacgagaaggagaacaacuucgugcuggagcagcugcuguacuucaacuacauggccagcugggugaugcugggcaucaccuacagaaacaagagccugaugugguucgacaagaccccccugagcuacacccacuggagagccggcagacccaccaucaagaacgagaaguuccuggccggccugagcaccgacggcuucugggacauccagaccuucaaggugaucgaggaggccguguacuuccaccagcacagcauccuggccugcaagaucgagaugguggacuacaaggaggaguacaacaccacccugccccaguucaugcccuacgaggacggcaucuacagcgugauccagaagaaggugaccugguacgaggcccugaacaugugcagccagagcggcggccaccuggccagcgugcacaaccagaacggccagcuguuccuggaggacaucgugaagagagacggcuucccccugugggugggccugagcagccacgacggcagcgagagcagcuucgaguggagcgacggcagcaccuucgacuacauccccuggaagggccagaccagccccggcaacugcgugcugcuggaccccaagggcaccuggaagcacgagaagugcaacagcgugaaggacggcgccaucugcuacaagcccaccaagagcaagaagcugagcagacugaccuacagcagcagaugccccgccgccaaggagaacggcagcagauggauccaguacaagggccacugcuacaagagcgaccaggcccugcacagcuucagcgaggccaagaagcugugcagcaagcacgaccacagcgccaccaucgugagcaucaaggacgaggacgagaacaaguucgugagcagacugaugagagagaacaacaacaucaccaugagaguguggcugggccugagccagcacagcguggaccagagcuggagcuggcuggacggcagcgaggugaccuucgugaagugggagaacaagagcaagagcggcgugggcagaugcagcaugcugaucgccagcaacgagaccuggaagaagguggagugcgagcacggcuucggcagaguggugugcaaggugccccuggacugccccagcagcaccuggauccaguuccaggacagcugcuacaucuuccugcaggaggccaucaagguggagagcaucgaggacgugagaaaccagugcaccgaccacggcgccgacaugaucagcauccacaacgaggaggagaacgccuucauccuggacacccugaagaagcaguggaagggccccgacgacauccugcugggcauguucuacgacaccgacgacgccagcuucaagugguucgacaacagcaacaugaccuucgacaaguggaccgaccaggacgacgacgaggaccugguggacaccugcgccuuccugcacaucaagaccggcgaguggaagaagggcaacugcgaggugagcagcguggagggcacccugugcaagaccgccauccccuacaagagaaaguaccugagcgacaaccacauccugaucagcgcccuggugaucgccagcaccgugauccugaccgugcugggcgccaucaucugguuccuguacaagaagcacagcgacagcagauucaccaccguguucagcaccgccccccagagccccuacaacgaggacugcgugcugguggugggcgaggagaacgaguaccccgugcaguucgacuaa

SEQ ID NO: 19481 - RNA, 5169 nt, Artificial Sequence
  LY75__Homo_sapiens__NP_002340
augagaaccggcugggccacccccagaagacccgccggccugcugaugcugcuguucugguucuucgaccuggccgagcccagcggcagagccgccaacgaccccuucaccaucgugcacggcaacaccggcaagugcaucaagcccguguacggcuggaucguggccgacgacugcgacgagaccgaggacaagcuguggaagugggugagccagcacagacuguuccaccugcacagccagaagugccugggccuggacaucaccaagagcgugaacgagcugagaauguucagcugcgacagcagcgccaugcugugguggaagugcgagcaccacagccuguacggcgccgccagauacagacuggcccugaaggacggccacggcaccgccaucagcaacgccagcgacguguggaagaagggcggcagcgaggagagccugugcgaccagcccuaccacgagaucuacaccagagacggcaacagcuacggcagacccugcgaguuccccuuccugaucgacggcaccuggcaccacgacugcauccuggacgaggaccacagcggccccuggugcgccaccacccugaacuacgaguacgacagaaaguggggcaucugccugaagcccgagaacggcugcgaggacaacugggagaagaacgagcaguucggcagcugcuaccaguucaacacccagaccgcccugagcuggaaggaggccuacgugagcugccagaaccagggcgccgaccugcugagcaucaacagcgccgccgagcugaccuaccugaaggagaaggagggcaucgccaagaucuucuggaucggccugaaccagcuguacagcgccagaggcugggaguggagcgaccacaagccccugaacuuccugaacugggaccccgacagacccagcgcccccaccaucggcggcagcagcugcgccagaauggacgccgagagcggccuguggcagagcuucagcugcgaggcccagcugcccuacgugugcagaaagccccugaacaacaccguggagcugaccgacguguggaccuacagcgacaccagaugcgacgccggcuggcugcccaacaacggcuucugcuaccugcuggugaacgagagcaacagcugggacaaggcccacgccaagugcaaggccuucagcagcgaccugaucagcauccacagccuggccgacguggaggugguggugaccaagcugcacaacgaggacaucaaggaggagguguggaucggccugaagaacaucaacauccccacccuguuccaguggagcgacggcaccgaggugacccugaccuacugggacgagaacgagcccaacgugcccuacaacaagacccccaacugcgugagcuaccugggcgagcugggccaguggaaggugcagagcugcgaggagaagcugaaguacgugugcaagagaaagggcgagaagcugaacgacgccagcagcgacaagaugugcccccccgacgagggcuggaagagacacggcgagaccugcuacaagaucuacgaggacgaggugcccuucggcaccaacugcaaccugaccaucaccagcagauucgagcaggaguaccugaacgaccugaugaagaaguacgacaagagccugagaaaguacuucuggaccggccugagagacguggacagcugcggcgaguacaacugggccaccgugggcggcagaagaagagccgugaccuucagcaacuggaacuuccuggagcccgccagccccggcggcugcguggccaugagcaccggcaagagcgugggcaagugggaggugaaggacugcagaagcuucaaggcccugagcaucugcaagaagaugagcggcccccugggccccgaggaggccagccccaagcccgacgaccccugccccgagggcuggcagagcuuccccgccagccugagcugcuacaagguguuccacgccgagagaaucgugagaaagagaaacugggaggaggccgagagauucugccaggcccugggcgcccaccugagcagcuucagccacguggacgagaucaaggaguuccugcacuuccugaccgaccaguucagcggccagcacuggcuguggaucggccugaacaagagaagccccgaccugcagggcagcuggcaguggagcgacagaacccccgugagcaccaucaucaugcccaacgaguuccagcaggacuacgacaucagagacugcgccgccgugaagguguuccacagacccuggagaagaggcuggcacuucuacgacgacagagaguucaucuaccugagacccuucgccugcgacaccaagcuggagugggugugccagauccccaagggcagaacccccaagacccccgacugguacaaccccgacagagccggcauccacggccccccccugaucaucgagggcagcgaguacugguucguggccgaccugcaccugaacuacgaggaggccgugcuguacugcgccagcaaccacagcuuccuggccaccaucaccagcuucgugggccugaaggccaucaagaacaagaucgccaacaucagcggcgacggccagaagugguggaucagaaucagcgaguggcccaucgacgaccacuucaccuacagcagauaccccuggcacagauuccccgugaccuucggcgaggagugccuguacaugagcgccaagaccuggcugaucgaccugggcaagcccaccgacugcagcaccaagcugcccuucaucugcgagaaguacaacgugagcagccuggagaaguacagccccgacagcgccgccaaggugcagugcagcgagcaguggauccccuuccagaacaagugcuuccugaagaucaagcccgugagccugaccuucagccaggccagcgacaccugccacagcuacggcggcacccugcccagcgugcugagccagaucgagcaggacuucaucaccagccugcugcccgacauggaggccacccuguggaucggccugagauggaccgccuacgagaagaucaacaaguggaccgacaacagagagcugaccuacagcaacuuccacccccugcuggugagcggcagacugagaauccccgagaacuucuucgaggaggagagcagauaccacugcgcccugauccugaaccugcagaagagccccuucaccggcaccuggaacuucaccagcugcagcgagagacacuucgugagccugugccagaaguacagcgaggugaagagcagacagacccugcagaacgccagcgagaccgugaaguaccugaacaaccuguacaagaucauccccaagacccugaccuggcacagcgccaagagagagugccugaagagcaacaugcagcuggugagcaucaccgaccccuaccagcaggccuuccugagcgugcaggcccugcugcacaacagcagccuguggaucggccuguucagccaggacgacgagcugaacuucggcuggagcgacggcaagagacugcacuucagcagaugggccgagaccaacggccagcuggaggacugcguggugcuggacaccgacggcuucuggaagaccguggacugcaacgacaaccagcccggcgccaucugcuacuacagcggcaacgagaccgagaaggaggugaagcccguggacagcgugaagugccccagccccgugcugaacacccccuggauccccuuccagaacugcugcuacaacuucaucaucaccaagaacagacacauggccaccacccaggacgaggugcacaccaagugccagaagcugaaccccaagagccacauccugagcaucagagacgagaaggagaacaacuucgugcuggagcagcugcuguacuucaacuacauggccagcugggugaugcugggcaucaccuacagaaacaagagccugaugugguucgacaagaccccccugagcuacacccacuggagagccggcagacccaccaucaagaacgagaaguuccuggccggccugagcaccgacggcuucugggacauccagaccuucaaggugaucgaggaggccguguacuuccaccagcacagcauccuggccugcaagaucgagaugguggacuacaaggaggaguacaacaccacccugccccaguucaugcccuacgaggacggcaucuacagcgugauccagaagaaggugaccugguacgaggcccugaacaugugcagccagagcggcggccaccuggccagcgugcacaaccagaacggccagcuguuccuggaggacaucgugaagagagacggcuucccccugugggugggccugagcagccacgacggcagcgagagcagcuucgaguggagcgacggcagcaccuucgacuacauccccuggaagggccagaccagccccggcaacugcgugcugcuggaccccaagggcaccuggaagcacgagaagugcaacagcgugaaggacggcgccaucugcuacaagcccaccaagagcaagaagcugagcagacugaccuacagcagcagaugccccgccgccaaggagaacggcagcagauggauccaguacaagggccacugcuacaagagcgaccaggcccugcacagcuucagcgaggccaagaagcugugcagcaagcacgaccacagcgccaccaucgugagcaucaaggacgaggacgagaacaaguucgugagcagacugaugagagagaacaacaacaucaccaugagaguguggcugggccugagccagcacagcguggaccagagcuggagcuggcuggacggcagcgaggugaccuucgugaagugggagaacaagagcaagagcggcgugggcagaugcagcaugcugaucgccagcaacgagaccuggaagaagguggagugcgagcacggcuucggcagaguggugugcaaggugccccugggccccgacuacaccgccaucgccaucaucguggccacccugagcauccuggugcugaugggcggccugaucugguuccuguuccagagacacagacugcaccuggccggcuucagcagcgugagauacgcccagggcgugaacgaggacgagaucaugcugcccagcuuccacgacuaa

SEQ ID NO: 19482 - RNA, 489 nt, Artificial Sequence
  LY86__Homo_sapiens__NP_004262
augaagggcuucaccgccacccuguuccuguggacccugaucuuccccagcugcagcggcggcggcggcggcaaggccuggcccacccacguggugugcagcgacagcggccuggaggugcuguaccagagcugcgacccccugcaggacuucggcuucagcguggagaagugcagcaagcagcugaagagcaacaucaacaucagauucggcaucauccugagagaggacaucaaggagcuguuccuggaccuggcccugaugagccagggcagcagcgugcugaacuucagcuaccccaucugcgaggccgcccugcccaaguucagcuucugcggcagaagaaagggcgagcagaucuacuacgccggccccgugaacaaccccgaguucaccaucccccagggcgaguaccaggugcugcuggagcuguacaccgagaagagaagcaccguggccugcgccaacgccaccaucaugugcagcuaa

SEQ ID NO: 19483 - RNA, 393 nt, Artificial Sequence
  LY96__Homo_sapiens__NP_001182726
augcugcccuuccuguucuucagcacccuguucagcagcaucuucaccgaggcccagaagcaguacugggugugcaacagcagcgacgccagcaucagcuacaccuacugcggcagagaccugaagcagcuguacuucaaccuguacaucaccgugaacaccaugaaccugcccaagagaaaggaggugaucugcagaggcagcgacgacgacuacagcuucugcagagcccugaagggcgagaccgugaacaccaccaucagcuucagcuucaagggcaucaaguucagcaagggcaaguacaagugcgugguggaggccaucagcggcagccccgaggagaugcuguucugccuggaguucgugauccugcaccagcccaacagcaacuaa

SEQ ID NO: 19484 - RNA, 582 nt, Artificial Sequence
  LY9__Homo_sapiens__NP_001028839
augguggcccccaagagccacaccgacgacugggcccccggccccuucagcagcaagccccagagaagccagcugcagaucuucagcagcgugcugcagaccagccugcuguuccugcugaugggccugagagccagcggcaaggacagcgcccccaccguggugagcggcauccugggcggcagcgugacccugccccugaacaucagcguggacaccgagaucgagaacgugaucuggaucggccccaagaacgcccuggccuucgccagacccaaggagaacgugaccaucauggugaagagcuaccugggcagacuggacaucaccaaguggagcuacagccugugcaucagcaaccugacccugaacgacgccggcagcuacaaggcccagaucaaccagagaaacuucgaggugaccaccgaggaggaguucacccuguucguguacgcccccuucaucgagaagcugagcgugcacgugaucgagggcgaccacagaacccugcuggagggcagcggccuggagagcaucaucagcacccuggccgagcccagagugagcgugagagagggcuaa

SEQ ID NO: 19485 - RNA, 1056 nt, Artificial Sequence
  LYL1__Homo_sapiens__XP_006722815
augaccggccuggacugggccgugggcagcguguucggcggccugggcagcgccuucgaggugaucgugagcguggugggcagccagggcugcuacggcggcugccugcagugggaguggggcagccugaagcagcuguggagcaccuucagagacagcaacggcaagaacagaagagugauccuggaggugagcacccccaccagcggcagcaugugccccccccaggcccaggccgaggugggccccaccaugaccgagaaggccgagauggugugcgcccccagccccgcccccgcccccccccccaagcccgccagccccggccccccccagguggaggaggugggccacagaggcggcagcagcccccccagacugccccccggcgugcccgugaucagccugggccacagcagaccccccggcguggccaugcccaccaccgagcugggcacccugagacccccccugcugcagcugagcacccugggcaccgccccccccacccuggcccugcacuaccacccccaccccuuccugaacagcguguacaucggccccgccggccccuucagcaucuuccccagcagcagacugaagagaagacccagccacugcgagcuggaccuggccgagggccaccagccccagaagguggccagaagaguguucaccaacagcagagagagauggagacagcagaacgugaacggcgccuucgccgagcugagaaagcugcugcccacccacccccccgacagaaagcugagcaagaacgaggugcugagacuggccaugaaguacaucggcuuccuggugagacugcugagagaccaggccgccgcccuggccgccggccccaccccccccggccccagaaagagacccgugcacagagugcccgacgacggcgccagaagaggcagcggcagaagagccgaggccgccgccagaagccagcccgccccccccgccgaccccgacggcagccccggcggcgccgccagacccaucaagauggagcagaccgcccugagccccgaggugagauaa

SEQ ID NO: 19486 - RNA, 1476 nt, Artificial Sequence
  LYN__Homo_sapiens__NP_001104567
augggcugcaucaagagcaagggcaaggacagccugagcgacgacggcguggaccugaagacccagcccgugcccgagagccagcugcugcccggccagagauuccagaccaaggaccccgaggagcagggcgacaucgugguggcccuguaccccuacgacggcauccaccccgacgaccugagcuucaagaagggcgagaagaugaaggugcuggaggagcacggcgagugguggaaggccaagagccugcugaccaagaaggagggcuucauccccagcaacuacguggccaagcugaacacccuggagaccgaggagugguucuucaaggacaucaccagaaaggacgccgagagacagcugcuggcccccggcaacagcgccggcgccuuccugaucagagagagcgagacccugaagggcagcuucagccugagcgugagagacuucgaccccgugcacggcgacgugaucaagcacuacaagaucagaagccuggacaacggcggcuacuacaucagccccagaaucaccuuccccugcaucagcgacaugaucaagcacuaccagaagcaggccgacggccugugcagaagacuggagaaggccugcaucagccccaagccccagaagcccugggacaaggacgccugggagauccccagagagagcaucaagcuggugaagagacugggcgccggccaguucggcgagguguggaugggcuacuacaacaacagcaccaagguggccgugaagacccugaagcccggcaccaugagcgugcaggccuuccuggaggaggccaaccugaugaagacccugcagcacgacaagcuggugagacuguacgccguggugaccagagaggagcccaucuacaucaucaccgaguacauggccaagggcagccugcuggacuuccugaagagcgacgagggcggcaaggugcugcugcccaagcugaucgacuucagcgcccagaucgccgagggcauggccuacaucgagagaaagaacuacauccacagagaccugagagccgccaacgugcuggugagcgagagccugaugugcaagaucgccgacuucggccuggccagagugaucgaggacaacgaguacaccgccagagagggcgccaaguuccccaucaaguggaccgcccccgaggccaucaacuucggcugcuucaccaucaagagcgacguguggagcuucggcauccugcuguacgagaucgugaccuacggcaagauccccuaccccggcagaaccaacgccgacgugaugaccgcccugagccagggcuacagaaugcccagaguggagaacugccccgacgagcuguacgacaucaugaagaugugcuggaaggagaaggccgaggagagacccaccuucgacuaccugcagagcgugcuggacgacuucuacaccgccaccgagggccaguaccagcagcagcccuaa

SEQ ID NO: 19487 - RNA, 294 nt, Artificial Sequence
  LYNX1__Homo_sapiens__NP_803253
augcagcugggcaccggccugcugcuggccgccgugcugagccugcagcuggccgccgccgaggccaucuggugccaccagugcaccggcuucggcggcugcagccacggcagcagaugccugagagacagcacccacugcgugaccaccgccaccagagugcugagcaacaccgaggaccugccccuggugaccaagaugugccacaucggcugccccgacauccccagccugggccugggccccuacgugagcaucgccugcugccagaccagccugugcaaccacgacuaa

SEQ ID NO: 19488 - RNA, 426 nt, Artificial Sequence
  LYPD1__Homo_sapiens__NP_653187
augugggugcugggcaucgccgccaccuucugcggccuguuccugcugcccggcuucgcccugcagauccagugcuaccagugcgaggaguuccagcugaacaacgacugcagcagccccgaguucaucgugaacugcaccgugaacgugcaggacaugugccagaaggaggugauggagcagagcgccggcaucauguacagaaagagcugcgccagcagcgccgccugccugaucgccagcgccggcuaccagagcuucugcagccccggcaagcugaacagcgugugcaucagcugcugcaacaccccccugugcaacggccccagacccaagaagagaggcagcagcgccagcgcccugagacccggccugagaaccaccauccuguuccugaagcuggcccuguucagcgcccacugcuaa

SEQ ID NO: 19489 - RNA, 378 nt, Artificial Sequence
  LYPD2__Homo_sapiens__NP_991108
augagaggcaccagacuggcccugcuggcccuggugcuggccgccugcggcgagcuggcccccgcccugagaugcuacgugugccccgagcccaccggcgugagcgacugcgugaccaucgccaccugcaccaccaacgagaccaugugcaagaccacccuguacagcagagagaucguguaccccuuccagggcgacagcaccgugaccaagagcugcgccagcaagugcaagcccagcgacguggacggcaucggccagacccugcccgugagcugcugcaacaccgagcugugcaacguggacggcgcccccgcccugaacagccugcacugcggcgcccugacccugcugccccugcugagccugagacuguaa

SEQ ID NO: 19490 - RNA, 1041 nt, Artificial Sequence
  LYPD3__Homo_sapiens__NP_055215
auggaccccgccagaaaggccggcgcccaggccaugaucuggaccgccggcuggcugcugcugcugcugcugagaggcggcgcccaggcccuggagugcuacagcugcgugcagaaggccgacgacggcugcagccccaacaagaugaagaccgugaagugcgcccccggcguggacgugugcaccgaggccgugggcgccguggagaccauccacggccaguucagccuggccgugagaggcugcggcagcggccugcccggcaagaacgacagaggccuggaccugcacggccugcuggccuucauccagcugcagcagugcgcccaggacagaugcaacgccaagcugaaccugaccagcagagcccuggaccccgccggcaacgagagcgccuacccccccaacggcguggagugcuacagcugcgugggccugagcagagaggccugccagggcaccagcccccccguggugagcugcuacaacgccagcgaccacguguacaagggcugcuucgacggcaacgugacccugaccgccgccaacgugaccgugagccugcccgugagaggcugcgugcaggacgaguucugcaccagagacggcgugaccggccccggcuucacccugagcggcagcugcugccagggcagcagaugcaacagcgaccugagaaacaagaccuacuucagccccagaauccccccccuggugagacugcccccccccgagcccaccaccguggccagcaccaccagcgugaccaccagcaccagcgcccccgugagacccaccagcaccaccaagcccaugcccgcccccaccagccagacccccagacagggcguggagcacgaggccagcagagacgaggagcccagacugaccggcggcgccgccggccaccaggacagaagcaacagcggccaguaccccgccaagggcggcccccagcagccccacaacaagggcugcguggcccccaccgccggccuggccgcccugcugcuggccguggccgccggcgugcugcuguaa

SEQ ID NO: 19491 - RNA, 636 nt, Artificial Sequence
  LYPD4__Homo_sapiens__NP_001278348
augggcccccagcaccugagacuggugcagcuguucugccugcugggcgccaucagcacccugcccagaaugagcugcggcgccggcugcuacaagacccagaagggcaccgccagaggcguggugggcuucaagggcugcagcagcagcagcagcuaccccgcccagaucagcuaccuggugagcccccccggcgugagcaucgccagcuacagcagagugugcagaagcuaccugugcaacaaccugaccaaccuggagcccuucgugaagcugaaggccagcacccccaagagcaucaccagcgccagcugcagcugccccaccugcgugggcgagcacaugaaggacugccugcccaacuucgugaccaccaacagcugcccccuggccgccagcaccugcuacagcagcacccugaaguuccaggccggcuuccugaacaccaccuuccugcugaugggcugcgccagagagcacaaccagcugcuggccgacuuccaccacaucggcagcaucaaggugaccgaggugcugaacauccuggagaagagccagaucgugggcgccgccagcagcagacaggaccccgccuggggcguggugcugggccugcuguucgccuucagagacuaa

SEQ ID NO: 19492 - RNA, 756 nt, Artificial Sequence
  LYPD5__Homo_sapiens__NP_001026919
auggccaugggcgugcccagagugauccugcugugccuguucggcgccgcccugugccugaccggcagccaggcccugcagugcuacagcuucgagcacaccuacuucggccccuucgaccugagagccaugaagcugcccagcaucagcugcccccacgagugcuucgaggccauccugagccuggacaccggcuacagagcccccgugacccuggugagaaagggcugcuggaccggcccccccgccggccagacccagagcaacgccgacgcccugccccccgacuacagcguggugagaggcugcaccaccgacaagugcaacgcccaccugaugacccacgacgcccugcccaaccugagccaggcccccgacccccccacccugagcggcgccgagugcuacgccugcaucggcgugcaccaggacgacugcgccaucggcagaagcagaagagugcagugccaccaggaccagaccgccugcuuccagggcaacggcagaaugaccgugggcaacuucagcgugcccguguacaucagaaccugccacagacccagcugcaccaccgagggcaccaccagccccuggaccgccaucgaccugcagggcagcugcugcgagggcuaccugugcaacagaaagagcaugacccagcccuucaccagcgccagcgccaccaccccccccagagcccugcaggugcuggcccugcugcugcccgugcugcugcuggugggccugagcgccuaa

SEQ ID NO: 19493 - RNA, 516 nt, Artificial Sequence
  LYPD6__Homo_sapiens__NP_001182614
auggagcccggccccgcccuggccuggcugcugcugcugagccugcuggccgacugccugaaggccgcccagagcagagacuucaccgugaaggacaucaucuaccugcaccccagcaccacccccuaccccggcggcuucaagugcuucaccugcgagaaggccgccgacaacuacgagugcaacagaugggcccccgacaucuacugccccagagagaccagauacugcuacacccagcacaccauggaggugaccggcaacagcaucagcgugaccaagagaugcgugccccuggaggagugccugagcaccggcugcagagacagcgagcacgagggccacaaggugugcaccagcugcugcgagggcaacaucugcaaccugccccugcccagaaacgagaccgacgccaccuucgccaccaccagccccaucaaccagaccaacggccaccccagaugcaugagcgugaucgugagcugccuguggcuguggcugggccugaugcuguaa

SEQ ID NO: 19494 - RNA, 714 nt, Artificial Sequence
  LYPD8__Homo_sapiens__NP_001078943
augaagggcauccugguggccggcaucaccgccgugcugguggccgccguggagagccugagcugcgugcagugcaacagcugggagaagagcugcgugaacagcaucgccagcgagugccccagccacgccaacaccagcugcaucagcagcagcgccagcagcagccuggagacccccgugagacuguaccagaacauguucugcagcgccgagaacugcagcgaggagacccacaucaccgccuucaccgugcacgugagcgccgaggagcacuuccacuucgugagccagugcugccagggcaaggagugcagcaacaccagcgacgcccuggaccccccccugaagaacgugagcagcaacgccgagugccccgccugcuacgagagcaacggcaccagcugcagaggcaagcccuggaagugcuacgaggaggagcagugcguguuccugguggccgagcugaagaacgacaucgagagcaagagccuggugcugaagggcugcagcaacgugagcaacgccaccugccaguuccugagcggcgagaacaagacccugggcggcgugaucuucagaaaguucgagugcgccaacgugaacagccugacccccaccagcgcccccaccaccagccacaacgugggcagcaaggccagccuguaccugcuggcccuggccagccugcugcugagaggccugcugcccuaa

SEQ ID NO: 19495 - RNA, 645 nt, Artificial Sequence
  LYPLA1__Homo_sapiens__NP_001266286
augugcggcaacaacaugagcaccccccugcccgccaucgugcccgccgccagaaaggccaccgccgccgugaucuuccugcacggccugggcgacaccggccacggcugggccgaggccuucgccggcaucagaagcagccacaucaaguacaucugcccccacgccuucgacaucaucggccugagccccgacagccaggaggacgagagcggcaucaagcaggccgccgagaacaucaaggcccugaucgaccaggaggugaagaacggcauccccagcaacagaaucauccugggcggcuucagccagggcggcgcccugagccuguacaccgcccugaccacccagcagaagcuggccggcgugaccgcccugagcugcuggcugccccugagagccagcuucccccagggccccaucggcggcgccaacagagacaucagcauccugcagugccacggcgacugcgacccccuggugccccugauguucggcagccugaccguggagaagcugaagacccuggugaaccccgccaacgugaccuucaagaccuacgagggcaugaugcacagcagcugccagcaggagaugauggacgugaagcaguucaucgacaagcugcugccccccaucgacuaa

SEQ ID NO: 19496 - RNA, 666 nt, Artificial Sequence
  LYPLAL1__Homo_sapiens__NP_001287699
auggccgccgccagcggcagcgugcugcagagaugcaucgugagccccgccggcagacacagcgccagccugaucuuccugcacggcagcggcgacagcggccagggccugagaauguggaucaagcaggugcugaaccaggaccugaccuuccagcacaucaagaucaucuaccccaccgccccccccagauucaagaucaccaacgacugccccgagcaccuggagagcaucgacgugaugugccaggugcugaccgaccugaucgacgaggaggugaagagcggcaucaagaagaacagaauccugaucggcggcuucagcaugggcggcugcauggccauccaccuggccuacagaaaccaccaggacguggccggcguguucgcccugagcagcuuccugaacaaggccagcgccguguaccaggcccugcagaagagcaacggcgugcugcccgagcuguuccagugccacggcaccgccgacgagcuggugcugcacagcugggccgaggagaccaacagcaugcugaagagccugggcgugaccaccaaguuccacagcuuccccaacguguaccacgagcugagcaagaccgagcuggacauccugaagcuguggauccugaccaagcugcccggcgagauggagaagcagaaguaa

SEQ ID NO: 19497 - RNA, 369 nt, Artificial Sequence
  LYRM1__Homo_sapiens__NP_001289765
augaccaccgccaccagacaggaggugcugggccuguacagaagcaucuucagacuggccagaaaguggcaggccaccagcggccagauggaggacaccaucaaggagaagcaguacauccugaacgaggccagaacccuguucagaaagaacaagaaccugaccgacaccgaccugaucaagcagugcaucgacgagugcaccgccagaaucgagaucggccugcacuacaagauccccuaccccagacccauccaccugccccccaugggccugaccccccugagaggcagaggccugagaagccaggagaagcugagaaagcugagcaagcccguguaccugagaagccacgacgaggugagcuaa

SEQ ID NO: 19498 - RNA, 393 nt, Artificial Sequence
  LYRM4__Homo_sapiens__NP_001158312
auggccgccagcagcagagcccaggugcugagccuguacagagccaugcugagagagagcaagagauucagcgccuacaacuacagaaccuacgccgugagaagaaucagagacgccuucagagagaacaagaacgugaaggaccccguggagauccagacccuggugaacaaggccaagagagaccugggcgugaucagaagacagauggacagccacagcguggcccaggccggcgugcacuggaacgaccugagcagccugcagccccugccccccugguucaagcaguucagcugccugagccugcccagcagcugggacuacagaagaaccccccccagacuggccaacuucugcauccugagcagagacgugaucagccuguacuaa

SEQ ID NO: 19499 - RNA, 315 nt, Artificial Sequence
  LYRM7__Homo_sapiens__NP_859056
augggcagagccgugaaggugcugcagcuguucaagacccugcacagaaccagacagcagguguucaagaacgacgccagagcccuggaggccgccagaaucaagaucaacgaggaguucaagaacaacaagagcgagaccagcagcaagaagaucgaggagcugaugaagaucggcagcgacguggagcugcugcugagaaccagcgugauccagggcauccacaccgaccacaacacccugaagcuggugcccagaaaggaccugcugguggagaacgugcccuacugcgacgcccccacccagaagcaguaa

SEQ ID NO: 19500 - RNA, 237 nt, Artificial Sequence
  LYRM9__Homo_sapiens__NP_001070148
auggccccccugcccggcgccgagcuggugagaagaccccugcagcuguacagauaccugcugagaugcugccagcagcugcccaccaagggcauccagcagcacuacaagcacgccgugagacagagcuucagagugcacagcgacgaggacaaccccgagagaauccagcagaucaucaagagagccaucgaggacgccgacuggaucaugaacaaguacaagaagcagaacuaa

SEQ ID NO: 19501 - RNA, 11406 nt, Artificial Sequence
  LYST__Homo_sapiens__NP_001288294
augagcaccgacagcaacagccuggccagagaguuccugaccgacgugaacagacugugcaacgccguggugcagagaguggaggccagagaggaggaggaggaggagacccacauggccacccugggccaguaccuggugcacggcagaggcuuccugcugcugaccaagcugaacagcaucaucgaccaggcccugaccugcagagaggagcugcugacccugcugcugagccugcugccccugguguggaagauccccgugcaggaggagaaggccaccgacuucaaccugccccugagcgccgacaucauccugaccaaggagaagaacagcagcagccagagaagcacccaggagaagcugcaccuggagggcagcgcccugagcagccaggugagcgccaaggugaacguguucagaaagagcagaagacagagaaagaucacccacagauacagcgugagagacgccagaaagacccagcugagcaccagcgacagcgaggccaacagcgacgagaagggcaucgccaugaacaagcacagaagaccccaccugcugcaccacuuccugaccagcuuccccaagcaggaccaccccaaggccaagcuggacagacuggccaccaaggagcagaccccccccgacgccauggcccuggagaacagcagagagaucauccccagacagggcagcaacaccgacauccugagcgagcccgccgcccugagcgugaucagcaacaugaacaacagccccuucgaccugugccacgugcugcugagccugcuggagaaggugugcaaguucgacgugacccugaaccacaacagcccccuggccgccagcguggugcccacccugaccgaguuccuggccggcuucggcgacugcugcagccugagcgacaaccuggagagcagaguggugagcgccggcuggaccgaggagcccguggcccugauccagagaaugcuguucagaaccgugcugcaccugcugagcguggacgugagcaccgccgagaugaugcccgagaaccugagaaagaaccugaccgagcugcugagagccgcccugaagaucagaaucugccuggagaagcagcccgaccccuucgcccccagacagaagaagacccugcaggaggugcaggaggacuucguguucagcaaguacagacacagagcccugcugcugcccgagcugcuggagggcgugcugcagauccugaucugcugccugcagagcgccgccagcaaccccuucuacuucagccaggccauggaccuggugcaggaguucauccagcaccacggcuucaaccuguucgagaccgccgugcugcagauggaguggcuggugcugagagacggcgugccccccgaggccagcgagcaccugaaggcccugaucaacagcgugaugaagaucaugagcaccgugaagaaggugaagagcgagcagcugcaccacagcaugugcaccagaaagagacacagaagaugcgaguacagccacuucaugcaccaccacagagaccugagcggccugcuggugagcgccuucaagaaccaggugagcaagaaccccuucgaggagaccgccgacggcgacguguacuaccccgagagaugcugcugcaucgccgugugcgcccaccagugccugagacugcugcagcaggccagccugagcagcaccugcgugcagauccugagcggcgugcacaacaucggcaucugcugcugcauggaccccaagagcgugaucaucccccugcugcacgccuucaagcugcccgcccugaagaacuuccagcagcacauccugaacauccugaacaagcugauccuggaccagcugggcggcgccgagaucagccccaagaucaagaaggccgccugcaacaucugcaccguggacagcgaccagcuggcccagcuggaggagacccugcagggcaaccugugcgacgccgagcugagcagcagccugagcagccccagcuacagauuccagggcauccugcccagcagcggcagcgaggaccugcuguggaagugggacgcccugaaggccuaccagaacuucguguucgaggaggacagacugcacagcauccagaucgccaaccacaucugcaaccugauccagaagggcaacaucguggugcaguggaagcuguacaacuacaucuucaaccccgugcugcagagaggcguggagcuggcccaccacugccagcaccugagcgugaccagcgcccagagccacgugugcagccaccacaaccagugccugccccaggacgugcugcagaucuacgugaagacccugcccauccugcugaagagcagagugaucagagaccuguuccugagcugcaacggcgugagccagaucaucgagcugaacugccugaacggcaucagaagccacagccugaaggccuucgagacccugaucaucagccugggcgagcagcagaaggacgccagcgugcccgacaucgacggcaucgacaucgagcagaaggagcugagcagcgugcacgugggcaccagcuuccaccaccagcaggccuacagcgacagcccccagagccugagcaaguucuacgccggccugaaggaggccuaccccaagagaagaaagaccgugaaccaggacgugcacaucaacaccaucaaccuguuccugugcguggccuuccugugcgugagcaaggaggccgagagcgacagagagagcgccaacgacagcgaggacaccagcggcuacgacagcaccgccagcgagccccugagccacaugcugcccugcaucagccuggagagccuggugcugcccagccccgagcacaugcaccaggccgccgacaucuggagcaugugcagauggaucuacaugcugagcagcguguuccagaagcaguucuacagacugggcggcuucagagugugccacaagcugaucuucaugaucauccagaagcuguucagaagccacaaggaggagcagggcaagaaggagggcgacaccagcgugaacgagaaccaggaccugaacagaaucagccagcccaagagaaccaugaaggaggaccugcugagccuggccaucaagagcgaccccauccccagcgagcugggcagccugaagaagagcgccgacagccugggcaagcuggagcugcagcacaucagcagcaucaacguggaggaggugagcgccaccgaggccgcccccgaggaggccaagcuguucaccagccaggagagcgagaccagccugcagagcaucagacugcuggaggcccugcuggccaucugccugcacggcgccagaaccagccagcagaagauggagcuggagcugcccaaccagaaccugagcguggagagcauccuguucgagaugagagaccaccugagccagagcaaggugaucgagacccagcuggccaagccccuguucgacgcccugcugagaguggcccugggcaacuacagcgccgacuucgagcacaacgacgccaugaccgagaagagccaccagagcgccgaggagcugagcagccagcccggcgacuucagcgaggaggccgaggacagccagugcugcagcuucaagcugcugguggaggaggagggcuacgaggccgacagcgagagcaaccccgaggacggcgagacccaggacgacggcguggaccugaagagcgagaccgagggcuucagcgccagcagcagccccaacgaccugcuggagaaccugacccagggcgagaucaucuaccccgagaucugcaugcuggagcugaaccugcugagcgccagcaaggccaagcuggacgugcuggcccacguguucgagagcuuccugaagaucaucagacagaaggagaagaacguguuccugcugaugcagcagggcaccgugaagaaccugcugggcggcuuccugagcauccugacccaggacgacagcgacuuccaggccugccagagagugcugguggaccugcuggugagccugaugagcagcagaaccugcagcgaggagcugacccugcugcugagaaucuuccuggagaagagccccugcaccaagauccugcugcugggcauccugaagaucaucgagagcgacaccaccaugagccccagccaguaccugaccuucccccugcugcacgcccccaaccugagcaacggcgugagcagccagaaguaccccggcauccugaacagcaaggccaugggccugcugagaagagccagagugagcagaagcaagaaggaggccgacagagagagcuucccccacagacugcugagcagcuggcacaucgcccccgugcaccugccccugcugggccagaacugcuggccccaccugagcgagggcuucagcgugagccugugguucaacguggagugcauccacgaggccgagagcaccaccgagaagggcaagaagaucaagaagagaaacaagagccugauccugcccgacagcagcuucgacggcaccgagagcgacagacccgagggcgccgaguacaucaaccccggcgagagacugaucgaggagggcugcauccacaucaucagccugggcagcaaggcccugaugauccaggugugggccgacccccacaacgccacccugaucuucagagugugcauggacagcaacgacgacaugaaggccgugcugcuggcccagguggagagccaggagaacaucuuccugcccagcaaguggcagcaccuggugcugaccuaccugcagcagccccagggcaagagaagaauccacggcaagaucagcaucugggugagcggccagagaaagcccgacgugacccuggacuucaugcugcccagaaagaccagccugagcagcgacagcaacaagaccuucugcaugaucggccacugccugagcagccaggaggaguuccugcagcuggccggcaagugggaccugggcaaccugcugcuguucaacggcgccaaggugggcagccaggaggccuucuaccuguacgccugcggccccaaccacaccagcgugaugcccugcaaguacggcaagcccgugaacgacuacagcaaguacaucaacaaggagauccugagaugcgagcagaucagagagcuguucaugaccaagaaggacguggacaucggccugcugaucgagagccugagcgugguguacaccaccuacugccccgcccaguacaccaucuacgagcccgugaucagacugaagggccagaugaagacccagcugagccagagacccuucagcagcaaggaggugcagagcauccugcuggagccccaccaccugaagaaccugcagcccaccgaguacaagaccauccagggcauccugcacgagaucggcggcaccggcaucuucguguuccuguucgccagagugguggagcugagcagcugcgaggagacccaggcccuggcccugagagugauccugagccugaucaaguacaaccagcagagagugcacgagcuggagaacugcaacggccugagcaugauccaccaggugcugaucaagcagaagugcaucgugggcuucuacauccugaagacccugcuggagggcugcugcggcgaggacaucaucuacaugaacgagaacggcgaguucaagcuggacguggacagcaacgccaucauccaggacgugaagcugcuggaggagcugcugcuggacuggaagaucuggagcaaggccgagcagggcgugugggagacccugcuggccgcccuggaggugcugaucagagccgaccaccaccagcagauguucaacaucaagcagcugcugaaggcccagguggugcaccacuuccugcugaccugccaggugcugcaggaguacaaggagggccagcugacccccaugcccagagaggugugcagaagcuucgugaagaucaucgccgaggugcugggcagcccccccgaccuggagcugcugaccaucaucuucaacuuccugcuggccgugcacccccccaccaacaccuacgugugccacaaccccaccaacuucuacuucagccugcacaucgacggcaagaucuuccaggagaaggugagaagcaucauguaccugagacacagcagcagcggcggcagaagccugaugagccccggcuucauggugaucagccccagcggcuucaccgccagccccuacgagggcgagaacagcagcaacaucaucccccagcagauggccgcccacaugcugagaagcagaagccugcccgccuuccccaccagcagccugcugacccagagccagaagcugaccggcagccugggcugcagcaucgacagacugcagaacaucgccgacaccuacguggccacccagagcaagaagcagaacagccugggcagcagcgacacccugaagaagggcaaggaggacgccuucaucagcagcugcgagagcgccaagaccgugugcgagauggaggccgugcugagcgcccaggugagcgugagcgacgugcccaagggcgugcugggcuuccccguggugaaggccgaccacaagcagcugggcgccgagcccagaagcgaggacgacagccccggcgacgagagcugccccagaagacccgacuaccugaagggccuggccagcuuccagagaagccacagcaccaucgccagccugggccuggccuuccccagccagaacggcagcgccgccgugggcagauggcccagccugguggacagaaacaccgacgacugggagaacuucgccuacagccugggcuacgagcccaacuacaacagaaccgccagcgcccacagcgugaccgaggacugccuggugcccaucugcugcggccuguacgagcugcugagcggcgugcugcugauccugcccgacgugcugcuggaggacgugauggacaagcugauccaggccgacacccugcuggugcuggugaaccaccccagccccgccauccagcagggcgugaucaagcugcuggacgccuacuucgccagagccagcaaggagcagaaggacaaguuccugaagaacagaggcuucagccugcuggccaaccagcuguaccugcacagaggcacccaggagcugcuggagugcuucaucgagauguucuucggcagacacaucggccuggacgaggaguucgaccuggaggacgugagaaacaugggccuguuccagaaguggagcgugauccccauccugggccugaucgagaccagccuguacgacaacauccugcugcacaacgcccugcugcugcugcugcagauccugaacagcugcagcaagguggccgacaugcugcuggacaacggccugcuguacgugcugugcaacaccguggccgcccugaacggccuggagaagaacauccccaugagcgaguacaagcugcuggccugcgacauccagcagcuguucaucgccgugaccauccacgccugcagcagcagcggcagccaguacuucagagugaucgaggaccugaucgugaugcugggcuaccugcagaacagcaagaacaagagaacccagaacauggccguggcccugcagcugagagugcugcaggccgccauggaguucaucagaaccaccgccaaccacgacagcgagaaccugaccgacagccugcagagccccagcgccccccaccacgccguggugcagaagagaaagagcaucgccggccccagaaaguucccccuggcccagaccgagagccugcugaugaagaugagaagcguggccaacgacgagcugcacgugaugaugcagagaagaaugagccaggagaaccccagccaggccaccgagaccgagcuggcccagagacugcagagacugaccgugcuggccgugaacagaaucaucuaccaggaguucaacagcgacaucaucgacauccugagaacccccgagaacgugacccagagcaagaccagcguguuccagaccgagaucagcgaggagaacauccaccacgagcagagcagcguguucaaccccuuccagaaggagaucuucaccuaccugguggagggcuucaaggugagcaucggcagcagcaaggccagcggcagcaagcagcaguggaccaagauccuguggagcugcaaggagaccuucagaaugcagcugggcagacugcuggugcacauccugagccccgcccacgccgcccaggagagaaagcagaucuucgagaucgugcacgagcccaaccaccaggagauccugagagacugccugagccccagccugcagcacggcgccaagcuggugcuguaccugagcgagcugauccacaaccaccagggcgagcugaccgaggaggagcugggcaccgccgagcugcugaugaacgcccugaagcugugcggccacaagugcaucccccccagcgccagcaccaaggccgaccugaucaagaugaucaaggaggagcagaagaaguacgagaccgaggagggcgugaacaaggccgccuggcagaagaccgugaacaacaaccagcagagccuguuccagagacuggacagcaagagcaaggacaucagcaagaucgccgccgacaucacccaggccgugagccugagccagggcaacgagagaaagaaggugauccagcacaucagaggcauguacaagguggaccugagcgccagcagacacuggcaggagcugauccagcagcugacccacgacagagccgugugguacgaccccaucuacuaccccaccagcuggcagcuggaccccaccgagggccccaacagagagagaagaagacugcagagaugcuaccugaccauccccaacaaguaccugcugagagacagacagaagagcgaggacguggugaagcccccccugagcuaccuguucgaggacaagacccacagcagcuucagcagcaccgugaaggacaaggccgccagcgagagcaucagagugaacagaagaugcaucagcguggcccccagcagagagaccgccggcgagcugcugcugggcaagugcggcauguacuucguggaggacaacgccagcgacaccguggagagcagcagccugcagggcgagcuggagcccgccagcuucagcuggaccuacgaggagaucaaggaggugcacaagagaugguggcagcugagagacaacgccguggagaucuuccugaccaacggcagaacccugcugcuggccuucgacaacaccaaggugagagacgacguguaccacaacauccugaccaacaaccugcccaaccugcuggaguacggcaacaucaccgcccugaccaaccugugguacaccggccagaucaccaacuucgaguaccugacccaccugaacaagcacgccggcagaagcuucaacgaccugaugcaguaccccguguuccccuucauccuggccgacuacgugagcgagacccuggaccugaacgaccugcugaucuacagaaaccugagcaagcccaucgccgugcaguacaaggagaaggaggacagauacguggacaccuacaaguaccuggaggaggaguacagaaagggcgccagagaggacgaccccaugccccccgugcagcccuaccacuacggcagccacuacagcaacagcggcaccgugcugcacuuccuggugagaaugccccccuucaccaagauguuccuggccuaccaggaccagagcuucgacauccccgacagaaccuuccacagcaccaacaccaccuggagacugagcagcuucgagagcaugaccgacgugaaggagcugauccccgaguucuucuaccugcccgaguuccuggugaacagagagggcuucgacuucggcgugagacagaacggcgagagagugaaccacgugaaccugccccccugggccagaaacgaccccagacuguucauccugauccacagacaggcccuggagagcgacuacgugagccagaacaucugccaguggaucgaccugguguucggcuacaagcagaagggcaaggccagcgugcaggccaucaacguguuccaccccgccaccuacuucggcauggacgugagcgccguggaggaccccgugcagagaagagcccuggagaccaugaucaagaccuacggccagacccccagacagcuguuccacauggcccacgugagcagacccggcgccaagcugaacaucgagggcgagcugcccgccgccgugggccugcuggugcaguucgccuucagagagaccagagagcaggugaaggagaucaccuaccccagcccccugagcuggaucaagggccugaaguggggcgaguacgugggcagccccagcgcccccgugcccguggugugcuucagccagccccacggcgagagauucggcagccugcaggcccugcccaccagagccaucugcggccugagcagaaacuucugccugcugaugaccuacagcaaggagcagggcgugagaagcaugaacagcaccgacauccaguggagcgccauccugagcuggggcuacgccgacaacauccugagacugaagagcaagcagagcgagccccccgugaacuucauccagagcagccagcaguaccaggugaccagcugcgccugggugcccgacagcugccagcuguucaccggcagcaagugcggcgugaucaccgccuacaccaacagauucaccagcagcacccccagcgagaucgagauggagacccagauccaccuguacggccacaccgaggagaucaccagccuguucgugugcaagcccuacagcauccugaucagcgugagcagagacggcaccugcaucaucugggaccugaacagacugugcuacgugcagagccuggccggccacaagagccccgugaccgccgugagcgccagcgagaccagcggcgacaucgccaccgugugcgacagcgccggcggcggcagcgaccugagacuguggaccgugaacggcgaccuggugggccacgugcacugcagagagaucaucugcagcguggccuucagcaaccagcccgagggcgugagcaucaacgugaucgccggcggccuggagaacggcaucgugagacuguggagcaccugggaccugaagcccgugagagagaucaccuuccccaagagcaacaagcccaucaucagccugaccuucagcugcgacggccaccaccuguacaccgccaacagcgacggcaccgugaucgccuggugcagaaaggaccagcagagacugaagcagcccauguucuacagcuuccugagcagcuacgccgccggcuaa

SEQ ID NO: 19502 - RNA, 969 nt, Artificial Sequence
  LYVE1__Homo_sapiens__NP_006682
auggccagaugcuucagccuggugcugcugcugaccagcaucuggaccaccagacugcuggugcagggcagccugagagccgaggagcugagcauccaggugagcugcagaaucaugggcaucacccuggugagcaagaaggccaaccagcagcugaacuucaccgaggccaaggaggccugcagacugcugggccugagccuggccggcaaggaccagguggagaccgcccugaaggccagcuucgagaccugcagcuacggcugggugggcgacggcuucguggugaucagcagaaucagccccaaccccaagugcggcaagaacggcgugggcgugcugaucuggaaggugcccgugagcagacaguucgccgccuacugcuacaacagcagcgacaccuggaccaacagcugcauccccgagaucaucaccaccaaggaccccaucuucaacacccagaccgccacccagaccaccgaguucaucgugagcgacagcaccuacagcguggccagccccuacagcaccauccccgcccccaccaccaccccccccgcccccgccagcaccagcauccccagaagaaagaagcugaucugcgugaccgagguguucauggagaccagcaccaugagcaccgagaccgagcccuucguggagaacaaggccgccuucaagaacgaggccgccggcuucggcggcgugcccaccgcccugcuggugcuggcccugcuguucuucggcgccgccgccggccugggcuucugcuacgugaagagauacgugaaggccuuccccuucaccaacaagaaccagcagaaggagaugaucgagaccaagguggugaaggaggagaaggccaacgacagcaaccccaacgaggagagcaagaagaccgacaagaaccccgaggagagcaagagccccagcaagaccaccgugagaugccuggaggccgagguguaa

SEQ ID NO: 19503 - RNA, 447 nt, Artificial Sequence
  LYZ__Homo_sapiens__NP_000230
augaaggcccugaucgugcugggccuggugcugcugagcgugaccgugcagggcaagguguucgagagaugcgagcuggccagaacccugaagagacugggcauggacggcuacagaggcaucagccuggccaacuggaugugccuggccaagugggagagcggcuacaacaccagagccaccaacuacaacgccggcgacagaagcaccgacuacggcaucuuccagaucaacagcagauacuggugcaacgacggcaagacccccggcgccgugaacgccugccaccugagcugcagcgcccugcugcaggacaacaucgccgacgccguggccugcgccaagagaguggugagagacccccagggcaucagagccuggguggccuggagaaacagaugccagaacagagacgugagacaguacgugcagggcugcggcguguaa

SEQ ID NO: 19504 - RNA, 585 nt, Artificial Sequence
  LYZL1__Homo_sapiens__NP_115906
augcaggacgccccccugagcugccugagccccaccaaguggagcagcgugagcagcgccgacagcaccgagaagagcgccagcggcgccggcaccagaaaccugcccuuccaguucugccugagacaggcccugagaaugaaggccgccggcauccugacccugaucggcugccuggugaccggcgccgagagcaagaucuacaccagaugcaagcuggccaagaucuucagcagagccggccuggacaacuacuggggcuucagccugggcaacuggaucugcauggccuacuacgagagcggcuacaacaccaccgcccagaccgugcuggacgacggcagcaucgacuacggcaucuuccagaucaacagcuucgccuggugcagaagaggcaagcugaaggagaacaaccacugccacguggccugcagcgcccugaucaccgacgaccugaccgacgccaucaucugcgccagaaagaucgugaaggagacccagggcaugaacuacuggcagggcuggaagaagcacugcgagggcagagaccugagcgaguggaagaagggcugcgaggugagcuaa

SEQ ID NO: 19505 - RNA, 585 nt, Artificial Sequence
  LYZL2__Homo_sapiens__NP_898881
augcaggacgccccccugagcugccugagccccaccaaguggagcagcgugagcagcgccgacagcaccgagaagagcgccagcgccgccggcaccagaaaccugcccuuccaguucugccugagacaggcccugagaaugaaggccgccggcauccugacccugaucggcugccuggugaccggcgccgagagcaagaucuacaccagaugcaagcuggccaagaucuucagcagagccggccuggacaacuacuggggcuucagccugggcaacuggaucugcauggccuacuacgagagcggcuacaacaccaccgcccagaccgugcuggacgacggcagcaucgacuacggcaucuuccagaucaacagcuucgccuggugcagaagaggcaagcugaaggagaacaaccacugccacguggccugcagcgcccuggugaccgacgaccugaccgacgccaucaucugcgccaagaagaucgugaaggagacccagggcaugaacuacuggcagggcuggaagaagcacugcgagggcagagaccugagcgacuggaagaaggacugcgaggugagcuaa

SEQ ID NO: 19506 - RNA, 447 nt, Artificial Sequence
  LYZL6__Homo_sapiens__NP_001186880
augaccaaggcccugcugaucuaccuggugagcagcuuccuggcccugaaccaggccagccugaucagcagaugcgaccuggcccaggugcugcagcuggaggaccuggacggcuucgagggcuacagccugagcgacuggcugugccuggccuucguggagagcaaguucaacaucagcaagaucaacgagaacgccgacggcagcuucgacuacggccuguuccagaucaacagccacuacuggugcaacgacuacaagagcuacagcgagaaccugugccacguggacugccaggaccugcugaaccccaaccugcuggccggcauccacugcgccaagagaaucgugagcggcgccagaggcaugaacaacuggguggaguggagacugcacugcagcggcagaccccuguucuacuggcugaccggcugcagacugagauaa

SEQ ID NO: 19507 - RNA, 849 nt, Artificial Sequence
  LZTFL1__Homo_sapiens__NP_001263307
augagauucgccagaagcaagagaggccugagacugaagaccguggacagcugcuuccaggaccugaaggagagcagacugguggaggacaccuucaccaucgacgaggugagcgaggugcugaacggccugcaggccguggugcacagcgagguggagagcgagcugaucaacaccgccuacaccaacgugcugcugcugagacagcuguucgcccaggccgagaagugguaccugaagcugcagaccgacaucagcgagcuggagaacagagagcugcuggagcagguggccgaguucgagaaggccgagaucaccagcagcaacaagaagcccauccuggacgugaccaagcccaagcuggccccccugaacgagggcggcaccgccgagcugcugaacaaggagauccugagacugcaggaggagaacgagaagcugaagagcagacugaagaccaucgagauccaggccaccaacgcccuggacgagaagagcaagcuggagaaggcccugcaggaccugcagcuggaccagggcaaccagaaggacuucaucaaggcccaggaccugagcaaccuggagaacaccguggccgcccugaagagcgaguuccagaagacccugaacgacaagaccgagaaccagaagagccuggaggagaaccuggccaccgccaagcacgaccugcugagagugcaggagcagcugcacauggccgagaaggagcuggagaagaaguuccagcagaccgccgccuacagaaacaugaaggagauccugaccaagaagaacgaccagaucaaggaccugagaaagagacuggcccaguacgagcccgaggacuaa

SEQ ID NO: 19508 - RNA, 2523 nt, Artificial Sequence
  LZTR1__Homo_sapiens__NP_006758
auggccggccccggcagcaccggcggccagaucggcgccgccgcccuggccggcggcgccagaagcaagguggcccccagcguggacuucgaccacagcugcagcgacagcguggaguaccugacccugaacuucggccccuucgagaccgugcacagauggagaagacugccccccugcgacgaguucgugggcgccagaagaagcaagcacaccgugguggccuacaaggacgccaucuacguguucggcggcgacaacggcaagaccaugcugaacgaccugcugagauucgacgugaaggacugcagcuggugcagagccuucaccaccggcaccccccccgcccccagauaccaccacagcgccgugguguacggcagcagcauguucguguucggcggcuacaccggcgacaucuacagcaacagcaaccugaagaacaagaacgaccuguucgaguacaaguucgccaccggccaguggaccgaguggaagaucgagggcagacugcccguggccagaagcgcccacggcgccaccguguacagcgacaagcuguggaucuucgccggcuacgacggcaacgccagacugaacgacauguggaccaucggccugcaggacagagagcugaccugcugggaggagguggcccagagcggcgagaucccccccagcugcugcaacuuccccguggccgugugcagagacaagauguucguguucagcggccagagcggcgccaagaucaccaacaaccuguuccaguucgaguucaaggacaagaccuggaccagaauccccaccgagcaccugcugagaggcagccccccccccccccagagaagauacggccacaccaugguggccuucgacagacaccuguacguguucggcggcgccgccgacaacacccugcccaacgagcugcacugcuacgacguggacuuccagaccugggagguggugcagcccagcagcgacagcgaggugggcggcgccgaggugcccgagagagccugcgccagcgaggaggugcccacccugaccuacgaggagagagugggcuucaagaagagcagagacguguucggccuggacuucggcaccaccagcgccaagcagcccacccagcccgccagcgagcugcccagcggcagacuguuccacgccgccgccgugaucagcgacgccauguacaucuucggcggcaccguggacaacaacaucagaagcggcgagauguacagauuccaguucagcugcuaccccaagugcacccugcacgaggacuacggcagacugugggagagcagacaguucugcgacguggaguucgugcugggcgagaaggaggagugcgugcagggccacguggccaucgugaccgccagaagcagauggcugagaagaaagaucacccaggccagagagagacuggcccagaagcuggagcaggaggccgcccccgugcccagagaggcccccggcguggccgccggcggcgccagacccccccugcugcacguggccaucagagaggccgaggccagacccuucgaggugcugaugcaguuccuguacaccgacaagaucaaguaccccagaaagggccacguggaggacgugcugcugaucauggacguguacaagcuggcccugagcuuccagcugugcagacuggagcagcugugcagacaguacaucgaggccagcguggaccugcagaacgugcugguggugugcgagagcgccgccagacugcagcugagccagcugaaggagcacugccugaacuucguggugaaggagagccacuucaaccaggugaucaugaugaaggaguucgagagacugagcagcccccugaucguggagaucgugagaagaaagcagcagcccccccccagaaccccccuggaccagcccguggacaucggcaccagccugauccaggacaugaaggccuaccuggagggcgccggcgccgaguucugcgacaucacccugcugcuggacggccaccccagacccgcccacaaggccauccuggccgccagaagcagcuacuucgaggccauguucagaagcuucaugcccgaggacggccaggugaacaucagcaucggcgagauggugcccagcagacaggccuucgagagcaugcugagauacaucuacuacggcgaggugaacaugccccccgaggacagccuguaccuguucgccgcccccuacuacuacggcuucuacaacaacagacugcaggccuacugcaagcagaaccuggagaugaacgugaccgugcagaacgugcugcagauccuggaggccgccgacaagacccaggcccuggacaugaagagacacugccugcacaucaucgugcaccaguucaccaaggugagcaagcugcccacccugagaagccugagccagcagcugcugcuggacaucaucgacagccuggccagccacaucagcgacaagcagugcgccgagcugggcgccgacaucuaa

SEQ ID NO: 19509 - RNA, 1791 nt, Artificial Sequence
  LZTS1__Homo_sapiens__XP_011542689
augggcagcgugagcagccugaucagcggccacagcuuccacagcaagcacugcagagccagccaguacaagcugagaaagagcagccaccugaagaagcugaacagauacagcgacggccugcugagauucggcuucagccaggacagcggccacggcaagagcagcagcaagaugggcaagagcgaggacuucuucuacaucaaggugagccagaaggccagaggcagccaccaccccgacuacaccgcccugagcagcggcgaccugggcggccaggccggcguggacuucgaccccagcaccccccccaagcugaugcccuucagcaaccagcuggagaugggcagcgagaagggcgccgugagacccaccgccuucaagcccgugcugcccagaagcggcgccauccugcacagcagccccgagagcgccagccaccagcugcaccccgccccccccgacaagcccaaggagcaggagcugaagcccggccugugcagcggcgcccugagcgacagcggcagaaacagcaugagcagccugcccacccacagcaccagcagcagcuaccagcuggacccccuggugacccccgugggccccaccagcagauucggcggcagcgcccacaacaucacccagggcaucgugcugcaggacagcaacaugaugagccugaaggcccugagcuucagcgacggcggcagcaagcugggccacagcaacaaggccgacaagggccccagcugcgugagaagccccaucagcaccgacgagugcagcauccaggagcuggagcagaagcugcuggagagagagggcgcccugcagaagcugcagagaagcuucgaggagaaggagcuggccagcagccuggccuacgaggagagacccagaagaugcagagacgagcuggagggccccgagcccaagggcggcaacaagcugaagcaggccagccagaagagccagagagcccagcaggugcugcaccugcaggugcugcagcugcagcaggagaagagacagcugagacaggagcuggagagccugaugaaggagcaggaccugcuggagaccaagcugagaagcuacgagagagagaagaccagcuucggccccgcccuggaggagacccagugggaggugugccagaagagcggcgagaucagccugcugaagcagcagcugaaggagagccagaccgaggugaacgccaaggccagcgagauccugggccugaaggcccagcugaaggacaccagaggcaagcuggagggccuggagcugagaacccaggaccuggagggcgcccugagaaccaagggccuggagcuggaggugugcgagaacgagcugcagagaaagaagaacgaggccgagcugcugagagagaaggugaaccugcuggagcaggagcugcaggagcugagagcccaggccgcccuggccagagacaugggcccccccaccuuccccgaggacgugcccgcccugcagagagagcuggagagacugagagccgagcugagagaggagagacagggccacgaccagaugagcagcggcuuccagcacgagagacugguguggaaggaggagaaggagaaggugauccaguaccagaagcagcugcagcagagcuacguggccauguaccagagaaaccagagacuggagaaggcccugcagcagcuggccagaggcgacagcgccggcgagccccuggagguggaccuggagggcgccgacauccccuacgaggacaucaucgccaccgagaucuaa

SEQ ID NO: 19510 - RNA, 576 nt, Artificial Sequence
  M6PR__Homo_sapiens__NP_001193953
auguuccccuucuacagcugcuggagaaccggccugcugcugcugcugcuggccguggccgugagagagagcuggcagaccgaggagaagaccugcgaccuggugggcgagaagggcaaggagagcgagaaggagcuggcccuggugaagagacugaagccccuguucaacaagagcuucgagagcaccgugggccagggcagcgacaccuacaucuacaucuucagagugugcagagaggccggcaaccacaccagcggcgccggccuggugcagaucaacaagagcaacggcaaggagaccguggugggcagacugaacgagacccacaucuucaacggcagcaacuggaucaugcugaucuacaagggcggcgacgaguacgacaaccacugcggcaaggagcagagaagagccguggugaugaucagcugcaacagacacacccuggccgacggcugcgacuucgugugcagaagcaagcccagaaacgugcccgccgccuacagaggcgugggcgacgaccagcugggcgaggagagcgaggagagagacgaccaccugcugcccauguaa

SEQ ID NO: 19511 - RNA, 2304 nt, Artificial Sequence
  MAATS1__Homo_sapiens__NP_203528
augagccacgccgugaccaucgaggagccccaggcccagccccaggugagccagaccagauacagagagagaagcagagccggcagccacaucagcagcaacagagccuacgacuuccuguacgacccccuguucaucgugagcagcgagaaggaccacacccaggccaacauccaggccacccugaucagaagcagacugagaaaggugcccagauucaagaccauguucagcaaccugauccacuaccccagauacagccuguacuggagcaagagcgaccccgugccccccuucaucagcagagaguggaagggccacaaggagaagcacagagaggcccugagacagcugaccaccaccgacgccagcuuccagaugcccaaggagguguacgaggaccccgaggugaccggcaagaacagauacaaguacuucgagagacccuuccugcccuucuuccagcagaugcccuucaacgugguguacgccgugagcaaggccgagcccuacaccuucccccccaccagcaccaagcaccugagcauccccagcaagagcaccgugggcacccagaccgacuacagagacgccgacgugcagaccgaccccuacagccccgaguacguggugugccaggacagcauccccgagcugcugacccuggccacccugaccuggggcagaggccugcccgccggccaggccgagguggagaugaucgagagagccagagagaagagagccugggaggccagccugcccgcccugagcgacaccagccaguucgagaagagaagaaagaugaugaacgagauggagagaaaggagugggccuucagagagcaggagaucgagaagcugcaggagaucagacuggaggugcugaaggagcugcugagaaagagagaggagaaccagaacgaggugaacaugaagcaccugaacgccagauggagcaagcugcaggagggcaaggaggccaagauggccaagauccagagaacccacgugagcaccaucagaaagcuggugggcaagagaaagaacaucgagggcaagcuggagagaagaaacaucaucaaggacuacagcgacuacgccagccagguguacggcccccugagcagacugggcugcuuccccgacaacaacagcgaggacuucguggugaagaacuacuaccugaacaccuacgagggccugguggagcuggagagcugccugcccgacuucgugacccagccccagaucagagcccccaagcccaaggugaucaccaccaaggccggcuuccugaagagagccgccagacuggacuacgagcuggccgaggugcacaaggcccugcuggacaagaagaacaaggugcuggaggugaagaagccccccagauuccugcagagaaaccccaucccccagcccagacugcccacccccacccuggagaugaccagcaacgaggaggaggagauggagauggccgugaucuaccugcagaagcugcugagaggcagaguggugcagaacaugauguucgagggcaaggagaagagacuggagcugauccaggagcugagaaccugccacgcccugcaggaggacgagaagcuggugaagaaggccgagaagcaggugacccuggcccugcagagacagagaaaccugcacgagcacaaggugagccugguggagaaccaccuggccggccuggagggcagagcccuggccgacauguucgacuuccugagcaaggagcuggugagacugcaggaggagagaagaauccacgccuucgugaugcuggccgagagacagagaagagugagagaggccgaggagagcggcagaagacagguggagaagcagagacugagagaggaggacgagaucuucaaggagguggugaaggugcaccacagcaccaucagcagcuaccuggaggacaucauccugaacaccgaggccaacaccgccgaggagcaggccagagccgagaucgagaagauggccgagaagaucaacgacaucgccuacgagauggagagcagaagaaccuaccugcagagcgaggagaucguggccgagcugguguacagcuuccugauccccgaggugcagaaguacuucgugaaggagaaggugagaaacgcccagagaaagcacauccuggccgcccaccagaucauccacagcuacaccgagagcauggugcagaagaagcugaccgagggcgagcaggacgaggccagcaacgccgccaugcugcuggagaaggagacccagaacgagaacaacagcuaa

SEQ ID NO: 19512 - RNA, 1080 nt, Artificial Sequence
  MAB21L1__Homo_sapiens__NP_005575
augaucgccgcccaggccaagcugguguaccaccugaacaaguacuacaacgagaagugccaggccagaaaggccgccaucgccaagaccaucagagaggugugcaagguggugagcgacgugcugaaggagguggaggugcaggagcccagauucaucagcagccugaacgagauggacaacagauacgagggccuggaggugaucagccccaccgaguucgagguggugcuguaccugaaccagaugggcguguucaacuucguggacgacggcagccugcccggcugcgccgugcugaagcugagcgacggcagaaagagaagcaugagccuguggguggaguucaucaccgccagcggcuaccugagcgccagaaagaucagaagcagauuccagacccugguggcccaggccguggacaagugcagcuacagagacguggugaagaugguggccgacaccagcgaggugaagcugagaaucagagacagauacguggugcagaucacccccgccuucaagugcaccggcaucuggcccagaagcgccgcccacuggccccugccccacauccccuggcccggccccaacagaguggccgaggugaaggccgagggcuucaaccugcugagcaaggagugccacagccuggccggcaagcagagcagcgccgagagcgacgccugggugcugcaguucgccgaggccgagaacagacugcagaugggcggcugcagaaagaagugccugagcauccugaagacccugagagacagacaccuggagcugcccggccagccccugaacaacuaccacaugaagacccuggugagcuacgagugcgagaagcaccccagagagagcgacugggacgagagcugccugggcgacagacugaacggcauccugcugcagcugaucagcugccugcagugcagaagaugcccccacuacuuccugcccaaccuggaccuguuccagggcaagccccacagcgcccuggagaacgccgccaagcagaccuggagacuggccagagagauccugaccaaccccaagagccuggagaagcuguaa

SEQ ID NO: 19513 - RNA, 1080 nt, Artificial Sequence
  MAB21L2__Homo_sapiens__NP_006430
augaucgccgcccaggccaagcugguguaccagcugaacaaguacuacaccgagagaugccaggccagaaaggccgccaucgccaagaccaucagagaggugugcaagguggugagcgacgugcugaaggagguggaggugcaggagcccagauucaucagcagccugagcgagaucgacgccagauacgagggccuggaggugaucagccccaccgaguucgagguggugcuguaccugaaccagaugggcguguucaacuucguggacgacggcagccugcccggcugcgccgugcugaagcugagcgacggcagaaagagaagcaugagccuguggguggaguucaucaccgccagcggcuaccugagcgccagaaagaucagaagcagauuccagacccugguggcccaggccguggacaagugcagcuacagagacguggugaagaugaucgccgacaccagcgaggugaagcugagaaucagagagagauacguggugcagaucacccccgccuucaagugcaccggcaucuggcccagaagcgccgcccaguggcccaugccccacauccccuggcccggccccaacagaguggccgaggugaaggccgagggcuucaaccugcugagcaaggagugcuacagccugaccggcaagcagagcagcgccgagagcgacgccugggugcugcaguucggcgaggccgagaacagacugcugaugggcggcugcagaaacaagugccugagcgugcugaagacccugagagacagacaccuggagcugcccggccagccccugaacaacuaccacaugaagacccugcugcuguacgagugcgagaagcaccccagagagaccgacugggacgagagcugccugggcgacagacugaacggcauccugcugcagcugaucagcugccugcagugcagaagaugcccccacuacuuccugcccaaccuggaccuguuccagggcaagccccacagcgcccuggagagcgccgccaagcagaccuggagacuggccagagagauccugaccaaccccaagagccuggacaagcuguaa

SEQ ID NO: 19514 - RNA, 1089 nt, Artificial Sequence
  MAB21L3__Homo_sapiens__XP_011538928
augaaguaccugaccgugggcgaccuggaggacugccugcugaacaagguggaccugagaagacagcagaucagccaggccguggaggaggugcagaagguggugcaccaccugaccaccaacaucagcaaccaggacaucagauuccaggccgugcccuacagcgacaccuacaacgagaacaucaaggugcuggcccccagccaguuccuggugaccgugcccaucaagggccuggccggcuacagagaggccagagagcagcacuggagauacuacacccugcagggcaccagacugcccugcccccugagagaccccgagggccugcagcaguggcuggagguggagcaguucaugaagagccuguggcaguggcacgagaccgacgugaacaucgacggcgacaucgugcccgccaaggugcugcugguguucagaaagcugguggagaacgccgugagaaccugccaccugagcggcaaggugagccugcugggcaacagaagcgccguguggguggccguggagaccagcgccuaccagguggagcuggagcuggugcccgccguggagauccccaccaccuggagcaagaaggccagauggcccagaugccugcagagauggcccagccaggagagaguggagugcaucaagagcuucggcuucaaccugcuggccugcagcaacuaccacuggcagcugagcuuccugagagccgagcaggugcugcuggagcagcuggacgaggacggcggcugcagaagaaagugcuuccaggugaugagacaccugaaggaggacaucuggugccccggcaacagacccgugaucaccagccaccaccugcagaccgugcuguucuggaccugcgagaaguacccccacuucaaggacuggcagguguucagcaaggccuuccugagacuggugagaaagcugcacaagugcgugagccagcacuuccugaagcacuacuucgugagaaacagcaaccuguuccagugcaccaaccccaccgagcuggacaccguggcccagaagcuggccaccuuccugaagaacccccagaucggcccccccuaa

SEQ ID NO: 19515 - RNA, 2559 nt, Artificial Sequence
  MACC1__Homo_sapiens__NP_877439
augcugaucaccgagagaaagcacuucagaagcggcagaaucgcccagagcaugagcgaggccaaccugaucgacauggaggccggcaagcugagcaagagcugcaacaucaccgagugccaggaccccgaccugcugcacaacuggcccgacgccuucacccugagaggcaacaacgccagcaagguggccaaccccuucuggaaccagcugagcgccagcaaccccuuccuggacgacaucacccagcugagaaacaacagaaagagaaacaacaucagcauccugaaggaggaccccuuccuguucugcagagagaucgagaacggcaacagcuucgacagcagcggcgacgagcuggacgugcaccagcugcugagacagaccagcagcagaaacagcggcagaagcaagagcgugagcgagcugcuggacauccuggacgacaccgcccacgcccaccagagcauccacaacagcgaccagauccugcugcacgaccuggaguggcugaagaacgacagagaggccuacaagauggccuggcugagccagagacagcuggccagaagcugccuggaccugaacaccaucagccagagccccggcugggcccagacccagcuggccgaggugaccaucgccugcaaggugaaccaccagggcggcagcgugcagcugcccgagagcgacaucaccgugcacgugccccagggccacguggccgugggcgaguuccaggaggugagccugagagccuuccuggaccccccccacaugcugaaccacgaccugagcugcaccgugagcccccugcuggagaucaugcugggcaaccugaacaccauggaggcccugcugcuggagaugaagaucggcgccgaggugagaaaggaccccuucagccaggugaugaccgagauggugugccugcacagccugggcaaggagggccccuucaaggugcugagcaacugcuacaucuacaaggacaccauccaggugaagcugaucgaccugagccaggugauguaccuggugguggccgcccaggccaaggcccugcccagccccgccgccaccaucugggacuacauccacaagaccaccagcaucggcaucuacggccccaaguacauccaccccagcuucaccguggugcugaccgugugcggccacaacuacaugcccggccagcugaccaucagcgacaucaagaagggcggcaagaacaucagccccgugguguuccagcuguggggcaagcagagcuuccugcuggacaagccccaggaccugagcaucagcaucuucagcugcgaccccgacuucgaggugaagaccgagggcgagagaaaggagaucaagcagaagcagcuggaggccggcgagguggugcaccagcaguuccuguucagccugguggagcacagagagaugcaccuguucgacuucugcgugcagguggagccccccaacggcgagcccguggcccaguucagcaucaccacccccgaccccacccccaaccugaagagacugagcaaccugcccggcuaccugcagaagaaggaggagaucaagagcgccccccugagccccaagauccuggugaaguaccccaccuuccaggacaagacccugaacuucagcaacuacggcgugacccugaaggccgugcugagacagagcaagaucgacuacuuccuggaguacuucaagggcgacaccaucgcccugcugggcgagggcaaggugaaggccaucggccagagcaaggugaaggagugguacgugggcgugcugagaggcaagaucggccuggugcacugcaagaacgugaaggugaucagcaaggagcaggugauguucaugagcgacagcguguucaccaccagaaaccugcuggagcagaucgugcugccccugaagaagcugaccuacaucuacagcguggugcugacccuggugagcgagaagguguacgacuggaaggugcuggccgacgugcugggcuacagccaccugagccuggaggacuucgaccagauccaggccgacaaggagagcgagaaggugagcuacgugaucaagaagcugaaggaggacugccacaccgagagaaacaccagaaaguuccuguacgagcugaucguggcccugcugaagauggacugccaggagcugguggccagacugauccaggaggccgccgugcugaccagcgccgugaagcugggcaagggcuggagagagcuggccgagaagcuggugagacugaccaagcagcagauggaggccuacgagaucccccacagaggcaacaccggcgacguggccguggagaugauguggaagcccgccuacgacuuccuguacaccuggagcgcccacuacggcaacaacuacagagacgugcugcaggaccugcagagcgcccuggacagaaugaagaaccccgugaccaagcacuggagagagcugaccggcgugcugauccuggugaacagccuggaggugcugagagugaccgccuucagcaccagcgaggagguguaa

SEQ ID NO: 19516 - RNA, 978 nt, Artificial Sequence
  MACROD1__Homo_sapiens__NP_054786
augagccugcagagcagacugagcggcagacuggcccagcugagagccgccggccagcugcuggugccccccagacccagacccggccaccuggccggcgccaccagaaccagaagcagcaccugcggcccccccgccuuccugggcguguucggcagaagagccagaaccagcgccggcgugggcgccuggggcgccgccgccgugggcagaaccgccggcgugagaaccugggccccccuggccauggccgccaagguggaccugagcaccagcaccgacuggaaggaggccaagagcuuccugaagggccugagcgacaagcagagagaggagcacuacuucugcaaggacuucgugagacugaagaagauccccaccuggaaggagauggccaagggcguggccgugaagguggaggagcccagauacaagaaggacaagcagcugaacgagaagaucagccugcugagaagcgacaucaccaagcuggagguggacgccaucgugaacgccgccaacagcagccugcugggcggcggcggcguggacggcugcauccacagagccgccggcccccugcugaccgacgagugcagaacccugcagagcugcaagaccggcaaggccaagaucaccggcggcuacagacugcccgccaaguacgugauccacaccgugggccccaucgccuacggcgagcccagcgccagccaggccgccgagcugagaagcugcuaccugagcagccuggaccugcugcuggagcacagacugagaagcguggccuuccccugcaucagcaccggcguguucggcuaccccugcgaggccgccgccgagaucgugcuggccacccugagagaguggcuggagcagcacaaggacaagguggacagacugaucaucugcguguuccuggagaaggacgaggacaucuacagaagcagacugccccacuacuuccccguggccuaa

SEQ ID NO: 19517 - RNA, 642 nt, Artificial Sequence
  MACROD2__Homo_sapiens__NP_001028259
augaacgaguucuucagcguggacgacaacaacgaggaggaggaggacguggagaugaaggaggacagcgacgagaacggccccgaggagaagcagagcguggaggagauggaggagcagagccaggacgccgacggcgugaacaccgugaccgugcccggccccgccagcgaggaggccguggaggacugcaaggacgaggacuucgccaaggacgagaacaucaccaagggcggcgaggugaccgaccacagcgugagagaccaggaccaccccgacggccaggagaacgacagcaccaagaacgagaucaagaucgagaccgagagccagagcagcuacauggagaccgaggagcugagcagcaaccaggaggacgccgugaucguggagcagcccgaggugaucccccugaccgaggaccaggaggagaaggagggcgagaaggcccccggcgaggacacccccagaaugcccggcaagagcgagggcagcagcgaccuggagaacacccccggccccgacguggagaugaacagccagguggacaaggugaacgaccccaccgagagccagcaggaggaccagcugaucgccggcgcccaggacgaggccaaggagcagagaaacggcaccaaguaa

SEQ ID NO: 19518 - RNA, 2157 nt, Artificial Sequence
  MAD1L1__Homo_sapiens__NP_001291452
auggaggaccugggcgagaacaccauggugcugagcacccugagaagccugaacaacuucaucagccagagaguggagggcggcagcggccuggacaucagcaccagcgcccccggcagccugcagaugcaguaccagcagagcaugcagcuggaggagagagccgagcagaucagaagcaagagccaccugauccagguggagagagagaagaugcagauggagcugagccacaagagagccagaguggagcuggagagagccgccagcaccagcgccagaaacuacgagagagagguggacagaaaccaggagcugcugaccagaaucagacagcugcaggagagagaggccggcgccgaggagaagaugcaggagcagcuggagagaaacagacagugccagcagaaccuggacgccgccagcaagagacugagagagaaggaggacagccuggcccaggccggcgagaccaucaacgcccugaagggcagaaucagcgagcugcaguggagcgugauggaccaggagaugagagugaagagacuggagagcgagaagcaggagcugcaggagcagcuggaccugcagcacaagaagugccaggaggccaaccagaagauccaggagcugcaggccagccaggaggccagagccgaccacgagcagcagaucaaggaccuggagcagaagcugagccugcaggagcaggacgccgccaucgugaagaacaugaagagcgagcuggugagacugcccagacuggagagagagcugaagcagcugagagaggagagcgcccaccugagagagaugagagagaccaacggccugcugcaggaggagcuggagggccugcagagaaagcugggcagacaggagaagaugcaggagacccuggugggccuggagcuggagaacgagagacugcuggccaagcugcagagcugggagagacuggaccagaccaugggccugagcaucagaacccccgaggaccugagcagauucgugguggagcugcagcagagagagcuggcccugaaggacaagaacagcgccgugaccagcagcgccagaggccuggagaaggccagacagcagcugcaggaggagcugagacaggugagcggccagcugcuggaggagagaaagaagagagagacccacgaggcccuggccagaagacugcagaagagagugcugcugcugaccaaggagagagacggcaugagagccauccugggcagcuacgacagcgagcugacccccgccgaguacagcccccagcugaccagaagaaugagagaggccgaggacauggugcagaaggugcacagccacagcgccgagauggaggcccagcugagccaggcccuggaggagcugggcggccagaagcagagagccgacaugcuggagauggagcugaagaugcugaagagccagagcagcagcgccgagcagagcuuccuguucagcagagaggaggccgacacccugagacugaagguggaggagcuggagggcgagagaagcagacuggaggaggagaagagaaugcuggaggcccagcuggagagaagagcccugcagggcgacuacgaccagagcagaaccaaggugcugcacaugagccugaaccccaccagcguggccagacagagacugagagaggaccacagccagcugcaggccgagugcgagagacugagaggccugcugagagccauggagagaggcggcaccgugcccgccgaccuggaggccgccgccgccagccugcccagcagcaaggagguggccgagcugaagaagcagguggagagcgccgagcugaagaaccagagacugaaggagguguuccagaccaagauccaggaguucagaaaggccugcuacacccugaccggcuaccagaucgacaucaccaccgagaaccaguacagacugaccagccuguacgccgagcaccccggcgacugccugaucuucaaggccaccagccccagcggcagcaagaugcagcugcuggagaccgaguucagccacaccgugggcgagcugaucgaggugcaccugagaagacaggacagcauccccgccuuccugagcagccugacccuggagcuguucagcagacagaccguggccuaa

SEQ ID NO: 19519 - RNA, 921 nt, Artificial Sequence
  MAD2L1BP__Homo_sapiens__NP_001003690
auggccagagugccccugggcagaagccugacccugagccccagacuggagcacaacggcaugaccagcgcccaccacaacuucagacugcccggcagcagagacagccccgccagcgccagccagguggccgagaucaucgaccuggagugguacgagaagagcgaggagacccacgccagccagaucgagcugcuggagaccagcagcacccaggagccccugaacgccagcgaggccuucugccccagagacugcauggugcccgugguguuccccggccccgugagccaggagggcugcugccaguucaccugcgagcugcugaagcacaucauguaccagagacagcagcugccccugcccuacgagcagcugaagcacuucuacagaaagcccagcccccaggccgaggagaugcugaagaagaagcccagagccaccaccgaggugagcagcagaaagugccagcaggcccuggccgagcuggagagcgugcugagccaccuggaggacuucuucgccagaacccuggugcccagagugcugauccugcugggcggcaacgcccugagccccaaggaguucuacgagcuggaccugagccugcuggcccccuacagcguggaccagagccugagcaccgccgccugccugagaagacuguucagagccaucuucauggccgacgccuucagcgagcugcaggcccccccccugaugggcaccguggugauggcccagggccacagaaacugcggcgaggacugguucagacccaagcugaacuacagagugcccagcagaggccacaagcugaccgugacccugagcugcggcagacccagcaucagaaccaccgccugggaggacuacaucugguuccaggcccccgugaccuucaagggcuucagagaguaa

SEQ ID NO: 19520 - RNA, 618 nt, Artificial Sequence
  MAD2L1__Homo_sapiens__NP_002349
auggcccugcagcugagcagagagcagggcaucacccugagaggcagcgccgagaucguggccgaguucuucagcuucggcaucaacagcauccuguaccagagaggcaucuaccccagcgagaccuucaccagagugcagaaguacggccugacccugcuggugaccaccgaccuggagcugaucaaguaccugaacaacgugguggagcagcugaaggacuggcuguacaagugcagcgugcagaagcuggugguggugaucagcaacaucgagagcggcgaggugcuggagagauggcaguucgacaucgagugcgacaagaccgccaaggacgacagcgcccccagagagaagagccagaaggccauccaggacgagaucagaagcgugaucagacagaucaccgccaccgugaccuuccugccccugcuggaggugagcugcagcuucgaccugcugaucuacaccgacaaggaccugguggugcccgagaagugggaggagagcggcccccaguucaucaccaacagcgaggaggugagacugagaagcuucaccaccaccauccacaaggugaacagcaugguggccuacaagauccccgugaacgacuaa

SEQ ID NO: 19521 - RNA, 636 nt, Artificial Sequence
  MAD2L2__Homo_sapiens__XP_011538809
augaccacccugaccagacaggaccugaacuucggccaggugguggccgacgugcugugcgaguuccuggagguggccgugcaccugauccuguacgugagagagguguaccccgugggcaucuuccagaagagaaagaaguacaacgugcccgugcagaugagcugccaccccgagcugaaccaguacauccaggacacccugcacugcgugaagccccugcuggagaagaacgacguggagaagguggugguggugauccuggacaaggagcacagacccguggagaaguucguguucgagaucacccagcccccccugcugagcaucagcagcgacagccugcugagccacguggagcagcugcugagagccuucauccugaagaucagcgugugcgacgccgugcuggaccacaacccccccggcugcaccuucaccgugcuggugcacaccagagaggccgccaccagaaacauggagaagauccaggugaucaaggacuuccccuggauccuggccgacgagcaggacgugcacaugcacgaccccagacugaucccccugaagaccaugaccagcgacauccugaagaugcagcuguacguggaggagagagcccacaagggcagcuaa

SEQ ID NO: 19522 - RNA, 1149 nt, Artificial Sequence
  MADCAM1__Homo_sapiens__NP_570116
auggacuucggccuggcccugcugcuggccggccugcugggccugcugcugggccagagccugcaggugaagccccugcagguggagccccccgagcccgugguggccguggcccugggcgccagcagacagcugaccugcagacuggccugcgccgacagaggcgccagcgugcaguggagaggccuggacaccagccugggcgccgugcagagcgacaccggcagaagcgugcugaccgugagaaacgccagccugagcgccgccggcaccagagugugcgugggcagcugcggcggcagaaccuuccagcacaccgugcagcugcugguguacgccuuccccgaccagcugaccgugagccccgccgcccuggugcccggcgaccccgagguggccugcaccgcccacaaggugacccccguggaccccaacgcccugagcuucagccugcuggugggcggccaggagcuggagggcgcccaggcccugggccccgaggugcaggaggaggaggaggagccccagggcgacgaggacgugcuguucagagugaccgagagauggagacugcccccccugggcacccccgugccccccgcccuguacugccaggccaccaugagacugcccggccuggagcugagccacagacaggccauccccgugcugcacagccccaccagccccgagccccccgacaccaccagccccgagagccccgacaccaccagccccgagagccccgacaccaccagccaggagccccccgacaccaccagccccgagccccccgacaagaccagccccgagcccgccccccagcagggcagcacccacacccccagaagccccggcagcaccagaaccagaagacccgagaucagccaggccggccccacccagggcgaggugauccccaccggcagcagcaagcccgccggcgaccagcugcccgccgcccuguggaccagcagcgccgugcugggccugcugcugcuggcccugcccaccuaccaccuguggaagagaugcagacaccuggccgaggacgacacccacccccccgccagccugagacugcugccccaggugagcgccugggccggccugagaggcaccggccaggugggcaucagccccagcuaa

SEQ ID NO: 19523 - RNA, 4746 nt, Artificial Sequence
  MADD__Homo_sapiens__NP_569831
auggugcagaagaagaaguucugccccagacugcuggacuaccuggugaucgugggcgccagacaccccagcagcgacagcguggcccagacccccgagcugcugagaagauacccccuggaggaccacaccgaguucccccugccccccgacgugguguucuucugccagcccgagggcugccugagcgugagacagagaagaaugagccugagagacgacaccagcuucguguucacccugaccgacaaggacaccggcgugaccagauacggcaucugcgugaacuucuacagaagcuuccagaagagaaucagcaaggagaagggcgagggcggcgccggcagcagaggcaaggagggcacccacgccaccugcgccagcgaggagggcggcaccgagagcagcgagagcggcagcagccugcagccccugagcgccgacagcacccccgacgugaaccagagccccagaggcaagagaagagccaaggccggcagcagaagcagaaacagcacccugaccagccugugcgugcugagccacuaccccuucuucagcaccuucagagagugccuguacacccugaagagacugguggacugcugcagcgagagacugcugggcaagaagcugggcauccccagaggcgugcagagagacaccauguggagaaucuucaccggcagccugcugguggaggagaagagcagcgcccugcugcacgaccugagagagaucgaggccuggaucuacagacugcugagaagccccgugcccgugagcggccagaagagaguggacaucgaggugcugccccaggagcugcagcccgcccugaccuucgcccugcccgaccccagcagauucacccugguggacuucccccugcaccugccccuggagcugcugggcguggacgccugccugcaggugcugaccugcauccugcuggagcacaagguggugcugcagagcagagacuacaacgcccugagcaugagcgugauggccuucguggccaugaucuacccccuggaguacauguuccccgugaucccccugcugcccaccugcauggccagcgccgagcagcugcugcuggcccccacccccuacaucaucggcgugcccgccagcuucuuccuguacaagcuggacuucaagaugcccgacgacguguggcugguggaccuggacagcaacagagugaucgcccccaccaacgccgaggugcugcccauccugcccgagcccgagagccuggagcugaagaagcaccugaagcaggcccuggccagcaugagccugaacacccagcccauccugaaccuggagaaguuccacgagggccaggagaucccccugcugcugggcagacccagcaacgaccugcagagcacccccagcaccgaguucaacccccugaucuacggcaacgacguggacagcguggacguggccaccagaguggccauggugagauucuucaacagcgccaacgugcugcagggcuuccagaugcacaccagaacccugagacuguuccccagacccgugguggccuuccaggccggcagcuuccuggccagcagacccagacagacccccuucgccgagaagcuggccagaacccaggccguggaguacuucggcgaguggauccugaaccccaccaacuacgccuuccagagaauccacaacaacauguucgaccccgcccugaucggcgacaagcccaagugguacgcccaccagcugcagcccauccacuacagaguguacgacagcaacagccagcuggccgaggcccugagcgugccccccgagagagacagcgacagcgagcccaccgacgacagcggcagcgacagcauggacuacgacgacagcagcagcagcuacagcagccugggcgacuucgugagcgagaugaugaagugcgacaucaacggcgacacccccaacguggacccccugacccacgccgcccugggcgacgccagcgagguggagaucgacgagcugcagaaccagaaggaggccgaggagcccggccccgacagcgagaacagccaggagaaccccccccugagaagcagcagcagcaccaccgccagcagcagccccagcaccgugauccacggcgccaacagcgagcccgccgacagcaccgagauggacgacaaggccgccgugggcgugagcaagccccugcccagcgugccccccagcaucggcaagagcaacguggacagaagacaggccgagaucggcgagggcagcgugagaagaagaaucuacgacaaccccuacuucgagccccaguacggcuucccccccgaggaggacgaggacgagcagggcgagagcuacacccccagauucagccagcacgugagcggcaacagagcccagaagcugcugagacccaacagccugagacuggccagcgacagcgacgccgagagcgacagcagagccagcagccccaacagcaccgugagcaacaccagcaccgagggcuucggcggcaucaugagcuucgccagcagccuguacagaaaccacagcaccagcuucagccugagcaaccugacccugcccaccaagggcgccagagagaaggccacccccuuccccagccugaagguguucggccugaacacccugauggagaucgugaccgaggccggccccggcagcggcgagggcaacagaagagcccugguggaccagaagagcagcgugaucaagcacagccccaccgugaagagagagccccccagcccccagggcagaagcagcaacagcagcgagaaccagcaguuccugaaggagguggugcacagcgugcuggacggccagggcgugggcuggcugaacaugaagaaggugagaagacugcuggagagcgagcagcugagaguguucgugcugagcaagcugaacagaauggugcagagcgaggacgacgccagacaggacaucauccccgacguggagaucagcagaaagguguacaagggcaugcuggaccugcugaagugcaccgugcugagccuggagcagagcuacgcccacgccggccugggcggcauggccagcaucuucggccugcuggagaucgcccagacccacuacuacagcaaggagcccgacaagagaaagagaagccccaccgagagcgugaacacccccgugggcaaggaccccggccuggccggcagaggcgaccccaaggccauggcccagcugagagugccccagcugggccccagagcccccagcgccaccggcaagggccccaaggagcuggacaccagaagccugaaggaggagaacuucaucgccagcaucgagcuguggaacaagcaccaggaggugaagaagcagaaggcccuggagaagcagagacccgaggugaucaagcccguguucgaccugggcgagaccgaggagaagaagagccagaucagcgccgacagcggcgugagccugaccagcagcagccagagaaccgaccaggacagcgugaucggcgugagccccgccgugaugaucagaagcagcagccaggacagcgaggugagcaccguggugagcaacagcagcggcgagacccugggcgccgacagcgaccugagcagcaacgccggcgacggccccggcggcgagggcagcgugcaccuggccagcagcagaggcacccugagcgacagcgagaucgagaccaacagcgccaccagcaccaucuucggcaaggcccacagccugaagcccagcaucaaggagaagcuggccggcagccccaucagaaccagcgaggacgugagccagagaguguaccuguacgagggccugcugggcagagacaagggcagcaugugggaccagcuggaggacgccgccauggagaccuucagcaucagcaaggagagaagcacccugugggaccagaugcaguucugggaggacgccuuccuggacgccgugaugcuggagagagagggcaugggcauggaccagggcccccaggagaugaucgacagauaccugagccugggcgagcacgacagaaagagacuggaggacgacgaggacagacugcuggccacccugcugcacaaccugaucagcuacaugcugcugaugaaggugaacaagaacgacaucagaaagaaggugagaagacugaugggcaagagccacaucggccugguguacagccagcagaucaacgaggugcuggaccagcuggccaaccugaacggcagagaccugagcaucuggagcagcggcagcagacacaugaagaagcagaccuucguggugcacgccggcaccgacaccaacggcgacaucuucuucauggaggugugcgacgacugcguggugcugagaagcaacaucggcaccguguacgagagauggugguacgagaagcugaucaacaugaccuacugccccaagaccaaggugcugugccuguggagaagaaacggcagcgagacccagcugaacaaguucuacaccaagaagugcagagagcuguacuacugcgugaaggacagcauggagagagccgccgccagacagcagagcaucaagcccggccccgagcugggcggcgaguuccccgugcaggaccugaagaccggcgagggcggccugcugcaggugacccuggagggcaucaaccugaaguucaugcacaaccaguuccugaagcugaagaagugguaa

SEQ ID NO: 19524 - RNA, 1191 nt, Artificial Sequence
  MAEA__Homo_sapiens__NP_001017405
auggccgugcaggagagcgccgcccagcugagcaugacccugaaggugcaggaguaccccacccugaaggugcccuacgagacccugaacaagagauucagagccgcccagaagaacaucgacagagagaccagccacgugaccauggugguggccgagcuggagaagacccugagcggcugccccgccguggacagcguggugagccugcuggacggcgugguggagaagcugagcgugcugaagagaaaggccguggagagcauccaggccgaggacgagagcgccaagcugugcaagagaagaaucgagcaccugaaggagcacagcagcgaccagcccgccgccgccagcguguggaagagaaagagaauggacagaaugaugguggagcaccugcugagaugcggcuacuacaacaccgccgugaagcuggccagacagagcggcaucgaggaccuggugaacaucgagauguuccugaccgccaaggagguggaggagagccuggagagaagagagaccgccaccugccuggccuggugccacgacaacaagagcagacugagaaagaugaagagcugccuggaguucagccugagaauccaggaguucaucgagcugaucagacagaacaagagacuggacgccgugagacacgccagaaagcacuucagccaggccgagggcagccagcuggacgaggugagacaggccaugggcaugcuggccuucccccccgacacccacaucagccccuacaaggaccugcuggaccccgccagauggagaaugcugauccagcaguucagauacgacaacuacagacugcaccagcugggcaacaacagcguguucacccugacccugcaggccggccugagcgccaucaagaccccccagugcuacaaggaggacggcagcagcaagagccccgacugccccgugugcagcagaagccugaacaagcuggcccagccccugcccauggcccacugcgccaacagcagacuggugugcaagaucagcggcgacgugaugaacgagaacaacccccccaugaugcugcccaacggcuacguguacggcuacaacagccugcugagcaucagacaggacgacaagguggugugccccagaaccaaggagguguuccacuucagccaggccgagaagguguacaucauguaa

SEQ ID NO: 19525 - RNA, 1212 nt, Artificial Sequence
  MAEL__Homo_sapiens__NP_001273306
augcccaacagaaaggccagcagaaacgccuacuacuucuucgugcaggagaagauccccgagcugagaagaagaggccugcccguggccagaguggccgacgccauccccuacugcagcagcgacugggccaagcccguguucaccccccugagaagacccggcaugcuggugcccaagcagaacgugagcccccccgacaugagcgcccugagccugaagggcgaccaggcccugcugggcggcaucuucuacuuccugaacaucuucagccacggcgagcugcccccccacugcgagcagagauuccugcccugcgagaucggcugcgugaaguacagccugcaggagggcaucauggccgacuuccacagcuucaucaaccccggcgagauccccagaggcuucagauuccacugccaggccgccagcgacagcagccacaagauccccaucagcaacuucgagagaggccacaaccaggccaccgugcugcagaaccuguacagauucauccaccccaaccccggcaacuggccccccaucuacugcaagagcgacgacagaaccagagugaacuggugccugaagcacauggccaaggccagcgagaucagacaggaccugcagcugcugaccguggaggaccugguggugggcaucuaccagcagaaguuccugaaggagcccagcaagaccuggaucagaagccugcuggacguggccaugugggacuacagcagcaacaccagaugcaaguggcacgaggagaacgacauccuguucugcgcccuggccgugugcaagaagaucgccuacugcaucagcaacagccuggccacccuguucggcauccagcugaccgaggcccacgugccccugcaggacuacgaggccagcaacagcgugacccccaagaugguggugcuggacgccggcagauaccagaagcugagagugggcagcagcggcuucagccacuucaacagcagcaacgaggagcagagaagcaacacccccaucggcgacuaccccagcagagccaagaucagcggccagaacagcagcgugagaggcagaggcaucaccagacugcuggagagcaucagcaacagcagcagcaacauccacaaguucagcaacugcgacaccagccugagccccuacaugagccagaaggacggcuacaagagcuucagcagccugagcuaa

SEQ ID NO: 19526 - RNA, 771 nt, Artificial Sequence
  MAF1__Homo_sapiens__NP_115648
augaagcugcuggagaacagcagcuucgaggccaucaacagccagcugaccguggagaccggcgacgcccacaucaucggcagaaucgagagcuacagcugcaagauggccggcgacgacaagcacauguucaagcaguucugccaggagggccagccccacgugcuggaggcccugagccccccccagaccagcggccugagccccagcagacugagcaagagccagggcggcgaggaggagggcccccugagcgacaagugcagcagaaagacccuguucuaccugaucgccacccugaacgagagcuucagacccgacuacgacuucagcaccgccagaagccacgaguucagcagagagcccagccugagcuggguggugaacgccgugaacugcagccuguucagcgccgugagagaggacuucaaggaccugaagccccagcuguggaacgccguggacgaggagaucugccuggccgagugcgacaucuacagcuacaaccccgaccuggacagcgaccccuucggcgaggacggcagccuguggagcuucaacuacuucuucuacaacaagagacugaagagaaucguguucuucagcugcagaagcaucagcggcagcaccuacacccccagcgaggccggcaacgagcuggacauggagcugggcgaggaggagguggaggaggagagcagaagcggcggcagcggcgccgaggagaccagcaccauggaggaggacagagugcccgugaucugcaucuaa

SEQ ID NO: 19527 - RNA, 1062 nt, Artificial Sequence
  MAFA__Homo_sapiens__NP_963883
auggccgccgagcuggccaugggcgccgagcugcccagcagcccccuggccaucgaguacgugaacgacuucgaccugaugaaguucgaggugaagaaggagccccccgaggccgagagauucugccacagacugccccccggcagccugagcagcaccccccugagcacccccugcagcagcgugcccagcagccccagcuucugcgcccccagccccggcaccggcggcggcggcggcgccggcggcggcggcggcagcagccaggccggcggcgcccccggcccccccagcggcggccccggcgccgugggcggcaccagcggcaagcccgcccuggaggaccuguacuggaugagcggcuaccagcaccaccugaaccccgaggcccugaaccugacccccgaggacgccguggaggcccugaucggcagcggccaccacggcgcccaccacggcgcccaccaccccgccgccgccgccgccuacgaggccuucagaggccccggcuucgccggcggcggcggcgccgacgacaugggcgccggccaccaccacggcgcccaccacgccgcccaccaccaccacgccgcccaccaccaccaccaccaccaccaccaccacggcggcgccggccacggcggcggcgccggccaccacgugagacuggaggagagauucagcgacgaccagcuggugagcaugagcgugagagagcugaacagacagcugagaggcuucagcaaggaggaggugaucagacugaagcagaagagaagaacccugaagaacagaggcuacgcccagagcugcagauucaagagagugcagcagagacacauccuggagagcgagaagugccagcugcagagccagguggagcagcugaagcuggaggugggcagacuggccaaggagagagaccuguacaaggagaaguacgagaagcuggccggcagaggcggccccggcagcgccggcggcgccggcuuccccagagagcccagccccccccaggccggccccggcggcgccaagggcaccgccgacuucuuccuguaa

SEQ ID NO: 19528 - RNA, 972 nt, Artificial Sequence
  MAFB__Homo_sapiens__NP_005452
auggccgccgagcugagcaugggccccgagcugcccaccagcccccuggccauggaguacgugaacgacuucgaccugcugaaguucgacgugaagaaggagccccugggcagagccgagagacccggcagacccugcaccagacugcagcccgccggcagcgugagcagcaccccccugagcacccccugcagcagcgugcccagcagccccagcuucagccccaccgagcagaagacccaccuggaggaccuguacuggauggccagcaacuaccagcagaugaaccccgaggcccugaaccugacccccgaggacgccguggaggcccugaucggcagccaccccgugccccagccccugcagagcuucgacagcuucagaggcgcccaccaccaccaccaccaccaccacccccacccccaccacgccuaccccggcgccggcguggcccacgacgagcugggcccccacgcccacccccaccaccaccaccaccaccaggccagccccccccccagcagcgccgccagccccgcccagcagcugcccaccagccaccccggccccggcccccacgccaccgccagcgccaccgccgccggcggcaacggcagcguggaggacagauucagcgacgaccagcuggugagcaugagcgugagagagcugaacagacaccugagaggcuucaccaaggacgaggugaucagacugaagcagaagagaagaacccugaagaacagaggcuacgcccagagcugcagauacaagagagugcagcagaagcaccaccuggagaacgagaagacccagcugauccagcagguggagcagcugaagcaggaggugagcagacuggccagagagagagacgccuacaaggugaagugcgagaagcuggccaacagcggcuucagagaggccggcagcaccagcgacagccccagcagccccgaguucuuccuguaa

SEQ ID NO: 19529 - RNA, 495 nt, Artificial Sequence
  MAFF__Homo_sapiens__NP_001155045
augagcguggacccccugagcagcaaggcccugaagaucaagagagagcugagcgagaacaccccccaccugagcgacgaggcccugaugggccugagcgugagagagcugaacagacaccugagaggccugagcgccgaggaggugaccagacugaagcagagaagaagaacccugaagaacagaggcuacgccgccagcugcagagugaagagagugugccagaaggaggagcugcagaagcagaagagcgagcuggagagagagguggacaagcuggccagagagaacgccgccaugagacuggagcuggacgcccugagaggcaagugcgaggcccugcagggcuucgccagaagcguggccgccgccagaggccccgccacccugguggcccccgccagcgugaucaccaucgugaagagcacccccggcagcggcagcggccccgcccacggccccgaccccgcccacggccccgccagcugcagcuaa

SEQ ID NO: 19530 - RNA, 489 nt, Artificial Sequence
  MAFG__Homo_sapiens__XP_011521881
augaccacccccaacaagggcaacaaggcccugaaggugaagagagagcccggcgagaacggcaccagccugaccgacgaggagcuggugaccaugagcgugagagagcugaaccagcaccugagaggccugagcaaggaggagaucgugcagcugaagcagagaagaagaacccugaagaacagaggcuacgccgccagcugcagagugaagagagugacccagaaggaggagcuggagaagcagaaggccgagcugcagcaggagguggagaagcuggccagcgagaacgccagcaugaagcuggagcuggacgcccugagaagcaaguacgaggcccugcagaccuucgccagaaccguggccagaagccccguggcccccgccagaggcccccuggccgccggccugggcccccuggugcccggcaagguggccgccaccagcgugaucaccaucgugaagagcaagaccgacgccagaagcuaa

SEQ ID NO: 19531 - RNA, 1122 nt, Artificial Sequence
  MAF__Homo_sapiens__NP_001026974
auggccagcgagcuggccaugagcaacagcgaccugcccaccagcccccuggccauggaguacgugaacgacuucgaccugaugaaguucgaggugaagaaggagcccguggagaccgacagaaucaucagccagugcggcagacugaucgccggcggcagccugagcagcacccccaugagcacccccugcagcagcgugccccccagccccagcuucagcgcccccagccccggcagcggcagcgagcagaaggcccaccuggaggacuacuacuggaugaccggcuacccccagcagcugaaccccgaggcccugggcuucagccccgaggacgccguggaggcccugaucagcaacagccaccagcugcagggcggcuucgacggcuacgccagaggcgcccagcagcuggccgccgccgccggcgccggcgccggcgccagccugggcggcagcggcgaggagaugggccccgccgccgccguggugagcgccgugaucgccgccgccgccgcccagagcggcgccggcccccacuaccaccaccaccaccaccacgccgccggccaccaccaccaccccaccgccggcgcccccggcgccgccggcagcgccgccgccagcgccggcggcgccggcggcgccggcggcggcggccccgccagcgccggcggcggcggcggcggcggcggcggcggcggcggcggcggcgccgccggcgccggcggcgcccugcacccccaccacgccgccggcggccugcacuucgacgacagauucagcgacgagcagcuggugaccaugagcgugagagagcugaacagacagcugagaggcgugagcaaggaggaggugaucagacugaagcagaagagaagaacccugaagaacagaggcuacgcccagagcugcagauucaagagagugcagcagagacacgugcuggagagcgagaagaaccagcugcugcagcagguggaccaccugaagcaggagaucagcagacuggugagagagagagacgccuacaaggagaaguacgagaagcuggugagcagcggcuucagagagaacggcagcagcagcgacaaccccagcagccccgaguucuucauguaa

SEQ ID NO: 19532 - RNA, 471 nt, Artificial Sequence
  MAFK__Homo_sapiens__XP_006715836
augaccaccaaccccaagcccaacaaggcccugaaggugaagaaggaggccggcgagaacgcccccgugcugagcgacgacgagcuggugagcaugagcgugagagagcugaaccagcaccugagaggccugaccaaggaggaggugaccagacugaagcagagaagaagaacccugaagaacagaggcuacgccgccagcugcagaaucaagagagugacccagaaggaggagcuggagagacagagaguggagcugcagcaggagguggagaagcuggccagagagaacagcagcaugagacuggagcuggacgcccugagaagcaaguacgaggcccugcagaccuucgccagaaccguggccagaggccccguggcccccagcaagguggccaccaccagcgugaucaccaucgugaagagcaccgagcugagcagcaccagcgugcccuucagcgccgccagcuaa

SEQ ID NO: 19533 - RNA, 1110 nt, Artificial Sequence
  MAGEA10__Homo_sapiens__NP_001011543
augcccagagcccccaagagacagagaugcaugcccgaggaggaccugcagagccagagcgagacccagggccuggagggcgcccaggccccccuggccguggaggaggacgccagcagcagcaccagcaccagcagcagcuuccccagcagcuuccccagcagcagcagcagcagcagcagcagcugcuacccccugauccccagcacccccgaggaggugagcgccgacgacgagacccccaaccccccccagagcgcccagaucgccugcagcagccccagcgugguggccagccugccccuggaccagagcgacgagggcagcagcagccagaaggaggagagccccagcacccugcaggugcugcccgacagcgagagccugcccagaagcgagaucgacgagaaggugaccgaccuggugcaguuccugcuguucaaguaccagaugaaggagcccaucaccaaggccgagauccuggagagcgugaucagaaacuacgaggaccacuucccccugcuguucagcgaggccagcgagugcaugcugcugguguucggcaucgacgugaaggagguggaccccaccggccacagcuucgugcuggugaccagccugggccugaccuacgacggcaugcugagcgacgugcagagcaugcccaagaccggcauccugauccugauccugagcaucaucuucaucgagggcuacugcacccccgaggaggugaucugggaggcccugaacaugaugggccuguacgacggcauggagcaccugaucuacggcgagcccagaaagcugcugacccaggacugggugcaggagaacuaccuggaguacagacaggugcccggcagcgaccccgccagauacgaguuccuguggggccccagagcccacgccgagaucagaaagaugagccugcugaaguuccuggccaaggugaacggcagcgaccccagaagcuucccccugugguacgaggaggcccugaaggacgaggaggagagagcccaggacagaaucgccaccaccgacgacaccaccgccauggccagcgccagcagcagcgccaccggcagcuucagcuaccccgaguaa

SEQ ID NO: 19534 - RNA, 1203 nt, Artificial Sequence
  MAGEA11__Homo_sapiens__NP_001011544
augagcaaggugagcaccauguucagcgaggacgacuuccagagcaccgagagagcccccuacggcccccagcugcaguggagccaggaccugcccagagugcagguguucagagagcaggccaaccuggaggacagaagccccagaagaacccagagaaucaccggcggcgagcaggugcuguggggccccaucacccagaucuuccccaccgugagacccgccgaccugaccagagugaucaugccccuggagcagagaagccagcacugcaagcccgaggagggccugcaggcccaggaggaggaccugggccuggugggcgcccaggcccugcaggccgaggagcaggaggccgccuucuucagcagcacccugaacgugggcacccuggaggagcugcccgccgccgagagccccagccccccccagagcccccaggaggagagcuucagccccaccgccauggacgccaucuucggcagccugagcgacgagggcagcggcagccaggagaaggagggccccagcaccagccccgaccugaucgaccccgagagcuucagccaggacauccugcacgacaagaucaucgaccuggugcaccugcugcugagaaaguacagagugaagggccugaucaccaaggccgagaugcugggcagcgugaucaagaacuacgaggacuacuuccccgagaucuucagagaggccagcgugugcaugcagcugcuguucggcaucgacgugaaggagguggaccccaccagccacagcuacgugcuggugaccagccugaaccugagcuacgacggcauccagugcaacgagcagagcaugcccaagagcggccugcugaucaucgugcugggcgugaucuucauggagggcaacugcauccccgaggaggugaugugggaggugcugagcaucaugggcguguacgccggcagagagcacuuccuguucggcgagcccaagagacugcugacccagaacugggugcaggagaaguaccugguguacagacaggugcccggcaccgaccccgccugcuacgaguuccuguggggccccagagcccacgccgagaccagcaagaugaaggugcuggaguacaucgccaacgccaacggcagagaccccaccagcuaccccagccuguacgaggacgcccugagagaggagggcgagggcguguaa

SEQ ID NO: 19535 - RNA, 945 nt, Artificial Sequence
  MAGEA12__Homo_sapiens__NP_001159858
augccccuggagcagagaagccagcacugcaagcccgaggagggccuggaggcccagggcgaggcccugggccuggugggcgcccaggcccccgccaccgaggagcaggagaccgccagcagcagcagcacccugguggaggugacccugagagaggugcccgccgccgagagccccagccccccccacagcccccagggcgccagcacccugcccaccaccaucaacuacacccuguggagccagagcgacgagggcagcagcaacgaggagcaggagggccccagcaccuuccccgaccuggagaccagcuuccagguggcccugagcagaaagauggccgagcuggugcacuuccugcugcugaaguacagagccagagagcccuucaccaaggccgagaugcugggcagcgugaucagaaacuuccaggacuucuuccccgugaucuucagcaaggccagcgaguaccugcagcugguguucggcaucgaggugguggagguggugagaaucggccaccuguacauccuggugaccugccugggccugagcuacgacggccugcugggcgacaaccagaucgugcccaagaccggccugcugaucaucgugcuggccaucaucgccaaggagggcgacugcgcccccgaggagaagaucugggaggagcugagcgugcuggaggccagcgacggcagagaggacagcguguucgcccaccccagaaagcugcugacccaggaccuggugcaggagaacuaccuggaguacagacaggugcccggcagcgaccccgccugcuacgaguuccuguggggccccagagcccugguggagaccagcuacgugaaggugcugcaccaccugcugaagaucagcggcggcccccacaucagcuaccccccccugcacgagugggccuucagagagggcgaggaguaa

SEQ ID NO: 19536 - RNA, 930 nt, Artificial Sequence
  MAGEA1__Homo_sapiens__NP_004979
augagccuggagcagagaagccugcacugcaagcccgaggaggcccuggaggcccagcaggaggcccugggccuggugugcgugcaggccgccaccagcagcagcagcccccuggugcugggcacccuggaggaggugcccaccgccggcagcaccgaccccccccagagcccccagggcgccagcgccuuccccaccaccaucaacuucaccagacagagacagcccagcgagggcagcagcagcagagaggaggagggccccagcaccagcugcauccuggagagccuguucagagccgugaucaccaagaagguggccgaccuggugggcuuccugcugcugaaguacagagccagagagcccgugaccaaggccgagaugcuggagagcgugaucaagaacuacaagcacugcuuccccgagaucuucggcaaggccagcgagagccugcagcugguguucggcaucgacgugaaggaggccgaccccaccggccacagcuacgugcuggugaccugccugggccugagcuacgacggccugcugggcgacaaccagaucaugcccaagaccggcuuccugaucaucgugcuggugaugaucgccauggagggcggccacgcccccgaggaggagaucugggaggagcugagcgugauggagguguacgacggcagagagcacagcgccuacggcgagcccagaaagcugcugacccaggaccuggugcaggagaaguaccuggaguacagacaggugcccgacagcgaccccgccagauacgaguuccuguggggccccagagcccuggccgagaccagcuacgugaaggugcuggaguacgugaucaaggugagcgccagagugagauucuucuuccccagccugagagaggccgcccugagagaggaggaggagggcguguaa

SEQ ID NO: 19537 - RNA, 945 nt, Artificial Sequence
  MAGEA2B__Homo_sapiens__NP_705692
augccccuggagcagagaagccagcacugcaagcccgaggagggccuggaggccagaggcgaggcccugggccuggugggcgcccaggcccccgccaccgaggagcagcagaccgccagcagcagcagcacccugguggaggugacccugggcgaggugcccgccgccgacagccccagccccccccacagcccccagggcgccagcagcuucagcaccaccaucaacuacacccuguggagacagagcgacgagggcagcagcaaccaggaggaggagggccccagaauguuccccgaccuggagagcgaguuccaggccgccaucagcagaaagaugguggagcuggugcacuuccugcugcugaaguacagagccagagagcccgugaccaaggccgagaugcuggagagcgugcugagaaacugccaggacuucuuccccgugaucuucagcaaggccagcgaguaccugcagcugguguucggcaucgaggugguggagguggugcccaucagccaccuguacauccuggugaccugccugggccugagcuacgacggccugcugggcgacaaccaggugaugcccaagaccggccugcugaucaucgugcuggccaucaucgccaucgagggcgacugcgcccccgaggagaagaucugggaggagcugagcaugcuggagguguucgagggcagagaggacagcguguucgcccaccccagaaagcugcugaugcaggaccuggugcaggagaacuaccuggaguacagacaggugcccggcagcgaccccgccugcuacgaguuccuguggggccccagagcccugaucgagaccagcuacgugaaggugcugcaccacacccugaagaucggcggcgagccccacaucagcuaccccccccugcacgagagagcccugagagagggcgaggaguaa

SEQ ID NO: 19538 - RNA, 945 nt, Artificial Sequence
  MAGEA3__Homo_sapiens__NP_005353
augccccuggagcagagaagccagcacugcaagcccgaggagggccuggaggccagaggcgaggcccugggccuggugggcgcccaggcccccgccaccgaggagcaggaggccgccagcagcagcagcacccugguggaggugacccugggcgaggugcccgccgccgagagccccgaccccccccagagcccccagggcgccagcagccugcccaccaccaugaacuacccccuguggagccagagcuacgaggacagcagcaaccaggaggaggagggccccagcaccuuccccgaccuggagagcgaguuccaggccgcccugagcagaaagguggccgagcuggugcacuuccugcugcugaaguacagagccagagagcccgugaccaaggccgagaugcugggcagcguggugggcaacuggcaguacuucuuccccgugaucuucagcaaggccagcagcagccugcagcugguguucggcaucgagcugauggagguggaccccaucggccaccuguacaucuucgccaccugccugggccugagcuacgacggccugcugggcgacaaccagaucaugcccaaggccggccugcugaucaucgugcuggccaucaucgccagagagggcgacugcgcccccgaggagaagaucugggaggagcugagcgugcuggagguguucgagggcagagaggacagcauccugggcgaccccaagaagcugcugacccagcacuucgugcaggagaacuaccuggaguacagacaggugcccggcagcgaccccgccugcuacgaguuccuguggggccccagagcccugguggagaccagcuacgugaaggugcugcaccacauggugaagaucagcggcggcccccacaucagcuaccccccccugcacgagugggugcugagagagggcgaggaguaa

SEQ ID NO: 19539 - RNA, 954 nt, Artificial Sequence
  MAGEA4__Homo_sapiens__NP_001011549
augagcagcgagcagaagagccagcacugcaagcccgaggagggcguggaggcccaggaggaggcccugggccuggugggcgcccaggcccccaccaccgaggagcaggaggccgccgugagcagcagcagcccccuggugcccggcacccuggaggaggugcccgccgccgagagcgccggccccccccagagcccccagggcgccagcgcccugcccaccaccaucagcuucaccugcuggagacagcccaacgagggcagcagcagccaggaggaggagggccccagcaccagccccgacgccgagagccuguucagagaggcccugagcaacaagguggacgagcuggcccacuuccugcugagaaaguacagagccaaggagcuggugaccaaggccgagaugcuggagagagugaucaagaacuacaagagaugcuuccccgugaucuucggcaaggccagcgagagccugaagaugaucuucggcaucgacgugaaggagguggaccccgccagcaacaccuacacccuggugaccugccugggccugagcuacgacggccugcugggcaacaaccagaucuuccccaagaccggccugcugaucaucgugcugggcaccaucgccauggagggcgacagcgccagcgaggaggagaucugggaggagcugggcgugaugggcguguacgacggcagagagcacaccguguacggcgagcccagaaagcugcugacccaggacugggugcaggagaacuaccuggaguacagacaggugcccggcagcaaccccgccagauacgaguuccuguggggccccagagcccuggccgagaccagcuacgugaaggugcuggagcacguggugagagugaacgccagagugagaaucgccuaccccagccugagagaggccgcccugcuggaggaggaggagggcguguaa

SEQ ID NO: 19540 - RNA, 945 nt, Artificial Sequence
  MAGEA6__Homo_sapiens__NP_005354
augccccuggagcagagaagccagcacugcaagcccgaggagggccuggaggccagaggcgaggcccugggccuggugggcgcccaggcccccgccaccgaggagcaggaggccgccagcagcagcagcacccugguggaggugacccugggcgaggugcccgccgccgagagccccgaccccccccagagcccccagggcgccagcagccugcccaccaccaugaacuacccccuguggagccagagcuacgaggacagcagcaaccaggaggaggagggccccagcaccuuccccgaccuggagagcgaguuccaggccgcccugagcagaaagguggccaagcuggugcacuuccugcugcugaaguacagagccagagagcccgugaccaaggccgagaugcugggcagcguggugggcaacuggcaguacuucuuccccgugaucuucagcaaggccagcgacagccugcagcugguguucggcaucgagcugauggagguggaccccaucggccacguguacaucuucgccaccugccugggccugagcuacgacggccugcugggcgacaaccagaucaugcccaagaccggcuuccugaucaucauccuggccaucaucgccaaggagggcgacugcgcccccgaggagaagaucugggaggagcugagcgugcuggagguguucgagggcagagaggacagcaucuucggcgaccccaagaagcugcugacccaguacuucgugcaggagaacuaccuggaguacagacaggugcccggcagcgaccccgccugcuacgaguuccuguggggccccagagcccugaucgagaccagcuacgugaaggugcugcaccacauggugaagaucagcggcggccccagaaucagcuacccccugcugcacgagugggcccugagagagggcgaggaguaa

SEQ ID NO: 19541 - RNA, 948 nt, Artificial Sequence
  MAGEA9__Homo_sapiens__NP_005356
augagccuggagcagagaagcccccacugcaagcccgacgaggaccuggaggcccagggcgaggaccugggccugaugggcgcccaggagcccaccggcgaggaggaggagaccaccagcagcagcgacagcaaggaggaggaggugagcgccgccggcagcagcagccccccccagagcccccagggcggcgccagcagcagcaucagcguguacuacacccuguggagccaguucgacgagggcagcagcagccaggaggaggaggagcccagcagcagcguggaccccgcccagcuggaguucauguuccaggaggcccugaagcugaagguggccgagcuggugcacuuccugcugcacaaguacagagugaaggagcccgugaccaaggccgagaugcuggagagcgugaucaagaacuacaagagauacuuccccgugaucuucggcaaggccagcgaguucaugcaggugaucuucggcaccgacgugaaggagguggaccccgccggccacagcuacauccuggugaccgcccugggccugagcugcgacagcaugcugggcgacggccacagcaugcccaaggccgcccugcugaucaucgugcugggcgugauccugaccaaggacaacugcgcccccgaggaggugaucugggaggcccugagcgugaugggcguguacgugggcaaggagcacauguucuacggcgagcccagaaagcugcugacccaggacugggugcaggagaacuaccuggaguacagacaggugcccggcagcgaccccgcccacuacgaguuccuguggggcagcaaggcccacgccgagaccagcuacgagaaggugaucaacuaccuggugaugcugaacgccagagagcccaucugcuaccccagccuguacgaggaggugcugggcgaggagcaggagggcguguaa

SEQ ID NO: 19542 - RNA, 1011 nt, Artificial Sequence
  MAGEB17__Homo_sapiens__NP_001264236
augcccagaggccaggccagcaagagaagagccagagagaagagaagacaggccagaggcgaggaccagugccugggcggcgcccaggccaccgccgccgagaaggagaagcugcccagcagcagcagccccgccugccagagccccccccagagcuuccccaacgccggcaucccccaggagagccagagagccagcuaccccagcagccccgccagcgccgugagccugaccagcagcgacgagggcgccaagggccagaagggcgagagccccaacagcuuccacggccccagcagcagcgagagcaccggcagagaccugcugaacaccaagaccggcgagcuggugcaguuccugcugaacaaguacaucagaaaggagcccaucaccagagaggccaugcugaaggugaucaacagaaaguacaagcagcacuuccccgagauccugagaagaagcaccgagaacguggaggugguguucggccuguaccugaaggagauggaccccagcagacagagcuacgugcuggugggcaagcuggacuuccccaaccagggcagccugagcgacggcggcggcuucccccugagcggccugcugauggugcugcugagcaccaucuucaugcacggcaacagagccaccgaggaggagaugugggagugccugaacgcccugggcauguacaagggcagaaagcacuucaucuacggcgagccccaggagcuggugaccaaggaccuggugagagagggcuaccuggaguaccagcaggugcccagcagcgacccccccagauacgaguuccuguggggccccagagccagagccgagaccagcaagaugaaggugcuggaguucguggccaagcugaacgacaccguggccagcaccuacaagagcagauacgaggaggcccugagagaggaggaggagcaggccagagccagagccguggccagagacagcgccagagccagagccagcagaagcuuccagcccuaa

SEQ ID NO: 19543 - RNA, 1044 nt, Artificial Sequence
  MAGEB1__Homo_sapiens__NP_803134
augcccagaggccagaagagcaagcugagagccagagagaagagaagaaaggccagagaggagacccagggccugaagguggcccacgccaccgccgccgagaaggaggagugccccagcagcagccccgugcugggcgacacccccaccagcagccccgccgccggcaucccccagaagccccagggcgccccccccaccaccaccgccgccgccgccgugagcugcaccgagagcgacgagggcgccaagugccagggcgaggagaacgccagcuucagccaggccaccaccagcaccgagagcagcgugaaggaccccguggccugggaggccggcaugcugaugcacuucauccugagaaaguacaagaugagagagcccaucaugaaggccgacaugcugaaggugguggacgagaaguacaaggaccacuucaccgagauccugaacggcgccagcagaagacuggagcugguguucggccuggaccugaaggaggacaaccccagcggccacaccuacacccuggugagcaagcugaaccugaccaacgacggcaaccugagcaacgacugggacuuccccagaaacggccugcugaugccccugcugggcgugaucuuccugaagggcaacagcgccaccgaggaggagaucuggaaguucaugaacgugcugggcgccuacgacggcgaggagcaccugaucuacggcgagcccagaaaguucaucacccaggaccuggugcaggagaaguaccugaaguacgagcaggugcccaacagcgacccccccagauaccaguuccuguggggccccagagccuacgccgagaccaccaagaugaaggugcuggaguuccuggccaagaugaacggcgccacccccagagacuuccccagccacuacgaggaggcccugagagacgaggaggagagagcccaggugagaagcagcgugagagccagaagaagaaccaccgccaccaccuucagagccagaagcagagcccccuucagcagaagcagccaccccauguaa

SEQ ID NO: 19544 - RNA, 960 nt, Artificial Sequence
  MAGEB2__Homo_sapiens__NP_002355
augcccagaggccagaagagcaagcugagagccagagagaagagaagaaaggccagagacgagaccagaggccugaacgugccccaggugaccgaggccgaggaggaggaggcccccugcugcagcagcagcgugagcggcggcgccgccagcagcagccccgccgccggcaucccccaggagccccagagagcccccaccaccgccgccgccgccgccgccggcgugagcagcaccaagagcaagaagggcgccaagagccaccagggcgagaagaacgccagcagcagccaggccagcaccagcaccaagagccccagcgaggacccccugaccagaaagagcggcagccuggugcaguuccugcuguacaaguacaagaucaagaagagcgugaccaagggcgagaugcugaagaucgugggcaagagauucagagagcacuuccccgagauccugaagaaggccagcgagggccugagcgugguguucggccuggagcugaacaaggugaaccccaacggccacaccuacaccuucaucgacaagguggaccugaccgacgaggagagccugcugagcagcugggacuuccccagaagaaagcugcugaugccccugcugggcgugaucuuccugaacggcaacagcgccaccgaggaggagaucugggaguuccugaacaugcugggcguguacgacggcgaggagcacagcguguucggcgagcccuggaagcugaucaccaaggaccuggugcaggagaaguaccuggaguacaagcaggugcccagcagcgacccccccagauuccaguuccuguggggccccagagccuacgccgagaccagcaagaugaaggugcuggaguuccuggccaaggugaacggcaccacccccugcgccuuccccacccacuacgaggaggcccugaaggacgaggagaaggccggcguguaa

SEQ ID NO: 19545 - RNA, 1224 nt, Artificial Sequence
  MAGEB6__Homo_sapiens__NP_775794
augcccagaggccacaagagcaagcugagaaccugcgagaagagacaggagaccaacggccagccccagggccugaccggcccccaggccaccgccgagaagcaggaggagagccacagcagcagcagcagcagcagagccugccugggcgacugcagaagaagcagcgacgccagcaucccccaggagagccagggcgugagccccaccggcagccccgacgccguggugagcuacagcaagagcgacguggccgccaacggccaggacgagaagagccccagcaccagcagagacgccagcgugccccaggagagccagggcgccagccccaccggcagccccgacgccggcgugagcggcagcaaguacgacguggccgccaacggccaggacgagaagagccccagcaccagccacgacgugagcgugccccaggagagccagggcgccagccccaccggcagccccgacgccggcgugagcggcagcaaguacgacguggccgccgagggcgaggacgaggagagcgugagcgccagccagaaggccaucaucuucaagagacugagcaaggacgccgugaagaagaaggccugcacccuggcccaguuccugcagaagaaguucgagaagaaggagagcauccugaaggccgacaugcugaagugcgugagaagagaguacaagcccuacuucccccagauccugaacagaaccagccagcaccuggugguggccuucggcguggagcugaaggagauggacagcagcggcgagagcuacacccuggugagcaagcugggccugcccagcgagggcauccugagcggcgacaacgcccugcccaagagcggccugcugaugagccugcugguggugaucuucaugaacggcaacugcgccaccgaggaggaggugugggaguuccugggccugcugggcaucuacgacggcauccugcacagcaucuacggcgacgccagaaagaucaucaccgaggaccuggugcaggacaaguacgugguguacagacaggugugcaacagcgacccccccugcuacgaguuccuguggggccccagagccuacgccgagaccaccaagaugagagugcugagagugcuggccgacagcagcaacaccagccccggccuguacccccaccuguacgaggacgcccugaucgacgagguggagagagcccugagacugagagccuaa

SEQ ID NO: 19546 - RNA, 3429 nt, Artificial Sequence
  MAGEC1__Homo_sapiens__NP_005453
augggcgacaaggacaugcccaccgccggcaugcccagccugcugcagagcagcagcgagagcccccagagcugccccgagggcgaggacagccagagcccccugcagaucccccagagcagccccgagagcgacgacacccuguacccccugcagagcccccagagcagaagcgagggcgaggacagcagcgacccccugcagagaccccccgagggcaaggacagccagagcccccugcagaucccccagagcagccccgagggcgacgacacccagagcccccugcagaacagccagagcagccccgagggcaaggacagccugagcccccuggagaucagccagagcccccccgagggcgaggacgugcagagcccccugcagaaccccgccagcagcuucuucagcagcgcccugcugagcaucuuccagagcagccccgagagcacccagagccccuucgagggcuucccccagagcgugcugcagauccccgugagcgccgccagcagcagcacccuggugagcaucuuccagagcagccccgagagcacccagagccccuucgagggcuucccccagagcccccugcagauccccgugagcagaagcuucagcagcacccugcugagcaucuuccagagcagccccgagagaacccagagcaccuucgagggcuucgcccagagcccccugcagauccccgugagccccagcagcagcagcacccugcugagccuguuccagagcuucagcgagagaacccagagcaccuucgagggcuucgcccagagcagccugcagauccccgugagccccagcuucagcagcacccuggugagccuguuccagagcagccccgagagaacccagagcaccuucgagggcuucccccagagcccccugcagauccccgugagcagcagcagcagcagcacccugcugagccuguuccagagcagccccgagagaacccacagcaccuucgagggcuucccccagagccugcugcagauccccaugaccagcagcuucagcagcacccugcugagcaucuuccagagcagccccgagagcgcccagagcaccuucgagggcuucccccagagcccccugcagauccccggcagccccagcuucagcagcacccugcugagccuguuccagagcagccccgagagaacccacagcaccuucgagggcuucccccagagcccccugcagauccccaugaccagcagcuucagcagcacccugcugagcauccugcagagcagccccgagagcgcccagagcgccuucgagggcuucccccagagcccccugcagauccccgugagcagcagcuucagcuacacccugcugagccuguuccagagcagccccgagagaacccacagcaccuucgagggcuucccccagagcccccugcagauccccgugagcagcagcagcagcagcagcacccugcugagccuguuccagagcagccccgagugcacccagagcaccuucgagggcuucccccagagcccccugcagaucccccagagcccccccgagggcgagaacacccacagcccccugcagaucgugcccagccugcccgagugggaggacagccugagcccccacuacuucccccagagccccccccagggcgaggacagccugagcccccacuacuucccccagagccccccccagggcgaggacagccugagcccccacuacuucccccagagcccccagggcgaggacagccugagcccccacuacuucccccagagccccccccagggcgaggacagcaugagcccccuguacuucccccagagcccccugcagggcgaggaguuccagagcagccugcagagccccgugagcaucugcagcagcagcacccccagcagccugccccagagcuuccccgagagcagccagagcccccccgagggccccgugcagagcccccugcacagcccccagagcccccccgagggcaugcacagccagagcccccugcagagccccgagagcgcccccgagggcgaggacagccugagcccccugcagaucccccagagcccccuggagggcgaggacagccugagcagccugcacuucccccagagcccccccgagugggaggacagccugagcccccugcacuucccccaguuccccccccagggcgaggacuuccagagcagccugcagagccccgugagcaucugcagcagcagcaccagccugagccugccccagagcuuccccgagagcccccagagcccccccgagggccccgcccagagcccccugcagagacccgugagcagcuucuucagcuacacccuggccagccugcugcagagcagccacgagagcccccagagcccccccgagggccccgcccagagcccccugcagagccccgugagcagcuuccccagcagcaccagcagcagccugagccagagcagccccgugagcagcuuccccagcagcaccagcagcagccugagcaagagcagccccgagagcccccugcagagccccgugaucagcuucagcagcagcaccagccugagccccuucagcgaggagagcagcagccccguggacgaguacaccagcagcagcgacacccugcuggagagcgacagccugaccgacagcgagagccugaucgagagcgagccccuguucaccuacacccuggacgagaagguggacgagcuggccagauuccugcugcugaaguaccaggugaagcagcccaucaccaaggccgagaugcugaccaacgugaucagcagauacaccggcuacuuccccgugaucuucagaaaggccagagaguucaucgagauccuguucggcaucagccugagagagguggaccccgacgacagcuacguguucgugaacacccuggaccugaccagcgagggcugccugagcgacgagcagggcaugagccagaacagacugcugauccugauccugagcaucaucuucaucaagggcaccuacgccagcgaggaggugaucugggacgugcugagcggcaucggcgugagagccggcagagagcacuucgccuucggcgagcccagagagcugcugaccaaggugugggugcaggagcacuaccuggaguacagagaggugcccaacagcagcccccccagauacgaguuccuguggggccccagagcccacagcgaggugaucaagagaaaggugguggaguuccuggccaugcugaagaacaccgugcccaucaccuuccccagcagcuacaaggacgcccugaaggacguggaggagagagcccaggccaucaucgacaccaccgacgacagcaccgccaccgagagcgccagcagcagcgugaugagccccagcuucagcagcgaguaa

SEQ ID NO: 19547 - RNA, 1122 nt, Artificial Sequence
  MAGEC2__Homo_sapiens__NP_057333
augccccccgugcccggcgugcccuucagaaacguggacaacgacagccccaccagcguggagcuggaggacuggguggacgcccagcaccccaccgacgaggaggaggaggaggccagcagcgccagcagcacccuguaccugguguucagccccagcagcuucagcaccagcagcagccugauccugggcggccccgaggaggaggaggugcccagcggcgugauccccaaccugaccgagagcauccccagcagccccccccagggccccccccagggccccagccagagcccccugagcagcugcugcagcagcuucagcuggagcagcuucagcgaggagagcagcagccagaagggcgaggacaccggcaccugccagggccugcccgacagcgagagcagcuucaccuacacccuggacgagaagguggccgagcugguggaguuccugcugcugaaguacgaggccgaggagcccgugaccgaggccgagaugcugaugaucgugaucaaguacaaggacuacuuccccgugauccugaagagagccagagaguucauggagcugcuguucggccuggcccugaucgaggugggccccgaccacuucugcguguucgccaacaccgugggccugaccgacgagggcagcgacgacgagggcaugcccgagaacagccugcugaucaucauccugagcgugaucuucaucaagggcaacugcgccagcgaggaggugaucugggaggugcugaacgccgugggcguguacgccggcagagagcacuucguguacggcgagcccagagagcugcugaccaaggugugggugcagggccacuaccuggaguacagagaggugccccacagcagcccccccuacuacgaguuccuguggggccccagagcccacagcgagagcaucaagaagaaggugcuggaguuccuggccaagcugaacaacaccgugcccagcagcuuccccagcugguacaaggacgcccugaaggacguggaggagagagugcaggccaccaucgacaccgccgacgacgccaccgugauggccagcgagagccugagcgugaugagcagcaacgugagcuucagcgaguaa

SEQ ID NO: 19548 - RNA, 1932 nt, Artificial Sequence
  MAGEC3__Homo_sapiens__NP_619647
augcugcugcccugccacugggugcuggacgccaccuucagcgacggcagccugggccagugggugaagaacaccugcgccaccuacgcccugagccccguggugcugcccccccagccccagcccagaaagaaggccaccgacaaggacuacagcgccuuccaccugggccaccugagagaggugagacuguuccugagaggcggcaccagcgaccagagaauggacagccuggugcugugccccaccuacuucaagcuguggagaacccugagcggcagccccggccugcagcugagcgaccugcacuucggcagccagcccgagggcaaguucagccugagaagagccgugagcgugaagcagagagaggagccccaggacuggccccugaacgagaagagaacccuguggaaggacagcgaccugcccaccuggagaagaggcaccggcuacacccugagccugcccgccgugagccccggcaagagacuguggggcgagaaggccggcagccugcccgagagcgagccccuguucaccuacacccuggacgagaagguggacaagcuggugcaguuccugcugcugaaguaccaggccaaggagccccugaccagagccgagaugcagaugaacgugaucaacaccuacaccggcuacuuccccaugaucuucagaaaggccagagaguucaucgagauccuguucggcaucagccugaccgagguggaccccgaccacuucuacguguucgugaacacccuggaccugaccugcgagggcagccugagcgacgagcagggcaugccccagaacagacugcugauccugauccugagcgugaucuucaucaagggcaacugcgccagcgaggaggugaucugggaggugcugaacgccaucggccccuggagcgcccuggccggcuucgccgacgugcugagcagacuggcccugugggagagcgagggccccgaggccuucugcgaggagagcggccugagaagcgccgagggcagcgugcuggaccuggccaacccccagggccuggccggccacagacaggaggacggcagaagaggccugaccgaggccagcccccagcagaagaagggcggcgaggacgaggacaugcccgccgccggcaugcccccccugccccagagcccccccgagauccccccccagggcccccccaagaucagcccccagggccccccccagagccccccccagagcccccuggacagcugcagcagcccccugcuguggaccagacuggacgaggagagcagcagcgaggaggaggacaccgccaccuggcacgcccugcccgagagcgagagccugcccagauacgcccuggacgagaagguggccgagcuggugcaguuccugcugcugaaguaccagaccaaggagcccgugaccaaggccgagaugcugaccaccgugaucaagaaguacaaggacuacuuccccaugaucuucggcaaggcccacgaguucaucgagcugaucuucggcaucgcccugaccgacauggaccccgacaaccacagcuacuucuucgaggacacccuggaccugaccuacgagggcagccugaucgacgaccagggcaugcccaagaacugccugcugauccugauccugagcaugaucuucaucaagggcagcugcgugcccgaggaggugaucugggaggugcugagcgccaucggccccauccagagacccgccagagaggugcuggaguuccugagcaagcugagcagcaucauccccagcgccuuccccagcugguacauggacgcccugaaggacauggaggacagagcccaggccaucaucgacaccaccgacgacgccaccgccauggccagcgccagccccagcgugaugagcaccaacuucugccccgaguaa

SEQ ID NO: 19549 - RNA, 2337 nt, Artificial Sequence
  MAGED1__Homo_sapiens__NP_001005332
auggcccagaagauggacugcggcgccggccugcugggcuuccaggccgaggccagcguggaggacagcgcccugcugaugcagacccugauggaggccauccagaucagcgaggccccccccaccaaccaggccaccgccgccgccagcccccagagcagccagccccccaccgccaacgagauggccgacauccaggugagcgccgccgccgccagacccaagagcgccuucaaggugcagaacgccaccaccaagggccccaacggcguguacgacuucagccaggcccacaacgccaaggacgugcccaacacccagcccaaggccgccuucaagagccagaacgccacccccaagggccccaacgccgccuacgacuucagccaggccgccaccaccggcgagcuggccgccaacaagagcgagauggccuucaaggcccagaacgccaccaccaaggugggccccaacgccaccuacaacuucagccagagccugaacgccaacgaccuggccaacagcagacccaagacccccuucaaggccuggaacgacaccaccaaggcccccaccgccgacacccagacccagaacgugaaccaggccaagauggccaccagccaggccgacaucgagaccgaccccggcaucagcgagcccgacggcgccaccgcccagaccagcgccgacggcagccaggcccagaaccuggagagcagaaccaucaucagaggcaagagaaccagaaagaucaacaaccugaacguggaggagaacagcagcggcgaccagagaagagccccccuggccgccggcaccuggagaagcgcccccgugcccgugaccacccagaacccccccggcgccccccccaacgugcuguggcagaccccccuggccuggcagaaccccagcggcuggcagaaccagaccgccagacagaccccccccgccagacagagcccccccgccagacagaccccccccgccuggcagaaccccguggccuggcagaaccccgugaucuggcccaaccccgugaucuggcagaaccccgugaucuggcccaaccccaucguguggcccggccccgugguguggcccaacccccuggccuggcagaacccccccggcuggcagaccccccccggcuggcagaccccccccggcuggcagggcccccccgacuggcagggcccccccgacuggccccugccccccgacuggccccugccccccgacuggccccugcccaccgacuggccccugccccccgacuggauccccgccgacuggcccaucccccccgacuggcagaaccugagacccagccccaaccugagacccagccccaacagcagagccagccagaaccccggcgccgcccagcccagagacguggcccugcugcaggagagagccaacaagcuggugaaguaccugaugcugaaggacuacaccaaggugcccaucaagagaagcgagaugcugagagacaucaucagagaguacaccgacguguaccccgagaucaucgagagagccugcuucgugcuggagaagaaguucggcauccagcugaaggagaucgacaaggaggagcaccuguacauccugaucagcacccccgagagccuggccggcauccugggcaccaccaaggacacccccaagcugggccugcugcuggugauccugggcgugaucuucaugaacggcaacagagccagcgaggccgugcugugggaggcccugagaaagaugggccugagacccggcgugagacacccccugcugggcgaccugagaaagcugcugaccuacgaguucgugaagcagaaguaccuggacuacagaagagugcccaacagcaacccccccgaguacgaguuccuguggggccugagaagcuaccacgagaccagcaagaugaaggugcugagauucaucgccgaggugcagaagagagaccccagagacuggaccgcccaguucauggaggccgccgacgaggcccuggacgcccuggacgccgccgccgccgaggccgaggccagagccgaggccagaaccagaaugggcaucggcgacgaggccgugagcggccccuggagcugggacgacaucgaguucgagcugcugaccugggacgaggagggcgacuucggcgaccccuggagcagaauccccuucaccuucugggccagauaccaccagaacgccagaagcagauucccccagaccuucgccggccccaucaucggccccggcggcaccgccagcgccaacuucgccgccaacuucggcgccaucggcuucuucuggguggaguaa

SEQ ID NO: 19550 - RNA, 1821 nt, Artificial Sequence
  MAGED2__Homo_sapiens__NP_055414
augagcgacaccagcgagagcggcgccggccugaccagauuccaggccgaggccagcgagaaggacagcagcagcaugaugcagacccugcugaccgugacccagaacguggaggugcccgagacccccaaggccagcaaggcccuggaggugagcgaggacgugaaggugagcaaggccagcggcgugagcaaggccaccgaggugagcaagacccccgaggccagagaggcccccgccacccaggccagcagcaccacccagcugaccgacacccaggugcuggccgccgagaacaagagccuggccgccgacaccaagaagcagaacgccgacccccaggccgugaccaugcccgccaccgagaccaagaaggugagccacguggccgacaccaaggugaacaccaaggcccaggagaccgaggccgcccccagccaggcccccgccgacgagcccgagcccgagagcgccgccgcccagagccaggagaaccaggacaccagacccaaggugaaggccaagaaggccagaaaggugaagcaccuggacggcgaggaggacggcagcagcgaccagagccaggccagcggcaccaccggcggcagaagagugagcaaggcccugauggccagcauggccagaagagccagcagaggccccaucgccuucugggccagaagagccagcagaaccagacuggccgccugggccagaagagcccugcugagccugagaagccccaaggccagaagaggcaaggccagaagaagagccgccaagcugcagagcagccaggagcccgaggcccccccccccagagacguggcccugcugcagggcagagccaacgaccuggugaaguaccugcuggccaaggaccagaccaagauccccaucaagagaagcgacaugcugaaggacaucaucaaggaguacaccgacguguaccccgagaucaucgagagagccggcuacagccuggagaagguguucggcauccagcugaaggagaucgacaagaacgaccaccuguacauccugcugagcacccuggagcccaccgacgccggcauccugggcaccaccaaggacagccccaagcugggccugcugauggugcugcugagcaucaucuucaugaacggcaacagaagcagcgaggccgugaucugggaggugcugagaaagcugggccugagacccggcauccaccacagccuguucggcgacgugaagaagcugaucaccgacgaguucgugaagcagaaguaccuggacuacgccagagugcccaacagcaacccccccgaguacgaguucuucuggggccugagaagcuacuacgagaccagcaagaugaaggugcugaaguucgccugcaaggugcagaagaaggaccccaaggagugggccgcccaguacagagaggccauggaggccgaccugaaggccgccgccgaggccgccgccgaggccaaggccagagccgagaucagagccagaaugggcaucggccugggcagcgagaacgccgccggccccugcaacugggacgaggccgacaucggccccugggccaaggccagaauccaggccggcgccgaggccaaggccaaggcccaggagagcggcagcgccagcaccggcgccagcaccagcaccaacaacagcgccagcgccagcgccagcaccagcggcggcuucagcgccggcgccagccugaccgccacccugaccuucggccuguucgccggccugggcggcgccggcgccagcaccagcggcagcagcggcgccugcggcuucagcuacaaguaa

SEQ ID NO: 19551 - RNA, 2226 nt, Artificial Sequence
  MAGED4B__Homo_sapiens__NP_110428
auggccgagggcagcuucagcgugcagagcgagagcuacagcguggaggacauggacgagggcagcgacgaggugggcgaggaggagaugguggagggcaacgacuacgaggaguucggcgccuucggcggcuacggcacccugaccagcuucgacauccacauccugagagccuucggcagccugggccccggccugagaauccugagcaacgagcccugggagcuggagaaccccgugcuggcccagacccugguggaggcccugcagcuggaccccgagacccuggccaacgagaccgccgccagagccgccaacguggccagagccgccgccagcaacagagccgccagagccgccgccgccgccgccagaaccgccuucagccaggugguggccagccacagaguggccaccccccaggugagcggcgaggacacccagcccaccaccuacgccgccgaggcccagggccccacccccgagcccccccuggccagcccccagaccagccagaugcuggugaccagcaagauggccgcccccgaggcccccgccaccagcgcccagagccagaccggcagccccgcccaggaggccgccaccgagggccccagcagcgccugcgccuucagccaggcccccugcgccagagagguggacgccaacagacccagcaccgccuuccugggccagaacgacguguucgacuucacccagcccgccggcgugagcggcauggccuuccccagacccaagagacccgcccccgcccaggaggccgccaccgagggccccagcgccgccagcggcgugccccagaccggccccggcagagagguggccgccaccagacccaagaccaccaagagcggcaaggcccuggccaagaccagauggguggagccccagaacgugguggccgccgccgccgccaaggccaagauggccaccagcauccccgagcccgagggcgccgccgccgccaccgcccagcacagcgccgagcccugggccagaaugggcggcaagagaaccaagaagagcaagcaccuggacgacgaguacgagagcagcgaggaggagagagagacccccgccgugccccccaccuggagagccagccagcccagccugaccgugagagcccagcuggcccccagaccccccauggcccccagaagccagauccccagcagacacgugcugugccugccccccagaaacgugacccugcugcaggagagagccaacaagcuggugaaguaccugaugaucaaggacuacaagaagauccccaucaagagagccgacaugcugaaggacgugaucagagaguacgacgagcacuuccccgagaucaucgagagagccaccuacacccuggagaagaaguucggcauccaccugaaggagaucgacaaggaggagcaccuguacauccuggugugcaccagagacagcagcgccagacugcugggcaagaccaaggacacccccagacugagccugcugcuggugauccugggcgugaucuucaugaacggcaacagagccagcgaggccgugcugugggaggcccugagaaagaugggccugagacccggcgugagacaccccuuccugggcgaccugagaaagcugaucaccgacgacuucgugaagcagaaguaccuggaguacaagaagauccccaacagcaacccccccgaguacgaguuccuguggggccugagagccagacacgagaccagcaagaugagagugcugagauucaucgcccagaaccagaacagagaccccagagaguggaaggcccacuuccuggaggccguggacgacgccuucaagaccauggacguggacauggccgaggagcacgccagagcccagaugagagcccagaugaacaucggcgacgaggcccugaucggcagauggagcugggacgacauccagguggagcugcugaccugggacgaggacggcgacuucggcgacgccugggccagaauccccuucgccuucugggccagauaccaccaguacauccugaacagcaacagagccaacagaagagccaccuggagagccggcgugagcagcggcaccaacggcggcgccagcaccagcgugcuggacggccccagcaccagcagcaccaucagaaccagaaacgccgccagagccggcgccagcuucuucagcuggauccagcacagauaa

SEQ ID NO: 19552 - RNA, 2220 nt, Artificial Sequence
  MAGED4__Homo_sapiens__NP_001092270
auggccgagggcagcuucagcgugcagagcgagagcuacagcguggaggacauggacgagggcagcgacgaggugggcgaggaggagaugguggagggcaacgacuacgaggaguucggcgccuucggcggcuacggcacccugaccagcuucgacauccacauccugagagccuucggcagccugggccccggccugagaauccugagcaacgagcccugggagcuggagaaccccgugcuggcccagacccugguggaggcccugcagcuggaccccgagacccuggccaacgagaccgccgccagagccgccaacguggccagagccgccgccagcaacagagccgccagagccgccgccgccgccgccagaaccgccuucagccaggugguggccagccacagaguggccaccccccaggugagcggcgaggacacccagcccaccaccuacgccgccgaggcccagggccccacccccgagcccccccuggccagcccccagaccagccagaugcuggugaccagcaagauggccgcccccgaggcccccgccaccagcgcccagagccagaccggcagccccgcccaggaggccgccaccgagggccccagcagcgccugcgccuucagccaggcccccugcgccagagagguggacgccaacagacccagcaccgccuuccugggccagaacgacguguucgacuucacccagcccgccggcgugagcggcauggccuuccccagacccaagagacccgcccccgcccaggaggccgccaccgagggccccagcgccgccagcggcgugccccagaccggccccggcagagagguggccgccaccagacccaagaccaccaagagcggcaaggcccuggccaagaccagauggguggagccccagaacgugguggccgccgccgccgccaaggccaagauggccaccagcauccccgagcccgagggcgccgccgccgccaccgcccagcacagcgccgagcccugggccagaaugggcggcaagagaaccaagaagagcaagcaccuggacgacgaguacgagagcagcgaggaggagagagagacccccgccgugccccccaccuggagagccagccagcccagccugaccgugagagcccagcuggcccccagaccccccauggcccccagaagccagauccccagcagacacgugcugugccugccccccagaaacgugacccugcugcaggagagagccaacaagcuggugaaguaccugaugaucaaggacuacaagaagauccccaucaagagagccgacaugcugaaggacgugaucagagaguacgacgagcacuuccccgagaucaucgagagagccaccuacacccuggagaagaaguucggcauccaccugaaggagaucgacaaggaggagcaccuguacauccuggugugcaccagagacagcagcgccagacugcugggcaagaccaaggacacccccagacugagccugcugcuggugauccugggcgugaucuucaugaacggcaacagagccagcgaggccgugcugugggaggcccugagaaagaugggccugagacccggcgugagacaccccuuccugggcgaccugagaaagcugaucaccgacgacuucgugaagcagaaguaccuggaguacaagaagauccccaacagcaacccccccgaguacgaguuccuguggggccugagagccagacacgagaccagcaagaugagagugcugagauucaucgcccagaaccagaacagagaccccagagaguggaaggcccacuuccuggaggccguggacgacgccuucaagaccauggacguggacauggccgaggagcacgccagagcccagaugagagcccagaugaacaucggcgacgaggcccugaucggcagauggagcugggacgacauccagguggagcugcugaccugggacgaggacggcgacuucggcgacgccugggccagaauccccuucgccuucugggccagauaccaccaguacauccugaacagcaacagagccaacagaagagccaccuggagagccggcgugagcagcggcaccaacggcggcgccagcaccagcgugcuggacggccccagcaccagcagcaccaucagaaccagaaacgccgccagagccggcgccagcuucuucagcuggauccaguaa

SEQ ID NO: 19553 - RNA, 2874 nt, Artificial Sequence
  MAGEE1__Homo_sapiens__NP_065983
augagccuggugagccagaacagcagaagaagaagaagaagaguggccaaggccaccgcccacaacagcagcuggggcgagaugcaggcccccaacgcccccggccugcccgccgacgugcccggcagcgacgugccccagggccccagcgacagccagauccugcagggccugugcgccagcgagggccccagcaccagcgugcugcccaccagcgccgagggccccagcaccuucgugccccccaccaucagcgaggccagcagcgccagcggccagcccaccaucagcgagggccccggcaccagcgugcugcccacccccagcgagggccugagcaccagcggcccccccaccaucagcaagggccugugcaccagcgugacccuggccgccagcgagggcagaaacaccagcagaccccccaccagcagcgaggagcccagcaccagcgugccccccaccgccagcgaggugcccagcaccagccugccccccacccccggcgagggcaccagcaccagcgugccccccaccgccuacgagggccccagcaccagcguggugcccacccccgacgagggccccagcaccagcgugcugcccacccccggcgagggccccggcaccagcgugccccuggccgccaccgagggccugagcaccagcgugcaggccacccccgacgagggccccagcaccagcgugccccccaccgccaccgagggccugagcacccccgugccccccaccagagacgagggccccagcaccagcgugcccgccacccccggcgagggccccagcaccagcgugcugcccgccgccagcgacggccagagcaucagccuggugcccaccagaggcaagggcagcagcaccagcgugccccccaccgccaccgagggccugagcaccagcgugcagcccaccgccggcgagggcagcagcaccagcgugccccccacccccggcggcggccugagcaccagcgugccccccaccgccaccgaggagcugagcaccagcgugccccccacccccggcgagggccccagcaccagcgugcugcccauccccggcgagggccugagcaccagcgugccccccaccgccagcgacggcagcgacaccagcgugccccccacccccggcgagggcgccagcacccuggugcagcccaccgcccccgacggccccggcagcagcgugcugcccaaccccggcgagggccccagcacccuguucagcagcagcgccagcguggacagaaaccccagcaagugcagccuggugcugcccagccccagagugaccaaggccagcguggacagcgacagcgagggccccaagggcgccgagggccccaucgaguucgaggugcugagagacugcgagagccccaacagcaucagcaucaugggccugaacaccagcagaguggccaucacccugaagccccaggaccccauggagcagaacguggccgagcugcugcaguuccugcuggugaaggaccagagcaaguaccccaucagagagagcgagaugagagaguacaucgugaaggaguacagaaaccaguuccccgagauccugagaagagccgccgcccaccuggagugcaucuucagauucgagcugagagagcuggaccccgaggcccacaccuacauccugcugaacaagcugggccccgugcccuucgagggccuggaggagagccccaacggccccaagaugggccugcugaugaugauccugggccagaucuuccugaacggcaaccaggccaaggaggccgagaucugggagaugcuguggagaaugggcgugcagagagagagaagacugagcaucuucggcaaccccaagagacugcugagcguggaguucguguggcagagauaccuggacuacagacccgugaccgacugcaagcccguggaguacgaguucuucuggggccccagaagccaccuggagaccaccaagaugaagauccugaaguucauggccaagaucuacaacaaggaccccauggacuggcccgagaaguacaacgaggcccuggaggaggacgccgccagagccuucgccgagggcuggcaggcccugccccacuucagaagacccuucuucgaggaggccgccgccgaggugcccagccccgacagcgaggugagcagcuacagcagcaaguacgccccccacagcuggcccgagagcagacuggagagcaaggccagaaagcuggugcagcuguuccugcugauggacagcaccaagcugcccauccccaagaagggcauccuguacuacaucggcagagagugcagcaagguguuccccgaccugcugaacagagccgccagaacccugaaccacguguacggcaccgagcugguggugcuggaccccagaaaccacagcuacacccuguacaacagaagagagauggaggagaccgaggagaucguggacagccccaacagacccggcaacaacuuccugaugcaggugcugagcuucaucuucaucaugggcaaccacgccagagagagcgccgugugggccuuccugagaggccugggcgugcaggccggcagaaagcacgugaucaccugcagauaccugagccagagauacaucgacagccugagagugcccgacagcgaccccgugcaguacgaguucguguggggccccagagccagacuggagaccagcaagaugaaggcccugagauacguggccagaauccacagaaaggagccccaggacuggccccagcaguacagagaggccauggaggacgaggccaacagagccgacgugggccacagacagaucuucgugcacaacuucagauaa

SEQ ID NO: 19554 - RNA, 660 nt, Artificial Sequence
  MAGEH1__Homo_sapiens__NP_054780
augcccagaggcagaaagagcagaagaagaagaaacgccagagccgccgaggagaacagaaacaacagaaagauccaggccagcgaggccagcgagacccccauggccgccagcgugguggccagcacccccgaggacgaccugagcggccccgaggaggaccccagcacccccgaggaggccagcaccacccccgaggaggccagcagcaccgcccaggcccagaagcccagcgugcccagaagcaacuuccagggcaccaagaagagccugcugaugagcauccuggcccugaucuucaucaugggcaacagcgccaaggaggcccugguguggaaggugcugggcaagcugggcaugcagcccggcagacagcacagcaucuucggcgaccccaagaagaucgugaccgaggaguucgugagaagaggcuaccugaucuacaagcccgugcccagaagcagccccguggaguacgaguucuucuggggccccagagcccacguggagagcagcaagcugaaggugaugcacuucguggccagagugagaaacagaugcagcaaggacuggcccugcaacuacgacugggacagcgacgacgacgccgagguggaggccauccugaacagcggcgccagaggcuacagcgcccccuaa

SEQ ID NO: 19555 - RNA, 3750 nt, Artificial Sequence
  MAGEL2__Homo_sapiens__NP_061939
augagccagcugagcaagaaccugggcgacagcagcccccccgccgaggcccccaagccccccguguacagcagacccaccgugcugaugagagccccccccgccagcagcagagccccccccgugcccugggaccccccccccaucgaccugcaggccagccuggccgccuggcaggccccccagcccgccugggaggccccccagggccagcugcccgcccccguggugcccaugacccagccccccgcccugggcggccccaucgugcccgcccccccccugggcggccccaugggcaagccccccacccccggcgugcugauggugcacccccccccccccggcgcccccauggcccagccccccacccccggcgugcugauggugcaccccagcgcccccggcgcccccauggcccacccccccccccccggcacccccaugagccacccccccccccccggcacccccauggcccacccccccccccccggcacccccauggcccacccccccccccccggcacccccauggugcacccccccccccccggcacccccauggcccacccccccccccccggcacccccauggcccacccccccccccccggcacccccauggcccacccccccccccccggcacccccauggcccacccccccccccccggcacccccauggcccagccccccgcccccggcgugcugauggcccagccccugacccccggcgugcugauggugcagcccgccgcccccggcgcccccauggugcagcccccccccgccgccaugaugacccagccccagcccagcggcgcccccauggccaagccccccggccccggcgugcugaugauccacccccccggcgccagagcccccaugacccagccccccgccagcggcgcccccauggcccagcccgccgccccccccgcccagcccauggccccccccgcccagcccauggccagcugggccccccaggcccagccccugauccugcagauccagagccaggugaucagagcccccccccaggugccccagggcccccaggccccccccgcccagcuggccaccccccccggcuggcaggccaccagccccggcuggcaggccacccagcagggcuggcaggccaccccccugaccuggcagaccacccaggugaccuggcaggcccccgccgugaccuggcaggugcccccccccaugagacagggccccccccccaucagacccggccccccccccaucagacccggccccccccccgugagacaggcccccccccugaucagacaggccccccccgugaucagacaggccccccccgugaucagacaggccccccccgugaucagacaggcccccgccgugaucagacaggccccccccgugaucagacaggccccccccgugaucagacaggccccccccgugaucagacaggcccccccccugaucagacaggcccccccccccaucagacccgccccccaggugcuggccacccagcccccccuguggcaggcccugccccccccccccccccugagacaggccccccaggccagacugcccgccccccaggugcaggccgccccccaggugcccaccgccccccccgccacccaggugcccgccgccccccccgccggcccccaggugccccagcccgugcugcccgccccccugagcgccccccugagcgccccccaggccgugcacugccccagcaucaucuggcaggcccccaagggccagccccccgugccccacgagauccccaccagcauggaguuccaggaggugcagcagacccaggcccuggccuggcaggcccagaaggcccccacccacaucuggcagccccugcccgcccaggaggcccagagacaggcccccccccuggugcagcuggagcagcccuuccagggcgccccccccagccagaaggccgugcagauccagcugcccccccagcaggcccaggccagcggcccccaggccgaggugcccacccugccccugcagcccagcuggcaggccccccccgccgugcugcaggcccagcccggcccccccguggccgccgccaacuucccccugggcagcgccaagagccugaugacccccagcggcgagugcagagccagcagcaucgacagaagaggcagcagcaaggagagaagaaccagcagcaaggagagaagagcccccagcaaggacagaaugaucuucgccgccaccuucugcgcccccaaggccgugagcgccgccagagcccaccugcccgccgccuggaagaaccugcccgccacccccgagaccuucgcccccagcagcagcguguuccccgccaccagccaguuccagcccgccagccugaacgccuucaagggccccagcgccgccagcgagacccccaagagccugcccuacgcccugcaggaccccuucgccugcguggaggcccugcccgccgugcccugggugccccagcccaacaugaacgccagcaaggccagccaggccgugcccaccuuccugauggccaccgccgccgccccccaggccaccgccaccacccaggaggccagcaagaccagcguggagccccccagaagaagcggcaaggccaccagaaagaagaagcaccuggaggcccaggaggacagcagaggccacacccuggccuuccacgacuggcagggccccagacccugggagaaccugaaccugagcgacugggaggugcagagccccauccaggugagcggcgacugggagcaccccaacacccccagaggccugagcggcugggagggccccagcaccagcagaauccugagcggcugggagggccccagcgccagcugggcccugagcgccugggagggccccagcaccagcagagcccugggccugagcgagagccccggcagcagccugcccgugguggugagcgagguggccagcgugagccccggcagcagcgccacccaggacaacagcaagguggaggcccagccccugagcccccuggacgagagagccaacgcccuggugcaguuccugcuggugaaggaccaggccaaggugcccgugcagagaagcgagauggugaaggugauccugagagaguacaaggacgagugccuggacaucaucaacagagccaacaacaagcuggagugcgccuucggcuaccagcugaaggagaucgacaccaagaaccacgccuacaucaucaucaacaagcugggcuaccacaccggcaaccugguggccagcuaccuggacagacccaaguucggccugcugaugguggugcugagccugaucuucaugaagggcaacugcgugagagaggaccugaucuucaacuuccuguucaagcugggccuggacgugagagagaccaacggccuguucggcaacaccaagaagcugaucaccgagguguucgugagacagaaguaccuggaguacagaagaauccccuacaccgagcccgccgaguacgaguuccuguggggccccagagccuuccuggagaccagcaagaugcuggugcugagauuccuggccaagcugcacaagaaggacccccagagcuggcccuuccacuaccuggaggcccuggccgagugcgagugggaggacaccgacgaggacgagcccgacaccggcgacagcgcccacggccccaccagcagacccccccccagauaa

SEQ ID NO: 19556 - RNA, 1806 nt, Artificial Sequence
  MAG__Homo_sapiens__NP_001186145
augcccagcagcaucagcgccuucgagggcaccugcgugagcauccccugcagauucgacuuccccgacgagcugagacccgccguggugcacggcgugugguacuucaacagccccuaccccaagaacuacccccccgugguguucaagagcagaacccagguggugcacgagagcuuccagggcagaagcagacugcugggcgaccugggccugagaaacugcacccugcugcugagcaacgugagccccgagcugggcggcaaguacuacuucagaggcgaccugggcggcuacaaccaguacaccuucagcgagcacagcgugcuggacaucgugaacacccccaacaucguggugccccccgaggugguggccggcaccgagguggaggugagcugcauggugcccgacaacugccccgagcugagacccgagcugagcuggcugggccacgagggccugggcgagcccgccgugcugggcagacugagagaggacgagggcaccugggugcaggugagccugcugcacuucgugcccaccagagaggccaacggccacagacugggcugccaggccagcuuccccaacaccacccugcaguucgagggcuacgccagcauggacgugaaguacccccccgugaucguggagaugaacagcagcguggaggccaucgagggcagccacgugagccugcugugcggcgccgacagcaacccccccccccugcugaccuggaugagagacggcaccgugcugagagaggccguggccgagagccugcugcuggagcuggaggaggugacccccgccgaggacggcguguacgccugccuggccgagaacgccuacggccaggacaacagaaccgugggccugagcgugauguacgcccccuggaagcccaccgugaacggcaccaugguggccguggagggcgagaccgugagcauccugugcagcacccagagcaaccccgaccccauccugaccaucuucaaggagaagcagauccugagcaccgugaucuacgagagcgagcugcagcuggagcugcccgccgugagccccgaggacgacggcgaguacuggugcguggccgagaaccaguacggccagagagccaccgccuucaaccugagcguggaguucgcccccgugcugcugcuggagagccacugcgccgccgccagagacaccgugcagugccugugcguggugaagagcaaccccgagcccagcguggccuucgagcugcccagcagaaacgugaccgugaacgagagcgagagagaguucguguacagcgagagaagcggccuggugcugaccagcauccugacccugagaggccaggcccaggccccccccagagugaucugcaccgccagaaaccuguacggcgccaagagccuggagcugcccuuccagggcgcccacagacugaugugggccaagaucggccccgugggcgccgugguggccuucgccauccugaucgccaucgugugcuacaucacccagaccagaagaaagaagaacgugaccgagagccccagcuucagcgccggcgacaacccccccgugcuguucagcagcgacuucagaaucagcggcgcccccgagaaguacgagagcgagagaagacugggcagcgagagaagacugcugggccugagaggcgagccccccgagcuggaccugagcuacagccacagcgaccugggcaagagacccaccaaggacagcuacacccugaccgaggagcuggccgaguacgccgagaucagagugaaguaa

SEQ ID NO: 19557 - RNA, 4389 nt, Artificial Sequence
  MAGI1__Homo_sapiens__NP_001028229
augagcaaggugauccagaagaagaaccacuggaccagcagagugcacgagugcaccgugaagagaggcccccagggcgagcugggcgugaccgugcugggcggcgccgagcacggcgaguuccccuacgugggcgccguggccgccguggaggccgccggccugcccggcggcggcgagggccccagacugggcgagggcgagcugcugcuggaggugcagggcgugagagugagcggccugcccagauacgacgugcugggcgugaucgacagcugcaaggaggccgugaccuucaaggccgugagacagggcggcagacugaacaaggaccugagacacuuccugaaccagagauuccagaagggcagccccgaccacgagcugcagcagaccaucagagacaaccuguacagacacgccgugcccugcaccaccagaagccccagagagggcgaggugcccggcguggacuacaacuuccugaccgugaaggaguuccuggaccuggagcagagcggcacccugcuggaggugggcaccuacgagggcaacuacuacggcacccccaagccccccagccagcccgugagcggcaaggugaucaccaccgacgcccugcacagccugcagagcggcagcaagcagagcacccccaagagaaccaagagcuacaacgacaugcagaacgccggcaucgugcacgccgagaacgaggaggaggacgacgugcccgagaugaacagcagcuucaccgccgacagcggcgagcaggaggagcacacccugcaggagaccgcccugccccccgugaacagcagcaucaucgccgcccccaucaccgaccccagccagaaguucccccaguaccugccccugagcgccgaggacaaccugggcccccugcccgagaacugggagauggccuacaccgagaacggcgagguguacuucaucgaccacaacaccaagaccaccagcuggcuggaccccagaugccugaacaagcagcagaagccccuggaggagugcgaggacgacgagggcgugcacaccgaggagcuggacagcgagcuggagcugcccgccggcugggagaagaucgaggaccccguguacggcaucuacuacguggaccacaucaacagaaagacccaguacgagaaccccgugcuggaggccaagagaaagaagcagcuggagcagcagcagcagcagcagcagcagcagcagcagcagcagcagcagcagcagcagcagcagaccgaggaguggaccgaggaccacagcgcccuggugccccccgugauccccaaccacccccccagcaaccccgagcccgccagagaggugccccugcagggcaagcccuucuucaccagaaaccccagcgagcugaagggcaaguucauccacaccaagcugagaaagagcagcagaggcuucggcuucaccguggugggcggcgacgagcccgacgaguuccugcagaucaagagccuggugcuggacggccccgccgcccuggacggcaagauggagaccggcgacgugaucgugagcgugaacgacaccugcgugcugggccacacccacgcccagguggugaagaucuuccagagcauccccaucggcgccagcguggaccuggagcugugcagaggcuacccccugcccuucgaccccgacgaccccaacaccagccuggugaccagcguggccauccuggacaaggagcccaucaucgugaacggccaggagaccuacgacagccccgccagccacagcagcaagaccggcaaggugaacggcaugaaggacgccagacccagcagccccgccgacguggccagcaacagcagccacggcuaccccaacgacaccgugagccuggccagcagcaucgccacccagcccgagcugaucaccgugcacaucgugaagggccccaugggcuucggcuucaccaucgccgacagccccggcggcggcggccagagagugaagcagaucguggacagccccagaugcagaggccugaaggagggcgaccugaucguggaggugaacaagaagaacgugcaggcccugacccacaaccaggugguggacaugcugguggagugccccaagggcagcgaggugacccugcuggugcagagaggcggccugcccgugcccaagaagagccccaagagccagccccuggagagaaaggacagccagaacagcagccagcacagcgugagcagccacagaagccugcacaccgccagccccagccacagcacccaggugcugcccgaguucccccccgccgaggcccaggcccccgaccagaccgacagcagcggccagaagaagcccgaccccuucaagaucugggcccagagcagaagcauguacgagaacagacugcccgacuaccaggagcaggacaucuuccuguggagaaaggagaccggcuucggcuucagaauccugggcggcaacgagcccggcgagcccaucuacaucggccacaucgugccccugggcgccgccgacaccgacggcagacugagaagcggcgacgagcugaucugcguggacggcacccccgugaucggcaagagccaccagcugguggugcagcugaugcagcaggccgccaagcagggccacgugaaccugaccgugagaagaaaggugguguucgccgugcccaagaccgagaacgaggugcccagccccgccagcagccaccacagcagcaaccagcccgccagccugaccgaggagaagagaaccccccagggcagccagaacagccugaacaccgugagcagcggcagcggcagcaccagcggcaucggcagcggcggcggcggcggcagcggcguggugagcaccguggugcagcccuacgacguggagaucagaagaggcgagaacgagggcuucggcuucgugaucgugagcagcgugagcagacccgaggccggcaccaccuucggcaacgccugcguggccaugccccacaagaucggcagaaucaucgagggcagccccgccgacagaugcggcaagcugaaggugggcgacagaauccuggccgugaacggcugcagcaucaccaacaagagccacagcgacaucgugaaccugaucaaggaggccggcaacaccgugacccugagaaucauccccggcgacgagagcagcaacgccacccugcugaccaacgccgagaagaucgccaccaucaccaccacccacacccccagccagcagggcacccaggagaccagaaacaccaccaagcccaagcaggagagccaguucgaguucaaggccccccaggccacccaggagcaggacuucuacaccguggagcuggagagaggcgccaagggcuucggcuucagccugagaggcggcagagaguacaacauggaccuguacgugcugagacuggccgaggacggccccgccgagagaugcggcaagaugagaaucggcgacgagauccuggagaucaacggcgagaccaccaagaacaugaagcacagcagagccaucgagcugaucaagaacggcggcagaagagugagacuguuccugaagagaggcgacggcagcgugcccgaguacgaccccagcagcgacagacacggccccgccaccggcccccagggcgugcccgaggugagagccggccccgacagaagacagcaccccagccuggagagcagcuacccccccgaccugcacaagagcagcccccacggcgagaagagagcccacgccagagaccccaagggcagcagagaguacagcagacagcccaacgagcaccacaccuggaacggcaccagcagaaagcccgacagcggcgccugcagacccaaggacagagcccccgagggcagaagagacgcccaggccgagagagccgccgccgccaacggccccaagagaagaagccccgagaagagaagagagggcaccagaagcgccgacaacacccuggagagaagagagaagcacgagaagagaagagacgugagccccgagagaagaagagagagaagccccaccagaagaagagacggcagccccagcagaagaagaagaagccuggagagacugcuggagcagagaagaagccccgagagaagaagaggcggcagccccgagagaagagccaagagcaccgacagaagaagagccagaagccccgagagaagaagagagagaagccuggacaagagaaacagagaggacagagccagccacagagagagagaggaggccaaccugaagcaggacgccggcagaagcagcagacacccccccgagcagagaagaagacccuacaaggagugcagcaccgaccugagcaucuaa

SEQ ID NO: 19558 - RNA, 4326 nt, Artificial Sequence
  MAGI2__Homo_sapiens__NP_001288057
augagcaagagccugaagaagaagagccacuggaccagcaaggugcacgagagcgugaucggcagaaaccccgagggccagcugggcuucgagcugaagggcggcgccgagaacggccaguuccccuaccugggcgaggugaagcccggcaagguggccuacgagagcggcagcaagcuggugagcgaggagcugcugcuggaggugaacgagacccccguggccggccugaccaucagagacgugcuggccgugaucaagcacugcaaggacccccugagacugaagugcgugaagcagggcggcaucguggacaaggaccugagacacuaccugaaccugagauuccagaagggcagcguggaccacgagcugcagcagaucaucagagacaaccuguaccugagaaccgugcccugcaccaccagaccccacaaggagggcgaggugcccggcguggacuacaucuucaucaccguggaggacuucauggagcuggagaagagcggcgcccugcuggagagcggcaccuacgaggacaacuacuacggcacccccaagccccccgccgagcccgccccccugcugcugaacgugaccgaccagauccugcccggcgccacccccagcgccgagggcaagagaaagagaaacaagagcgugagcaacauggagaaggccagcaucgagccccccgaggaggaggaggaggagagacccguggugaacggcaacggcgugguggugacccccgagagcagcgagcacgaggacaagagcgccggcgccagcggcgagaugcccagccagcccuaccccgcccccguguacagccagcccgaggagcugaaggagcagauggacgacaccaagcccaccaagcccgaggacaacgaggagcccgacccccugcccgacaacugggagauggccuacaccgagaagggcgagguguacuucaucgaccacaacaccaagaccaccagcuggcuggaccccagacuggccaagaaggccaagccccccgaggagugcaaggagaacgagcugcccuacggcugggagaagaucgacgaccccaucuacggcaccuacuacguggaccacaucaacagaagaacccaguucgagaaccccgugcuggaggccaagagaaagcugcagcagcacaacaugccccacaccgagcugggcaccaagccccugcaggcccccggcuucagagagaagccccuguucaccagagacgccagccagcugaagggcaccuuccugagcaccacccugaagaagagcaacaugggcuucggcuucaccaucaucggcggcgacgagcccgacgaguuccugcaggugaagagcgugauccccgacggccccgccgcccaggacggcaagauggagaccggcgacgugaucguguacaucaacgaggugugcgugcugggccacacccacgccgacguggugaagcuguuccagagcgugcccaucggccagagcgugaaccuggugcugugcagaggcuacccccugcccuucgaccccgaggaccccgccaacagcauggugcccccccuggccaucauggagagacccccccccgugauggugaacggcagacacaacuacgagaccuaccuggaguacaucagcagaaccagccagagcgugcccgacaucaccgacagacccccccacagccugcacagcaugcccaccgacggccagcuggacggcaccuaccccccccccgugcacgacgacaacgugagcauggccagcagcggcgccacccaggccgagcugaugacccugaccaucgugaagggcgcccagggcuucggcuucaccaucgccgacagccccaccggccagagagugaagcagauccuggacauccagggcugccccggccugugcgagggcgaccugaucguggagaucaaccagcagaacgugcagaaccugagccacaccgaggugguggacauccugaaggacugccccaucggcagcgagaccagccugaucauccacagaggcggcuucuucagccccuggaagacccccaagcccaucauggacagaugggagaaccagggcagcccccagaccagccugagcgcccccgccaucccccagaaccugcccuucccccccgcccugcacagaagcagcuuccccgacagcaccgaggccuucgaccccagaaagcccgaccccuacgagcuguacgagaagagcagagccaucuacgagagcagaagacccgacuacaaggagcuggacgugcaccugagaagaauggagagcggcuucggcuucagaauccugggcggcgacgagcccggccagcccauccugaucggcgccgugaucgccaugggcagcgccgacagagacggcagacugcaccccggcgacgagcugguguacguggacggcauccccguggccggcaagacccacagauacgugaucgaccugaugcaccacgccgccagaaacggccaggugaaccugaccgugagaagaaaggugcugugcggcggcgagcccugccccgagaacggcagaagccccggcagcgugagcacccaccacagcagccccagaagcgacuacgccaccuacaccaacagcaaccacgccgcccccagcagcaacgccagcccccccgagggcuucgccagccacagccugcagaccagcgacguggugauccacagaaaggagaacgagggcuucggcuucgugaucaucagcagccugaacagacccgagagcggcagcaccaucaccgugccccacaagaucggcagaaucaucgacggcagccccgccgacagaugcgccaagcugaaggugggcgacagaauccuggccgugaacggccagagcaucaucaacaugccccacgccgacaucgugaagcugaucaaggacgccggccugagcgugacccugagaaucaucccccaggaggagcugaacagccccaccagcgcccccagcagcgagaagcagagccccauggcccagcagagcccccuggcccagcagagcccccuggcccagcccagccccgccacccccaacagccccaucgcccagcccgcccccccccagccccugcagcugcagggccacgagaacagcuacagaagcgaggugaaggccagacaggacgugaagcccgacaucagacagccccccuucaccgacuacagacagcccccccuggacuacagacagccccccggcggcgacuaccagcagccccccccccuggacuacagacagcccccccugcuggacuacagacagcacagccccgacaccagacaguacccccugagcgacuacagacagccccaggacuucgacuacuucaccguggacauggagaagggcgccaagggcuucggcuucagcaucagaggcggcagagaguacaagauggaccuguacgugcugagacuggccgaggacggccccgccaucagaaacggcagaaugagagugggcgaccagaucaucgagaucaacggcgagagcaccagagacaugacccacgccagagccaucgagcugaucaagagcggcggcagaagagugagacugcugcugaagagaggcaccggccaggugcccgaguacgacgagcccgcccccuggagcagccccgccgccgccgcccccggccugcccgaggugggcgugagccuggacgacggccuggcccccuucagccccagccaccccgccccccccagcgaccccagccaccagaucagccccggccccaccugggacaucaagagagagcacgacgugagaaagcccaaggagcugagcgccugcggccagaagaagcagagacugggcgagcagagagagagaagcgccagcccccagagagccgccagacccagacuggaggaggcccccggcggccagggcagacccgaggccggcagacccgccagcgaggccagagcccccggccuggccgccgccgacgccgccgacgccgccagagccggcggcaaggaggcccccagagccgccgccggcagcgagcugugcagaagagagggccccggcgccgcccccgccuucgccggccccggcggcggcggcagcggcgcccuggaggccgagggcagagccggcgccagagccggccccagacccggccccagaccccccggcggcgcccccgccagaaaggccgccguggcccccggccccuggaaggugcccggcagcgacaagcugcccagcgugcugaagcccggcgccagcgccgccagcagauaa

SEQ ID NO: 19559 - RNA, 3762 nt, Artificial Sequence
  MAGI3__Homo_sapiens__XP_011539510
auggagagaauggacagcagccugcccgaggaggaggaggacgaggacaaggaggccaucaacggcagcggcaacgccgagaacagagagagacacagcgagagcagcgacuggaugaagaccgugcccagcuacaaccagaccaacagcagcauggacuucagaaacuacaugaugagagacgagacccuggagccccugcccaagaacugggagauggccuacaccgacaccggcaugaucuacuucaucgaccacaacaccaagaccaccaccuggcuggaccccagacugugcaagaaggccaaggcccccgaggacugcgaggacggcgagcugcccuacggcugggagaagaucgaggacccccaguacggcaccuacuacguggaccaccugaaccagaagacccaguucgagaaccccguggaggaggccaagagaaagaagcagcugggccagguggagaucggcagcagcaagcccgacauggagaagagccacuucaccagagaccccagccagcugaagggcgugcuggugagagccagccugaagaagagcaccaugggcuucggcuucaccaucaucggcggcgacagacccgacgaguuccugcaggugaagaacgugcugaaggacggccccgccgcccaggacggcaagaucgcccccggcgacgugaucguggacaucaacggcaacugcgugcugggccacacccacgccgacguggugcagauguuccagcuggugcccgugaaccaguacgugaaccugacccugugcagaggcuacccccugcccgacgacagcgaggaccccgugguggacaucguggccgccacccccgugaucaacggccagagccugaccaagggcgagaccugcaugaacccccaggacuucaagcccggcgccauggugcuggagcagaacggcaagagcggccacacccugaccggcgacggccugaacggccccagcgacgccagcgagcagagagugagcauggccagcagcggcagcagccagcccgagcuggugaccaucccccugaucaagggccccaagggcuucggcuucgccaucgccgacagccccaccggccagaaggugaagaugauccuggacagccaguggugccagggccugcagaagggcgacaucaucaaggagaucuaccaccagaacgugcagaaccugacccaccugcaggugguggaggugcugaagcaguuccccgugggcgccgacgugccccugcugauccugagaggcggcccccccagccccaccaagaccgccaagaugaagaccgacaagaaggagaacgccggcagccuggaggccaucaacgagcccaucccccagcccaugcccuucccccccagcaucaucagaagcggcagccccaagcuggaccccagcgagguguaccugaagagcaagacccuguacgaggacaagccccccaacaccaaggaccuggacguguuccugagaaagcaggagagcggcuucggcuucagagugcugggcggcgacggccccgaccagagcaucuacaucggcgccaucaucccccugggcgccgccgagaaggacggcagacugagagccgccgacgagcugaugugcaucgacggcauccccgugaagggcaagagccacaagcaggugcuggaccugaugaccaccgccgccagaaacggccacgugcugcugaccgugagaagaaagaucuucuacggcgagaagcagcccgaggacgacagcagccaggccuucaucagcacccagaacggcagccccagacugaacagagccgaggugcccgccagacccgccccccaggagcccuacgacguggugcugcagagaaaggagaacgagggcuucggcuucgugauccugaccagcaagaacaagcccccccccggcgugaucccccacaagaucggcagagugaucgagggcagccccgccgacagaugcggcaagcugaaggugggcgaccacaucagcgccgugaacggccagagcaucguggagcugagccacgacaacaucgugcagcugaucaaggacgccggcgugaccgugacccugaccgugaucgccgaggaggagcaccacggcccccccagcggcaccaacagcgccagacagagccccgcccugcagcacagacccaugggccagagccaggccaaccacauccccggcgacagaagcgcccuggagggcgagaucggcaaggacgugagcaccagcuacagacacagcuggagcgaccacaagcaccuggcccagcccgacaccgccgugaucagcguggugggcagcagacacaaccagaaccugggcugcuaccccguggagcuggagagaggccccagaggcuucggcuucagccugagaggcggcaaggaguacaacaugggccuguucauccugagacuggccgaggacggccccgccaucaaggacggcagaauccacgugggcgaccagaucguggagaucaacggcgagcccacccagggcaucacccacaccagagccaucgagcugauccaggccggcggcaacaaggugcugcugcugcugagacccggcaccggccugauccccgaccacggcgacugggacaucaacaaccccagcagcagcaacgugaucuacgacgagcagagcccccugccccccagcagccacuucgccagcaucuucgaggagagccacgugcccgugaucgaggagagccugagagugcagaucugcgagaaggccgaggagcugaaggacaucgugcccgagaagaagagcacccugaacgagaaccagcccgagaucaagcaccagagccugcugcagaagaacgugagcaagagagacccccccagcagccacggccacagcaacaagaagaaccugcugaagguggagaacggcgugaccagaagaggcagaagcgugagccccaagaagcccgccagccagcacagcgaggagcaccuggacaagauccccagcccccugaagaacaaccccaagagaagacccagagaccagagccugagccccagcaagggcgagaacaagagcugccaggugagcaccagagccggcagcggccaggaccagugcagaaagagcagaggcagaagcgccagccccaagaagcagcagaagaucgagggcagcaaggcccccagcaacgccgaggccaagcugcuggagggcaagagcagaagaaucgccggcuacaccggcagcaacgccgagcagauccccgacggcaaggagaagagcgacgugaucagaaaggacgccaagcagaaccagcuggagaagagcagaaccagaagccccgagaagaagaucaagagaaugguggagaagagccugcccagcaagaugaccaacaagaccaccagcaaggaggugagcgagaacgagaagggcaagaaggugaccaccggcgagaccagcagcagcaacgacaagaucggcgagaacgugcagcugagcgagaagagacugaagcaggagcccgaggagaagguggugagcaacaagaccgaggaccacaagggcaaggagcuggaggccgccgacaagaacaaggagaccggcagauucaagcccgagagcagcagccccgugaagaagacccugaucacccccggccccuggaaggugcccagcggcaacaaggugaccggcaccaucggcauggccgagaagagacaguaa

SEQ ID NO: 19560 - RNA, 1104 nt, Artificial Sequence
  MAGT1__Homo_sapiens__NP_115497
augagaaagggcaagggccccaucugccuguucagcagacccacccugagacccagcagaagcaaggugagccugaucgagggcagaggcgccaacauggccgccagauggagauucuggugcgugagcgugaccauggugguggcccugcugaucgugugcgacgugcccagcgccagcgcccagagaaagaaggagauggugcugagcgagaaggugagccagcugauggaguggaccaacaagagacccgugaucagaaugaacggcgacaaguucagaagacuggugaaggccccccccagaaacuacagcgugaucgugauguucaccgcccugcagcugcacagacagugcguggugugcaagcaggccgacgaggaguuccagauccuggccaacagcuggagauacagcagcgccuucaccaacagaaucuucuucgccaugguggacuucgacgagggcagcgacguguuccagaugcugaacaugaacagcgcccccaccuucaucaacuuccccgccaagggcaagcccaagagaggcgacaccuacgagcugcaggugagaggcuucagcgccgagcagaucgccagauggaucgccgacagaaccgacgugaacaucagagugaucagaccccccaacuacgccggcccccugaugcugggccugcugcuggccgugaucggcggccugguguaccugagaagaagcaacauggaguuccuguucaacaagaccggcugggccuucgccgcccugugcuucgugcuggccaugaccagcggccagauguggaaccacaucagaggcccccccuacgcccacaagaacccccacaccggccacgugaacuacauccacggcagcagccaggcccaguucguggccgagacccacaucgugcugcuguucaacggcggcgugacccugggcauggugcugcugugcgaggccgccaccagcgacauggacaucggcaagagaaagaucaugugcguggccggcaucggccugguggugcuguucuucagcuggaugcugagcaucuucagaagcaaguaccacggcuaccccuacagcuuccugaugagcuaa

SEQ ID NO: 19561 - RNA, 903 nt, Artificial Sequence
  MAK16__Homo_sapiens__NP_115898
augcagagcgacgacgugaucugggacacccugggcaacaagcaguucugcagcuucaagaucagaaccaagacccagagcuucugcagaaacgaguacagccugaccggccugugcaacagaagcagcugcccccuggccaacagccaguacgccaccaucaaggaggagaagggccagugcuaccuguacaugaaggugaucgagagagccgccuuccccagaagacugugggagagagugagacugagcaagaacuacgagaaggcccuggagcagaucgacgagaaccugaucuacuggcccagauucaucagacacaagugcaagcagagauucaccaagaucacccaguaccugaucagaaucagaaagcugacccugaagagacagagaaagcuggugccccugagcaagaagguggagagaagagagaagagaagagaggagaaggcccugaucgccgcccagcuggacaacgccaucgagaaggagcugcuggagagacugaagcaggacaccuacggcgacaucuacaacuuccccauccacgccuucgacaaggcccuggagcagcaggaggccgagagcgacagcagcgacaccgaggagaaggacgacgacgacgacgacgaggaggacgugggcaagagagaguucguggaggacggcgagguggacgagagcgacaucagcgacuucgaggacauggacaagcuggacgccagcagcgacgaggaccaggacggcaagagcagcagcgaggaggaggaggagaaggcccugagcgccaagcacaagggcaagaugccccugagaggcccccugcagagaaagagagccuacguggagaucgaguacgagcaggagaccgagcccguggccaaggccaagaccaccuaa

SEQ ID NO: 19562 - RNA, 1872 nt, Artificial Sequence
  MAK__Homo_sapiens__NP_005897
augaacagauacaccaccaugagacagcugggcgacggcaccuacggcagcgugcugaugggcaagagcaacgagagcggcgagcugguggccaucaagagaaugaagagaaaguucuacagcugggacgagugcaugaaccugagagaggugaagagccugaagaagcugaaccacgccaacgugaucaagcugaaggaggugaucagagagaacgaccaccuguacuucaucuucgaguacaugaaggagaaccuguaccagcugaugaaggacagaaacaagcuguuccccgagagcgugaucagaaacaucauguaccagauccugcagggccuggccuucauccacaagcacggcuucuuccacagagacaugaagcccgagaaccugcugugcaugggccccgagcuggugaagaucgccgacuucggccuggccagagagcugagaagccagccccccuacaccgacuacgugagcaccagaugguacagagcccccgaggugcugcugagaagcagcguguacagcagccccaucgacgugugggccgugggcagcaucauggccgagcuguacaugcugagaccccuguuccccggcaccagcgagguggacgagaucuucaagaucugccaggugcugggcacccccaagaagagcgacuggcccgagggcuaccagcuggccagcagcaugaacuucagauucccccagugcgugcccaucaaccugaagacccugauccccaacgccagcaacgaggccauccagcugaugaccgagaugcugaacugggaccccaagaagagacccaccgccagccaggcccugaagcaccccuacuuccaggugggccaggugcugggccccagcagcaaccaccuggagagcaagcagagccugaacaagcagcugcagccccuggagagcaagcccagccugguggagguggagcccaagccccugcccgacaucaucgaccagguggugggccagccccagcccaagaccagccagcagccccugcagcccauccagcccccccagaaccugagcgugcagcagccccccaagcagcagagccaggagaagcccccccagacccuguuccccagcaucgugaagaacaugcccaccaagcccaacggcacccugagccacaagagcggcagaagaagauggggccagaccaucuucaagagcggcgacagcugggaggagcuggaggacuacgacuucggcgccagccacagcaagaagcccagcaugggcguguucaaggagaagagaaagaaggacagccccuucagacugcccgagcccgugcccagcggcagcaaccacagcaccggcgagaacaagagccugcccgccgugaccagccugaagagcgacagcgagcugagcaccgcccccaccagcaagcaguacuaccugaagcagagcagauaccugcccggcgugaaccccaagaaggugagccugaucgccagcggcaaggagaucaacccccacaccuggagcaaccagcuguuccccaagagccugggccccgugggcgccgagcuggccuucaagagaagcaacgccggcaaccugggcagcuacgccaccuacaaccagagcggcuacauccccagcuuccugaagaaggaggugcagagcgccggccagagaauccaccuggccccccugaacgccaccgccagcgaguacaccuggaacaccaagaccggcagaggccaguucagcggcagaaccuacaaccccaccgccaagaaccugaacaucgugaacagagcccagcccauccccagcgugcacggcagaaccgacuggguggccaaguacggcggccacagauaa

SEQ ID NO: 19563 - RNA, 462 nt, Artificial Sequence
  MAL__Homo_sapiens__NP_002362
auggcccccgccgccgccaccggcggcagcacccugcccagcggcuucagcguguucaccacccugcccgaccugcuguucaucuucgaguucaucuucggcggccugguguggauccugguggccagcagccuggugcccuggccccuggugcagggcugggugauguucgugagcguguucugcuucguggccaccaccacccugaucauccuguacaucaucggcgcccacggcggcgagaccagcugggugacccuggacgccgccuaccacugcaccgccgcccuguucuaccugagcgccagcgugcuggaggcccuggccaccaucaccaugcaggacggcuucaccuacagacacuaccacgagaacaucgccgccgugguguucagcuacaucgccacccugcuguacguggugcacgccguguucagccugaucagauggaagagcagcuaa

SEQ ID NO: 19564 - RNA, 462 nt, Artificial Sequence
  MALL__Homo_sapiens__NP_005425
auggccagccccgacccccccgccaccagcuacgcccccagcgacgugcccagcggcguggcccuguuccugaccauccccuucgccuucuuccugcccgagcugaucuucggcuuccugguguggaccaugguggccgccacccacaucguguacccccugcugcagggcugggugauguacgugagccugaccagcuuccugaucagccugauguuccugcugagcuaccuguucggcuucuacaagagauucgagagcuggagagugcuggacagccuguaccacggcaccaccggcauccuguacaugagcgccgccgugcugcaggugcacgccaccaucgugagcgagaagcugcuggaccccagaaucuacuacaucaacagcgccgccagcuucuucgccuucaucgccacccugcuguacauccugcacgccuucagcaucuacuaccacuaa

SEQ ID NO: 19565 - RNA, 6471 nt, Artificial Sequence
  MALRD1__Homo_sapiens__NP_001135780
augcuguucuuccuggacagaaugcuggccuuccccaugaacgagaccuucugcugccuguggaucgccugcguguucaacagcacccuggcccagcagggcaccgagagcuuccagugcgacaacggcgugagccugccccccgacagcaucugcgacuucaccgaccagugcggcgacagcagcgacgagagacacugccugaacuacgagagaugcgacuucgaggacggccugugccacaugacccaggaccagagccugcagcccagcuggaccaagagaagcggcaugaucggccugagcccccccuucuacgaccacaacggcgacgugagcgcccacuuccugagccuggugagcagaguggacagcaucagcagcagccugagaagcagaguguuccugcccaccaacgaccagcacgacugccagaucaccuucuacuacuucagcugccaggugagcggcaagcugauggugggccugcagaccgccugcggcggccccauccagcaccuguggcagaacaccgccgcccugcccaaccagugggagagaaacgugaucaagauccagagcagccagagauuccaggugguguucgagggccagauggccagcaccuacgagcaggacgaggugaucgccaucgacgacaucagcuucagcagcggcugccugcccgccaacgacggcauccugcugugccaggaggcccugaacgccgagagagagcugugccaccccgacaccgaccugugcagauucgacgccaccgacgaggagcugagacugugccaggccugcggcuucgaguucgacaugugcgaguggaccagcgaggccagcgccggccagaucagcuggaugagaaccaaggccagagagauccccgccuucgagagcaccccccagcaggaccagggcggcgacgacgagggcuacuacgugugggugggcgccaagcacggcuucacccugaaccaccuggacagcagagccuaccugaacagcagcgugugccacugccugggcaagagcugccaccugcaguucuacuacgccauggagagcagcgugcugagagugagacuguacaacaacaaggaggaggagaucuucuggaccuacaacaucagcacccacagccagugggugaaggccgacgugcugauccccgaggaccugaagaccuucaagaucaucuucgagggcacccugcugagccagagaagcuucaucgcccuggaccaccuguggguguacgccugcggccagacccagagcagaaagcugugcagcgccgacgaguuccccugcaccagcggccagugcaucgccaaggagagcgugugcgacagcagacaggacugcagcgacgagagcgacgaggaccccgccaccugcagcaagcaccugaccugcgacuucgagagcggcuucugcggcugggagcccuuccugaccgaggacagccacuggaagcugaugaagggccugaacaacggcgagcaccacuuccccgccgccgaccacaccgccaacaucaaccacggcagcuucaucuaccuggaggcccagagaagccccggcguggccaagcugggcagccccgugcugaccaagcugcugaccgccagcacccccugccaggugcaguucugguaccaccugagccagcacagcaaccugagcguguucaccagaaccagccuggacggcaaccugcagaagcagggcaagaucaucagauucagcgagagccaguggagccacgccaagaucgaccugaucgccgaggccggcgagagcacccugcccuuccagcugauccuggaggccaccgugcugagcagcaacgccaccguggcccuggacgacaucagcgugagccaggagugcgagaucagcuacaagagccugcccagaaccagcacccagagcaaguucagcaagugcgacuucgaggccaacagcugcgacugguucgaggccaucagcggcgaccacuucgacuggaucagaagcagccagagcgagcugagcgccgacuucgagcaccaggccccccccagagaccacagccugaacgccagccagggccacuucauguucauccugaagaagagcagcagccuguggcagguggccaagcugcagagccccaccuucagccagaccggccccggcugcauccugagcuucugguucuacaacuacggccugagcgugggcgccgccgagcugcagcugcacauggagaacagccacgacagcaccgugaucuggagagugcuguacaaccagggcaagcaguggcuggaggccaccauccagcugggcagacugagccagcccuuccaccugagccuggacaaggugagccugggcaucuacgacggcgugagcgccaucgacgacaucagauucgagaacugcacccugccccugcccgccgagagcugcgagggccuggaccacuucuggugcagacacaccagagccugcaucgagaagcugagacugugcgaccugguggacgacugcggcgacagaaccgacgaggugaacugcgcccccgagcugcagugcaacuucgagaccggcaucugcaacugggagcaggacgccaaggacgacuucgacuggaccagaagccagggccccacccccacccugaacaccggccccaugaaggacaacacccugggcaccgccaagggccacuaccuguacaucgagagcagcgagccccaggccuuccaggacagcgccgcccugcugagccccauccugaacgccaccgacaccaagggcugcaccuucagauucuacuaccacauguucggcaagagaaucuacagacuggccaucuaccagagaaucuggagcgacagcagaggccagcugcuguggcagaucuucggcaaccagggcaacagauggaucagaaagcaccugaacaucagcagcagacagcccuuccagauccugguggaggccagcgugggcgacggcuucaccggcgacaucgccaucgacgaccugagcuucauggacugcacccuguaccccggcaaccugcccgccgaccugcccaccccccccgagaccagcgugcccgugacccugcccccccacaacugcaccgacaacgaguucaucugcagaagcgacggccacugcaucgagaagaugcagaagugcgacuucaaguacgacugccccgacaagagcgacgaggccagcugcgugauggaggugugcagcuucgagaagagaagccugugcaagugguaccagcccauccccgugcaccugcugcaggacagcaacaccuucagauggggccugggcaacggcaucagcauccaccacggcgaggagaaccacagacccagcguggaccacacccagaacaccaccgacggcugguaccuguacgccgacagcagcaacggcaaguucggcgacaccgccgacauccugacccccaucaucagccugaccggccccaagugcacccugguguucuggacccacaugaacggcgccaccgugggcagccugcaggugcugaucaagaaggacaacgugaccagcaagcugugggcccagaccggccagcagggcgcccaguggaagagagccgagguguuccugggcaucagaagccacacccagaucguguucagagccaagagaggcaucagcuacaucggcgacguggccguggacgacaucagcuuccaggacugcagcccccugcugagccccgagagaaagugcaccgaccacgaguucaugugcgccaacaagcacugcaucgccaaggacaagcugugcgacuucgugaacgacugcgccgacaacagcgacgagaccaccuucaucugcagaaccagcagcggcagaugcgacuucgaguucgaccugugcagcuggaagcaggagaaggacgaggacuucgacuggaaccugaaggccagcagcauccccgccgccggcaccgagcccgccgccgaccacacccugggcaacagcagcggccacuacaucuucaucaagagccuguucccccagcagcccaugagagccgccagaaucagcagccccgugaucagcaagagaagcaagaacugcaagaucaucuuccacuaccacauguacggcaacggcaucggcgcccugacccugaugcaggugagcgugaccaaccagaccaaggugcugcugaaccugaccguggagcagggcaacuucuggagaagagaggagcugagccuguucggcgacgaggacuuccagcugaaguucgagggcagagugggcaagggccagagaggcgacaucgcccuggacgacaucgugcugaccgagaacugccugagccugcacgacagcgugcaggaggagcuggccgugccccugcccaccggcuucugcccccugggcuacagagagugccacaacggcaagugcuacagacuggagcagagcugcaacuucguggacaacugcggcgacaacaccgacgagaacgagugcggcagcagcugcaccuucgagaagggcuggugcggcuggcagaacagccaggccgacaacuucgacugggugcugggcgugggcagccaccagagccugagaccccccaaggaccacacccugggcaacgagaacggccacuucauguaccuggaggccaccgccgugggccugagaggcgacaaggcccacuucagaagcaccauguggagagagagcagcgccgccugcaccaugagcuucugguacuucgugagcgccaaggccaccggcagcauccagauccugaucaagaccgagaagggccugagcaagguguggcaggagagcaagcagaaccccggcaaccacuggcagaaggccgacauccugcugggcaagcugagaaacuucgaggugaucuuccagggcaucagaaccagagaccugggcggcggcgccgccaucgacgacaucgaguucaagaacugcaccaccgugggcgagaucagcgagcugugccccgagaucaccgacuuccugugcagagacaagaagugcaucgccagccaccugcugugcgacuacaagcccgacugcagcgacagaagcgacgaggcccacugcgcccacuacaccagcaccaccggcagcugcaacuucgagaccagcagcggcaacuggaccaccgccugcagccugacccaggacagcgaggacgaccuggacugggccaucggcagcagaauccccgccaaggcccugauccccgacagcgaccacacccccggcagcggccagcacuuccuguacgugaacagcagcggcagcaaggagggcagcguggccagaaucaccaccagcaagagcuuccccgccagccugggcaugugcaccgugagauucugguucuacaugaucgaccccagaagcaugggcauccugaagguguacaccaucgaggagagcggccugaacauccugguguggagcgugaucggcaacaagagaaccggcuggaccuacggcagcgugccccugagcagcaacagccccuucaagguggccuucgaggccgaccuggacggcaacgaggacaucuucaucgcccuggacgacaucagcuucacccccgagugcgugaccggcggccccgugcccgugcagcccagccccugcgaggccgaccaguucagcugcaucuacacccugcagugcgugccccugagcggcaagugcgacggccacgaggacugcaucgacggcagcgacgagauggacugcccccugagccccacccccccccugugcagcaacauggaguuccccugcagcaccgacgagugcauccccagccugcugcugugcgacggcgugcccgacugccacuucaacgaggacgagcugaucugcagcaacaagagcugcagcaacggcgcccuggugugcgccagcagcaacagcugcauccccgcccaccagagaugcgacggcuucgccgacugcauggacuuccagcuggacgagagcagcugcagcgagugcccccugaacuacugcagaaacggcggcaccugcgugguggagaagaacggccccaugugcagaugcagacagggcuggaagggcaacagaugccacaucaaguucaacccccccgccaccgacuucaccuacgcccagaacaacaccuggacccugcugggcaucggccuggccuuccugaugacccacaucaccguggccgugcugugcuuccuggccaacagaaaggugcccaucagaaagaccgagggcagcggcaacugcgccuucgugaaccccguguacggcaacuggagcaaccccgagaagaccgagagcagcguguacagcuucagcaacccccuguacggcaccaccagcggcagccuggagacccugagccaccaccugaaguaa

SEQ ID NO: 19566 - RNA, 2475 nt, Artificial Sequence
  MALT1__Homo_sapiens__NP_006776
augagccugcugggcgacccccugcaggcccugccccccagcgccgcccccaccggcccccugcuggccccccccgccggcgccacccugaacagacugagagagccccugcugagaagacugagcgagcugcuggaccaggcccccgagggcagaggcuggagaagacuggccgagcuggccggcagcagaggcagacugagacugagcugccuggaccuggagcagugcagccugaaggugcuggagcccgagggcagccccagccugugccugcugaagcugaugggcgagaagggcugcaccgugaccgagcugagcgacuuccugcaggccauggagcacaccgaggugcugcagcugcugagcccccccggcaucaagaucaccgugaaccccgagagcaaggccgugcuggccggccaguucgugaagcugugcugcagagccaccggccaccccuucgugcaguaccagugguucaagaugaacaaggagauccccaacggcaacaccagcgagcugaucuucaacgccgugcacgugaaggacgccggcuucuacgugugcagagugaacaacaacuucaccuucgaguucagccaguggagccagcuggacgugugcgacauccccgagagcuuccagagaagcguggacggcgugagcgagagcaagcugcagaucugcguggagcccaccagccagaagcugaugcccggcagcacccuggugcugcagugcguggccgugggcagccccaucccccacuaccagugguucaagaacgagcugccccugacccacgagaccaagaagcuguacauggugcccuacguggaccuggagcaccagggcaccuacuggugccacguguacaacgacagagacagccaggacagcaagaagguggagaucaucaucggcagaaccgacgaggccguggagugcaccgaggacgagcugaacaaccugggccaccccgacaacaaggagcagaccaccgaccagccccuggccaaggacaagguggcccugcugaucggcaacaugaacuacagagagcaccccaagcugaaggccccccugguggacguguacgagcugaccaaccugcugagacagcuggacuucaagguggugagccugcuggaccugaccgaguacgagaugagaaacgccguggacgaguuccugcugcugcuggacaagggcguguacggccugcuguacuacgccggccacggcuacgagaacuucggcaacagcuucauggugcccguggacgcccccaaccccuacagaagcgagaacugccugugcgugcagaacauccugaagcugaugcaggagaaggagaccggccugaacguguuccugcuggacaugugcagaaagagaaacgacuacgacgacaccauccccauccuggacgcccugaaggugaccgccaacaucguguucggcuacgccaccugccagggcgccgaggccuucgagauccagcacagcggccuggccaacggcaucuucaugaaguuccugaaggacagacugcuggaggacaagaagaucaccgugcugcuggacgagguggccgaggacaugggcaagugccaccugaccaagggcaagcaggcccuggagaucagaagcagccugagcgagaagagagcccugaccgaccccauccagggcaccgaguacagcgccgagagccuggugagaaaccugcagugggccaaggcccacgagcugcccgagagcaugugccugaaguucgacugcggcgugcagauccagcugggcuucgccgccgaguucagcaacgugaugaucaucuacaccagcaucguguacaagccccccgagaucaucaugugcgacgccuacgugaccgacuucccccuggaccuggacaucgaccccaaggacgccaacaagggcacccccgaggagaccggcagcuaccuggugagcaaggaccugcccaagcacugccuguacaccagacugagcagccugcagaagcugaaggagcaccugguguucaccgugugccugagcuaccaguacagcggccuggaggacaccguggaggacaagcaggaggugaacgugggcaagccccugaucgccaagcuggacaugcacagaggccugggcagaaagaccugcuuccagaccugccugaugagcaacggccccuaccagagcagcgccgccaccagcggcggcgccggccacuaccacagccugcaggaccccuuccacggcguguaccacagccaccccggcaaccccagcaacgugacccccgccgacagcugccacugcagcagaacccccgacgccuucaucagcagcuucgcccaccacgccagcugccacuucagcagaagcaacgugcccguggagaccaccgacgagauccccuucagcuucagcgacagacugagaaucagcgagaaguaa

SEQ ID NO: 19567 - RNA, 3051 nt, Artificial Sequence
  MAML1__Homo_sapiens__NP_055572
auggugcugcccaccugccccauggccgaguucgcccugcccagacacagcgccgugauggagagacugagaagaagaaucgagcugugcagaagacaccacagcaccugcgaggccagauacgaggccgugagccccgagagacuggagcuggagagacagcacaccuucgcccugcaccagagaugcauccaggccaaggccaagagagccggcaagcacagacagccccccgccgccaccgcccccgcccccgccgcccccgcccccagacuggacgccgccgacggccccgagcacggcagacccgccacccaccugcacgacaccgugaagagaaaccuggacagcgccaccagcccccagaacggcgaccagcagaacggcuacggcgaccuguuccccggccacaagaagaccagaagagaggccccccugggcguggccaucagcagcaacggccugccccccgccagcccccugggccagagcgacaagcccagcggcgccgacgcccugcagagcagcggcaagcacagccugggccuggacagccugaacaagaagagacuggccgacagcagccugcaccugaacggcggcagcaaccccagcgagagcuucccccugagccugaacaaggagcugaagcaggagcccguggaggaccugcccugcaugaucaccggcaccgugggcagcaucagccagagcaaccugaugcccgaccugaaccugaacgagcaggaguggaaggagcugaucgaggagcugaacagaagcgugcccgacgaggacaugaaggaccuguucaacgaggacuucgaggagaagaaggaccccgagagcagcggcagcgccacccagaccccccuggcccaggacaucaacaucaagaccgaguucagccccgccgccuucgagcaggagcagcugggcagcccccaggugagagccggcagcgccggccagaccuuccugggccccagcagcgcccccgugagcaccgacagccccagccugggcggcagccagacccuguuccacaccagcggccagcccagagccgacaaccccagccccaaccugaugcccgccagcgcccaggcccagaacgcccagagagcccuggccggcguggugcugcccagccagggccccggcggcgccagcgagcugagcagcgcccaccagcugcagcagaucgccgccaagcagaagagagagcagaugcugcagaacccccagcaggccacccccgcccccgcccccggccagaugagcaccuggcagcagaccggccccagccacagcagccuggacgugcccuaccccauggagaagcccgccagccccagcagcuacaagcaggacuucaccaacagcaagcugcugaugaugcccagcgugaacaagagcagccccagacccggcggccccuaccugcagcccagccacgugaaccugcugagccaccagccccccagcaaccugaaccagaacagcgccaacaaccagggcagcgugcuggacuacggcaacaccaagccccugagccacuacaaggccgacugcggccagggcagccccggcagcggccagagcaagcccgcccugauggccuaccugccccagcagcugagccacaucagccacgagcagaacagccuguuccugaugaagcccaagcccggcaacaugcccuucagaagccuggugccccccggccaggagcagaaccccagcagcgugcccgugcaggcccaggccaccagcgugggcacccagccccccgccgugagcguggccagcagccacaacagcagccccuaccugagcagccagcagcaggccgccgugaugaagcagcaccagcugcugcuggaccagcagaagcagagagagcagcagcagaagcaccugcagcagcagcaguuccugcagagacagcagcaccugcuggccgagcaggagaagcagcaguuccagagacaccugaccagaccccccccccaguaccaggaccccacccagggcagcuucccccagcaggugggccaguucaccggcagcagcgccgccgugcccggcaugaacacccugggccccagcaacagcagcugccccagaguguucccccaggccggcaaccugaugcccaugggccccggccacgccagcgugagcagccugcccaccaacagcggccagcaggacagaggcguggcccaguuccccggcagccagaacaugccccagagcagccuguacggcauggccagcggcaucacccagaucguggcccagccccccccccaggccaccaacggccacgcccacauccccagacagaccaacgugggccagaacaccagcgugagcgccgccuacggccagaacagccugggcagcagcggccugagccagcagcacaacaagggcacccugaaccccggccugaccaagccccccgugcccagagugagccccgccaugggcggccagaacagcagcuggcagcaccagggcaugcccaaccugagcggccagacccccggcaacagcaacgugagccccuucaccgccgccagcagcuuccacaugcagcagcaggcccaccugaagaugagcagcccccaguucagccaggccgugcccaacagacccauggcccccaugagcagcgccgccgccgugggcagccugcugccccccgugagcgcccagcagagaaccagcgcccccgcccccgcccccccccccaccgccccccagcagggccugcccggccugagccccgccggccccgagcugggcgccuucagccagagccccgccagccagaugggcggcagagccggccugcacugcacccaggccuaccccgugagaaccgccggccaggagcugcccuucgccuacagcggccagcccggcggcagcggccugagcagcguggccggccacaccgaccugaucgacagccugcugaagaacagaaccagcgaggaguggaugagcgaccuggacgaccugcugggcagccaguaa

SEQ ID NO: 19568 - RNA, 3471 nt, Artificial Sequence
  MAML2__Homo_sapiens__NP_115803
augggcgacaccgcccccccccaggcccccgccggcggccugggcggcgccagcggcgccggccugcugggcggcggcagcgugacccccagagugcacagcgccaucguggagagacugagagccagaaucgccgugugcagacagcaccaccugagcugcgagggcagauacgagagaggcagagccgagagcagcgacagagagagagagagcacccugcagcugcugagccuggugcagcacggccagggcgccagaaaggccggcaagcacaccaaggccaccgccaccgccgccaccaccaccgcccccccccccccccccgccgccccccccgccgccagccaggccgccgccaccgccgcccccccccccccccccgacuaccaccaccaccaccagcagcaccugcugaacagcagcaacaacggcggcagcggcggcaucaacggcgagcagcagccccccgccagcacccccggcgaccagagaaacagcgcccugaucgcccugcagggcagccugaagagaaagcagguggugaaccugagccccgccaacagcaagagacccaacggcuucguggacaacagcuuccuggacaucaagagaaucagagugggcgagaaccugagcgccggccagggcggccugcagaucaacaacggccagagccagaucaugagcggcacccugcccaugagccaggccccccugagaaagaccaacacccugcccagccacacccacagccccggcaacggccuguucaacaugggccugaaggaggugaagaaggagcccggcgagacccugagcugcagcaagcacauggacggccagaugacccaggagaacaucuuccccaacagauacggcgacgaccccggcgagcagcugauggaccccgagcugcaggagcuguucaacgagcugaccaacaucagcgugccccccaugagcgaccuggagcuggagaacaugaucaacgccaccaucaagcaggacgaccccuucaacaucgaccugggccagcagagccagagaagcacccccagacccagccugcccauggagaagaucgugaucaagagcgaguacagccccggccugacccagggccccagcggcagcccccagcugagaccccccagcgccggccccgccuucagcauggccaacagcgcccugagcaccagcagccccauccccagcgugccccagagccaggcccagccccagaccggcagcggcgccagcagagcccugcccagcuggcaggaggugagccacgcccagcagcugaagcagaucgccgccaacagacagcagcacgccagaaugcagcagcaccagcagcagcaccagcccaccaacuggagcgcccugcccagcagcgccggccccagccccggccccuucggccaggagaagauccccagccccagcuucggccagcagaccuucagcccccagagcagccccaugcccggcguggccggcggcagcggccagagcaaggugauggccaacuacauguacaaggccggccccagcgcccagggcggccaccuggacgugcugaugcagcagaagccccaggaccugagcagaagcuucaucaacaacccccaccccgccauggagcccagacagggcaacaccaagccccuguuccacuucaacagcgaccaggccaaccagcagaugcccagcgugcugcccagccagaacaagcccagccugcugcacuacacccagcagcagcagcagcagcagcagcagcagcagcagcagcagcagcagcagcagcagcagcagcagcagcagcagcagcagcagcagcagcagcagcagcagagcagcaucagcgcccagcagcagcagcagcagcagagcagcaucagcgcccagcagcagcagcagcagcagcagcagcagcagcagcagcagcagcagcagcagcagcagcagcagcagcagcagcagcagcccagcagccagcccgcccagagccugcccagccagccccugcugagaagcccccugccccugcagcagaagcugcugcugcagcagaugcagaaccagcccaucgccggcaugggcuaccaggugagccagcagcagagacaggaccagcacagcguggugggccagaacaccggccccagccccagccccaaccccugcagcaaccccaacaccggcagcggcuacaugaacagccagcagagccugcugaaccagcagcugaugggcaagaagcagacccugcagagacagaucauggagcagaagcagcagcugcugcugcagcagcagaugcuggccgacgccgagaagaucgccccccaggaccagaucaacagacaccugagcagacccccccccgacuacaaggaccagagaagaaacgugggcaacaugcagcccaccgcccaguacagcggcggcagcagcaccaucagccugaacagcaaccaggcccuggccaaccccgugagcacccacaccauccugacccccaacagcagccugcugagcaccagccacggcaccagaaugcccagccugagcaccgccgugcagaacaugggcauguacggcaaccugcccugcaaccagcccaacaccuacagcgugaccagcggcaugaaccagcugacccagcagagaaaccccaagcagcugcuggccaaccagaacaaccccaugaugcccagaccccccacccugggccccagcaacaacaacaacguggccaccuucggcgccggcagcgugggcaacagccagcagcugagacccaaccugacccacagcauggccagcaugcccccccagagaaccagcaacgugaugaucaccagcaacaccaccgcccccaacugggccagccaggagggcaccagcaagcagcaggaggcccugaccagcgccggcgugagauuccccaccggcacccccgccgccuacacccccaaccagagccugcagcaggccgugggcagccagcaguucagccagagagccguggccccccccaaccagcugacccccgccgugcagaugagacccaugaaccagaugagccagacccugaacggccagaccaugggcccccugagaggccugaaccugagacccaaccagcugagcacccagauccugcccaaccugaaccagagcggcaccggccugaaccagagcagaaccggcaucaaccagccccccagccugacccccagcaacuuccccagccccaaccagagcagcagagccuuccagggcaccgaccacagcagcgaccuggccuucgacuuccugagccagcagaacgacaacaugggccccgcccugaacagcgacgccgacuucaucgacagccugcugaagaccgagcccggcaacgacgacuggaugaaggacaucaaccuggacgagauccugggcaacaacagcuaa

SEQ ID NO: 19569 - RNA, 3402 nt, Artificial Sequence
  MAML3__Homo_sapiens__NP_061187
augggcgacuucgccgcccccgccgccgccgccaacggcagcagcaucugcaucaacagcagccugaacagcagccugggcggcgccggcaucggcgugaacaacacccccaacagcacccccgccgcccccagcagcaaccaccccgccgccggcggcugcggcggcagcggcggccccggcggcggcagcgccgccgugcccaagcacagcaccgugguggagagacugagacagagaaucgagggcugcagaagacaccacgugaacugcgagaacagauaccagcaggcccagguggagcagcuggagcuggagagaagagacaccgugagccuguaccagagaacccuggagcagagagccaagaagagcggcgccggcaccggcaagcagcagcaccccagcaagccccagcaggacgccgaggccgccagcgccgagcagagaaaccacacccugaucaugcugcaggagaccgugaagagaaagcuggagggcgccagaagcccccugaacggcgaccagcagaacggcgccugcgacggcaacuucagccccaccagcaagagaaucagaaaggacaucagcgccggcauggaggccaucaacaaccugcccagcaacaugccccugcccagcgccagcccccugcaccagcuggaccugaagcccagccugccccugcagaacagcggcacccacacccccggccugcuggaggaccugagcaagaacggcagacugcccgagaucaagcugcccgugaacggcugcagcgaccuggaggacagcuucaccauccugcagagcaaggaccugaagcaggagccccuggacgaccccaccugcaucgacaccagcgagaccagccugagcaaccagaacaagcuguucagcgacaucaaccugaacgaccaggaguggcaggagcugaucgacgagcuggccaacaccgugcccgaggacgacauccaggaccuguucaacgaggacuucgaggagaagaaggagcccgaguucagccagcccgccaccgagaccccccugagccaggagagcgccagcgugaagagcgaccccagccacagccccuucgcccacgugagcaugggcagcccccaggccagacccagcagcagcggcccccccuucagcaccgugagcaccgccaccagccugcccagcguggccagcacccccgccgcccccaaccccgccagcagccccgccaacugcgccgugcagagcccccagacccccaaccaggcccacacccccggccaggccccccccagacccggcaacggcuaccugcugaaccccgccgccgugaccguggccggcagcgccagcggccccguggccgugcccagcagcgacaugagccccgccgagcagcugaagcagauggccgcccagcagcagcagagagccaagcugaugcagcagaagcagcagcagcagcagcagcagcagcagcagcagcagcagcagcagcagcagcagcagcagcagcacagcaaccagaccagcaacuggagcccccugggcccccccagcagccccuacggcgccgccuucaccgccgagaagcccaacagccccaugauguacccccaggccuucaacaaccagaaccccaucgugccccccauggccaacaaccugcagaagaccaccaugaacaacuaccugccccagaaccacaugaacaugaucaaccagcagcccaacaaccugggcaccaacagccugaacaagcagcacaacauccugaccuacggcaacaccaagccccugacccacuucaacgccgaccugagccagagaaugaccccccccguggccaaccccaacaagaacccccugaugcccuacauccagcagcagcagcagcagcagcagcagcagcagcagcagcagcagcagcagcagcccccccccccccagcugcaggcccccagagcccaccugagcgaggaccagaagagacugcugcugaugaagcagaagggcgugaugaaccagcccauggccuacgccgcccugcccagccacggccaggagcagcaccccgugggccugcccagaaccaccggccccaugcagagcagcgugccccccggcagcggcggcauggugagcggcgccagccccgccggccccggcuuccugggcagccagccccaggccgccaucaugaagcagaugcugaucgaccagagagcccagcugaucgagcagcagaagcagcaguuccugagagagcagagacagcagcagcagcagcagcagcagauccuggccgagcagcagcugcagcagagccaccugcccagacagcaccugcagccccagagaaaccccuaccccgugcagcaggugaaccaguuccagggcagcccccaggacaucgccgccgugagaagccaggccgcccugcagagcaugagaaccagcagacugauggcccagaacgccggcaugaugggcaucggccccagccagaaccccggcaccauggccaccgccgccgcccagagcgagaugggccuggcccccuacagcaccacccccaccagccagcccggcauguacaacaugagcaccggcaugacccagaugcugcagcaccccaaccagagcggcaugagcaucacccacaaccaggcccagggccccagacagcccgccagcggccagggcgugggcauggugagcggcuucggccagagcaugcuggugaacagcgccaucacccagcagcacccccagaugaagggccccgugggccaggcccugcccagaccccaggccccccccagacugcagagccugaugggcaccgugcagcagggcgcccagagcuggcagcagagaagccugcagggcaugcccggcagaaccagcggcgagcugggccccuucaacaacggcgccagcuacccccugcaggccggccagcccagacugaccaagcagcacuucccccagggccugagccagagcgugguggacgccaacaccggcaccgugagaacccugaaccccgccgccaugggcagacagaugaugcccagccugcccggccagcagggcaccagccaggccagacccauggugaugagcggccugagccagggcgugcccggcaugcccgccuucagccagccccccgcccagcagcagauccccagcggcagcuucgcccccagcagccagagccaggccuacgagagaaacgccccccaggacgugagcuacaacuacagcggcgacggcgccggcggcagcuuccccggccugcccgacggcgccgaccugguggacagcaucaucaagggcggccccggcgacgaguggaugcaggagcuggacgagcuguucggcaaccccuaa

SEQ ID NO: 19570 - RNA, 2997 nt, Artificial Sequence
  MAMLD1__Homo_sapiens__NP_001170936
auggacgacuggaagagcagacuggugaucaagagcaugcugccccacuucgccauggugggcaacagacaggagcccagaaagcugcaggagagcggcaccgugaagagaagacaggaggaggaccacuuccaguuccccgacauggccgacggcggcuaccccaacaagaucaagagacccugccuggaggacgugacccuggccaugggccccggcgcccaccccagcaccgccugcgccgagcugcaggugcccccccugaccaucaaccccagccccgccgccaugggcguggccggccagagccugcugcuggagaacaaccccaugaacggcaacaucaugggcagccccuucguggugccccagaccaccgaggugggccugaagggccccaccgugcccuacuacgagaagaucaacagcgugcccgccguggaccaggagcugcaggagcugcuggaggagcugaccaagauccaggaccccagccccaacgagcuggaccuggagaagauccugggcaccaagcccgaggagccccuggugcuggaccacccccaggccacccugagcaccacccccaagcccagcgugcagaugagccaccuggagagccuggccagcagcaaggaguucgccagcagcugcagccaggugaccggcaugagccugcagauccccagcagcagcaccggcaucagcuacagcauccccagcaccagcaagcagaucgugagccccagcagcagcauggcccagagcaagagccaggugcaggccaugcugcccguggcccugcccccccugcccgugccccaguggcaccacgcccaccagcugaaggcccuggccgccagcaagcagggcagcgccaccaagcagcagggccccacccccagcuggagcggccugcccccccccggccugagcccccccuacagacccgugcccagcccccacccccccccccugccccugccccccccccccccccccuucagcccccagagccugauggugagcugcaugagcagcaacacccugagcggcagcacccugagaggcagccccaacgcccugcugagcagcaugaccagcagcagcaacgccgcccugggccccgccaugcccuacgcccccgagaagcugcccagccccgcccugacccagcagccccaguucggcccccagagcagcauccuggccaaccugaugagcagcaccaucaagaccccccagggccaccugaugagcgcccugcccgccagcaaccccggccccagcccccccuacagacccgagaagcugagcagccccggccugccccagcagagcuucaccccccagugcagccugaucagaagccugacccccaccagcaaccugcugagccagcagcagcagcagcagcagcagcagcagcaggccaacgugaucuucaagcccaucagcagcaacagcagcaagacccugagcaugaucaugcagcagggcauggccagcagcagccccggcgccaccgagcccuucaccuucggcaacaccaagccccugagccacuucgugagcgagcccggcccccagaagaugcccagcaugcccaccaccagcagacagcccagccugcugcacuaccugcagcagcccacccccacccaggccagcagcgccaccgccagcagcaccgccaccgccacccugcagcugcagcagcagcagcagcagcagcagcagcagcccgaccacagcagcuuccugcugcagcagaugaugcagcagccccagagauuccagagaagcguggccagcgacagcaugcccgcccugcccagacagcaggaggagcagagaagcggccugauggccaugacccccgagagacagaacgccuacaucagccagcagaugagccccuucgaggccgugcaggagcaggugaccagcaagugcagcagaaucaaggccagcccccccagcagcaagcaccugaugccccccagaaccggccugcugcagaacaaccugagccccggcaugaucccccugaccagacaccagagcugcgagggcaugggcgugaucagccccacccugggcaagagacagggcaucuucaccagcagcccccagugccccauccugagccacagcggccagaccccccugggcagacuggacagcgugugccagcacaugcagagccccaaggccaccccccccgaggugccccugcccggcuucugccccagcagccugggcacccagagccugagcccccaccagcugagaagacccagcgugcccagaaugcccaccgccuucaacaacgccgccugggugaccgccgccgccgccgugaccaccgccgugagcggcaagaccccccugagccagguggacaacagcgugcagcagcacagccccagcggccaggccugccugcagagacccagcgacugggaggcccaggugcccgccgccaugggcacccaggugccccuggccaacaaccccagcuucagccugcugggcagccagagccugagacagagccccgugcagggccccgugcccguggccaacaccaccaaguuccugcagcagggcauggccagcuucagcccccugagccccauccagggcaucgagccccccagcuacguggccgccgccgccaccgccgccgccgccagcgccguggccgccagccaguuccccggccccuucgacagaaccgacaucccccccgagcugccccccgccgacuuccugagacagccccagcccccccugaacgaccugaucagcagccccgacugcaacgagguggacuucaucgaggcccugcugaagggcagcugcgugagccccgacgaggacugggugugcaaccugagacugaucgacgacauccuggagcagcacgccgccgcccagaacgccaccgcccagaacagcggccaggugacccaggacgccggcgcccuguaa

SEQ ID NO: 19571 - RNA, 1962 nt, Artificial Sequence
  MAN1A1__Homo_sapiens__NP_005898
augcccgugggcggccugcugccccuguucagcagccccgccggcggcgugcugggcggcggccugggcggcggcggcggcagaaagggcagcggccccgccgcccugagacugaccgagaaguucgugcugcugcugguguucagcgccuucaucacccugugcuucggcgccaucuucuuccugcccgacagcagcaagcugcugagcggcgugcuguuccacagcagccccgcccugcagcccgccgccgaccacaagcccggccccggcgccagagccgaggacgccgccgagggcagagccagaagaagagaggagggcgcccccggcgaccccgaggccgcccuggaggacaaccuggccagaaucagagagaaccacgagagagcccugagagaggccaaggagacccugcagaagcugcccgaggagauccagagagacauccugcuggagaagaagaagguggcccaggaccagcugagagacaaggcccccuucagaggccugccccccguggacuucgugccccccaucggcguggagagcagagagcccgccgacgccgccaucagagagaagagagccaagaucaaggagaugaugaagcacgccuggaacaacuacaagggcuacgccuggggccugaacgagcugaagcccaucagcaagggcggccacagcagcagccuguucggcaacaucaagggcgccaccaucguggacgcccuggacacccuguucaucauggagaugaagcacgaguucgaggaggccaagagcuggguggaggagaaccuggacuucaacgugaacgccgagaucagcguguucgaggugaacaucagauucgugggcggccugcugagcgccuacuaccugagcggcgaggagaucuucagaaagaaggccguggagcugggcgugaagcugcugcccgccuuccacacccccagcggcauccccugggcccugcugaacaugaagagcggcaucggcagaaacuggcccugggccagcggcggcagcagcauccuggccgaguucggcacccugcaccuggaguucaugcaccugagccaccugagcggcaaccccaucuucgccgagaaggugaugaacaucagaaccgugcugaacaagcuggagaagccccagggccuguaccccaacuaccugaaccccagcagcggccaguggggccagcaccacgugagcgugggcggccugggcgacagcuucuacgaguaccugcugaaggccuggcugaugagcgacaagaccgaccuggaggccaagaagauguacuucgacgccgugcaggccaucgagacccaccugaucagaaagagcagcagcggccugaccuacaucgccgaguggaagggcggccugcuggagcacaagaugggccaccugaccugcuucgccggcggcauguucgcccugggcgccgacgccgcccccgagggcauggcccagcacuaccuggagcugggcgccgagaucgccagaaccugccacgagagcuacaacagaaccuucaugaagcugggccccgaggccuucagauucgacggcggcguggaggccaucgccaccagacagaacgagaaguacuacauccugagacccgaggugauggagaccuacauguacauguggagacugacccacgaccccaaguacagaaagugggccugggaggccguggaggcccuggagaaccacugcagagugaacggcggcuacagcggccugagagacguguaccugcugcacgagagcuacgacgacgugcagcagagcuucuuccuggccgagacccugaaguaccuguaccugaucuucagcgacgacgaccugcugccccuggagcacuggaucuucaacagcgaggcccaccugcugcccauccugcccaaggacaagaaggagguggagaucagagaggaguaa

SEQ ID NO: 19572 - RNA, 2100 nt, Artificial Sequence
  MAN1B1__Homo_sapiens__NP_057303
auggccgccugcgagggcagaagaagcggcgcccugggcagcagccagagcgacuuccugaccccccccgugggcggcgcccccugggccguggccaccaccguggugauguacccccccccccccccccccccccacagagacuucaucagcgugacccugagcuucggcgagaacuacgacaacagcaagagcuggagaagaagaagcugcuggagaaaguggaagcagcugagcagacugcagagaaacaugauccuguuccugcuggccuuccugcuguucugcggccugcuguucuacaucaaccuggccgaccacuggaaggcccuggccuucagacuggaggaggagcagaagaugagacccgagaucgccggccugaagcccgccaacccccccgugcugcccgccccccagaaggccgacaccgaccccgagaaccugcccgagaucagcagccagaagacccagagacacauccagagaggccccccccaccugcagaucagaccccccagccaggaccugaaggacggcacccaggaggaggccaccaagagacaggaggcccccguggaccccagacccgagggcgacccccagagaaccgugaucagcuggagaggcgccgugaucgagcccgagcagggcaccgagcugcccagcagaagagccgaggugcccaccaagcccccccugccccccgccagaacccagggcacccccgugcaccugaacuacagacagaagggcgugaucgacguguuccugcacgccuggaagggcuacagaaaguucgccuggggccacgacgagcugaagcccgugagcagaagcuucagcgagugguucggccugggccugacccugaucgacgcccuggacaccauguggauccugggccugagaaaggaguucgaggaggccagaaagugggugagcaagaagcugcacuucgagaaggacguggacgugaaccuguucgagagcaccaucagaauccugggcggccugcugagcgccuaccaccugagcggcgacagccuguuccugagaaaggccgaggacuucggcaacagacugaugcccgccuucagaacccccagcaagauccccuacagcgacgugaacaucggcaccggcguggcccacccccccagauggaccagcgacagcaccguggccgaggugaccagcauccagcuggaguucagagagcugagcagacugaccggcgacaagaaguuccaggaggccguggagaaggugacccagcacauccacggccugagcggcaagaaggacggccuggugcccauguucaucaacacccacagcggccuguucacccaccugggcguguucacccugggcgccagagccgacagcuacuacgaguaccugcugaagcaguggauccagggcggcaagcaggagacccagcugcuggaggacuacguggaggccaucgagggcgugagaacccaccugcugagacacagcgagcccagcaagcugaccuucgugggcgagcuggcccacggcagauucagcgccaagauggaccaccuggugugcuuccugcccggcacccuggcccugggcguguaccacggccugcccgccagccacauggagcuggcccaggagcugauggagaccugcuaccagaugaacagacagauggagaccggccugagccccgagaucgugcacuucaaccuguacccccagcccggcagaagagacguggaggugaagcccgccgacagacacaaccugcugagacccgagaccguggagagccuguucuaccuguacagagugaccggcgacagaaaguaccaggacuggggcugggagauccugcagagcuucagcagauucaccagagugcccagcggcggcuacagcagcaucaacaacgugcaggacccccagaagcccgagcccagagacaagauggagagcuucuuccugggcgagacccugaaguaccuguuccugcuguucagcgacgaccccaaccugcugagccuggacgccuacguguucaacaccgaggcccacccccugcccaucuggacccccgccuaa

SEQ ID NO: 19573 - RNA, 3435 nt, Artificial Sequence
  MAN2A1__Homo_sapiens__NP_002363
augaagcugagcagacaguucaccguguucggcagcgccaucuucugcguggugaucuucagccuguaccugaugcuggacagaggccaccuggacuaccccagaaaccccagaagagagggcagcuucccccagggccagcugagcaugcugcaggagaagaucgaccaccuggagagacugcuggccgagaacaacgagaucaucagcaacaucagagacagcgugaucaaccugagcgagagcguggaggacggccccaagagcagccagagcaacuucagccagggcgccggcagccaccugcugcccagccagcugagccugagcguggacaccgccgacugccuguucgccagccagagcggcagccacaacagcgacgugcagaugcuggacguguacagccugaucagcuucgacaaccccgacggcggcguguggaagcagggcuucgacaucaccuacgagagcaacgagugggacaccgagccccugcagguguucguggugccccacagccacaacgaccccggcuggcugaagaccuucaacgacuacuucagagacaagacccaguacaucuucaacaacauggugcugaagcugaaggaggacagcagaagaaaguucaucuggagcgagaucagcuaccugagcaaguggugggacaucaucgacauccagaagaaggacgccgugaagagccugaucgagaacggccagcuggagaucgugaccggcggcugggugaugcccgacgaggccaccccccacuacuucgcccugaucgaccagcugaucgagggccaccaguggcuggagaacaacaucggcgugaagcccagaagcggcugggccaucgaccccuucggccacagccccaccauggccuaccugcugaacagagccggccugagccacaugcugauccagagagugcacuacgccgugaagaagcacuucgcccugcacaagacccuggaguucuucuggagacagaacugggaccugggcagcgugaccgacauccugugccacaugaugcccuucuacagcuacgacaucccccacaccugcggccccgaccccaagaucugcugccaguucgacuucaagagacugcccggcggcagauucggcugccccuggggcgugccccccgagaccauccaccccggcaacgugcagagcagagccagaaugcugcuggaccaguacagaaagaagagcaagcuguucagaaccaaggugcugcuggccccccugggcgacgacuucagauacugcgaguacaccgagugggaccugcaguucaagaacuaccagcagcuguucgacuacaugaacagccagagcaaguucaaggugaagauccaguucggcacccugagcgacuucuucgacgcccuggacaaggccgacgagacccagagagacaagggccagagcauguuccccgugcugagcggcgacuucuucaccuacgccgacagagacgaccacuacuggagcggcuacuucaccagcagacccuucuacaagagaauggacagaaucauggagagccaccugagagccgccgagauccuguacuacuucgcccugagacaggcccacaaguacaagaucaacaaguuccugagcagcagccuguacaccgcccugaccgaggccagaagaaaccugggccuguuccagcaccacgacgccaucaccggcaccgccaaggacuggguggugguggacuacggcaccagacuguuccacagccugauggugcuggagaagaucaucggcaacagcgccuuccugcugauccugaaggacaagcugaccuacgacagcuacagccccgacaccuuccuggagauggaccugaagcagaagagccaggacagccugccccagaagaacaucaucagacugagcgccgagcccagauaccuggugguguacaacccccuggagcaggacagaaucagccuggugagcguguacgugagcagccccaccgugcagguguucagcgccagcggcaagcccguggaggugcaggugagcgccgugugggacaccgccaacaccaucagcgagaccgccuacgagaucagcuucagagcccacauccccccccugggccugaagguguacaagauccuggagagcgccagcagcaacagccaccuggccgacuacgugcuguacaagaacaagguggaggacagcggcaucuucaccaucaagaacaugaucaacaccgaggagggcaucacccuggagaacagcuucgugcugcugagauucgaccagaccggccugaugaagcagaugaugaccaaggaggacggcaagcaccacgaggugaacgugcaguucagcugguacggcaccaccaucaagagagacaagagcggcgccuaccuguuccugcccgacggcaacgccaagcccuacguguacaccaccccccccuucgugagagugacccacggcagaaucuacagcgaggugaccugcuucuucgaccacgugacccacagagugagacuguaccacauccagggcaucgagggccagagcguggaggugagcaacaucguggacaucagaaagguguacaacagagagaucgccaugaagaucagcagcgacaucaagagccagaacagauucuacaccgaccugaacggcuaccagauccagcccagaaugacccugagcaagcugccccugcaggccaacguguaccccaugaccaccauggccuacauccaggacgccaagcacagacugacccugcugagcgcccagagccugggcgugagcagccugaacagcggccagaucgaggugaucauggacagaagacugaugcaggacgacaacagaggccuggagcagggcauccaggacaacaagaucaccgccaaccuguucagaauccugcuggagaagagaagcgccgugaacaccgaggaggagaagaagagcgugagcuaccccagccugcugagccacaucaccagcagccugaugaaccaccccgugauccccauggccaacaaguucagcagccccacccuggagcugcagggcgaguucagcccccugcagagcagccugcccugcgacauccaccuggugaaccugagaaccauccagagcaaggugggcaacggccacagcaacgaggccgcccugauccugcacagaaagggcuucgacugcagauucagcagcaagggcaccggccuguucugcagcaccacccagggcaagauccuggugcagaagcugcugaacaaguucaucguggagagccugacccccagcagccugagccugaugcacagcccccccggcacccagaacaucagcgagaucaaccugagccccauggagaucagcaccuucagaauccagcugagauaa

SEQ ID NO: 19574 - RNA, 3453 nt, Artificial Sequence
  MAN2A2__Homo_sapiens__NP_006113
augaagcugaagaagcaggugaccgugugcggcgccgccaucuucugcguggccguguucagccuguaccugaugcuggacagagugcagcacgaccccaccagacaccagaacggcggcaacuuccccagaagccagaucagcgugcugcagaacagaaucgagcagcuggagcagcugcuggaggagaaccacgagaucaucagccacaucaaggacagcgugcuggagcugaccgccaacgccgagggcccccccgccaugcugcccuacuacaccgugaacggcagcuggguggugccccccgagcccagacccagcuucuucagcaucagcccccaggacugccaguucgcccugggcggcagaggccagaagcccgagcugcagaugcugaccgugagcgaggagcugcccuucgacaacguggacggcggcguguggagacagggcuucgacaucagcuacgacccccacgacugggacgccgaggaccugcagguguucguggugccccacagccacaacgaccccggcuggaucaagaccuucgacaaguacuacaccgagcagacccagcacauccugaacagcauggugagcaagcugcaggaggaccccagaagaagauuccugugggccgaggugagcuucuucgccaaguggugggacaacaucaacgugcagaagagagccgccgugagaagacuggugggcaacggccagcuggagaucgccaccggcggcugggugaugcccgacgaggccaacagccacuacuucgcccugaucgaccagcugaucgagggccaccaguggcuggagagaaaccugggcgccacccccagaagcggcugggccguggaccccuucggcuacagcagcaccaugcccuaccugcugagaagagccaaccugaccagcaugcugauccagagagugcacuacgccaucaagaagcacuucgccgccacccacagccuggaguucauguggagacagaccugggacagcgacagcagcaccgacaucuucugccacaugaugcccuucuacagcuacgacgugccccacaccugcggccccgaccccaagaucugcugccaguucgacuucaagagacugcccggcggcagaaucaacugccccuggaaggugccccccagagccaucaccgaggccaacguggccgagagagccgcccugcugcuggaccaguacagaaagaagagccagcuguucagaagcaacgugcugcuggugccccugggcgacgacuucagauacgacaagccccaggagugggacgcccaguucuucaacuaccagagacuguucgacuucuucaacagcagacccaaccugcacgugcaggcccaguucggcacccugagcgacuacuucgacgcccuguacaagagaaccggcguggagcccggcgccagaccccccggcuuccccgugcugagcggcgacuucuucagcuacgccgacagagaggaccacuacuggaccggcuacuacaccagcagacccuucuacaagagccuggacagagugcuggaggcccaccugagaggcgccgaggugcuguacagccuggccgccgcccacgccagaagaagcggccuggccggcagauacccccugagcgacuucacccugcugaccgaggccagaagaacccugggccuguuccagcaccacgacgccaucaccggcaccgccaaggaggccguggugguggacuacggcgugagacugcugagaagccuggugaaccugaagcaggugaucauccacgccgcccacuaccuggugcugggcgacaaggagaccuaccacuucgaccccgaggcccccuuccugcagguggacgacaccagacugagccacgacgcccugcccgagagaaccgugauccagcuggacagcagccccagauucguggugcuguucaacccccuggagcaggagagauucagcauggugagccugcuggugaacagccccagagugagagugcugagcgaggagggccagccccuggccgugcagaucagcgcccacuggagcagcgccaccgaggccgugcccgacguguaccaggugagcgugcccgugagacugcccgcccugggccugggcgugcugcagcugcagcugggccuggacggccacagaacccugcccagcagcgugagaaucuaccugcacggcagacagcugagcgugagcagacacgaggccuucccccugagagugaucgacagcggcaccagcgacuucgcccugagcaacagauacaugcaggugugguucagcggccugaccggccugcugaagagcaucagaagaguggacgaggagcacgagcagcagguggacaugcaggugcugguguacggcaccagaaccagcaaggacaagagcggcgccuaccuguuccugcccgacggcgaggccaagcccuacgugcccaaggagccccccgugcugagagugaccgagggccccuucuucagcgaggugguggccuacuacgagcacauccaccaggccgugagacuguacaaccugcccggcguggagggccugagccuggacaucagcagccugguggacaucagagacuacgugaacaaggagcuggcccugcacauccacaccgacaucgacagccagggcaucuucuucaccgaccugaacggcuuccaggugcagcccagaagauaccugaagaagcugccccugcaggccaacuucuaccccaugcccgugauggccuacauccaggacgcccagaagagacugacccugcacaccgcccaggcccugggcgugagcagccugaaggacggccagcuggaggugauccuggacagaagacugaugcaggacgacaacagaggccugggccagggccugaaggacaacaagagaaccugcaacagauucagacugcugcuggagagaagaaccgugggcagcgaggugcaggacagccacagcaccagcuaccccagccugcugagccaccugaccagcauguaccugaacgcccccgcccuggcccugcccguggccagaaugcagcugcccggccccggccugagaagcuuccacccccuggccagcagccugcccugcgacuuccaccugcugaaccugagaacccugcaggccgaggaggacacccugcccagcgccgagaccgcccugauccugcacagaaagggcuucgacugcggccuggaggccaagaaccugggcuucaacugcaccaccagccagggcaagguggcccugggcagccuguuccacggccuggacgugguguuccugcagcccaccagccugacccugcuguacccccuggccagccccagcaacagcaccgacguguaccuggagcccauggagaucgccaccuucagacugagacugggcuaa

SEQ ID NO: 19575 - RNA, 3036 nt, Artificial Sequence
  MAN2B1__Homo_sapiens__NP_000519
augggcgccuacgccagagccagcggcgugugcgccagaggcugccuggacagcgccggccccuggaccaugagcagagcccugagacccccccugcccccccugugcuucuuccugcugcugcuggccgccgccggcgccagagccggcggcuacgagaccugccccaccgugcagcccaacaugcugaacgugcaccugcugccccacacccacgacgacgugggcuggcugaagaccguggaccaguacuucuacggcaucaagaacgacauccagcacgccggcgugcaguacauccuggacagcgugaucagcgcccugcuggccgaccccaccagaagauucaucuacguggagaucgccuucuucagcagaugguggcaccagcagaccaacgccacccaggagguggugagagaccuggugagacagggcagacuggaguucgccaacggcggcugggugaugaacgacgaggccgccacccacuacggcgccaucguggaccagaugacccugggccugagauuccuggaggacaccuucggcaacgacggcagacccagaguggccuggcacaucgaccccuucggccacagcagagagcaggccagccuguucgcccagaugggcuucgacggcuucuucuucggcagacuggacuaccaggacaagugggugagaaugcagaagcuggagauggagcagguguggagagccagcaccagccugaagccccccaccgccgaccuguucaccggcgugcugcccaacggcuacaacccccccagaaaccugugcugggacgugcugugcguggaccagccccugguggaggaccccagaagccccgaguacaacgccaaggagcugguggacuacuuccugaacguggccaccgcccagggcagauacuacagaaccaaccacaccgugaugaccaugggcagcgacuuccaguacgagaacgccaacaugugguucaagaaccuggacaagcugaucagacuggugaacgcccagcaggccaagggcagcagcgugcacgugcuguacagcacccccgccugcuaccugugggagcugaacaaggccaaccugaccuggagcgugaagcacgacgacuucuuccccuacgccgacggcccccaccaguucuggaccggcuacuucagcagcagacccgcccugaagagauacgagagacugagcuacaacuuccugcaggugugcaaccagcuggaggcccuggugggccuggccgccaacgugggccccuacggcagcggcgacagcgccccccugaacgaggccauggccgugcugcagcaccacgacgccgugagcggcaccagcagacagcacguggccaacgacuacgccagacagcuggccgccggcuggggccccugcgaggugcugcugagcaacgcccuggccagacugagaggcuucaaggaccacuucaccuucugccagcagcugaacaucagcaucugcccccugagccagaccgccgccagauuccaggugaucguguacaacccccugggcagaaaggugaacuggauggugagacugcccgugagcgagggcguguucguggugaaggaccccaacggcagaaccgugcccagcgacguggugaucuuccccagcagcgacagccaggcccacccccccgagcugcuguucagcgccagccugcccgcccugggcuucagcaccuacagcguggcccaggugcccagauggaagccccaggccagagccccccagcccauccccagaagaagcuggagccccgcccugaccaucgagaacgagcacaucagagccaccuucgaccccgacaccggccugcugauggagaucaugaacaugaaccagcagcugcugcugcccgugagacagaccuucuucugguacaacgccagcaucggcgacaacgagagcgaccaggccagcggcgccuacaucuucagacccaaccagcagaagccccugcccgugagcagaugggcccagauccaccuggugaagaccccccuggugcaggaggugcaccagaacuucagcgccuggugcagccagguggugagacuguaccccggccagagacaccuggagcuggaguggagcgugggccccauccccgugggcgacaccuggggcaaggaggugaucagcagauucgacaccccccuggagaccaagggcagauucuacaccgacagcaacggcagagagauccuggagagaagaagagacuacagacccaccuggaagcugaaccagaccgagcccguggccggcaacuacuaccccgugaacaccagaaucuacaucaccgacggcaacaugcagcugaccgugcugaccgacagaagccagggcggcagcagccugagagacggcagccuggagcugauggugcacagaagacugcugaaggacgacggcagaggcgugagcgagccccugauggagaacggcagcggcgccugggugagaggcagacaccuggugcugcuggacaccgcccaggccgccgccgccggccacagacugcuggccgagcaggaggugcuggccccccagguggugcuggcccccggcggcggcgccgccuacaaccugggcgccccccccagaacccaguucagcggccugagaagagaccugccccccagcgugcaccugcugacccuggccagcuggggccccgagauggugcugcugagacuggagcaccaguucgccgugggcgaggacagcggcagaaaccugagcgcccccgugacccugaaccugagagaccuguucagcaccuucaccaucaccagacugcaggagaccacccugguggccaaccagcugagagaggccgccagcagacugaaguggaccaccaacaccggccccaccccccaccagacccccuaccagcuggaccccgccaacaucacccuggagcccauggagaucagaaccuuccuggccagcgugcaguggaaggagguggacggcuaa

SEQ ID NO: 19576 - RNA, 3174 nt, Artificial Sequence
  MAN2C1__Homo_sapiens__NP_001243423
auggccgccgcccccgcccugaagcacuggagaaccacccuggagagaguggagaaguucgugagcccccuguacuucaccgacugcaaccugagaggcagacuguucggcgccagcugccccguggccgugcugagcagcuuccugacccccgagagacugcccuaccaggaggccgugcagagagacuucagacccgcccaggugggcgacagcuucggccccaccugguggaccugcugguucagaguggagcugaccauccccgaggccugggugggccaggaggugcaccugugcugggagagcgacggcgagggccugguguggagagacggcgagcccgugcagggccugaccaaggagggcgagaagaccagcuacgugcugaccgacagacugggcgagagagaccccagaagccugacccuguacguggagguggccugcaacggccugcugggcgccggcaagggcagcaugaucgccgcccccgaccccgagaagauguuccagcugagcagagccgagcuggccguguuccacagagacgugcacaugcugcugguggaccuggagcugcugcugggcaucgccaagggccugggcaaggacaaccagagaagcuuccaggcccuguacaccgccaaccagauggugaacgugugcgaccccgcccagcccgagaccuuccccguggcccaggcccuggccagcagauucuucggccagcacggcggcgagagccagcacaccauccacgccaccggccacugccacaucgacaccgccuggcuguggcccuucaaggagaccgugagaaagugcgccagaagcugggugaccgcccugcagcugauggagagaaaccccgaguucaucuucgccugcagccaggcccagcagcuggagugggugaagagcagauaccccggccuguacagcagaauccaggaguucgccugcagaggccaguucgugcccgugggcggcaccuggguggagauggacggcaaccugcccagcggcgaggccauggugagacaguuccugcagggccagaacuucuuccugcaggaguucggcaagaugugcagcgaguucuggcugcccgacaccuucggcuacagcgcccagcugccccagaucaugcacggcugcggcaucagaagauuccugacccagaagcugagcuggaaccuggugaacagcuucccccaccacaccuucuucugggagggccuggacggcagcagagugcuggugcacuucccccccggcgacagcuacggcaugcagggcagcguggaggaggugcugaagaccguggccaacaacagagacaagggcagagccaaccacagcgccuuccuguucggcuucggcgacggcggcggcggccccacccagaccaugcuggacagacugaagagacugagcaacaccgacggccugcccagagugcagcugagcagccccagacagcuguucagcgcccuggagagcgacagcgagcagcugugcaccugggugggcgagcuguuccuggagcugcacaacggcaccuacaccacccacgcccagaucaagaagggcaacagagagugcgagagaauccugcacgacguggagcugcugagcagccuggcccuggccagaagcgcccaguuccuguaccccgccgcccagcugcagcaccuguggagacugcugcugcugaaccaguuccacgacguggugaccggcagcugcauccagaugguggccgaggaggccaugugccacuacgaggacaucagaagccacggcaacacccugcugagcgccgccgccgccgcccugugcgccggcgagcccggccccgagggccugcugaucgugaacacccugcccuggaagagaaucgaggugauggcccugcccaagcccggcggcgcccacagccugggccugacccccagccccggcgacagcgcccagcacggccugugcagcugcagcagcccccaccugaccgccgcccccgccgcccccgccgccugcgugagaagcgccagagcccccaccgacagcgccagcagacccccccccaccaagaccgacggcagcgugacccuggacaacggcaucaucagagugaagcuggaccccaccggcagacugaccagccuggugcugguggccagcggcagagaggccaucgccgagggcgccgugggcaaccaguucgugcuguucgacgacgugccccuguacugggacgccugggacgugauggacuaccaccuggagaccagaaagcccgugcugggccaggccggcacccuggccgugggcaccgagggcggccugagaggcagcgccugguuccugcugcagaucagccccaacagcagacugagccaggagguggugcuggacgugggcugccccuacgugagauuccacaccgaggugcacuggcacgaggcccacaaguuccugaagguggaguuccccgccagagugagaagcagccaggccaccuacgagauccaguucggccaccugcagagacccacccacuacaacaccagcugggacugggccagauucgaggugugggcccacagauggauggaccugagcgagcacggcuucggccuggcccugcugaacgacugcaaguacggcgccagcgugagaggcagcauccugagccugagccugcugagagcccccaaggcccccgacgccaccgccgacaccggcagacacgaguucaccuacgcccugaugccccacaagggcagcuuccaggacgccggcgugauccaggccgccuacagccugaacuucccccugcuggcccugcccgcccccagccccgcccccgccaccagcuggagcgccuucagcgugagcagccccgccguggugcuggagaccgugaagcaggccgagagcagcccccagagaagaagccuggugcugagacuguacgaggcccacggcagccacguggacugcuggcugcaccugagccugcccgugcaggaggccauccugugcgaccugcuggagagacccgaccccgccggccaccugacccugagagacaacagacugaagcugaccuucagccccuuccaggugcugagccugcugcuggugcugcagccccccccccacuaa

SEQ ID NO: 19577 - RNA, 2640 nt, Artificial Sequence
  MANBA__Homo_sapiens__NP_005899
augagacugcaccugcugcugcugcuggcccugugcggcgccggcaccaccgccgccgagcugagcuacagccugagaggcaacuggagcaucugcaacggcaacggcagccuggagcugcccggcgccgugcccggcugcgugcacagcgcccuguuccagcagggccugauccaggacagcuacuacagauucaacgaccugaacuacagaugggugagccuggacaacuggaccuacagcaaggaguucaagauccccuucgagaucagcaaguggcagaaggugaaccugauccuggagggcguggacaccgugagcaagauccuguucaacgaggugaccaucggcgagaccgacaacauguucaacagauacagcuucgacaucaccaacguggugagagacgugaacagcaucgagcugagauuccagagcgccgugcuguacgccgcccagcagagcaaggcccacaccagauaccaggugccccccgacugccccccccuggugcagaagggcgagugccacgugaacuucgugagaaaggagcagugcagcuucagcugggacuggggccccagcuuccccacccagggcaucuggaaggacgugagaaucgaggccuacaacaucugccaccugaacuacuucaccuucagccccaucuacgacaagagcgcccaggaguggaaccuggagaucgagagcaccuucgacguggugagcagcaagcccgugggcggccaggugaucguggccauccccaagcugcagacccagcagaccuacagcaucgagcugcagcccggcaagagaaucguggagcuguucgugaacaucagcaagaacaucaccguggagaccugguggccccacggccacggcaaccagaccggcuacaacaugaccgugcuguucgagcuggacggcggccugaacaucgagaagagcgccaagguguacuucagaaccguggagcugaucgaggagcccaucaagggcagccccggccugagcuucuacuucaagaucaacggcuuccccaucuuccugaagggcagcaacuggauccccgccgacagcuuccaggacagagugaccagcgagcugcugagacugcugcugcagagcgugguggacgccaacaugaacacccugagaguguggggcggcggcaucuacgagcaggacgaguucuacgagcugugcgacgagcugggcaucaugguguggcaggacuucauguucgccugcgcccuguaccccaccgaccagggcuuccuggacagcgugaccgccgagguggccuaccagaucaagagacugaagagccaccccagcaucaucaucuggagcggcaacaacgagaacgaggaggcccugaugaugaacugguaccacaucagcuucaccgacagacccaucuacaucaaggacuacgugacccuguacgugaagaacaucagagagcuggugcuggccggcgacaagagcagacccuucaucaccagcagccccaccaacggcgccgagaccguggccgaggccugggugagccagaaccccaacagcaacuacuucggcgacgugcacuucuacgacuacaucagcgacugcuggaacuggaagguguuccccaaggccagauucgccagcgaguacggcuaccagagcuggcccagcuucagcacccuggagaaggugagcagcaccgaggacuggagcuucaacagcaaguucagccugcacagacagcaccacgagggcggcaacaagcagaugcuguaccaggccggccugcacuucaagcugccccagagcaccgacccccugagaaccuucaaggacaccaucuaccugacccaggugaugcaggcccagugcgugaagaccgagaccgaguucuacagaagaagcagaagcgagaucguggaccagcagggccacaccaugggcgcccuguacuggcagcugaacgacaucuggcaggcccccagcugggccagccuggaguacggcggcaaguggaagaugcugcacuacuucgcccagaacuucuucgccccccugcugcccgugggcuucgagaacgagaacaccuucuacaucuacggcgugagcgaccugcacagcgacuacagcaugacccugagcgugagagugcacaccuggagcagccuggagcccgugugcagcagagugaccgagagauucgugaugaagggcggcgaggccgugugccuguacgaggagcccgugagcgagcugcugagaagaugcggcaacugcaccagagagagcugcguggugagcuucuaccugagcgccgaccacgagcugcugagccccaccaacuaccacuuccugagcagccccaaggaggccgugggccugugcaaggcccagaucaccgccaucaucagccagcagggcgacaucuucguguucgaccuggagaccagcgccguggcccccuucguguggcuggacgugggcagcauccccggcagauucagcgacaacggcuuccugaugaccgagaagaccagaaccauccuguucuaccccugggagcccaccagcaagaacgagcuggagcagagcuuccacgugaccagccugaccgacaucuacuaa

SEQ ID NO: 19578 - RNA, 1389 nt, Artificial Sequence
  MANEA__Homo_sapiens__NP_078917
auggccaaguucagaagaagaaccugcaucauccuggcccuguucauccuguucaucuucagccugaugaugggccugaagaugcugagacccaacaccgccaccuucggcgcccccuucggccuggaccugcugcccgagcugcaccagagaaccauccaccugggcaagaacuucgacuuccagaagagcgacagaaucaacagcgagaccaacaccaagaaccugaagagcguggagaucaccaugaagcccagcaaggccagcgagcugaaccuggacgagcugcccccccugaacaacuaccugcacguguucuacuacagcugguacggcaacccccaguucgacggcaaguacauccacuggaaccaccccgugcuggagcacugggaccccagaaucgccaagaacuacccccagggcagacacaacccccccgacgacaucggcagcagcuucuaccccgagcugggcagcuacagcagcagagaccccagcgugaucgagacccacaugagacagaugagaagcgccagcaucggcgugcuggcccugagcugguacccccccgacgugaacgacgagaacggcgagcccaccgacaaccuggugcccaccauccuggacaaggcccacaaguacaaccugaaggugaccuuccacaucgagcccuacagcaacagagacgaccagaacauguacaagaacgugaaguacaucaucgacaaguacggcaaccaccccgccuucuacagauacaagaccaagaccggcaacgcccugcccauguucuacguguacgacagcuacaucaccaagcccgagaagugggccaaccugcugaccaccagcggcagcagaagcaucagaaacagccccuacgacggccuguucaucgcccugcugguggaggagaagcacaaguacgacauccugcagagcggcuucgacggcaucuacaccuacuucgccaccaacggcuucaccuacggcagcagccaccagaacugggccagccugaagcuguucugcgacaaguacaaccugaucuucauccccagcgugggccccggcuacaucgacaccagcaucagacccuggaacacccagaacaccagaaacagaaucaacggcaaguacuacgagaucggccugagcgccgcccugcagaccagacccagccugaucagcaucaccagcuucaacgaguggcacgagggcacccagaucgagaaggccgugcccaagagaaccagcaacaccguguaccuggacuacagaccccacaagcccggccuguaccuggagcugaccagaaaguggagcgagaaguacagcaaggagagagccaccuacgcccuggacagacagcugcccgugagcuaa

SEQ ID NO: 19579 - RNA, 558 nt, Artificial Sequence
  MANF__Homo_sapiens__NP_006001
augagaagaaugagaagaaugugggccacccagggccuggccguggcccuggcccugagcgugcugcccggcagcagagcccugagacccggcgacugcgaggugugcaucagcuaccugggcagauucuaccaggaccugaaggacagagacgugaccuucagccccgccaccaucgagaacgagcugaucaaguucugcagagaggccagaggcaaggagaacagacugugcuacuacaucggcgccaccgacgacgccgccaccaagaucaucaacgaggugagcaagccccuggcccaccacauccccguggagaagaucugcgagaagcugaagaagaaggacagccagaucugcgagcugaaguacgacaagcagaucgaccugagcaccguggaccugaagaagcugagagugaaggagcugaagaagauccuggacgacuggggcgagaccugcaagggcugcgccgagaagagcgacuacaucagaaagaucaacgagcugaugcccaaguacgcccccaaggccgccagcgccagaaccgaccuguaa

SEQ ID NO: 19580 - RNA, 1296 nt, Artificial Sequence
  MANSC1__Homo_sapiens__NP_060520
auguucuucggcggcgagggcagccugaccuacacccuggugaucaucugcuuccugacccugagacugagcgccagccagaacugccugaagaagagccuggaggacguggugaucgacauccagagcagccugagcaagggcaucagaggcaacgagcccguguacaccagcacccaggaggacugcaucaacagcugcugcagcaccaagaacaucagcggcgacaaggccugcaaccugaugaucuucgacaccagaaagaccgccagacagcccaacugcuaccuguucuucugccccaacgaggaggccugcccccugaagcccgccaagggccugaugagcuacagaaucaucaccgacuuccccagccugaccagaaaccugcccagccaggagcugccccaggaggacagccugcugcacggccaguucagccaggccgugaccccccuggcccaccaccacaccgacuacagcaagcccaccgacaucagcuggagagacacccugagccagaaguucggcagcagcgaccaccuggagaagcuguucaagauggacgaggccagcgcccagcugcuggccuacaaggagaagggccacagccagagcagccaguucagcagcgaccaggagaucgcccaccugcugcccgagaacgugagcgcccugcccgccaccguggccguggccagcccccacaccaccagcgccacccccaagcccgccacccugcugcccaccaacgccagcgugacccccagcggcaccagccagccccagcuggccaccaccgccccccccgugaccaccgugaccagccagccccccaccacccugaucagcaccguguucaccagagccgccgccacccugcaggccauggccaccaccgccgugcugaccaccaccuuccaggcccccaccgacagcaagggcagccuggagaccauccccuucaccgagaucagcaaccugacccugaacaccggcaacguguacaaccccaccgcccugagcaugagcaacguggagagcagcaccaugaacaagaccgccagcugggagggcagagaggccagccccggcagcagcagccagggcagcgugcccgagaaccaguacggccugcccuucgagaaguggcugcugaucggcagccugcuguucggcgugcuguuccuggugaucggccuggugcugcugggcagaauccugagcgagagccugagaagaaagagauacagcagacuggacuaccugaucaacggcaucuacguggacaucuaa

SEQ ID NO: 19581 - RNA, 1584 nt, Artificial Sequence
  MAOA__Homo_sapiens__NP_000231
auggagaaccaggagaaggccagcaucgccggccacauguucgacgugguggugaucggcggcggcaucagcggccugagcgccgccaagcugcugaccgaguacggcgugagcgugcuggugcuggaggccagagacagagugggcggcagaaccuacaccaucagaaacgagcacguggacuacguggacgugggcggcgccuacgugggccccacccagaacagaauccugagacugagcaaggagcugggcaucgagaccuacaaggugaacgugagcgagagacuggugcaguacgugaagggcaagaccuaccccuucagaggcgccuucccccccguguggaaccccaucgccuaccuggacuacaacaaccuguggagaaccaucgacaacaugggcaaggagauccccaccgacgcccccugggaggcccagcacgccgacaagugggacaagaugaccaugaaggagcugaucgacaagaucugcuggaccaagaccgccagaagauucgccuaccuguucgugaacaucaacgugaccagcgagccccacgaggugagcgcccugugguuccugugguacgugaagcagugcggcggcaccaccagaaucuucagcgugaccaacggcggccaggagagaaaguucgugggcggcagcggccaggugagcgagagaaucauggaccugcugggcgaccaggugaagcugaaccaccccgugacccacguggaccagagcagcgacaacaucaucaucgagacccugaaccacgagcacuacgagugcaaguacgugaucaacgccaucccccccacccugaccgccaagauccacuucagacccgagcugcccgccgagagaaaccagcugauccagagacugcccaugggcgccgugaucaagugcaugauguacuacaaggaggccuucuggaagaagaaggacuacugcggcugcaugaucaucgaggacgaggacgcccccaucagcaucacccuggacgacaccaagcccgacggcagccugcccgccaucaugggcuucauccuggccagaaaggccgacagacuggccaagcugcacaaggagaucagaaagaagaagaucugcgagcuguacgccaaggugcugggcagccaggaggcccugcaccccgugcacuacgaggagaagaacuggugcgaggagcaguacagcggcggcugcuacaccgccuacuucccccccggcaucaugacccaguacggcagagugaucagacagcccgugggcagaaucuucuucgccggcaccgagaccgccaccaaguggagcggcuacauggagggcgccguggaggccggcgagagagccgccagagaggugcugaacggccugggcaaggugaccgagaaggacaucugggugcaggagcccgagagcaaggacgugcccgccguggagaucacccacaccuucugggagagaaaccugcccagcgugagcggccugcugaagaucaucggcuucagcaccagcgugaccgcccugggcuucgugcuguacaaguacaagcugcugcccagaagcuaa

SEQ ID NO: 19582 - RNA, 1563 nt, Artificial Sequence
  MAOB__Homo_sapiens__NP_000889
augagcaacaagugcgacguggugguggugggcggcggcaucagcggcauggccgccgccaagcugcugcacgacagcggccugaacgugguggugcuggaggccagagacagagugggcggcagaaccuacacccugagaaaccagaaggugaaguacguggaccugggcggcagcuacgugggccccacccagaacagaauccugagacuggccaaggagcugggccuggagaccuacaaggugaacgagguggagagacugauccaccacgugaagggcaagagcuaccccuucagaggccccuucccccccguguggaaccccaucaccuaccuggaccacaacaacuucuggagaaccauggacgacaugggcagagagauccccagcgacgcccccuggaaggccccccuggccgaggagugggacaacaugaccaugaaggagcugcuggacaagcugugcuggaccgagagcgccaagcagcuggccacccuguucgugaaccugugcgugaccgccgagacccacgaggugagcgcccugugguuccugugguacgugaagcagugcggcggcaccaccagaaucaucagcaccaccaacggcggccaggagagaaaguucgugggcggcagcggccaggugagcgagagaaucauggaccugcugggcgacagagugaagcuggagagacccgugaucuacaucgaccagaccagagagaacgugcugguggagacccugaaccacgagauguacgaggccaaguacgugaucagcgccaucccccccacccugggcaugaagauccacuucaaccccccccugcccaugaugagaaaccagaugaucaccagagugccccugggcagcgugaucaagugcaucguguacuacaaggagcccuucuggagaaagaaggacuacugcggcaccaugaucaucgacggcgaggaggcccccguggccuacacccuggacgacaccaagcccgagggcaacuacgccgccaucaugggcuucauccuggcccacaaggccagaaagcuggccagacugaccaaggaggagagacugaagaagcugugcgagcuguacgccaaggugcugggcagccuggaggcccuggagcccgugcacuacgaggagaagaacuggugcgaggagcaguacagcggcggcugcuacaccaccuacuucccccccggcauccugacccaguacggcagagugcugagacagcccguggacagaaucuacuucgccggcaccgagaccgccacccacuggagcggcuacauggagggcgccguggaggccggcgagagagccgccagagagauccugcacgccaugggcaagauccccgaggacgagaucuggcagagcgagcccgagagcguggacgugcccgcccagcccaucaccaccaccuuccuggagagacaccugcccagcgugcccggccugcugagacugaucggccugaccaccaucuucagcgccaccgcccugggcuuccuggcccacaagagaggccugcuggugagaguguaa

SEQ ID NO: 19583 - RNA, 3144 nt, Artificial Sequence
  MAP10__Homo_sapiens__NP_061963
auggcccacugcggccagcugaccaacuggcugugccuggccugggagagaaaggagagccccgacuuccugagcaucuuccugagauacaucgaccugacccccaagcugcacaagaucugcagcgacaagaccaucacccagaagacccacugccugcugccccugaucagcagcgcccugagcagcaucgugcugauccagggcugguggcagaagaccgcccacaaguacgccuacaagggcgccaagcacaucgagcagcagaacccccagagcagacacagacccagacccgccggcgcccugccccagaucagcagagacagcagacagagaugccugcugcugagauuccuggugagacccagaggcuucagcuucagcuucgccgagcccgccgccgccuuccccggcgccaccgccauggccgccagccugagcgagagacuguucagccuggagcugcugguggacugggugagacuggaggccagacugcugcccagccccgccgccgccguggagcaggaggaggaggaggaggagaaggagcagggcgaggccagcagccccagaggccugugccccgccguggccuucagacugcuggacuuccccacccugcugguguacccccccgacggccccggcgcccccgccgccgagcccuggcccggcgugaucagauucggcagaggcaagagcugccuguucagacugcagcccgccacccugcacugcagacugcugagaaccccccuggccacccugcugcugcagcugccccccggcagacccacccccaccccccagcugcugggcgccugcgacaucagccuggccaccgccgcccacagaguggugggccccgccgccagcggcugcagccacagacacagaggcagauucccccugcacaacagagugggcgagagaaccggcgacaucgcccuggccuacagacugaccgaccugggcagcagacugcugagccagcuggagagaccccugaccuucaccagaaccggcggcggcgccgaggugagcccccagacccagcaggagagacagcagcugcagcagcccgccagccagcccagccccaaggaggccgacaagccccugggcgagcuggagauccccgaggcccagaaggaccugaaggagauggugaagagcaaggccgagugcgacaacgugggcagcguggagaacggcaagaccaacagcguggugaccugcagcggcgccggcaacggcagaaacgugagcagccugaacgaggaggugaccgagcuggacauggagaccaacaucuucugcccccccccccuguacuacaccaaccugacccaggagaagcccccccccgcccaggccaagaucaccaucgagccccagaugaacgcccccgaggagauggacgacgccagccccgagaagaagagagugaacccccccgcccacagaagcugccugaagcaccccagcagcgccgcccacgagcacccccccaugcuggugaaccccccccacauccagaacaucggcgccaccaaccagaccugccagaccgagcagaacagaaucaacaccaucagacagcugccccugcugaacgcccugcugguggagcugagccugcuguacgaccagcccgugaccagccccgcccacauccacccccaccuggccuggcuguacagaaccgaggacaagaagagccccgagagcagcgccaagagcaccugcagaagcgaggccaagaaggacaagagaagcgugggcggcugcgagaagagcgugagccugcaguacaagaagaaccagaucgagaacuacaaggaggacaaguacagcgagaagagcagcggcgcccugcacaagagagugcccaagggcagacugcuguacggccugaccaacacccugagacugagacugaagcugaccaaccccgacaugcugguggugcacgagaagagagagcuguacagaaagagacagagccagaugcugggcaccaaguucagaauccccagcagcaaggugaagcugcugagcagcgccgagcagagccagaagccccagcugcccgaggacaaguaccuggacagcgacgccagcuucaccgagaacagcgacaccagcagacagaucagcggcguguucgacgagcccagcaccagcaaggagaccaagcugaaguacgccaccgagaagaagaccguggacugcagcaagaacagaaucaacaacgugagccuggaggagguggugagccccgccaacagcaucauccccgagagacugacccccaccaacauccugggcggcaacguggagaugaagauccagagccccugcguguuccagcaggacgccgugguggacagaaucguggacaaggagaucgacaucagacaggugaagaccaccgacaacgacauccugauggccgacaucagcgacaagagaaccggcaagaacagcugcuacgagaacaucagcgagcugaaguacagcgacgaccugagcagccccugcuacagcgaggacuucugcaccagcgaggacaccagcagaagcuucaaggcccacgacagcagcagcagaaccgagaaccccaagcacagccaguacaccagcaagagcagcgacaccggcgugagcaagaagaagaacagcagcgacagaagcagcauccugagcccccccuucagcgccggcagccccgugcacagcuacagaaaguuccacaucagcaagacccaggacaagagccuggaggaggccagcagcaucagcgccagcgaccugagcagcacccacuggaccgagcagaaggagaaccagaucgaccagaacagcaugcacaacagcgagaucaccaagagagcccaggacaucagcgugaagaccagaagcagcuggaagagccuggagaagagccagagcccccagaccagccaggugagcagcuaccugcccagcaacgugagcgagcugaacgugcuggacagcagcaccagcgaccacuucgaggagggcaacgacgacgugggcagccugaacaucagcaagcagugcaaggacaucugcgagcuggugaucaacaagcugcccggcuacaccauguaa

SEQ ID NO: 19584 - RNA, 8412 nt, Artificial Sequence
  MAP1A__Homo_sapiens__NP_002364
auggacggcguggccgaguucagcgaguacgugagcgagaccguggacgugcccagccccuucgaccugcuggagccccccaccagcggcggcuuccugaagcugagcaagcccugcugcuacaucuuccccggcggcagaggcgacagcgcccuguucgccgugaacggcuucaacauccugguggacggcggcagcgacagaaagagcugcuucuggaagcuggugagacaccuggacagaaucgacagcgugcugcugacccacaucggcgccgacaaccugcccggcaucaacggccugcugcagagaaagguggccgagcuggaggaggagcagagccagggcagcagcagcuacagcgacugggugaagaaccugaucagccccgagcugggcgugguguucuucaacgugcccgagaagcugagacugcccgacgccagcagaaaggccaagagaagcaucgaggaggccugccugacccugcagcaccugaacagacugggcauccaggccgagccccuguacagaguggugagcaacaccaucgagccccugacccuguuccacaagaugggcgugggcagacuggacauguacgugcugaaccccgugaaggacagcaaggagaugcaguuccugaugcagaagugggccggcaacagcaaggccaagaccggcaucgugcugcccaacggcaaggaggccgagaucagcgugcccuaccugaccagcaucaccgcccuggugguguggcugcccgccaaccccaccgagaagaucgugagagugcuguuccccggcaacgccccccagaacaagauccuggagggccuggagaagcugagacaccuggacuuccugagauaccccguggccacccagaaggaccuggccagcggcgccgugcccaccaaccugaagcccagcaagaucaagcagagagccgacagcaaggagagccugaaggccaccaccaagaccgccgugagcaagcuggccaagagagaggaggugguggaggagggcgccaaggaggccagaagcgagcuggccaaggagcuggccaagaccgagaagaaggccaaggagagcagcgagaagccccccgagaagcccgccaagcccgagagagugaagaccgagagcagcgaggcccugaaggccgagaagagaaagcugaucaaggacaaggugggcaagaagcaccugaaggagaagaucagcaagcuggaggagaagaaggacaaggagaagaaggagaucaagaaggagagaaaggagcugaagaaggacgagggcagaaaggaggagaagaaggacgccaagaaggaggagaagagaaaggacaccaagcccgagcugaagaagaucagcaagcccgaccugaagcccuucacccccgaggugagaaagacccuguacaaggccaaggugcccggcagagugaagaucgacagaagcagagccaucagaggcgagaaggagcugagcagcgagccccagaccccccccgcccagaagggcaccgugccccugcccaccaucagcggccacagagagcuggugcugagcagccccgaggaccugacccaggacuucgaggagaugaagagagaggagagagcccugcuggccgagcagagagacaccggccugggcgacaagcccuucccccuggacaccgccgaggagggcccccccagcaccgccauccagggcaccccccccagcgugcccggccugggccaggaggagcacgugaugaaggagaaggagcuggugcccgaggugcccgaggagcagggcagcaaggacagaggccuggacagcggcgccgagaccgaggaggagaaggacaccugggaggagaagaagcagagagaggccgagagacugcccgacagaaccgaggccagagaggagagcgagcccgaggugaaggaggacgugaucgagaaggccgagcuggaggagauggaggaggugcaccccagcgacgaggaggaggaggacgccaccaaggccgagggcuucuaccagaagcacaugcaggagccccugaaggugacccccagaagcagagaggccuucggcggcagagagcugggccugcagggcaaggcccccgagaaggagaccagccuguuccugagcagccugaccacccccgccggcgccaccgagcacgugagcuacauccaggacgagaccauccccggcuacagcgagaccgagcagaccaucagcgacgaggagauccacgacgagcccgaggagagacccgccccccccagauuccacaccagcaccuacgaccugcccggccccgagggcgccggccccuucgaggccagccagcccgccgacagcgccgugcccgccaccagcggcaagguguacggcacccccgagaccgagcugaccuaccccaccaacaucguggccgccccccuggccgaggaggagcacgugagcagcgccaccagcaucaccgagugcgacaagcugagcagcuucgccaccagcguggccgaggaccagagcguggccagccugaccgccccccagaccgaggagaccggcaagagcagccugcugcuggacaccgugaccagcauccccagcagcagaaccgaggccacccagggccuggacuacgugcccagcgccggcaccaucagccccaccagcagccuggaggaggacaagggcuucaagagcccccccugcgaggacuucagcgugaccggcgagagcgagaagagaggcgagaucaucggcaagggccugagcggcgagagagccguggaggaggaggaggaggagaccgccaacguggagaugagcgagaagcugugcagccaguacggcacccccguguucagcgcccccggccacgcccugcaccccggcgagcccgcccugggcgaggccgaggagagaugccugagccccgacgacagcaccgugaagauggccagccccccccccagcggcccccccagcgccacccacacccccuuccaccagagccccguggaggagaagagcgagccccaggacuuccaggaggccgacagcuggggcgacaccaagagaacccccggcgugggcaaggaggacgccgccgaggagaccgugaagcccggccccgaggagggcacccuggagaaggaggagaaggugcccccccccagaagcccccaggcccaggaggcccccgugaacaucgacgagggccugaccggcugcaccauccagcugcugcccgcccaggacaaggccaucguguucgagaucauggaggccggcgagcccaccggccccauccugggcgccgaggcccugcccggcggccugagaacccugccccaggagcccggcaagccccagaaggacgaggugcugagauaccccgacagaagccugagccccgaggacgccgagagccugagcgugcugagcgugcccagccccgacaccgccaaccaggagcccacccccaagagccccugcggccugaccgagcaguaccugcacaaggacagauggcccgaggugagccccgaggacacccagagccugagccugagcgaggagagccccagcaaggagaccagccuggacgugagcagcaagcagcugagccccgagagccugggcacccugcaguucggcgagcugaaccugggcaaggaggagaugggccaccugaugcaggccgaggacaccagccaccacaccgcccccaugagcgugcccgagccccacgccgccaccgccagcccccccaccgacggcaccaccagauacagcgcccagaccgacaucaccgacgacagccuggacagaaagagccccgccagcagcuucagccacagcacccccagcggcaacggcaaguaccugcccggcgccaucaccagccccgacgagcacauccugacccccgacagcagcuucagcaagagccccgagagccugcccggccccgcccuggaggacaucgccaucaagugggaggacaaggugcccggccugaaggacagaaccagcgagcagaagaaggagcccgagcccaaggacgaggugcugcagcagaaggacaagacccuggagcacaaggaggugguggagcccaaggacaccgccaucuaccagaaggacgaggcccugcacgugaagaacgaggccgugaagcagcaggacaaggcccuggagcagaagggcagagaccuggagcagaaggacaccgcccuggagcagaaggacaaggcccuggagcccaaggacaaggaccuggaggagaaggacaaggcccuggagcagaaggacaagauccccgaggagaaggacaaggcccuggagcagaaggacaccgcccuggagcagaaggacaaggcccuggagcccaaggacaaggaccuggagcagaaggacagagugcuggagcagaaggagaagauccccgaggagaaggacaaggcccuggaccagaaggugagaagcguggagcacaaggcccccgaggacaccguggccgagaugaaggacagagaccuggagcagaccgacaaggcccccgagcagaagcaccaggcccaggagcagaaggacaaggugagcgagaagaaggaccaggcccuggagcagaaguacugggcccugggccagaaggacgaggcccuggagcagaacauccaggcccuggaggagaaccaccagacccaggagcaggagagccuggugcaggaggacaagaccagaaagcccaagaugcuggaggagaagagccccgagaaggugaaggccauggaggagaagcuggaggcccugcuggagaagaccaaggcccugggccuggaggagagccuggugcaggagggcagagccagagagcaggaggagaaguacuggagaggccaggacguggugcaggaguggcaggagaccagccccaccagagaggagcccgccggcgagcagaaggagcuggcccccgccugggaggacaccagccccgagcaggacaacagauacuggagaggcagagaggacguggcccuggagcaggacaccuacuggagagagcugagcugcgagagaaaggugugguucccccacgagcuggacggccagggcgccagaccccacuacaccgaggagagagagagcaccuuccuggacgagggccccgacgacgagcaggaggugccccugagagagcacgccaccagaagccccugggccagcgacuucaaggacuuccaggagagcagcccccagaagggccuggagguggagagauggcuggccgagagccccgugggccugccccccgaggaggaggacaagcugaccagaagccccuucgagaucaucagcccccccgccagcccccccgagauggugggccagagagugcccagcgcccccggccaggagagccccauccccgaccccaagcugaugccccacaugaagaacgagcccaccacccccagcuggcuggccgacaucccccccugggugcccaaggacagaccccugccccccgccccccugagccccgcccccggcccccccacccccgcccccgagagccacacccccgcccccuucagcuggggcaccgccgaguacgacagcgugguggccgccgugcaggagggcgccgccgagcuggagggcggccccuacagcccccugggcaaggacuacagaaaggccgagggcgagagagaggaggagggcagagccgaggcccccgacaagagcagccacagcagcaaggugcccgaggccagcaagagccacgccaccaccgagcccgagcagaccgagcccgagcagagagagcccacccccuaccccgacgagagaagcuuccaguacgccgacaucuacgagcagaugaugcugaccggccugggccccgccugccccaccagagagcccccccugggcgccgccggcgacuggccccccugccugagcaccaaggaggccgccgccggcagaaacaccagcgccgagaaggagcugagcagccccaucagccccaagagccugcagagcgacacccccaccuucagcuacgccgcccuggccggccccaccgugccccccagacccgagcccggccccagcauggagcccagccugaccccccccgccgugccccccagagcccccauccugagcaagggccccagccccccccugaacggcaacauccugagcugcagccccgacagaagaagccccagccccaaggagagcggcagaagccacugggacgacagcaccagcgacagcgagcuggagaagggcgccagagagcagcccgagaaggaggcccagagccccagccccccccaccccauccccaugggcagccccacccuguggcccgagaccgaggcccacgugagccccccccuggacagccaccugggccccgccagacccagccuggacuuccccgccagcgccuucggcuucagcagccugcagcccgcccccccccagcugcccagccccgccgagcccagaagcgcccccugcggcagccuggccuucagcggcgacagagcccuggcccuggcccccggcccccccaccagaaccagacacgacgaguaccuggaggugaccaaggcccccagccuggacagcagccugccccagcugcccagccccagcagccccggcgccccccugcugagcaaccugcccagacccgccagccccgcccugagcgagggcagcagcagcgaggccaccacccccgugaucagcagcguggccgagagauucagccccagccuggaggccgccgagcaggagagcggcgagcuggaccccggcauggagcccgccgcccacagccugugggaccugaccccccugagccccgccccccccgccagccuggaccuggcccuggcccccgcccccagccugcccggcgacaugggcgacggcauccugcccugccaccuggagugcagcgaggccgccaccgagaagcccagccccuuccaggugcccagcgaggacugcgccgccaacggccccaccgagaccagccccaacccccccggccccgcccccgccaaggccgagaacgaggaggccgccgccugccccgccugggagagaggcgccuggcccgagggcgccgagagaagcagcagacccgacacccugcugagccccgagcagcccgugugccccgccggcggcagcggcggcccccccagcagcgccagccccgagguggaggccggcccccagggcugcgccaccgagcccagaccccacagaggcgagcugagccccagcuuccugaaccccccccugccccccagcaucgacgacagagaccugagcaccgaggaggugagacuggugggcagaggcggcagaagaagagugggcggccccggcaccaccggcggccccugccccgugaccgacgagaccccccccaccagcgccagcgacagcggcagcagccagagcgacagcgacgugccccccgagaccgaggagugccccagcaucaccgccgaggccgcccuggacagcgacgaggacggcgacuuccugcccguggacaaggccggcggcgugagcggcacccaccaccccagacccggccacgacccccccccccugccccagcccgaccccagacccagcccccccagacccgacgugugcauggccgaccccgagggccugagcagcgagagcggcagaguggagagacugagagagaaggagaaggugcagggcagagugggcagaagagcccccggcaaggccaagcccgccagccccgccagaagacuggaccugagaggcaagagaagccccacccccggcaagggccccgccgacagagccagcagagccccccccagacccagaagcaccaccagccaggugacccccgccgaggagaaggacggccacagccccaugagcaagggccuggugaacggccugaaggccggccccauggcccugagcagcaagggcagcagcggcgcccccguguacguggaccuggccuacauccccaaccacugcagcggcaagaccgccgaccuggacuucuucagaagagugagagccagcuacuacguggugagcggcaacgaccccgccaacggcgagcccagcagagccgugcuggacgcccugcuggagggcaaggcccaguggggcgagaaccugcaggugacccugauccccacccacgacaccgaggugaccagagagugguaccagcagacccacgagcagcagcagcagcugaacgugcuggugcuggccagcagcagcaccguggugaugcaggacgagagcuuccccgccugcaagaucgaguucuaa

SEQ ID NO: 19585 - RNA, 7407 nt, Artificial Sequence
  MAP1B__Homo_sapiens__NP_005900
auggccaccguggugguggaggccaccgagcccgagcccagcggcagcaucgccaaccccgccgccagcaccagccccagccugagccacagauuccuggacagcaaguucuaccugcuggugguggugggcgagaucgugaccgaggagcaccugagaagagccaucggcaacaucgagcugggcaucagaagcugggacaccaaccugaucgagugcaaccuggaccaggagcugaagcuguucgugagcagacacagcgccagauucagccccgaggugcccggccagaagauccugcaccacagaagcgacgugcuggagaccguggugcugaucaaccccagcgacgaggccgugagcaccgaggugagacugaugaucaccgacgccgccagacacaagcugcuggugcugaccggccagugcuucgagaacaccggcgagcugauccugcagagcggcagcuucagcuuccagaacuucaucgagaucuucaccgaccaggagaucggcgagcugcugagcaccacccaccccgccaacaaggccagccugacccuguucugccccgaggagggcgacuggaagaacagcaaccuggacagacacaaccugcaggacuucaucaacaucaagcugaacagcgccagcauccugcccgagauggagggccugagcgaguucaccgaguaccugagcgagagcguggaggugcccagccccuucgacauccuggagccccccaccagcggcggcuuccugaagcugagcaagcccugcugcuacaucuuccccggcggcagaggcgacagcgcccuguucgccgugaacggcuucaacaugcugaucaacggcggcagcgagagaaagagcugcuucuggaagcugaucagacaccuggacagaguggacagcauccugcugacccacaucggcgacgacaaccugcccggcaucaacagcaugcugcagagaaagaucgccgagcuggaggaggagcagagccagggcagcaccaccaacagcgacuggaugaagaaccugaucagccccgaccugggcgugguguuccugaacgugcccgagaaccugaagaaccccgagcccaacaucaagaugaagagaagcaucgaggaggccugcuucacccugcaguaccugaacaagcugagcaugaagcccgagccccuguucagaagcgugggcaacaccaucgaccccgugauccuguuccagaagaugggcgugggcaagcuggagauguacgugcugaaccccgugaagagcagcaaggagaugcaguacuucaugcagcaguggaccggcaccaacaaggacaaggccgaguucauccugcccaacggccaggagguggaccugcccaucagcuaccugaccagcgugagcagccugaucguguggcaccccgccaaccccgccgagaagaucaucagagugcuguuccccggcaacagcacccaguacaacauccuggagggccuggagaagcugaagcaccuggacuuccugaagcagccccuggccacccagaaggaccugaccggccaggugcccacccccguggugaagcagaccaagcugaagcagagagccgacagcagagagagccugaagcccgccgccaagccccugcccagcaagagcgugagaaaggagagcaaggaggagacccccgaggugaccaaggugaaccacguggagaagccccccaagguggagagcaaggagaaggugauggugaagaaggacaagcccaucaagaccgagaccaagcccagcgugaccgagaaggaggugcccagcaaggaggagcccagccccgugaaggccgagguggccgagaagcaggccaccgacgugaagcccaaggccgccaaggagaagaccgugaagaaggagaccaaggugaagcccgaggacaagaaggaggagaaggagaagcccaagaaggagguggccaagaaggaggacaagacccccaucaagaaggaggagaagcccaagaaggaggaggugaagaaggaggugaagaaggagaucaagaaggaggagaagaaggagcccaagaaggaggugaagaaggagaccccccccaaggaggugaagaaggaggugaagaaggaggagaagaaggaggugaagaaggaggagaaggagcccaagaaggagaucaagaagcugcccaaggacgccaagaagagcagcaccccccugagcgaggccaagaagcccgccgcccugaagcccaaggugcccaagaaggaggagagcgugaagaaggacagcguggccgccggcaagcccaaggagaagggcaagaucaaggugaucaagaaggagggcaaggccgccgaggccguggccgccgccgugggcaccggcgccaccaccgccgccgugauggccgccgccggcaucgccgccaucggccccgccaaggagcuggaggccgagagaagccugaugagcagccccgaggaccugaccaaggacuucgaggagcugaaggccgaggagguggacgugaccaaggacaucaagccccagcuggagcugaucgaggacgaggagaagcugaaggagaccgagcccguggaggccuacgugauccagaaggagagagaggugaccaagggccccgccgagagccccgacgagggcaucaccaccaccgagggcgagggcgagugcgagcagacccccgaggagcuggagcccguggagaagcagggcguggacgacaucgagaaguucgaggacgagggcgccggcuucgaggagagcagcgagaccggcgacuacgaggagaaggccgagaccgaggaggccgaggagcccgaggaggacggcgaggagcacgugugcgugagcgccagcaagcacagccccaccgaggacgaggagagcgccaaggccgaggccgacgccuacaucagagagaagagagagagcguggccagcggcgacgacagagccgaggaggacauggacgaggccaucgagaagggcgaggccgagcagagcgaggaggaggccgacgaggaggacaaggccgaggacgccagagaggaggaguacgagcccgagaagauggaggccgaggacuacgugauggccgugguggacaaggccgccgaggccggcggcgccgaggagcaguacggcuuccugaccacccccaccaagcagcugggcgcccagagccccggcagagagcccgccagcagcauccacgacgagacccugcccggcggcagcgagagcgaggccaccgccagcgacgaggagaacagagaggaccagcccgaggaguucaccgccaccagcggcuacacccagagcaccaucgagaucagcagcgagcccacccccauggacgagaugagcacccccagagacgugaugagcgacgagaccaacaacgaggagaccgagagccccagccaggaguucgugaacaucaccaaguacgagagcagccuguacagccaggaguacagcaagcccgccgacgugaccccccugaacggcuucagcgagggcagcaagaccgacgccaccgacggcaaggacuacaacgccagcgccagcaccaucagcccccccagcagcauggaggaggacaaguucagcagaagcgcccugagagacgccuacugcagcgaggugaaggccagcaccacccuggacaucaaggacagcaucagcgccgugagcagcgagaaggugagccccagcaagagccccagccugagccccagcccccccagcccccuggagaagaccccccugggcgagagaagcgugaacuucagccugacccccaacgagaucaaggugagcgccgaggccgagguggcccccgugagccccgaggugacccaggaggugguggaggagcacugcgccagccccgaggacaagacccuggagguggugagccccagccagagcgugaccggcagcgccggccacacccccuacuaccagagccccaccgacgagaagagcagccaccugcccaccgaggugaucgagaagccccccgccgugcccgugagcuucgaguucagcgacgccaaggacgagaacgagagagccagcgugagccccauggacgagcccgugcccgacagcgagagccccaucgagaaggugcugagcccccugagaagccccccccugaucggcagcgagagcgccuacgagagcuuccugagcgccgacgacaaggccagcggcagaggcgccgagagccccuucgaggagaagagcggcaagcagggcagccccgaccaggugagccccgugagcgagaugaccagcaccagccuguaccaggacaagcaggagggcaagagcaccgacuucgcccccaucaaggaggacuucggccaggagaagaagaccgacgacguggaggccaugagcagccagcccgcccuggcccuggacgagagaaagcugggcgacgugagccccacccagaucgacgugagccaguucggcagcuucaaggaggacaccaagaugagcaucagcgagggcaccgugagcgacaagagcgccacccccguggacgagggcguggccgaggacaccuacagccacauggagggcguggccagcgugagcaccgccagcguggccaccagcagcuuccccgagcccaccaccgacgacgugagccccagccugcacgccgaggugggcagcccccacagcaccgagguggacgacagccugagcgugagcguggugcagacccccaccaccuuccaggagaccgagaugagccccagcaaggaggagugccccagacccaugagcaucagcccccccgacuucagccccaagaccgccaagagcagaacccccgugcaggaccacagaagcgagcagagcagcaugagcaucgaguucggccaggagagccccgagcagagccuggccauggacuucagcagacagagccccgaccaccccaccgugggcgccggcgugcugcacaucaccgagaacggccccaccgagguggacuacagccccagcgacaugcaggacagcagccugagccacaagaucccccccauggaggagcccagcuacacccaggacaacgaccugagcgagcugaucagcgugagccagguggaggccagccccagcaccagcagcgcccacacccccagccagaucgccagcccccugcaggaggacacccugagcgacguggccccccccagagacaugagccuguacgccagccugaccagcgagaaggugcagagccuggagggcgagaagcugagccccaagagcgacaucagcccccugacccccagagagagcagcccccuguacagccccaccuucagcgacagcaccagcgccgugaaggagaagaccgccaccugccacagcagcagcagcccccccaucgacgccgccagcgccgagcccuacggcuucagagccagcgugcuguucgacaccaugcagcaccaccuggcccugaacagagaccugagcacccccggccuggagaaggacagcggcggcaagacccccggcgacuucagcuacgccuaccagaagcccgaggagaccaccagaagccccgacgaggaggacuacgacuacgagagcuacgagaagaccaccagaaccagcgacgugggcggcuacuacuacgagaagaucgagagaaccaccaagagccccagcgacagcggcuacagcuacgagaccaucggcaagaccaccaagacccccgaggacggcgacuacagcuacgagaucaucgagaagaccaccagaacccccgaggagggcggcuacagcuacgacaucagcgagaagaccaccagcccccccgaggugagcggcuacagcuacgagaagaccgagagaagcagaagacugcuggacgacaucagcaacggcuacgacgacagcgaggacggcggccacacccugggcgaccccagcuacagcuacgagaccaccgagaagaucaccagcuuccccgagagcgagggcuacagcuacgagaccagcaccaagaccaccagaacccccgacaccagcaccuacugcuacgagaccgccgagaagaucaccagaaccccccaggccagcaccuacagcuacgagaccagcgaccugugcuacaccgccgagaagaagagccccagcgaggccagacaggacguggaccugugccuggugagcagcugcgaguacaagcaccccaagaccgagcugagccccagcuucaucaaccccaacccccuggagugguucgccagcgaggagcccaccgaggagagcgagaagccccugacccagagcggcggcgccccccccccccccggcggcaagcagcagggcagacagugcgacgagaccccccccaccagcgugagcgagagcgcccccagccagaccgacagcgacgugccccccgagaccgaggagugccccagcaucaccgccgacgccaacaucgacagcgaggacgagagcgagaccauccccaccgacaagaccgugaccuacaagcacauggaccccccccccgcccccgugcaggacagaagccccagccccagacaccccgacgugagcaugguggaccccgaggcccuggccaucgagcagaaccugggcaaggcccugaagaaggaccugaaggagaagaccaagaccaagaagcccggcaccaagaccaagagcagcagccccgugaagaagagcgacggcaagagcaagccccuggccgccagccccaagcccgccggccugaaggagagcagcgacaaggugagcagaguggccagccccaagaagaaggagagcguggagaaggccgccaagcccaccaccacccccgaggugaaggccgccagaggcgaggagaaggacaaggagaccaagaacgccgccaacgccagcgccagcaagagcgccaagaccgccaccgccggccccggcaccaccaagaccaccaagagcagcgccgugccccccggccugcccguguaccuggaccugugcuacauccccaaccacagcaacagcaagaacguggacguggaguucuucaagagagugagaagcagcuacuacguggugagcggcaacgaccccgccgccgaggagcccagcagagccgugcuggacgcccugcuggagggcaaggcccaguggggcagcaacaugcaggugacccugauccccacccacgacagcgaggugaugagagagugguaccaggagacccacgagaagcagcaggaccugaacaucauggugcuggccagcagcagcaccguggugaugcaggacgagagcuuccccgccugcaagaucgagcuguaa

SEQ ID NO: 19586 - RNA, 366 nt, Artificial Sequence
  MAP1LC3A__Homo_sapiens__NP_115903
augcccagcgacagacccuucaagcagagaagaagcuucgccgacagaugcaaggaggugcagcagaucagagaccagcaccccagcaagauccccgugaucaucgagagauacaagggcgagaagcagcugcccgugcuggacaagaccaaguuccuggugcccgaccacgugaacaugagcgagcuggugaagaucaucagaagaagacugcagcugaaccccacccaggccuucuuccugcuggugaaccagcacagcauggugagcgugagcacccccaucgccgacaucuacgagcaggagaaggacgaggacggcuuccuguacaugguguacgccagccaggagaccuucggcuucuaa

SEQ ID NO: 19587 - RNA, 378 nt, Artificial Sequence
  MAP1LC3B2__Homo_sapiens__NP_001078950
augcccagcgagaagaccuucaagcagagaagaaccuucgagcagagaguggaggacgugagacugaucagagagcagcaccccaccaagauccccgugaucaucgagagauacaagggcgagaagcagcugcccgugcuggacaagaccaaguuccuggugcccgaccacgugaacaugagcgagcugaucaagaucaucagaagaagacugcagcugaacgccaaccaggccuucuuccugcuggugaacggccacagcauggugagcgugagcacccccaucagcgagguguacgagagcgagaaggacgaggacggcuuccuguacauggugugcgccagccaggagaccuucggcaugaagcugagcguguaa

SEQ ID NO: 19588 - RNA, 378 nt, Artificial Sequence
  MAP1LC3B__Homo_sapiens__NP_073729
augcccagcgagaagaccuucaagcagagaagaaccuucgagcagagaguggaggacgugagacugaucagagagcagcaccccaccaagauccccgugaucaucgagagauacaagggcgagaagcagcugcccgugcuggacaagaccaaguuccuggugcccgaccacgugaacaugagcgagcugaucaagaucaucagaagaagacugcagcugaacgccaaccaggccuucuuccugcuggugaacggccacagcauggugagcgugagcacccccaucagcgagguguacgagagcgagaaggacgaggacggcuuccuguacaugguguacgccagccaggagaccuucggcaugaagcugagcguguaa

SEQ ID NO: 19589 - RNA, 3180 nt, Artificial Sequence
  MAP1S__Homo_sapiens__NP_060644
auggccgccguggccggcagcggcgccgccgccgcccccagcagccugcugcugguggugggcagcgaguucggcagccccggccugcugaccuacgugcuggaggagcuggagagaggcaucagaagcugggacguggaccccggcgugugcaaccuggacgagcagcugaagguguucgugagcagacacagcgccaccuucagcagcaucgugaagggccagagaagccugcaccacagaggcgacaaccuggagacccuggugcugcugaaccccagcgacaagagccuguacgacgagcugagaaaccugcugcuggaccccgccagccacaagcugcuggugcuggccggccccugccuggaggagaccggcgagcugcugcugcagaccggcggcuucagcccccaccacuuccugcaggugcugaaggacagagagaucagagacauccuggccaccacccccccccccgugcagccccccauccugaccaucaccugccccaccuucggcgacugggcccagcuggcccccgccgugcccggccugcagggcgcccugagacugcagcugagacugaacccccccgcccagcugcccaacagcgagggccugugcgaguuccuggaguacguggccgagagccuggagccccccagccccuucgagcugcuggagccccccaccagcggcggcuuccugagacugggcagacccugcugcuacaucuuccccggcggccugggcgacgccgccuucuucgccgugaacggcuucaccgugcuggugaacggcggcagcaaccccaagagcagcuucuggaagcuggugagacaccuggacagaguggacgccgugcuggugacccaccccggcgccgacagccugcccggccugaacagccugcugagaagaaagcuggccgagagaagcgagguggccgccggcggcggcagcugggacgacagacugagaagacugaucagccccaaccugggcgugguguucuucaacgccugcgaggccgccagcagacuggccagaggcgaggacgaggccgagcuggcccugagccugcuggcccagcugggcaucaccccccugccccugagcagaggccccgugcccgccaagcccaccgugcuguucgagaagaugggcgugggcagacuggacauguacgugcugcacccccccagcgccggcgccgagagaacccuggccagcgugugcgcccugcugguguggcaccccgccggccccggcgagaagguggugagagugcuguuccccggcugcaccccccccgccugccugcuggacggccuggugagacugcagcaccugagauuccugagagagcccguggugaccccccaggaccuggagggccccggcagagccgagagcaaggagagcgugggcagcagagacagcagcaagagagagggccugcuggccacccaccccagacccggccaggagagacccggcguggccagaaaggagcccgccagagccgaggcccccagaaagaccgagaaggaggccaagacccccagagagcugaagaaggaccccaagcccagcgugagcagaacccagcccagagaggugagaagagccgccagcagcgugcccaaccugaagaagaccaacgcccaggccgcccccaagcccagaaaggcccccagcaccagccacagcggcuucccccccguggccaacggccccagaagcccccccagccugagaugcggcgaggccagcccccccagcgccgccugcggcagccccgccagccagcugguggccacccccagccuggagcugggccccauccccgccggcgaggagaaggcccuggagcugccccuggccgccagcagcauccccagacccagaacccccagccccgagagccacagaagccccgccgagggcagcgagagacugagccugagcccccugagaggcggcgaggccggccccgacgccagccccaccgugaccacccccaccgugaccacccccagccugcccgccgaggugggcagcccccacagcaccgagguggacgagagccugagcgugagcuucgagcaggugcugccccccagcgcccccaccagcgaggccggccugagccugccccugagaggccccagagccagaagaagcgccagcccccacgacguggaccugugccuggugagccccugcgaguucgagcacagaaaggccgugcccauggcccccgcccccgccagccccggcagcagcaacgacagcagcgccagaagccaggagagagccggcggccugggcgccgaggagaccccccccaccagcgugagcgagagccugcccacccugagcgacagcgaccccgugccccuggcccccggcgccgccgacagcgacgaggacaccgagggcuucggcgugcccagacacgacccccugcccgacccccugaaggugccccccccccugcccgaccccagcagcaucugcaugguggaccccgagaugcugccccccaagaccgccagacagaccgagaacgugagcagaaccagaaagccccuggccagacccaacagcagagccgccgcccccaaggccacccccguggccgccgccaagaccaagggccuggccggcggcgacagagccagcagaccccugagcgccagaagcgagcccagcgagaagggcggcagagccccccugagcagaaagagcagcacccccaagaccgccaccagaggccccagcggcagcgccagcagcagacccggcgugagcgccaccccccccaagagccccguguaccuggaccuggccuaccugcccagcggcagcagcgcccaccugguggacgaggaguucuuccagagagugagagcccugugcuacgugaucagcggccaggaccagagaaaggaggagggcaugagagccgugcuggacgcccugcuggccagcaagcagcacugggacagagaccugcaggugacccugauccccaccuucgacagcguggccaugcacaccugguacgccgagacccacgccagacaccaggcccugggcaucaccgugcugggcagcaacagcauggugagcaugcaggacgacgccuuccccgccugcaagguggaguucuaa

SEQ ID NO: 19590 - RNA, 1680 nt, Artificial Sequence
  MAP2__Homo_sapiens__NP_001034627
auggccgacgagagaaaggacgaggccaaggccccccacuggaccagcgccccccugaccgaggccagcgcccacagccacccccccgagaucaaggaccagggcggcgccggcgagggccuggugagaagcgccaacggcuuccccuacagagaggacgaggagggcgccuucggcgagcacggcagccagggcaccuacagcaacaccaaggagaacggcaucaacggcgagcugaccagcgccgacagagagaccgccgaggaggugagcgccagaaucgugcagguggugaccgccgaggccguggccgugcugaagggcgagcaggagaaggaggcccagcacaaggaccagaccgccgcccugccccuggccgccgaggagaccgccaaccugccccccagccccccccccagccccgccagcgagcagaccgugaccguggaggaggccgccggcggcgagagcgcccuggcccccagcguguucaagcaggccaaggacaaggugagcaacagcacccugagcaagauccccgcccugcagggcagcaccaagagccccagauacagcagcgccugccccagcaccaccaagagagccaccuucagcgacagccugcugauccagcccaccagcgccggcagcaccgacagacugcccuacagcaagagcggcaacaaggacggcgugaccaagagccccgagaagagaagcagccugcccagacccagcagcauccugccccccagaagaggcgugagcggcgacagagacgagaacagcuucagccugaacagcagcaucagcagcagcgccagaagaaccaccagaagcgagcccaucagaagagccggcaagagcggcaccagcacccccaccacccccggcagcaccgccaucacccccggcaccccccccagcuacagcagcagaacccccggcacccccggcacccccagcuaccccagaaccccccacacccccggcacccccaagagcgccauccuggugcccagcgagaagaagguggccaucaucagaaccccccccaagagccccgccacccccaagcagcugagacugaucaaccagccccugcccgaccugaagaacgugaagagcaagaucggcagcaccgacaacaucaaguaccagcccaagggcggccaggugagaauccugaacaagaagaucgacuucagcaaggugcagagcagaugcggcagcaaggacaacaucaagcacagcgccggcggcggcaacgugcagaucgugaccaagaagaucgaccugagccacgugaccagcaagugcggcagccugaagaacaucagacacagacccggcggcggcagagugaagaucgagagcgugaagcuggacuucaaggagaaggcccaggccaaggugggcagccuggacaacgcccaccacgugcccggcggcggcaacgugaagaucgacagccagaagcugaacuucagagagcacgccaaggccagaguggaccacggcgccgagaucaucacccagagccccggcagaagcagcguggccagccccagaagacugagcaacgugagcagcagcggcagcaucaaccugcuggagagcccccagcuggccacccuggccgaggacgugaccgccgcccuggccaagcagggccuguaa

SEQ ID NO: 19591 - RNA, 1182 nt, Artificial Sequence
  MAP2K1__Homo_sapiens__NP_002746
augcccaagaagaagcccacccccauccagcugaaccccgcccccgacggcagcgccgugaacggcaccagcagcgccgagaccaaccuggaggcccugcagaagaagcuggaggagcuggagcuggacgagcagcagagaaagagacuggaggccuuccugacccagaagcagaaggugggcgagcugaaggacgacgacuucgagaagaucagcgagcugggcgccggcaacggcggcgugguguucaaggugagccacaagcccagcggccuggugauggccagaaagcugauccaccuggagaucaagcccgccaucagaaaccagaucaucagagagcugcaggugcugcacgagugcaacagccccuacaucgugggcuucuacggcgccuucuacagcgacggcgagaucagcaucugcauggagcacauggacggcggcagccuggaccaggugcugaagaaggccggcagaauccccgagcagauccugggcaaggugagcaucgccgugaucaagggccugaccuaccugagagagaagcacaagaucaugcacagagacgugaagcccagcaacauccuggugaacagcagaggcgagaucaagcugugcgacuucggcgugagcggccagcugaucgacagcauggccaacagcuucgugggcaccagaagcuacaugagccccgagagacugcagggcacccacuacagcgugcagagcgacaucuggagcaugggccugagccugguggagauggccgugggcagauaccccauccccccccccgacgccaaggagcuggagcugauguucggcugccagguggagggcgacgccgccgagaccccccccagacccagaacccccggcagaccccugagcagcuacggcauggacagcagaccccccauggccaucuucgagcugcuggacuacaucgugaacgagcccccccccaagcugcccagcggcguguucagccuggaguuccaggacuucgugaacaagugccugaucaagaaccccgccgagagagccgaccugaagcagcugauggugcacgccuucaucaagagaagcgacgccgaggagguggacuucgccggcuggcugugcagcaccaucggccugaaccagcccagcacccccacccacgccgccggcguguaa

SEQ ID NO: 19592 - RNA, 1203 nt, Artificial Sequence
  MAP2K2__Homo_sapiens__NP_109587
augcuggccagaagaaagcccgugcugcccgcccugaccaucaaccccaccaucgccgagggccccagccccaccagcgagggcgccagcgaggccaaccugguggaccugcagaagaagcuggaggagcuggagcuggacgagcagcagaagaagagacuggaggccuuccugacccagaaggccaaggugggcgagcugaaggacgacgacuucgagagaaucagcgagcugggcgccggcaacggcggcguggugaccaaggugcagcacagacccagcggccugaucauggccagaaagcugauccaccuggagaucaagcccgccaucagaaaccagaucaucagagagcugcaggugcugcacgagugcaacagccccuacaucgugggcuucuacggcgccuucuacagcgacggcgagaucagcaucugcauggagcacauggacggcggcagccuggaccaggugcugaaggaggccaagagaauccccgaggagauccugggcaaggugagcaucgccgugcugagaggccuggccuaccugagagagaagcaccagaucaugcacagagacgugaagcccagcaacauccuggugaacagcagaggcgagaucaagcugugcgacuucggcgugagcggccagcugaucgacagcauggccaacagcuucgugggcaccagaagcuacauggcccccgagagacugcagggcacccacuacagcgugcagagcgacaucuggagcaugggccugagccugguggagcuggccgugggcagauaccccauccccccccccgacgccaaggagcuggaggccaucuucggcagacccgugguggacggcgaggagggcgagccccacagcaucagccccagacccagaccccccggcagacccgugagcggccacggcauggacagcagacccgccauggccaucuucgagcugcuggacuacaucgugaacgagcccccccccaagcugcccaacggcguguucacccccgacuuccaggaguucgugaacaagugccugaucaagaaccccgccgagagagccgaccugaagaugcugaccaaccacaccuucaucaagagaagcgagguggaggagguggacuucgccggcuggcugugcaagacccugagacugaaccagcccggcacccccaccagaaccgccguguaa

SEQ ID NO: 19593 - RNA, 957 nt, Artificial Sequence
  MAP2K3__Homo_sapiens__NP_002747
augagcaagccccccgcccccaaccccaccccccccagaaaccuggacagcagaaccuucaucaccaucggcgacagaaacuucgagguggaggccgacgaccuggugaccaucagcgagcugggcagaggcgccuacggcgugguggagaaggugagacacgcccagagcggcaccaucauggccgugaagagaaucagagccaccgugaacagccaggagcagaagagacugcugauggaccuggacaucaacaugagaaccguggacugcuucuacaccgugaccuucuacggcgcccuguucagagagggcgacguguggaucugcauggagcugauggacaccagccuggacaaguucuacagaaaggugcuggacaagaacaugaccauccccgaggacauccugggcgagaucgccgugagcaucgugagagcccuggagcaccugcacagcaagcugagcgugauccacagagacgugaagcccagcaacgugcugaucaacaaggagggccacgugaagaugugcgacuucggcaucagcggcuaccugguggacagcguggccaagaccauggacgccggcugcaagcccuacauggcccccgagagaaucaaccccgagcugaaccagaagggcuacaacgugaagagcgacguguggagccugggcaucaccaugaucgagauggccauccugagauuccccuacgagagcuggggcacccccuuccagcagcugaagcaggugguggaggagcccagcccccagcugcccgccgacagauucagccccgaguucguggacuucaccgcccagugccugagaaagaaccccgccgagagaaugagcuaccuggagcugauggagcaccccuucuucacccugcacaagaccaagaagaccgacaucgccgccuucgugaaggagauccugggcgaggacagcuaa

SEQ ID NO: 19594 - RNA, 1233 nt, Artificial Sequence
  MAP2K4__Homo_sapiens__NP_001268364
auggccgcccccagccccagcggcggcggcggcagcggcggcggcagcggcagcggcacccccggccccgugggcagccccgcccccggccaccccgccgugagcagcaugcagggcuuccagaucaacuucugcgagaaggcccagagcaagagaaaggcccugaagcugaacuucgccaacccccccuucaagagcaccgccagauucacccugaaccccaaccccaccggcgugcagaacccccacaucgagagacugagaacccacagcaucgagagcagcggcaagcugaagaucagccccgagcagcacugggacuucaccgccgaggaccugaaggaccugggcgagaucggcagaggcgccuacggcagcgugaacaagauggugcacaagcccagcggccagaucauggccgugaagagaaucagaagcaccguggacgagaaggagcagaagcagcugcugauggaccuggacguggugaugagaagcagcgacugccccuacaucgugcaguucuacggcgcccuguucagagagggcgacugcuggaucugcauggagcugaugagcaccagcuucgacaaguucuacaaguacguguacagcgugcuggacgacgugauccccgaggagauccugggcaagaucacccuggccaccgugaaggcccugaaccaccugaaggagaaccugaagaucauccacagagacaucaagcccagcaacauccugcuggacagaagcggcaacaucaagcugugcgacuucggcaucagcggccagcugguggacagcaucgccaagaccagagacgccggcugcagacccuacauggcccccgagagaaucgaccccagcgccagcagacagggcuacgacgugagaagcgacguguggagccugggcaucacccuguacgagcuggccaccggcagauuccccuaccccaaguggaacagcguguucgaccagcugacccagguggugaagggcgaccccccccagcugagcaacagcgaggagagagaguucagccccagcuucaucaacuucgugaaccugugccugaccaaggacgagagcaagagacccaaguacaaggagcugcugaagcaccccuucauccugauguacgaggagagagccguggagguggccugcuacgugugcaagauccuggaccagaugcccgccacccccagcagccccauguacguggacuaa

SEQ ID NO: 19595 - RNA, 1239 nt, Artificial Sequence
  MAP2K5__Homo_sapiens__NP_001193733
augauggagggccacuucccccagagcgacgugaucggccaggugcugcccgaggccaccaccaccgccuucgaguacgaggacgaggacggcgacagaaucaccgugagaagcgacgaggagaugaaggccaugcugagcuacuacuacagcaccgugauggagcagcaggugaacggccagcugaucgagccccugcagaucuuccccagagccugcaagccccccggcgagagaaacauccacggccugaaggugaacaccagagccggccccagccagcacagcagccccgccgugagcgacagccugcccagcaacagccugaagaagagcagcgccgagcugaagaagauccuggccaacggccagaugaacgagcaggacaucagauacagagacacccugggccacggcaacggcggcaccguguacaaggccuaccacgugcccagcggcaagauccuggccgugaaggugauccugcuggacaucacccuggagcugcagaagcagaucaugagcgagcuggagauccuguacaagugcgacagcagcuacaucaucggcuucuacggcgccuucuucguggagaacagaaucagcaucugcaccgaguucauggacggcggcagccuggacguguacagaaagaugcccgagcacgugcugggcagaaucgccguggccguggugaagggccugaccuaccuguggagccugaagauccugcacagagacgugaagcccagcaacaugcuggugaacaccagaggccaggugaagcugugcgacuucggcgugagcacccagcuggugaacagcaucgccaagaccuacgugggcaccaacgccuacauggcccccgagagaaucagcggcgagcaguacggcauccacagcgacguguggagccugggcaucagcuucauggagcuggcccugggcagauuccccuacccccagauccagaagaaccagggcagccugaugccccugcagcugcugcagugcaucguggacgaggacagccccgugcugcccgugggcgaguucagcgagcccuucgugcacuucaucacccagugcaugagaaagcagcccaaggagagacccgcccccgaggagcugaugggccaccccuucaucgugcaguucaacgacggcaacgccgccguggugagcaugugggugugcagagcccuggaggagagaagaagccagcagggcccccccuaa

SEQ ID NO: 19596 - RNA, 1005 nt, Artificial Sequence
  MAP2K6__Homo_sapiens__NP_002749
augagccagagcaagggcaagaagagaaaccccggccugaagauccccaaggaggccuucgagcagccccagaccagcagcaccccccccagagaccuggacagcaaggccugcaucagcaucggcaaccagaacuucgaggugaaggccgacgaccuggagcccaucauggagcugggcagaggcgccuacggcgugguggagaagaugagacacgugcccagcggccagaucauggccgugaagagaaucagagccaccgugaacagccaggagcagaagagacugcugauggaccuggacaucagcaugagaaccguggacugccccuucaccgugaccuucuacggcgcccuguucagagagggcgacguguggaucugcauggagcugauggacaccagccuggacaaguucuacaagcaggugaucgacaagggccagaccauccccgaggacauccugggcaagaucgccgugagcaucgugaaggcccuggagcaccugcacagcaagcugagcgugauccacagagacgugaagcccagcaacgugcugaucaacgcccugggccaggugaagaugugcgacuucggcaucagcggcuaccugguggacagcguggccaagaccaucgacgccggcugcaagcccuacauggcccccgagagaaucaaccccgagcugaaccagaagggcuacagcgugaagagcgacaucuggagccugggcaucaccaugaucgagcuggccauccugagauuccccuacgacagcuggggcacccccuuccagcagcugaagcaggugguggaggagcccagcccccagcugcccgccgacaaguucagcgccgaguucguggacuucaccagccagugccugaagaagaacagcaaggagagacccaccuaccccgagcugaugcagcaccccuucuucacccugcacgagagcaagggcaccgacguggccagcuucgugaagcugauccugggcgacuaa

SEQ ID NO: 19597 - RNA, 1308 nt, Artificial Sequence
  MAP2K7__Homo_sapiens__NP_001284484
auggccgccagcagccuggagcagaagcugagcagacuggaggccaagcugaagcaggagaacagagaggccagaagaagaaucgaccugaaccuggacaucagcccccagagacccagacccaucaucgugaucacccugagccccgcccccgcccccagccagagagccgcccugcagcugccccuggccaacgacggcggcagcagaagccccagcagcgagagcagcccccagcaccccaccccccccgccagacccagacacaugcugggccugcccagcacccuguucacccccagaagcauggagagcaucgagaucgaccagaagcugcaggagaucaugaagcagaccggcuaccugaccaucggcggccagagauaccaggccgagaucaacgaccuggagaaccugggcgagaugggcagcggcaccugcggccagguguggaagaugagauucagaaagaccggccacgugaucgccgugaagcagaugagaagaagcggcaacaaggaggagaacaagagaauccugauggaccuggacguggugcugaagagccacgacugccccuacaucgugcagugcuucggcaccuucaucaccaacaccgacguguucaucgccauggagcugaugggcaccugcgccgagaagcugaagaagagaaugcagggccccauccccgagagaauccugggcaagaugaccguggccaucgugaaggcccuguacuaccugaaggagaagcacggcgugauccacagagacgugaagcccagcaacauccugcuggacgagagaggccagaucaagcugugcgacuucggcaucagcggcagacugguggacagcaaggccaagaccagaagcgccggcugcgccgccuacauggcccccgagagaaucgacccccccgaccccaccaagcccgacuacgacaucagagccgacguguggagccugggcaucagccugguggagcuggccaccggccaguuccccuacaagaacugcaagaccgacuucgaggugcugaccaaggugcugcaggaggagcccccccugcugcccggccacaugggcuucagcggcgacuuccagagcuucgugaaggacugccugaccaaggaccacagaaagagacccaaguacaacaagcugcuggagcacagcuucaucaagagauacgagacccuggagguggacguggccagcugguucaaggacgugauggccaagaccgagagccccagaaccagcggcgugcugagccagccccaccugcccuucuucagauaa

SEQ ID NO: 19598 - RNA, 2865 nt, Artificial Sequence
  MAP3K10__Homo_sapiens__NP_002437
auggaggaggaggagggcgccguggccaaggaguggggcaccacccccgccggccccguguggaccgccguguucgacuacgaggccgccggcgacgaggagcugacccugagaagaggcgacagagugcaggugcugagccaggacugcgccgugagcggcgacgagggcugguggaccggccagcugcccagcggcagagugggcguguuccccagcaacuacguggcccccggcgcccccgccgcccccgccggccugcagcugccccaggagauccccuuccacgagcugcagcuggaggagaucaucggcgugggcggcuucggcaagguguacagagcccuguggagaggcgaggagguggccgugaaggccgccagacuggaccccgagaaggaccccgccgugaccgccgagcaggugugccaggaggccagacuguucggcgcccugcagcaccccaacaucaucgcccugagaggcgccugccugaaccccccccaccugugccuggugauggaguacgccagaggcggcgcccugagcagagugcuggccggcagaagagugcccccccacgugcuggugaacugggccgugcagguggccagaggcaugaacuaccugcacaacgacgcccccgugcccaucauccacagagaccugaagagcaucaacauccugauccuggaggccaucgagaaccacaaccuggccgacaccgugcugaagaucaccgacuucggccuggccagagaguggcacaagaccaccaagaugagcgccgccggcaccuacgccuggauggcccccgaggugaucagacugagccuguucagcaagagcagcgacguguggagcuucggcgugcugcugugggagcugcugaccggcgaggugcccuacagagagaucgacgcccuggccguggccuacggcguggccaugaacaagcugacccugcccauccccagcaccugccccgagcccuucgccagacugcuggaggagugcugggaccccgacccccacggcagacccgacuucggcagcauccugaagagacuggaggugaucgagcagagcgcccuguuccagaugccccuggagagcuuccacagccugcaggaggacuggaagcuggagauccagcacauguucgacgaccugagaaccaaggagaaggagcugagaagcagagaggaggagcugcugagagccgcccaggagcagagauuccaggaggagcagcugagaagaagagagcaggagcuggccgagagagagauggacaucguggagagagagcugcaccugcugaugugccagcugagccaggagaagcccagagugagaaagagaaagggcaacuucaagagaagcagacugcugaagcugagagagggcggcagccacaucagccugcccagcggcuucgagcacaagaucaccgugcaggccagccccacccuggacaagagaaagggcagcgacggcgccagcccccccgccagccccagcaucauccccagacugagagccaucagacugacccccguggacugcggcggcagcagcagcggcagcagcagcggcggcagcggcaccuggagcagaggcggcccccccaagaaggaggagcuggugggcggcaagaagaagggcagaaccuggggccccagcagcacccugcagaaggagagagugggcggcgaggagagacugaagggccugggcgagggcagcaagcaguggagcagcagcgcccccaaccugggcaagagccccaagcacacccccaucgcccccggcuucgccagccugaacgagauggaggaguucgccgaggccgaggacggcggcagcagcgugccccccagccccuacagcacccccagcuaccugagcgugccccugcccgccgagcccagccccggcgccagagcccccugggagcccacccccagcgccccccccgccagauggggccacggcgccagaagaagaugcgaccuggcccugcugggcugcgccacccugcugggcgccgugggccugggcgccgacguggccgaggccagagccgccgacggcgaggagcagagaagauggcuggacggccuguucuuccccagagccggcagauuccccagaggccugagcccccccgccagaccccacggcagaagagaggacgugggccccggccugggccuggcccccagcgccacccuggugagccugagcagcgugagcgacugcaacagcaccagaagccugcugagaagcgacagcgacgaggccgcccccgccgcccccagccccccccccagcccccccgcccccacccccacccccagccccagcaccaacccccugguggaccuggagcuggagagcuucaagaaggaccccagacagagccugacccccacccacgugaccgccgccugcgccgugagcagaggccacagaagaacccccagcgacggcgcccugggccagagaggcccccccgagcccgccggccacggccccggccccagagaccugcuggacuuccccagacugcccgacccccaggcccuguuccccgccagaagaagaccccccgaguuccccggcagacccaccacccugaccuucgcccccagacccagacccgccgccagcagacccagacuggaccccuggaagcuggugagcuucggcagaacccugaccaucagcccccccagcagacccgacacccccgagagccccggcccccccagcgugcagcccacccugcuggacauggacauggagggccagaaccaggacagcaccgugccccugugcggcgcccacggcagccacuaa

SEQ ID NO: 19599 - RNA, 2544 nt, Artificial Sequence
  MAP3K11__Homo_sapiens__NP_002410
auggagccccugaagagccuguuccugaagagcccccugggcagcuggaacggcagcggcagcggcggcggcggcggcggcggcggcggcagacccgagggcagccccaaggccgccggcuacgccaaccccguguggaccgcccuguucgacuacgagcccagcggccaggacgagcuggcccugagaaagggcgacagaguggaggugcugagcagagacgccgccaucagcggcgacgagggcuggugggccggccaggugggcggccaggugggcaucuuccccagcaacuacgugagcagaggcggcggccccccccccugcgagguggccagcuuccaggagcugagacuggaggaggugaucggcaucggcggcuucggcaagguguacagaggcagcuggagaggcgagcugguggccgugaaggccgccagacaggaccccgacgaggacaucagcgugaccgccgagagcgugagacaggaggccagacuguucgccaugcuggcccaccccaacaucaucgcccugaaggccgugugccuggaggagcccaaccugugccuggugauggaguacgccgccggcggcccccugagcagagcccuggccggcagaagagugcccccccacgugcuggugaacugggccgugcagaucgccagaggcaugcacuaccugcacugcgaggcccuggugcccgugauccacagagaccugaagagcaacaacauccugcugcugcagcccaucgagagcgacgacauggagcacaagacccugaagaucaccgacuucggccuggccagagaguggcacaagaccacccagaugagcgccgccggcaccuacgccuggauggcccccgaggugaucaaggccagcaccuucagcaagggcagcgacguguggagcuucggcgugcugcugugggagcugcugaccggcgaggugcccuacagaggcaucgacugccuggccguggccuacggcguggccgugaacaagcugacccugcccauccccagcaccugccccgagcccuucgcccagcugauggccgacugcugggcccaggacccccacagaagacccgacuucgccagcauccugcagcagcuggaggcccuggaggcccaggugcugagagagaugcccagagacagcuuccacagcaugcaggagggcuggaagagagagauccagggccuguucgacgagcugagagccaaggagaaggagcugcugagcagagaggaggagcugaccagagccgccagagagcagagaagccaggccgagcagcugagaagaagagagcaccugcuggcccagugggagcuggagguguucgagagagagcugacccugcugcugcagcagguggacagagagagaccccacgugagaagaagaagaggcaccuucaagagaagcaagcugagagccagagacggcggcgagagaaucagcaugccccuggacuucaagcacagaaucaccgugcaggccagccccggccuggacagaagaagaaacguguucgaggugggccccggcgacagccccaccuuccccagauucagagccauccagcuggagcccgccgagcccggccaggccuggggcagacagagccccagaagacuggaggacagcagcaacggcgagagaagagccugcugggccuggggccccagcagccccaagcccggcgaggcccagaacggcagaagaagaagcagaauggacgaggccaccugguaccuggacagcgacgacagcagcccccugggcagccccagcaccccccccgcccugaacggcaacccccccagacccagccuggagcccgaggagcccaagagacccgugcccgccgagagaggcagcagcagcggcacccccaagcugauccagagagcccugcugagaggcaccgcccugcuggccagccugggccugggcagagaccugcagccccccggcggccccggcagagagagaggcgagagccccaccaccccccccacccccacccccgcccccugccccaccgagcccccccccagcccccugaucugcuucagccugaagacccccgacagcccccccacccccgccccccugcugcuggaccugggcauccccgugggccagagaagcgccaagagccccagaagagaggaggagcccagaggcggcaccgugagccccccccccggcaccagcagaagcgcccccggcacccccggcacccccagaagccccccccugggccugaucagcagacccagacccagcccccugagaagcagaaucgaccccuggagcuucgugagcgccggccccagacccagcccccugcccagcccccagcccgcccccagaagagcccccuggacccuguuccccgacagcgaccccuucugggacagcccccccgccaaccccuuccagggcggcccccaggacugcagagcccagaccaaggacaugggcgcccaggcccccugggugcccgaggccggccccuaa

SEQ ID NO: 19600 - RNA, 2580 nt, Artificial Sequence
  MAP3K12__Homo_sapiens__NP_006292
auggccugccugcacgagaccagaacccccagccccagcuucggcggcuucgugagcacccugagcgaggccagcaugagaaagcuggaccccgacaccagcgacugcacccccgagaaggaccugacccccacccacgugcugcagcugcacgagcaggacgccggcggccccggcggcgccgccggcagccccgagagcagagccagcagagugagagccgacgaggugagacugcagugccagagcggcagcggcuuccuggagggccuguucggcugccugagacccguguggaccaugaucggcaaggccuacagcaccgagcacaagcagcagcaggaggaccugugggaggugcccuucgaggagauccuggaccugcagugggugggcagcggcgcccagggcgccguguuccugggcagauuccacggcgaggagguggccgugaagaaggugagagaccugaaggagaccgacaucaagcaccugagaaagcugaagcaccccaacaucaucaccuucaagggcgugugcacccaggcccccugcuacugcauccugauggaguucugcgcccagggccagcuguacgaggugcugagagccggcagacccgugacccccagccugcugguggacuggagcaugggcaucgccggcggcaugaacuaccugcaccugcacaagaucauccacagagaccugaagagccccaacaugcugaucaccuacgacgacguggugaagaucagcgacuucggcaccagcaaggagcugagcgacaagagcaccaagaugagcuucgccggcaccguggccuggauggcccccgaggugaucagaaacgagcccgugagcgagaagguggacaucuggagcuucggcguggugcugugggagcugcugaccggcgagauccccuacaaggacguggacagcagcgccaucaucuggggcgugggcagcaacagccugcaccugcccgugcccagcagcugccccgacggcuucaagauccugcugagacagugcuggaacagcaagcccagaaacagacccagcuucagacagauccugcugcaccuggacaucgccagcgccgacgugcugagcaccccccaggagaccuacuucaagagccaggccgaguggagagaggaggugaagcugcacuucgagaagaucaagagcgagggcaccugccugcacagacuggaggaggagcuggugaugagaagaagagaggagcugagacacgcccuggacaucagagagcacuacgagagaaagcuggagagagccaacaaccuguacauggagcugaacgcccugaugcugcagcuggagcugaaggagagagagcugcugagaagagagcaggcccuggagagaagaugccccggccugcugaagccccaccccagcagaggccugcugcacggcaacaccauggagaagcugaucaagaagagaaacgugccccagaagcugagcccccacagcaagagacccgacauccugaagaccgagagccugcugcccaagcuggacgccgcccugagcggcgugggccugcccggcugccccaagggcccccccagccccggcagaagcagaagaggcaagaccagacacagaaaggccagcgccaagggcagcugcggcgaccugcccggccugagaaccgccgugcccccccacgagcccggcggccccggcagccccggcggccugggcggcggccccagcgccugggaggccugcccccccgcccugagaggccugcaccacgaccugcugcugagaaagaugagcagcagcagccccgaccugcugagcgccgcccugggcagcagaggcagaggcgccaccggcggcgccggcgaccccggcagccccccccccgccagaggcgacaccccccccagcgagggcagcgcccccggcagcaccagccccgacagccccggcggcgccaagggcgagccccccccccccgugggccccggcgagggcgugggccugcugggcaccggcagagagggcaccagcggcagaggcggcagcagagccggcagccagcaccugacccccgccgcccugcuguacagagccgccgugaccagaagccagaagagaggcaucagcagcgaggaggaggagggcgagguggacagcgagguggagcugaccagcagccagagauggccccagagccugaacaugagacagagccugagcaccuucagcagcgagaaccccagcgacggcgaggagggcaccgccagcgagcccagccccagcggcacccccgaggugggcagcaccaacaccgacgagagacccgacgagagaagcgacgacaugugcagccagggcagcgagaucccccuggaccccccccccagcgaggugauccccggccccgagcccagcagccugcccaucccccaccaggagcugcugagagagagaggcccccccaacagcgaggacagcgacugcgacagcaccgagcuggacaacagcaacagcguggacgcccugagaccccccgccagccugccccccuaa

SEQ ID NO: 19601 - RNA, 2280 nt, Artificial Sequence
  MAP3K13__Homo_sapiens__NP_001229246
auguacugcggcauccagauccuggcccugugggagagaggcgugugcacccaggcccccugcuacugcaucaucauggaguacugcgcccacggccagcuguacgaggugcugagagccggcagaaagaucacccccagacugcugguggacuggagcaccggcaucgccagcggcaugaacuaccugcaccugcacaagaucauccacagagaccugaagagccccaacgugcuggugacccacaccgacgccgugaagaucagcgacuucggcaccagcaaggagcugagcgacaagagcaccaagaugagcuucgccggcaccguggccuggauggcccccgaggugaucagaaacgagcccgugagcgagaagguggacaucuggagcuucggcguggugcugugggagcugcugaccggcgagauccccuacaaggacguggacagcagcgccaucaucuggggcgugggcagcaacagccugcaccugcccgugcccagcaccugccccgacggcuucaagauccugaugaagcagaccuggcagagcaagcccagaaacagacccagcuucagacagacccugaugcaccuggacaucgccagcgccgacgugcuggccaccccccaggagaccuacuucaagagccaggccgaguggagagaggaggugaagaagcacuucgagaagaucaagagcgagggcaccugcauccacagacuggacgaggagcugaucagaagaagaagagaggagcugagacacgcccuggacaucagagagcacuacgagagaaagcuggagagagccaacaaccuguacauggagcugagcgccaucaugcugcagcuggagaugagagagaaggagcugaucaagagagagcaggccguggagaagaaguaccccggcaccuacaagagacaccccgugagacccaucauccaccccaacgccauggagaagcugaugaagagaaagggcgugccccacaagagcggcaugcagaccaagagacccgaccugcugagaagcgagggcauccccaccaccgagguggcccccaccgccagcccccugagcggcagccccaagaugagcaccagcagcagcaagagcagauacagaagcaagcccagacacagaagaggcaacagcagaggcagccacagcgacuucgccgccauccugaagaaccagcccgcccaggagaacagcccccaccccaccuaccugcaccaggcccagagccaguaccccagccugcaccaccacaacagccugcagcagcaguaccagcagcccccccccgccaugagccagagccaccaccccagacugaacaugcacggccaggacaucgccaccugcgccaacaaccugagauacuucggccccgccgccgcccugagaagcccccugagcaaccacgcccagagacagcugcccggcagcagccccgaccugaucagcaccgccauggccgccgacugcuggagaagcagcgagcccgacaagggccaggccggccccuggggcugcugccaggccgacgccuacgaccccugccugcagugcagacccgagcaguacggcagccuggacauccccagcgccgagcccgugggcagaagccccgaccugagcaagagccccgcccacaacccccugcuggagaacgcccagagcagcgagaagaccgaggagaacgaguucagcggcugcagaagcgagagcagccugggcaccagccaccugggcaccccccccgcccugcccagaaagaccagaccccugcagaagagcggcgacgacagcagcgaggaggaggagggcgagguggacagcgagguggaguuccccagaagacagagaccccacagaugcaucagcagcugccagagcuacagcaccuucagcagcgagaacuucagcgugagcgacggcgaggagggcaacaccagcgaccacagcaacagccccgacgagcuggccgacaagcuggaggacagacuggccgagaagcuggacgaccugcugagccagacccccgagauccccaucgacaucagcagccacagcgacggccugagcgacaaggagugcgccgugagaagagugaagacccagaugagccugggcaagcugugcguggaggagagaggcuacgagaaccccaugcaguucgaggagagcgacugcgacagcagcgacggcgagugcagcgacgccaccgugagaaccaacaagcacuacagcagcgccaccugguaa

SEQ ID NO: 19602 - RNA, 2844 nt, Artificial Sequence
  MAP3K14__Homo_sapiens__XP_011523743
auggccgugauggagauggccugccccggcgcccccggcagcgccgugggccagcagaaggagcugcccaaggccaaggagaagacccccccccugggcaagaagcagagcagcguguacaagcuggaggccguggagaagagccccguguucugcggcaagugggagauccugaacgacgugaucaccaagggcaccgccaaggagggcagcgaggccggccccgccgccaucagcaucaucgcccaggccgagugcgagaacagccaggaguucagccccaccuucagcgagagaaucuucaucgccggcagcaagcaguacagccagagcgagagccuggaccagauccccaacaacguggcccacgccaccgagggcaagauggccagagugugcuggaagggcaagagaagaagcaaggccagaaagaagagaaagaagaagagcagcaagagccuggcccacgccggcguggcccuggccaagccccugcccagaacccccgagcaggagagcugcaccauccccgugcaggaggacgagagcccccugggcgcccccuacgugagaaacaccccccaguucaccaagccccugaaggagcccggccugggccagcugugcuucaagcagcugggcgagggccugagacccgcccugcccagaagcgagcugcacaagcugaucagcccccugcagugccugaaccacguguggaagcugcaccacccccaggacggcggcccccugccccugcccacccaccccuuccccuacagcagacugccccaccccuuccccuuccacccccugcagcccuggaagccccacccccuggagagcuuccugggcaagcuggccugcguggacagccagaagccccugcccgacccccaccugagcaagcuggccugcguggacagccccaagccccugcccggcccccaccuggagcccagcugccugagcagaggcgcccacgagaaguucagcguggaggaguaccuggugcacgcccugcagggcagcgugagcagcggccaggcccacagccugaccagccuggccaagaccugggccgccagaggcagcagaagcagagagcccagccccaagaccgaggacaacgagggcgugcugcugaccgagaagcugaagcccguggacuacgaguacagagaggaggugcacugggccacccaccagcugagacugggcagaggcagcuucggcgaggugcacagaauggaggacaagcagaccggcuuccagugcgccgugaagaaggugagacuggagguguucagagccgaggagcugauggccugcgccggccugaccagccccagaaucgugccccuguacggcgccgugagagagggccccugggugaacaucuucauggagcugcuggagggcggcagccugggccagcuggugaaggagcagggcugccugcccgaggacagagcccuguacuaccugggccaggcccuggagggccuggaguaccugcacagcagaagaauccugcacggcgacgugaaggccgacaacgugcugcugagcagcgacggcagccacgccgcccugugcgacuucggccacgccgugugccugcagcccgacggccugggcaagagccugcugaccggcgacuacauccccggcaccgagacccacauggcccccgagguggugcugggcagaagcugcgacgccaagguggacguguggagcagcugcugcaugaugcugcacaugcugaacggcugccaccccuggacccaguucuucagaggcccccugugccugaagaucgccagcgagcccccccccgugagagagaucccccccagcugcgccccccugaccgcccaggccauccaggagggccugagaaaggagcccauccacagagugagcgccgccgagcugggcggcaaggugaacagagcccugcagcaggugggcggccugaagagccccuggagaggcgaguacaaggagcccagacaccccccccccaaccaggccaacuaccaccagacccugcacgcccagcccagagagcugagccccagagcccccggccccagacccgccgaggagaccaccggcagagcccccaagcugcagcccccccugccccccgagccccccgagcccaacaagagccccccccugacccugagcaaggaggagagcggcaugugggagccccugccccugagcagccuggagcccgcccccgccagaaaccccagcagccccgagagaaaggccaccgugcccgagcaggagcugcagcagcuggagaucgagcuguuccugaacagccugagccagcccuucagccuggaggagcaggagcagauccugagcugccugagcaucgacagccugagccugagcgacgacagcgagaagaaccccagcaaggccagccagagcagcagagacacccugagcagcggcgugcacagcuggagcagccaggccgaggccagaagcagcagcuggaacauggugcuggccagaggcagacccaccgacacccccagcuacuucaacggcgugaaggugcagauccagagccugaacggcgagcaccugcacaucagagaguuccacagagugaaggugggcgacaucgccaccggcaucagcagccagauccccgccgccgccuucagccuggugaccaaggacggccagcccgugagauacgacauggaggugcccgacagcggcaucgaccugcagugcacccuggcccccgacggcagcuucgccuggagcuggagagugaagcacggccagcuggagaacagacccuaa

SEQ ID NO: 19603 - RNA, 3648 nt, Artificial Sequence
  MAP3K19__Homo_sapiens__NP_001018054
augagcagcaugcccaagcccgagagacacgccgagagccugcuggacaucugccacgacaccaacagcagccccaccgaccugaugaccgugaccaagaaccagaacaucauccugcagagcaucagcagaagcgaggaguucgaccaggacggcgacugcagccacagcacccuggugaacgaggaggaggaccccagcggcggcagacaggacuggcagcccagaaccgaggaguucagcaccagccacaugaaguacagcggcagaagcaucaaguuccugcugcccccccugagccugcugcccaccagaagcggcgugcugaccaucccccagaaccacaaguuccccaaggagaaggagagaaacauccccagccugaccagcuucgugcccaagcugagcgugagcgugagacagagcgacgagcugagccccagcaacgagccccccggcgcccuggugaagagccugauggaccccacccugagaagcagcgacggcuucaucuggagcagaaacaugugcagcuuccccaagaccaaccaccacagacagugccuggagaaggaggagaacuggaagagcaaggagaucgaggagugcaacaagaucgagaucacccacuucgagaagggccagagccuggugagcuucgagaaccugaaggagggcaacauccccgccgugagagaggaggacaucgacugccacggcagcaagaccagaaagcccgaggaggagaacagccaguaccugagcagcagaaagaacgagagcagcguggccaagaacuacgagcaggaccccgagaucgugugcaccauccccagcaaguuccaggagacccagcacagcgagaucacccccagccaggacgaggagaugagaaacaacaaggccgccagcaagagagugagccugcacaagaacgaggccauggagcccaacaacauccuggaggagugcaccgugcugaagagccugagcagcgugguguucgacgaccccaucgacaagcugcccgagggcugcagcagcauggagaccaacaucaagaucagcaucgccgagagagccaagcccgagaugagcagaauggugccccugauccacaucaccuuccccguggacggcagccccaaggagcccgugaucgccaagcccagccugcagaccagaaagggcaccauccacaacaaccacagcgugaacauccccgugcaccaggagaacgacaagcacaagaugaacagccacagaagcaagcuggacagcaagaccaagaccagcaagaagaccccccagaacuucgugaucagcaccgagggccccaucaagcccaccaugcacaagaccagcaucaagacccagaucuuccccgcccugggccugguggaccccagacccuggcagcugcccagauuccagaagaagaugccccagaucgccaagaagcagagcacccacagaacccagaagcccaagaagcagagcuuccccugcaucugcaagaaccccggcacccagaagagcugcgugccccugagcgugcagcccaccgagcccagacugaacuaccuggaccugaaguacagcgacauguucaaggagaucaacagcaccgccaacggccccggcaucuacgagauguucggcacccccguguacugccacgugagagagaccgagagagacgagaacaccuacuacagagagaucugcagcgcccccagcggcagaagaaucaccaacaagugcagaagcagccacagcgagagaaagagcaacaucagaaccagacugagccagaagaagacccacaugaagugccccaagaccagcuucggcaucaagcaggagcacaaggugcugaucagcaaggagaagagcagcaaggccgugcacagcaaccugcacgacaucgagaacggcgacggcaucagcgagcccgacuggcagaucaagagcagcggcaacgaguuccugagcagcaaggacgagauccaccccaugaaccuggcccagacccccgagcagagcaugaagcagaacgaguucccccccgugagcgaccugagcaucguggaggaggugagcauggaggagagcaccggcgacagagacaucagcaacaaccagauccugaccaccagccugagagaccugcaggagcuggaggagcugcaccaccagauccccuucauccccagcgaggacagcugggccgugcccagcgagaagaacagcaacaaguacgugcagcaggagaagcagaacaccgccagccugagcaaggugaacgccagcagaauccugaccaacgaccuggaguucgacagcgugagcgaccacagcaagacccugaccaacuucagcuuccaggccaagcaggagagcgccagcagccagaccuaccaguacugggugcacuaccuggaccacgacagccuggccaacaagagcaucaccuaccagauguucggcaagacccugagcggcaccaacagcaucagccaggagaucauggacagcgugaacaacgaggagcugaccgacgagcugcugggcugccuggccgccgagcugcuggcccuggacgagaaggacaacaacagcugccagaagauggccaacgagaccgaccccgagaaccugaaccuggugcugagauggagaggcagcacccccaaggagaugggcagagagaccaccaaggugaagauccagagacacagcagcggccugagaaucuacgacagagaggagaaguuccugaucagcaacgagaagaagaucuucagcgagaacagccugaagagcgaggagcccauccuguggaccaagggcgagauccugggcaagggcgccuacggcaccguguacugcggccugaccagccagggccagcugaucgccgugaagcagguggcccuggacaccagcaacaagcuggccgccgagaaggaguacagaaagcugcaggaggagguggaccugcugaaggcccugaagcacgugaacaucguggccuaccugggcaccugccugcaggagaacaccgugagcaucuucauggaguucgugcccggcggcagcaucagcagcaucaucaacagauucggcccccugcccgagaugguguucugcaaguacaccaagcagauccugcagggcguggccuaccugcacgagaacugcguggugcacagagacaucaagggcaacaacgugaugcugaugcccaccggcaucaucaagcugaucgacuucggcugcgccagaagacuggccugggccggccugaacggcacccacagcgacaugcugaagagcaugcacggcacccccuacuggauggcccccgaggugaucaacgagagcggcuacggcagaaagagcgacaucuggagcaucggcugcaccguguucgagauggccaccggcaagcccccccuggccagcauggacagaauggccgccauguucuacaucggcgcccacagaggccugaugcccccccugcccgaccacuucagcgagaacgccgccgacuucgugagaaugugccugaccagagaccagcacgagagacccagcgcccugcagcugcugaagcacagcuuccuggagagaagccacuaa

SEQ ID NO: 19604 - RNA, 4539 nt, Artificial Sequence
  MAP3K1__Homo_sapiens__NP_005912
auggccgccgccgccggcaacagagccagcagcagcggcuuccccggcgccagagccaccagccccgaggccggcggcggcggcggcgcccugaaggccagcagcgcccccgccgccgccgccggccugcugagagaggccggcagcggcggcagagagagagccgacuggagaagaagacagcugagaaaggugagaagcguggagcuggaccagcugcccgagcagccccuguuccuggccgccagcccccccgccagcagcaccagccccagccccgagcccgccgacgccgccggcagcggcaccggcuuccagcccguggccgugccccccccccacggcgccgccagcagaggcggcgcccaccugaccgagagcguggccgcccccgacagcggcgccagcagccccgccgccgccgagcccggcgagaagagagcccccgccgccgagcccagccccgccgccgcccccgccggcagagagauggagaacaaggagacccugaagggccugcacaagauggacgacagacccgaggagagaaugaucagagagaagcugaaggccaccugcaugcccgccuggaagcacgaguggcuggagagaagaaacagaagaggccccgugguggugaagcccauccccgugaagggcgacggcagcgagaugaaccaccuggccgccgagagccccggcgaggugcaggccagcgccgccagccccgccagcaagggcagaagaagccccagccccggcaacagccccagcggcagaaccgugaagagcgagagccccggcgugagaagaaagagagugagccccgugcccuuccagagcggcagaaucaccccccccagaagagcccccagccccgacggcuucagccccuacagccccgaggagaccaacagaagagugaacaaggugaugagagccagacuguaccugcugcagcagaucggccccaacagcuuccugaucggcggcgacagccccgacaacaaguacagaguguucaucggcccccagaacugcagcugcgccagaggcaccuucugcauccaccugcuguucgugaugcugagaguguuccagcuggagcccagcgaccccaugcuguggagaaagacccugaagaacuucgagguggagagccuguuccagaaguaccacagcagaagaagcagcagaaucaaggcccccagcagaaacaccauccagaaguucgugagcagaaugagcaacagccacacccugagcagcagcagcaccagcaccagcagcagcgagaacagcaucaaggacgaggaggagcagaugugccccaucugccugcugggcaugcuggacgaggagagccugaccgugugcgaggacggcugcagaaacaagcugcaccaccacugcaugagcaucugggccgaggagugcagaagaaacagagagccccugaucugcccccugugcagaagcaaguggagaagccacgacuucuacagccacgagcugagcagccccguggacagccccagcagccugagagccgcccagcagcagaccgugcagcagcagccccuggccggcagcagaagaaaccaggagagcaacuucaaccugacccacuacggcacccagcagaucccccccgccuacaaggaccuggccgagcccuggauccagguguucggcauggagcuggugggcugccuguucagcagaaacuggaacgugagagagauggcccugagaagacugagccacgacgugagcggcgcccugcugcuggccaacggcgagagcaccggcaacagcggcggcagcagcggcagcagccccagcggcggcgccaccagcggcagcagccagaccagcaucagcggcgacgugguggaggccugcugcagcgugcugagcauggugugcgccgaccccguguacaagguguacguggccgcccugaagacccugagagccaugcugguguacacccccugccacagccuggccgagagaaucaagcugcagagacugcugcagcccgugguggacaccauccuggugaagugcgccgacgccaacagcagaaccagccagcugagcaucagcacccugcuggagcugugcaagggccaggccggcgagcuggccgugggcagagagauccugaaggccggcagcaucggcaucggcggcguggacuacgugcugaacugcauccugggcaaccagaccgagagcaacaacuggcaggagcugcugggcagacugugccugaucgacagacugcugcuggaguuccccgccgaguucuacccccacaucgugagcaccgacgugagccaggccgagcccguggagaucagauacaagaagcugcugagccugcugaccuucgcccugcagagcaucgacaacagccacagcauggugggcaagcugagcagaagaaucuaccugagcagcgccagaauggugaccaccgugccccacguguucagcaagcugcuggagaugcugagcgugagcagcagcacccacuucaccagaaugagaagaagacugauggccaucgccgacgagguggagaucgccgaggccauccagcugggcguggaggacacccuggacggccagcaggacagcuuccugcaggccagcgugcccaacaacuaccuggagaccaccgagaacagcagccccgagugcaccgugcaccuggagaagaccggcaagggccugugcgccaccaagcugagcgccagcagcgaggacaucagcgagagacuggccagcaucagcgugggccccagcagcagcaccaccaccaccaccaccaccaccgagcagcccaagcccauggugcagaccaagggcagaccccacagccagugccugaacagcagcccccugagccaccacagccagcugauguuccccgcccugagcacccccagcagcagcacccccagcgugcccgccggcaccgccaccgacgugagcaagcacagacugcagggcuucauccccugcagaauccccagcgccagcccccagacccagagaaaguucagccugcaguuccacagaaacugccccgagaacaaggacagcgacaagcugagccccguguucacccagagcagaccccugcccagcagcaacauccacagacccaagcccagcagacccacccccggcaacaccagcaagcagggcgaccccagcaagaacagcaugacccuggaccugaacagcagcagcaagugcgacgacagcuucggcugcagcagcaacagcagcaacgccgugauccccagcgacgagaccguguucacccccguggaggagaagugcagacuggacgugaacaccgagcugaacagcagcaucgaggaccugcuggaggccagcaugcccagcagcgacaccaccgugaccuucaagagcgagguggccgugcugagccccgagaaggccgagaacgacgacaccuacaaggacgacgugaaccacaaccagaagugcaaggagaagauggaggccgaggaggaggaggcccuggccaucgccauggccaugagcgccagccaggacgcccugcccaucgugccccagcugcagguggagaacggcgaggacaucaucaucauccagcaggacacccccgagacccugcccggccacaccaaggccaagcagcccuacagagaggacaccgaguggcugaagggccagcagaucggccugggcgccuucagcagcugcuaccaggcccaggacgugggcaccggcacccugauggccgugaagcaggugaccuacgugagaaacaccagcagcgagcaggaggaggugguggaggcccugagagaggagaucagaaugaugagccaccugaaccaccccaacaucaucagaaugcugggcgccaccugcgagaagagcaacuacaaccuguucaucgaguggauggccggcggcagcguggcccaccugcugagcaaguacggcgccuucaaggagagcguggugaucaacuacaccgagcagcugcugagaggccugagcuaccugcacgagaaccagaucauccacagagacgugaagggcgccaaccugcugaucgacagcaccggccagagacugagaaucgccgacuucggcgccgccgccagacuggccagcaagggcaccggcgccggcgaguuccagggccagcugcugggcaccaucgccuucauggcccccgaggugcugagaggccagcaguacggcagaagcugcgacguguggagcgugggcugcgccaucaucgagauggccugcgccaagccccccuggaacgccgagaagcacagcaaccaccuggcccugaucuucaagaucgccagcgccaccaccgcccccagcauccccagccaccugagccccggccugagagacguggcccugagaugccuggagcugcagccccaggacagaccccccagcagagagcugcugaagcaccccguguucagaaccaccugguaa

SEQ ID NO: 19605 - RNA, 1860 nt, Artificial Sequence
  MAP3K2__Homo_sapiens__NP_006600
auggacgaccagcaggcccugaacagcaucaugcaggaccuggccgugcugcacaaggccagcagacccgcccugagccugcaggagaccagaaaggccaagagcagcagccccaagaagcagaacgacgugagagugaaguucgagcacagaggcgagaagagaauccugcaguuccccagacccgugaagcuggaggaccugagaagcaaggccaagaucgccuucggccagagcauggaccugcacuacaccaacaacgagcuggugaucccccugaccacccaggacgaccuggacaaggccguggagcugcuggacagaagcauccacaugaagagccugaagauccugcuggugaucaacggcagcacccaggccaccaaccuggagccccugcccagccuggaggaccuggacaacaccguguucggcgccgagagaaagaagagacugagcaucaucggccccaccagcagagacagaagcagccccccccccggcuacauccccgacgagcugcaccagguggccagaaacggcagcuucaccagcaucaacagcgagggcgaguucauccccgagagcauggaccagaugcuggacccccugagccugagcagccccgagaacagcggcagcggcagcugccccagccuggacagcccccuggacggcgagagcuaccccaagagcagaaugcccagagcccagagcuaccccgacaaccaccaggaguucagcgacuacgacaaccccaucuucgagaaguucggcaagggcggcaccuaccccagaagauaccacgugagcuaccaccaccaggaguacaacgacggcagaaagaccuuccccagagccagaagaacccagggcaccagccugagaagccccgugagcuucagccccaccgaccacagccugagcaccagcagcggcagcagcaucuucacccccgaguacgacgacagcagaaucagaagaagaggcagcgacaucgacaaccccacccugaccgugauggacaucagcccccccagcagaagccccagagcccccaccaacuggagacugggcaagcugcugggccagggcgccuucggcagaguguaccugugcuacgacguggacaccggcagagagcuggccgugaagcaggugcaguucgaccccgacagccccgagaccagcaaggaggugaacgcccuggagugcgagauccagcugcugaagaaccugcugcacgagagaaucgugcaguacuacggcugccugagagacccccaggagaagacccugagcaucuucauggaguacaugcccggcggcagcaucaaggaccagcugaaggccuacggcgcccugaccgagaacgugaccagaaaguacaccagacagauccuggagggcgugcacuaccugcacagcaacaugaucgugcacagagacaucaagggcgccaacauccugagagacagcaccggcaacgugaagcugggcgacuucggcgccagcaagagacugcagaccaucugccugagcggcaccggcaugaagagcgugaccggcacccccuacuggaugagccccgaggugaucagcggcgagggcuacggcagaaaggccgacaucuggagcguggccugcaccgugguggagaugcugaccgagaagccccccugggccgaguucgaggccauggccgccaucuucaagaucgccacccagcccaccaaccccaagcugcccccccacgugagcgacuacaccagagacuuccugaagagaaucuucguggaggccaagcugagacccagcgccgacgagcugcugagacacauguucgugcacuaccacuaa

SEQ ID NO: 19606 - RNA, 1881 nt, Artificial Sequence
  MAP3K3__Homo_sapiens__NP_002392
auggacgagcaggaggcccugaacagcaucaugaacgaccugguggcccugcagaugaacagaagacacagaaugcccggcuacgagaccaugaagaacaaggacaccggccacagcaacagacagagcgacgugagaaucaaguucgagcacaacggcgagagaagaaucaucgccuucagcagacccgugaaguacgaggacguggagcacaaggugaccaccguguucggccagccccuggaccugcacuacaugaacaacgagcugagcauccugcugaagaaccaggacgaccuggacaaggccaucgacauccuggacagaagcagcagcaugaagagccugagaauccugcugcugagccaggacagaaaccacaacagcagcagcccccacagcggcgugagcagacaggugagaaucaaggccagccagagcgccggcgacaucaacaccaucuaccagccccccgagcccagaagcagacaccugagcgugagcagccagaaccccggcagaagcagccccccccccggcuacgugcccgagagacagcagcacaucgccagacagggcagcuacaccagcaucaacagcgagggcgaguucauccccgagaccagcgagcagugcaugcuggacccccugagcagcgccgagaacagccugagcggcagcugccagagccuggacagaagcgccgacagccccagcuucagaaagagcagaaugagcagagcccagagcuuccccgacaacagacaggaguacagcgacagagagacccagcuguacgacaagggcgugaagggcggcaccuaccccagaagauaccacgugagcgugcaccacaaggacuacagcgacggcagaagaaccuuccccagaaucagaagacaccagggcaaccuguucacccuggugcccagcagcagaagccugagcaccaacggcgagaacaugggccuggccgugcaguaccuggaccccagaggcagacugagaagcgccgacagcgagaacgcccugagcgugcaggagagaaacgugcccaccaagagccccagcgcccccaucaacuggagaagaggcaagcugcugggccagggcgccuucggcagaguguaccugugcuacgacguggacaccggcagagagcuggccagcaagcaggugcaguucgaccccgacagccccgagaccagcaaggaggugagcgcccuggagugcgagauccagcugcugaagaaccugcagcacgagagaaucgugcaguacuacggcugccugagagacagagccgagaagacccugaccaucuucauggaguacaugcccggcggcagcgugaaggaccagcugaaggccuacggcgcccugaccgagagcgugaccagaaaguacaccagacagauccuggagggcaugagcuaccugcacagcaacaugaucgugcacagagacaucaagggcgccaacauccugagagacagcgccggcaacgugaagcugggcgacuucggcgccagcaagagacugcagaccaucugcaugagcggcaccggcaugagaagcgugaccggcacccccuacuggaugagccccgaggugaucagcggcgagggcuacggcagaaaggccgacguguggagccugggcugcaccgugguggagaugcugaccgagaagccccccugggccgaguacgaggccauggccgccaucuucaagaucgccacccagcccaccaacccccagcugcccagccacaucagcgagcacggcagagacuuccugagaagaaucuucguggaggccagacagagacccagcgccgaggagcugcugacccaccacuucgcccagcugauguacuaa

SEQ ID NO: 19607 - RNA, 4827 nt, Artificial Sequence
  MAP3K4__Homo_sapiens__NP_005913
augagagaggccgccgccgcccuggugcccccccccgccuucgccgugacccccgccgccgccauggaggagccccccccccccccccccccccccccccccccccccgagcccgagaccgagagcgagcccgagugcugccuggccgccagacaggagggcacccugggcgacagcgccugcaagagccccgagagcgaccuggaggacuucagcgacgagaccaacaccgagaaccuguacggcaccagcccccccagcacccccagacagaugaagagaaugagcaccaagcaccagagaaacaacgugggcagacccgccagcagaagcaaccugaaggagaagaugaacgcccccaaccagcccccccacaaggacaccggcaagaccguggagaacguggaggaguacagcuacaagcaggagaagaagaucagagccgcccugagaaccaccgagagagaccacaagaagaacgugcagugcagcuucaugcuggacagcgugggcggcagccugcccaagaagagcauccccgacguggaccugaacaagcccuaccugagccugggcugcagcaacgccaagcugcccgugagcgugcccaugcccaucgccagacccgccagacagaccagcagaaccgacugccccgccgacagacugaaguucuucgagacccugagacugcugcugaagcugaccagcgugagcaagaagaaggacagagagcagagaggccaggagaacaccagcggcuucuggcugaacagaagcaacgagcugaucuggcuggagcugcaggccuggcacgccggcagaaccaucaacgaccaggacuucuuccuguacaccgccagacaggccauccccgacaucaucaacgagauccugaccuucaagguggacuacggcagcuucgccuucgugagagacagagccggcuucaacggcaccagcguggagggccagugcaaggccacccccggcaccaagaucgugggcuacagcacccaccacgagcaccugcagagacagagagugagcuucgagcaggugaagagaaucauggagcugcuggaguacaucgaggcccuguaccccagccugcaggcccugcagaaggacuacgagaaguacgccgccaaggacuuccaggacagagugcaggcccugugccuguggcugaacaucaccaaggaccugaaccagaagcugagaaucaugggcaccgugcugggcaucaagaaccugagcgacaucggcuggcccguguucgagauccccagccccagacccagcaagggcaacgagcccgaguacgagggcgacgacaccgagggcgagcugaaggagcuggagagcagcaccgacgagagcgaggaggagcagaucagcgaccccagagugcccgagaucagacagcccaucgacaacagcuucgacauccagagcagagacugcaucagcaagaagcuggagagacuggagagcgaggacgacagccugggcuggggcgcccccgacuggagcaccgaggccggcuucagcagacacugccugaccagcaucuacagacccuucguggacaaggcccugaagcagaugggccugagaaagcugauccugagacugcacaagcugauggacggcagccugcagagagccagaaucgcccuggugaagaacgacagacccguggaguucagcgaguuccccgaccccauguggggcagcgacuacgugcagcugagcagaaccccccccagcagcgaggagaagugcagcgccgugagcugggaggagcugaaggccauggaccugcccagcuucgagcccgccuuccuggugcugugcagagugcugcugaacgugauccacgagugccugaagcugagacuggagcagagacccgccggcgagcccagccugcugagcaucaagcagcuggugagagagugcaaggaggugcugaagggcggccugcugaugaagcaguacuaccaguucaugcugcaggaggugcuggaggaccuggagaagcccgacugcaacaucgacgccuucgaggaggaccugcacaagaugcugaugguguacuucgacuacaugagaagcuggauccagaugcugcagcagcugccccaggccagccacagccugaagaaccugcuggaggaggaguggaacuucaccaaggagaucacccacuacaucagaggcggcgaggcccaggccggcaagcuguucugcgacaucgccggcaugcugcugaagagcaccggcagcuuccuggaguucggccugcaggagagcugcgccgaguucuggaccagcgccgacgacagcagcgccagcgacgagaucagaagaagcgugaucgagaucagcagagcccugaaggagcuguuccacgaggccagagagagagccagcaaggcccugggcuucgccaagaugcugagaaaggaccuggagaucgccgccgaguucagacugagcgcccccgugagagaccugcuggacgugcugaagagcaagcaguacgugaaggugcagauccccggccuggagaaccugcagauguucgugcccgacacccuggccgaggagaagagcaucauccugcagcugcugaacgccgccgccggcaaggacugcagcaaggacagcgacgacgugcugaucgacgccuaccugcugcugaccaagcacggcgacagagccagagacagcgaggacagcuggggcaccugggaggcccagcccgugaagguggugccccagguggagaccguggacacccugagaagcaugcagguggacaaccugcugcugguggugaugcagagcgcccaccugaccauccagagaaaggccuuccagcagagcaucgagggccugaugacccugugccaggagcagaccagcagccagcccgugaucgccaaggcccugcagcagcugaagaacgacgcccuggagcugugcaacagaaucagcaacgccaucgacagaguggaccacauguucaccagcgaguucgacgccgagguggacgagagcgagagcgugacccugcagcaguacuacagagaggccaugauccagggcuacaacuucggcuucgaguaccacaaggagguggugagacugaugagcggcgaguucagacagaagaucggcgacaaguacaucagcuucgccagaaaguggaugaacuacgugcugaccaagugcgagagcggcagaggcaccagacccagaugggccacccagggcuucgacuuccugcaggccaucgagcccgccuucaucagcgcccugcccgaggacgacuuccugagccugcaggcccugaugaacgagugcaucggccacgugaucggcaagccccacagccccgugaccggccuguaccuggccauccacagaaacagccccagacccaugaaggugcccagaugccacagcgacccccccaacccccaccugaucauccccacccccgagggcuucagcaccagaagcaugcccagcgacgccagaagccacggcagccccgccgccgccgccgccgccgccgccgccgccguggccgccagcagacccagccccagcggcggcgacagcgugcugcccaagagcaucagcagcgcccacgacaccagaggcagcagcgugcccgagaacgacagacuggccagcaucgccgccgagcugcaguucagaagccugagcagacacagcagccccaccgaggagagagacgagcccgccuaccccagaggcgacagcagcggcagcaccagaagaagcugggagcugagaacccugaucagccagagcaaggacaccgccagcaagcugggccccaucgaggccauccagaagagcgugagacuguucgaggagaagagauacagagagaugagaagaaagaacaucaucggccaggugugcgacacccccaagagcuacgacaacgugaugcacgugggccugagaaaggugaccuucaaguggcagagaggcaacaagaucggcgagggccaguacggcaagguguacaccugcaucagcguggacaccggcgagcugauggccaugaaggagaucagauuccagcccaacgaccacaagaccaucaaggagaccgccgacgagcugaagaucuucgagggcaucaagcaccccaaccuggugagauacuucggcguggagcugcacagagaggagauguacaucuucauggaguacugcgacgagggcacccuggaggaggugagcagacugggccugcaggagcacgugaucagacuguacagcaagcagaucaccaucgccaucaacgugcugcacgagcacggcaucgugcacagagacaucaagggcgccaacaucuuccugaccagcagcggccugaucaagcugggcgacuucggcugcagcgugaagcugaagaacaacgcccagaccaugcccggcgaggugaacagcacccugggcaccgccgccuacauggcccccgaggugaucaccagagccaagggcgagggccacggcagagccgccgacaucuggagccugggcugcguggugaucgagauggugaccggcaagagacccuggcacgaguacgagcacaacuuccagaucauguacaaggugggcaugggccacaagccccccauccccgagagacugagccccgagggcaaggacuuccugagccacugccuggagagcgaccccaagaugagauggaccgccagccagcugcuggaccacagcuucgugaaggugugcaccgacgaggaguaa

SEQ ID NO: 19608 - RNA, 4125 nt, Artificial Sequence
  MAP3K5__Homo_sapiens__NP_005914
augagcaccgaggccgacgagggcaucaccuucagcgugccccccuucgcccccagcggcuucugcaccauccccgagggcggcaucugcagaagaggcggcgccgccgccgugggcgagggcgaggagcaccagcugcccccccccccccccggcagcuucuggaacguggagagcgccgccgcccccggcaucggcugccccgccgccaccagcagcagcagcgccaccagaggcagaggcagcagcgugggcggcggcagcagaagaaccaccguggccuacgugaucaacgaggccagccagggccagcuggugguggccgagagcgaggcccugcagagccugagagaggccugcgagaccgugggcgccacccuggagacccugcacuucggcaagcuggacuucggcgagaccaccgugcuggacagauucuacaacgccgacaucgccgugguggagaugagcgacgccuucagacagcccagccuguucuaccaccugggcgugagagagagcuucagcauggccaacaacaucauccuguacugcgacaccaacagcgacagccugcagagccugaaggagaucaucugccagaagaacaccaugugcaccggcaacuacaccuucgugcccuacaugaucaccccccacaacaagguguacugcugcgacagcagcuucaugaagggccugaccgagcugaugcagcccaacuucgagcugcugcugggccccaucugccugccccugguggacagauucauccagcugcugaagguggcccaggccagcagcagccaguacuucagagagagcauccugaacgacaucagaaaggccagaaaccuguacaccggcaaggagcuggccgccgagcuggccagaaucagacagagaguggacaacaucgaggugcugaccgccgacaucgugaucaaccugcugcugagcuacagagacauccaggacuacgacagcaucgugaagcugguggagacccuggagaagcugcccaccuucgaccuggccagccaccaccacgugaaguuccacuacgccuucgcccugaacagaagaaaccugcccggcgacagagccaaggcccuggacaucaugauccccauggugcagagcgagggccagguggccagcgacauguacugccuggugggcagaaucuacaaggacauguuccuggacagcaacuucaccgacaccgagagcagagaccacggcgccagcugguucaagaaggccuucgagagcgagcccacccugcagagcggcaucaacuacgccgugcugcugcuggccgccggccaccaguucgagagcagcuucgagcugagaaaggugggcgugaagcugagcagccugcugggcaagaagggcaaccuggagaagcugcagagcuacugggaggugggcuucuuccugggcgccagcgugcuggccaacgaccacaugagagugauccaggccagcgagaagcuguucaagcugaagacccccgccugguaccugaagagcaucguggagaccauccugaucuacaagcacuucgugaagcugaccaccgagcagcccguggccaagcaggagcugguggacuucuggauggacuuccugguggaggccaccaagaccgacgugaccguggugagauuccccgugcugauccuggagcccaccaagaucuaccagcccagcuaccugagcaucaacaacgagguggaggagaagaccaucagcaucuggcacgugcugcccgacgacaagaagggcauccacgaguggaacuucagcgccagcagcgugagaggcgugagcaucagcaaguucgaggagagaugcugcuuccuguacgugcugcacaacagcgacgacuuccagaucuacuucugcaccgagcugcacugcaagaaguucuucgagauggugaacaccaucaccgaggagaagggcagaagcaccgaggagggcgacugcgagagcgaccugcuggaguacgacuacgaguacgacgagaacggcgacagaguggugcugggcaagggcaccuacggcaucguguacgccggcagagaccugagcaaccaggugagaaucgccaucaaggagauccccgagagagacagcagauacagccagccccugcacgaggagaucgcccugcacaagcaccugaagcacaagaacaucgugcaguaccugggcagcuucagcgagaacggcuucaucaagaucuucauggagcaggugcccggcggcagccugagcgcccugcugagaagcaaguggggcccccugaaggacaacgagcagaccaucggcuucuacaccaagcagauccuggagggccugaaguaccugcacgacaaccagaucgugcacagagacaucaagggcgacaacgugcugaucaacaccuacagcggcgugcugaagaucagcgacuucggcaccagcaagagacuggccggcaucaaccccugcaccgagaccuucaccggcacccugcaguacauggcccccgagaucaucgacaagggccccagaggcuacggcaaggccgccgacaucuggagccugggcugcaccaucaucgagauggccaccggcaagccccccuucuacgagcugggcgagccccaggccgccauguucaaggugggcauguucaaggugcaccccgagauccccgagagcaugagcgccgaggccaaggccuucauccugaagugcuucgagcccgaccccgacaagagagccugcgccaacgaccugcugguggacgaguuccugaaggugagcagcaagaagaagaagacccagcccaagcugagcgcccugagcgccggcagcaacgaguaccugagaagcaucagccugcccgugcccgugcugguggaggacaccagcagcagcagcgaguacggcagcgugagccccgacaccgagcugaagguggaccccuucagcuucaagaccagagccaagagcugcggcgagagagacgugaagggcaucagaacccuguuccugggcauccccgacgagaacuucgaggaccacagcgccccccccagccccgaggagaaggacagcggcuucuucaugcugagaaaggacagcgagagaagagccacccugcacagaauccugaccgaggaccaggacaagaucgugagaaaccugauggagagccuggcccagggcgccgaggagcccaagcugaagugggagcacaucaccacccugaucgccagccugagagaguucgugagaagcaccgacagaaagaucaucgccaccacccugagcaagcugaagcuggagcuggacuucgacagccacggcaucagccaggugcagguggugcuguucggcuuccaggacgccgugaacaaggugcugagaaaccacaacaucaagccccacuggauguucgcccuggacagcaucaucagaaaggccgugcagaccgccaucaccauccuggugcccgagcugagaccccacuucagccuggccagcgagagcgacaccgccgaccaggaggaccuggacguggaggacgaccacgaggagcagcccagcaaccagaccgugagaagaccccaggccgugaucgaggacgccguggccaccagcggcgugagcacccugagcagcaccgugagccacgacagccagagcgcccacagaagccugaacgugcagcugggcagaaugaagaucgagaccaacagacugcuggaggagcuggugagaaaggagaaggagcugcaggcccugcugcacagagccaucgaggagaaggaccaggagaucaagcaccugaagcugaagagccagcccaucgagauccccgagcugcccguguuccaccugaacagcagcggcaccaacaccgaggacagcgagcugaccgacuggcugagagugaacggcgccgacgaggacaccaucagcagauuccuggccgaggacuacacccugcuggacgugcuguacuacgugaccagagacgaccugaagugccugagacugagaggcggcaugcugugcacccuguggaaggccaucaucgacuucagaaacaagcagaccuaa

SEQ ID NO: 19609 - RNA, 3843 nt, Artificial Sequence
  MAP3K6__Homo_sapiens__NP_001284538
auggccggccccugccccagaagcggcgccgagagagccggcagcugcuggcaggacccccuggccguggcccugagcagaggcagacagcuggccgccccccccggcagaggcugcgccagaagcagaccccugagcgugguguacgugcugaccagagagccccagcccggccuggagcccagagagggcaccgaggccgagccccugccccugagaugccugagagaggccugcgcccaggugcccagacccagaccccccccccagcugagaagccugcccuucggcacccuggagcugggcgacaccgccgcccuggacgccuucuacaacgccgacgugguggugcuggaggugagcagcagccuggugcagcccagccuguucuaccaccugggcgugagagagagcuucagcaugaccaacaacgugcugcugugcagccaggccgaccugcccgaccugcaggcccugagagacugcgugggcagcuacacccugauccccuacguggugaccgccaccggcagagugcugugcggcgacgccggccugcugagaggccuggccgacggccuggugcaggccggcgugggcaccgaggcccugcugaccccccuggugggcagacuggccagacugcuggaggccacccccaccgacagcugcggcuacuucagagagaccaucagaagagacaucagacaggccagagagagauucagcggcccccagcugagacaggagcuggccagacugcagagaagacuggacagcguggagcugcugagccccgacaucaucaugaaccugcugcugagcuacagagacgugcaggacuacagcgccaucaucgagcugguggagacccugcaggcccugcccaccugcgacguggccgagcagcacaacgugugcuuccacuacaccuucgcccugaacagaagaaacagacccggcgacagagccaaggcccugagcgugcugcugccccuggugcagcuggagggcagcguggcccccgaccuguacugcaugugcggcagaaucuacaaggacauguucuucagcagcggcuuccaggacgccggccacagagagcaggccuaccacugguacagaaaggccuucgacguggagcccagccugcacagcggcaucaacgccgccgugcugcugaucgccgccggccagcacuucgaggacagcaaggagcugagacugaucggcaugaagcugggcugccugcuggccagaaagggcugcguggagaagaugcaguacuacugggacgugggcuucuaccugggcgcccagauccuggccaacgaccccacccagguggugcuggccgccgagcagcuguacaagcugaacgcccccaucugguaccuggugagcgugauggagaccuuccugcuguaccagcacuucagacccacccccgagccccccggcggcccccccagaagagcccacuucuggcugcacuuccugcugcagagcugccagcccuucaagaccgccugcgcccagggcgaccagugccuggugcuggugcuggagaugaacaaggugcugcugcccgccaagcuggaggugagaggcaccgaccccgugagcaccgugacccugagccugcuggagcccgagacccaggacauccccagcagcuggaccuuccccguggccagcaucugcggcgugagcgccagcaagagagacgagagaugcugcuuccuguacgcccugccccccgcccaggacgugcagcugugcuuccccagcgugggccacugccagugguucugcggccugauccaggccugggugaccaaccccgacagcaccgcccccgccgaggaggccgagggcgccggcgagaugcuggaguucgacuacgaguacaccgagaccggcgagagacuggugcugggcaagggcaccuacggcgugguguacgccggcagagacagacacaccagagugagaaucgccaucaaggagauccccgagagagacagcagauucagccagccccugcacgaggagaucgcccugcacagaagacugagacacaagaacaucgugagauaccugggcagcgccagccagggcggcuaccugaagaucuucauggaggaggugcccggcggcagccugagcagccugcugagaagcguguggggcccccugaaggacaacgagagcaccaucagcuucuacaccagacagauccugcagggccugggcuaccugcacgacaaccacaucgugcacagagacaucaagggcgacaacgugcugaucaacaccuucagcggccugcugaagaucagcgacuucggcaccagcaagagacuggccggcaucacccccugcaccgagaccuucaccggcacccugcaguacauggcccccgagaucaucgaccagggccccagaggcuacggcaaggccgccgacaucuggagccugggcugcaccgugaucgagauggccaccggcagaccccccuuccacgagcugggcagcccccaggccgccauguuccaggugggcauguacaaggugcacccccccaugcccagcagccugagcgccgaggcccaggccuuccugcugagaaccuucgagcccgaccccagacugagagccagcgcccagacccugcugggcgaccccuuccugcagcccggcaagagaagcagaagccccagcagccccagacacgcccccagacccagcgacgcccccagcgccagccccacccccagcgccaacagcaccacccagagccagaccuuccccugcccccaggcccccagccagcacccccccagcccccccaagagaugccugagcuacggcggcaccagccagcugagagugcccgaggagcccgccgccgaggagcccgccagccccgaggagagcagcggccugagccugcugcaccaggagagcaagagaagagccaugcuggccgccgugcuggagcaggagcugcccgcccuggccgagaaccugcaccaggagcagaagcaggagcagggcgccagacugggcagaaaccacguggaggagcugcugagaugccugggcgcccacauccacacccccaacagaagacagcuggcccaggagcugagagcccugcagggcagacugagagcccagggccugggccccgcccugcugcacagaccccuguucgccuuccccgacgccgugaagcagauccugagaaagagacagaucagaccccacuggauguucgugcuggacagccugcugagcagagccgugagagccgcccugggcgugcugggccccgagguggagaaggaggccgugagccccagaagcgaggagcugagcaacgagggcgacagccagcagagccccggccagcagagcccccugcccguggagcccgagcagggccccgccccccugauggugcagcugagccugcugagagccgagaccgacagacugagagagauccuggccggcaaggagagagaguaccaggcccuggugcagagagcccugcagagacugaacgaggaggccagaaccuacgugcuggcccccgagccccccaccgcccugagcaccgaccagggccuggugcaguggcugcaggagcugaacguggacagcggcaccauccagaugcugcugaaccacagcuucacccugcacacccugcugaccuacgccaccagagacgaccugaucuacaccagaaucagaggcggcauggugugcagaaucuggagagccauccuggcccagagagccggcagcacccccgugaccagcggccccuaa

SEQ ID NO: 19610 - RNA, 429 nt, Artificial Sequence
  MAP3K7CL__Homo_sapiens__NP_001273546
augaucagcaccgccagagugcccgccgacaagcccgugagaaucgccuucagccugaacgacgccagcgacgacaccccccccgaggacagcaucccccugguguuccccgagcuggaccagcagcugcagccccugccccccugccacgacagcgaggagagcauggagguguucaagcagcacugccagaucgccgaggaguaccacgaggugaagaaggagaucacccugcuggagcagagaaagaaggagcugaucgccaagcuggaccaggccgagaaggagaagguggacgccgccgagcuggugagagaguucgaggcccugaccgaggagaacagaacccugagacuggcccagagccagugcguggagcagcuggagaagcugagaauccaguaccagaagagacagggcagcagcuaa

SEQ ID NO: 19611 - RNA, 1740 nt, Artificial Sequence
  MAP3K7__Homo_sapiens__NP_003179
augagcaccgccagcgccgccagcagcagcagcagcagcagcgccggcgagaugaucgaggcccccagccaggugcugaacuucgaggagaucgacuacaaggagaucgagguggaggagguggugggcagaggcgccuucggcguggugugcaaggccaaguggagagccaaggacguggccaucaagcagaucgagagcgagagcgagagaaaggccuucaucguggagcugagacagcugagcagagugaaccaccccaacaucgugaagcuguacggcgccugccugaaccccgugugccuggugauggaguacgccgagggcggcagccuguacaacgugcugcacggcgccgagccccugcccuacuacaccgccgcccacgccaugagcuggugccugcagugcagccagggcguggccuaccugcacagcaugcagcccaaggcccugauccacagagaccugaagccccccaaccugcugcugguggccggcggcaccgugcugaagaucugcgacuucggcaccgccugcgacauccagacccacaugaccaacaacaagggcagcgccgccuggauggcccccgagguguucgagggcagcaacuacagcgagaagugcgacguguucagcuggggcaucauccugugggaggugaucaccagaagaaagcccuucgacgagaucggcggccccgccuucagaaucaugugggccgugcacaacggcaccagacccccccugaucaagaaccugcccaagcccaucgagagccugaugaccagaugcuggagcaaggaccccagccagagacccagcauggaggagaucgugaagaucaugacccaccugaugagauacuuccccggcgccgacgagccccugcaguaccccugccaguacagcgacgagggccagagcaacagcgccaccagcaccggcagcuucauggacaucgccagcaccaacaccagcaacaagagcgacaccaacauggagcaggugcccgccaccaacgacaccaucaagagacuggagagcaagcugcugaagaaccaggccaagcagcagagcgagagcggcagacugagccugggcgccagcagaggcagcagcguggagagccugccccccaccagcgagggcaagagaaugagcgccgacaugagcgagaucgaggccagaaucgccgccaccaccggcaacggccagcccagaagaagaagcauccaggaccugaccgugaccggcaccgagcccggccaggugagcagcagaagcagcagccccagcgugagaaugaucaccaccagcggccccaccagcgagaagcccaccagaagccaccccuggacccccgacgacagcaccgacaccaacggcagcgacaacagcauccccauggccuaccugacccuggaccaccagcugcagccccuggcccccugccccaacagcaaggagagcauggccguguucgagcagcacugcaagauggcccaggaguacaugaaggugcagaccgagaucgcccugcugcugcagagaaagcaggagcugguggccgagcuggaccaggacgagaaggaccagcagaacaccagcagacuggugcaggagcacaagaagcugcuggacgagaacaagagccugagcaccuacuaccagcagugcaagaagcagcuggaggugaucagaagccagcagcagaagagacagggcaccagcuaa

SEQ ID NO: 19612 - RNA, 1404 nt, Artificial Sequence
  MAP3K8__Homo_sapiens__XP_005252421
auggaguacaugagcaccggcagcgacaacaaggaggagaucgaccugcugaucaagcaccugaacgugagcgacgugaucgacaucauggagaaccuguacgccagcgaggagcccgccguguacgagcccagccugaugaccaugugccaggacagcaaccagaacgacgagagaagcaagagccugcugcugagcggccaggaggugcccuggcugagcagcgugagauacggcaccguggaggaccugcuggccuucgccaaccacaucagcaacaccgccaagcacuucuacggccagagaccccaggagagcggcauccugcugaacauggugaucaccccccagaacggcagauaccagaucgacagcgacgugcugcugauccccuggaagcugaccuacagaaacaucggcagcgacuucauccccagaggcgccuucggcaagguguaccuggcccaggacaucaagaccaagaagagaauggccugcaagcugauccccguggaccaguucaagcccagcgacguggagauccaggccugcuucagacacgagaacaucgccgagcuguacggcgccgugcuguggggcgagaccgugcaccuguucauggaggccggcgagggcggcagcgugcuggagaagcuggagagcugcggccccaugagagaguucgagaucaucugggugaccaagcacgugcugaagggccuggacuuccugcacagcaagaaggugauccaccacgacaucaagcccagcaacaucguguucaugagcaccaaggccgugcugguggacuucggccugagcgugcagaugaccgaggacguguacuuccccaaggaccugagaggcaccgagaucuacaugagccccgaggugauccugugcagaggccacagcaccaaggccgacaucuacagccugggcgccacccugauccacaugcagaccggcaccccccccugggugaagagauaccccagaagcgccuaccccagcuaccuguacaucauccacaagcaggcccccccccuggaggacaucgccgacgacugcagccccggcaugagagagcugaucgaggccagccuggagagaaaccccaaccacagacccagagccgccgaccugcugaagcacgaggcccugaacccccccagagaggaccagcccagaugccagagccuggacagcgcccugcuggagagaaagagacugcugagcagaaaggagcuggagcugcccgagaacaucgccgacagcagcugcaccggcagcaccgaggagagcgagaugcugaagagacagagaagccuguacaucgaccugggcgcccuggccggcuacuucaaccuggugagaggcccccccacccuggaguacggcuaa

SEQ ID NO: 19613 - RNA, 3315 nt, Artificial Sequence
  MAP3K9__Homo_sapiens__NP_001271159
auggagcccagcagagcccugcugggcugccuggccagcgccgccgccgccgccccccccggcgaggacggcgccggcgccggcgccgaggaggaggaggaggaggaggaggaggccgccgccgccgugggccccggcgagcugggcugcgacgccccccugcccuacuggaccgccguguucgaguacgaggccgccggcgaggacgagcugacccugagacugggcgacgugguggaggugcugagcaaggacagccaggugagcggcgacgagggcugguggaccggccagcugaaccagagagugggcaucuuccccagcaacuacgugacccccagaagcgccuucagcagcagaugccagcccggcggcgaggaccccagcugcuacccccccauccagcugcuggagaucgacuucgccgagcugacccuggaggagaucaucggcaucggcggcuucggcaagguguacagagccuucuggaucggcgacgagguggccgugaaggccgccagacacgaccccgacgaggacaucagccagaccaucgagaacgugagacaggaggccaagcuguucgccaugcugaagcaccccaacaucaucgcccugagaggcgugugccugaaggagcccaaccugugccuggugauggaguucgccagaggcggcccccugaacagagugcugagcggcaagagaaucccccccgacauccuggugaacugggccgugcagaucgccagaggcaugaacuaccugcacgacgaggccaucgugcccaucauccacagagaccugaagagcagcaacauccugauccugcagaagguggagaacggcgaccugagcaacaagauccugaagaucaccgacuucggccuggccagagaguggcacagaaccaccaagaugagcgccgccggcaccuacgccuggauggcccccgaggugaucagagccagcauguucagcaagggcagcgacguguggagcuacggcgugcugcugugggagcugcugaccggcgaggugcccuucagaggcaucgacggccuggccguggccuacggcguggccaugaacaagcuggcccugcccauccccagcaccugccccgagcccuucgccaagcugauggaggacugcuggaaccccgacccccacagcagacccagcuucaccaacauccuggaccagcugaccaccaucgaggagagcggcuucuucgagaugcccaaggacagcuuccacugccugcaggacaacuggaagcacgagauccaggagauguucgaccagcugagagccaaggagaaggagcugagaaccugggaggaggagcugaccagagccgcccugcagcagaagaaccaggaggagcugcugagaagaagagagcaggagcuggccgagagagagaucgacauccuggagagagagcugaacaucaucauccaccagcugugccaggagaagcccagagugaagaagagaaagggcaaguucagaaagagcagacugaagcugaaggacggcaacagaaucagccugcccagcgacuuccagcacaaguucaccgugcaggccagccccaccauggacaagagaaagagccugaucaacagcagaagcagcccccccgccagccccaccaucauccccagacugagagccauccagcugacccccggcgagagcagcaagaccuggggcagaagcagcguggugcccaaggaggagggcgaggaggaggagaagagagcccccaagaagaagggcagaaccuggggccccggcacccugggccagaaggagcuggccagcggcgacgagggcagcccccagagaagagagaaggccaacggccugagcacccccagcgagagcccccacuuccaccugggccugaagagccugguggacggcuacaagcaguggagcagcagcgcccccaaccuggugaagggccccagaagcagccccgcccugcccggcuucaccagccugauggagauggaggacgaggacagcgagggccccggcagcggcgagagcagacugcagcacagccccagccagagcuaccugugcauccccuuccccagaggcgaggacggcgacggccccagcagcgacggcauccacgaggagcccacccccgugaacagcgccaccagcaccccccagcugacccccaccaacagccugaagagaggcggcgcccaccacagaagaugcgagguggcccugcugggcugcggcgccgugcuggccgccaccggccugggcuucgaccugcuggaggccggcaagugccagcugcugccccuggaggagcccgagccccccgccagagaggagaagaagagaagagagggccuguuccagagaagcagcagacccagaagaagcaccagcccccccagcagaaagcuguucaagaaggaggagcccaugcugcugcugggcgaccccagcgccagccugacccugcugagccugagcagcaucagcgagugcaacagcaccagaagccugcugagaagcgacagcgacgagaucgugguguacgagaugcccgugagccccguggaggcccccccccugagccccugcacccacaacccccuggugaacgugagaguggagagauucaagagagaccccaaccagagccugacccccacccacgugacccugaccacccccagccagcccagcagccacagaagaacccccagcgacggcgcccugaagcccgagacccugcuggccagcagaagccccagcagcaacggccugagccccagccccggcgccggcaugcugaagacccccagccccagcagagaccccggcgaguuccccagacugcccgaccccaacgugguguucccccccacccccagaagauggaacacccagcaggacagcacccuggagagacccaagacccuggaguuccugcccagacccagacccagcgccaacagacagagacuggaccccuggugguucgugagccccagccacgccagaagcaccagccccgccaacagcagcagcaccgagacccccagcaaccuggacagcugcuucgccagcagcagcagcaccguggaggagagacccggccugcccgcccugcugcccuuccaggccggcccccugccccccaccgagagaacccugcuggaccuggacgccgagggccagagccaggacagcaccgugccccugugcagagccgagcugaacacccacagacccgcccccuacgagauccagcaggaguucuggagcuaa

SEQ ID NO: 19614 - RNA, 3408 nt, Artificial Sequence
  MAP4__Homo_sapiens__NP_001127836
auggccgaccugagccuggccgacgcccugaccgagcccagccccgacaucgagggcgagaucaagagagacuucaucgccacccuggaggccgaggccuucgacgacguggugggcgagaccgugggcaagaccgacuacaucccccugcuggacguggacgagaagaccggcaacagcgagagcaagaagaagcccugcagcgagaccagccagaucgaggacacccccagcagcaagcccacccugcuggccaacggcggccacggcguggagggcagcgacaccaccggcagccccaccgaguuccuggaggagaagauggccuaccaggaguaccccaacagccagaacuggcccgaggacaccaacuucugcuuccagcccgagcaggugguggaccccauccagaccgaccccuucaagauguaccacgacgacgaccuggccgaccugguguuccccagcagcgccaccgccgacaccagcaucuucgccggccagaacgacccccugaaggacagcuacggcaugagccccugcaacaccgccguggugccccagggcuggagcguggaggcccugaacagcccccacagcgagagcuucgugagccccgaggccguggccgagcccccccagcccaccgccgugccccuggagcuggccaaggagaucgagauggccagcgaggagagaccccccgcccaggcccuggagaucaugaugggccugaagaccaccgacauggcccccagcaaggagaccgagauggcccuggccaaggacauggcccuggccaccaagaccgagguggcccuggccaaggacauggagagccccaccaagcuggacgugacccuggccaaggacaugcagcccagcauggagagcgacauggcccuggugaaggacauggagcugcccaccgagaaggagguggcccuggugaaggacgugagauggcccaccgagaccgacgugagcagcgccaagaacguggugcugcccaccgagaccgagguggcccccgccaaggacgugacccugcugaaggagaccgagagagccagccccaucaagauggaccuggcccccagcaaggacaugggcccccccaaggagaacaagaaggagaccgagagagccagccccaucaagauggaccuggcccccagcaaggacaugggcccccccaaggagaacaagaucgugcccgccaaggaccuggugcugcugagcgagaucgagguggcccaggccaacgacaucaucagcagcaccgagaucagcagcgccgagaagguggcccugagcagcgagaccgagguggcccuggccagagacaugacccugccccccgagaccaacgugauccugaccaaggacaaggcccugccccuggaggccgagguggcccccgugaaggacauggcccagcugcccgagaccgagaucgcccccgccaaggacguggcccccagcaccgugaaggaggugggccugcugaaggacaugagcccccugagcgagaccgagauggcccugggcaaggacgugacccccccccccgagaccgagguggugcugaucaagaacgugugccugccccccgagauggagguggcccugaccgaggaccaggugcccgcccugaagaccgaggccccccuggccaaggacggcgugcugacccuggccaacaacgugacccccgccaaggacgugcccccccugagcgagaccgaggccacccccgugcccaucaaggacauggagaucgcccagacccagaagggcaucagcgaggacagccaccuggagagccugcaggacgugggccagagcgccgcccccaccuucaugaucagccccgagaccgugaccggcaccggcaagaagugcagccugcccgccgaggaggacagcgugcuggagaagcugggcgagagaaagcccugcaacagccagcccagcgagcugagcagcgagaccagcggcaucgccagacccgaggagggcagacccguggugagcggcaccggcaacgacaucaccaccccccccaacaaggagcugccccccagccccgagaagaagaccaagccccuggccaccacccagcccgccaagaccagcaccagcaaggccaagacccagcccaccagccugcccaagcagcccgcccccaccaccaucggcggccugaacaagaagcccaugagccuggccagcggccuggugcccgccgccccccccaagagacccgccguggccagcgccagacccagcauccugcccagcaaggacgugaagcccaagcccaucgccgacgccaaggcccccgagaagagagccagccccagcaagcccgccagcgcccccgccagcagaagcggcagcaagagcacccagaccguggccaagaccaccaccgccgccgccguggccagcaccggccccagcagcagaagccccagcacccugcugcccaagaagcccaccgccaucaagaccgagggcaagcccgccgaggugaagaagaugaccgccaagagcgugcccgccgaccugagcagacccaagagcaccagcaccagcagcaugaagaagaccaccacccugagcggcaccgcccccgccgccggcguggugcccagcagagugaaggccacccccaugcccagcagacccagcaccacccccuucaucgacaagaagcccaccagcgccaagcccagcagcaccacccccagacugagcagacuggccaccaacaccagcgcccccgaccugaagaacgugagaagcaaggugggcagcaccgagaacaucaagcaccagcccggcggcggcagagccaagguggagaagaagaccgaggccgccgccaccaccagaaagcccgagagcaacgccgugaccaagaccgccggccccaucgccagcgcccagaagcagcccgccggcaaggugcagaucgugagcaagaaggugagcuacagccacauccagagcaagugcggcagcaaggacaacaucaagcacgugcccggcggcggcaacgugcagauccagaacaagaagguggacaucagcaaggugagcagcaagugcggcagcaaggccaacaucaagcacaagcccggcggcggcgacgugaagaucgagagccagaagcugaacuucaaggagaaggcccaggccaaggugggcagccuggacaacgugggccaccugcccgccggcggcgccgugaagaucgagaccuacagacugaccuucagagccaacgccagagccagaaccgaccacggcgccgacaucgugagcagacccccccacuuccccggcggccccaacagcggcagcagagugcugggcccccugagcagagccgugcacuaa

SEQ ID NO: 19615 - RNA, 2466 nt, Artificial Sequence
  MAP4K1__Homo_sapiens__NP_001036065
auggacgugguggaccccgacaucuucaacagagaccccagagaccacuacgaccugcugcagagacugggcggcggcaccuacggcgagguguucaaggccagagacaaggugagcggcgaccugguggcccugaagauggugaagauggagcccgacgacgacgugagcacccugcagaaggagauccugauccugaagaccugcagacacgccaacaucguggccuaccacggcagcuaccuguggcugcagaagcuguggaucugcauggaguucugcggcgccggcagccugcaggacaucuaccaggugaccggcagccugagcgagcugcagaucagcuacgugugcagagaggugcugcagggccuggccuaccugcacagccagaagaagauccacagagacaucaagggcgccaacauccugaucaacgacgccggcgaggugagacuggccgacuucggcaucagcgcccagaucggcgccacccuggccagaagacugagcuucaucggcacccccuacuggauggcccccgagguggccgccguggcccugaagggcggcuacaacgagcugugcgacaucuggagccugggcaucaccgccaucgagcuggccgagcugcagcccccccuguucgacgugcacccccugagagugcuguuccugaugaccaagagcggcuaccagccccccagacugaaggagaagggcaaguggagcgccgccuuccacaacuucaucaaggugacccugaccaagagccccaagaagagacccagcgccaccaagaugcugagccaccagcuggugagccagcccggccugaacagaggccugauccuggaccugcuggacaagcugaagaaccccggcaagggccccagcaucggcgacaucgaggacgaggagcccgagcugccccccgccauccccagaagaaucagaagcacccacagaagcagcagccugggcauccccgacgccgacugcugcagaagacacauggaguucagaaagcugagaggcauggagaccagaccccccgccaacaccgccagacugcagccccccagagaccugagaagcagcagccccagaaagcagcugagcgagagcagcgacgacgacuacgacgacguggacauccccacccccgccgaggacaccccccccccccugccccccaagcccaaguucagaagccccagcgacgagggccccggcagcaugggcgacgacggccagcugagccccggcgugcuggugagaugcgccagcggccccccccccaacagccccagacccggccccccccccagcaccagcagcccccaccugaccgcccacagcgagcccagccuguggaacccccccagcagagagcuggacaagcccccccugcugccccccaagaaggagaagaugaagagaaagggcugcgcccugcuggugaagcuguucaacggcugcccccugagaauccacagcaccgccgccuggacccaccccagcaccaaggaccagcaccugcugcugggcgccgaggagggcaucuucauccugaacagaaacgaccaggaggccacccuggagaugcuguuccccagcagaaccaccuggguguacagcaucaacaacgugcugaugagccugagcggcaagaccccccaccuguacagccacagcauccugggccugcuggagagaaaggagaccagagccggcaaccccaucgcccacaucagcccccacagacugcuggccagaaagaacauggugagcaccaagauccaggacaccaagggcugcagagccugcugcguggccgagggcgccagcagcggcggccccuuccugugcggcgcccuggagaccagcguggugcugcugcagugguaccagcccaugaacaaguuccugcuggugagacaggugcuguucccccugcccaccccccugagcguguucgcccugcugaccggccccggcagcgagcugcccgccgugugcaucggcgugagccccggcagacccggcaagagcgugcuguuccacaccgugagauucggcgcccugagcugcuggcugggcgagaugagcaccgagcacagaggccccgugcaggugacccagguggaggaggacauggugauggugcugauggacggcagcgugaagcuggugacccccgagggcagccccgugagaggccugagaacccccgagauccccaugaccgaggccguggaggccguggccauggugggcggccagcugcaggccuucuggaagcacggcgugcaggugugggcccugggcagcgaccagcugcugcaggagcugagagaccccacccugaccuucagacugcugggcagccccagacccguggugguggagaccagacccguggacgaccccaccgcccccagcaaccuguacauccaggaguaa

SEQ ID NO: 19616 - RNA, 2463 nt, Artificial Sequence
  MAP4K2__Homo_sapiens__NP_004570
auggcccugcugagagacgugagccugcaggaccccagagacagauucgagcugcugcagagagugggcgccggcaccuacggcgacguguacaaggccagagacaccgugaccagcgagcuggccgccgugaagaucgugaagcuggaccccggcgacgacaucagcagccugcagcaggagaucaccauccugagagagugcagacaccccaacgugguggccuacaucggcagcuaccugagaaacgacagacuguggaucugcauggaguucugcggcggcggcagccugcaggagaucuaccacgccaccggcccccuggaggagagacagaucgccuacgugugcagagaggcccugaagggccugcaccaccugcacagccagggcaagauccacagagacaucaagggcgccaaccugcugcugacccugcagggcgacgugaagcuggccgacuucggcgugagcggcgagcugaccgccagcguggccaagagaagaagcuucaucggcacccccuacuggauggcccccgagguggccgccguggagagaaagggcggcuacaacgagcugugcgacgugugggcccugggcaucaccgccaucgagcugggcgagcugcagcccccccuguuccaccugcaccccaugagagcccugaugcugaugagcaagagcagcuuccagccccccaagcugagagacaagaccagauggacccagaacuuccaccacuuccugaagcuggcccugaccaagaaccccaagaagagacccaccgccgagaagcugcugcagcaccccuucaccacccagcagcugcccagagcccugcugacccagcugcuggacaaggccagcgacccccaccugggcacccccagccccgaggacugcgagcuggagaccuacgacauguuccccgacaccauccacagcagaggccagcacggccccgccgagagaacccccagcgagauccaguuccaccaggugaaguucggcgcccccagaagaaaggagaccgacccccugaacgagcccugggaggaggaguggacccugcugggcaaggaggagcugagcggcagccugcugcagagcgugcaggaggcccuggaggagagaagccugaccaucagaagcgccagcgaguuccaggagcuggacagccccgacgacaccaugggcaccaucaagagagcccccuuccugggcccccugcccaccgacccccccgccgaggagccccugagcagcccccccggcacccugccccccccccccagcggccccaacagcagcccccugcugcccaccgccugggccaccaugaagcagagagaggaccccgagagaagcagcugccacggccugccccccacccccaaggugcacaugggcgccugcuucagcaagguguucaacggcugcccccugagaauccacgccgccgugaccuggauccaccccgugaccagagaccaguuccugguggugggcgccgaggagggcaucuacacccugaaccugcacgagcugcacgaggacacccuggagaagcugaucagccacagaugcagcuggcuguacugcgugaacaacgugcugcugagccugagcggcaagagcacccacaucugggcccacgaccugcccggccuguucgagcagagaagacugcagcagcaggugccccugagcauccccaccaacagacugacccagagaaucauccccagaagauucgcccugagcaccaagauccccgacaccaagggcugccugcagugcagaguggugagaaaccccuacaccggcgccaccuuccugcuggccgcccugcccaccagccugcugcugcugcagugguacgagccccugcagaaguuccugcugcugaagaacuucagcagcccccugcccagccccgccggcaugcuggagccccuggugcuggacggcaaggagcugccccaggugugcgugggcgccgagggccccgagggccccggcugcagagugcuguuccacgugcugccccuggaggccggccugacccccgacauccugaucccccccgagggcauccccggcagcgcccagcaggugauccagguggacagagacaccauccuggugagcuucgagagaugcgugagaaucgugaacaugcagggcgagcccaccgccacccuggcccccgagcugaccuucgacuuccccaucgagaccguggugugccugcaggacagcgugcuggccuucuggagccacggcaugcagggcagaagccuggacaccaacgaggugacccaggagaucaccgacgagaccagaaucuucagagugcugggcgcccacagagacaucauccuggagagcauccccaccgacaaccccgaggcccacagcaaccuguacauccugaccggccaccagagcaccuacuaa

SEQ ID NO: 19617 - RNA, 2622 nt, Artificial Sequence
  MAP4K3__Homo_sapiens__NP_001257354
augaaccccggcuucgaccugagcagaagaaacccccaggaggacuucgagcugauccagagaaucggcagcggcaccuacggcgacguguacaaggccagaaacgugaacaccggcgagcuggccgccaucaaggugaucaagcuggagcccggcgaggacuucgccguggugcagcaggagaucaucaugaugaaggacugcaagcaccccaacaucguggccuacuucggcagcuaccugagaagagacaagcuguggaucugcauggaguucugcggcggcggcagccugcaggacaucuaccacgugaccggcccccugagcgagcugcagaucgccuacgugagcagagagacccugcagggccuguacuaccugcacagcaagggcaagaugcacagagacaucaagggcgccaacauccugcugaccgacaacggccacgugaagcuggccgacuucggcgugagcgcccagaucaccgccaccaucgccaagagaaagagcuucaucggcacccccuacuggauggcccccgagguggccgccguggagagaaagggcggcuacaaccagcugugcgaccugugggccgugggcaucaccgccaucgagcuggccgagcugcagccccccauguucgaccugcaccccaugagagcccuguuccugaugaccaagagcaacuuccagccccccaagcugaaggacaagaugaaguggagcaacagcuuccaccacuucgugaagauggcccugaccaagaaccccaagaagagacccaccgccgagaagcugcugcagcaccccuucgugacccagcaccugaccagaagccuggccaucgagcugcuggacaaggugaacaaccccgaccacagcaccuaccacgacuucgacgacgacgaccccgagccccugguggccgugccccacagaauccacagcaccagcagaaacgugagagaggagaagaccagaagcgagaucaccuucggccaggugaaguucgaccccccccugagaaaggagaccgagccccaccacgagcuggaccugcagcuggaguacggccagggccaccagggcggcuacuuccugggcgccaacaagagccugcugaagagcguggaggaggagcugcaccagagaggccacguggcccaccuggaggacgacgagggcgacgacgacgagagcaagcacagcacccugaaggccaagaucccccccccccugccccccaagcccaagagcaucuucaucccccaggagaugcacagcaccgaggacgagaaccagggcaccaucaagagaugccccaugagcggcagccccgccaagcccagccaggugccccccagaccccccccccccagacugcccccccacaagcccguggcccugggcaacggcaugagcagcuuccagcugaacggcgagagagacggcagccugugccagcagcagaacgagcacagaggcaccaaccugagcagaaaggagaagaaggacgugcccaagcccaucagcaacggccugccccccacccccaaggugcacaugggcgccugcuucagcaagguguucaacggcugcccccugaagauccacugcgccagcagcuggaucaaccccgacaccagagaccaguaccugaucuucggcgccgaggagggcaucuacacccugaaccugaacgagcugcacgagaccagcauggagcagcuguuccccagaagaugcaccuggcuguacgugaugaacaacugccugcugagcaucagcggcaaggccagccagcuguacagccacaaccugcccggccuguucgacuacgccagacagaugcagaagcugcccguggccauccccgcccacaagcugcccgacagaauccugcccagaaaguucagcgugagcgccaagauccccgagaccaaguggugccagaagugcugcguggugagaaaccccuacaccggccacaaguaccugugcggcgcccugcagaccagcaucgugcugcuggaguggguggagcccaugcagaaguucaugcugaucaagcacaucgacuuccccauccccugcccccugagaauguucgagaugcugguggugcccgagcaggaguacccccuggugugcgugggcgugagcagaggcagagacuucaaccagguggugagauucgagaccgugaaccccaacagcaccagcagcugguucaccgagagcgacaccccccagaccaacgugacccacgugacccagcuggagagagacaccauccuggugugccuggacugcugcaucaagaucgugaaccugcagggcagacugaagagcagcagaaagcugagcagcgagcugaccuucgacuuccagaucgagagcaucgugugccugcaggacagcgugcuggccuucuggaagcacggcaugcagggcagaagcuucagaagcaacgaggugacccaggagaucagcgacagcaccagaaucuucagacugcugggcagcgacagagugguggugcuggagagcagacccaccgacaaccccaccgccaacagcaaccuguacauccuggccggccacgagaacagcuacuaa

SEQ ID NO: 19618 - RNA, 3720 nt, Artificial Sequence
  MAP4K4__Homo_sapiens__NP_001229488
auggccaacgacagccccgccaagagccugguggacaucgaccugagcagccugagagaccccgccggcaucuucgagcugguggagguggugggcaacggcaccuacggccagguguacaagggcagacacgugaagaccggccagcuggccgccaucaaggugauggacgugaccgaggacgaggaggaggagaucaagcuggagaucaacaugcugaagaaguacagccaccacagaaacaucgccaccuacuacggcgccuucaucaagaagagcccccccggccacgacgaccagcuguggcuggugauggaguucugcggcgccggcagcaucaccgaccuggugaagaacaccaagggcaacacccugaaggaggacuggaucgccuacaucagcagagagauccugagaggccuggcccaccugcacauccaccacgugauccacagagacaucaagggccagaacgugcugcugaccgagaacgccgaggugaagcugguggacuucggcgugagcgcccagcuggacagaaccgugggcagaagaaacaccuucaucggcacccccuacuggauggcccccgaggugaucgccugcgacgagaaccccgacgccaccuacgacuacagaagcgaccuguggagcugcggcaucaccgccaucgagauggccgagggcgcccccccccugugcgacaugcaccccaugagagcccuguuccugauccccagaaaccccccccccagacugaagagcaagaaguggagcaagaaguucuucagcuucaucgagggcugccuggugaagaacuacaugcagagacccagcaccgagcagcugcugaagcaccccuucaucagagaccagcccaacgagagacaggugagaauccagcugaaggaccacaucgacagaaccagaaagaagagaggcgagaaggacgagaccgaguacgaguacagcggcagcgaggaggaggaggaggaggugcccgagcaggagggcgagcccagcagcaucgugaacgugcccggcgagagcacccugagaagagacuuccugagacugcagcaggagaacaaggagagaagcgaggcccugagaagacagcagcugcugcaggagcagcagcugagagagcaggaggaguacaagagacagcugcuggccgagagacagaagagaaucgagcagcagaaggagcagagaagaagacuggaggagcagcagagaagagagagagaggccagaagacagcaggagagagagcagagaagaagagagcaggaggagaagagaagacuggaggagcuggagagaagaagaaaggaggaggaggagagaagaagagccgaggaggagaagagaagaguggagagagagcaggaguacaucagaagacagcuggaggaggagcagagacaccuggaggugcugcagcagcagcugcugcaggagcaggccaugcugcuggagugcagauggagagagauggaggagcacagacaggccgagagacugcagagacagcugcagcaggagcaggccuaccugcugagccugcagcacgaccacagaagaccccacccccagcacagccagcagcccccccccccccagcaggagagaagcaagcccagcuuccacgcccccgagcccaaggcccacuacgagcccgccgacagagccagagagguggaggacagauucagaaagaccaaccacagcagccccgaggcccagagcaagcagaccggcagagugcuggagccccccgugcccagcagaagcgagagcuucagcaacggcaacagcgagagcgugcaccccgcccugcagagacccgccgagccccaggugcccgugagaaccaccagcagaagccccgugcugagcagaagagacagcccccugcagggcagcggccagcagaacagccaggccggccagagaaacagcaccagcaucgagcccagacugcugugggagagaguggagaagcuggugcccagacccggcagcggcagcagcagcggcagcagcaacagcggcagccagcccggcagccaccccggcagccagagcggcagcggcgagagauucagagugagaagcagcagcaagagcgagggcagccccagccagagacuggagaacgccgugaagaagcccgaggacaagaaggagguguucagaccccugaagcccgccgaccugaccgcccuggccaaggagcugagagccguggaggacgugagacccccccacaaggugaccgacuacagcagcagcagcgaggagagcggcaccaccgacgaggaggacgacgacguggagcaggagggcgccgacgagagcaccagcggccccgaggacaccagagccgccagcagccugaaccugagcaacggcgagaccgagagcgugaagaccaugaucgugcacgacgacguggagagcgagcccgccaugacccccagcaaggagggcacccugaucgugagacagacccagagcgccagcagcacccugcagaagcacaagagcagcagcagcuucacccccuucaucgaccccagacugcugcagaucagccccagcagcggcaccaccgugaccagcguggugggcuucagcugcgacggcaugagacccgaggccaucagacaggaccccaccagaaagggcagcguggugaacgugaaccccaccaacaccagaccccagagcgacacccccgagaucagaaaguacaagaagagauucaacagcgagauccugugcgccgcccuguggggcgugaaccugcuggugggcaccgagagcggccugaugcugcuggacagaagcggccagggcaagguguacccccugaucaacagaagaagauuccagcagauggacgugcuggagggccugaacgugcuggugaccaucagcggcaagaaggacaagcugagaguguacuaccugagcuggcugagaaacaagauccugcacaacgaccccgagguggagaagaagcagggcuggaccaccgugggcgaccuggagggcugcgugcacuacaagguggugaaguacgagagaaucaaguuccuggugaucgcccugaagagcagcguggagguguacgccugggcccccaagcccuaccacaaguucauggccuucaagagcuucggcgagcuggugcacaagccccugcugguggaccugaccguggaggagggccagagacugaaggugaucuacggcagcugcgccggcuuccacgccguggacguggacagcggcagcguguacgacaucuaccugcccacccacauccagugcagcaucaagccccacgccaucaucauccugcccaacaccgacggcauggagcugcuggugugcuacgaggacgagggcguguacgugaacaccuacggcagaaucaccaaggacguggugcugcaguggggcgagaugcccaccagcguggccuacaucagaagcaaccagaccaugggcuggggcgagaaggccaucgagaucagaagcguggagaccggccaccuggacggcguguucaugcacaagagagcccagagacugaaguuccugugcgagagaaacgacaagguguucuucgccagcgugagaagcggcggcagcagccagguguacuucaugacccugggcagaaccagccugcugagcugguaa

SEQ ID NO: 19619 - RNA, 2541 nt, Artificial Sequence
  MAP4K5__Homo_sapiens__XP_006720076
auggaggccccccugagacccgccgccgacauccugagaagaaacccccagcaggacuacgagcuggugcagagagugggcagcggcaccuacggcgacguguacaaggccagaaacgugcacaccggcgagcuggccgccgugaagaucaucaagcuggagcccggcgacgacuucagccugauccagcaggagaucuucauggugaaggagugcaagcacugcaacaucguggccuacuucggcagcuaccugagcagagagaagcuguggaucugcauggaguacugcggcggcggcagccugcaggacaucuaccacgugaccggcccccugagcgagcugcagaucgccuacgugugcagagagacccugcagggccuggccuaccugcacaccaagggcaagaugcacagagacaucaagggcgccaacauccugcugaccgaccacggcgacgugaagcuggccgacuucggcguggccgccaagaucaccgccaccaucgccaagagaaagagcuucaucggcacccccuacuggauggcccccgagguggccgccguggagaagaacggcggcuacaaccagcugugcgacaucugggccgugggcaucaccgccaucgagcugggcgagcugcagccccccauguucgaccugcaccccaugagagcccuguuccugaugagcaagagcaacuuccagccccccaagcugaaggacaagaccaaguggagcagcaccuuccacaacuucgugaagaucgcccugaccaagaaccccaagaagagacccaccgccgagagacugcugacccacaccuucguggcccagcccggccugagcagagcccuggccguggagcugcuggacaaggugaacaaccccgacaaccacgcccacuacaccgaggccgacgacgacgacuucgagccccacgccaucaucagacacaccaucagaagcaccaacagaaacgccagagccgagagaaccgccagcgagaucaacuucgacaagcugcaguucgagcccccccugagaaaggagaccgaggccagagacgagaugggccugagcagcgaccccaacuucaugcugcaguggaaccccuucguggacggcgccaacaccggcaagagcaccagcaagagagccaucccccccccccugccccccaagcccagaaucagcagcuaccccgaggacaacuuccccgacgaggagaaggccagcaccaucaagcacugccccgacagcgagagcagagccccccagauccugagaagacagagcagccccagcugcggccccguggccgagaccagcagcaucggcaacggcgacggcaucagcaagcugaugagcgagaacaccgagggcagcgcccaggccccccagcugcccagaaagaaggacaagagagacuuccccaagcccgccaucaacggccugccccccacccccaaggugcugaugggcgccugcuucagcaagguguucgacggcugcccccugaagaucaacugcgccaccagcuggauccaccccgacaccaaggaccaguacaucaucuucggcaccgaggacggcaucuacacccugaaccugaacgagcugcacgaggccaccauggagcagcuguuccccagaaagugcaccuggcuguacgugaucaacaacacccugaugagccugagcgagggcaagaccuuccagcuguacagccacaaccugaucgcccuguucgagcacgccaagaagcccggccuggccgcccacauccagacccacagauuccccgacagaauccugcccagaaaguucgcccugaccaccaagauccccgacaccaagggcugccacaagugcugcaucgugagaaaccccuacaccggccacaaguaccugugcggcgcccugcagagcggcaucgugcugcugcagugguacgagcccaugcagaaguucaugcugaucaagcacuucgacuucccccugcccagcccccugaacguguucgagaugcuggugauccccgagcaggaguaccccauggugugcguggccaucagcaagggcaccgagagcaaccagguggugcaguucgagaccaucaaccugaacagcgccagcagcugguucaccgagaucggcgccggcagccagcagcuggacagcauccacgugacccagcuggagagagacaccgugcuggugugccuggacaaguucgugaagaucgugaaccugcagggcaagcugaagagcagcaagaagcuggccagcgagcugagcuucgacuucagaaucgagagcguggugugccugcaggacagcgugcuggccuucuggaagcacggcaugcagggcaagagcuucaagagcgacgaggugacccaggagaucagcgacgagaccagaguguucagacugcugggcagcgacagagugguggugcuggagagcagacccaccgagaaccccaccgcccacagcaaccuguacauccuggccggccacgagaacagcuacuaa

SEQ ID NO: 19620 - RNA, 2442 nt, Artificial Sequence
  MAP6__Homo_sapiens__NP_149052
auggccuggcccugcaucaccagagccugcugcaucgccagauucuggaaccagcuggacaaggccgacaucgccgugccccugguguucaccaaguacagcgaggccaccgagcaccccggcgcccccccccagcccccccccccccagcagcaggcccagcccgcccuggccccccccagcgccagagccguggccaucgagacccagcccgcccagggcgagcuggacgccguggccagagccaccggccccgcccccggccccaccggcgagagagagcccgccgccggccccggcagaagcggccccggccccggccugggcagcggcagcaccagcggccccgccgacagcgugaugagacaggacuacagagccuggaaggugcagagacccgagcccagcugcagacccagaagcgaguaccagcccagcgacgcccccuucgagagagagacccaguaccagaaggacuucagagccuggccccugcccagaagaggcgaccaccccuggauccccaagcccgugcagaucagcgccgccagccaggccagcgcccccauccugggcgcccccaagagaagaccccagagccaggagagauggcccgugcaggccgccgccgaggccagagagcaggaggccgcccccggcggcgccggcggccuggccgccggcaaggccagcggcgccgacgagagagacaccagaagaaaggccggccccgccuggaucgugagaagagccgagggccugggccacgagcagaccccccugcccgccgcccaggcccaggugcaggccaccggccccgaggccggcagaggcagagccgccgccgacgcccugaacagacagaucagagaggagguggccagcgccgugagcagcagcuacagaaacgaguucagagccuggaccgacaucaagcccgugaagcccaucaaggccaagccccaguacaagccccccgacgacaagauggugcacgagaccagcuacagcgcccaguucaagggcgaggccagcaagcccaccaccgccgacaacaaggugaucgacagaagaagaaucagaagccuguacagcgagcccuucaaggagccccccaagguggagaagcccagcgugcagagcagcaagcccaagaagaccagcgccagccacaagcccaccagaaaggccaaggacaagcaggccgugagcggccaggccgccaagaagaagagcgccgagggccccagcaccaccaagcccgacgacaaggagcagagcaaggagaugaacaacaagcuggccgaggccaaggagagccuggcccagcccgugagcgacagcagcaagacccagggccccguggccaccgagcccgacaaggaccagggcagcguggugcccggccugcugaagggccagggccccauggugcaggagccccugaagaagcagggcagcguggugcccggcccccccaaggaccugggccccaugaucccccugcccgugaaggaccaggaccacaccgugcccgagccccugaagaacgagagccccgugaucagcgcccccgugaaggaccagggccccagcgugcccgugccccccaagaaccagagccccauggugcccgccaaggugaaggaccagggcagcguggugcccgagagccugaaggaccagggccccagaauccccgagcccgugaagaaccaggcccccauggugcccgcccccgugaaggacgagggccccauggugagcgccagcgugaaggaccagggccccauggugagcgcccccgugaaggaccagggccccaucgugcccgcccccgugaagggcgagggccccaucgugcccgcccccgugaaggacgagggccccauggugagcgcccccaucaaggaccaggaccccauggugcccgagcaccccaaggacgagagcgccauggccaccgcccccaucaagaaccagggcagcauggugagcgagcccgugaagaaccagggccugguggugagcggccccgugaaggaccaggacgugguggugcccgagcacgccaaggugcacgacagcgccgugguggcccccgugaagaaccagggccccguggugcccgagagcgugaagaaccaggaccccauccugcccgugcuggugaaggaccagggccccaccgugcugcagccccccaagaaccagggcagaaucgugcccgagccccugaagaaccaggugcccaucgugcccgugccccugaaggaccaggacccccuggugcccgugcccgccaaggaccagggccccgccgugcccgagccccugaagacccagggccccagagacccccagcugcccaccgugagcccccugcccagagugaugauccccaccgccccccacaccgaguacaucgagagcagccccuaa

SEQ ID NO: 19621 - RNA, 2205 nt, Artificial Sequence
  MAP7__Homo_sapiens__NP_001185540
augcccggcagcgccaccgcccugagacacgagagacugaagaagaccaacgccagacccaucccccugggccuguucaccaucaacgaggaggacgagcagcagaagaacggcaacagcagaagacccaaggcccccgacagcuacaaggugcaggacaagaagaacgccagcagcagacccgccagcgccaucagcggccagaacaacaaccacagcggcaacaagcccgaccccccccccgugcugagaguggacgacagacagagacuggccagagagagaagagaggagagagagaagcagcuggccgccagagagaucguguggcuggagagagaggagagagccagacagcacuacgagaagcaccuggaggagagaaagaagagacuggaggagcagagacagaaggaggagagaagaagagccgccguggaggagaagagaagacagagacuggaggaggacaaggagagacacgaggccguggugagaagaaccauggagagaagccagaagcccaagcagaagcacaacagauggagcuggggcggcagccugcacggcagccccagcauccacagcgccgccagaagacugcagcugagccccugggagagcagcguggugaacagacugcugacccccacccacagcuuccuggccagaagcaagagcaccgccgcccugagcggcgaggccgccagcugcagccccaucaucaugcccuacaaggccgcccacagcagaaacagcauggacagacccaagcuguucgugaccccccccgagggcagcagcagaagaagaaucauccacggcaccgccagcuacaagaaggagagagagagagagaacgugcuguuccugaccagcggcaccagaagagccgugagccccagcaaccccaaggccagacagcccgccagaagcagacuguggcugcccagcaagagccugccccaccugcccggcacccccagacccaccagcagccugccccccggcagcgugaaggccgcccccgcccaggugagaccccccagccccggcaacaucagacccgugaagagagaggugaagguggagcccgagaagaaggaccccgagaaggagccccagaagguggccaacgagcccagccugaagggcagagccccccuggugaagguggaggaggccaccguggaggagagaacccccgccgagcccgaggugggccccgccgcccccgccauggcccccgcccccgccagcgcccccgcccccgccagcgcccccgcccccgcccccgugcccacccccgccauggugagcgcccccagcagcaccgugaacgccagcgccagcgugaagaccagcgccggcaccaccgaccccgaggaggccaccagacugcuggccgagaagagaagacuggccagagagcagagagagaaggaggagagagagagaagagagcaggaggagcuggagagacagaagagagaggagcuggcccagagaguggccgaggagagaaccaccagaagagaggaggagagcagaagacuggaggccgagcaggccagagagaaggaggagcagcugcagagacaggccgaggagagagcccugagagagagagaggaggccgagagagcccagagacagaaggaggaggaggccagagugagagaggaggccgagagagugagacaggagagagagaagcacuuccagagagaggagcaggagagacuggagagaaagaagagacuggaggagaucaugaagagaaccagaagaaccgaggccaccgacaagaagaccagcgaccagagaaacggcgacaucgccaagggcgcccugaccggcggcaccgaggugagcgcccugcccugcaccaccaacgcccccggcaacggcaagcccgugggcagcccccacguggugaccagccaccagagcaaggugaccguggagagcacccccgaccuggagaagcagcccaacgagaacggcgugagcgugcagaacgagaacuucgaggagaucaucaaccugcccaucggcagcaagcccagcagacuggacgugaccaacagcgagagccccgagaucccccugaaccccauccuggccuucgacgacgagggcacccugggcccccugccccagguggacggcgugcagacccagcagaccgccgaggugaucuaa

SEQ ID NO: 19622 - RNA, 1944 nt, Artificial Sequence
  MAP9__Homo_sapiens__NP_001034669
augagcgacgagguguucagcaccacccuggccuacaccaagagccccaaggugaccaagagaaccaccuuccaggacgagcugaucagagccaucaccgccagaagcgccagacagagaagcagcgaguacagcgacgacuucgacagcgacgagaucgugagccugggcgacuucagcgacaccagcgccgacgagaacagcgugaacaagaagaugaacgacuuccacaucagcgacgacgaggagaagaaccccagcaagcugcuguuccugaagaccaacaagagcaacggcaacaucaccaaggacgagcccgugugcgccaucaagaacgaggaggagauggcccccgacggcugcgaggacaucguggugaagagcuucagcgagagccagaacaaggacgaggaguucgagaaggacaagaucaagaugaagcccaagcccagaauccugagcaucaagagcaccagcagcgccgagaacaacagccuggacaccgacgaccacuucaagcccagccccagacccagaagcaugcugaagaagaagagccacauggaggagaaggacggccuggaggacaaggagaccgcccugagcgaggagcuggagcugcacagcgcccccagcagccugcccacccccaacggcauccagcuggaggccgagaagaaggccuucagcgagaaccuggaccccgaggacagcugccugaccagccuggccagcagcagccugaagcagauccugggcgacagcuucagccccggcagcgagggcaacgccagcggcaaggaccccaacgaggagaucaccgagaaccacaacagccugaagagcgacgagaacaaggagaacagcuucagcgccgaccacgugaccaccgccguggagaagagcaaggagagccaggugaccgccgacgaccuggaggaggagaaggccaaggccgagcugaucauggacgacgacagaaccguggacccccugcugagcaagagccagagcauccugaucagcaccagcgccaccgccagcagcaagaagaccaucgaggacagaaacaucaagaacaagaagagcaccaacaacagagccagcagcgccagcgccagacugaugaccagcgaguuccugaagaagagcagcagcaagagaagaacccccagcaccaccaccagcagccacuaccugggcacccugaaggugcuggaccagaagcccagccagaagcagagcaucgagcccgacagagccgacaacaucagagccgccguguaccaggaguggcuggagaagaagaacguguaccugcacgagaugcacagaaucaagagaaucgagagcgagaaccugagaauccagaacgagcagaagaaggccgccaagagagaggaggcccuggccagcuucgaggccuggaaggccaugaaggagaaggaggccaagaagaucgccgccaagaagagacuggaggagaagaacaagaagaagaccgaggaggagaacgccgccagaaagggcgaggcccugcaggccuucgagaaguggaaggagaagaagauggaguaccugaaggagaagaacagaaaggagagagaguacgagagagccaagaagcagaaggaggaggagaccguggccgagaagaagaaggacaaccugaccgccguggagaaguggaacgagaagaaggaggccuucuucaagcagaaggagaaggagaagaucaacgagaagagaaaggaggagcugaagagagccgagaagaaggacaaggacaagcaggccaucaacgaguacgagaaguggcuggagaacaaggagaagcaggagagaaucgagagaaagcagaagaagagacacagcuuccuggagagcgaggcccugccccccuggagcccccccagcagaaccguguucgccaagguguucuaa

SEQ ID NO: 19623 - RNA, 1269 nt, Artificial Sequence
  MAPK10__Homo_sapiens__NP_002744
augagccugcacuuccuguacuacugcagcgagcccacccuggacgugaagaucgccuucugccagggcuucgacaagcagguggacgugagcuacaucgccaagcacuacaacaugagcaagagcaagguggacaaccaguucuacagcguggaggugggcgacagcaccuucaccgugcugaagagauaccagaaccugaagcccaucggcagcggcgcccagggcaucgugugcgccgccuacgacgccgugcuggacagaaacguggccaucaagaagcugagcagacccuuccagaaccagacccacgccaagagagccuacagagagcuggugcugaugaagugcgugaaccacaagaacaucaucagccugcugaacguguucaccccccagaagacccuggaggaguuccaggacguguaccuggugauggagcugauggacgccaaccugugccaggugauccagauggagcuggaccacgagagaaugagcuaccugcuguaccagaugcugugcggcaucaagcaccugcacagcgccggcaucauccacagagaccugaagcccagcaacaucguggugaagagcgacugcacccugaagauccuggacuucggccuggccagaaccgccggcaccagcuucaugaugacccccuacguggugaccagauacuacagagcccccgaggugauccugggcaugggcuacaaggagaacguggacaucuggagcgugggcugcaucaugggcgagauggugagacacaagauccuguuccccggcagagacuacaucgaccaguggaacaaggugaucgagcagcugggcacccccugccccgaguucaugaagaagcugcagcccaccgugagaaacuacguggagaacagacccaaguacgccggccugaccuuccccaagcuguuccccgacagccuguuccccgccgacagcgagcacaacaagcugaaggccagccaggccagagaccugcugagcaagaugcuggugaucgaccccgccaagagaaucagcguggacgacgcccugcagcaccccuacaucaacgugugguacgaccccgccgagguggaggccccccccccccagaucuacgacaagcagcuggacgagagagagcacaccaucgaggaguggaaggagcugaucuacaaggaggugaugaacagcgaggagaagaccaagaacggcguggugaagggccagcccagccccagcgcccaggugcagcaguaa

SEQ ID NO: 19624 - RNA, 1095 nt, Artificial Sequence
  MAPK11__Homo_sapiens__NP_002742
augagcggccccagagccggcuucuacagacaggagcugaacaagaccgugugggaggugccccagagacugcagggccugagacccgugggcagcggcgccuacggcagcgugugcagcgccuacgacgccagacugagacagaagguggccgugaagaagcugagcagacccuuccagagccugauccacgccagaagaaccuacagagagcugagacugcugaagcaccugaagcacgagaacgugaucggccugcuggacguguucacccccgccaccagcaucgaggacuucagcgagguguaccuggugaccacccugaugggcgccgaccugaacaacaucgugaagugccaggcccugagcgacgagcacgugcaguuccugguguaccagcugcugagaggccugaaguacauccacagcgccggcaucauccacagagaccugaagcccagcaacguggccgugaacgaggacugcgagcugagaauccuggacuucggccuggccagacaggccgacgaggagaugaccggcuacguggccaccagaugguacagagcccccgagaucaugcugaacuggaugcacuacaaccagaccguggacaucuggagcgugggcugcaucauggccgagcugcugcagggcaaggcccuguuccccggcagcgacuacaucgaccagcugaagagaaucauggagguggugggcacccccagccccgaggugcuggccaagaucagcagcgagcacgccagaaccuacauccagagccugccccccaugccccagaaggaccugagcagcaucuucagaggcgccaacccccuggccaucgaccugcugggcagaaugcuggugcuggacagcgaccagagagugagcgccgccgaggcccuggcccacgccuacuucagccaguaccacgaccccgaggacgagcccgaggccgagcccuacgacgagagcguggaggccaaggagagaacccuggaggaguggaaggagcugaccuaccaggaggugcugagcuucaagccccccgagccccccaagccccccggcagccuggagaucgagcaguaa

SEQ ID NO: 19625 - RNA, 1074 nt, Artificial Sequence
  MAPK12__Homo_sapiens__NP_001290181
augagcagccccccccccgccagaagcggcuucuacagacaggaggugaccaagaccgccugggaggugagagccguguacagagaccugcagcccgugggcagcggcgccuacggcgccgugugcagcgccguggacggcagaaccggcgccaagguggccaucaagaagcuguacagacccuuccagagcgagcuguucgccaagagagccuacagagagcugagacugcugaagcacaugagacacgagaacgugaucggccugcuggacguguucacccccgacgagacccuggacgacuucaccgacuucuaccuggugaugcccuucaugggcaccgaccugggcaagcugaugaagcacgagaagcugggcgaggacagaauccaguuccugguguaccagaugcugaagggccugagagaccugaagcccggcaaccuggccgugaacgaggacugcgagcugaagauccuggacuucggccuggccagacaggccgacagcgagaugaccggcuacguggugaccagaugguacagagcccccgaggugauccugaacuggaugagauacacccagaccguggacaucuggagcgugggcugcaucauggccgagaugaucaccggcaagacccuguucaagggcagcgaccaccuggaccagcugaaggagaucaugaaggugaccggcaccccccccgccgaguucgugcagagacugcagagcgacgaggccaagaacuacaugaagggccugcccgagcuggagaagaaggacuucgccagcauccugaccaacgccagcccccuggccgugaaccugcuggagaagaugcuggugcuggacgccgagcagagagugaccgccggcgaggcccuggcccaccccuacuucgagagccugcacgacaccgaggacgagccccaggugcagaaguacgacgacagcuucgacgacguggacagaacccuggacgaguggaagagagugaccuacaaggaggugcugagcuucaagccccccagacagcugggcgccagagugagcaaggagaccccccuguaa

SEQ ID NO: 19626 - RNA, 1098 nt, Artificial Sequence
  MAPK13__Homo_sapiens__NP_002745
augagccugaucagaaagaagggcuucuacaagcaggacgugaacaagaccgccugggagcugcccaagaccuacgugagccccacccacgugggcagcggcgccuacggcagcgugugcagcgccaucgacaagagaagcggcgagaagguggccaucaagaagcugagcagacccuuccagagcgagaucuucgccaagagagccuacagagagcugcugcugcugaagcacaugcagcacgagaacgugaucggccugcuggacguguucacccccgccagcagccugagaaacuucuacgacuucuaccuggugaugcccuucaugcagaccgaccugcagaagaucaugggcauggaguucagcgaggagaagauccaguaccugguguaccagaugcugaagggccugaaguacauccacagcgccggcguggugcacagagaccugaagcccggcaaccuggccgugaacgaggacugcgagcugaagauccuggacuucggccuggccagacacgccgacgccgagaugaccggcuacguggugaccagaugguacagagcccccgaggugauccugagcuggaugcacuacaaccagaccguggacaucuggagcgugggcugcaucauggccgagaugcugaccggcaagacccuguucaagggcaaggacuaccuggaccagcugacccagauccugaaggugaccggcgugcccggcaccgaguucgugcagaagcugaacgacaaggccgccaagagcuacauccagagccugccccagacccccagaaaggacuucacccagcuguuccccagagccagcccccaggccgccgaccugcuggagaagaugcuggagcuggacguggacaagagacugaccgccgcccaggcccugacccaccccuucuucgagcccuucagagaccccgaggaggagaccgaggcccagcagcccuucgacgacagccuggagcacgagaagcugaccguggacgaguggaagcagcacaucuacaaggagaucgugaacuucagccccaucgccagaaaggacagcagaagaagaagcggcaugaagcuguaa

SEQ ID NO: 19627 - RNA, 1083 nt, Artificial Sequence
  MAPK14__Homo_sapiens__NP_001306
augagccaggagagacccaccuucuacagacaggagcugaacaagaccaucugggaggugcccgagagauaccagaaccugagccccgugggcagcggcgccuacggcagcgugugcgccgccuucgacaccaagaccggccugagaguggccgugaagaagcugagcagacccuuccagagcaucauccacgccaagagaaccuacagagagcugagacugcugaagcacaugaagcacgagaacgugaucggccugcuggacguguucacccccgccagaagccuggaggaguucaacgacguguaccuggugacccaccugaugggcgccgaccugaacaacaucgugaagugccagaagcugaccgacgaccacgugcaguuccugaucuaccagauccugagaggccugaaguacauccacagcgccgacaucauccacagagaccugaagcccagcaaccuggccgugaacgaggacugcgagcugaagauccuggacuucggccuggccagacacaccgacgacgagaugaccggcuacguggccaccagaugguacagagcccccgagaucaugcugaacuggaugcacuacaaccagaccguggacaucuggagcgugggcugcaucauggccgagcugcugaccggcagaacccuguuccccggcaccgaccacaucaaccagcugcagcagaucaugagacugaccggcaccccccccgccuaccugaucaacagaaugcccagccacgaggccagaaacuacauccagagccugacccagaugcccaagaugaacuucgccaacguguucaucggcgccaacccccuggccguggaccugcuggagaagaugcuggugcuggacagcgacaagagaaucaccgccgcccaggcccuggcccacgccuacuucgcccaguaccacgaccccgacgacgagcccguggccgaccccuacgaccagagcuucgagagcagagaccugcugaucgacgaguggaagagccugaccuacgacgaggugaucagcuucgugccccccccccuggaccaggaggagauggagagcuaa

SEQ ID NO: 19628 - RNA, 1635 nt, Artificial Sequence
  MAPK15__Homo_sapiens__NP_620590
augugcaccgugguggaccccagaaucgugagaagauaccugcugagaagacagcugggccagggcgccuacggcaucguguggaaggccguggacagaagaaccggcgaggugguggccaucaagaagaucuucgacgccuucagagacaagaccgacgcccagagaaccuucagagagaucacccugcugcaggaguucggcgaccaccccaacaucaucagccugcuggacgugaucagagccgagaacgacagagacaucuaccugguguucgaguucauggacaccgaccugaacgccgugaucagaaagggcggccugcugcaggacgugcacgugagaagcaucuucuaccagcugcugagagccaccagauuccugcacagcggccacguggugcacagagaccagaagcccagcaacgugcugcuggacgccaacugcaccgugaagcugugcgacuucggccuggccagaagccugggcgaccugcccgagggccccgaggaccaggccgugaccgaguacguggccaccagaugguacagagcccccgaggugcugcugagcagccacagauacacccugggcguggacauguggagccugggcugcauccugggcgagaugcugagaggcagaccccuguuccccggcaccagcacccugcaccagcuggagcugauccuggagaccauccccccccccagcgaggaggaccugcuggcccugggcagcggcugcagagccagcgugcugcaccagcugggcagcagacccagacagacccuggacgcccugcugccccccgacaccagccccgaggcccuggaccugcugagaagacugcugguguucgcccccgacaagagacugagcgccacccaggcccugcagcaccccuacgugcagagauuccacugccccagcgacgagugggccagagaggccgacgugagacccagagcccacgagggcgugcagcugagcgugcccgaguacagaagcagaguguaccagaugauccuggagugcggcggcagcagcggcaccagcagagagaagggccccgagggcgugagccccagccaggcccaccugcacaagcccagagccgacccccagcugcccagcagaacccccgugcagggccccagacccagaccccagagcagccccggccacgaccccgccgagcacgagagccccagagccgccaagaacgugcccagacagaacagcgccccccugcugcagaccgcccugcugggcaacggcgagagaccccccggcgccaaggaggcccccccccugacccugagccuggugaagcccagcggcagaggcgccgcccccagccugaccagccaggccgccgcccagguggccaaccaggcccugaucagaggcgacuggaacagaggcggcggcgugagaguggccagcgugcagcaggugccccccagacugccccccgaggccagacccggcagaagaauguucagcaccagcgcccugcagggcgcccagggcggcgccagagcccugcugggcggcuacagccaggccuacggcaccgugugccacagcgcccugggccaccugccccugcuggagggccaccacguguaa

SEQ ID NO: 19629 - RNA, 1083 nt, Artificial Sequence
  MAPK1__Homo_sapiens__NP_620407
auggccgccgccgccgccgccggcgccggccccgagauggugagaggccagguguucgacgugggccccagauacaccaaccugagcuacaucggcgagggcgccuacggcauggugugcagcgccuacgacaacgugaacaaggugagaguggccaucaagaagaucagccccuucgagcaccagaccuacugccagagaacccugagagagaucaagauccugcugagauucagacacgagaacaucaucggcaucaacgacaucaucagagcccccaccaucgagcagaugaaggacguguacaucgugcaggaccugauggagaccgaccuguacaagcugcugaagacccagcaccugagcaacgaccacaucugcuacuuccuguaccagauccugagaggccugaaguacauccacagcgccaacgugcugcacagagaccugaagcccagcaaccugcugcugaacaccaccugcgaccugaagaucugcgacuucggccuggccagaguggccgaccccgaccacgaccacaccggcuuccugaccgaguacguggccaccagaugguacagagcccccgagaucaugcugaacagcaagggcuacaccaagagcaucgacaucuggagcgugggcugcauccuggccgagaugcugagcaacagacccaucuuccccggcaagcacuaccuggaccagcugaaccacauccugggcauccugggcagccccagccaggaggaccugaacugcaucaucaaccugaaggccagaaacuaccugcugagccugccccacaagaacaaggugcccuggaacagacuguuccccaacgccgacagcaaggcccuggaccugcuggacaagaugcugaccuucaacccccacaagagaaucgagguggagcaggcccuggcccaccccuaccuggagcaguacuacgaccccagcgacgagcccaucgccgaggcccccuucaaguucgacauggagcuggacgaccugcccaaggagaagcugaaggagcugaucuucgaggagaccgccagauuccagcccggcuacagaagcuaa

SEQ ID NO: 19630 - RNA, 1074 nt, Artificial Sequence
  MAPK3__Homo_sapiens__NP_001035145
auggccgccgccgccgcccagggcggcggcggcggcgagcccagaagaaccgagggcgugggccccggcgugcccggcgagguggagauggugaagggccagcccuucgacgugggccccagauacacccagcugcaguacaucggcgagggcgccuacggcauggugagcagcgccuacgaccacgugagaaagaccagaguggccaucaagaagaucagccccuucgagcaccagaccuacugccagagaacccugagagagauccagauccugcugagauucagacacgagaacgugaucggcaucagagacauccugagagccagcacccuggaggccaugagagacguguacaucgugcaggaccugauggagaccgaccuguacaagcugcugaagagccagcagcugagcaacgaccacaucugcuacuuccuguaccagauccugagaggccugaaguacauccacagcgccaacgugcugcacagagaccugaagcccagcaaccugcugaucaacaccaccugcgaccugaagaucugcgacuucggccuggccagaaucgccgaccccgagcacgaccacaccggcuuccugaccgaguacguggccaccagaugguacagagcccccgagaucaugcugaacagcaagggcuacaccaagagcaucgacaucuggagcgugggcugcauccuggccgagaugcugagcaacagacccaucuuccccggcaagcacuaccuggaccagcugaaccacauccugggcauccugggcagccccagccaggaggaccugaacugcaucaucaacaugaaggccagaaacuaccugcagagccugcccagcaagaccaagguggccugggccaagcuguuccccaagagcgacagcaaggcccuggaccugcuggacagaaugcugaccuucaaccccaacaagagaaucaccguggaggaggcccuggcccaccccuaccuggagcaguacuacgaccccaccgacgaggugggccagagccccgccgccgugggccugggcgccggcgagcagggcggcaccuaa

SEQ ID NO: 19631 - RNA, 2166 nt, Artificial Sequence
  MAPK6__Homo_sapiens__XP_005254596
auggccgagaaguucgagagccugaugaacauccacggcuucgaccugggcagcagauacauggaccugaagccccugggcugcggcggcaacggccugguguucagcgccguggacaacgacugcgacaagagaguggccaucaagaagaucgugcugaccgacccccagagcgugaagcacgcccugagagagaucaagaucaucagaagacuggaccacgacaacaucgugaagguguucgagauccugggccccagcggcagccagcugaccgacgacgugggcagccugaccgagcugaacagcguguacaucgugcaggaguacauggagaccgaccuggccaacgugcuggagcagggcccccugcuggaggagcacgccagacuguucauguaccagcugcugagaggccugaaguacauccacagcgccaacgugcugcacagagaccugaagcccgccaaccuguucaucaacaccgaggaccuggugcugaagaucggcgacuucggccuggccagaaucauggacccccacuacagccacaagggccaccugagcgagggccuggugaccaagugguacagaagccccagacugcugcugagccccaacaacuacaccaaggccaucgacaugugggccgccggcugcaucuucgccgagaugcugaccggcaagacccuguucgccggcgcccacgagcuggagcagaugcagcugauccuggagagcauccccguggugcacgaggaggacagacaggagcugcugagcgugauccccguguacaucagaaacgacaugaccgagccccacaagccccugacccagcugcugcccggcaucagcagagaggcccuggacuuccuggagcagauccugaccuucagccccauggacagacugaccgccgaggaggcccugagccaccccuacaugagcaucuacagcuuccccauggacgagcccaucagcagccaccccuuccacaucgaggacgagguggacgacauccugcugauggacgagacccacagccacaucuacaacugggagagauaccacgacugccaguucagcgagcacgacuggcccgugcacaacaacuucgacaucgacgaggugcagcuggaccccagagcccugagcgacgugaccgacgaggaggaggugcagguggaccccagaaaguaccuggacggcgacagagagaaguaccuggaggaccccgccuucgacaccaacuacagcaccgagcccugcuggcaguacagcgaccaccacgagaacaaguacugcgaccuggagugcagccacaccugcaacuacaagaccagaagcagcagcuaccuggacaaccugguguggagagagagcgaggugaaccacuacuacgagcccaagcugaucaucgaccugagcaacuggaaggagcagagcaaggagaagagcgacaagaagggcaagagcaagugcgagagaaacggccuggugaaggcccagaucgcccuggaggaggccagccagcagcuggccggcaaggagagagagaagaaccagggcuucgacuucgacagcuucaucgccggcaccauccagcugagcagccagcacgagcccaccgacgugguggacaagcugaacgaccugaacagcagcgugagccagcuggagcugaagagccugaucagcaagagcgugagccaggagaagcaggagaagggcauggccaaccuggcccagcuggaggcccuguaccagagcagcugggacagccaguucgugagcggcggcgaggacugcuucuucaucaaccaguucugcgaggugagaaaggacgagcagguggagaaggagaacaccuacaccagcuaccuggacaaguucuucagcagaaaggaggacaccgagaugcuggagaccgagcccguggaggacggcaagcugggcgagagaggccacgaggagggcuuccugaacaacagcggcgaguuccuguucaacaagcagcuggagagcaucggcaucccccaguuccacagccccgugggcagcccccugaagagcauccaggccacccugacccccagcgccaugaagagcagcccccagaucccccaccagaccuacagcagcauccugaagcaccugaacuaa

SEQ ID NO: 19632 - RNA, 2451 nt, Artificial Sequence
  MAPK7__Homo_sapiens__NP_002740
auggccgagccccugaaggaggaggacggcgaggacggcagcgccgagccccccggccccgugaaggccgagcccgcccacaccgccgccagcguggccgccaagaaccuggcccugcugaaggccagaagcuucgacgugaccuucgacgugggcgacgaguacgagaucaucgagaccaucggcaacggcgccuacggcguggugagcagcgccagaagaagacugaccggccagcagguggccaucaagaagauccccaacgccuucgacguggugaccaacgccaagagaacccugagagagcugaagauccugaagcacuucaagcacgacaacaucaucgccaucaaggacauccugagacccaccgugcccuacggcgaguucaagagcguguacguggugcuggaccugauggagagcgaccugcaccagaucauccacagcagccagccccugacccuggagcacgugagauacuuccuguaccagcugcugagaggccugaaguacaugcacagcgcccaggugauccacagagaccugaagcccagcaaccugcuggugaacgagaacugcgagcugaagaucggcgacuucggcauggccagaggccugugcaccagccccgccgagcaccaguacuucaugaccgaguacguggccaccagaugguacagagcccccgagcugaugcugagccugcacgaguacacccaggccaucgaccuguggagcgugggcugcaucuucggcgagaugcuggccagaagacagcuguuccccggcaagaacuacgugcaccagcugcagcugaucaugauggugcugggcacccccagccccgccgugauccaggccgugggcgccgagagagugagagccuacauccagagccugccccccagacagcccgugcccugggagaccguguaccccggcgccgacagacaggcccugagccugcugggcagaaugcugagauucgagcccagcgccagaaucagcgccgccgccgcccugagacaccccuuccuggccaaguaccacgaccccgacgacgagcccgacugcgccccccccuucgacuucgccuucgacagagaggcccugaccagagagagaaucaaggaggccaucguggccgagaucgaggacuuccacgccagaagagagggcaucagacagcagaucagauuccagcccagccugcagcccguggccagcgagcccggcugccccgacguggagaugcccagccccugggcccccagcggcgacugcgccauggagagccccccccccgcccccccccccugccccggccccgcccccgacaccaucgaccugacccugcagccccccccccccgugagcgagcccgccccccccaagaaggacggcgccaucagcgacaacaccaaggccgcccugaaggccgcccugcugaagagccugagaagcagacugagagacggccccagcgccccccuggaggcccccgagcccagaaagcccgugaccgcccaggagagacagagagagagagaggagaagagaagaagaagacaggagagagccaaggagagagagaagagaagacaggagagagagagaaaggagagaggcgccggcgccagcggcggccccagcaccgacccccuggccggccuggugcugagcgacaacgacagaagccugcuggagagauggaccagaauggccagacccgccgcccccgcccugaccagcgugcccgcccccgcccccgcccccacccccacccccacccccgugcagcccaccagccccccccccggccccguggcccagcccaccggcccccagccccagagcgccggcagcaccagcggccccgugccccagcccgccugccccccccccggccccgccccccaccccaccggcccccccggccccauccccgugcccgcccccccccagaucgccaccagcaccagccugcuggccgcccagagccuggugcccccccccggccugcccggcagcagcacccccggcgugcugcccuacuucccccccggccugcccccccccgacgccggcggcgccccccagagcagcaugagcgagagccccgacgugaaccuggugacccagcagcugagcaagagccagguggaggacccccugccccccguguucagcggcacccccaagggcagcggcgccggcuacggcgugggcuucgaccuggaggaguuccugaaccagagcuucgacaugggcguggccgacggcccccaggacggccaggccgacagcgccagccugagcgccagccugcuggccgacuggcuggagggccacggcaugaaccccgccgacaucgagagccugcagagagagauccagauggacagccccaugcugcuggccgaccugcccgaccugcaggaccccuaa

SEQ ID NO: 19633 - RNA, 927 nt, Artificial Sequence
  MAPK8__Homo_sapiens__NP_001265477
augagcagaagcaagagagacaacaacuucuacagcguggagaucggcgacagcaccuucaccgugcugaagagauaccagaaccugaagcccaucggcagcggcgcccagggcaucgugugcgccgccuacgacgccauccuggagagaaacguggccaucaagaagcugagcagacccuuccagaaccagacccacgccaagagagccuacagagagcuggugcugaugaagugcgugaaccacaagaacaucaucggccugcugaacguguucaccccccagaagagccuggaggaguuccaggacguguacaucgugauggagcugauggacgccaaccugugccaggugauccagauggagcuggaccacgagagaaugagcuaccugcuguaccagaugcugugcggcaucaagcaccugcacagcgccggcaucauccacagagaccugaagcccagcaacaucguggugaagagcgacugcacccugaagauccuggacuucggccuggccagaaccgccggcaccagcuucaugaugacccccuacguggugaccagauacuacagagcccccgaggugauccugggcaugggcuacaaggagaacgccgacagcgagcacaacaagcugaaggccagccaggccagagaccugcugagcaagaugcuggugaucgacgccagcaagagaaucagcguggacgaggcccugcagcaccccuacaucaacgugugguacgaccccagcgaggccgaggcccccccccccaagauccccgacaagcagcuggacgagagagagcacaccaucgaggaguggaaggagcugaucuacaaggaggugauggaccuggaggagagaaccaagaacggcgugaucagaggccagcccagcccccuggcccaggugcagcaguaa

SEQ ID NO: 19634 - RNA, 2136 nt, Artificial Sequence
  MAPK8IP1__Homo_sapiens__NP_005447
auggccgagagagagagcggcggccugggcggcggcgccgccagcccccccgccgccagccccuuccugggccugcacaucgccagcccccccaacuucagacugacccacgacaucagccuggaggaguucgaggacgaggaccugagcgagaucaccgacgagugcggcaucagccugcagugcaaggacacccugagccugagaccccccagagccggccugcugagcgccggcggcggcggcgccggcagcagacugcaggccgagaugcugcagauggaccugaucgacgccaccggcgacacccccggcgccgaggacgacgaggaggacgacgacgaggagagagccgccagaagacccggcgccggcccccccaaggccgagagcggccaggagcccgccagcagaggccagggccagagccagggccagagccagggccccggcagcggcgacaccuacagacccaagagacccaccacccugaaccuguucccccaggugcccagaagccaggacacccugaacaacaacagccugggcaagaagcacagcuggcaggacagagugagcagaagcagcagcccccugaagaccggcgagcagacccccccccacgagcacaucugccugagcgacgagcugcccccccagagcggccccgcccccaccaccgacagaggcaccagcaccgacagccccugcagaagaagcaccgccacccagauggccccccccggcggcccccccgccgccccccccggcggcagaggccacagccacagagacagaauccacuaccaggccgacgugagacuggaggccaccgaggagaucuaccugacccccgugcagagaccccccgacgccgccgagcccaccagcgccuuccugccccccaccgagagcagaaugagcgugagcagcgaccccgaccccgccgccuaccccagcaccgccggcagaccccaccccagcaucagcgaggaggaggagggcuucgacugccugagcagccccgagagagccgagccccccggcggcggcuggagaggcagccugggcgagcccccccccccccccagagccagccugagcagcgacaccagcgcccugagcuacgacagcgugaaguacacccuggugguggacgagcacgcccagcuggagcuggugagccugagacccugcuucggcgacuacagcgacgagagcgacagcgccaccguguacgacaacugcgccagcgugagcagccccuacgagagcgccaucggcgaggaguacgaggaggcccccagaccccagccccccgccugccugagcgaggacagcacccccgacgagcccgacgugcacuucagcaagaaguuccugaacguguucaugagcggcagaagcagaagcagcagcgccgagagcuucggccuguucagcugcaucaucaacggcgaggagcaggagcagacccacagagccaucuucagauucgugcccagacacgaggacgagcuggagcuggagguggacgacccccugcugguggagcugcaggccgaggacuacugguacgaggccuacaacaugagaaccggcgccagaggcguguuccccgccuacuacgccaucgaggugaccaaggagcccgagcacauggccgcccuggccaagaacagcgacuggguggaccaguucagagugaaguuccugggcagcgugcaggugcccuaccacaagggcaacgacgugcugugcgccgccaugcagaagaucgccaccaccagaagacugaccgugcacuucaacccccccagcagcugcgugcuggagaucagcgugagaggcgugaagaucggcgugaaggccgacgacagccaggaggccaagggcaacaagugcagccacuucuuccagcugaagaacaucagcuucugcggcuaccaccccaagaacaacaaguacuucggcuucaucaccaagcaccccgccgaccacagauucgccugccacguguucgugagcgaggacagcaccaaggcccuggccgagagcgugggcagagccuuccagcaguucuacaagcaguucguggaguacaccugccccaccgaggacaucuaccuggaguaa

SEQ ID NO: 19635 - RNA, 2475 nt, Artificial Sequence
  MAPK8IP2__Homo_sapiens__NP_036456
auggccgacagagccgagauguucagccugagcaccuuccacagccugagcccccccggcugcagacccccccaggacaucagccuggaggaguucgacgacgaggaccugagcgagaucaccgacgacugcggccugggccugagcuacgacagcgaccacugcgagaaggacagccugagccugggcagaagcgagcagccccaccccaucugcagcuuccaggacgacuuccaggaguucgagaugaucgacgacaacgaggaggaggacgacgaggacgaggaggaggaggaggaggaggaggagggcgacggcgagggccaggagggcggcgaccccggcagcgaggcccccgcccccggcccccugauccccagccccagcguggaggagccccacaagcacagacccaccacccugagacugaccacccugggcgcccaggacagccugaacaacaacggcggcuucgaccuggugagacccgccagcuggcaggagaccgcccugugcagccccgcccccgaggcccugagagagcugcccggcccccugcccgccaccgacaccggccccggcggcgcccagagccccgugagacccggcugcgacugcgagggcaacagacccgccgagccccccgcccccggcggcaccagccccagcagcgaccccggcaucgaggccgaccugagaagcagaagcagcggcggcagaggcggcagaagaagcagccaggagcugagcagccccggcagcgacagcgaggacgccggcggcgccagacugggcagaaugaucagcagcaucagcgagaccgagcuggagcugagcagcgacggcggcagcagcagcagcggcagaagcagccaccugaccaacagcaucgaggaggccagcagccccgccagcgagcccgagccccccagagagccccccagaagacccgccuuccugcccgugggccccgacgacaccaacagcgaguacgagagcggcagcgagagcgagcccgaccugagcgaggacgccgacagccccuggcugcugagcaaccuggugagcagaaugaucagcgagggcagcagccccaucagaugccccggccagugccugagccccgcccccagaccccccggcgagcccgugagccccgccggcggcgccgcccaggacagccaggaccccgaggccgccgccggccccggcggcguggagcugguggacauggagacccugugcgccccccccccccccgcccccgccgcccccagacccggccccgcccagcccggccccugccuguuccugagcaaccccaccagagacaccaucaccccccugugggccgcccccggcagagccgccagacccggcagagccugcagcgccgccugcagcgaggaggaggacgaggaggacgacgaggaggaggaggacgccgaggacagcgccggcagccccggcggcagaggcaccggccccagcgcccccagagacgccagccugguguacgacgccgugaaguacacccuggugguggacgagcacacccagcuggagcuggugagccugagaagaugcgccggccugggccacgacagcgaggaggacagcggcggcgaggccagcgaggaggaggccggcgccgcccugcugggcggcggccaggugagcggcgacaccagccccgacagccccgaccugaccuucagcaagaaguuccugaacguguucgugaacagcaccagcagaagcagcagcaccgagagcuucggccuguucagcugccuggugaacggcgaggagagagagcagacccacagagccguguucagauucauccccagacaccccgacgagcuggagcuggacguggacgaccccgugcugguggaggccgaggaggacgacuucugguucagaggcuucaacaugagaaccggcgagagaggcguguuccccgccuucuacgcccacgccgugcccggccccgccaaggaccugcugggcagcaagagaagccccugcuggguggagagauucgacgugcaguuccugggcagcguggaggugcccugccaccagggcaacggcauccugugcgccgccaugcagaagaucgccaccgccagaaagcugaccgugcaccugagaccccccgccagcugcgaccuggagaucagccugagaggcgugaagcugagccugagcggcggcggccccgaguuccagagaugcagccacuucuuccagaugaagaacaucagcuucugcggcugccaccccagaaacagcugcuacuucggcuucaucaccaagcacccccugcugagcagauucgccugccacguguucgugagccaggagagcaugagacccguggcccagagcgugggcagagccuuccuggaguacuaccaggagcaccuggccuacgccugccccaccgaggacaucuaccuggaguaa

SEQ ID NO: 19636 - RNA, 3993 nt, Artificial Sequence
  MAPK8IP3__Homo_sapiens__NP_001035529
augauggagauccagauggacgagggcggcggcguggugguguaccaggacgacuacugcagcggcagcgugaugagcgagagagugagcggccuggccggcagcaucuacagagaguucgagagacugauccacugcuacgacgaggagguggugaaggagcugaugccccugguggugaacgugcuggagaaccuggacagcgugcugagcgagaaccaggagcacgagguggagcuggagcugcugagagaggacaacgagcagcugcugacccaguacgagagagagaaggcccugagaagacaggccgaggagaaguucaucgaguucgaggacgcccuggagcaggagaagaaggagcugcagauccagguggagcacuacgaguuccagaccagacagcuggagcugaaggccaagaacuacgccgaccagaucagcagacuggaggagagagagagcgagaugaagaaggaguacaacgcccugcaccagagacacaccgagaugauccagaccuacguggagcacaucgagagaagcaagaugcagcaggugggcggcaacagccagaccgagagcagccugcccggcagaagaaaggagagacccaccagccugaacguguucccccuggccgacggcaccgugagagcccagaucggcggcaagcuggugcccgccggcgaccacuggcaccugagcgaccugggccagcugcagagcagcagcagcuaccagugcccccaggacgagaugagcgagagcggccagagcagcgccgccgccacccccagcaccaccggcaccaagagcaacacccccaccagcagcgugcccagcgccgccgugaccccccugaacgagagccugcagccccugggcgacuacggcgugggcagcaagaacagcaagagagccagagagaagagagacagcagaaacauggaggugcaggugacccaggagaugagaaacgugagcaucggcaugggcagcagcgacgaguggagcgacgugcaggacaucaucgacagcacccccgagcuggacaugugccccgagaccagacuggacagaaccggcagcagccccacccagggcaucgugaacaaggccuucggcaucaacaccgacagccuguaccacgagcugagcaccgccggcagcgaggugaucggcgacguggacgagggcgccgaccugcugggcgaguucagcggcaugggcaaggaggugggcaaccugcugcuggagaacagccagcugcuggagaccaagaacgcccugaacguggugaagaacgaccugaucgccaagguggaccagcugagcggcgagcaggaggugcugagaggcgagcuggaggccgccaagcaggccaaggugaagcuggagaacagaaucaaggagcuggaggaggagcugaagagagugaagagcgaggccaucaucgccagaagagagcccaaggaggaggccgaggacgugagcagcuaccugugcaccgagagcgacaagauccccauggcccagagaagaagauucaccagaguggagauggccagagugcugauggagagaaaccaguacaaggagagacugauggagcugcaggaggccgugagauggaccgagaugaucagagccagcagagagcaccccagcgugcaggagaagaagaagagcaccaucuggcaguucuucagcagacuguucagcagcagcagcagccccccccccgccaagagacccuaccccagcgugaacauccacuacaagagccccaccaccgccggcuucagccagagaagaaaccacgccaugugccccaucagcgccggcagcagaccccuggaguucuuccccgacgacgacugcaccagcagcgccagaagagagcagaagagagagcaguacagacaggugagagagcacgugagaaacgacgacggcagacugcaggccugcggcuggagccugcccgccaaguacaagcagcugagccccaacggcggccaggaggacaccagaaugaagaacgugcccgugcccguguacugcagaccccugguggagaaggaccccaccaugaagcuguggugcgccgccggcgugaaccugagcggcuggagacccaacgaggacgacgccggcaacggcgugaagcccgcccccggcagagacccccugaccugcgacagagagggcgacggcgagcccaagagcgcccacaccagccccgagaagaagaaggccaaggagcugcccgagauggacgccaccagcagcagaguguggauccugaccagcacccugaccaccagcaagguggugaucaucgacgccaaccagcccggcaccgugguggaccaguucaccgugugcaacgcccacgugcugugcaucagcagcauccccgccgccagcgacagcgacuacccccccggcgagauguuccuggacagcgacgugaaccccgaggaccccggcgccgacggcgugcuggccggcaucacccuggugggcugcgccaccagaugcaacgugcccagaagcaacugcagcagcagaggcgacacccccgugcuggacaagggccagggcgagguggccaccaucgccaacggcaaggugaaccccagccagagcaccgaggaggccaccgaggccaccgaggugcccgaccccggccccagcgagcccgagaccgccacccugagacccggcccccugaccgagcacguguucaccgaccccgcccccacccccagcagcggcccccagcccggcagcgagaacggccccgagcccgacagcagcagcaccagacccgagcccgagcccagcggcgaccccaccggcgccggcagcagcgccgcccccaccauguggcugggcgcccagaacggcuggcuguacgugcacagcgccguggccaacuggaagaagugccugcacagcaucaagcugaaggacagcgugcugagccuggugcacgugaagggcagagugcugguggcccuggccgacggcacccuggccaucuuccacagaggcgaggacggccagugggaccugagcaacuaccaccugauggaccugggccacccccaccacagcaucagaugcauggccgugguguacgacagaguguggugcggcuacaagaacaaggugcacgugauccagcccaagaccaugcagaucgagaagagcuucgacgcccaccccagaagagagagccaggugagacagcuggccuggaucggcgacggcgugugggugagcaucagacuggacagcacccugagacuguaccacgcccacacccaccagcaccugcaggacguggacaucgagcccuacgugagcaagaugcugggcaccggcaagcugggcuucagcuucgugagaaucaccgcccugcugguggccggcagcagacugugggugggcaccggcaacggcguggugaucagcaucccccugaccgagaccguggugcugcacagaggccagcugcugggccugagagccaacaagaccagccccaccagcggcgagggcgccagacccggcggcaucauccacguguacggcgacgacagcagcgacagagccgccagcagcuucauccccuacugcagcauggcccaggcccagcugugcuuccacggccacagagacgccgugaaguucuucgugagcgugcccggcaacgugcuggccacccugaacggcagcgugcuggacagccccgccgagggccccggccccgccgcccccgccagcgagguggagggccagaagcugagaaacgugcuggugcugagcggcggcgagggcuacaucgacuucagaaucggcgacggcgaggacgacgagaccgaggagggcgccggcgacaugagccaggugaagcccgugcugagcaaggccgagagaagccacaucaucguguggcaggugagcuacacccccgaguaa

SEQ ID NO: 19637 - RNA, 729 nt, Artificial Sequence
  MAPK9__Homo_sapiens__NP_001128516
augagcgacagcaagugcgacagccaguucuacagcgugcagguggccgacagcaccuucaccgugcugaagagauaccagcagcugaagcccaucggcagcggcgcccagggcaucgugugcgccgccuucgacaccgugcugggcaucaacguggccgugaagaagcugagcagacccuuccagaaccagacccacgccaagagagccuacagagagcuggugcugcugaagugcgugaaccacaagaacaucaucagccugcugaacguguucaccccccagaagacccuggaggaguuccaggacguguaccuggugauggagcugauggacgccaaccugugccaggugauccacauggagcuggaccacgagagaaugagcuaccugcuguaccagaugcugugcggcaucaagcaccugcacagcgccggcaucauccacagagaccugaagcccagcaacaucguggugaagagcgacugcacccugaagauccuggacuucggccuggccagaaccgccugcaccaacuucaugaugacccccuacguggugaccagauacuacagagcccccgaggugauccugggcaugggcuacaaggagaacguggacaucuggagcgugggcugcaucaugggcgagcuggugaagggcugcgugaucuuccagggcaccgacagaauccugcccagagaccugggccccgccaugcugagcuaa

SEQ ID NO: 19638 - RNA, 1569 nt, Artificial Sequence
  MAPKAP1__Homo_sapiens__NP_001006618
auggccuuccuggacaaccccaccaucauccuggcccacaucagacagagccacgugaccagcgacgacaccggcaugugcgagauggugcugaucgaccacgacguggaccuggagaagauccacccccccagcaugcccggcgacagcggcagcgagauccagggcagcaacggcgagacccagggcuacguguacgcccagagcguggacaucaccagcagcugggacuucggcaucagaagaagaagcaacaccgcccagagacuggagagacugagaaaggagagacagaaccagaucaagugcaagaacauccaguggaaggagagaaacagcaagcagagcgcccaggagcugaagagccuguucgagaagaagagccugaaggagaagccccccaucagcggcaagcagagcauccugagcgugagacuggagcagugcccccugcagcugaacaaccccuucaacgaguacagcaaguucgacggcaagggccacgugggcaccaccgccaccaagaagaucgacguguaccugccccugcacagcagccaggacagacugcugcccaugaccguggugaccauggccagcgccagagugcaggaccugaucggccugaucugcuggcaguacaccagcgagggcagagagcccaagcugaacgacaacgugagcgccuacugccugcacaucgccgaggacgacggcgagguggacaccgacuuccccccccuggacagcaacgagcccauccacaaguucggcuucagcacccuggcccugguggagaaguacagcagccccggccugaccagcaaggagagccuguucgugagaaucaacgccgcccacggcuucagccugauccagguggacaacaccaaggugaccaugaaggagauccugcugaaggccgugaagagaagaaagggcagccagaaggugagcggcccccaguacagacuggagaagcagagcgagcccaacguggccguggaccuggacagcacccuggagagccagagcgccugggaguucugccuggugagagagaacagcagcagagccgacggcguguucgaggaggacagccagaucgacaucgccaccgugcaggacaugcugagcagccaccacuacaagagcuucaaggugagcaugauccacagacugagauucaccaccgacgugcagcugggcaucagcggcgacaagguggagaucgaccccgugaccaaccagaaggccagcaccaaguucuggaucaagcagaagcccaucagcaucgacagcgaccugcugugcgccugcgaccuggccgaggagaagagccccagccacgccaucuucaagcugaccuaccugagcaaccacgacuacaagcaccuguacuucgagagcgacgccgccaccgugaacgagaucgugcugaaggugaacuacauccuggagagcagagccagcaccgccagagccgacuacuucgcccagaagcagagaaagcugaacagaagaaccagcuucagcuuccagaaggagaagaagagcggccagcaguaa

SEQ ID NO: 19639 - RNA, 1113 nt, Artificial Sequence
  MAPKAPK2__Homo_sapiens__NP_004750
augcugagcaacagccagggccagagcccccccgugcccuuccccgcccccgccccccccccccagccccccacccccgcccugccccacccccccgcccagcccccccccccccccccccagcaguucccccaguuccacgugaagagcggccugcagaucaagaagaacgccaucaucgacgacuacaaggugaccagccaggugcugggccugggcaucaacggcaaggugcugcagaucuucaacaagagaacccaggagaaguucgcccugaagaugcugcaggacugccccaaggccagaagagagguggagcugcacuggagagccagccagugcccccacaucgugagaaucguggacguguacgagaaccuguacgccggcagaaagugccugcugaucgugauggagugccuggacggcggcgagcuguucagcagaauccaggacagaggcgaccaggccuucaccgagagagaggccagcgagaucaugaagagcaucggcgaggccauccaguaccugcacagcaucaacaucgcccacagagacgugaagcccgagaaccugcuguacaccagcaagagacccaacgccauccugaagcugaccgacuucggcuucgccaaggagaccaccagccacaacagccugaccacccccugcuacacccccuacuacguggcccccgaggugcugggccccgagaaguacgacaagagcugcgacauguggagccugggcgugaucauguacauccugcugugcggcuacccccccuucuacagcaaccacggccuggccaucagccccggcaugaagaccagaaucagaaugggccaguacgaguuccccaaccccgaguggagcgaggugagcgaggaggugaagaugcugaucagaaaccugcugaagaccgagcccacccagagaaugaccaucaccgaguucaugaaccaccccuggaucaugcagagcaccaaggugccccagaccccccugcacaccagcagagugcugaaggaggacaaggagagaugggaggacgugaagggcugccugcacgacaagaacagcgaccaggccaccuggcugaccagacuguaa

SEQ ID NO: 19640 - RNA, 1149 nt, Artificial Sequence
  MAPKAPK3__Homo_sapiens__NP_001230855
auggacggcgagaccgccgaggagcagggcggccccgugcccccccccguggcccccggcggccccggccugggcggcgcccccggcggcagaagagagcccaagaaguacgccgugaccgacgacuaccagcugagcaagcaggugcugggccugggcgugaacggcaaggugcuggagugcuuccacagaagaaccggccagaagugcgcccugaagcugcuguacgacagccccaaggccagacaggagguggaccaccacuggcaggccagcggcggcccccacaucgugugcauccuggacguguacgagaacaugcaccacggcaagagaugccugcugaucaucauggagugcauggagggcggcgagcuguucagcagaauccaggagagaggcgaccaggccuucaccgagagagaggccgccgagaucaugagagacaucggcaccgccauccaguuccugcacagccacaacaucgcccacagagacgugaagcccgagaaccugcuguacaccagcaaggagaaggacgccgugcugaagcugaccgacuucggcuucgccaaggagaccacccagaacgcccugcagacccccugcuacacccccuacuacguggcccccgaggugcugggccccgagaaguacgacaagagcugcgacauguggagccugggcgugaucauguacauccugcugugcggcuucccccccuucuacagcaacaccggccaggccaucagccccggcaugaagagaagaaucagacugggccaguacggcuuccccaaccccgaguggagcgaggugagcgaggacgccaagcagcugaucagacugcugcugaagaccgaccccaccgagagacugaccaucacccaguucaugaaccaccccuggaucaaccagagcaugguggugccccagaccccccugcacaccgccagagugcugcaggaggacaaggaccacugggacgaggugaaggaggagaugaccagcgcccuggccaccaugagaguggacuacgaccaggugaagaucaaggaccugaagaccagcaacaacagacugcugaacaagagaagaaagaagcaggccggcagcagcagcgccagccagggcugcaacaaccaguaa

SEQ ID NO: 19641 - RNA, 4545 nt, Artificial Sequence
  MAPKBP1__Homo_sapiens__NP_001122080
auggccguggagggcagcaccaucaccagcagaaucaagaaccugcugagaagccccagcaucaagcugagaagaagcaaggccggcaacagaagagaggaccugagcagcaaggugacccuggagaaggugcugggcaucaccgugagcggcggcagaggccuggccugcgaccccagaagcggccugguggccuaccccgccggcugcgugguggugcuguucaaccccagaaagcacaagcagcaccacauccugaacagcagcagaaagaccaucaccgcccuggccuucagccccgacggcaaguaccuggugaccggcgagagcggccacaugcccgccgugagagugugggacguggccgagcacagccagguggccgagcugcaggagcacaaguacggcguggccugcguggccuucagccccagcgccaaguacaucgugagcgugggcuaccagcacgacaugaucgugaacgugugggccuggaagaagaacaucgugguggccagcaacaaggugagcagcagagugaccgccgugagcuucagcgaggacugcagcuacuucgugaccgccggcaacagacacaucaaguucugguaccuggacgacagcaagaccagcaaggugaacgccaccgugccccugcugggcagaagcggccugcugggcgagcugagaaacaaccuguucaccgacguggccugcggcagaggcaagaaggccgacagcaccuucugcaucaccagcagcggccugcugugcgaguucagcgacagaagacugcuggacaaguggguggagcugagaaacaucgacagcuucaccaccaccguggcccacugcaucagcgugagccaggacuacaucuucugcggcugcgccgacggcaccgugagacuguucaaccccagcaaccugcacuuccugagcacccugcccagaccccacgcccugggcaccgacaucgccagcgugaccgaggccagcagacuguucagcggcguggccaacgccagauaccccgacaccaucgcccugaccuucgaccccaccaaccaguggcugagcugcguguacaacgaccacagcaucuacgugugggacgugagagaccccaagaaggugggcaagguguacagcgcccuguaccacagcagcugcguguggagcguggagguguaccccgaggugaaggacagcaaccaggccugccugccccccagcagcuucaucaccugcagcagcgacaacaccaucagacuguggaacaccgagagcagcggcgugcacggcagcacccugcacagaaacauccugagcagcgaccugaucaagaucaucuacguggacggcaacacccaggcccugcuggacaccgagcugcccggcggcgacaaggccgacgccagccugcuggaccccagagugggcaucagaagcgugugcgugagccccaacggccagcaccuggccagcggcgacagaaugggcacccugagagugcacgagcugcagagccugagcgagaugcugaagguggaggcccacgacagcgagauccugugccuggaguacagcaagcccgacaccggccugaagcugcuggccagcgccagcagagacagacugauccacgugcuggacgccggcagagaguacagccugcagcagacccuggacgagcacagcagcagcaucaccgccgugaaguucgccgccagcgacggccaggugagaaugaucagcugcggcgccgacaagagcaucuacuucagaaccgcccagaagagcggcgacggcgugcaguucaccagaacccaccacguggugagaaagaccacccuguacgacauggacguggagcccagcuggaaguacaccgccaucggcugccaggacagaaacaucagaaucuucaacaucagcagcggcaagcagaagaagcuguucaagggcagccagggcgaggacggcacccugaucaaggugcagaccgaccccagcggcaucuacaucgccaccagcugcagcgacaagaaccugagcaucuucgacuucagcagcggcgagugcguggccaccauguucggccacagcgagaucgugaccggcaugaaguucagcaacgacugcaagcaccugaucagcgugagcggcgacagcugcaucuucguguggagacugagcagcgagaugaccaucagcaugagacagagacuggccgagcugagacagagacagagaggcggcaagcagcagggccccagcagcccccagagagccagcggccccaacagacaccaggcccccagcaugcugagccccggccccgcccugagcagcgacagcgacaaggagggcgaggacgagggcaccgaggaggagcugcccgcccugcccgugcuggccaagagcaccaagaaggcccuggccagcgugcccagccccgcccugcccagaagccugagccacugggagaugagcagagcccaggagagcgugggcuuccuggaccccgcccccgccgccaaccccggccccagaagaagaggcagaugggugcagcccggcguggagcugagcgugagaagcaugcuggaccugagacagcuggagacccuggcccccagccugcaggaccccagccaggacagccuggccaucauccccagcggccccagaaagcacggccaggaggcccuggagaccagccugaccagccagaacgagaagccccccagaccccaggccagccagcccugcagcuacccccacaucaucagacugcugagccaggaggagggcguguucgcccaggaccuggagcccgcccccaucgaggacggcaucguguaccccgagcccagcgacaaccccaccauggacaccagcgaguuccaggugcaggcccccgccagaggcacccugggcagaguguaccccggcagcagaagcagcgagaagcacagccccgacagcgccugcagcguggacuacagcagcagcugccugagcagccccgagcaccccaccgaggacagcgagagcaccgagccccugagcguggacggcaucagcagcgaccuggaggagcccgccgagggcgacgaggaggaggaggaggaggagggcggcaugggccccuacggccugcaggagggcagcccccagacccccgaccaggagcaguuccugaagcagcacuucgagacccuggccagcggcgccgcccccggcgcccccgugcaggugcccgagagaagcgagagcagaagcaucagcagcagauuccugcugcaggugcagaccagaccccugagagagcccagccccagcagcagcagccuggcccugaugagcagacccgcccaggugccccaggccagcggcgagcagcccagaggcaacggcgccaacccccccggcgccccccccgagguggagcccagcagcggcaaccccagcccccagcaggccgccagcgugcugcugcccagaugcagacugaaccccgacagcagcugggcccccaagagaguggccaccgccagccccuucagcggccugcagaaggcccagagcgugcacagccuggugccccaggagagacacgaggccagccugcaggcccccagccccggcgcccugcugagcagagagaucgaggcccaggacggccugggcagccugccccccgccgacggcagacccagcagaccccacagcuaccagaaccccaccaccagcagcauggccaagaucagcagaagcaucagcgugggcgagaaccugggccugguggccgagccccaggcccacgcccccaucagagugagcccccugagcaagcuggcccugcccagcagagcccaccuggugcuggacauccccaagccccugcccgacagacccacccuggccgccuucagccccgugaccaagggcagagcccccggcgaggccgagaagcccggcuuccccgugggccugggcaaggcccacagcaccaccgagagaugggccugccugggcgagggcaccacccccaagcccagaaccgagugccaggcccaccccggccccagcagccccugcgcccagcagcugcccgugagcagccuguuccagggccccgagaaccugcagccccccccccccgagaagacccccaaccccauggagugcaccaagcccggcgccgcccugagccaggacagcgagcccgccgugagccuggagcagugcgagcagcugguggccgagcugagaggcagcgugagacaggccgugagacuguaccacagcguggccggcugcaagaugcccagcgccgagcagagcagaaucgcccagcugcugagagacaccuucagcagcgugagacaggagcuggaggccguggccggcgccgugcugagcagccccggcagcagccccggcgccgugggcgccgagcagacccaggcccugcuggagcaguacagcgagcugcugcugagagccguggagagaagaauggagagaaagcuguaa

SEQ ID NO: 19642 - RNA, 807 nt, Artificial Sequence
  MAPRE1__Homo_sapiens__NP_036457
auggccgugaacguguacagcaccagcgugaccagcgacaaccugagcagacacgacaugcuggccuggaucaacgagagccugcagcugaaccugaccaagaucgagcagcugugcagcggcgccgccuacugccaguucauggacaugcuguuccccggcagcaucgcccugaagaaggugaaguuccaggccaagcuggagcacgaguacauccagaacuucaagauccugcaggccggcuucaagagaaugggcguggacaagaucauccccguggacaagcuggugaagggcaaguuccaggacaacuucgaguucgugcagugguucaagaaguucuucgacgccaacuacgacggcaaggacuacgaccccguggccgccagacagggccaggagaccgccguggcccccagccugguggcccccgcccugaacaagcccaagaagccccugaccagcagcagcgccgccccccagagacccaucagcacccagagaaccgccgccgcccccaaggccggccccggcguggugagaaagaaccccggcgugggcaacggcgacgacgaggccgccgagcugaugcagcaggugaacgugcugaagcugaccguggaggaccuggagaaggagagagacuucuacuucggcaagcugagaaacaucgagcugaucugccaggagaacgagggcgagaacgaccccgugcugcagagaaucguggacauccuguacgccaccgacgagggcuucgugauccccgacgagggcggcccccaggaggagcaggaggaguacuaa

SEQ ID NO: 19643 - RNA, 855 nt, Artificial Sequence
  MAPRE2__Homo_sapiens__NP_001137298
auggccgugaacguguacagcaccagcaucacccaggagaccaugagcagacacgacaucaucgccugggugaacgacaucgugagccugaacuacaccaagguggagcagcugugcagcggcgccgccuacugccaguucauggacaugcuguuccccggcugcaucagccugaagaaggugaaguuccaggccaagcuggagcacgaguacauccacaacuucaagcugcugcaggccagcuucaagagaaugaacguggacaaggugauccccguggagaagcuggugaagggcagauuccaggacaaccuggacuucauccagugguucaagaaguucuacgacgccaacuacgacggcaaggaguacgaccccguggaggccagacagggccaggacgccauccccccccccgaccccggcgagcagaucuucaaccugcccaagaagagccaccacgccaacagccccaccgccggcgccgccaagagcagccccgccgccaagcccggcagcacccccagcagacccagcagcgccaagagagccagcagcagcggcagcgccagcaagagcgacaaggaccuggagacccaggugauccagcugaacgagcaggugcacagccugaagcuggcccuggagggcguggagaaggagagagacuucuacuucggcaagcugagagagaucgagcugcugugccaggagcacggccaggagaacgacgaccuggugcagagacugauggacauccuguacgccagcgaggagcacgagggccacaccgaggagcccgaggccgaggagcaggcccacgagcagcagcccccccagcaggaggaguacuaa

SEQ ID NO: 19644 - RNA, 846 nt, Artificial Sequence
  MAPRE3__Homo_sapiens__NP_001289979
auggccgugaacguguacagcaccagcgugaccagcgagaaccugagcagacacgacaugcuggccugggugaacgacagccugcaccugaacuacaccaagaucgagcagcugugcagcggcgccgccuacugccaguucauggacaugcuguuccccggcugcgugcaccugagaaaggugaaguuccaggccaagcuggagcacgaguacauccacaacuucaaggugcugcaggccgccuucaagaagaugggcguggacaagaucauccccguggagaagcuggugaagggcaaguuccaggacaacuucgaguucauccagugguucaagaaguucuucgacgccaacuacgacggcaaggacuacaacccccugcuggccagacagggccaggacguggcccccccccccaaccccggcgaccagaucuucaacaagagcaagaagcugaucggcaccgccgugccccagagaaccagccccaccggccccaagaacaugcagaccagcggcagacugagcaacguggccccccccugcauccugagaaagaacccccccagcgccagaaacggcggccacgagaccgacgcccagauccuggagcugaaccagcagcugguggaccugaagcugaccguggacggccuggagaaggagagagacuucuacuucagcaagcugagagacaucgagcugaucugccaggagcacgagagcgagaacagccccgugaucagcggcaucaucggcauccuguacgccaccgaggagggcuucgccccccccgaggacgacgagaucgaggagcaccagcaggaggaccaggacgaguacuaa

SEQ ID NO: 19645 - RNA, 2331 nt, Artificial Sequence
  MAPT__Homo_sapiens__NP_001116538
auggccgagcccagacaggaguucgaggugauggaggaccacgccggcaccuacggccugggcgacagaaaggaccagggcggcuacaccaugcaccaggaccaggagggcgacaccgacgccggccugaaggagagcccccugcagacccccaccgaggacggcagcgaggagcccggcagcgagaccagcgacgccaagagcacccccaccgccgaggacgugaccgccccccugguggacgagggcgcccccggcaagcaggccgccgcccagccccacaccgagauccccgagggcaccaccgccgaggaggccggcaucggcgacacccccagccuggaggacgaggccgccggccacgugacccaggagcccgagagcggcaagguggugcaggagggcuuccugagagagcccggcccccccggccugagccaccagcugaugagcggcaugcccggcgccccccugcugcccgagggccccagagaggccaccagacagcccagcggcaccggccccgaggacaccgagggcggcagacacgcccccgagcugcugaagcaccagcugcugggcgaccugcaccaggagggccccccccugaagggcgccggcggcaaggagagacccggcagcaaggaggagguggacgaggacagagacguggacgagagcagcccccaggacagcccccccagcaaggccagccccgcccaggacggcagacccccccagaccgccgccagagaggccaccagcauccccggcuuccccgccgagggcgccaucccccugcccguggacuuccugagcaaggugagcaccgagauccccgccagcgagcccgacggccccagcgugggcagagccaagggccaggacgccccccuggaguucaccuuccacguggagaucacccccaacgugcagaaggagcaggcccacagcgaggagcaccugggcagagccgccuuccccggcgcccccggcgagggccccgaggccagaggccccagccugggcgaggacaccaaggaggccgaccugcccgagcccagcgagaagcagcccgccgccgcccccagaggcaagcccgugagcagagugccccagcugaaggccagaauggugagcaagagcaaggacggcaccggcagcgacgacaagaaggccaagaccagcaccagaagcagcgccaagacccugaagaacagacccugccugagccccaagcaccccacccccggcagcagcgacccccugauccagcccagcagccccgccgugugccccgagccccccagcagccccaaguacgugagcagcgugaccagcagaaccggcagcagcggcgccaaggagaugaagcugaagggcgccgacggcaagaccaagaucgccacccccagaggcgccgccccccccggccagaagggccaggccaacgccaccagaauccccgccaagaccccccccgcccccaagaccccccccagcagcgccaccaagcaggugcagagaagacccccccccgccggccccagaagcgagagaggcgagccccccaagagcggcgacagaagcggcuacagcagccccggcagccccggcacccccggcagcagaagcagaacccccagccugcccaccccccccaccagagagcccaagaagguggccguggugagaaccccccccaagagccccagcagcgccaagagcagacugcagaccgcccccgugcccaugcccgaccugaagaacgugaagagcaagaucggcagcaccgagaaccugaagcaccagcccggcggcggcaaggugcagaucaucaacaagaagcuggaccugagcaacgugcagagcaagugcggcagcaaggacaacaucaagcacgugcccggcggcggcagcgugcagaucguguacaagcccguggaccugagcaaggugaccagcaagugcggcagccugggcaacauccaccacaagcccggcggcggccagguggaggugaagagcgagaagcuggacuucaaggacagagugcagagcaagaucggcagccuggacaacaucacccacgugcccggcggcggcaacaagaagaucgagacccacaagcugaccuucagagagaacgccaaggccaagaccgaccacggcgccgagaucguguacaagagccccguggugagcggcgacaccagccccagacaccugagcaacgugagcagcaccggcagcaucgacaugguggacagcccccagcuggccacccuggccgacgaggugagcgccagccuggccaagcagggccuguaa

SEQ ID NO: 19646 - RNA, 1014 nt, Artificial Sequence
  MARC1__Homo_sapiens__NP_073583
augggcgccgccggcagcagcgcccuggccagauucgugcugcuggcccagagcagacccggcuggcugggcguggccgcccugggccugaccgccguggcccugggcgccguggccuggagaagagccuggcccaccagaagaagaagacugcugcagcaggugggcaccguggcccagcuguggaucuaccccgugaagagcugcaagggcgugcccgugagcgaggccgagugcaccgccaugggccugagaagcggcaaccugagagacagauucuggcuggugaucaaccaggagggcaacauggugaccgccagacaggagcccagacuggugcugaucagccugaccugcgacggcgacacccugacccugagcgccgccuacaccaaggaccugcugcugcccaucaagacccccaccaccaacgccgugcacaagugcagagugcacggccuggagaucgagggcagagacugcggcgaggccaccgcccaguggaucaccagcuuccugaagagccagcccuacagacuggugcacuucgagccccacaugagacccagaagaccccaccagaucgccgaccuguucagacccaaggaccagaucgccuacagcgacaccagccccuuccugauccugagcgaggccagccuggccgaccugaacagcagacuggagaagaaggugaaggccaccaacuucagacccaacaucgugaucagcggcugcgacguguacgccgaggacagcugggacgagcugcugaucggcgacguggagcugaagagagugauggccugcagcagaugcauccugaccaccguggaccccgacaccggcgugaugagcagaaaggagccccuggagacccugaagagcuacagacagugcgaccccagcgagagaaagcuguacggcaagagcccccuguucggccaguacuucgugcuggagaaccccggcaccaucaaggugggcgaccccguguaccugcugggccaguaa

SEQ ID NO: 19647 - RNA, 738 nt, Artificial Sequence
  MARC2__Homo_sapiens__XP_011507986
auguucuggcuggugaucaaggaggacggccacauggugaccgccagacaggagcccagacuggugcugaucagcaucaucuacgagaacaacugccugaucuucagagcccccgacauggaccagcuggugcugcccagcaagcagcccagcagcaacaagcugcacaacugcagaaucuucggccuggacaucaagggcagagacugcggcaacgaggccgccaagugguucaccaacuuccugaagaccgaggccuacagacuggugcaguucgagaccaacaugaagggcagaaccagcagaaagcugcugcccacccuggaccagaacuuccagguggccuaccccgacuacugcccccugcugaucaugaccgacgccagccugguggaccugaacaccagaauggagaagaagaugaagauggagaacuucagacccaacaucguggugaccggcugcgacgccuucgaggaggacaccugggacgagcugcugaucggcagcguggaggugaagaaggugauggccugccccagaugcauccugaccaccguggaccccgacaccggcgugaucgacagaaagcagccccuggacacccugaagagcuacagacugugcgaccccagcgagagagagcuguacaagcugagcccccuguucggcaucuacuacagcguggagaagaucggcagccugagagugggcgaccccguguacagaaugguguaa

SEQ ID NO: 19648 - RNA, 870 nt, Artificial Sequence
  MARCH1__Homo_sapiens__NP_001159845
augcugggcuggugcgaggccaucgccagaaacccccacagaauccccaacaacaccagaacccccgagaucagcggcgaccuggccgacgccagccagaccagcacccugaacgagaagagccccggcagaagcgccagcagaagcagcaacaucagcaaggccagcagccccaccaccggcaccgcccccagaagccagagcagacugagcgugugccccagcacccaggacaucugcagaaucugccacugcgagggcgacgaggagagcccccugaucacccccugcagaugcaccggcacccugagauucgugcaccagagcugccugcaccaguggaucaagagcagcgacaccagaugcugcgagcugugcaaguacgacuucaucauggagaccaagcugaagccccugagaaagugggagaagcugcagaugaccaccagcgagagaagaaagaucuucugcagcgugaccuuccacgugaucgccaucaccugcgugguguggagccuguacgugcugaucgacagaaccgccgaggagaucaagcagggcaacgacaacggcgugcuggaguggcccuucuggaccaagcugguggugguggccaucggcuucaccggcggccugguguucauguacgugcagugcaagguguacgugcagcuguggagaagacugaaggccuacaacagagugaucuucgugcagaacugccccgacaccgccaagaagcuggagaagaacuucagcugcaacgugaacaccgacaucaaggacgccgugguggugcccgugccccagaccggcgccaacagccugcccagcgccgagggcggcccccccgagguggugagcguguaa

SEQ ID NO: 19649 - RNA, 741 nt, Artificial Sequence
  MARCH2__Homo_sapiens__NP_001005415
augaccaccggcgacugcugccaccugcccggcagccugugcgacugcagcggcagccccgccuucagcaaggugguggaggccaccggccugggccccccccaguacguggcccaggugaccagcagagacggcagacugcugagcaccgugaucagagcccuggacacccccagcgacggccccuucugcagaaucugccacgagggcgccaacggcgagugccugcugagccccugcggcugcaccggcacccugggcgccgugcacaagagcugccuggagaaguggcugagcagcagcaacaccagcuacugcgagcugugccacaccgaguucgccguggagaagagacccagaccccugaccgaguggcugaaggaccccggccccagaaccgagaagagaacccugugcugcgacauggugugcuuccuguucaucaccccccuggccgccaucagcggcuggcugugccugagaggcgcccaggaccaccugagacugcacagccagcuggaggccgugggccugaucgcccugaccaucgcccuguucaccaucuacgugcuguggacccuggugagcuucagauaccacugccagcuguacagcgaguggagaaagaccaaccagaaggugagacugaagaucagagaggccgacagccccgagggcccccagcacagcccccuggccgccggccugcugaagaagguggccgaggagacccccguguaa

SEQ ID NO: 19650 - RNA, 837 nt, Artificial Sequence
  MARCH5__Homo_sapiens__NP_060294
augcccgaccaggcccugcagcagaugcuggacagaagcugcugggugugcuucgccaccgacgaggacgacagaaccgccgagugggugagacccugcagaugcagaggcagcaccaagugggugcaccaggccugccugcagagauggguggacgagaagcagagaggcaacagcaccgccagaguggccugcccccagugcaacgccgaguaccugaucguguuccccaagcugggccccgugguguacgugcuggaccuggccgacagacugaucagcaaggccugccccuucgccgccgccggcaucauggugggcagcaucuacuggaccgccgugaccuacggcgccgugaccgugaugcagguggugggccacaaggagggccuggacgugauggagagagccgacccccuguuccugcugaucggccugcccaccauccccgugaugcugauccugggcaagaugaucagaugggaggacuacgugcugagacuguggagaaaguacagcaacaagcugcagauccugaacagcaucuuccccggcaucggcugccccgugcccagaauccccgccgaggccaacccccuggccgaccacgugagcgccaccagaauccugugcggcgcccugguguuccccaccaucgccaccaucgugggcaagcugauguucagcagcgugaacagcaaccugcagagaaccauccugggcggcaucgccuucguggccaucaagggcgccuucaagguguacuucaagcagcagcaguaccugagacaggcccacagaaagauccugaacuaccccgagcaggaggaggccuaa

SEQ ID NO: 19651 - RNA, 2733 nt, Artificial Sequence
  MARCH6__Homo_sapiens__NP_005876
auggacaccgccgaggaggacaucugcagagugugcagaagcgagggcacccccgagaagccccuguaccaccccugcgugugcaccggcagcaucaaguucauccaccaggagugccuggugcaguggcugaagcacagcagaaaggaguacugcgagcugugcaagcacagauucgccuucacccccaucuacagccccgacaugcccagcagacugcccauccaggacaucuucgccggccuggugaccagcaucggcaccgccaucagauacugguuccacuacacccugguggccuucgccuggcugggcguggugccccugaccgccugcagaaucuacaagugccuguucaccggcagcgugagcagccugcugacccugccccuggacaugcugagcaccgagaaccugcuggccgacugccugcagggcugcuucguggugaccugcacccugugcgccuucaucagccugguguggcugagagagcagaucgugcacggcggcgcccccaucuggcuggagcacgccgccccccccuucaacgccgccggccaccaccagaacgaggcccccgccggcggcaacggcgccgagaacguggccgccgaccagcccgccaacccccccgccgagaacgccguggugggcgagaaccccgacgcccaggacgaccaggccgaggaggaggaggaggacaacgaggaggaggacgacgccggcguggaggacgccgccgacgccaacaacggcgcccaggacgacaugaacuggaacgcccuggagugggacagagccgccgaggagcugaccugggagagaaugcugggccuggacggcagccugguguuccuggagcacguguucuggguggugagccugaacacccuguucauccugguguucgccuucugccccuaccacaucggccacuucagccuggugggccugggcuucgaggagcacgugcaggccagccacuucgagggccugaucaccaccaucgugggcuacauccugcuggccaucacccugaucaucugccacggccuggccacccuggugaaguuccacagaagcagaagacugcugggcgugugcuacaucguggugaaggugagccugcugguggugguggagaucggcguguucccccugaucugcggcugguggcuggacaucugcagccuggagauguucgacgccacccugaaggacagagagcugagcuuccagagcgcccccggcaccaccauguuccugcacuggcuggugggcaugguguacguguucuacuucgccagcuucauccugcugcugagagaggugcugagacccggcgugcugugguuccugagaaaccugaacgaccccgacuucaaccccgugcaggagaugauccaccugcccaucuacagacaccugagaagauucauccugagcgugaucguguucggcagcaucgugcugcugaugcuguggcugcccaucagaaucaucaagagcgugcugcccaacuuccugcccuacaacgugaugcuguacagcgacgcccccgugagcgagcugagccuggagcugcugcugcugcagguggugcugcccgcccugcuggagcagggccacaccagacaguggcugaagggccuggugagagccuggaccgugaccgccggcuaccugcuggaccugcacagcuaccugcugggcgaccaggaggagaacgagaacagcgccaaccagcaggugaacaacaaccagcacgccagaaacaacaacgccauccccguggugggcgagggccugcacgccgcccaccaggccauccugcagcagggcggccccgugggcuuccagcccuacagaagaccccugaacuucccccugagaaucuuccugcugaucguguucaugugcaucacccugcugaucgccagccugaucugccugacccugcccguguucgccggcagauggcugaugagcuucuggaccggcaccgccaagauccacgagcuguacaccgccgccugcggccuguacgugugcuggcugaccaucagagccgugaccgugaugguggccuggaugccccagggcagaagagugaucuuccagaaggugaaggaguggagccugaugaucaugaagacccugaucguggccgugcugcuggccggcguggugccccugcugcugggccugcuguucgagcuggugaucguggccccccugagagugccccuggaccagaccccccuguucuaccccuggcaggacugggcccugggcgugcugcacgccaagaucaucgccgccaucacccugaugggcccccagugguggcugaagaccgugaucgagcagguguacgccaacggcaucagaaacaucgaccugcacuacaucgugagaaagcuggccgcccccgugaucagcgugcugcugcugagccugugcgugcccuacgugaucgccagcggcguggugccccugcugggcgugaccgccgagaugcagaaccuggugcacagaagaaucuaccccuuccugcugauggugguggugcugauggccauccugagcuuccaggugagacaguucaagagacuguacgagcacaucaagaacgacaaguaccuggugggccagagacuggugaacuacgagagaaagagcggcaagcagggcagcagccccccccccccccagagcagccaggaguaa

SEQ ID NO: 19652 - RNA, 1908 nt, Artificial Sequence
  MARCH7__Homo_sapiens__NP_001269735
auggagagcaagcccagcagaauccccagaagaaucagcgugcagcccagcagcagccugagcgccagaaugaugagcggcagcagaggcagcagccugaacgacaccuaccacagcagagacagcagcuucagacuggacagcgaguaccagagcaccagcgccagcgccagcgccagccccuuccagagcgccugguacagcgagagcgagaucacccagggcgccagaagcagaagccagaaccagcagagagaccacgacagcaagagacccaagcugagcugcaccaacugcaccaccagcgccggcagaaacgugggcaacggccugaacacccugagcgacgugcaggacagagugcccagcuacagccagggcgccagacccaaggagaacagcaugagcacccugcagcugaacaccagcagcaccaaccaccagcugcccagcgagcaccagaccauccugagcagcagagacagcagaaacagccugagaagcaacuucagcagcagagagagcgagagcagcagaagcaacacccagcccggcuucagcuacagcagcagcagagacgaggcccccaucaucagcaacagcgagagaguggugagcagccagagacccuuccaggagagcagcgacaacgagggcagaagaaccaccagaagacugcugagcagaaucgccagcagcaugagcagcaccuucuucagcagaagaagcagccaggacagccugaacaccagaagccugaacagcgagaacagcuacgugagccccagaauccugaccgccagccagagcagaagcaacgugcccagcgccagcgaggugcccgacaacagagccagcgaggccagccagggcuucagauuccugagaagaagauggggccugagcagccugagccacaaccacagcagcgagagcgacagcgagaacuucaaccaggagagcgagggcagaaacaccggccccuggcugagcagcagccugagaaacagaugcaccccccuguucagcagaagaagaagagagggcagagacgagagcagcagaauccccaccagcgacaccagcagcagaagccacaucuucagaagagagagcaacgagguggugcaccuggaggcccagaacgacccccugggcgccgccgccaacagaccccaggccagcgccgccagcagcagcgccaccaccggcggcagcaccagcgacagcgcccagggcggcagaaacaccggcaucagcggcauccugcccggcagccuguucagauucgccgugccccccgcccugggcagcaaccugaccgacaacgugaugaucaccguggacaucauccccagcggcuggaacagcgccgacggcaagagcgacaagaccaagagcgcccccagcagagaccccgagagacugcagaagaucaaggagagccugcugcuggaggacagcgaggaggaggagggcgaccugugcagaaucugccagauggccgccgccagcagcagcaaccugcugaucgagcccugcaagugcaccggcagccugcaguacgugcaccaggacugcaugaagaaguggcugcaggccaagaucaacagcggcagcagccuggaggccgugaccaccugcgagcugugcaaggagaagcuggagcugaaccuggaggacuucgacauccacgagcugcacagagcccacgccaacgagcaggccgaguacgaguucaucagcagcggccuguaccugguggugcugcugcaccugugcgagcagagcuucagcgacaugaugggcaacaccaacgagcccagcaccagagugagacugcagagaaugauccccaagaagaccgagaccaucaccggccaccugauccugcccaacuucaucuaa

SEQ ID NO: 19653 - RNA, 876 nt, Artificial Sequence
  MARCH8__Homo_sapiens__NP_001002266
augagcaugccccugcaccagaucagcgccauccccagccaggacgccaucagcgccagaguguacagaagcaagaccaaggagaaggagagagaggagcagaacgagaagacccugggccacuucaugagccacagcagcaacaucagcaaggccggcagcccccccagcgccagcgcccccgcccccgugagcagcuucagcagaaccagcaucacccccagcagccaggacaucugcagaaucugccacugcgagggcgacgacgagagcccccugaucacccccugccacugcaccggcagccugcacuucgugcaccaggccugccugcagcaguggaucaagagcagcgacaccagaugcugcgagcugugcaaguacgaguucaucauggagaccaagcugaagccccugagaaagugggagaagcugcagaugaccagcagcgagagaagaaagaucaugugcagcgugaccuuccacgugaucgccaucaccugcgugguguggagccuguacgugcugaucgacagaaccgccgaggagaucaagcagggccaggccaccggcauccuggaguggcccuucuggaccaagcugguggugguggccaucggcuucaccggcggccugcuguucauguacgugcagugcaagguguacgugcagcuguggaagagacugaaggccuacaacagagugaucuacgugcagaacugccccgagaccagcaagaagaacaucuucgagaagagcccccugaccgagcccaacuucgagaacaagcacggcuacggcaucugccacagcgacaccaacagcagcugcugcaccgagcccgaggacaccggcgccgagaucauccacguguaa

SEQ ID NO: 19654 - RNA, 999 nt, Artificial Sequence
  MARCKS__Homo_sapiens__NP_002347
augggcgcccaguucagcaagaccgccgccaagggcgaggccgccgccgagagacccggcgaggccgccguggccagcagccccagcaaggccaacggccaggagaacggccacgugaaggugaacggcgacgccagccccgccgccgccgagagcggcgccaaggaggagcugcaggccaacggcagcgcccccgccgccgacaaggaggagcccgccgccgccggcagcggcgccgccagccccagcgccgccgagaagggcgagcccgccgccgccgccgcccccgaggccggcgccagccccguggagaaggaggcccccgccgagggcgaggccgccgagcccggcagccccaccgccgccgagggcgaggccgccagcgccgccagcagcaccagcagccccaaggccgaggacggcgccacccccagccccagcaacgagacccccaagaagaagaagaagagauucagcuucaagaagagcuucaagcugagcggcuucagcuucaagaagaacaagaaggaggccggcgagggcggcgaggccgaggcccccgccgccgagggcggcaaggacgaggccgccggcggcgccgccgccgccgccgccgaggccggcgccgccagcggcgagcaggccgccgcccccggcgaggaggccgccgccggcgaggagggcgccgccggcggcgacccccaggaggccaagccccaggaggccgccguggcccccgagaagccccccgccagcgacgagaccaaggccgccgaggagcccagcaagguggaggagaagaaggccgaggaggccggcgccagcgccgccgccugcgaggcccccagcgccgccggccccggcgccccccccgagcaggaggccgcccccgccgaggagcccgccgccgccgccgccagcagcgccugcgccgcccccagccaggaggcccagcccgagugcagccccgaggccccccccgccgaggccgccgaguaa

SEQ ID NO: 19655 - RNA, 1563 nt, Artificial Sequence
  MARCO__Homo_sapiens__NP_006761
augagaaacaagaagauccugaaggaggacgagcugcugagcgagacccagcaggccgccuuccaccagaucgccauggagcccuucgagaucaacgugcccaagcccaagagaagaaacggcgugaacuucagccuggccgugguggugaucuaccugauccugcugaccgccggcgccggccugcugguggugcaggugcugaaccugcaggccagacugagagugcuggagauguacuuccugaacgacacccuggccgccgaggacagccccagcuucagccugcugcagagcgcccaccccggcgagcaccuggcccagggcgccagcagacugcaggugcugcaggcccagcugaccugggugagagugagccacgagcaccugcugcagagaguggacaacuucacccagaaccccggcauguucagaaucaagggcgagcagggcgcccccggccugcagggccacaagggcgccaugggcaugcccggcgcccccggcccccccggcccccccgccgagaagggcgccaagggcgccaugggcagagacggcgccaccggccccagcggcccccagggcccccccggcgugaagggcgaggccggccugcagggcccccagggcgcccccggcaagcagggcgccaccggcacccccggcccccagggcgagaagggcagcaagggcgacggcggccugaucggccccaagggcgagaccggcaccaagggcgagaagggcgaccugggccugcccggcagcaagggcgacagaggcaugaagggcgacgccggcgugaugggcccccccggcgcccagggcagcaagggcgacuucggcagacccggcccccccggccuggccggcuuccccggcgccaagggcgaccagggccagcccggccugcagggcgugcccggcccccccggcgccgugggccaccccggcgccaagggcgagcccggcagcgccggcagccccggcagagccggccugcccggcagccccggcagccccggcgccaccggccugaagggcagcaagggcgacaccggccugcagggccagcagggcagaaagggcgagagcggcgugcccggccccgccggcgugaagggcgagcagggcagccccggccuggccggccccaagggcgcccccggccaggccggccagaagggcgaccagggcgugaagggcagcagcggcgagcagggcgugaagggcgagaagggcgagagaggcgagaacagcgugagcgugagaaucgugggcagcagcaacagaggcagagccgagguguacuacagcggcaccuggggcaccaucugcgacgacgaguggcagaacagcgacgccaucguguucugcagaaugcugggcuacagcaagggcagagcccuguacaaggugggcgccggcaccggccagaucuggcuggacaacgugcagugcagaggcaccgagagcacccuguggagcugcaccaagaacagcuggggccaccacgacugcagccacgaggaggacgccggcguggagugcagcguguaa

SEQ ID NO: 19656 - RNA, 2343 nt, Artificial Sequence
  MARK1__Homo_sapiens__NP_001273055
augagcgccagaaccccccugcccaccgugaacgagagagacaccgagaaccacaccagcguggacggcuacaccgagccccacauccagcccaccaagagcagcagcagacagaacauccccagaugcagaaacagcaucaccagcgccaccgacgagcagccccacaucggcaacuacagacugcagaagaccaucggcaagggcaacuucgccaaggugaagcuggccagacacgugcugaccggcagagagguggccgugaagaucaucgacaagacccagcugaaccccaccagccugcagaagcuguucagagaggugagaaucaugaagauccugaaccaccccaacaucgugaagcuguucgaggugaucgagaccgagaagacccuguaccuggugauggaguacgccagcggcggcgagguguucgacuaccugguggcccacggcagaaugaaggagaaggaggccagagccaaguucagacagaucgugagcgccgugcaguacugccaccagaaguacaucgugcacagagaccugaaggccgagaaccugcugcuggacggcgacaugaacaucaagaucgccgacuucggcuucagcaacgaguucaccgugggcaacaagcuggacaccuucugcggcagcccccccuacgccgcccccgagcuguuccagggcaagaaguacgacggccccgagguggacguguggagccugggcgugauccuguacacccuggugagcggcagccugcccuucgacggccagaaccugaaggagcugagagagagagugcugagaggcaaguacagaauccccuucuacaugagcaccgacugcgagaaccugcugaagaagcugcuggugcugaaccccaucaagagaggcagccuggagcagaucaugaaggacagauggaugaacgugggccacgaggaggaggagcugaagcccuacaccgagcccgaccccgacuucaacgacaccaagagaaucgacaucauggugaccaugggcuucgccagagacgagaucaacgacgcccugaucaaccagaaguacgacgaggugauggccaccuacauccugcugggcagaaagccccccgaguucgagggcggcgagagccugagcagcggcaaccugugccagagaagcagacccagcagcgaccugaacaacagcacccugcagagccccgcccaccugaaggugcagagaagcaucagcgccaaccagaagcagagaagauucagcgaccacgccggccccagcaucccccccgccgugagcuacaccaagagaccccaggccaacagcguggagagcgagcagaaggaggagugggacaaggacguggccagaaagcugggcagcaccaccgugggcagcaagagcgagaugaccgccagcccccuggugggccccgagagaaagaagagcagcaccauccccagcaacaacguguacagcggcggcagcauggccagaagaaacaccuacgugugcgagagaaccaccgacagauacguggcccugcagaacggcaaggacagcagccugaccgagaugagcgugagcagcaucagcagcgccggcagcagcguggccagcgccgugcccagcgccagacccagacaccagaagagcaugagcaccagcggccaccccaucaaggugacccugcccaccaucaaggacggcagcgaggccuacagacccggcaccacccagagagugcccgccgccagccccagcgcccacagcaucagcaccgccacccccgacagaaccagauuccccagaggcagcagcagcagaagcaccuuccacggcgagcagcugagagagagaagaagcguggccuacaacggcccccccgccagccccagccacgagaccggcgccuucgcccacgccagaagaggcaccagcaccggcaucaucagcaagaucaccagcaaguucgugagaagaagcaccagcggcgagcccaaggagagagacaaggaggagggcaaggacagcaagcccagaagccugagauucaccuggagcaugaagaccaccagcagcauggaccccaacgacaugaugagagagaucagaaaggugcuggacgccaacaacugcgacuacgagcagaaggagagauuccugcuguucugcgugcacggcgacgccagacaggacagccuggugcagugggagauggaggugugcaagcugcccagacugagccugaacggcgugagauucaagagaaucagcggcaccagcaucgccuucaagaacaucgccagcaagaucgccaacgagcugaagcuguaa

SEQ ID NO: 19657 - RNA, 2367 nt, Artificial Sequence
  MARK2__Homo_sapiens__NP_001034558
augagcagcgccagaaccccccugcccacccugaacgagagagacaccgagcagcccacccugggccaccuggacagcaagcccagcagcaagagcaacaugaucagaggcagaaacagcgccaccagcgccgacgagcagccccacaucggcaacuacagacugcugaagaccaucggcaagggcaacuucgccaaggugaagcuggccagacacauccugaccggcaaggagguggccgugaagaucaucgacaagacccagcugaacagcagcagccugcagaagcuguucagagaggugagaaucaugaaggugcugaaccaccccaacaucgugaagcuguucgaggugaucgagaccgagaagacccuguaccuggugauggaguacgccagcggcggcgagguguucgacuaccugguggcccacggcagaaugaaggagaaggaggccagagccaaguucagacagaucgugagcgccgugcaguacugccaccagaaguucaucgugcacagagaccugaaggccgagaaccugcugcuggacgccgacaugaacaucaagaucgccgacuucggcuucagcaacgaguucaccuucggcaacaagcuggacaccuucugcggcagcccccccuacgccgcccccgagcuguuccagggcaagaaguacgacggccccgagguggacguguggagccugggcgugauccuguacacccuggugagcggcagccugcccuucgacggccagaaccugaaggagcugagagagagagugcugagaggcaaguacagaauccccuucuacaugagcaccgacugcgagaaccugcugaagaaguuccugauccugaaccccagcaagagaggcacccuggagcagaucaugaaggacagauggaugaacgugggccacgaggacgacgagcugaagcccuacguggagccccugcccgacuacaaggaccccagaagaaccgagcugauggugagcaugggcuacaccagagaggagauccaggacagccuggugggccagagauacaacgaggugauggccaccuaccugcugcugggcuacaagagcagcgagcuggagggcgacaccaucacccugaagcccagacccagcgccgaccugaccaacagcagcgcccccagccccagccacaaggugcagagaagcgugagcgccaaccccaagcagagaagauucagcgaccaggccgccggccccgccauccccaccagcaacagcuacagcaagaagacccagagcaacaacgccgagaacaagagacccgaggaggacagagagagcggcagaaaggccagcagcaccgccaaggugcccgccagcccccugcccggccuggagagaaagaagaccacccccacccccagcaccaacagcgugcugagcaccagcaccaacagaagcagaaacagcccccugcuggagagagccagccugggccaggccagcauccagaacggcaaggacagccugaccaugcccggcagcagagccagcaccgccagcgccagcgccgccgugagcgccgccagacccagacagcaccagaagagcaugagcgccagcgugcaccccaacaaggccagcggccugccccccaccgagagcaacugcgaggugcccagacccagcaccgccccccagagagugcccguggccagccccagcgcccacaacaucagcagcagcggcggcgcccccgacagaaccaacuuccccagaggcgugagcagcagaagcaccuuccacgccggccagcugagacaggugagagaccagcagaaccugcccuacggcgugacccccgccagccccagcggccacagccagggcagaagaggcgccagcggcagcaucuucagcaaguucaccagcaaguucgugagaagaaaccugagcuucagauucgccagaagaaaccugaacgagcccgagagcaaggacagaguggagacccugagaccccacguggugggcagcggcggcaacgacaaggagaaggaggaguucagagaggccaagcccagaagccugagauucaccuggagcaugaagaccaccagcagcauggagcccaacgagaugaugagagagaucagaaaggugcuggacgccaacagcugccagagcgagcugcacgagaaguacaugcugcugugcaugcacggcacccccggccacgaggacuucgugcagugggagauggaggugugcaagcugcccagacugagccugaacggcgugagauucaagagaaucagcggcaccagcauggccuucaagaacaucgccagcaagaucgccaacgagcugaagcuguaa

SEQ ID NO: 19658 - RNA, 2262 nt, Artificial Sequence
  MARK3__Homo_sapiens__NP_001122390
augagcaccagaaccccccugcccaccgugaacgagagagacaccgagaaccacaccagccacggcgacggcagacaggaggugaccagcagaaccagcagaagcggcgccagaugcagaaacagcaucgccagcugcgccgacgagcagccccacaucggcaacuacagacugcugaagaccaucggcaagggcaacuucgccaaggugaagcuggccagacacauccugaccggcagagagguggccaucaagaucaucgacaagacccagcugaaccccaccagccugcagaagcuguucagagaggugagaaucaugaagauccugaaccaccccaacaucgugaagcuguucgaggugaucgagaccgagaagacccuguaccugaucauggaguacgccagcggcggcgagguguucgacuaccugguggcccacggcagaaugaaggagaaggaggccagaagcaaguucagacagaucgugagcgccgugcaguacugccaccagaagagaaucgugcacagagaccugaaggccgagaaccugcugcuggacgccgacaugaacaucaagaucgccgacuucggcuucagcaacgaguucaccgugggcggcaagcuggacaccuucugcggcagcccccccuacgccgcccccgagcuguuccagggcaagaaguacgacggccccgagguggacguguggagccugggcgugauccuguacacccuggugagcggcagccugcccuucgacggccagaaccugaaggagcugagagagagagugcugagaggcaaguacagaauccccuucuacaugagcaccgacugcgagaaccugcugaagagauuccuggugcugaaccccaucaagagaggcacccuggagcagaucaugaaggacagauggaucaacgccggccacgaggaggacgagcugaagcccuucguggagcccgagcuggacaucagcgaccagaagagaaucgacaucauggugggcaugggcuacagccaggaggagauccaggagagccugagcaagaugaaguacgacgagaucaccgccaccuaccugcugcugggcagaaagagcagcgagcuggacgccagcgacagcagcagcagcagcaaccugagccuggccaaggugagacccagcagcgaccugaacaacagcaccggccagagcccccaccacaaggugcagagaagcgugagcagcagccagaagcagagaagauacagcgaccacgccggccccgccauccccagcgugguggccuaccccaagagaagccagaccagcaccgccgacagcgaccugaaggaggacggcaucagcagcagaaagagcagcggcagcgccgugggcggcaagggcaucgcccccgccagccccaugcugggcaacgccagcaaccccaacaaggccgacauccccgagagaaagaagagcagcaccgugcccagcagcaacaccgccagcggcggcaugaccagaagaaacaccuacgugugcagcgagagaaccaccgccgacagacacagcgugauccagaacggcaaggagaacagcaccauccccgaccagagaacccccguggccagcacccacagcaucagcagcgccgccacccccgacagaaucagauuccccagaggcaccgccagcagaagcaccuuccacggccagcccagagagagaagaaccgccaccuacaacggcccccccgccagccccagccugagccacgaggccaccccccugagccagaccagaagcagaggcagcaccaaccuguucagcaagcugaccagcaagcugaccagaagaaacaugagcuucagauucaucaagagacugcccaccgaguacgagagaaacggcagauacgagggcagcagcagaaacgugagcgccgagcagaaggacgagaacaaggaggccaagcccagaagccugagauucaccuggagcaugaagaccaccagcagcauggaccccggcgacaugaugagagagaucagaaaggugcuggacgccaacaacugcgacuacgagcagagagagagauuccugcuguucugcgugcacggcgacggccacgccgagaaccuggugcagugggagauggaggugugcaagcugcccagacugagccugaacggcgugagauucaagagaaucagcggcaccagcaucgccuucaagaacaucgccagcaagaucgccaacgagcugaagcuguaa

SEQ ID NO: 19659 - RNA, 2259 nt, Artificial Sequence
  MARK4__Homo_sapiens__NP_001186796
augagcagcagaaccgugcuggcccccggcaacgacagaaacagcgacacccacggcacccugggcagcggcagaagcagcgacaagggccccagcuggagcagcagaagccugggcgccagaugcagaaacagcaucgccagcugccccgaggagcagccccacgugggcaacuacagacugcugagaaccaucggcaagggcaacuucgccaaggugaagcuggccagacacauccugaccggcagagagguggccaucaagaucaucgacaagacccagcugaaccccagcagccugcagaagcuguucagagaggugagaaucaugaagggccugaaccaccccaacaucgugaagcuguucgaggugaucgagaccgagaagacccuguaccuggugauggaguacgccagcgccggcgagguguucgacuaccuggugagccacggcagaaugaaggagaaggaggccagagccaaguucagacagaucgugagcgccgugcacuacugccaccagaagaacaucgugcacagagaccugaaggccgagaaccugcugcuggacgccgaggccaacaucaagaucgccgacuucggcuucagcaacgaguucacccugggcagcaagcuggacaccuucugcggcagcccccccuacgccgcccccgagcuguuccagggcaagaaguacgacggccccgagguggacaucuggagccugggcgugauccuguacacccuggugagcggcagccugcccuucgacggccacaaccugaaggagcugagagagagagugcugagaggcaaguacagagugcccuucuacaugagcaccgacugcgagagcauccugagaagauuccuggugcugaaccccgccaagagaugcacccuggagcagaucaugaaggacaaguggaucaacaucggcuacgagggcgaggagcugaagcccuacaccgagcccgaggaggacuucggcgacaccaagagaaucgaggugauggugggcaugggcuacaccagagaggagaucaaggagagccugaccagccagaaguacaacgaggugaccgccaccuaccugcugcugggcagaaagaccgaggagggcggcgacagaggcgcccccggccuggcccuggccagagugagagcccccagcgacaccaccaacggcaccagcagcagcaagggcaccagccacagcaagggccagagaagcagcagcagcaccuaccacagacagagaagacacagcgacuucugcggccccagccccgccccccugcaccccaagagaagccccaccagcaccggcgaggccgagcugaaggaggagagacugcccggcagaaaggccagcugcagcaccgccggcagcggcagcagaggccugccccccagcagccccauggugagcagcgcccacaaccccaacaaggccgagauccccgagagaagaaaggacagcaccagcacccccaacaaccugccccccagcaugaugaccagaagaaacaccuacgugugcaccgagagacccggcgccgagagacccagccugcugcccaacggcaaggagaacagcagcggcacccccagagugccccccgccagccccagcagccacagccuggccccccccagcggcgagagaagcagacuggccagaggcagcaccaucagaagcaccuuccacggcggccaggugagagacagaagagccggcggcggcggcggcggcggcgugcagaacggcccccccgccagccccacccuggcccacgaggccgccccccugcccgccggcagacccagacccaccaccaaccuguucaccaagcugaccagcaagcugaccagaagaguggccgacgagcccgagagaaucggcggccccgaggugaccagcugccaccugcccugggaccagaccgagaccgcccccagacugcugagauuccccuggagcgugaagcugaccagcagcagaccccccgaggcccugauggccgcccugagacaggccaccgccgccgccagaugcagaugcagacagccccagcccuuccugcuggccugccugcacggcggcgccggcggccccgagccccugagccacuucgagguggaggugugccagcugcccagacccggccugagaggcgugcuguucagaagaguggccggcaccgcccuggccuucagaacccuggugaccagaaucagcaacgaccuggagcuguaa

SEQ ID NO: 19660 - RNA, 1782 nt, Artificial Sequence
  MARS2__Homo_sapiens__NP_612404
augcugagaaccagcgugcugagacugcugggcagaaccggcgccagcagacugagccugcuggaggacuucggccccagauacuacagcagcggcagccugagcgccggcgacgacgccugcgacgugagagccuacuucaccacccccaucuucuacgugaacgccgccccccacaucggccaccuguacagcgcccugcuggccgacgcccugugcagacacagaagacugagaggccccagcaccgccgccaccagauucagcaccggcaccgacgagcacggccugaagauccagcaggccgccgccaccgccggccuggcccccaccgagcugugcgacagagugagcgagcaguuccagcagcuguuccaggaggccggcaucagcugcaccgacuucaucagaaccaccgaggccagacacagaguggccgugcagcacuucuggggcgugcugaagagcagaggccugcuguacaagggcguguacgagggcugguacugcgccagcgacgagugcuuccugcccgaggccaaggugacccagcagcccggccccagcggcgacagcuuccccgugagccuggagagcggccaccccgugagcuggaccaaggaggagaacuacaucuucagacugagccaguucagaaagccccugcagagauggcugagaggcaacccccaggccaucacccccgagcccuuccaccacguggugcugcaguggcuggacgaggagcugcccgaccugagcgugagcagaagaagcagccaccugcacuggggcauccccgugcccggcgacgacagccagaccaucuacguguggcuggacgcccuggugaacuaccugaccgugaucggcuaccccaacgccgaguucaagagcugguggcccgccaccagccacaucaucggcaaggacauccugaaguuccacgccaucuacuggcccgccuuccugcugggcgccggcaugagccccccccagagaaucugcgugcacagccacuggaccgugugcggccagaagaugagcaagagccugggcaacgugguggaccccagaaccugccugaacagauacaccguggacggcuucagauacuuccugcugagacagggcgugcccaacugggacugcgacuacuacgacgagaagguggugaagcugcugaacagcgagcuggccgacgcccugggcggccugcugaacagaugcaccgccaagagaaucaaccccagcgagaccuaccccgccuucugcaccaccugcuuccccagcgagcccggccuggugggccccagcgugagagcccaggccgaggacuacgcccuggugagcgccguggccacccugcccaagcagguggccgaccacuacgacaacuucagaaucuacaaggcccuggaggccgugagcagcugcgugagacagaccaacggcuucgugcagagacacgcccccuggaagcugaacugggagagccccguggacgcccccuggcugggcaccgugcugcacguggcccuggagugccugagaguguucggcacccugcugcagcccgugacccccagccuggccgacaagcugcugagcagacugggcgugagcgccagcgagagaagccugggcgagcuguacuuccugcccagauucuacggccaccccugccccuucgagggcagaagacugggccccgagaccggccugcuguuccccagacuggaccagagcagaaccuggcuggugaaggcccacagaaccuaa
